United States Patent 9,518,277 (GENETICALLY ENGINEERED MICROBIAL STRAINS INCLUDING CHLORELLA PROTOTHECOIDES LIPID PATHWAY GENES) - sequence listing, part 4

SEQ ID NO: 8655 - DNA, 1416 bp, Chlorella protothecoides
atggctggaagcctggccggcatcaccgggaagacgtgcgtggcacccctggagcgcgccaagatcctgttccaggtctgcccagcgtcgaggcggagggcggtttcctgcatgagctcccaccccccgcatgccagcctcagaggcactccactcccactccaacacgcgcagacgggtcgcctgacctcgggcagcctggctgcaaccctggccgccatctaccggcacgagggtttctcgggcctgttcaggtatgctggcgcgccggggcccatgcatataatgccgggacggtgtgcgcagcttcccgccaaccgcttccctccgacacgcaagactcctccaaaccgcagggggaacggcgccagcgtgctgcgcatcgtgccctactccgccatccacttcacggcctacgagcactaccgccgcctgctggtggagcacgtgatggcggccgggccgccggggcgcagcgtgccgcccgtctgggacctggcggccggcgccggcgccggcgccagcgccgtcctggtcacctacccgctggacctggtgcggacacggctggcctacaccagcgaggcggccggcgaggccccgcggccccggtacctgaacgcccccgggggaccgtcggccgggcctggggcgcagaacccggcggcaccctgggcagcagcgactccctcggccgccccgacggcgtccacggtggcaacccccgccgcacccagccagacacttccaccgaaagcccctcccgcccgggcgcggctgggcatcggcgccatgctggcgaccacgctgcggcacgagggcctgcgcggcgcctaccacggcgtgggcgcctccatgtacggcatcctgccctacgccgggctcaagttttacgtgtaccagagcctgaagcagcagtaccaccaccgggccgccggcgccagtactgccgccggcgacggtactgccgccggctctacgcccaacccaggggccgcccacccgcgcctccccgtccccgtcatgctcacgtttggcgggctggcggggctggtggcgcagacggcgacctacccctttgatgttgtgcggcggcgcatgcaggtggaggcgctgcagctggagagcctgcatgcgggcatgacggggcggctgtccacgggaggcctggctctgcgctccacgccgcaggccctcctgctcatcgcgcgcgtgcagggctggcgcacgctgttcgtggggcttagcatcaactacctcaaggtaaaccgggggtgggaatcgccccaggcgctgtgcgggggatggcatctggtcggatggcaagctaccacggccaggatgggcatgcgttccctgggcccggtcagcactgctcggcagggactggcaagccgctgccgtttcgttcggtga

SEQ ID NO: 8656 - DNA, 363 bp, Chlorella protothecoides
atgggtcaggtggatgtcgaagagtggcggacaggcctgtggctccaggccctgcaagcccagccctcagtggtgctggaggaagccgctgccacggcggccgccctccagcgacgcttctgcaccagcaggatagaggcctttcgcttcctacccgctgtggcgtcgatgctgggcacgctgcggtccagctgcctcaccaccgtcatcatcaccaatggccactctgacgtccaggcgtccaagctggaggcctgcggcgcccgcaacctggtggattatgtcatcatcgggggtgacgaggtggcggccgggcgatacgagaagccgcaccgctcgatctatgacaggtgggaacgctga

SEQ ID NO: 8657 - DNA, 273 bp, Chlorella protothecoides
atgacgatcactcctgctttccctcgctcaccccaacaccacagagcctgccagctggcgggctgcacccccgatcaggccattatggtgggcgacaactacatctgcgatgtggttgggggtcaggaggctggccttcttgccacagtgtggatcaatgaaaccggcaaggcggtgcccgaaggcgcagccgtgatgcccacgttcaccgtgtccagtgtcgtagagctccccgccctgattgatcagctcaatgccggcccgccgcggtga

SEQ ID NO: 8658 - DNA, 810 bp, Chlorella protothecoides
gccgcggcgctggcgcagcagctgcgcgaggcgggggtgccgcgcgagcgcgtcgcgctgctgggcacgctgctggcgcgctgcggcgccaaggagcgcgtgtccgacctgttccaggaccgcacgttgtcctcacgctttgcggtgctcgccaagcagcacatcaaggagagtgtcgatgggggggcagggggttgcccaggcagggcagaggggggtggcatgggagccgcacggatggggctgtcgattgtgcgtatgacgggcccacctgcgcgtgggagcaggaggggtatgacagatgccggtggggggcccttgtgccagtcgtggcacattaagcatggtggcaggaccccctgtccacccctggcccgtaccttgctttgcaaccccagctgcccctcagctgccataccacccccgcaccccctctcccccctctcaaagggcgtggagaatgtgtacacgcagcatgtgccgccgctggtgggcaccctggagcggctggccaagggcaagctgtcggaggcggagtaccccgccgcggaccgcgctgcgggggctgggccgccgccgccgccgccgcgcctcatcgtggccttcgtcgtgggcgggaccacgtacgaggaggcggccgccgtggcggggctcaacgcggcggcggcgaagggggaggggccgctgccgccggggaccagagtgctcctgggcggcaccggggtgcagaacagcagctccttcctgcgggacctggcggaggtggcggccgccacgcccgcgccgcagggcaggctggggcttcgatga

SEQ ID NO: 8659 - DNA, 345 bp, Chlorella protothecoides
atgcaggtgatcggcatcgtcaaggcgcactgcaagctgggcctgacggcgacgctggtgcgggaggaccacctcatcactgacctcaacttcctcatcggtcccaagctgtacgaggccaactggctggacctaacccgggcggggcacatcgccaacgtacagtgcgcggaggtgtggtgccccatgacccgtgagttctaccgcgagtatctgcgcccgggcacgcccgtcacccagcgccagctgctctacgtcatgaacccctccaagctccaggcctgccagttcctcgtccagtaccacgaacggcggtgggtggtggcctcgcattgtctgatttga

SEQ ID NO: 8660 - DNA, 534 bp, Chlorella protothecoides
atgaagcgccccttcatctacggcgccacggggcaccaggagcgcacccgcatcctgcacgccttcaagcacaacccggaggtgaacaccgtcttcctgtccaaggtgggcgacaactcgctggacatccccgaggccaacgtcctggtccaaatctccagccacgcggggtccaggcgccaggaggcccagcgcctgggccgcatcctgcgcaagaagaaggcgcggctgggggtgggggaggccgaggagtttgacgccttcttctacaccctcgtgtccaacgacacccaggtgggtgggtgtgttggggggcggggaggtgaggcaccagaggaaagaaggcggactgacatggcaacggggaggagggaggagggctgtgcccgctggtcggaggtctactttaccagcaagcggcagcagttcctggtggaccagggctacagctacaaggtcatcccctccctcctggagaacgcaggtgggcgcacgcgcggggcgcatgcggagcattttgttgtgacgttgtga

SEQ ID NO: 8661 - DNA, 1188 bp, Chlorella protothecoides
atgccgttgctgcctttgagcaacacgagcatccgcgcagagggccccgcagttcagccgagcccagcacccacctccaagcgggcaacgtgtcagagctgcagaccaggacaggtacctcagcagcgctcccgttcttcctcctcttcagccgcccagccagggtttgcctgtgtgccagcgtccccaaggaaaagttctgcacggaagggaaggtcatcgtgctccagcacccatatgaggccaggtgaggataccatcaggcctgtgccgaccccagctgtgctgggaaattctacatacggctataacatgcacggccctcactcagtcccaatcctcgggtgcaggaagccgttgggcacggtgtccctgctacgcttgtgcctgcaggacatccacgtgctgactggacggaagtacaaggtgatgcgagatgctggtgcctgctcaggctgtcaagctagggagggctctgatgttggcggcttcatgctcccagaaataatgcactctccagccagcttgtctgtaccggttgagggggatctgagacgccccccttcggagcacggcatcctgactgaggccatccaggccgccagggatggcctcactcccctcctggtcctgttccccgcccccggggccgctcgactggacggcgcacacgtcgcgccgggcctggcggcgcggcaagcaggcgtgtcgaatgaaaccgagctggaggggcccctgcactcgctgcgcctgggtcagaggggggcctacacgctgctggcgctggacgggacctggcagcaggcgcgggagatgtggggcgccagccaggcccacctcgtgcctccagggacggcggtgtgcctggcccccgaggccatcggcgacccgagcgcgcgactgaagatggagcccgcgcgggggtgcaccaccacctgcgaggcggtggccgccgcgctgcgtgtgctggagccgcggggcgccgccgtggcgggcggggtgctggacctgctggcggccatgacgcgggcgcaggccgtctgggaccctgcggtgcgcgcgcggcagagcgggacgggggggttgtacgccacggggcgcgcgcgcttcggcgtggggccgggcgtggcgaggtgcgctgccgcgggcggggaccagcccccgccgcccgatgtagacgtggagtag

SEQ ID NO: 8662 - DNA, 864 bp, Chlorella protothecoides
atgacggctggccgatcttgccacctggaatcaagggatgcgtcaggcttcccccatgctgcccgagcgcccccctcccctccacacatgcccaaatcaccctctgccccccctcccccactcgcgcccaggtttgtcgtgcgcttcaccaactctgatgtcatctgccagatcgcgtacgccacgctggccggcgacgtcgtggtctcctccgcctactcccacgagctgcccgcctacggcctgaccacgggcctgaccaattacgcggccgcctacgccacgggcctcctgctggcccgccgcgtgctgaccaagtttgggctggataaggcgtatgagggcaacacaggggatgtgggcgaggactacaacgtggatgccgcggacgagggcccccgccccttcgtcgcgctgctggacacgggcctcaagcgcaccagcaccgggtccaaggtctttgccgcgctgaagggcgccctggacggcggcctggacgtgccccactccgacaagcgcttcgtcggctactcgcgtgagaccaaggagctggactccgaggtcctgcgcaagtacatcctgggcggccatgtggcggagtacatggagtcgctgaaggaggaggagccggagaagtacgagcgccacttctcgcgctacgtcaaggccgggctggaggccgaggggctggaggagctgtacacctcggtgcacgcagccatccgcgccgacccggtgcagaagcggaaggagcgcaaggcgcctgccgacaagaaggcctggaaggagtccaagctgacgtatgaggcgcgcaaggagaagctgaaggccaagctggcggagctgaccgccgccgacgagtag

SEQ ID NO: 8663 - DNA, 1524 bp, Chlorella protothecoides
  modified_base (420)..(429): a, c, t, g, unknown or other
atgggcgcaccaggccggggcaggggccccgtgggacatggagcgagtccaggtgcccgacagaagcatctcccccgcccctccagctcactcccacttctgggcgaccagttccgccaggtccaccacgcgctggctgtagccccactcgttgtcgtaccaggcgatgaccttgaccatgtcgtcgcccatgaccatggtcagcgcggcgtcgatggtgctgctgacgtcggtcatgcggtagtcgcaggacaccaggggctcgtcggacaccgccaggatgcccttcaggtagccctcggaggcctcccggaaggcggagttgacctcctcggtgaacgtcttcttctccgtctgtggtggcgatttggaaaggttgcattttggggtttggggtgggggaggagggatgggtgtgcnnnnnnnnnngaacgtcttcttctccgtctgtggtggcgaattggaaaggttgctttttggggattggggtgggggaggaggcatgggtgtgtaggccaggacggcgggatccatactcttaggggccacgccgttcagcttgcccttgagctgcggcagcaccagggccacggccttggccgcgccggtggtggtgggcacgatgttcagcgctgctgcgcgtgcgcggcgcaggtcgcggtgggaggcgtccagcagccgctggtcgccagtgtaggagtgggtggtggtcatggtgcccttcacgatgccgaagcggtcgttgagcaccttgacaaagggcgccaggcagttggtggtgcaggaggcgttggagatgatgtcgtcggagttggagtactggtccgcattcacgcccatgacgtaggtgggcacgtcggagcctttggccggcgcggtgatgatgaccttcttggcccccgcctgcaggtgcttgctggcgcccttgcggtccacaaacactccagtcccctcgatcaccaggtccacgcccagctcgccccagggcagggccagggggtcgcgggaggagacgacgcggatgtcgcggccgttgacggagaaggtgccctcgcccgagatcttgatgtcggcgttgaaggtgcccatggtggagtcgtacttgagcaggtggctggcctgcttcacgccgccggagtcgttcacggccacgatctccagcagcgagtcctcgcgcccctccacgcagcgcaggaactggcggccgatgcggccgaacccgttgatggccaccttgatcttgcgctgggcggtggtggtcatgcgcgtggtggagccggaggaggagccgcgggtctggaccgcggcgcgggactggagggtgggggtgctggggcagcccagggtgtgccgggacaggccggtgtaggccggaccggcgctagacacccgctgcatggggcaggtggggttgggtgggtgggtgaggggggtgccacgaaggggggctcgccaggcagagcatgctgcgggcatggccccgtcgctgtcctgtacatgagagtaatgctgggattcggttga

SEQ ID NO: 8664 - DNA, 972 bp, Chlorella protothecoides
atgcgtaggagcgccagtcgactgctgcagctcacaaagttcctcgaggcggaaaccgcagtcatgacacccgccctgggctggggcagggccgcgaggcccgcaggccccccgcacctgggcccccgagcttccttctctagtctcatacatagaccacccgctcagcctgggacgacggggcgactcctccccacccgccagatgccaggcttccagcgcttgccgtgccgcgtggcctgctccacctcctcctctgccgccgctttcccgccgcccaaccgcaacctgacctcctcggcatccagctggtggacgtccctcaagtccagggaggaggaggacagcctggacacgcgggtggcccccgaggccccgccctcgacgggcccgacggaggcacacaagcgcgaaatgcacgctgtgaacgtggcggtggccgtcaacatcaccatcatgatcgccaagcttggcgcctggttcgtcacctccagcgggtacggggggaagcggggctggagcttttgtgggcaaggtctgctcatcatgcccgatgaacaggagagcctcgggcacacatgcttgtgggccctcacagattacgaattcctcgccttccacctcccaccgacctgcagcgcactgctggctgagaccatgcacagcatggccgacgtcatgaatcagctgctgctccgagcagggctgcacctctcgcgccgagcgcccacgaagcagcacccctacggcttccacaaggagaagtacatctacgccctcatgtcggcggtgggaatcttctgcctgggggctggggcggcggtggttcacggcatccagtccctcttcgatccgccgcagctggaaaacatggtgtggagtctgggaggtgaggaagcttggttggtgtggtggggaggacatgtgggactggattgccttgctggggatgagaagggagagcggtggtga

SEQ ID NO: 8665 - DNA, 288 bp, Chlorella protothecoides
atgcaccctgacgctgccaccccctctcccatgcacgggacaggcaaggtgacgaccgaggacctgcggccccagttgaccccggcggcggaggaggcggccgcggcgtggcgcacctcgcccagccccaggccgcccgttggccgcggcacctcccaggaagctgccggcccgctggacctgttgcccgactgggtggggtacagcgcgctgtacctcgtctccatcgcgcccgtgctgatcgccgtggcggccatcgccatcctcttctacagctccctgcgctga

SEQ ID NO: 8666 - DNA, 1902 bp, Chlorella protothecoides
  modified_base (1666)..(1675): a, c, t, g, unknown or other
atgtccaccggaggcaaacgtctccccaactcaccggcagcaacgccctttcgccttgtgatggctgtaggggaagtaccggctcgggaggaagatcggctcggggagctttggcgacatttacataggtgcgtggcgctctctggtggcacagtcgttttggtcctcaggtgcacaggcgaagctcacaacgaatcgggaatccatgcgatgcacaggcacccacctcctcaccggcgaggaggttggcatcaagctggagtcggtgaagaccaagcacccccagctgctcgttgggcttcccttgtccaagcgcaccttgccagctgtcgcccaccactcacacaacacccatcgcccctgccaccctatgcagctgggatccctaacatacgctggtttgggatggagggtgactacacagtgatggtgatcgatctgctgggacccagccttgaggatctgttcaacttttgcaaccgcaagttcagccttaagacggtcctgatgctcgcggatcagatggtaggcaggggggcgttcgttgggctggcagtgtgtgagaagcctctgcatcgtccagggttgtgtctgaggtgtggctccctgcatgctctctcgcatcgagttcctgcacagcaagtcgttcatccaccgcgacatcaagcccgacaatttcctgatggggctggggcgccgtgcaaaccaggtgtgggggcgtggtgcctggactgggttggcgggatggggagtggcttgtggaggatcttgggtttggatgtgcatgtgacagggtattttcaccacagccctgccctttcctcttcggctgccctgcgctctgaccagccgtctcacaaggcaactcacacaccctccgacccctcacctgacacgcatgcacccccactttcccccttgcgccccccttcccaccaggtgtacatgatcgactttgggctggccaagaagtaccgcgaccccaagagccacatccacatcccgtacagggagaacaagaacctgacggggacggcgcggtacgcctccatcaacacgcacctgggcattgagcagtcgcgccgcgacgacctcgagtccctgggctacgttctcatgtacttcctgcgcggcatgctgccctggcagggcatgaaggcggccaccaagaaggccaagtacgacaagatctcggaccgcaagctggccacgcccaccgagacgctgtgccgcggcttccccaccgagttccccgtctacttccagtacgtgcgcagcctgcgcttcgacgacaagcccgactactcttacctccgcaagctgttccgggacctgtttgtgcgcgaaggtgggcgattcgaggtgttttgggggtggccaggagggagaaaggagagcgtggtgtgggagaagggtcagtctggagacctgtcgaggggatacaggtgggggttggggagcagcaaaggtgctggcgcccgccatgcctggaacgaggccaacaagtcgcggcggcctcaagtgtcgcacgcacgcgccctgcactggttggactccagccgatgggcttgcccttgcggcacccacgccgagcctgttcacgagcgtggttgtgcaccaggcacattccccccaacccccacttctcaaccaaggctcccccctnnnnnnnnnntatgcctggaacgaggccaacaagctgcggcggcctcgagcatcgcacgctcgcgccctgcgctggttggactccagccgatgggcttgcccttgcggcacccacgccgagcctgttcacgagcgtggttgcgcaccgggcacacatcccccccacccccacttctcaaccaaggctcccccctctccgtgacgcctgttccctcgcacgttccccgcaacacttga

SEQ ID NO: 8667 - DNA, 597 bp, Chlorella protothecoides
atgtcggtggacgaggagcgcgcgcagctggaggcggaggcggagtcgctggcggatgcggagggtggcgaggcggagcagcgtctggaggacatctacgagcggctggaggccatggagagcgagatggcggagacgcgggcggcctccatcctgcacggcctggggttcgacaagaagatgcaggccaagcccacgcgcgacttctccggcggctggcgcatgcgcatcgcgctggcgcgcgcgctgttcgtggagcccacctttttgatcctggacgagcccaccaaccacctggacctggaggcctgcgtgtggctggaggagacgctgaagaagtggaagcgcatcctgctcctcgtctcccactcccaggacttcctcaacggcgtctgcaccaacatcatcctcatgcagcacaagcagctcaagtactacgcaggtgggaatgcgtcgagcggtgtctgccatccccctctctgctcgcgccatgtgcaatctggtgcaacccccacaccctgcccagccctgtctgtgctggagcaccctccctttcctcgaatcttcctcaccctgcctgcttgcacccttccgtga

SEQ ID NO: 8668 - DNA, 420 bp, Chlorella protothecoides
atgtgggttctgacttgcacggaagctggggcctggggcggtactttgtgcgtctttttgtatgtatgcactgacatcgatgctgcctacatccacctgctcaccgagccccttccaccgcttgtccacagggtaagcgaccgcaagaagaagcaggcggccctgaagaagggcaaggtcgcgggcaagggatcctctgccaccctcgcctctgagagctccgatgccgagaacgcgttcggcagcacaacacagctggcgcgggacgtggaggacctggaactgaacgacaggtcctgcacgggcatcctcacctcccacccccagtcgcgcgacatccacttccagtcctttaccctcctcttccacgggcacgagatcctgacggatgcggaccttgagctcaattatggcaggtga

SEQ ID NO: 8669 - DNA, 1713 bp, Chlorella protothecoides
atggatggtaagggccgagtctgtgtcctgggattgcgctccctgcgatctgagggaccctgctgtgacaagtcagcacacgggcaccacagcattccagactccctgatacccatccccgcccattctgtcccgctcctccagcttgacaggaagctgctctgcagggactggatgtcccagctgcgcgccctgcaggcgggcgtcgccgcggcgggcggcgacccggcctcctatgccactgctctggaaagggcggccgccacgggcgtggatgcagagcggtcgttgctgggggggctcaagggccaggccagggtgtgggacaggctggcgcgagcctacgaggcccgcaagtgccacgtggcggaggccgcccagcgcctcgcccgcgccgcagactatgaggcgccggcgctcaagcgcggcatggcccgagcgcagcagcagctggcggacctggagaaacgcaaggccgaggcacatcgcgccggagcgcgagcggagcaggcgcccttgtgtcctgaccttcaagcagaaggtggcatttggggcaaggcgggcggtgcagggcaggttcttgcatggcatgctggagaagtttggttcgccggccaggcccaccttggaacagccgaggcaatgctggcaccttgcctggtgacagcatgccgtctgggacaggagtgcaagcgcctggacatctcgccaacgcaggacgcgaccgccgagctgcgtgccctggcttcccgccggcttcccgctgccctgcaggcctgcgtcgccgcgatggttacggaggaggtccacgcatcggtgcaatgttatgccgagtttatcgcggctgacgatagcgcagccgccgcggagcactcgctgccagtcctggtggaggtgctcgcgggcaccacagaggccccgctcttgccgagcatcccatccaccggagcccagggtgctgcggagggcgatgatacagccggaggagcgccggaggcggaggctgtgggagtcgatgaccttgatctgtcagccctcgcctctgctggcgccagcggcgccgcggaggacgccggaccaggcctcatcagctgggacatcggcacagaagcaggcggcgacgacgctccacaggatgccgctggcagcccgcggccggctggcggcgacggcggggaggtcgacccgggcatcgactggggcttggaggtggagggcggcgaggcggccggcgcggaggagggcgaggcagtcttgcaggacctcttgacctcggccaatgtgttcgagggatctgacccggtagttcaggatgcaggcggaacccttgcaggctcagtgtccaaattagaatgtacacccagacctgacctcagaacccgcatctccccccaccacttgcagcggctgggtctggacggcgcgtaccgcgccgccctggccgacgacctgcacgagctccgcgctttcctcacggcgcggcgcggggagctgcgggccggaaacgtgggcgccacgctgggtgcggccaccgcgacgggcgaggaggcggccgcctggctggccaccgtggagcgcgcgctgggcgcgctgggcagccccgacctgcagcacctgctcctgctgcacggcaggccgcagtacctggcccgccaggcggccgccctggagggcaagcgggccgcggggggaaagctacacaggtggttgtaa

SEQ ID NO: 8670 - DNA, 825 bp, Chlorella protothecoides
atggccacctggctggatgccacggccttcctagagcggggctgcggagccctccatcccgaggagctggtgcatggcgaagacttcagcctgtatgaggccatgcttgccattcagattggggacaccaagatggacatcggcctgcggcgagagcagggcccgagcctggcagaggaactggcgtcggggcatgcacccctcgccctctccctggcgactctggagcagcttggcatgcagctgatgcaggcagaagccacctggcacctggggtccatgctccccaccaccgtcttctcctccctctacatgctcgacatcccaaggtgcaggcaggattctgagggttgggggaagggcttcactcactcccggccgcctccccatcgccgctgccacagtcgaaggacattcgccgcccacactcttgttcccacaggctcacgcctgcctgtcgcctcctggcaatggaaggcctcgggatgtaaactcgacactgccctccctgaaccgcccgctcctcctcaagcgcaggatgaggacatcagcatccacacctttggcatgagaatcctgggggccccagggaccaccgccctcccgcaggcctgtgccgccctgcgctcggctgtggaggacctgggcagtgatgctcccgggctggcagcccacctctccttccgcctgcactgcctccaggtgccgccgggtggctacggcgttcgagtgccttggagtctccatggctgccagcctgtccggggcccacatcgcatgttggtctctgcccagctattgaccccgagcaaatgcgcgtgctaa

SEQ ID NO: 8671 - DNA, 498 bp, Chlorella protothecoides
atgggatcatggggaggtgcaggggggcacggtggacggagccagggtgtaagtttgcaggaacaagttcaacaatggggagggttcgcctcgcagaatgcctctgatcacggccagagcccagaccagtcaggtcactggcttgggggtggcactcagcgcccgtacacggtggcgctgctgctggcggacgcgctggccctgccaccggtgctggaggccgaggcttgggagctcgctgacgcagacctcttgccgtatgcggatgaggaggcgttggcagaggcggaggcattggaggaggcggaggcgctcgaggaggcggaggcgttggaggaggcggatgcattggcggaggcagaggcgttgctggatgcgctggcggtggccgatgcgcttgacgttgccgacccatttccaaacacggaggacattgccgtggctgaggcctgcggggtggaagtgccattgggaactgtggtgagtttggcatgctga

SEQ ID NO: 8672 - DNA, 327 bp, Chlorella protothecoides
atgctggccgcaaacgcggatggcatcgacgctggggtcgcgcagctcgagctcgcgctgggctgcctggaggccgtctcggcagcggcgtccagcgacgcggctacagataccgcggccgacggctcctgtggccccaggagcctgggctttgtccccggcatcaacgtccggcacatggggctggccccgccgcgcgctctggcctgggtgggcgccaggccggcggcggcgcactggcgcggcgtgctgcgcgcgctgtgtgacgccgcgcgagccgtgcgggcggtgcgcacctggccccagctccgcgcggtgggtgcggcg

SEQ ID NO: 8673 - DNA, 1068 bp, Chlorella protothecoides
atggggttcagagaagggagcgggtgggttggcgctagaatttggcaatggcagggccatgaagaggcgcaatgccaccatagttgcaagtttcggagtcgtgagactgctgtggtgaggctctgtctgcgctatggaccgcccctgctgcatgcctgtgtcgagaggctgacatccctcaccctcaccccttccccgggcacccctctcccaccttcacgtgtgtcgccatctttggtggtctcggatgccacctcgctgccaggccactcactcgcagccaccccggtcgggagaggggcagaggggcctgtgggaaccctccaggacagtcatcgagggtctaagtttccacattccattcgagcggtctgtgattcagcacaggcattgatgggcgagcggggtgaaatgccgtggtcatgtgaggcagcactggagaatccgcatctcgacagcaactgttcaaatgttccccgatcccgccccgggcccaccctagggggtgaacttggtggcagccgcgaagccattgttggtccaggggtcggccagggggtccaggccttcgccggcgggcccgccgttcacgcggtagccctccaccaggcccatgagaatgacctgggagatgagggtggccacgatggactgggcgtgcaccagggaggggttgcccaggtagtccaggccgccggactggaagatctgggagccggccttgaaccaaacggcctcgccgaaggaggcggcgccgttgcgctccagcagctcgggggtgatgatgcccagggcgcccagcagggcccagcgggcgtggatcacctcgatctcgcggtagcgggcaaaggtctcggggtcggcggacagaccggcggtgtcccagccgtagtcaccggggtactcgcctgccagtgtggggggggagggggggcgggggagggtgagaagggttctggatggggggtggaatgcgatgcagctacaagattcagcaagatcgagctgcaggagctacgaggccaggcagggacacgatcctggcagtgccatcccatcgctcaatga

SEQ ID NO: 8674 - DNA, 768 bp, Chlorella protothecoides
  modified_base (553)..(562): a, c, t, g, unknown or other
atgctgtcacggctaggggtttcagttgcggtatccgctcctcggcctctcccgagtgggctggcagcaggcggtctgcctcaagaccagaattctctgcatcctttggtcccctggagcgccaggattggcatgtacttcaccacatatctgccagcatcacaccctctgctccattcaaccctttccaccaaccccatcgcaatttcaggcaggatgctggtggacctggcggcggtggttcccgacggcatcatctgcttcttcgtctcctactcctacatggactccatagtgtcacgctggaacgacatgggcatcctgtcggcgctcatgacgcacaagctggtcttcatcgagacagtggacgtggtggagacgacgctggcgctggacaactaccggcgcgcgtgcgactgcgggcggggcgccatcttcttcaggtgcatgacggtggtgcaaggggtgaagtgggcggcgccgatggcaaaggctgcccggcggagtggcctttgcggtccgcgggggctcggtggcaacggcccctgctccnnnnnnnnnngggcggcgccgatggcaaaggctgcccggccgagtggcctttgcggtccgcggggacttggtggcaacggcccctgctcgtgcacctcactcttgtatgcatgctgccctggacctgctcgccttctccctcgctccccgttccagtccagcctgacaccaatgcagtgtggcgaggggcaaggtggcggagggcatagactttga

SEQ ID NO: 8675 - DNA, 999 bp, Chlorella protothecoides
  modified_base (199)..(208): a, c, t, g, unknown or other
  modified_base (826)..(835): a, c, t, g, unknown or other
atgccgcggggcgcaacgtggctcgcctccggtccgagatcgagcgcgtcaagtccacagacgccgaccggctcaagcgggagtaccagcgcctggtgcaggtgggtgggtatgggaggtcacagggatgggagcagggtggccgtatcacggcatgcttgcagtcacctgccccctgactgccgccctttgctgaggnnnnnnnnnncctgggatgggagcagggtggccgtatctcggcatgcttgcagttgcctgccccctgactgccgccctttgctgagtaactccctctgcccggcatcttcccagggccttgcgagccagggggccctcaggggcggcggggagagcgagcagtggctcgccaacccggcgctgccggccgacatcctccaggaagcggtgccggggaacatccgccgtgccggtgggtggcctgggggggatccaagagggtgccaggtaccacctgggtgcctcagagtcactcacaatgacccaacctcccgactccccacccgcctcagagcacttcctcgccttcctccagcgcttcctctccttcctgcgcacgcggctcaacgtcaaccaggtggtgtccgacacccccacctccttcctcacccacctccagagcgtgagaggaagtcccagtgggtgattgcggtcctgactggggaatggtggccgtgtctggccatggaggccacactcctctgtgggacccccacctcacgctcgacagcagacacccagggcaggccaccacccttaccacccctcctttgtgtgtttgcccctctcccccaggtggttgccatcnnnnnnnnnnggccatggaggccacactcctctgtgggacacccacctcacgctcgacagcagacacccagtgcaggccaccaccctgaccaccccttcttctcgttttcgcccctcctccccaggtggttgccattgagggcaagacgctgcgcttctgctacgaccggctga

SEQ ID NO: 8676 - DNA, 519 bp, Chlorella protothecoides
atgggcgagatcgtgcgccgcgccctggcccgtctgggccagcatgccggcctgttcggccgcgccgatgccctacccgccgccctgctcacgcccgggtcgctgggcagcgcggcggtggccgccatggacgaggacgagagcgccgacctggcggccgccggcgccgcgctggccacgctgggcgttgcccggcccacgaggcgccagcgccgcgttgcgcgcgcgctggcgcgactggccgcgctgcgctccgcgcgcctgagcgccgccgcactgtgcgcgctcctgcgccacctgggctgggatgagcgcagccgcgtggtggccgccatggacggctccgtcttctgccggtacgcggggtaccgcgccatgatgcgggacaccctcgagcgcctgctgggccgcgaggccgcggcggcgctggagctgcgggaggcgcgggatgggtcagtacgtggcgccgcctaccttgcggccgccgcctcccgatacgaccacgcccccagggcctag

SEQ ID NO: 8677 - DNA, 1005 bp, Chlorella protothecoides
  modified_base (70)..(79): a, c, t, g, unknown or other
atgtgttgccatctgtttgagatgtcgtctggcatcccacaggctgcaacactcgatagacagcggagcnnnnnnnnnnggcactgggttttgagcggcaagaaaacacagtggagcctccgcaacggtgagttggtgggcatccctacaatactgtacacatttcctctgcactggtgtctgcgtacttcgatggctgggctagcgcagtacagcagggcacttatcaagatgtttgcacctcaaaagttgctcggggtcaagacgcagacacatcctcgggacctatgtctgcagtttggctgcgtccggctggagcggccggtggctgcagcgctggcaaccttcaagcagagatatgtcgcccaggttgccattgctcaaagggggacggtggcactcaacaaacccgtgtttgtggcggcaatcttcctcgctgtggcgcagaaaaacaaagtcaaggtggacaagcggagactgctggagcctttgggtgtcctacctacagaatttgctgcggctgccactgctgttgcttccctgatgcccgagctcagcaccggcagcagtgccaagcgtaggcgaaaacctgagggcgcagaagacgaggctgcagatgggagctatgcctcgcattctccacatgcaggtgcctggctgttgcggcttcagcgagactggaggagctcggcagcagtgacgaagaggtgctggaggatggcgccgtggggcgccgggtgcatgccggcaagcagcagaagcgggtgtggagtgaaggcagggctggacagggtgctgtggaccagcgggggggcaccaggctgctggaatgcaatggtcgatgttcttgagattggcacactgcgcacgcatcccccagcccctgccaaacgtgtcgcggtgctcaggagtatgatgcctggaagacggctatgctggagcgaagggcagcggaggccaaggccaacgatccgcccagtggccccctgcgccaggccacgctga

SEQ ID NO: 8678 - DNA, 1083 bp, Chlorella protothecoides
atgctgctgccttgcaggcttccccctgcacagaaggcgttgatggagttgactcttggtgacgcttcacgtactcttgccgctcaaaacccagtgccgtcagctcaccgtgcccatgctcgccccagcaagtcttgtattggcaagtcgcatgtattccgaggctttgttctgcaccgctctgtcgctgatgccgattctgcgagccagcatggagatatccatctcaacagatgtgttgagccacggacgctgaacaccgcacacgccagcgaagccaaggagctgcttttcaatttatttcatcacataacgcgtccaatgtgcgtcttcagcgcgcaggctgctggtgcccggggaggacgagttcgtaatttcataccctacgcgtgcgttgcgtgccatgcgtctccgggtgtcacgcagggtgtcgaaccagcttcagccgcaatgggggaggtgaacgctgaacgacgagaggataccgggctgactgcgtccaacagcgggatctccatcgaggaccagtcgatgcttgctcgggtggccttgagctctggtgtgcctgtcaagtggtctgatctgcagccggtggttcacgctgcgattgatgctgtgctatcacggtttgcggagaggggagggacacaggttgggcccccaccccccatgctggatggcagcgaccttgagaccttcagaaagcggctgcatgctctgctcgacgtgatggatggccctccattcacgatgcaacggctggcagagctcttgctaggcccagagaagcaatattcctcactcccaaagcttccagaattcatacccctgccctctcccctccaggcgtctgccttggaaaagctcctcatggtcgtcacttctgctcccgtgctggaggctgcagacgccgacgtgcagccgcttcctccagtccacccagccatcattgcccgtataaatgacaaccctcccagccactatgttgtgcagatctctgatggatccctggacgtgagcatggacacagaagaagatgtgcatgtgccagaagctgtgaacgctgaggctgtaaaagagtag

SEQ ID NO: 8679 - DNA, 594 bp, Chlorella protothecoides
atggtgccaggagaggcagctgctgacttgtatcaccacaccttcctctgccagggagaggagcaggacattcgggaatggcccattcccaaggagtgcttcaataccgactctggaaagctgctggagtttgtggctgactgcgtcgaggagatgctggtcgagcacccgccagcgtctggggccctgcccgttcttggcttctgtttcagctttggtttcaaccagaccgcgctcaacaatggtgtccttgtgcggtggacaaagggcttctacggcaagggcctgattggcgaggacatcgtgggtgcgctgcagtgtgtcttccgggcgcggggcagggcggtggagatcccggccatcctaaacgacaccgtggcgacgctgatcgccctacgctacgcggaacccgccacgcagctgggcatcatcctgggcacggggaccaacgccgcctatcaggagcgcatcgacaggtcagggattgtcgagcagtggggggaaagagggttccatcaggggactcaagacccacctctctcgctgaagcctagcacccacggtggctggacccatgagcaacagccctcctga

SEQ ID NO: 8680 - DNA, 306 bp, Chlorella protothecoides
atggcctacctcctcgcaggagcggcagggctgttctacttgctgtacaagggaaagcgcgaggccggcgataggagtcttctcatgctgcgatcttgggttgcacggatgagactggcaagctttgatcttagatccccctccccttccttgcatgcacagtaccaagacctctttgatgtttcgacgcaaaggctgcgggacgtgcagcgcgacctcatcctgcaagtagaagcgggactcaggggcgacaaatcggggctcctcatgctcccaacctttgtggacatcctgcctacagggtga

SEQ ID NO: 8681 - DNA, 852 bp, Chlorella protothecoides
atgccacgacaggtggcgcggcacgccggcgccctgctggcggcgcgcgacgcgctgtgcgcgctggacctcgcctccgcgcgcgccgcgcacgcccgctggctcggggcccagcggccgacattcggggcgggcgtggagctggagggcatgcgccacccggcgctgctgggggtcagcctcgggcatgcgtctggcgggggggaggccggcgcagagggcgcaaggggtgctgacaagggcgctgcgacgaggagtgccggtgcgatcgctgcggcggctgcatctgacgccaatggcgccgcgacgaggagtgacggtgcgatcgctgcggcggctgcatcggacgccgatgcggcgccaaacggctgcgaggaggcttcctccgcatcccccaccccctccctcccaccacccccggtgcccatcgggctgcacatcccgcctgccagccgcgtggcggccatcaccggccccaacacgggcggcaagaccgccgcgctgaagacactgggcctggcgtgcctcatggcgcgcgctggcctgttcctgcccgccggcccaggaccccgcctccccttcttcgaggcggtgctggccgacgtgggcgacggccagggcctgggcgccgggctttccaccttcagcgcgcacatgcggcgcgtggccggcgcctgcgcgggcgccggcccatcctccctggtcctcctggacgagctggggagcgggaccgagcccagcgagggcgccgccatcgccacggcgacgctgacgtggctggccgggcgggcggggctgaccctcgtcaccacccaccacaccgccgtcagggtaagcagagaggggtgttga

SEQ ID NO: 8682 - DNA, 456 bp, Chlorella protothecoides
atgctgcaatgcgtcacccacaacacccgcatgggcgccgtgacacctggagcgaggcaccatggcatgcaccgcatggctgcgagctcgatgcctccgcaaggtgccgctgctcgcgttgacagagccccatgggccaatgcagggtggcatggagcacgacctcaccatgcaggcaggacgcctgtggtgaggagtgctgcccaggtgacatcagaaggcacagccttgtcagccctgaaatcaagccccctcacaaaacatgacctggtgctggactccctagccatgctggggtggcaggaggtgtgcgtccaggtgggacgcttctgtcggacccccatgggcatggaggccgcccatggcccgcatggcctggccttgggctcttccagggaagtcagcgagcgcctgctgcgggagacagagcaagcactgcacctcacaacaccgtga

SEQ ID NO: 8683 - DNA, 969 bp, Chlorella protothecoides
atgggcatgccctctgtcctgccatcggatgtcaggggctcgtgggccgcgcactcgctcctgcagcccctggacatcacagaccggcctcccctcctccatactttccagatgccgacggggacaggcaagaccatcaccctgctgtccctcatcacctcgtaccagctggcccaccccgagaccggcaagctcatatactgcacgcgcaccgtaccagagatggagaaggtgatggtgtgtgtcgggggcgcagggcgccctatgcagcggcagttgccgaggcgggaccgaggctctgatccgggtgtaatggcctgcctgctcctgcaggtgtacagcaccttagccctgaggcttccccccccaaccctcttttttctcccttcccacccccctcaggtcctggcggaggtcaaggacctgatcgagtatcgatcccgctacttcaccgacgcccccgcccccaagctgctggccctgggcctgtccagtcgcaagaacctgtgcatccacccgcgcgtggcggaggaggggtctcgagagagtgtggacgcgcggtgcatgcgcctgaccgcctcctgggtccgggagcgggcgcgcggcgcagcccgccccggcgcggagaccacggatgccggcgccgccgccgcggtgccggccgcagtgcctgacattgagctctgcgagttcttcgagggcctggagggcgcgggcgccgacggccgcctggacgccggggtctacaccatgcacgacctgcgcgcgctggggcgcaagcggcgctggtgcccctacttcctggcgcgccacatggtggcctacgccaacgtggtggtctggaactatcagtacctgttggaccccaaggtggcagccatggtgtcgcgcgagatggagcgcgagtgcatcgtggtcttcgacgaggcccacaacatcgacaacgtgtgcatcgaggcgctgaggtga

SEQ ID NO: 8684 - DNA, 600 bp, Chlorella protothecoides
atgggcagggttgaaggtgctgggcagaaacagaaacatgctgagatacgggtgcgccgcgggcgtgatctgccgcgcgagccgccggccccttggcccgggcctcgccccaatatagctcggacagctcctcacatcgacccttctttcgttcatcccaacaccaacatctcacagaatctcattccggctcggctggaataccttcgcgagaccttccagatcaaggagtcggacttcctggcctttgacgcggtgcggcaggcggcgcagtgcgtgggccgcgtcatccgctccaaggccgactacgggctgatggtgtttgcggacaagcgctaccagcgccacgacaagcgcgacaagttgcctggctggatctccagccagctgcgggacgcgcacctcaacctctccaccgacatgctcctgtgcatcgcgcgggagttcatgcgcgccatggcccagcccttcgacggcgggtcggcggagggtgccagcctgctctccgaggcggcggtgaatgccctggacactgcaggggcagggccaatggggcagggcccatggtcctgggatgatcctggctgcctggtgctctga

SEQ ID NO: 8685 - DNA, 882 bp, Chlorella protothecoides
  modified_base (445)..(454): a, c, t, g, unknown or other
atgcatgtcgccttctgggtctaccaaagcatgcgcacgcttgcagtcgccgcctgccccagccttccccactcccacgaccacaatcctcaccaggcaaaagaagaagagctggcagaggcccgggcggcgctcgaggcacagcaggcagagtttgaggcgagcgcgaccagagagatccaggagcgggagggcctgctccaggagtggcagagccggctgcaggcggagcagcgggagctggagaccgaggctcgcgacgtgcgagcggcagccgccgcgcgggaggagagcgtgctggagcgcgagcgtgccagcctggccaacgctcgtgagctggaggagcgcgtcgcggaggccgaggcccgcgacagaaaggccgcgcgggtgggttgtggagggtggcgttggtgtgagggcagtttgggtcgggctgctgagtgtnnnnnnnnnnccgcgacagaaaggccgcgcgggtgggttgcggagggtggcgttggtgtgagggcggtttgggtcgggctgctgagcgccccggcggctgccagctcgactcgctgcatcccctgtcaggcggtggtagctgcaggagcgcaaatgactttcgacaatgcaaaccatctcaagcccagatccagctgggccccaccaccctgtgacctcgtgaacccccccctcacgacaacactgcaggcgctgaaggcccggcgggagggcgtggaggagggcgaggcgcggctcaaagcccgccgtgcggagctggatgagcgggaggcagccgctgcccagaccagggccaggctggaggggctggagcgagagctgtcccgccgcgagcgcgaggtcgagcacgcgcagcgccaggtggggaggatggagtga

SEQ ID NO: 8686 - DNA, 321 bp, Chlorella protothecoides
atgagactgatgaaacactcattccttttcacactctgggggcaggcggtggcacgcagcgtgacccgggacagcggccacgcccaggaggaggccaagaggctggcgagccagcgcgcggaggcggagcgccaggctgcggaggtgcggcgggagcgggaggcggtccgtctggcgcaggcggagctggcggaggagcggactctgatggaagcccgctccaccaagctggaggcacagacaagggaggcccgccaggagaaccaggagcgggagcgggctgctctggaggcgcaggctgcacagctgaaagcagagtga

SEQ ID NO: 8687 - DNA, 3135 bp, Chlorella protothecoides
  modified_base (246)..(255): a, c, t, g, unknown or other
  modified_base (797)..(806): a, c, t, g, unknown or other
  modified_base (1977)..(1986): a, c, t, g, unknown or other
atggagagggtggaggtcatgcaccggtggatgaaggatggaggccgcagcgcagatgcgtggcatcgtctgatgtgccggccagcttgcgcgaacagcacgtcgtgtgctgatcaacctgtcactcgcggcggcgaacctgcctcgcctgcgccatcccaggcctcgcacctggatcctcacataatcatactcccccttgccccgttccttgcctctccagatgtacctgccggacttcatggnnnnnnnnnntgcacctggatcctcacaccatcatactcccccttgcccctttccttgtctctccagatgtacctgccggacttcatggtcctggccctgggcctgatggagaccgggctgcggtcgctgccgggcgcggccggcgacgcggcgccggccgcccccccggaagagagggcctcctccgaggagggcaggggagcgcgcacgctgcgaacccagggcatgcgcctgctggccgagatgatcgagctgagcgaggccggggcggggggcctggccttcctctggcctcgcctgatggcggcggcggagggctggctgccgcgcctggtgccggaggcagcggggcaggagccgcccgcgctgatggaactggctgcggttctggctcagcgtcccgacctggccgccctgctcgccgacgccgagtggagggcggaggggccgggggtggaggcggcaccggccgtggacgccgaggaccccgatgaccacactgttgacggcaagcatcactctcggcagaactcctacgtgctgaccccaannnnnnnnnntggaggggccgtggctggaggcggcgccggccaactcctacgtgctgaccccaaggcccgaggcctgggcggcagacgcccacgtcggctcgcgcctgctggagcaggtggtcgcggcgctaggcagccccggctgctcccccgccggccgcgctgccgcgctgggcgtcgccgaggcgctggtcggcctgcccgactccgggctggcggtgctgctgacgcgccacctgggcccgctgctggccgggctgcaggccctcatcgtggccgtctggcagcagcagacggggcgggggggaaacccccacctgctctccggcgcgggcgccggcgtacgcgcgaagcgcgggtcccccggcggcgcggatccgcaggccctggccgcgcgggcgctggacctgctggtggtggtggggcaggaggccgcgaccccggcgctggcctgccagctcaccgccgcgctgctgcccatgctggcggcgcccggcgggaagctgaccgaggcgcagctgaggctggtggtccgcgcactggccgtgctggcagcgctctggcggcgctgcgccgcgacagcggacgccggggcctcggctgtcgcgccgacccggacgccggggcctcggctgccgcgccaaccgtcgcagagggctccgacttactacgccgcgtgctggccgcgctgggcccgctggcggggcggcccgagcctacgctggcgcgggtgctggccgacgccgcggccgcctgcgcgggcgcgctgggctgtcccgcgcacatcgccgcggcccgcaccctggtggagctggcctcgctggaccccgcgggcgtggacgaccccgactacgaccgccgcctggccgccttcctgagcctcaaggcccgcgtctggcgcgagctggcggagggcgaaggtgtcgacgccgtgccggcctcgcttgtgctgcaccgcgcggcctcggacctgcgcaacgccgccgacctgggcctgcgcaccgccgcggccgagtgtctggaccagttcctcatcgccgtggtcgaggtggcgggtggcgatgcaaccgccgaggacaccgctggcgccaaggacacctgcaggaatgctgatgacacggccatcccatccatccccgcaccgccagcatcaacctcgccgcacccgctggtgctggcnnnnnnnnnntcctgcaggtgtggacgaccccgactacgaccgccgcttggccgcctttttgagcctcaaggcccgcgcctggcgcgagctggcggagggcaaaggatcaacctcgccgcacccgctggtgctggccgcgcagcgcgtgctcttcccctccttgaagcgggggttgacggccgtgtcgcaggcggtgcggtcggagcacctggcgctgatgcgcacgctggcgctggcgctgccacgccagtacccgggcctggccgcgctggccagccgggaggacccggaggtcgacttctggctcaatgccgcgcacatccagctgcaccggcgcgcgcgggggctggcgcgcctggcgcgcgcgctgcgcgaacccgacgcgctgtgcacgctgggcctgggcgtcatgctgggcgtgctggcgcccctcctccaggcgatggtcgtggagggcggcggctcgggcacggccatcatgctggccgcgggcgggcacgagcccaaggcgggcgacgtggcggtcaccgccaacgtgaccgacgcggcggttggcgcgctgggcgcgctgggcgcggccctgccctggaccgcgtactcgcaggtgctggggcaggcgctgcgcgcgctgcgcctccacgccgacggcccggccgccaagcccgtggtgcgcgccgtctgctgcctgctggacaacttccactttctgggtggggaggaggacgtgggggaagcaagcgacatggaggccatccaccgctacctggtcaagtgaggaggcaggggctttggaaggaggttagggattgggaaggagatacaggtgggtgctggggagggcaagggtggaagacgtgttcatatgcggcccacaccactgctcccccaggatgtggaatcaacatcgcaagtcatccccgacctgcgcaagcacctggtggtcaactccgagacggtgcgggccccggtggcgctggcggtggtcaaggttctgcgcctgctgccggaggacgcggcgcgcgccgagttgccgcgcgtgctgcagagtgtggcaaacctgctgtccaaaccgctgcagcgcatccgcgacgacgcgcgcgctgtgctggtctccatggcggtggagctggggcccgcctacctcccctttgtcattga

SEQ ID NO: 8688 - DNA, 1668 bp, Chlorella protothecoides
  modified_base (105)..(114): a, c, t, g, unknown or other
  modified_base (590)..(599): a, c, t, g, unknown or other
  modified_base (654)..(663): a, c, t, g, unknown or other
  modified_base (718)..(727): a, c, t, g, unknown or other
  modified_base (886)..(920): a, c, t, g, unknown or other
atggaaatagtcgctctggcatgcgtcgccgcttgctgggttaccttgagttgctctatcagcccccaaaacactgtgaaaccaacaaactgcacaggtggcctnnnnnnnnnncgacgtcatcatggtgagcagtgcgaggggggggtggcctgcccgctgcgaggatttgtggcgcacgtccgcggctacaccatccatgcggtggtggagggcctggcggcggcgggcgcccccgccggcagcctggacccctgcgtgcccatgctacttcccatcgtggaggcggacatgtggggcgagctggtggatgcgcgcgaggccacccacttcttgggcgcgtacaaggaggcaaagcgctgccgcgcgcaggagctgtacgcgctgatgtggcgcctggccggctttgaaacccatgcgggggagctgctggcgctggtacaccagcacctggacgacgccggcggcgccaagggccgcgctcgcatctccagcctgctggcggcgttggtccgcggcacgctggctaatgccggcgccgacgcgcgtgcgctgtgcgtctttgtctacgccacgctggaggcggggcnnnnnnnnnncgggtgcagctgccgggcatatcagcggcctggcgccgcctgcgcgcacccaccnnnnnnnnnnggggtgcagctgccgggcacaccggcggcctggcgccgcctgcgcgcacccaccnnnnnnnnnngggcgcgctggctaatgccggcgccgacgcgcgcgctgtgtgcatctttgtctacgccacgctggaggcggggctggagggcgaggagagcgcgcgcgccgcagccgaggccgccgcgggcgtgggcggggagggggcgatggaggaggcaggagatgnnnnnnnnnnnnnnnnnnnnnnnnnnnnnnnnnnnacctgccccacaccgagctcatcgtggaggcggcgctgggcgtgctggcgagcgcgctgcgccgggccggcacacgcctagtgtctcgctggcgctggccacgctgggcctgctgctgcagagcgcgctgccaggcatggaggccgcggtcccgaccgcgtatgaggtggggtggtggtgcttttctctggggatttgtatgccatccggggaggaggggggatctgcaaggtccacgggaggggtcaagcccctggcgagtgtgaaccctggctggccgggctggccgggctcagacgcgtggcccgaccccttctcctccctccaccaaaactcaggaggtgacccgactgctgaacggctgccctgggaccgacacccccctggcccaggagtgcttccggctgctggcgggcctgctgcgcgccagctccaccttccagccgccacgcgccgacctgcagctgctgctgggcacccgcctgggcgacctggaggacagcgtgggcggcgccaccttcggcctgctcaaggccgtgctggcgcggcgcctggtggtgccccaggtctacgacgccatgcatcgcctggagcggctgatggtgcgcagccagggcgcgtcggtacgcgaggccagcgctgcctgcctcctgcagtacctcctggactacccgttgggcacgccgcgcctggacgcccacctgcaattcttgctgaccaacctcacctaccagcacgagacggggag

SEQ ID NO: 8689 - DNA, 1056 bp, Chlorella protothecoides
ccggtcctgggcgcgggcggcgagcccagcgacgcgctgccctcgctgctgggcatcgaggtgcgagggacgggagcgcagcgcgcacagcacggcggattgggccgcgaaggccaggtggcgatcggccggctgggcacgctgctggagcacggcgcgggcgtgccgggctggctggccgcgactctggcggccggcctgctgggcacgctgcgcgtccggtttgggccgctgtggaacggcgcggcaggggcgctgggccaggcgctgcggcgccacgcccccgaggtctggcccgtggccttggaggagctgcgccacacgcagcgcgagttcctggagggagggccgtcggaccgctgggcggcggccggcgcagcgacgacggccggagagacggcgcccgaaaccagcacgcccctgcgccgccgtttctcggcggcatgcgtgcccgaggacgcgccaggcaccgacgcggcgacgcgcctgacgcacatcctgcgagcgctggcggcgtcggagcacgcgctggtggaggcgcgcgcccgggactggctccccctcttcctcgccttctcctcggcgcctgtggtgctgcggcggcggggtggtgaggatgatccggcaggagaggcggaggttgctgaggagctggaggacgcggcggatgatgagccctcccacgaggaggcccgcgggggagaggacggcgactacgtgatggtagcacgcccccaggcagaggctccggcgtcccaagcgcaaaaagccccggcgtcccaagcgcaaaagacggacgagagtggtcggtctgcaaacgggaaagccggacacccggtggacgcggcggcgccggcgcctggcccccgccaggccatgagcgtcaaggagtggcgggccgggctgcgtgagtggctggccctgctgggcacgctgcgcggcatccgcggcctgcaccgcgccgacgacctgctgcagggcatcgtggtgcacgtccgcgactccgaccccgcagtccagcaggcggcgctgctctgcctcaaggtgagggagtga

SEQ ID NO: 8690 - DNA, 417 bp, Chlorella protothecoides
ttcttcgacgcgcgcggcatctcgcgcgaggccctggagcgcaacggcgtggcggcggagacgctgcacgtccccggcggcgccggcgaggccgccgtcatcgccttcccctaccaccgcgcgggccggctggtcaacgtcaagtaccgcacgctggacaagcgcttctggcaggtgcgcggggcggagaaggtgctgtacggcctggaccagctggtcttcgacggcccggccggcggcgacgtggtcatcgtggagggcgagatggacaagctggccatggagagcgcgggcctgggcaacgtggtgtcggtgccggacggcgcgccggcgcgcgtgcgcgatggggacctgcccccggccaaggacgacaccaagttctcctacctctggaactgcaagcagtatctggaccag

SEQ ID NO: 8691 - DNA, 561 bp, Chlorella protothecoides
  modified_base (127)..(136): a, c, t, g, unknown or other
atgcagctgctccccctggcacccactccctggctggtcctgggcatcgagctcctgcagggcgccacctttgccctcggctggacggcagggtgtgtgtacgtcaagcgcacggctccccgccacnnnnnnnnnntctgggcatcgagctcctacagggcgccaccttcgccctcggctggacggcggggtgcgtgtacgtcaagcgcacggctccccgccacgcaaggtccaccacccagccgccaaaccagcatccctgcatcgcattccggcaccttttctgcgcacatcctgccctcctgtgatcccctacagagcgtgttttcggggctctacaccggaataggagcaggcgtcggcgcactactggcggggggactctacggccccatgggcggggcgggtgtgtttggcctgggagccggcatgctggcggtcggctggggcgccgcgctgtgcgtgctgtggtggctgcggcacacgaggacagcacacagcagcgcctacgtcaggctggaggctgagctggcgccgcccaggggcctggcgtcgccatga

SEQ ID NO: 8692 - DNA, 1494 bp, Chlorella protothecoides
atgacaagcagagcctcagcccaggcgggacagcagcacctcctcgctgagcgggtcgttcagctctgccggctcaaaggggagcatgagggaggggtcgcaggacacgtaaaccctctgcttcaccccaaagtcgtacagcgccctgtcctccttcttggacaccagcaggtccatctcctgtgcgatcgagatgacaccgcccctgacacacggcgcacggctcccgcccaaaatgcaacatcgcaggaacatgtgctcccagccaccccaccacctaccctggcctcccagtgtccaccctcacaggtcgtgcccccgagtcgccctggaccagtcccccccccccctcaccagcccgtcgtcaaactggaggtagtagcgcgcggtccagcccaccagcgtcttggcgatgaccgtggcggggcagatgcggggctggcggtagtcggcgtgcaggctgacgtcggagggcctgaccatgacaaaggggcgggcagttgtcagccccatcttgcgcacgaagaggcagccggcgggaaggtgcatgacgtcgcccacgaagttcatgacgaagggcgagcggggccgggcggcgatgtcctccattcgccccgcctgctccacgcgcccagcgttgaacagcaccacgctgtcggccagctcccaggcctcctcctggtcgtgggtgaccatgatggtggtcaccccgatctcgcgcacgatgtcgcgcagcgagcgctgcagcgccttgcgcaccagcgggtccagcgcgccgaagggctcgtccaggagcagcaggcgcgggctgcaggccagcgcgcgggccagcgccacgcgctggcgctgcccgccggacagctgcggagggtagcgcgaaccccccgtcagcgccaggagctcggccacgcgcgcctggacgtcgatgcgcaggcggcgcacgcgcgggccgaacgcgatgttctccgccaccgtcatgtgcttgaacagcgcgtagccctggaaggtgaaccccacgtcgcggtcctggatggagcgctgcgtcatgtccacgccgtcgaacgcgatggcgcccgcggtgggcgtctccagccccgcgatcaggcgcagcagcgtggtcttgccggagccggaggggcccagcagcgcggtgatcgtgcccggcgccacctccacgtccacgtcctgcaccgcgcggaacaggccgcggtcagtgtggtagtgcttgcgcatgccgcgcaccgacacgtgagtgccctggacgtggaaggaggaggcggcgggggggtggggcaagggcacgggcggcgggggggagcgggagccgtccgactccagcgactcgagcgccgggggcccgaccgagcgggcgggaggggcacgccgacgacgtccctgggaggttggagggagggagggagggtgaggttgggatgggtggagggtgattgtgagggggggccagggaggaaatggtggatgcagggagggtga

SEQ ID NO: 8693 - DNA, 1230 bp, Chlorella protothecoides
atgaaggccctcacatccccagcccactgctgggcgcccagcctcaaggcacccctccacacctgcccgccccgcgttgcaccggtgagtggccctggagatcggtcgtccgggtgggatggcgaagcgggccggcgcccgtgtgagcgcctccggtccacaaacactctcagtctgggcacaagaggacgtcgtcggcgtgcccctcccgcccgctcggtcgggcccccggcgctcgagtcgctggagtcggacggctcccgctcccccccgccgcccgtgcccttgccccacccccccgccgcctcctccttccacgtccagggcactcacgtgtcggtgcgcggcatgcgcaagcactaccacactgaccgcggcctgttccgcgcggtgcaggacgtggacgtggaggtggcgccgggcacgatcaccgcgctgctgggcccctccggctccggcaagaccacgctgctgcgcctgatcgcggggctggagacgcccaccgcgggcgccatcgcgttcgacggcgtggacatgacgcagcgctccatccaggaccgcgacgtggggttcaccttccagggctacgcgctgttcaagcacatgacggtggcggagaacatcgcgttcggcccgcgcgtgcgccgcctgcgcatcgacgtccaggcgcgcctgtccggcgggcagcgccagcgcgtggcgctggcccgcgcgctggcctgcagcccgcgcctgctgctcctggacgagcccttcggcgcgctggacccgctggtgcgcaaggcgctgcagcgctcgctgcgcgacatcgtgcgcgagatcggggtgaccaccatcatggtcacccacgaccaggaggaggcctgggagctggccgacagcgtggtgctgttcaacgctgggcgcgtggagcaggcggggcgaatggaggacatcgccgcccggccccgctcgcccttcgtcatgaacttcgtgggcgacgtcatgcaccttcccgccggctgcctcttcgtgcgcaagatggggctgacaactgcccgcccctttgtcatggtcaggccctccgacgtcagcctgcacgccgactaccgccagccccgcatctgccccgccacggtcatcgccaagacgctggtgggctggaccgcgcgctactacctccagtttgacgacgggctggtgaggggggggggggactggtccagggcgactcgggggcacgacctgtga

SEQ ID NO: 8694 - DNA, 933 bp, Chlorella protothecoides
  modified_base (263)..(272): a, c, t, g, unknown or other
  modified_base (344)..(353): a, c, t, g, unknown or other
gcctgggggaggattattgtttctgttcagggatttgtaagcgtggacaagtggttggaatatcgtgacccaggagctgacagatcataccaactgctcctccctccacaggcttctacttcctgcactacctgcaaaccctggtcggggggccagaagtgtttgaggctttcttcaaggattacatcaaggccttcagcttcaagaccgtcaccagcgacggattcaaggtttctacttcctgcactacctgcaaaccctgnnnnnnnnnngggggaggccatgcgtgcaggggcgccgtccctctaccttgaccctggccaggcctacttcctggactactnnnnnnnnnnagggaggccatgcgtgcaggggcgccatgttagtattgtcaatggaaatggcatgccctcgttgcttgtcctgcgtcctgtccacaattctagccagctctctaccttgaaccctggccaggcctacttcctggactacttcacggacagtacgcccggtgtggggggcattgactgggacctctggttctaccagcctggtgagtgtgtgcgcattgaccctgggagcctgagatgtgccatacgacaagtgacaggtcacgcaaggtttgaatctcatgtgaaccaatgcaattgctggacgggacgtctgcaggcatctgctgacaatagctgcaaccatctgcaagccccgacggcaataccgaccccttgcctccatccttttatcccaggaatgcccccaaacgtcaactcgtacgatgccagcctggctgaatctgcgtatgccctggcacagagctggcacacctctgacctgatgggccttggcaccgggagtactgcaggccctgccaaggcctccaccactgatctggatgggtggtcggcctcccaggtgcctttgctggagacctga

SEQ ID NO: 8695 - DNA, 1242 bp, Chlorella protothecoides
atgttcccctgcaacgagtgcgccaagctgatgatccaggcgggcatcgccgaggtggtcttccacgaggacaagggcacggccgccggcgggtcgggcccagccgccgacaacgcccagccagctccggggagcataaggtgggggcagggtcctgagttgccgcggcctgatgatctcctgacgacaggaccgtcagaaactcatgccatcgtcttccatacacacttccgcagtcggagccagcagtatgcagcgtctaagaagctcatggccatggcaggggtgcatgtgcgtcagcaccgcttccatcgcagcagtcgacgcacaaaggctcgcgacggggggcacacgggctcgcagtggcaggggaacgagaaagaaagtccagcttgccgggcagccatgcagcgatgcggtcgccagctctcaggcgttccatcagacagcagcgggcatctgcaggtctgtggcgaccatcttggcggcaatgggatggtacatctcgcgatgggcggcaaaggtgtcgagggcggcctggcggctcttagggttggcgtagagcgcacgggtcctgagttgcctcggcctgatgatctcctgatgccaggaccgtcagaacctcatgccatcggtaacgagaaagaaagtctagctcgccgggcagccatgcagcgctgcggtcgccagctcccacgcgttccgtcagacagcagcgggcacctgcagggtcccaaagatcctcacccaagaactcaccttcatgcggccctgctccgagaggaaggccagggtctgtgggaggattgccaggtcacctgcaaggaatggaggggcccaagcacatgtgggagggagtgtcctgcctgggcacttagaagccacttgaggttaggtcgtcagcctccacttgtcgcaaagagacctgcgccctctcacgggccgcatctggtgcgttatgttgggagcccgccgccgaccacctggccccggcctccccacccccccggccatcaccatacctgctttgatgcagagcgagtaccaggcgcggcgcagctcggcgttcttggagtcatcgaagtggtacagctcctgcatgcgccttgtggtggcgggggtgaagggcttcatgctcctcagctcccccagtttgtccaagaaggccactttctgtggacaccagggggaaatgacaggggtgacccccacttaagcatgcctgatgcaggggagaactga

SEQ ID NO: 8696 - DNA, 966 bp, Chlorella protothecoides
atgcagccgagattcgaaaccccagcgcgctggattgaatcggaggcacgatcaagaacatgggcaagagcgtgcaaaattggtggtttatcgatgcgaagttcctcctccttgagcatttggcatgcacacatacagccacagaagcgatctcgcactcgtgggcgccgcagtgggggctgctgtggtgtcgtcgtccctgacgtactggtttctgcggagccagtgcacgcggcagtggagacagcgctgtgtacatttcatcgggtgtggacccgatgccaaacgggattcgatgctggactcagccgggccatgcccggtgaatccctacgacacgaagccacgctcagggtgggtgtggagaaggtctctgggcaaggcgacgagggggctcaatgcctgcccatcataaaccaggcccgcaagctccctccagggtgtggtggaggccagcgtcctggtgactggaagcccaaggcaccagcaggatgttggggggtgctggatgactatcctctccactgccactggctgccctgcttgcataccaacatttcactcgggcttgccggcccccaacaacacagtggcatcgtcaggtaccctagaagcgtgcctttcacagcttccaccccccccctctccctcccctcccctcaggtgggagcatgcatcgtcgaccgccagaatgtcatctgtggcatcggatacaacgggttcccccgcggctgccccgacgcacagctcccctggtccaaggcggcggagagcggggacttgctggacaccaagtacccctatgtctgccacgcggagatgaacgcgctgctgaacaagaatggggcgtctgtcagcggggcggtgagggggggtagagctcctggcgtcgtcgtgatcatgggcgcaagtgtgtggcgccgtccccgaggtacttccccgccgactccgctggaggtgtggtga

SEQ ID NO: 8697 - DNA, 504 bp, Chlorella protothecoides
atgcgcgaacagaacgtcatccatcagtttagccacctggccggcgccagcccacacctacgcttcttcggcaacctccgcctgggcagggaggtccagctggacgagctgaggcggcaataccatgccgtggtcctggcatatggcgctgagtcagacaggagccttggcatccctggggaggccgcccccggggtgtactcggcgcgcgagttcgtgtggtggtacaacggccacccctcccaggctggcctgccaatcgacctgcgcagcgtgcaaagcgtggcagtcgtcgggctgggcaacgtcgccctggactgcgcgcgtgtcctgctgcagcccccggagcgcctagcgtcgacggacatcgcggagcacgcgctgcgtacgctgcgcaggagcgccgtcaccgacgtccatgtcatcgggcgcaggggccccgtgcaggtgggagggggcaatggagcgaaggaatcttggatatttctggggcatgagccctga

SEQ ID NO: 8698 - DNA, 537 bp, Chlorella protothecoides
atgtgccaggggcggccaacaccagtgtaccctcatccgccccatcccaacggcctgtctcccagcatctgcccccccttgattctctcgcaggtgctgaagagcatcggctaccgctccatccccgtccccggtctgccctttgatgcggagcggggtgtggtgcccaaccggatgggccaggtgctggaaagcgcggcggcggacgctcccgccgtccccggcctcttcgtcgtgggctggctgagccggggccccagtggcatcatcggcaccaacctggccgacgccgagcagacggtggagggcatggtccgagcacagacggactggccgaccccggagcggagggccggcctggagcgagccttggccccggagtcaatcgcggtgccctgggcgggctgggcccggatcgacgccgccgaggtggcggcgggggaagccgtggggaagccgcgcgagaagatgacgagcgtcgagcgcatgctggcctgtgcggtggcaggtgccgcctcggcgccaggctcaccttga

SEQ ID NO: 8699 - DNA, 345 bp, Chlorella protothecoides
atgggggggggtgcgccagtctcgcacccaccacgccctcgcgcacctccccatgatgccaccaccttgcatacaggcatcgacctcgacgaggcccggcggaagcgagaggacaacatcgtacagttgcggaaggaccggcgggatgagaacctccagaagaagcgcatggtcagcaccgtggctgtgcagaccggggagctagagaccacccgatctacgccgtctggagtccagcagcgggtgcgcgggaggggcgagcccgcctcgtgcactggagtacgggatgtcttcatgtgtgagggggagtgtcaagagtgtgggagtgcctgtggcacggcctga

SEQ ID NO: 8700 - DNA, 3597 bp, Chlorella protothecoides
  modified_base (436)..(486): a, c, t, g, unknown or other
  modified_base (640)..(649): a, c, t, g, unknown or other
  modified_base (3358)..(3465): a, c, t, g, unknown or other
atgatgttgttttcccggcgccctgcaaaggtggtgcttgtcagcgcatgctgtgtgaatctcatgtcgtcctgcttcgtctcagacacaatcgccgtctggcacatcgaagtgagaagcactcgattgggcgcaaggctggatggggaattcaggtggcagccgattgtggtcccggcttccgccttcgtggttgccccatgcatggattgcatgctgtgcagcttaacccccccccccactcatacctccagggagcgcccacgagctctcacatcgccatttcacagtttgtatagtatactcgacatatatgatgaggagcaagagacctccagcgtcccgaaagggcttacgctagtcgttcacctagtcaacatgttggtcggcacgctctgcctagctttggtgctggctcggatggggccgcttgcgnnnnnnnnnnnnnnnnnnnnnnnnnnnnnnnnnnnnnnnnnnnnnnnnnnnacgctcctcgctccacaattgttgcgggtggggagcatgggttggcttggcaagccaggtccacttcttgctgtgaccggcagcaatacctggaagacaatgattcctgtttatttcatgagcataccgttgttaggacacttctgtctcttgnnnnnnnnnnatgactccatgtcggacgtctggtgctcctacggtttccaaaggtgcaaggacggcccccgcgcccggctgctggacgtgatcatttcccagcccgtcttccctcgccagtcccctgtggaggctgccgcacaacagctgatggaggagcagcacgggtcgcagcgcgcgctcctggaggagcgagtcaaggagatggtggaggaaagcttggcggcgcgcggcatcggcccgcgcgcgcgccggctctcacaggcgcttcctggctggtacgacgtggggccagggacgcgcttcctgctggaggccgccgcgtcggttgggctcgagggtgacgacggctctgggaccctgggagcagtgacccctgcagcaggagcacagcctgctgaggtgggcctggcagcagcaggggcccagcttgacgctgcagacgaggggagggaggcgggaagccttgacccggagccgtcggaggtccaagcccctcccctggccatcccaccgccatcgccagaccccccagtgccccctgaagcccacgctgacaaggagccgacggtggtgattgatgaggcgcccccgcagcagccctggctggcccgggcccccctctggctctacgtcctcatcggctcctccggcctcctcgtcctgctggtgcatctggtccactgcacgctgagcatgctgtgcccgcagccccagcccgagcagctggggaaggggaagggcgacccggaggccggccacacggccccaggcgagcaattcctgatccgggttgggccccccccggaggcgcctgtcagcgccgcggcggcgccaccccccggcccacaaaagggggtcctgcagacctggccgcagcagggcgccaaccacccaggagcttgggggcaacacccccaggacttaccctcgccatacagcagccccccgtccatgcgctctgctgtgtcacccacgggtctcaggtgggagcagccccccgtccatgcactctgctgtgtcacccatgggtctcaggtgggaggtgtctggcctgctggatttgatgtgggagtgtgcaggctcctgactctctgggcatcgtcgcccgggcctcctgctctccaccctggcgtccacaatgccggcttcctcatgtgcacgatccccgcctctaccgcacccagctgtcgcccccctgccctcccgtcgacctcctcccctcacaacacacacacatcctcaccgcaggctggcgatgccctccatccccacggtagacatctctgtgcgccggagggacctgagcgccatggggtgggccatcaacccctcagcctccgactccgccgcctttcacaaccccaccttccaggcgggcagcagcctcttcgacggtgggttttggtgagggctggggaggggaatctctggtgtcgctgcgtggcaatacagggtggtgcgacaagccttagggaggcatcttcctcgaccacacccgccgccgtttcacccttcttgcgtgaccctcaaaaacgcgcagaggcgtccttggggtcgggcgacagcccgggcaccggggtgttctcggaggacagcagccccgcagcctcgccgctgcgcaaggcctcgcacgactttgccctgggcacgacggtgtcgcgcgccgacagcggcgcgcccgcctcccctgcaagccaggaaagcgtggccacgctgcaccccgcggcctccatccagccgcacgaggtggcggccgcgcacgccgtgctggcggccgacggcgaggcctggccgcgccctggctcaccgccagcgcccgatccggcaggggctgcaggagtggggggcgaggctgagacgctggggcagggtggagcaagtgaggatgtggccgagccggtgggggctgtgcccgggatgcctggctcgacaccgccagcctcaccgtcacgcccggcgcccccgccgccgccccgccccggcgcgccgacggagctgctgagcgccgagcagctggcggccgaggtgcgcgtgctctccctgctgggctccggcagcaccggcagcgtctacgccggcacctggcgcggcgcgccggtggcggtcaagcgcatccaccccgcgctggcggccgcccccggcgcggcgctcgcgctggcccgcgaggtgggcgtgctgtccggcctggcgccccacccctgcatcgtgcccaacctggcggcctgcctcgcccccgggcacctgtgcctggtccaggagctggcggcggggggctcgctgcacgccaagctgcacgaccagggtcgccgcccgcagtacggcctgctgctggcgctggccgctgacctggcgcggggcatggcgcactgccacgccgcgcacccgccggtggtccaccgcgacctcaagtcccacaacgtgctgctggcgggggaaggagacggtgccgggggtggtggcgcgatcggacccgcgacctcctcccccaccccggcggcgcgcatcgccgactttggcctggcgcgagcgctgccgcgcgacacggcgtgcggcgccgacgccgccgacgccgccccggagccggggctgggcacggcggcgtacatggcgcccgaggccttttccggcggccccgtcgccgcgccggccgacgtctgggcctgggcgctggtggtgcacgagatgctgggggggcggcagccctgggcggagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagcggcgccgccccgccatgcccctgggcacgccgcccgcactggccaagctgctgcgcgagtgctggcgccacgagcccgcgctgaggcccaccagcacccaggtgctggagcgcgtcgaggccctgcg

SEQ ID NO: 8701 - DNA, 1599 bp, Chlorella protothecoides
  modified_base (112)..(121): a, c, t, g, unknown or other
  modified_base (210)..(219): a, c, t, g, unknown or other
  modified_base (711)..(720): a, c, t, g, unknown or other
atgccgctgccgcctgagcgagctggggcggatgacggggcagacgcccccccaaccccttcccagaggcaccacgcggcttccttgcccgtgcacactcggccgacgatcnnnnnnnnnncagtgtgtgtaaccaaaagacatgtttctaaaaatcttacgccggctgggattcctgccgtacagcggaccggtccattttgctgccannnnnnnnnnggaggcgctgcgcccccgcgcgcatgccgccgccgcctgagcgagccggggcggatgacggggcggacgcccaccccaccccttcccagaggcaccgcgcggcttccttgcccgtgcacactcggccaacgatggcgccatgtaccaccaccgcctcctccctgtgtcagaacaccaccggccctggctcccaagccggtcattcaaggttttttccaggcctgcctctgtactttctcagtgtgtgtaaccaaaagacatgtttctagaaattttacgccggctgggagtcctgccgtacagcggaccggtccaggttgctgccgctccaccctgccgattcgctgcaccggggaccgaccggggacaggtgccagagcggaggggctgctgacgcgcgcaccttgctgccctcatcatgaccctaacaatgccaaacccagccttccaacatcaaaccctctcaacatccaagcattcatatactctatnnnnnnnnnngaccctaacaatgccaaacccagccttccagcctcaaaccctttcaacatccaagcattcatatactctacaatgaatgacaagatcgccctcgtgttcctggctcttgcggtgtcctgcgccggagcccaggctgccgtcaccagcgaaaacctggaggccatccctgcgtcccaattcgtgtacaccccaccaacaccctcccccaatgcactgtcggtagggggcgtgtcgcagcggcgtaccgcgcgcgagtggcccgcactcgagggacttggtatctcgcaaacaagcttcacactggagccctgtgcggtgcgcagccctcacatccaccagaacgcagcgggcctcttgtacgccatcaatggtgcgccgggggagggtgctgccttgcatgatcaaccttctgtgtgccctgatggcacctggatacgcataattctggcacccccccctaaatgtcgccgactcaagcctaccaccagccaccctcctgcagccgagtccctcatggttgggttcgtccaggagaatgggacagcagtggagaacaccatcacctcaggcacctctgccgtctttccccagggccttgtacactaccagtacaacactgggtgcagccccgccacctataccatcacctacaacgatgcgcagggcgccacagtcaatattgtgccggcgctcgtcaatcttcctcaggcggtggtcatggcgagcctgaatatcagcgagatggcatacgcggagctggttctgggtgcgccgaccaccaacttcatcgccgaggccgatgagtgcatggcaaagtgcatggtgaagagtcagtccacccagggacgtcgtctcctcggcgcccagcctgagatgtga

SEQ ID NO: 8702 - DNA, 151 bp, Chlorella protothecoides
atgcgcgagttcttcggctactgcttcacctgggcctgctgccctctggacggcgccatctgctgcgacgaccaccagcactgctgcccccagaacctgccggtctgcgacacgttggcggggcgctgcctggccgccgcgggcgtgctag

SEQ ID NO: 8703 - DNA, 552 bp, Chlorella protothecoides
atggagcgcgcgctcacctccatcctggccctgggcctgggcatcaccatcgggcgggaactccgccgctggatctcggccccagggacggaagaagatcccctgagcgtcgtatctgactccgcgagggtcatcgctggtggagagtcgggtttcccttgccaccccgcagcatggagggccttggaggctgaggagccagagcctctggtctacgatgaattcgctgtggcgctggcaggcccatcggcgctggcatcagccagggcatgtgcacagccgttcacgggcgcagccggccctgggaagccccatcgtgcccgcaagctctgcctctccaacgtgacggcacgtgtgtggtggttcgatgagcagatcagggctgcgctttcttctggaaccaatgcaccacgccaggtggtggtgctgggcagcggcatggacacccgcccctggaggtgctccgatttccctcctggtacgcaggatgggggttgtgggaagagggatctggaatctgcaggagggctggcctgtgatcattcgctgtag

SEQ ID NO: 8704 - DNA, 477 bp, Chlorella protothecoides
  modified_base (90)..(99): a, c, t, g, unknown or other
atgatggcggcggcgacgctggcggctgcgccgccaggacgtccccgccggcctccgtggaggtgcggtatcgcctcctgccgcgcggcnnnnnnnnnncgcgccgccaggacacccccgccggcctccgttgaggtgcggtatcgcctcctgccgcgcggcgagcgcgtggtgctgcagccgcgggcggcggccttccaggccgaggtggggccaggcatgcgcgaagcgctggaggcggcgctgggcgcgcggtccacgctgaccgagggcgactgggtgcgggtggggcagcacctgctgcgtgtgcgggagctgcaccccgaccgccaggtcagcgtgctggacgccgagctggaggcggacatcgccgccagcctggagaccgaggagcggattgggcgggaggagagcgaggcgcggcggcgcctggagaccctggctgcagaggccttggaggcggcgcgggaagccgag

SEQ ID NO: 8705 - DNA, 1452 bp, Chlorella protothecoides
atgccgcccctccagggcatgaccttcacggtgctgggcctgggcgactccaactacacccagttctgccgcgtgccgcgcgcgctgcggtcccaggtcctggccctgggggcgggggagtttcatcccggcaaggacgcggacgaggtggacgggctggaggatgtcgtggaggcatggctggaccagatgctgccggcgctgaagcgcgcatgcctgcccacagtcgccgcagaggcggcgtcagaggggctcaaggagacggtaccccctgagcacgccgccagcaccaagccggtgcccctgcccgagtgccgcatcgaggtggagtggctgactgaccgcagtgccacgcaggccgtgctcgacaaggaagccgctggggccacggcagaggagctgggccaccgcgacccagagggactctactccccggagcagcccttccacgccccgctcatcgcggcgcggtggctcaccacgagcgccgctggcgacaggagggtcctgcactgcgagctgggggtggaggggtcgggtgccaggacccaccccggcgactcgctgggcgtcaagccggccaacccccccgcgctggtctctgcgctggcagcccggctgggcctggaggcgtcggcggtgttcgacgttcggcccaggccgggagttgcgacgcagcacctcctcccccacctgcacacgccgtgctccattggccacgccctcacggagtctgtggacatcgcagccccgccgcgcaagtcgctgctgcggctgctagcggagcactgcgctggtgaggaggccaggcagaccctgctgcgctggacgtctcgagccggtcgcgacgagtatgccaaggtgaccccccgaggcagggatgcgggatggatgcagcgcccggcccggcactcacatgctcgtgctccaccctcgtacacaagtgcatgcctggcagttaagcctgcacttcaacagcattccccaccccctcccccaggaggttctggaggggcggccctcgctgctggacctgctgacgcggttcgactcccgccctccccttgcgccattgctggacgcgctgccggccctggtcccacgcccctactccatcgccaatgcggcggttgcgcagcccggcaaggtgagacgaagcagagggctgcaagggcaatgaatcttggactggttgccatggccctctcgatcgtgcggttcaccaaggcgtgcggcacggagcatgagggcgtggctactacctggctggaaaggaaggcggctcccctggtgcagggcagttggaaaggcgcggagggccccacaaccgccgtcccacggattcccatctacttccgcaggtgcgtggtgaggctgctgtcccgcatggcagggcgcggtggcctgatgggaagcacatggcagctgactgcacttctctggatgtgttaa

SEQ ID NO: 8706 - DNA, 849 bp, Chlorella protothecoides
atggcgtcagtactggtcagtgccggtgaagtcgagtatgtacggagggggttcgaggccggcgtccgtggcgatgggcgggggccactcgacttccggcagatagagatcgagacgggggtcatcggccaagccaccggctcggcgcgcgtgcgtctaggcaccaccgacgtcctcgtcggtgtcaaggcgcgccaccctttgggttgggcggaggttggcccaccagcagagggcgcgcccaaccagggcaggatatcctttgcgacggagttctcccccatagccagccccagcttccaggggcggggcggggaggagctcgcctcggacctcaccgccatgctccagcgcacattcttccgcagccccgtcagcgggagtgagctgagaggggtggtagagggctacaagtggggctggtgtagtggattggttttggccagccatgtggagggctattgtgatgaatgttggaagccatcgccagaccaaggggtgagggaggcctccaaccctcctcctcacccaccacacggccttgccatgccatgccgcggcgacgcaccacagccacctccccctgcttgcaccctccgcaggggccggcctggacctcaccaccctcagcatcgtgtctggcaagtcttgctgggtggtgtatgtcgatgtcctggtcctcgctgtcgggggcgctgtggtcgacaccgcctccattgcggtcaaggtgcggctggtgctcatgatagggaggggcccggcctcagctcattacccgcgacagcccataggcatcggggccggtgcaggatgtgtgcgcagtgccacctcacccccccccccttatag

SEQ ID NO: 8707 - DNA, 333 bp, Chlorella protothecoides
atggtctctgccaagggccgggcgctggacgccctgggcgcgcaaaagggcacggggccgggcgagggggcgcgcaagcaccccttgcacgtcgccagctggcacgcgctgaccgccgacctgtccggacccgactgggtccaggccctggccgcctgtgggtttgaccctgggcagccgaccctgtggattgtggaggggctcttcatgtacctggagccacgagacggcaccggcctgctgcacaccatgcagggtgagctggtgcggtggagcgtgggcacagggaggggatgggaagctggggcaggggcaggaacttgttgccagtga

SEQ ID NO: 8708 - DNA, 789 bp, Chlorella protothecoides
atgcggcagccgccgaccaccgcacagcctgccagtgtcaaaggtagcgctgggcatggccccgggccgggctccccggagcccgagtctgacacgtcatcaacgccggcgccctccccagcagcagcgccccaacctccagatcaggcatcgcgggacaccacagccagcccagctgggcccgcgccgtccaagcttgacgggggcggggcagccccaaaggcggcagctccgccagctgcagcgggtggcgcggccatcttggcccgcctgcgagcgcagagggcaggcggccggggtggtggcgctgcaggggcggcggcgggagggggagtctctgctccgaagcccgtcaccgtcctgtacggcagccagacagggaccgcccaggaaatcgcacagaacattggtggccgggctcgggagctgggccttgttgcaaaggggaccgggaggctcaggtcgcggaaggtgccagacctagctctgctcaatgggcatctgaaggggcggcactgctcccaagccagggcaaagaaagagggcctccttgactacgcctccaacaatgcatgtcaagatccccttgtggcggcgctggacgagtttggtctggacgccctcacgccagcaaccgtgcccgtcctcgtcctcgtctcatcctccaccggcgatggcgacccccctgacaatgctgcccgcttctatggccagatcaagaagcgcgggcagcaacccgaccgcctcaaggtcggtgtgcaagcgtgggggaggcaggatcacgtgtga

SEQ ID NO: 8709 - DNA, 480 bp, Chlorella protothecoides
atggctaaatgctctccatataccccctcccaaacaacctccagcgggttcctacaagacaggagacacaggctggcagctgctgaccttgggttcgaggcaggcccatcctggctcttctttgggtgccgccatccagaccaggattacctctacaagcaggagctggaggagtttgaggctgatggcaccctctcccggctcagcgtggccttctcgcgccaacaggcacgcaaggtgtacgtccagcacctggtggagaggcacgcccatgagctagccgccctgctggcgcatccggcggcctcgatcttcgtctgcggcgacggcgcgggcatggccgccggggtcaacgaggccctggcccgcgtgctgactgggccgggggcctttgcatcgggcgcggactggaaggcgggtgctgcggcgctggccgccatggcgcgggaggggcggtacgtgcgcgacatctggagctga

SEQ ID NO: 8710 - DNA, 435 bp, Chlorella protothecoides
atggaccagcacggcctgccaccctttgccgaagaaggaatgttccaaacccgacctcccaacaataatcccccggcaccccgctttccagggcactctgcgcctgggagccggctggtgacgcacaacgtcacgcaggagctggtggacggcgtgcaggacggctcgataacagagtaccccccctactcccaggacctggttcgcacctggcactacggcttcccggcgcccctggagcccgcccttgccgagctggggtggcgggtcactacaaaggcctcgcgcgcccaaatagcgcggtccatcttcggcgcaggctcggacgaggagctggagggctgcgtcgagtttgatgcgcggttggggtgtgcgatggaccgctactcggtgtttgtggccgccaccgttgcggatgtcaagccacggacgtag

SEQ ID NO: 8711 - DNA, 408 bp, Chlorella protothecoides
atggtggcgggggaggaccccgaggacgagcccgactacgagatcgacgatgaccccagtgtgtccgtcccgctggacacgcggtacgtgcccctgaccctgacggtgtcccaggtgggcgtcactccagcgctggacctggacctactagaggaggccagcgccgccgctgcactgtcggtgggggtggacgccgagggcagggtggtgggcaccacgcagcggggagcgggcgggatcagccccgagacattactggtgaggcaccagaagctggacactgctccccaagacccaagcacccttgccgcacaggacatgctggacatcgcagagcagaggggcatcgccctgcatgccgccatcgacgcgcacctgaccagacagcgggcgaatggtatggcctga

SEQ ID NO: 8712 - DNA, 801 bp, Chlorella protothecoides
atgccacaatgccgtccacagccaccctggactccctcatcccgccccccccctcctccacccacccatccaaggttcatggaggaagggctgcgggagctgatgttggcgcccgggacgcgacccggtgaccccccgggggttgtgggctcccgcaacctctccgacgtggtctccgacctgaaggcccaggtggcggcgaacacgcgcggcatcgcgctcgtgcgctcgctgatcggggagtacacgctgcccgtggtcggcgcctacatggcccacattcaggcagcggccgaggcggctgtgcgcgacatgctccgcgcctttgccgccacgcagggcctgggcgaaggaggagtcgtgaccgcgcacgactccatggacgacggcacgcccatctgcctggcggtgcgcgtggatgcggcggcggggtcggcggtcttcgacttcacgggcacgggcgcccaggtgtggggcaacaccaatgcgcccccggccgtcaccgcctcggccatcatctacgcgctgcgctgcatggtcacgcgcgacataccgctcaaccatggctgcatggcaccaatccaggtggtcatccccccgcgctccctcctccacccctcccccgaggcgggggtggtgggcgggaacgtgctcaccagccagcgcgtgacagacgtggtgctcaaggccttccaggccgcggcagcctcccaggtggggttggggtgttgtttcgagggaatggggtttgtgatgaagcggggagcgcacaggagagcacagggagagggcgaagcttga

SEQ ID NO: 8713 - DNA, 564 bp, Chlorella protothecoides
  modified_base (474)..(483): a, c, t, g, unknown or other
atggacaggcaggtggcagctgggactgggggaagtgtatcgagtgaggctgactgccatcacgagctctgcgataccgtgcccagtggactgacgcccacccggccatcaccaccacacccccactccgtagacgaggtgcccacccccgacgccgtcgtgtctgcctactttgagatcgggggccggcaggacacgcccgccttcctgctgggccggctggcaccggggcagcgggtgcccggcccagccatcctcctcgacgacatcagcacgatcgtggttgagccggggtgcgccgctttcctcaccgcggcgggggacgtgaggatcagcatcggggacgaggcggtgggcgcggggggcaagcagggcttgtccctggaagcagaccccatccagctggccgtgttctcccaccggtgggtgcttgagcggggggtgggagaggttcttgggttcccagcaggatgnnnnnnnnnnttctcccaccggtgggtgcttgagcgggggatgggagagattgttgggttcccagcaggatcgggaaggattgtgctgtga

SEQ ID NO: 8714 - DNA, 420 bp, Chlorella protothecoides
atgaaggggcacgacgtttcccgccacgtcctcgcctgcttcggcggcgcaggcgggcagcacgcctgcgccatcgccgtcgccctcggcatccgaaccgtctttgtgcaccgctactccggcatcctctccgccgtcggcatcgggctggcccaagtggtcaaggaggcgcaggttgcttgttgtggcggtgtggattgggtggccatgcatgggtccagattctttgggtgggtgaatggagtggaagaactgcgcaagaagaggtgggagacttgtgtgcctgtgtctgtgcattcgcggtcgtgcgggggtggagggggggtggggagggggcgggcggcccttgagtgggatcattccctggcctggcactcagcgtctgacgccaccccccttgtcctatgtctgtcaacctga

SEQ ID NO: 8715 - DNA, 1428 bp, Chlorella protothecoides
atggccgggtcatccgcatcgtttttgcggagggtggaccctttgaggccaggggtgggggcttcccctctcgcggaggtgcggcgggtgtggctgggtgggagagggagggaggaaagggggggactgtggcagaaatcacactgcccagccgggtttgggggcgccgcccccccatccgcggcgggcggcccgcccgggggcggcttcccgggagcttcccgcgcgcccaacgccagccgcgtggtgggcggcgacctggcctaccactccgcgctgggcgcggcgcagctactgggcggctccggcacgcccggccagaccgcagatgcgctgaccaagctgctggcgaggcgctcgcgctccgagctctacgcactgctggccgcggtgcaggagctggcgggggcggaccgcgcggctgcgcgtgacctgctggcctccaaccctgcgctggccaaggccctgttccagagccaggtcatcctggggtacgtgagcaacccgcgcggcgacgtggcgcccaagggcatcgcgccgccggggacgatgccggggcgtgggttcgccggcgccgcgcacgatgcgccgccggcgcagtaccgccacgccgaccccacgccggccgtgcagtaccagggcggtaccggcggcggctacgcggcaccctccggcgggtatgcgcagggcaccgtcccggcgggcctggcgccgcctgccgcaggctacggcgcgcagtcgacaggctacggcgcgcagtcggcaggctacggcgcgcagtcggcaggctacggcacgcagtcgacaggctacggcgcgcagtcgacaggctatggcgcacagtcggcagggtacggcgcacagtcgacaggctatggcgcacagccggcagggtatggtgccgcgccgacttcctatggcgacgggcacgagggcgcctacgcgcccatggccccggtgggcctggcgccggcgcacggcgcaggtgcggcttacggcggcggcaacgggtaccacgctgtacccaccccacgccgacgcggcgtcggccgtgccagccgacccgcgccagagggcgggttttgcgccgggcatgacggagccgcagcaggggtacggcggcgcgccatcgcacaacgccggccccgccgccgggctgtctgccgcggcgggcatgacgccagaccagcagcaagcttgacacacactgctctgagcgccttgtcaagcatcgctttgacgctggctcatcctccctatcaccatctcggcaatccaaatcctcatcccttcctcccacacagtactgctggagcaagtgctgtccctgaccccggcgcagctagaccagctgccaccggaccagaaggcgcaggtgctggcgctgcagcaacagatggtgagctggcggtgagggagaaggggtga

SEQ ID NO: 8716 - DNA, 1890 bp, Chlorella protothecoides
  modified_base (1092)..(1101): a, c, t, g, unknown or other
atggccattgggctcttgccttcagcacgtggcacaggggcagccaaccctgtaacagaatcctcaatgcagcctcggagtcctgacaagtcaccttacgctcttgacgggtccacacttgccaaagtagtttatgatgtcctggtcagtcaggtcgtaggacaggttgccgactgcatgggtgggaaggagaccctgtctatggtagtgtacgtaccaaacactgcgggcgcgggctcgccagctccctgcagggcagccatcggaggggtgccgccgaaactccaaagccccgctccttattcctccctcctaactgtatgtatctggaatggagctggaatcccagacagcgtgcacgatcccacttttgtcaatggagctgaaggaccgcgccatcttggagacccaaaacaatccccacctagggcgcgaaggattctacgccgaggactgatccgcttaagatattcaaaagcgctgtcggacgcttccgcagtgcctcaggatgccggctgccagcgaagtgacgtcgctctacagagccattctcagggcaggtgggtgacggtggccggcttctcacatgtcacgtactcgccgatatctcgaatcacgccagcaggctctccgatcggcccctcacgtcatacctttgtgctctccttctccatgtgcagatacgtgaagcggcgagctggcgagaagttcagggagcttccgaagggagggagtgctgaggcagtggaggctgccttccggcgaggctgcgaagaactggaagttgttaagcgccaggctgtggtctacaagctgtacgcccggaagcagaagagtgtcatggtgcggggggtggggtggggaggggtggggaggggtgtgagggtggggccatgcaatgaggggctcgtgttgcacgaggccgttgtttggagtgcacatggacagcgttattctcggcgcaggaaatgttggttgacaagggcgtggaggcagcacccatgctcgggtggtaatccagcagtctcagtttcggtttcagtatcagtagggggaagcatggaggcaggattctttggaggatgggaagannnnnnnnnnctggtaatccagcagtctcagtttcgttttcagtatcagcagggggaagcagggaggcaggattctttggaggatgggaagaagtggcactgcaatccctacgcagagtcagctgtgtggttcaatggctggaggcccatccggtacagcaatgttcaactggccaggccctccatccatgcactcaccccccatgccggccagccccgcctcggccacgcccgccacctcatccagcgccgcctcgacctgcgcgttgcagagccccagcgcccgccaccacccgtgctccagtggccctggctcgcacggtgggcccccgtcccgctgacgcggcacaatcaagacagatgcaacatgcagcgcggccgacgccagtgggcccgggcggtggcgcgcagcgcacgcacaccccgccagcgcgtcgcccagcaggcacagcgcggcggccaggagtgggcggggggctcgccgcgcgccggcgagcgcgaggaggtgcgggtgggggtggtgcaccctaaggtcgaagcgcagcgtgcgcagcgcgcgctgctcgtccaggacgagcagcgctttggccgcgtagtaggtgccgcccaccagggccggaggcggggtggcgagggggtcgggaggggggcgctggtacgcggagggcgaggcgcacagcaggctggccacgttgagcaggtcgttggtcacgaggcatgtctggcagcagggagtgggaggggggtggggtggctggtctgggcgagggagctgagctgttggaggagagcaaagtga

SEQ ID NO: 8717 - DNA, 459 bp, Chlorella protothecoides
atgacacgaaaatctcctcgttacaacatcaacgtggagctcgaatgttgcagacgtgaccacccgtgcacgtcgcctgcgctgccagccccaatggcacagcggcctcaccgcgcgggactgagcgctatgaccctcgccacggcggtcctcctcgcgatcctggcatttgtcgccggcgacatgcagtatcacaactacctagagaagtttccctcgggcctgctgcccctggagaaagagcacgacgtgagcatccattacaacgccacctccctccagcacagcggcgactgggtggaggtcagcgtgcagggcgtggctcgcccgcacagggacgacatcctggccctgtacgcgcctgcggatgcccacctgcacggcgcagcgcctgtcaagtacgagtacgtcagggcggacgcgcggtacctcaagcatgggcacgccaccctcaggtag

SEQ ID NO: 8718 - DNA, 936 bp, Chlorella protothecoides
atgggcactggtccgcgggactttcgcttcagcatcgatcggggagggacgttcaccgatgtgtttgcagagtttgtggatgcggaggggaaccccggccagcgcgtgttgaagctgctgtcggaggacccagcaaactatccggatgccccgagggagggcattcgccgcatcctggaggcagagacgggcattccccacccgaggtccagccccgtggatacctccaggataacctccatccgcatgggcacgacggtgtgtatggtccgcggatcaccaatgttcggctgggtgggggctcagagcagggtgccccgcccagccgtgatccggagtgctgcatcatggacatcgccacatccgatgccacgacacaccctgcaggtggccaccaatgcgttgctggagcgcaagggtgagcgcacggccctggtggtcacccgcgggttccgagacctgctccatatcggaaaccagtcccggcccgagatcttcgacctggagatctcggccccagacgtcctctacgagacggcggtggagtgcgatgagcaggtggtcctgcccctgggagacacacccagcatccgcgcggggagggaccccgtgggcgacgccgcgcggcatcccctggagggcagagcggctgtcgcgaccacgggcgaggcggtggtcgtgcgccgggcccccgacctggaggacctccgcacgcgcctgctggaggtcagggagtccggcatcgccagccttgccgtggtgctgaagcactcggccatcttccccgaccacgagcgcgcggtgggggagctggcgctggagctgggcttcacacaggtctcgctctcctcctccatcatggccatggtgaagatggtgccgcggggatacaccgcggccgccgatgcctatctcacgccccacatcctcaggtga

SEQ ID NO: 8719 - DNA, 456 bp, Chlorella protothecoides
atgccactgctgcgcggggcggcgctggcgcgcacggaccccggcgcggcccccttgaccgccctgttcctcaccccgtgccacgccacgccctactgggccaggatgcacggcgtggcggctcgcatgcgcttcctggactgctcccccgcgcggtaccgcggagaggtggccgccctgaacgccgccgcccaggcctggctgcccttccccgacgggctctgcctgccaggccaaagcgagctggagtgcctgcatcggcggcccgtggacgtggcgaggggcctggtggaggcaggggcccccagccacgtggtcctctttgcgccgctgggcaccgtggtgggggcgacgctggcggagggcgggtacgcgctctggcgcagcctgcccaactgctgggtccaggtggacgaagactacccctgcaccctccaggtgtgggccaggacctga

SEQ ID NO: 8720 - DNA, 726 bp, Chlorella protothecoides
atgaacaacttcacgtttggggacgaggggctgggctactatgagacggtggccggtggcgcgggcgccgggccgggctggcacgggcgatccggggtgcacacccacatgaccaacacgcggatcaccgaccccgagattctggagcgtcggtttccgctggtcctgcaccgcttctgcctcagaccaggtgccagtgctggggctggtactttgggggtgccgaaatacctcatcctcctctcctccggcaatcacgcaaccccacgcgcccatccgcaaccgcgcacaggcaccggtggcgagggcatgtggcgcggcggcgatggcgtggagcgggagatcgagtttctgcgtcccctcaccgcctccatcctctccgagcgacgcgcgctggccccttttggtatcctggggggcaggcctggggcccggggggtcaacctgtggcaacgccgggacggcaccaccgtcagcctgggcggcaaggccaccgtccaggcccagggcggcgaccgcatccgcctcctgacaccgggcggggggggctacggcccaccggaggacgaggccgaccccaccgccgtcgccgagctgcggcggcgcgccgccgagctggcgcgcgcgcgggcagaggcgctgggtcgcgcggtgggcgacattccccggccgcgcctggcgggcggcagcctggcaaagtaccacgcggaccagcactccgcgtga

SEQ ID NO: 8721 - DNA, 600 bp, Chlorella protothecoides
atggggtccagtgcggaaagagtggccagggggttccgcacctctattcatggcaggctgtggcgcagggccgtggtgtgcaccctgcctagatccactcatcccaccgcctctcaatcctgcatccctgcacaggagggcgacgtggtgatggccaaccaccctcagctggcgggtggctcccatctgcccgacatcacggtcatcacccccgtgttcaatgagggcaaggtcgtcttctttgtcgcctcacgcgggcaccatgcagatatcgggggcatctccccggggtcaatgcccccacactcccacctcctggtggaggagggtgtggccgtggtttcatacaagctcgtctcccacggcaggtctggcctgatgctgggagggggtggggcgatgaggctggttgagctgccgctagaagtacgtgtgtcgactgctttccaccaccctggcctgggggctctgggagatccctctgcggagcccatcacccgagccgcatgcagcgacaatgttgcagagtcgtcaggctgcctgggaatgacactgcgcctgcctgcccgcttgctcgcttgcctgctctaccgagcttga

SEQ ID NO: 8722 - DNA, 678 bp, Chlorella protothecoides
atgagcaagctgctgcacaaggccatcggcctgggcgggcacggccccgcgggggcgggcgcctacgaggcctacctccagcacttccgcgccgcgccggtcaccgtcctgcgcgacctgctggagctgcacaccggggcgcaggccgtggacgtggaggaggtggagtccgtggccgacatcgtggcgcggttctgcacgggggggatgagcctgggcgccatcagccgcgagacgcacgagaccatcgccatcgccatgaaccggctgggcgggaagagcaactcgggcgagggcggggaggaccccgtgcgctggctggagctggacggcgtggacaagggcgggcgctcggcgctgctgccccacctcaaggggctgcgtgctggggacaccgccacctcccgcatcaagcaggtggcctcgggccggttcggcgtgaccccggagttcctggtcaacgccgaccaggtggagatcaagatcgcgcagggcgccaagccaggtgtgtgtgggggggggcccctcggaggcgggagggtgggaggctcggaggcgtggagtcgggagcgtctggggccgtgggcaggggtggtggacccggctcctcatcggtccctgggtccccccacccaccctcactccacgctctgccccccctccctaccgaacctctga

SEQ ID NO: 8723 - DNA, 1089 bp, Chlorella protothecoides
cttggcgatggccccgcccaggcgccccagggccgagcggtcggtgttggcgatgtcgtaggaccggcggacggtgccctcctcgtcgatggccttctggacctcggcgtcggccaggatgacgtcgtcccactcgctgccgttgtcgtgcggcggcgcgccgcgccgctccgtgctggtggccgtctcgccggcgaagcgggtcaggatggacaggtccagcgccgaggtcttggccaggctgacgtcggtgcgctggcgcaggtagtcgccgcgccccaccagctcgtccagcgagcgcaggcccagcgaggccagccccgcgcgcacctcctccgccacaaacatgaagtagttgaccagaacacaggctcgagagggtgttcagatacgggacgcatccgagaggccagagccgtgcgtcgcccacccgcaccagccccgctggacgagatgcacacccacacccatgcagggtccctgccccctcccccaaacacccccctcttcacctgggaatcgcttgcgcagctcctcgcgctggctggccacgcccacggggcagttgttggtgtggcagacgcgggccatgatgcagcccgtggcgatcatggccacggtgccgaagccgaactcgtcgccgccgagggcggcggccaccagcacgtcgcgcccggtgcgcatgccgccgtcggcgcgcaggaccacgcggtcgcgcaggccgttggcggtcagggtctggtgcacctcggccaggcccatctccatggggcccccagcgtgcttgatggaggagatgggggaggcccccgtccctccgtcgtgccccgacacctggatcacgtccgacccggccttggccacgcccgaggccacggtgccgatccccgcctgggccaccagcttgaccgacacgcgcgccgccgggttcacctggtgcaggtcgtagatgagctgggccaggtcctcgatggagtagatgtcgtggtgggggggcggggagatgaggggcacgcccggcttgctgcgccgcaggtccgcgatgtagggcgacaccttcttgccgggcagctgcccgccctcacctga

SEQ ID NO: 8724 - DNA, 981 bp, Chlorella protothecoides
atggagagatggggtctgctcacgcacgcaactcataccccatccaccgccaccgcagtgcctggtcctggccacctgcatctcctggacccagtcacaggcggtgggcgtgggcgacgacaccccggcccccgccaccccagactccagtgtgaataccaccgctccgcagaccctggcagagaagcagtaccagaaggccatctccatacggtacatggggtgttgtgtccaggactctgggagcatgctctgctcagtgtcgcatcgcaccaccaggcccctgcttcctctgcgccaggctcctgggaggggccgggcgcaacctcctactcatatactccctcacattgccccacacacagggactcagcatcccccagcaaggaggacctggccacggcggtaaatctgctgctggccgccgcggggatcgatgccatccaggtcgcccccggacgtggccgggcggccggcacggggaccccccatgccagggatgcgccggtcaccgcagcagatgtgagcatcgtccccacccccgacgccgggccaccccacaaggaggccctgcgcgagctcatctacgtgtacctggagggggacggcgtgccctataaccccgccatcgccgatgcgctgctgcacgtgctggccgacgccgggtcggcggaggccggcgcagacgtgggcctgcacaccgcgctgggggtgcggctggtgggccccaacccgcgcggcgcgctgttcgcgctgtccgagccggacctccccgccgcgctggcgcggtaccagctggcggccatggctggcgacggcgcggcgcagatggcgctgggccaccgccacctgcacgggctgggcgtgccgcgctcctgcgaggccgccgcgctgtactacatccccgccgccggcgcggcagtggcgctggcctcaacgcggcagggcctgccgccgcagcgcgcgctgcggctggccggc

SEQ ID NO: 8725 - DNA, 1425 bp, Chlorella protothecoides
atgattgcgagctgggccgcccaccgacacatcgaggccctggtcgaccgattttacacgaacactccggcgatctcgtcgcgccatgactttacccctgctacccctcctcccggagcaaaggacatgatgcagacattgcaacacccagcgaatcaagtcctcgtagccttgcagccatcctggcttcaacggagtgcgtctcatgtcagtcagcgcagagcactgcaacaggccaaaacatttctccctactcagatcaatgcccaatgcatagcgccagtctgtagtccgacaggccccagaacattggagcttttgggaaggttcacttgtttcctcagactgctccaatttggatgtacatacggtaaacgagtaggaattggcagaggcctctttgccaggcgtcgccactttcaccctggtattcacaacacatgcaatccttcaacaatcggttgcatattcacatataatgtttcttggggcttgaatgccgatgtttactgctacttgaggggaggcaccaaaccgggtgccgttcgtggtactggaaagggcgactgctcggcatttactacacgggagaatttgggttggtcgccccactcttcgacaccggatatttggtgtgaaagcagttattcgcgtgactggacaagcatgttgcggcacgcggctcgcggcgtatgccgcgcggcgggtctccgcagcgtgagctccagcactgctgccttccaggagctgaatgccagcgaacagagcaagaagggccccctccacccgtctgccctcccaccacccgtgcccaactcgcaggagttcctgagcaaattcgctgccttccagggcacgatgaacgagcctgagttccccagcaacttcgtcaagccggtggagaaggcggagaacgccagcgtgcccgacaagctgaagttcaacttctacattccctctgcggccatcaaccagggcagctcggtggacctggtcctcctgcccgccaccaccggcgactttggcgtcatgccggggcacgtgcccaccgtagcggagctccggcctggtgttgtctctgtgcacaacgagctggacaaggacgtcaccaagtactttgtcaggtgtgggcagggtggtggtcgggcttggcaaggaagcaagtcaagccaggtatcctcaaagggacggtgtgagcgcacatgtggcggcttcgccttcatccatgccgactccaccaccgatgtgtgtgctgtggaggctgtccctctctccgacatcgactctgacgccgtccgtgccggccttgccgagtatacgggcaagctggcctcgctgcagggcaagggtgacgactacgagctcgcggccgcacaagccggcgtggaggtctactccgcgctcaactccgccctgggcctctga

SEQ ID NO: 8726 - DNA, 1194 bp, Chlorella protothecoides
atgcgggagccctggttgacggtgcagccgtcgcccaggatggacatctccacctctgcatgtgcgccaatggtgttggaagaggatgatgcaccgtggactgtggctgagcatagaggtaggccaccgccgtccaagcgggcaactgttgtcccccctgctcaaggccccccctctttttcgttccacccagcaccatttctcccccagcgcacctgcggaaaggaccttgcaggggggcaggaagcgcgacatggtgtagatgggcgcatccttgtcgtagaagctgaagttggggttggggctgtcggtcaggcccaggttgctctcgtagaaggcacggatggtcccgatgtcctcccagtaccccttgaacaggtgggcctggacgtgcatgcccagatccttggcgccagggatgatgtccgacccaaagtcgttctgggtggtgaagcgctcggtgagcaggtggtgcatggcactggccttgcacaggtagatgcccatggaggcaatgtacggcttgcgcgcggccctgcattcacgggtggtgaatgccagcggggtgttgaaggtcgatgtgggcatggagtgggtgatgccaatcaaatacaccatcactaccgccccagagcgcagcaagcattacaccagaaatttagtccagggcagcgccgcgaccgtgatctccgcgcccgcgcggcggtgcgcagccacgaactcggagtagtccatgcggtacaggtggtcgccggagaggatgaggtagtcctccaccccgccgcgcgtggcctcctcgaacagccagaggtactgccgcaccgcgtcggccgtgccctggaaccagttcttctgcgtggtggtctgcgaggcggccagcacctccacgaagccgcgcgagttgtacccgcccacgttggagttgtaggcctgggacaggtggcggttcagcgacgcggagttgaactgggtcaggcagtagatcttgttcacgccggagttgatgcagttggagacggggatgtcgatcaggcggtagttggcgcccagcgggaccgcgggcttggcgcgctgcttggtcagcgggtacaggcgggagccggcgccgccgcccaggatgatgcccagcacggtctgggaggtgtgtgggggaaatggggaagggtggtggtggtgggattttgggcgccgtga

SEQ ID NO: 8727 - DNA, 1422 bp, Chlorella protothecoides
atggacagcagcctcacgcggcgcggccagccctgctggtaccgccagccgcacgtgggcatggtggccatcaacgacggcatcatcctggagtcgtgcatctaccgcctgctcaagctgcacttccgtgcccaccccgcctacgtgcacctgctggagctcttccacgataccacccaccgcaccgcgcacgggcagctgctggacacgaccaccgcgccgccggggggcgtggacctggcccgatacacggaggccacctacctgcgcatcgtgacctacaagaccgcattctacaccatctacctgcccgtggcatgcggcctggcgctggcgggcgtgaccgacgaggccagcctggcgctggccgaggacctgagcgtgcgcatggggtgctacttccagatccaggacgacgtgctggacgcctttggcgagccggaggtcatcggcaaggtgggcaccgacatccaggactccaagtgctcctggctggtggtgcgcgcgctggcggtcgccagcgctgagcagcgtgaggccatcaaggcaaactacgggcgcgacgatgcggaggcggtggaggcggtgaaggccgtgtaccgggagctggacctgcccgccgcctttgccgcgtacgagcaggagagctacgacgggctggttcaggctatcgaggggcaggacaagttcccacccgccgtcttcatgggcattctggccaagatatacaagcgcaccaaggggaagggcgagccagggctggtggcacctggctggtggagggggctgcccaggcgtcaactcctcctgctcccgcgcgaagtgtgctggtgcagggagcctctcgcaacgcccgggcccccatcaaatactttggggcaaggggcgataaggcagtggctagcacatgatagtaatcctatcggaacctcattgcgaaattaccatccattgccgacagcacttgccccgccgaggtcgaactggtgcgcgatgcagtgtgcctatctcacccactcgaccaccccagccggtgagtgggggcccgctcggtcctgctggatggctggcggcatggatctcgagtactcgaacccgaaactccggcgttgcctcagggttcccgctcacacttcctgccgtcgatcccacccctcctcgtcacagggctggcagggagcaaggccagcgtcgcgacgcggcccgtcaccaggtcccgtgcaccgaccgctcctgcccgtcaatctaggagggtacgctccatgccgagtggagaagtggccctggcatacccgatcgcctgtgagaagggaggggcacacccagccgctctcacgggtgcctcccaatcgcttgcacccgcacaggccctgcagacccgcgccaccgcacagctggaccgcgacgtggccagtatcctga

SEQ ID NO: 8728 - DNA, 459 bp, Chlorella protothecoides
atgcaacaccattcacattggattggggatacagatacagagcctgccccctccctcggcactggtggtcattgtgtatgcactccttctcatggcagccctgctgcaaggcaccaagcctttcccaacccccctcccaaacttcagatgctggactacaatgttccccatggcaagttaaatcgtggcatggcggtgcttgacgtcctgctggctgccaggggcggggacgtgaccgagaaggagcgcgaggctgccaatgtcctgggctggtgcatcgagctggtacgtgtgcaggcggtcattgcattcctgccagtgggccagcttggcacctctgagatgggcgtctcgcgcgcggcgcgagtcccggcacggcctgcaccatcctggacggttggagcagcgccctgggcccggcatacccccaccggatgcccctcaatgcccccactttga

SEQ ID NO: 8729 - DNA, 954 bp, Chlorella protothecoides
atgccgcgaccgagaacaccatacatcgaaccgaaacccggcctcggaaaccatacttggcaactgagaacgatgtgcagagttatcttacgtccccaagcgcgcgagcagagggggggtgccccgtctgcggtcgcgggcaactttgctgacctgatgacgggctttgacccagccagcctgctggaggccaagcaggagtctctgagcccagattcagaactgctggagacggcagaggggtttgagctgcaggatacggatgcggacctcctggccatgtttcaagagctggcagaggagcccgccccggagctcgcacccctggccatgccaacctcgcccgcgccttccctccctggtcccatggtgcccttcgagccggtgcagactctccccgtccccgcccggcccgccatgaccatcttcgatcaacaactgatgttccagcaggccatgctgcagcagcagcaagcagccatggccacggctcagattcccgtcaagcctgggtaccccaccctccgccgcggcaagacgcccgaagaggtggctgcccaggtagagcgcaccaagcagcgccgcagggagtctgcccaccgctcgcgctctcgccgcaaggactacatgaagaccctggaggatgagaacgacgccctgcgcgctgagaatgcggcccttcgcgccaagctgaaggtccagggggggtccctgacctcctctgtgatggacgcagcctcaaggcagacgtctggcggagccgactcgggatccagctccgaggtggcggccatgcagatgagacaaactcctttgccaaatggttgtgaagagactaagacttacattttggcgagaagcgagggtctggagtgtcagagtgggcaaggtgtgggcgagtgccgagtcacggtggcagatgaaaagccaaacagcaatcagatggaggaatga

SEQ ID NO: 8730 - DNA, 765 bp, Chlorella protothecoides
atgcccacatcgaccttcaacaccccgctggcattcaccacccgtgaatgcagggccgcgcgcaagccgtacattgcctccatgggcatctacctgtgcaaggccagtgccatgcaccacctgctcaccgagcgcttcaccacccagaacgactttgggtcggacatcatccctggcgccaaggatctgggcatgcacgtccaggcccacctgttcaaggggtactgggaggacatcgggaccatccgtgccttctacgagagcaacctgggcctgaccgacagccccaaccccaacttcagcttctacgacaaggatgcgcccatctacaccatgtcgcgcttcctgcccccctgcaaggtcctttccgcaggggggacaacagttgcccgcttggacggcggtggcctacctctatgctcagccacagtccacggtgcatcatcctcttccaacaccattggcgcacatgcagaggtggagatgtccatcctgggcgacggctgcaccgtcaaccagggctcccgcatcgtgcacagtgtgatcggcctgcgatcccgcatcggccaggactgcctgatcgaggacaccatgctcatgggcgcagactactacgagcagggggcggagctggacgagtgcgcgcgcctagacaagtgcgtgcccatcggcgtcggctccgggtcccacgtgagtggcgctggcctgggagggggatggatagaaaggggagtggggatgggaagggtacgtgggtgtttgtga

SEQ ID NO: 8731 - DNA, 717 bp, Chlorella protothecoides
atgggttctggctcatccaccacggcccactccagcacttcctgggcgccctccgccaccgccgacgccccgcgccgcatcagcaagtcggggtacgacatcacccccctcacggcggagcagcgggaggcggccgccgcgaggttgaccccccaccagcgcgacgtggcgctggccagcggcacggagcgcgccttcacgggcaagaccgtggacggcacgccccacgacagcaaggccaaggggctgtatgtctcggccgtgggcgggctgcccctcttctcatcggacaccaagtttgattcgggtgtgcagactggggagaggaggttggggggcgctggtggctccctgcccaagagcttgaccagtcacggagagggaagggatggggcgtacaagtcttgcggtcccaagcctggacgagctgcggtgctgagcgcggactcggagcttgctctgggccagattggcaccggctggccgagcttctatactcccgttgacccagagcatgtgatcgaggtgacagatgcctccatccccttcatggtccgtacagaggtgttggacgcaaggtccggcgcacacctgggccacgtcttcaacgacggtccccgccccaccggcaagcggtactgcatgaacgctgcagcactgcgcttcattcccgcgggggccgatgtcccgccagaatcgaagccggtgtcaccctga

SEQ ID NO: 8732 - DNA, 765 bp, Chlorella protothecoides
atgtgggcgaggcacatgcaccatcgccagagcagtgaaggcaaagcagaacatcctcagcaggggggccaggcgcatcccagttgcgccgcagcgctggcagcagtcacggagacgagcgcttgggactccggtgtgcccaggagaatgcctgttgatgacgttccgcagcccagccatagggtcagagggaggggcggcatgggtgcaaggatggacgaggcaggcccatccctccctgctactgacgcaagggagagggtgaatgaggacatcgcactggtggatcgcagggttcaaggtcctttctttccacctgctggcgtgaagtctgaggagggttcgcaaggcaaagacgctgggggttcgttcctttgcatgtcgccatcgcggagccgcatcccaagcgacagcccttccagcagtgagaacaggaaagcaaggaagacagaccgcagatcgaggggaaagtcttccaagtataaaaagagaatagagaagcgtgagaagaagaagatgaagaaacgaagtcgctatgacaaggaagggtttggtgtgaagccctctttaaattacataactgtcatggaccgacaaacctcctcacaaggtagaagggccattcggctgcctagcaagagattccctatgtgtcacatcacgcctgaagatgatgtcaaattgactcttaaaggagattgcattcagcctaaattcaaggcccctcctcgtcctttttccgcttgcgtggaggcttcttcttag

SEQ ID NO: 8733 - DNA, 297 bp, Chlorella protothecoides
atggcccacacaacctctaaattagctgccctcatcctgcgggacgccgagcaactccgacgcaatgctcaagatgccggggtgagcgcctatgttcagagacccgtccagagggagaaacccaatacaagatttctgcacaccactctgcggagtgtggaacatggtgagtgtgtgtgtgtattcccttacatatggaggcgcaattccaaggtgtgcatgcttgcaccagtgaagatcgagagcgtggatcatgatctgctggcaatgctgataccttcaagccctgccatctga

SEQ ID NO: 8734 - DNA, 981 bp, Chlorella protothecoides
  modified_base (323)..(332): a, c, t, g, unknown or other
  modified_base (535)..(544): a, c, t, g, unknown or other
atggccccgccgcctgcccagcagcgagagatcgccgatggcggcctcatccccacaggcgtgccgggggcggaagggcccggggctcccattcctgaaagcgttctggaggaggcaggcctggcaccggtcatgggcgacgaggagatcctggtgaggagggctggctggtgcttgagcggggccagggcccgcagagtcgggccctgctgggcccctcatgcgctggccctgctgcaaggggccacgcgtgcagttcacgtccgagcactccaccgtcgaacccgcgatccccccggtccaccaaaacgcagtcggcggcnnnnnnnnnnggtggtcgcgcaggcaggacaggcaatggagcgcattgttgggcctgggcctgggctggcgaatgatcaaacgccaggagtggctgaaaacatggccccgccacctgcgcagcagcgagagatcgccgacggcggcctcatccccacaggcatgccggggtcggaagggcctggggctcccattcctgaaagcgttctggagnnnnnnnnnntgtgcagctcacgcccgagcactccaccgtcgaacccgcaactcccccggtccaccaaaacgcagtcggcggccgccacccagggcagctgcgacgccgcggcgctgtcgttcgcgctttcctccacgcgcggctccctgtacgggcgggcgctgacccgggtgctggccctggccgggccgcgcggcgcctccacggccgaggcggcggggcggggggtggagctgcgcctgctctccccctcgcgcatggcgccggagcagcgcagcgccaccgtggccgggctgggaagggccagcgccaaggagcacgtcgcgcatgtcggcggctatcgctacgcgctcaaggcctttgccggcgtggtggaccagcccaagccccagaaggccggcggggcaggggcggcgtccaagggcccggccccggggcctgcatga

SEQ ID NO: 8735 - DNA, 987 bp, Chlorella protothecoides
  modified_base (191)..(200): a, c, t, g, unknown or other
  modified_base (923)..(932): a, c, t, g, unknown or other
atgttaagccatgcctgtttacaagtcctccctggtccatctccttacgcatggagatctcatccctatttgtaccccttgctcttcagtcctcgaggaaggagtgccggtggctcgccagaccgtgagcgtgaaccagccgcttcggtacaagggactgacggcctaccagacagactgggccctggcgnnnnnnnnnntcgccagaccgtgagcgtgaaccagccgctccggtacaagggactgacggcctaccaaaccgactgggccctggcagccgtgagggtgtcggccctgcccctgagcgacgctgccttgggaccacagacgggcaccgctctttctcaaacgccaccagatgaagccggtgtctcggagggccagggaaagccagtacccaatcccccgcggcagcctgtccaactgtctcttcccatggcccagctggcgggggagagccccgaaagcaagctgttcggcaccttcctgcccctgtccacgctgggcctgcccgcggaggacggcgcgccggggtccaacccgcgcggaatctccctgctggcgcgggatctccagacggtggtgctatacgacggcaagggggcctttgtgggggtgaggcgcccggggtcaaacctccccatcacggtggagggagtggagctccgcatcggcgccatcacgccctccagcggcatgcagctgaagattgaccccggggtccccttggtgtacgctggcttccttgtggctgactgccctcaccacagaatcctccgcaccaattctagattcatgctgagccatccactcaatctcgtgatcccccccccggccccgtcagtccagccccttgaccgaatctccacctcaccccaccgctgttccaggcctgtgcattacggtggtggtgtcctacctgnnnnnnnnnngtggctgactgccctcaccacagaatcctctgcaccatttctagattcatgctga

SEQ ID NO: 8736 - DNA, 756 bp, Chlorella protothecoides
atggagcgtagggcagttccatgcacgagcggcatcgctatcggggggaactcctcctttccaccccgctgcgaactcgaccgtgattctgacagatggggactcgcccgcagtactccgacgcctacgcggagcctggcggcaatccgcgactgggcacaccggcctttaaatatctccagatcagcctggccctgggatgacagcgatgcgacgcctgtgaccgttccagcgatgcagggtgccgagagcgcccgagcgcaggctccggtcaggaccagggaggagatgctgcaggaatggagggagcagcgtgctgtacgcatctcggggaaagccgatgtaaaattacagcaatcttcggccccggcgccctctggcgatgctgggaaggaaaaccatgggaccaccagaccacctatggcgagtcacaaggtcacccaatcccagccggagccccattccgccccttctcgaggcgtgaattccatcgcggcccggctggagagtttgaagcgggagtccctgcggccctccatagccccaccctccacttcccaggcggggatccagtttgaagctgcgggccccgtagactccaccgcgctgcgtcgcctggcggggcagctcttcgacgacgagagctggaagcagctgtacgataaagggatgaacgcgaagctgacgcgaagtagggatggggccaccgaggagaccaagataaaagaacttgcaggtatgatgttaaggggttga

SEQ ID NO: 8737 - DNA, 1521 bp, Chlorella protothecoides
  modified_base (1101)..(1110): a, c, t, g, unknown or other
ccccgcgccgctgcgcaggccgaggcggccgaggcggtgacgcgcgccgtggaggccctggctgtagaaggacagaggaccgcgccggggtcttcagccacggcccccggtgcccccccgagcgagctggacgcgctgaccgcggcagagtggccaggcgtggaccccgaggacgtgctgctggacccgccggctgtgcgcgcgatctggcgccagttcacctccgactcggccatcgcggtgcagcaggcggccgccacgcgcgaggccaaccgcctggccggcgcgcgcgggccgccgctgtgggccatcgctgccatggctgtgctgggcttcaacgaggccatggccgtgctgcgcaacccgctctggctcctcttgctcctcctcgccttcctcttcgcacgcaccgtctacaacgtgggtgctgctgggttcatgactgcggctatgttgtcatgcttgtcgctggggctcgcacctctgcccgccgcgcgccccgattccagcaccccctgcctctgggtcccacctatccaccccccaccacacacatccgcaggagctggatgtggagggggagatggccaacgggctgctgcctggggcgctcgccgtggcggccaagttctggcccaccctgcagcgcgtcgtgcatcagaccctggcctcggccaagaagttcctggccgaggacgagggcggcgcggcgcgcgccggcgacgcggcggacgggagcgggccgggcggcttcgcgcgcgcggagcccgcgagcagcgccgcgcaggtcgttcgcaggcaggactcgggcatcaggccctcggtccgttcacccgtcggcctggccccgctgccggcctacacgcgggaggtggagatgacggaggccatcgaggaggagccggagcacgaggcgctggccgcggtggaggaggaggacgcgccgcatgccggggccggtgtctcggcagccgaagaggtcgaggacggggggggcgagcggggctcggccgctcccctggaggtgacgctggagagctccactcctcccgccgtggatcccagggacagggatgccgcctctgggcagccgcaggccgnnnnnnnnnnggcgacgcggcggacgggagcgggccgggcagcttcacgtgcgcggagcccgcgagcagcgacgcccaggtcgtgcgcaggcaggactcgggcatcaggccctcgtcccgctcacccgtcggcccggccacgatgccggcctacacgcgggaggtggagatgacggaggccattgacgaggagccggagcacgaggcactggccgcggtggaggaggaggaaacgccgcatgccggggccggtgtctcagcagccgaagaggtcgaggacggtgtgggcgagcggggcccggccgctccccaggaggtgacgctggagagctccactcctcccgccatggatcccagggacagggatgccacccctgggcagccgcaggccacccctgacgagtcccggaaggatcgttga

SEQ ID NO: 8738 - DNA, 1125 bp, Chlorella protothecoides
atgtcgaggcgggagcttcagttcctggatgcacaggatgaggacgatgcctcctcctcccagtctggatctccttcagcatccgaggatgaaactgggtaccccagcagcgacgacgacagccctgcggtgtgcagcgaccgaccgggaccgagtgctgccccccagcccgtcacacccccgctccaggccgggagaaagatctccattaagctgggaggaacctccagcgagctcacatgccacgtgcgtggtgtgtggtgtgaagggcggcctgccctgggaaacgtctgtggaaagaagggccattgtgctggcttcatcggcgcccgctacttcgactgccccaacaagccctgctacctgtgcgggcagagcggtcatagcaccatgacctgtcccttccggatagatcccggtcacggctgcagcgccgcccctggatccaaccccacagacggggttcagtgggaggtgctccggcgggagcagggcgcggcgggcgccgccgccccggggttgccgcctcagcgcaagcgctggcaggtggagagcgcggtgctccgcctgcatgaccgccgtgtggtgtgcctggaattccatccgcgcaaccagaacatcgtcctgtcggggtccaagggcgggcgcatcgcggtctgggacatggagaaggtgacgagtgcgtgcttgaggggtgggctgccaaggaagagagcgattgaagactgtggtgcgcatcaggcctgcgtactcccagtggttgtatggccaatcttgtgtcaaggtgcgtgcgcatgcctgccactcccttcagctcaggcagcttcgtcctccccgcaggtgtatgagcgcactgtctaccgctccatcaacttctggctcacgagtgctctgaagtttgcgccaggcagcgatggattggcctgtgccacctgtagctacgacagcaccgtcaagatctttgatgttgagacgggagcagcaaccacactgcacactgccaccccacgggagtggaggggtcctgtagaggaggatgggagctggattacccagatggccatggacgtcatgcagggtgagcatcacatctcgggagtgggaggtacaagggttgggagttga

SEQ ID NO: 8739 - DNA, 600 bp, Chlorella protothecoides
atgacccccgagggcctcgcggcggcactggagcgagcggcagccgccgaggcggcgggccgcgcggcgcgcgaggcggccagcgccgcggaggtgcgctgcgacgagctcgagctggcggtccgggccctgaccagcgacctggaggggagccgggcggagggtgcgcagagcacggcgcgggcggagggcttggcgggggatctggccgaggcgaggcgcggcgccgaggcgctggaggcctcgctgggctcgagccgcgaggagtgtgcggaggcgcggcgggccgccgccgacgcctcggcccggctgcagcggctggggggggagctggaggcactgcaggagtgcacgctaggcctggggtcgggggaccagggcgagatgctcagccgactgctgcaccgggtgggggcgctggagggcgcgctgctggcttccgagaccaggaggcgggccctgcacaacaccctggtggagctgcgcggcaacagtctcacacccgattcctgcggcgacctggccctgccgcctccaccagtaccccgacgccctgccgtgtgtggatgtccatgtcgtcccctcagggatgcctgttga

SEQ ID NO: 8740 - DNA, 777 bp, Chlorella protothecoides
atgctctacttctgcgacccgcggcactcctcggcctttgcgaccatgcaggcccacaagaagggcaccaaggtgcaactggagcggagcgtggctgggaaccccgtggacgccaacctcctgctcacggcagggaacgactatgctgctcgcctgcttgacctgagggtgctgggaggaaagcaggaagcgggggccgaggtgccccgtgctgagctggcgtcgctgcagcacagcaaggtgatcaatgccgcgtacttcagccccatcacgggccgcaagattctcaccaccagccaggacaaccgactcagagtgtgggactatgtgtatacctcggatcaggtacgagagaggtggacactcgaggggggcaggggtctggaactcaagagggaggggctggcacgcgcacctggaggtggagaccgagtttgcgggcaagggtgtactttgtcattgcgtggctcctgctatgtgccattcacagtctgcctgggcagccatggatgcactcctcttggggatggacatcgtcaggctgcattcctgcagcatgtcaggctgcatcctgcatctcccttgcaggagccggaccgaatgattgtgcacagcaataacttcaaccgctacttgacgcccttccgggcagagtgggaccccaaggatctcacggaaaggctcatcgtgtgcggcaggtcggtttgtcagacaggggatgggttgtacgccttgaggatcaagtctgggaccagacctggagtgtgtgatccgtaa

SEQ ID NO: 8741 - DNA, 87 bp, Chlorella protothecoides
acgccgcgacatgctcctgctctccgccggagcgcgggagacgatccgcttcctgcccccgctcaacgtgagcgaggaggagattga

SEQ ID NO: 8742 - DNA, 1029 bp, Chlorella protothecoides
gggagtggggggccagggtgggagtgggggcccagggtgggagtggggggcgtgggttgccgagggcggcgaggctgtggtggggcgggcgtgcaggggtggggggcatgggcatgtacgagcgtggaggggcgggcaaggggctccagagcatctgagccgtgcctgtcgagcacccctctccgcccctgccctgccccccgcaccgtgatttccatccttctcgaccctcatggcggtgcccgggaccggccacacatgccccggctccacaaccccgacctcaccccccttcacctgcctgccagggacgctgaggtgctgtccctcttcgccatgctcatcaaccgcctcaaggacgggatgcggctggaggtgcctcgcatcttcgaggccgtgtttgagcccacgctgcagatgatcaccaagaactttgaggtgggggggtgctggaatggggggcaaggggggtgggggggcatgcaggagcaggtgtgtactcgagccgggcagcacaccacgcgacccacgtcatcagtctggagatccatctgtgggagggtgaggccagactcgaccaggcagccaaggcccgcgcctctgcacgtacctgccaggagcacttcctccatggccgcccacccatccaccacaggattatccggagcaccgcctccagttcttcggcctgcttcgagccatcaccaaccactgcttctccaccctcttcaccatgacgccggagcaggtgcctgggtgttggggagggggtgggccaagggtctgaccgggggggcaaggctgcaccgtcagggccaccgggtgcgggcgggcaaacaggcccgtctcgcgaccacccgccacaccacccatccaccactccaccgtgcgcagctcaaactggtcatcgactccatcgtctgggcgttccgacacacagaacgcaacatcgcagacacaggtgggggcatggaggggttgtggtggcctccgcatctcagcaaggcagcggacggcatgcagacgtga

SEQ ID NO: 8743 - DNA, 1167 bp, Chlorella protothecoides
atgtgcgccctgtgctcctggtctctgggcaaaaccatcgtcacccgactccccatcccatctgcccccccggccaccctccgccacgcctgcaggcctcaacctgctccaggaaatgctggccatgtttgcgcagtccgactttgccacgcagttctaccagtcctactacctccagctgctgcgggagatctttgcggtcatgacaggtgggctggcggagggtgggtgactggtctcggctgctttgcagctggcacctgcaccgcggcccttcaatacgttccacaagccggggttcaagctgcaggccaggatcctgcaccacctgttctgtatcgtcggggtgagtccaggcgcggcgggtggctgcgagggagtgcacgacttgccgtcacagctcatgagccgctggctccacccacccctcccctcactcacctcctgaacgtcagaccgaggtcatcaagggcccgctctgggatgccagccagccggggaacttctcgtccaaccccgagtttgtgcagcattactcgagagctcgcacagcgaggaagcgcgggtggctggcgaaccgcctgtcacacagcaggggggttccccccgtgccatgggggattgggccttcccaaagatgcacaccgctgctgcagccctggtactttttgcgaccagctcctcattcccctttccgcccctcaccatctacaggccaccgtgctgggcatgatggagctgaaggagttcacgaccttcaagcagcacctgcgggacttcctggtgcaggccaaccagtttgcggatcagaacaacgcggatctgtatgcggacgaggtcgccgcggcggtgaggcggatggtgtccttttgtatggagggatcaggatggagagagggggagcatctcgcacagccctcgcttgaacttgcccaacaaggaacacacgcacaattaccctgtctcctcgcagcgggaggcggagcagaagaagatggccgccatccccggcatggtgaacccgcacaagctggaagaacccaccatcgatgccttgtgaagtcgactgccctgcctgtcacacctataatgcatgaggacatccggcgatgggggtggcagcaagggctttgccaaggcaatgcatgggggaaggaaggggtttga

SEQ ID NO: 8744 - DNA, 693 bp, Chlorella protothecoides
atgtcgcgacccatggtgagcgaccttgccaccgcccaagtcatcatgacgccgctctggtctgcgccagaggtcctctgccggcagagggccagtgtcaaggcaagcgcgcctggaatgcccagggggatggggtggggctgggtcgcatcctgtcttcaggctttggagccgaggaatgcgcttgcactggaccctgagctgacacaggtgcgctgcatttgtttccgatggtctctagctccccaacacctcttagagcgacatctggagctacggcatcctcatctgggagattgtgacggggcgggacatcacacagtaccagccgctgtccctgacccaggggtggatgcagcaggtgagggctgggggcctgcagggcaagactgggattctctgccaacagtcttctgtactcgccatccctggacacatgctggacggcatgatggcactcagttctcaggcctctttgttctcaacaagacacaccctggaccacagggcctgcaggacacggacacgagcgcgaggagcatcatgcagatggatgagggggctccagccctggcacgccatatcttccagcagtgcacacagccctcccccgccctcagacccgccgcctcccagatcgtggagtggctgcgtggtgggaccacgctcccacagagcaccggctccggctga

SEQ ID NO: 8745 - DNA, 2025 bp, Chlorella protothecoides
ggccgggcggcatggcctgcggacgaggggagcggtgcggcggagggcggggacgaggcgcccaccccggaccccttccgcgcccaccggggcaagcacgccgccgccgcgctggccgccccggagtccacgcccagcccctctggcgtggtcccggccgaccagggctcggcctccgcggccacctccgcggacagcgccgcggccgacaggggcccctgggaggcgcacgcgccgcgctttctcgcgacgcgacaccccatcttcgccatcgcggagggggtgcacagcgagagcgaccgctcggcgatggaggggccggacgcgctggggcccgacacctctcggggtaggggtgtgtgtgtggggggttggccctgccattgtgttggggatacacactgtgtgaggcctagaatgcctgctgcgcggggctgcatggcggggccgcaggtgtggtctctatcaggatgcgctgtggccggtcaccctggattctgttcgtcacgagccctccattcccaccaaacacgcacagatgtcgaggacttctttgcagaccaccaggactggttggtggctgatgcagacatcgagctgtgccgggtgagggatgagaaggggcttcagtgcgggacctcggtccatgcacctggcatgcaagcggcccgcttcgttctgtctgccatgggtgacgcctcgtcaccctgcaaaaatgctgctccacccctgatccacaggatggcccgggtcgcagcgcagcatgccccgtcttgtgtccgttcagtccaggctgtgagggatcccgacggatggcatgtcatgcgtgtttgggctgggggagtccatcaagttgcgtaccccttccagcaacccacccttaatgcaccgcagggtctggcgcacggcgtcgacgaggtggcggtgaagcgcatccgcgctgagcagccctcccctgcccagatcaaggtcttcagggacgagatcaactgcctgcgccgcctcaaccatcgcaatattgtgcaggtgggctgggagtcgtgcattggtggttgcatgccaagctctcgatgggaaggggctttctctgcctccccagatcgcatgctcccggaagcattcttccttgtgacagaaatgatgacaggtgggcatgattggtgggaatggagggatctcccagcacagtttccgtacccgaagcctcgccccattccaatcaccaggcggggacttgtatggcgccctgcgccgccaccccgagctcttggcctgggacaaactgggccggaaggtcgcgctggacgtcgcgctgggcctccactacctccagtcccgccggcctcccgtcctgcaccgggacctgaagagccccaatatcttactcacagccaggggacggcaatgtcaacgccatgccccactgacctcaccacctccacccccacacccggcaggcgagggtgtggccaagatcgcggatgtgggcatgtctcggcgaatggtcagcgaccttgccacggcgcagcccatcatgaccccgctctggtcggcgccagaggtcttgcggcgggaacgcgtcagcgcaaaggtgcactgcgcctgggggcctcctgttctgttgggtggagtctaaaacgatgcttggcatgccgccaggcttccaccacatggcatcaaggagattgtggtcaaccagcgaactcccctgcctacatgcccagctatacttacccctcacccatcaaccactccatcgcaggcggacatgtggagctacggcgtgctggtctgggagatcgtgacggggcaggacatcaccaagttccagcctctggccctgacccgggtgtcggagcagtcggtgcgtggggaggaaagcagagctttgctgacctgggggatcacaggtgccacatgtgttcttccttgttcggcaggacatgccggcggcgcatgggctgtgctgctctgtcctcacatcccgtcgtcggcagcctgcgccgtggcgctttccgtgcataa

SEQ ID NO: 8746 - DNA, 1713 bp, Chlorella protothecoides
atgccaccctcagcacttgctactcctttgcaccctcgctcacctacaggcccacgtgcctctctgcatgatgccgcctcggccatcatccggcgcgcccagcacgcggcagcgggggcagctgcggcagcggtcctgctggccgccccgcctttggccggcgcggccactaccatccgcttccccctgcccccctcccccgagatcttcgcggtgcagaagaccctgatccaggcctggagcattgtgaccgaggccttcgttgacccccacttcaatgccgtggcctgggacgcggagctggcgtccgcgctggccgcggcgtctgcggcgccctcccccgaggccgccgcggagaccttgccctccctcctcggcaagctgggagaccgcttcacgcgctgggtccccgcccgcgagtatgccgacttccgcgtggcctccgacggcgagctgcagggtgtgggcctgctcatcgcctccgacccggtctcgggccacctggtggtgctggcccccatcgccggctcccccgccgaccgcgcgggcatccgccccggggacgaggtggagcgcgtcgacggcgcgcccaccgacggctgggacgatgcccgcgcggcgcggtcgctgcgcggcgctgggggtagcgccgtcagcgtcggcatcgcgcggcgcctggacaacggcggcgcgggctcgccggggccgcgtgacatcgtccccggcgtgcctgccgcccccgccggctccgccgcggcggcggccatggagcaccgcacgctgcgcctgcgacgcgagcggctggagctgtcccccgtctacgccgcagccatgcacggcgaagacgaccgcacctacggctacatccggctggcggccttctcccagcacgccgccgccgacatgctgcgtgcgctgggcacgctgggccgcgacggtgtggacgggtacatcctcgacctgcgcaacaacccgggcggcctggtgaacgccgccatggacgtggcggggctgtggctcgacccacgcgctcaccccgtggtgctgcgcatccaggacagggggacgggcggcgatctggtgggccgcgcgcgcgggggggctgccgccgcggagattgcctccgcgccgcaagtcagcgagaaggctgtggtgctggacggcgaccggggcccggcggtcagcgcccccctggtggtgctggttaatcgccagtcggcctccgcctccgagatcctggcctccgcgttgcaggacaacgggcgggccaccgtcatcggcggtgggtcgagagggggtggcgggcgtgcaaggttttgttggaggggagggggaggaccggtgtggggtcgtgttgacgtgcacctctgcatttgtgtgcccagggcggaggccttcgattgccccaagcagcccctgtccctgactcggagggttgggaagcgcctccagccacccctcctgtccccgttccgcaccctacaactcccccctaacatcaagtcaccccacccctcctccccctccaaacttgcagagcccacctttggcaagggcaagatccagagcgtgtatgagctgggggacggctccgccctctttgtcaccgtggcaaagtacaagacggcctccggcctggagattgatgggatgggcgtgatgccatcgcagacgtgcaggtggtgttcatgctggcggttgctgccaggatga

SEQ ID NO: 8747 - DNA, 2397 bp, Chlorella protothecoides
atgatggagggagaaacacctataacagtcgatggaggcaaacatgggttgtccgtctcgaagttatcgtcgatcatgtaccgagtcggggtcggcaggatgtcccgcctcatcccgagtctgccgctcccacagtatcttcctccatccggcttcagcgaacgcttgctaaacccttcaggacccatcaccgacaattggacagaatacaccatgaacgtcaacagaaccaactttcgcccgctcaactatcgggagataagaaaacaaaggaaatataaggatctggaaaggacctggaagaatttattgaggaataatgacaccgccggggttgtcgatggcttcctggccgaggtcgagcctctgctgaactccatccacctcgacaagccggtcagtaatctgctgtccaagaaccccgacagctccccggataacgaggactccataccgaaactgctgaactgggtggatcttattctggcaggtcaggtcgataaatgggcgtgccagcgagtggtgcatatccaggttgtgcctgtcacagcggaatctatgccaggaggtgccctgcttggaatcgcgcatgttggctacatatatgcgctagagcatgctggcatccgttttagcatgcccaaattcctctccagggccattggcgggacgtctgctggagcactggcggcggtgctactcgcagggcttcgccccactcctgacgcgccagcggggaggaggctgttagacctgctccttggtatgccggtccagaaattcaaggatgggaggatgctagaccgcacacttggggagtctatcctttccctcataagtgacctgccttcggcatggtggaggtggctactgcttccagctcttcctgtggcaatgatgaacatcagacccagctctaattcgggtcctcccccctcccgctgtcagatccgagtgtggaagcaaggaggcgtccacccgggcgacgccctcgaagagtgggtgcacgaacaacttgctgaacatggggccggcacgctcgcagagctgagggagaaatgcgacctgagtggtatacgctttgaaggcggagaccaggaagagattcagcgcagcggccggtttttgctacaggattatgacagctggcgctctcctgagggtctggtggtcactgtagctaccgatgtgacgtgtgggattaaggcggtgctgagctggaagagagacaagctgatgaccggagtacccatgacgcactctgagctctactggcccaacgcaggtgcgtctggcagtcaacccaagggttgtgtcatgggctgttacaggcagcgttcacgttctgcagaaggcaaatttgcttcacctgtatacccatgcagggcttcatctcagtccagtaaactcgtatccggcctgactctccacgcctgctccttcccaatcacagatgtggtaagccctgccaagtgcgtgcgcgctagcgtctccctgccggtatttttccggccgatgacggtgcccagtagtaaggacgagagggtgccttttgctggtgtgtgcgcagatgacctgttattcaccaagtggacggaaacaggatttacctccaccatccctgatcgggttcgttttcaagatggtggcgtgatatccaatttccccatcaacctcttccatctgccgtcacaccttgatgtgcgctggcccacctttggggttggactgtcccctcccaaggaggcacaatcgacttcaggccttggtcaactgctagttgcttctgtgaccacggccaccgccatccaagacgtggagttcaacacccagaacaaagagtgtgcgctgctgactcagactgtcaacactgggaaggtgtgcgcccttgattttaatatgtccatactgggcaaatttgtcctgttctacaatggcgttcttgctgctcgggacttcctcatgggaacaaaggagagagacggcttccattgggatacatacaaaatggtgagacatgatcttgcagagatcggcaaaaagcacaggctgaaggacccttggaccacccccctgggttcagtggccaaagtgcttgacgaggcagagaatccaacttcagatgattatgctggttttgttgcgctggtgaaaaggttatctgaagcccaagatctcaacctcgcccagcatgatagcacaacaagggcgcagcttcctgaaccacccatccttatccctgcttggatactgcacaggtccatatcatcccctgtctacccagcagcaacatgtttgcacctcgatgaaggcgccagtcccaatgtcggcattgcacacatcacaccatctcgctccttgctcatgggaaacatgccctggcaggcatggactgag

SEQ ID NO: 8748 - DNA, 3621 bp, Chlorella protothecoides
atgattcctggtgcgatcacggctcgttcattgcacaaagtccctgttgcgcatgccatacctccctccacacggcgcctggcgaggcgggtgatcccctccgcggcctccaactggacacccctagactgggaacaggtgaaggacgatcctgaatgggccgatctggagcgcaagtggcaggggtatgctgagagcaactccctcgacaagattgcgaaagatttccaggagaaggtggacccgatactggcggagatccagctctcggactacgtgagtgacctgcggtcaaagcccccgccctctcctgcttctggagctggtcctcatcccccgaccactcttcaatgggttgaccttgtgctggcagtcgctgctcgcccgccccaccctcctcaggaggcgcgctcctgggcattgcccatgtcggctatatctttgctcttgagagggctggcatccgattcaggtagcttcagggttggatgggtgtcagacataggtcctactcggtgtctggattgcctccacccgattctccatcgcagggctctggcggggacatccgctggggccatggcggcggtcttgctggccgggctacgtgaatccccagatgcagcggcgggtgaggccctcctgctcaagctcctggacctcccagtccccagcctcaaggatggggcccctgcagacaaagcgctgggggatgccctgatcgggctcctcactggcaccaagatctcctggtccacctggttccgcctccccctctttccttgggctctgtcaacactcgtgtttacctgcaatcacgcccagcgccgtcccatcaacaggccagcatctggaagaacggcggcatccatccagggaaggcgctgtatgactgggtggcaacggttgtcatgcttgcatgagggtagggcgggctgggcttccctcccacgtccaaagaaaagggagaactgcaggccttgtcatcctaccataattgctcgccaacatcaccctgtgagggctggggttcattcatgtgggtctgtttccagggtccctgccggcctcacgtcggcgagttcaaccccaccttctgcaggtgccggatgtcgagtctgtggcggaccgtcccttggagggcctagtcgtggccgtggcagccgatgtgacaaccgccaccaaggcggccctgagctgggagaggccattcaatccaactacccggcccctgacggtctcggagctttactggaccgacccagcgagagccccgcgacttgcgtgcgcgccagcgtctccatccccattttcttccagccctacaccgtccccgccgacccagcactgaagctgcctgatgcgggcgcgacagcaaacaccctcaccaacaacaagtggtcggaggtggggtttgatgccaccatccctgaccgggtgcaattccaggacggcggcctcctctcgtccttccccatcaacctattccacgttgcctctggccagcaggtccgctgccccacctttggggttgggctgtcagaaccacgccgggccgcgtccatcagtaacctcggcgagctgctggctgccgccacgtccacagcaataaacatccaggactacgaggcaagagcgtgtcttggagagcctggatcctcatcacatcctctgtcgaggcttcatgcctcaacacctcacaaggctcctctattgccgcaagcccccttccccccccttaaccctgtgcacacaggagtacaaactgctggcccagctggtgaatgttgccggcgtgcctgggctggatttcaacctgcccataattggaaagtacgtcctcttccacaacggcgttctggcggcacgggacttcctcatgggcggcccgggacgggtggctttcaactggaagcactacaaagagctcagggcggcactgtccaaagccaatcggacttgaccgtgcggatttgtgacgggtgccgagggcagctgcgcgactgcccgccgtgcagaatgcctgtggatgctctaaagtacaattgtgggatgccgtgtgtacatgcacagcccaccgttgttggatctgctccgagttactactgtatctggttgtcaatcgccagcgaatatatgtcggcctactctgctaccactgtgcaagtgatttgaggtgattcttcatatctcaaagatggcagatacaggccccgcccaaacggtgcatctgacccgatggagcagactggcttgcacggtagccgttgtgcttacacactgaggcccaaggaaatacgatttaatgacatggaagtgcattgcaatgtcactgttatctacatgatgcatgtgtcacccaaggaagctcttgtggctgaggagcagtctccagaaacaggcgcatttcctcggcgcatgcattgttaccacggggaaccacgactcaaagcgaattccaagtgtccttgtcaggctggcggctgtctcgttcatgacggcggcctcctctcgtgcttccccctcaatctgttccatgttgcctcaggccagcaggtgcgctgcccgacctttggggtggggctgtctgatccacgccgggccgcgtccatcggtaacctcggcgagttgctggctgccgccaccgccactgcaacaaacatccaggactacgagtttgtcagccagaacaaggtgagattggatgagcgggaggcagaggatcaggctggagtacaagctactggcgcagctggtgaatgtcgccggcgtgcctgggctggacttcaacctgcccatcatcggaaagtacgtcctcttccacaacggcgtgctggcggcgcgggacttcctgatggggggcccgggccgtgcgggtttcgactggaaatactacaaacagctcagggtggcactgtccaatgccaatcggacttgaccaatcagccatcacagcttgcgcctgtgcacaaccgtacagcagttggaacttctctgttcttagtgcctgaggatgctctaaagtataaatgtgggataccgtgtgtacatgcacaacccaccgttgttagatctgccccgtgttactgctgtatttggatgtccatcatcagcgaatatatgacagactactctgataccactgtgcaagtgattcggggtgattcttcatatctcaaggatggcagatacaggccccgcccaaacggtgcatctgacccgatggagcagactggcttgcacgctgatctgtccgtcaggtcacccaaggaagctcttgtggctggggagcagtctccagagataggcgcatgtcctcggcgcatgcattgttatcactgcgaaccacgacacaaagcgaatttcaagtgtcctcatcaggctggcggctgtctcgttcatataaaccagatgctcttcactccgtcattgggaacagtgcatgacgatagccaatggatgagaggtgacgacgcaataccgaatcaaatgcagagcaggaacctgctgttgaaaacgtgggctttagcatggctcgagatgtacgccgcgcgaagcgatgcagatatttatctgaggccttccatgccaagcagctgcagcaactcaagattggtgtga

SEQ ID NO: 8749 - DNA, 2031 bp, Chlorella protothecoides
atggcggggcagagtcctaccaccctccggaactccaacccttgggagaataatgcaaggttcaagccgctggagttcagtgtactcatgaagagtgctgagtgggaggaccggcaggagaaatgggagcgccttgcccggaacgacaaatgggatgaggtcaccaaagagttccgcaagctggtgcagcccgtcctcgacgaaatccgactgcgcaaacctgtgagcgatctccggtccctcaacagagatcccctgccaaagtcagctgggccaacttcagaaacaattaattgggtcgatctcgtcctctccgatacgacttcccccagctcccgacatccggctcaccagcaagggcgcgacgcatgggcagtggtacccactgcagatgacaaaatccagcaccctaacaccattgatagcctcagactcatactgactcgtatgcactactcacaggtggaggcgttttgggctatgctcacgtgggctatgtccttgcgctggaggatgcaggtctccggttcaggtatggggactgcgacaggcgtcagcataatggccattgggggtgcttctgccggagcggttgcagcctttatcatgggtgctgtgcgcaaaagtccagatgccccagtggcagaggacctgcttcgtctaatggtggagatgcccacctccacctttgacgacggcggtaaggcggagcggggcctgttgtccgccatcaccagcgtcctcgagaagaatatttcgacccttgatttcttcagcctccctctgtttccccttgcggtgtggcgtgcctcgtctcttttcccacaacagatcagtgctctgaagaacagcggcctgcatcccggcaagattttcgaggactggctgaagaacctcatggaaacatatggagctggcacactgagcgatctcaaggccaagtgtgacctcagcaagataaactggctcaaggccgaggatggaaggcagccgaaggatgtggagggcttggtctgctgtgtggcctccgacatcaccacctctaccaaggctgtgctgagctgggagaggcctgtgaattacgaccagcctcctatcacacacacggagctttacatggcaaaccctgatggagagaacccggggcactgcgtccgtgccagcatggccgtccccttcttcttctacccaaagaagttccccgcacagccgggggagaaaattccatatgccgggcagcgggccgccagcctgccgaacacaaagtggaaggagattgggtacgaggactacatcccagagcaggtgaagttttggagcatctgggaatgcgcggagcatcaagggcagtgtgcaggggagagtgtgtgggaacggtatggagcttttgcagtgccacccctcgcaagattcgggcaggtctgtgacctgcacttgcacgcatgtaggctcattgccaaggctcccacctgcccccctgccaatgccggtgagagcccatgcatcgtcctgttcctctcagcccagccctccatccctactgccctgcaagctatgtccaggacttcctcctcccctcccgccgcacaggtcacgctcgtggatggcggcttcctgtccaatcacccggttgacctgttccatgtcccacgcgagaaggtcgtgtggtgccccaccttctgcgtcaacctgtccccaccccgcactgctcgccgtactgggaatctcatcgagacaaccgcggcgctcctttccaccggcatccagacacgcgactttgacaagtgggcatgtgatccctcttcatgccgtccaccaacaaccactcggcaggagtacaagcttctcactgccagtgtgcacactggtggaatttcggccctcaactttgacgtcagccccgttgggaagtttgtgctgttttacaatggggtggtggcggcctacgacttccttgtcggaggggacggcagcaaaggaccgttcgactgggaggtgtacaaatccatgaggaacagcgcggcaaactga

SEQ ID NO: 8750 - DNA, 384 bp, Chlorella protothecoides
atgcaggttcggttccaggatggcgctgtcctctccggcttccccatcaacctctttcatgtgcctcccaccgagcccgtccgctgtcccacctttggggtagcgctgtcgccccccagggagaagaagaagacctccaacctgctggagctgctgggggccaccatcatgacggcgacgcacatccaggacatcgagttcattgcccagaacaaggtgcagctggaggggctggaaaggggggaatgggattggagccgcatggctgtgttgtgttcgcacgacggtttgccctctgaattgtcgctgctacggtcaggaatttcctgctccgacgagtctgtaaaatggtacttcacccacagtgtagcgacacccgaatag

SEQ ID NO: 8751 - DNA, 1674 bp, Chlorella protothecoides
atgtttgtgctcaagaaggcggtggcagacgaggaccacctgatcaccttcacgctgcccatctcggagccgctgcccccccagtacttcatccgcgtggtctcggatcgctggctgggttgcgagtccagcctacccgtctccttccgccgcctcatcctgccggccaagtacccgccccccaccgagctgctggacctggcgcccctgccggtgacggccctgcgcgacgccgccgcccaggctgcgctctacccgcgcctcaccgccttcaacccagtgcagacgcagtgcttcgccgcgctgcactccagcgacgacaacgtcctggtcgccgccccggctggctccggcaagacgctgtgcgcggagctggccatcctgcgcatggccgccgtggccgccggcggcggcgacgccgcgccgccggcacgctgcgtctacgtcgcgccgcgggaggacctggtggccgcgcgcctggccgactgggcgccgcgcttcggcgcgctgggcctcagcgtggcgcgcctggtcggcgacggccccgccgacgccaagaccctggagcgcagcaacgtcgtgctggccacgcccgagcactgggacgcgctgtcgcggcgctggcgccagcgccgcgccgtgcaggccgtgtccctgtacgtattcgacgagctgcacctggtgggcggcaccggcgggcccgtgctggaggtggtcgcctcgcgcgcgcggtacgtgggcagcgtcgcgccgcgcgcgccgcgcatcgtggcgctggccgcctcgctggccaacgccggcgacgtcggcgactggctgggcgtgcgccccgcctgcctcttcaactttcccccctccgtcaggccggtcccgctggaggtgcacgtccagggcttcgaagtggccgacctggaggcgcgcatggcggccatggcgcggcccgcctacggcgcgatcgccgcgcatgcgcccggcgccgcgccggccatcgtgtttgtgcccacgcggcgccacgcgcgccgcgtggcgctggacctgctcgcctttgccgccgccgacggccggcccgccgccttcctgcacgccgaccgcgccacgctggcgccgtacctggagcgggtcaaggacgccgctctgcgccacgcgctggagcacggcgtcgcctttgtgcacgaggctcaggccgaggacgaacgcgccgtggcgcagaccctgtttgactccggcgccgtgcaggtgggtttgagtttgttggggggggtgagaaggagggggtgttggagggtgggatggggaggtttagtgagcctgaaaacagcttatcaggagtttttggattgttatcttaaccttgttccggaaagcagggctggggaaagactgtcgcaggtccattcacccacacgcccgcactctattctattccctcaccccccacccccccaccacacacacacgcacgcacacaccaatcgatcacatcaacctctgcagatcctggtggccacggcggcgacggcctggggcctgacctccgtggcgcggctggtggtcatccagggcacgcaggcgtatgatgcctcgggccagggcgcccgcgactatgccgtcaccgacctgctccagatgctgggcagggccagccgcccaggcatcgacgcctccggcatgtga

SEQ ID NO: 8752 - DNA, 804 bp, Chlorella protothecoides
atgcaaggtcgctggctcgggtgggcgtgcgcttcggcgtcccgtcgcacttccgtgcgccgatgtggtacggcctgggtccccacgagtgctaccccgaccgcatggcctcggggaggctggcagcgtggcgcgaggacgacatcaggaaactgcacacgccctacatcttcccgagccgcactggctcgcgctcctcgtgacgcatgcaccctccgccctcgcccaggcgagagtgggggccgcgcggatgtgcgctggatggtgctggtcaacgatgccaaggccggcctcttggccttcagccctgcggagaggacgcccctgcagatgagcgtgagcccctacggcctggagagcttcgagaaggcacggcacgaccatgagctggaggtgcgcctgccgggcatgctctgcgtggggctagaaaggggcacggcggcggtgctgggccaagctccaggaaaggggcacagcggcggtgctgggtcaagctccagggttgaagacacaggcgccaaggcagtgatgcccactaggcctggtaagaaaagggacagaggtctgatagcgtgctggagcgccaacctctgcgacccacgcccacgcctgcccacaggcctctggcttcacgcatgtgcacctggatgccgtgcacatgggccttggaggggacgacagctggagcccgtcgggtgggtttgcggtgttgggagggccagagctggacggggtgttgtgctggacactatcgtggacgtggacacggcatgggcggacgagggtgctcaaacccgattctga

SEQ ID NO: 8753 - DNA, 2445 bp, Chlorella protothecoides
  modified_base (2023)..(2032): a, c, t, g, unknown or other
  modified_base (2368)..(2377): a, c, t, g, unknown or other
atgactcggataagaaagcgtgccgtgcggcgtgaaccacgaaaatccgtacacaccgcagggaacagccaggtctctgcctccgggtccgcggccgctctcggtcccggaagcaaggtttcttccgccatcgacctgtccaacaacgtgaaggacaagtatgccaacggtgccaccactgcgacagctgagggttcaacggcgctggttcaatctgctggaggatcctttgtcaatgacaaccgccaggccgtgaatgtcatttcatccgccaaggtgatttgtgaacagcatgccggtggggatggggcatgtggctccaggtgcccttcagcattcaggcccctgatcccatgccggtggggatggggggcatgtggctccaggtgccctttagtattcacgcccctgatccgtgccgagcgcttccatggatgccacagcgagcacaatgaaacctggccagccaccccgactccctcatattttccactccatgctccccacaggcactggacgccaccctcctggagactacctccacttacaactcgagccagccgccgaggtctcccaccaaagcccgcaaggcgctcctcctctgaacaaacccctccccagacaacatccccggattttattcacaacagtcaccaatgcgtctcaaccccggggccctcccgttcctcacgccagccccaccccgcgcccctcaccttcctgctggcgcttcacatcgggaacggccctccctcctctttgtctgcagcacccaagcctcactcaccgggacgcctggtccccctgaggggacccccaccaccctgcatgcgcaggtcctcttcactcctcctccctgaagtggatgcaagctgccgggccattgtgtccctgttctgtgtcactcttgagtataggtactatgcgatggtcgctttgtatttgctctgttccctgaaagttttagcacagctgcgaggctgcctgctcctttgtccttaccacaccttgttcttgacactgcgtatgattttgctggacaaaccctacacaccatttgggcatcaggcttctgcactttacgtagcacacccctttgttgtccgctctgagttgggctcgatgccgcctccgagcgtggtgccggtcgctcgggactgggagacccctggagtcttcggtatcaacaagcgcgaagcccatgtcaagttacggtcctacgccgccccagctgaggctctgcgagcttacactcttcgggacggcaaggagaccagcaccaggcttcaggctttgaatggaagcgactgggccttccagctgtatgcaaagcccgaggatgtgcccagggaggtgctcatgggaatggctaccccatcccagggatgggcacaggtgagatcggagccaatcagctgtgctgccccctgttgggccttgtgggggaaagggtatgccatttgtgatagctgtgagctcatttcggagatgacctcagttcgtcggtcaggagccaggcgtgaccaccatgcacaccgccgcgctgtgcctcatgggagaatccctttgtccctcttcaactcacagatcgccgtgcccgggagttgggagctgcagggccatgggtcgcctcagtatctcaacttcgactaccccttccccatcaacccgccgttcgtgccagagaccaatcccacgggcgtgtaccgccgcgaattcccgagcgtccagccccagggcggcacgcgctccttcctggtagtggaaagcgcggactctgcagtgtacgtctggctcaacggccggtgcatcggctacagccaggacagccgcctgcccgcggagtttgaggtctcttgcgccctgctgccgcccgggggcggcaccaacgtcctggtgctgcaggcaggctggctgtgtcgttggtctgagagactctggggggtgttggagccggcagagggcgtctcatggccggcgggtatgcggaaggggggtgtgcagtggtacatgtgtgttcgcnnnnnnnnnnggtctgagagactctggggggtgttggagctggcagagggcgtctcatggccgatgggtatgaggaaaaggggtgtgcagtggtacatgtgcgttcgtgggggctggcgcccaccgtcccgaacccggtgcgctagcgcaggtgatgaagtggagcgacgggagctacttggaggaccaagacatgtggagactgccgggcctgcacaggtaccggcacgcgagaggcgccagacgtttccatgtgatgtcggccctgcatgcagctgcatccctgcaccgaaagacggtcaccgtctcctcaccatggatgaacagcgtcgggcgtcaggaatcnnnnnnnnnngatgtcggccctgcatgcagctgcatccctccaccgaaagacggttaccgtctcctcgccatggatga

SEQ ID NO: 8754 - DNA, 1332 bp, Chlorella protothecoides
  modified_base (325)..(334): a, c, t, g, unknown or other
  modified_base (1103)..(1112): a, c, t, g, unknown or other
atggtgagggatcccgggatacccctcgtactaagggacaccttcagggaaatagtcaagcaaggacgtggaccagagttcgcaaccttccgagactcaaattatgtttcggagtggatcagcgtatcacaggccttcttgagtccgccgtgggtaacacccgtcggactattccgagggcccatacttgggtgggagtcctgcgcgggaaataagcacgttaggggaccgccagcgccccggctgctcgcagaccacgggcgacattcaccgcgtcgggatgcccgacggggtctttcggccgttaaggcattgagcagccctnnnnnnnnnnagtatagggaccgccagcgccccggctgcttgcagaccacgggcgacatccaccgcgtcgggatgcccgacggggcccttcggccagccgcttcgcccggtggaagaccgcaaaccatgtattaccacagaaggtgcgtcggtttgaaatgggggctgagtgcggcaccccctccacggagcacacaagagtccgagacagagccgccgacacacttctccgctccactcccacgcaaccacctcaccgcgacagtctgggacttcgagctgcgtcccctggccacctcggctgcgcttgccagcctggccgtggccgccctgccaggcatggccccgcccctcccccgcaacccgttctcccacattcccctcccccgtctcgccccccgccgccgcgcccgcccccggcgcggcctgccgcgagctgcgcgcggcgcggcgcagttcctggcgggcggtctggcgggtgcggtcaccaagaccttggtggccccgcttgagcgcgtgtcctgcatgctcatggccccggccgcgggtgccgcgcccggcgcactggccgcgctgcgcgccgcctgggctgagggcggcctgcccgccatgtaccgcggccacgccgccacgctggccaagatcgcgcccgcctccgccgtgcagttcgccgtctaccatggtctgcgcgacacgctggctgcgcgacgcggcgcgggaccggggcctgcggcggcgcgggagggcggcctcaccacccccgagcgactggcggcggnnnnnnnnnnggcgggggcggcggggggcgccgccgcgaccctcgtcacatacccgctggaagccacgcgcacggtgagagcgcctgccactgtgcgtgaggcttttggtccaggttcaggggcagggcggcccacttgccggacctgcgaccttaccttcaggcccaatgttgagacactgtgtggctgtcgttcttggcacccttctcgtcgtgtgagggggtcatga

SEQ ID NO: 8755 - DNA, 1176 bp, Chlorella protothecoides
atggactccgaggaggcggagtacatagacatggatttcgggtgcctgggtggcatcgacccgagaagcgcaggcccagacgacatcgtcaatgtggagacctacctgaccaagcccactctgtgggccgaagcgggccacacgctgcagcacgaccagatccccctctccgactgggccaagccctatgcagcctggctggcaacaaaggcccccaagccgccgcaggccgcggcgcccaaggccaaggtgccccctccagtcaagagcgaggagggggaggagggcgaggagggcgaggaggcgcgcgccggccccaccttccgcgtctgccccgacaccggcgccctggtctcgttctgcgacccggtcctgggcgagctgctggccgccccggtcgtgccgtgcctgtaccgcgcgcccacggacaacgaccgcggcgggtccggcggcaccagccacgcggcgcggtggcggctggcggggctggaccgcctgcgccccgagcccggctctgtggtcgtggcggccgacgaggctgacgcctcgcacgtgcgcgtcacattcgtcctggtgccgcgccctgcccaggcgggggaggaggaagaaggcgtgatcgtggagggggtcggcgtcggagaggtgcgcggcgggggttgtcgcgggggaggtacaggggaggtacagggaacgtgtggcaagttggatcggggcgtgaggcggcacatgcgggatcagcgcccgggggtcggcgtcggggaggtgcgcggcgggagttgttgcgggggaggtacaggggaggtgcatgggacgtgtggcaagttggatcggggcttgaggcggcacatgcgggttcagcgcctggccggcagcctcttctacgctgacatatggggatcttcttgtgcatgctgctacgatcctgcagcgtcagagccaagaccgccacctcctcgcacagactggcggcacgcactggctctccgaagcgagcaaggaggccgcgggccccctccccacccagccgccaggcgctgcgcgcatcccggtgacggtggagtaccggctggacgccgccaggcgccagctcagcatggcctgggaggtggacgccacgtcggcgctcccgggggtgcccgatgggaaacggtgggtggcgctgggtgtgttgtgtga

SEQ ID NO: 8756 - DNA, 696 bp, Chlorella protothecoides
atggacgccatgatcctgcacggagcgggccggcccgcgcagctctggtccgccgaccgcccgcacctctacctcctgaccctgttgctggtggacgccaggggcagcgcactggagcacgaggcgtgccaggtcggcttccgtacgacttccgtgaggaacaagaagctggtgcacaatggctggcccatcctgatccgaggtcggtgtgggcacgttgagccgagagagccgtggtccgatgcgcatgccggagaaggggtgcccagaggcctgtgtgaatccccagaggctgacgcgcgaggaccgggcgtactcgctgcagctgcattcgtgtcgagaggccacgccacccctcacacgacccccgcaacgcctcccaactccgcccctcccccgtaccccatctgcacaggcgtgaaccggcacgagcacaacgaccgcaccggccggaccgtgagctttgcgtccatgctggaggacgcgcggctgatgaagcgcttgaacttcaacgccgtgcgctgctcccactaccccaacgaggacgcctggtacgaggtctgcgcgctcattggtctctacgtcgtggacgaggccaacgtggagacgcacggcttcgacgccacgctgtccaagccggagctcaaccccaccgccgcgcccgcctggctcgccgcagtcgtgggtgagcggtag

SEQ ID NO: 8757 - DNA, 1383 bp, Chlorella protothecoides
atgtgccacacgccgcgcaaggagtactacaagaagttcctgttcgagccgctgcccgtggactcccacctggacgccgtcctgcacgacaccctggcggcggaggtggtgacccgcacggtgaccaacaagcaggacgcggtggactacctgacctggacgctatactaccggcgcctgggcgccaaccccaattactacggcatgaccgggtccagccaccgccacatcagcgaccacctgtcggacctggtggagcgcgtgctggccgacctggaggcctcgcgcgtgatcgccatcgaggacgacatggacctggagccgctgaacctgggcatgatcgcggcgcactactacgtggcctacaccaccatcgagctgatggcggccagcctgggggccaagaccaagctggcggggctggtggaggtgctggcggccgcctccgagtacgacgacgtgctggtccgccccggggaggagcgcgcgatcgagcggctgctggcacacgcgcccctggcgctggccgcgccgcggtacaccgacccacacacaaaggtggatgcgctgctgcaggcccacgtctcgcgtgcggtgctgggcgccgacctggccgccgacgccgcggccgctgtggccgcggcgccgcgcctgctccaggccatggtggacgtgctgtcctcctccggctggctggcccccgccctggcggccatggaactgggccagatgctgacgcaggcgcgctgggcgcgcgactcgcccctgctccagctcccgcacttcacgccggagctggtggaggccgcaaaggcggccggcgtggagggcgtgttcgacctcatggagatggaggacgcggagcgccgcgcgctgctcaagctggaggagccgcagctggcagaggtggcgcgctggtgcaaccgctacccggacgtcgccgtgtcctacgagttggcggagcctgacgcagtccgagcgggagaatccgcgagcctggtggtgtccttggagcgagagggcgagggcgaagtgaccccggtcatcgcaccactgtatgtggatgggttggtgaagggaggggtggtatcgagggtggcctgctcgcttcgcgctgggggtgggcgggggctgctgctgttttggtgcgtggaagaggcatggtggctggtcgtcggcgacacctcttccaacagcctgctggccatcaagcgtgtcgccctccaggtgcccagagagaggggttggtggagtttggagtgccccgggctgggcctgaggcaatctccaagacgccgcatgacccgccgcctccaagcataccttggccagcccacaccggccctgcttctcatcgctgcccatccctctcgagccgcatag

SEQ ID NO: 8758 - DNA, 483 bp, Chlorella protothecoides
atggcagccactgataagcccgtggagaagttccgcaaggactacaagccgagcccctacctcatctccactgtccatcttgactttcaactgaacgaggaaagcaccctcgtccagtccaagctgcgaattgtgccaaaccatgctgagtccagtccggtctccctcttcctgaatggccatgctgatgttgtgctcgagagcatcaaggtcaacggggctgatctggaggcttcgcactatgctgctgatgcacagggcctgaccatcaagtctggacttccttcgggtagggccatgtctgctgggcagtgtcagcagtgcagcagttcctcttatagtttccatccagcttgggtcccgcggctcgcccccttgcagtgtgaggcggagggtttccggcacatcacctactttctggatcgcccggacgtcatggccaagtgcgttgtgggggatgagtctgcctttggagatggctga

SEQ ID NO: 8759 - DNA, 282 bp, Chlorella protothecoides
atgacccgccgcctccaaacgtaccttgtccagaccacaccggccctggttctcatcgctgcccatccctctcgagccacagagacacgcaagtcgcgggtgaagctggaattcgtcgcgccggccaaggcgggcccggcctcgctcaccctcttcttcatgtgcgactcgtacctgggctgcgaccaggagtttggcctggactttgaggtgctgcctggcgacgaggaggcagaggatgccggggaggagaccgccgtccccatggatgacgacaagtga

SEQ ID NO: 8760 - DNA, 888 bp, Chlorella protothecoides
atggagagtcgagcggggcatccccaggagggtgagcgctgcttcgcgccacctgcgtccctcccccctctgacgctccaaacacccctatctctcccaccaccgcctcacccgacccagatccactacgagggcggaggcagtcgcacccccgccaccgacgtcatctgccccatgtatgcccgcgtgcaccaggcggaggagctggccgggaatgccgacgacccccgccccgtcatcctctgcgagtacgcccacgccatgggcaacagctccggcaacgtggccgagtactggcgcgcctttgacggcgtggagggcgtggagggcgggttcgtgtgggactgggccgaccaggccctgctcaaggctggcaccaagggcggcgccgagctgcagtactgggcgtatgggggggactttggggagacccaccacgatgcacaggcaagctggcgctggctggtcccccgctggtggcctgcagacactctcccaacgtcccggcgcccaatcccctgggtggggccgctcggcgctgcctaccccacctcacccctccccccgcgctgctccccaccccacccccagttctgtctgaacggcatcgtgtggccggaccgagaaccccacccctgcgcctgggagttcaagttcctgcagcggccccttcgcatcacggcctgcccggccacctccaagcacatggcggtcgaggtggcgagtaccacgccctttgggtacacgtgcgagacagccatgaaggtgaccctgcagagagcaggtgagcctgcgctgacgaggactgggggctggggtgctgcagcagacggcgcgagcccccggcctgagcgggcgcaggccggtgacgtgctcaccctctcttga

SEQ ID NO: 8761 - DNA, 1497 bp, Chlorella protothecoides
atgcccccccctttccccctttcctcccccccacccaggcacttcactgtgtgggaggatccgtttgtgaagccctgctacctcttcgccctggtggccggagacctggcagtgcaggaggacaccttccgcaccatgagtgggaaggacgtcgcactccgcatctacacagacgtgagtggaagatgcaggggccatgcccctgtgccccctgaggagcgtgcaaggggtcggtcctgggtcgcagctcccgagccttgctccagatcgcctcagcaagcctatctctcacaccccccccttttccaccctcggcaggcacacaacaccagcaaggtggcctttgccatgcagtccctcaagcgcgccatgaagtgggacgaggagacttttgggctggagtacgacctggacctgttcaacatcgtggcggtggacgacttcaacatgggtgccatggagaacaagagcctgaacctgttcaactcgcgcctggtgctggccacgcccgacaccgccaccgacgcggactttgggcgcatcgagggcgtggtcgggcacgagtacttccacaactggacggggaaccgcgtgacctgccgcgactggttccagctgacgctgaaggaggggctcaccgtgtaccgcgaccaggagttctccgccgacctgaactcgcgcggcgtcaagcgcgtggaggacgtggcccgcctgcgcgcggcgcagttccccgaggacgcaggcccgctggcgcacgccatccgccccgactcggtgatcaagatggacaacttctacaccgccaccgtgtacgagaagggcgcggaggtggtgcgcctgtacgaggcgctgctgggccgcgccggcttccgcgcggggctggacctctactttgcgcgccacgacggcggcgcggtgacctgcgacgacttccgcgccgccatggccgacgccaacggcgccgacctggggggcctggagggctggtacgcgcgcgccggcacgccgcgcgtggaggtcggggtcgagcacgacgcgggggccgggacgctgacggtgaccgcgacgcaggcgccgcccgtgctgacggccaagggagggcggggtgacggcggcaggggaggcgacgctcaggcaggtgaggagggcgactccccgccgccgctcctcatccccatccgcctggggctgctgggcgccgacggcgcggcgctgcccctgcacctgcgctccgggcccggccccgaccccgccggcggctccgaggcggtgctgcgcctggagcaccagcgtgagacctgggtgtttgagcgcgtcccggcgcgccccgtgcccagcgtcctgcgcggcttctccgcgccggtgcgcctgacggtgcgcgggcagagccgcgaggagctgctcttcctcctcgcccacgacgccgacgccttcaaccgctgggaggcggcgcagcgcctcggcaccgccctggtgctggagcggtacggcaccgcc

SEQ ID NO: 8762 - DNA, 1896 bp, Chlorella protothecoides
  modified_base (1501)..(1510): a, c, t, g, unknown or other
atggccaccctcttcttcctcatggcctttgtcaacaccgtgatggacacgctgaaggacacattggtcatcaccgcggtcggcggggggacacaggtcatccccttcatcacaggtgggtggcgacgcggggcgtggtcgaggctgaggtggggctccgagcggtcagcacgagtcgccatggccctgggcccccggcctgcatggcatgcgcactgcatcagcaccctgcgagcagccagccccacggtttctccccacccaaacccttcccagtctatggcgtgctgccggcctcctttgccttcctcctcgccttttcgtggggcacccagcgactggcgcgccgccacctgttcaacatcaccatctcctgcttcctctgcttcctgggcgggtgggtacgagccagttttctgggatcctgggagctcacagcggttatgggctcgccgccgccgccctggtgctgcctggaccccgccctcgcatgacgccccccccccgcctcagctgcctacccctgcgcctgctcagatccagatgcctctctgtctcgcacgcatgcacggctccaccgcctccgctcctccgccgctccgccccccgccacacacacacaccaccgccccccgcaaacccctcccgcctcccaggtttgcgctgttctacccggtccacgaatccctgcacctcggcccgctggccgcctggctcggcccccggctcccgctggggctggcgggcggcgtgggcatgctgcgcaactggatgttcaccctcttctactgcgcctcggagctgtggggcgacgtctgcctcagcctgctcttctggggcctggccaacgagactacctccatggccgaagcccccgtcctatacccgctgttcggcatcggggccaacatcgcgcagacgctggcggggcgcacgatgcgcctggccttctccggcgcggcgcgcgcgcgtgccggctacgcggcccggctgcaggccatgctggggctgtgctgcggcctgtgcctggccatcatggcgctgcagagctggatcgcggcgcggttcagggccagccacgcgccgccgccgccggcgggggcgcgcgctgtcgccaccttcgaagaccccgccccgggcgactcgtcctcggacgaggagggcggcgcgggggcagggggcggctcgccggcggccatgtcgctgggccaggcctggcacttcctgcgccagtcgccgcagatccggtgcctggccctcttggccatcagccaggtgtgtgtattcgagggaggggggaaaagggggggcggggaccgcgcgagagagtgggcagggcactcccctcggcacgccatctccgcctcatgccctgatcgtggggcctggatctgccatgcccactcctacaaaccccacacccatcagtcctcccacgcatgtccagcctccgaagccccttccctcgtcccccaccctcgtcccaccctccttcccacgnnnnnnnnnncgtggggcctggatctgccatgcccactcccacaaaccccacccatcagtcctcccacgtatgtccagcctccgacgccccttttctcgtcccccaccctcatcccaccccccttcccacccgtcccagggcatcacctcgaacctcctggacctggcatggaagcaccacctgcaccgcctggccaccactcccgcggcctactctgccatcctgggagacaccgccatgtggaccggcatcgtgacggggtcgctcatgctcctgtcgcccaccctcttcgcgcgcctgggctgggagggcgtggccaagaccacgcctcgcctcatgctctacgccggcattcccttcttcctgggctgcatcggttacaacttctggctgtc

SEQ ID NO: 8763 - DNA, 1284 bp, Chlorella protothecoides
atgtccaaggccgtgaaggctgctgccacacgaatccgtgtagtcatcaatgccggccaagccaagccagccccccctgtgggtccggccctcggccaggcaggcctgaagatcatggacttttgcaaggactttaatgcgaagaccgccgacatcaaggtgctgggggtcctgcatcggcttgcacgcctggctcttgacctgcagtggcgcttgtctggcatccagcatggtctcaggatgcatgcagtggcacccaacatgctgcggattctccgccatcacgccatgcagcctgacgtccctattcccgtcgtcatcttcccgactcccgacaagaagttcacatacgtgagtgatctgcagggcgcggcgctcgggcagccgcccccctgcgtgcatgcgggtgccccccttggcccttgccaagcttgttgggattcgacccagggatgtccaacccctccaccatccgatgcaggtcatgaagacgccgccagcctcctacttcatcaagaaggcagctggattggagtcggggagccagaagcccgggcacgatgtggcaggcacgatctcgctgaagcacatctacgagatcgcactggcaaagcaggccgatgtgccgcacatccctctcaagtctgtctgcaagtccctggtcggcacctgcagggccatgggcgtggccgtcgtggcgaggccagaggaggcatgagggctggagggcaccctcctggccaggtggggcctgtggatcgtgctggagctttccagacccctccccggatatccaagctggcacccgcaagagagctcctgggtggtcccaccagggccgctggctgggacacgggccccggtgctcactcccttcccctgcctgaatgcataccccttgtgcgcccatgcctgtcgccctgttggcaagctttccttgcacagtcctcagcagcagcagcaggcaccgtgcatggtcccgggggcatgggtgggcaggcacgagcgtgtacagggcacggcccggaggatgttcatcaggcccggcgaggccgagcaggaggggaggctgccaccggagaccccattcagaaggccccggcgttggcctggggcagctcgcgccacctccagatcttcacctgcccccgctcgtcgccggagagcagcaggttcccggcgctgtacccggtcatggcgcgcacgttcttgaccccggacaggaccccccgcccctcgaaggagggcagctcccagagccgaatgacgggctcgccgttgtag

SEQ ID NO: 8764 - DNA, 618 bp, Chlorella protothecoides
atggcccctcacgacgaggtggtcgagggccacgccgagggggaaatcgtcccccacaatccactggccggcacaatgatcagtatagcaataacagacccgataactatcaaggtacgagcggtgctgccctgcggcactgtgcgcttgcgtgatgctgggcaccttgctcactgttcctgcaattcatcggttccaagcacaggcggaacgagtgggagacagaacgacacatactacaactctggataccaagatcagtaccaccaaggctggcagaacgggagagggcggggccgaggctacttcggaggccgaggctcgcagaaccccggctaccagcagcagcaaggctacagcagcaaccgggggggcaggggccgggggcgcggtcggagtcagcctggccagtcccagcctgcccctgagcccctcccagacgacgtggagttcctggccgagctgaaggggcacacaggcaaggtcacagtggtggccatggatcaaggatcgggccaactcttcacaggcagccacgatgggaccgttcgggtctggagttgtgcttcaggggaggtgcgtgtttgcagtggtcaggggtggacagtgagtggatga

SEQ ID NO: 8765 - DNA, 342 bp, Chlorella protothecoides
ggggcggccggcggcggcgacaacagcaagggccccgcctcgccggggacgaccggcaccggccctgcgccgccgtcggtcaccctgctcctgcgtccctttgcggaggagcagggctcggtgttgctgggctcgcccggcgcgcgcgcggtgctggcggccgccgacgtcgccgccttcgtcttcgacgccacctcgcgcgaaagcttttcggccgctgtggcgcgcatgctggcggtggccagcgctgccgacgactgcctgccctgcgtgctcatcgccgcgcaggacaccgtcatggacccggtgagcttggtggggaggaagggggagggtccctga

SEQ ID NO: 8766 - DNA, 3351 bp, Chlorella protothecoides
  modified_base (131)..(140): a, c, t, g, unknown or other
  modified_base (654)..(663): a, c, t, g, unknown or other
  modified_base (1479)..(1488): a, c, t, g, unknown or other
  modified_base (2014)..(2023): a, c, t, g, unknown or other
  modified_base (2858)..(2867): a, c, t, g, unknown or other
atgagaggctcagggcctctggcctgcctgtggtggctgcttgaaacggcgctggcttcccaaagtacccatcgccatgataccagaaccctgctctcaccctttgccactcccggcccccaaccccccgnnnnnnnnnngctggcttcccaaagtacccatcgccatgacaccagaacactgctctcaccctttgtcactcccggcccccaaccccccacctccctactcacagggtctggagaacctgatgcaggagctatcggtgcggttcaccaatcgcaccgacgagcggctgctggcggtggtgcatgcgctgggccagcgcacgtacaagacggggctgccgccctccgcccccatccccgaaaccttcaagaaggagctggtcaatgtgtgccgggcctgctcggcgcgcgacggcgccgggccgtcacgcagcaaccagtaccaccagcagtttgccaaggacgtggacccggccagcccctcctcgccccagaccctgggcgcactgacggagcgcctcaagggctggagggtcatgctcgaggcagtgatcgaggacacctaccccacccacctcaagctggagaacgaggcgcccctgtcgacgtcattctcgctccagaccctcaccatccgccccactcnnnnnnnnnngtcacttcgcccctggtagtcgacgtcatttccgctccagaccctcgccatcagccccacttacctctacccactcatcagctgctggacctggcgctggacgacgtggagatgcccgggcaggcccctgccagcctggacagccccgagcccgtcttcatcgagcgggtggcgagcacgctggaggtggtccgtcgcaactgcaactccttccgccgcctgacgctgtacggatcggacggccagccgcgccacttcctcatccaggcccagcagcaacgtgaggagggggggggtgggggggggtggaagcgcgaaggaaaaggatcgaggcaacggcggggctgtgtttctctggtggtgcgctgcagggtagctggctgggggcggggccgaggccgcgattgtgaggcgcctgtcgcccgaatgatggccccagcgagtcgcgccggcgcagcctgcagttctccaccccggccatcctgcccatctggctgggagtgcgcatcgtggaggacgatcccacctccctctccttcctggacgtgtacgaaaaccactgcgcccggtaggcatgcgtctctgggcttggggagggcttttgagaggagtggaggggggtcgtggaacggggaggggagccgatgcgcggcgcgccttgaatcaagaaaagggaaggaggggcggcgccgcaccggacgccctcagcagcccctggacaatcagtatcgcatcccctttgtcccgctctcccgtcctttccttcccagcgtgaccccgccacccatttcaatatacactcgatcacctcattgnnnnnnnnnncgccctcagcagcccctggacaatcagtattgcatcccttttatcccgctctcccgccctttccttcccatcgtgaccccctcacccatttcagtatgcactcgatcgcctcatcaccctgcacaggtacggccgggagccggacgacccgatcgtggccttcaaggcgcggtgctgctcagcggagggcatcaccaccaacctggaggtgcggctgtcggcctacgaggaggtggcctccaaggtggtgacggaaaacatcctgagccagcacatgcacaagaccatgatcgaccccaagatgacctggatcgtgaagaagcagtttgcgcagtccgccgccatgtcagcatctggccagccgtccatcggggcaccagctctcccaaccctaaacaaagtcctcactgcgtgtgccccctcccttctccccacagccgtgcaatgctatatgctgctgctgacggggcgctcccctgggcgggtgctggtgtccaagtcaacgggacgcatcagccagatggannnnnnnnnntgtcgccctgccagcatctggccagccggatccaactacgacgtgcacttccagctggagaaggggcacgagacggtgcccttccgcctgacgcgcaacatggtggccttcatgggagtgcacgggctggagggcctgttcgtggcggccgccgccgccgcggcgcagggcctgcaggccccgcactcgccgctggcctccctgctggccctcttcctccgcgacgacatcctggcctgggcggcccggcgctccggctcgcgctccgtggcggcgctcagctccagctttggccccgcccaaatccagacctgcgtggccatgaacgtgaaggcggcgaccgagcgcgtggcggcggtggggcccgccagcagcgtgctggcggccgccaacccgcagaccggcatgcgcaagctggtggacgcggcgaccaacccgcagaacctgtgccgcatggagcccacctggcagccctggttctagtgcttgttgatgtggcagcacccatgtcccctctttattgtttgacgaggatgcctgggattgatggcaatgcacccctgcggaagaaaacgaagggcgtcggggtgttggggctacatcgagtggcccgctcctccgaaggcacatgggccctcccatgttgtcaaagggggagctgtgcctcacagattgggaagacgcatggcagtgtgctccagagaaaagggttcctgcacgtcagggggagaggtcctcttccccactcaaacagccatgacggcgagctgcgaggtcccgcatcaggcagcggccctggcctccggcacggcgcgcgcctcggccgccctgccannnnnnnnnngctccagagaaaagggttcctgcacgtcagtgggagagtccctcttcccgactcaaacagccacgacggcgagctgcaaggtcccgcgtcaggcagccgccctgggctccggcacggcgcgcgcctcggccgccttgccggagcccagcagcggcaggccgtggtaggcccgccacgcggcgtaccccgccaacgtggccacgaggcccgcgccgccagcccaggcggcgcggcgcagcgcacggcgctgccgccgccgggcctgcagcgagggcgtgtcggggatggtgagctccgcgcccagcgccgcgcccgccagcgcctggtacatgccccggcccgggaaggtgccggagtaggggatgggcggggccacgcccagccggctgcacgattcccccacctccgccgccagggtctgcgcgggggaggttggatgaaatggagattgctgctgccagggatggagagcgaggaacgatga

SEQ ID NO: 8767 - DNA, 243 bp, Chlorella protothecoides
atgtaccaggcgctggcgggcgcggcgctgggcgcggagctcaccatccccgacacgccctcgctgcaggcccggcggcggcagcgccgtgcgctgcgccgcgccgcctgggctggcggcgcgggcctcgtggccacgttggcggggtacgccgcgtggcgggcctaccacggcctgccgctgctgggctccggcaaggcggccgaggcgcgcgccgtgccggagcccagggcggctgcctga

SEQ ID NO: 8768 - DNA, 444 bp, Chlorella protothecoides
atgaggctcatcctacttcagcggtcgcaaccttccacctcctgttgccgccccctggaccccctccctgcccctgcctgctccctgcagcttgacgttgtggctggcctgtccgtgggtgccatggtcatcccccagggcatgtcctacgccaacctggccggcctgccctctgtctacggcctgtacggcgcctttgtgccctgcctggtgtactccctcctcggatcctcccgccagctggtgaggggcttgggttctgcgatgagtgggcctgccctgtgcattgaggggggagtgtggtgcagggctgtgccgtgggcggcaagctacctgcttgtgcacccacccacccacccaccctccctccccacggtcgtggtcatctcaagggcaaccacgcgctcgcaaacaaccccccaccccccccactctaccccttga

SEQ ID NO: 8769 - DNA, 3111 bp, Chlorella protothecoides
  modified_base (1317)..(1326): a, c, t, g, unknown or other
  modified_base (1811)..(1820): a, c, t, g, unknown or other
  modified_base (2249)..(2258): a, c, t, g, unknown or other
  modified_base (2545)..(2554): a, c, t, g, unknown or other
  modified_base (3026)..(3035): a, c, t, g, unknown or other
atgagcgcggggttgcgggcgagccagcgaggtcggcctgccctgcgccctggtttgacgatccaatgctccccttcggagatcccacccccccaccccccaaatgaacccctccacaaccgccaggccgacaaggcgcgggtgaaggactacatccaccgcctggacaactttgacggccccgcagtgggcgagatcgcagtgggctacgagctgttcgaggaggcgttcgagatctacaagaagtttggcctgcgcgcccaggccatccacgtgctgctggaccacctggaagacctggaccgcgcgcacgagtatgcgaccaaggtggacgaggcgggcgtctggaccgagctggccgacgcctacctggcccacgcccgcgtgtcggacgccatcgcggcctacctccgcgccggcgacaccagcaagcacgtggaggtggtggccaaggcgcacgagagcggcgactacgcggagctgaccaagtacctgctcatggtgcgcaagcgggtcaaggaccccaaggtggacacggagatcgtgcactcctacgcgcgcgccggcgacctgcccgcgctggaggccttcgtggccgccccccacctcgccgacctccgcgcggtgggcgaccgctgcgcggaggagggcctgcacgacgccgcacgcctggtcttcgccaccatccccgactacggccgcctggccagcaccctggtcaagctgcaccgctaccaggcggcggtggacgcggcgcgcaaggccaacagcccacgcacgtggaaggaggtgtgctatgcctgcgtggaggagggcgagttcaagctggcccagctgtgcggcctgaacatcatcgtcgccgccgacgacctggccgaggtggccgagttctacacgcagcgcggccacgccgacgagctcatcgcgctgctggagtcgggcatcggcctggagcgcgcgcacatgggcatcttcaccgagctgggcgcgctgtacgcgcgccaccgcccggaacgcctcatggagcacctcaagctgtttgcgccgcgctgcaacgtccccgccctcatccgcgtctgcgaggagctggagctctggcgcgagctcaccttcctctacgtcgcctacgacgagtacgacaacgcgctgggggtcatggtggggcacgcggccgctgcctgggagcacgtccagttcaaggacgtggcggtgaaggtgaaggcggccgagaccctgatggggatcaaaggaattggtgggcatgcggccagggccgctcccatgcccggcgaggcagcgtcctggcactccgtcctnnnnnnnnnnggatggggatcaaaggaattggtgggcatgtggccagggccgctcccatgtccggcaaggcagcgtcctggcactccatccctttccccttccattggtaactggcaatcccaccattctcgtacgacacctggccccgtccctcgcaaactttcgcacgccctggtcccttcccccttcccctcccctctaaacccggcgcctgcccaactcgcaggtggtggagtcgcgggtggaccactcgcgcgtggtggacatcatgcgccgcgccgggcagttgcccctggtcaaggagtacctggtgtcggtgcagaagaacgacctgcaggcggtgaacgaggcggtgaacgagctgcttcggcacgaggacaccgagttccggcgcctggccgcgctcatctacaagcgcaacctcaagtggcacaaggcggtggctctggccaagaccgacaagctgtacgaggtcagcgctggtgttgggtttnnnnnnnnnngcgcaacctcaagtggcacaaggcggtggccctggccaagaccgacaagctctacgagcagacaggcactcctgacggtggccaggggctgcctcgctcatcaccaccaccctcgatctcctcacccgtgccacccgcaaacacaccgaacgaacaggacgccatggagacggcggcccagtccggggagcgcggcatcgccgaggacctcctgcgcttcttcgtggaggagggcgcgcacgaccgcttcgccgagtgcctggaccgctgccgcgacctggtcaagcccgacgtggccctggaggttgcctggcgcaacggcctcaccgacgccgtcatgccctacctcatctccgtgctccgcgactacaccaccaaggtggacaccctggtccacgagcgcaaggaggctcagggctgtccagaccnnnnnnnnnnctacaccaccaaggtggacaccctggtccatgagcgcaaggaggctcaggtgcagggggtgggggaaggggggactgggaggtggttgatggggttggagcgtcggtgtgattggaggggagaggcggcgaatatcgaggcagggcagtctagactggaatgccgcaagaggacaggctgggacccagagtgtacgatatgggagggggccacacccaaggcaaagcacaggtcacgccctcacccagtccaactcacaaccaccccctcccacacacaggaggcgnnnnnnnnnnttgggccggggatcgctggaacattccttcaggttcaccataggccacagccaaggcaaaccacaggtcacaccctcacccaagccaactcccaaccaccccctcccacacacaggaggccagcaagctggacgaggaggccaagaagcagcaggagcaggcggccaacgcctacctgcacctcaactcctacctggcgctgcccgcacccacatccaacggcgcgccctcccccccggcctttggcgacgcggcggggtttgaccgcttctgagcgcacgtgtggcgtggctcccgctgccaccctgactggggccggacctgcctgcctaaacgtgtgtgcatgcgatgcccatttagaatgcgaggagtcacggtctgcgttacttcacgggagggcagctgggggaatgtgggcgggcggccgggtagggggtccaggtgaaaattctgcagcaccaggtgcccatgnnnnnnnnnntttagaatgcgaggagtcacggtctgcgttgattcacagggagcagctgggggaatgtgggcggggggccgggtag

SEQ ID NO: 8770 - DNA, 618 bp, Chlorella protothecoides
atgctgcgaccggggctgcacaccagtccgtgcgcccgcaccttgcgcctcgtatcggtgaagtgcaccagatcgcgtgggcgagctcccacgctgatcaggggcagccaaacgggagcaggtgagattcctgtgtggggcctcatggacatggtgccggtgtgcaccttgcatggcgttgttcggcctccggcatgcgccatgtccgactggcagcttgcccaccccgcaaccctggaccccagcagcagccaagcccatgcacaagccccctttccagcagactggcgcgcccggctctcgccagaccccgccgccggtgcctgggtggccctgggcaagtttgacgcgctgcatcggggccatgcggccctggccgcctgggcggctgccaggccgggcgtcccctggctcatctccttctctggcatggcggccgtgctgggctggagggagcggctgccgctggtggcgcctggcgaccgggcccgcatcctgtccgcctggggcaaggagttcggggtgacgccgcgtgagctgcgcataccctttgccgaggtgcgcgatgcgatgcagacctggagctgccggggaatgcagggggcgcagggatcttag

SEQ ID NO: 8771 - DNA, 1875 bp, Chlorella protothecoides
atgttcgccgcctctcccctccgatcacaccgaccctccaaccccatcaaccacctcccagttccccccacccccccgcacctgagcctccttgcgctcgtggaccagggtgtccaccttggtggtgtagtcgcggagcacggagatgaggtagggcatgacggcgtcggtgaggccgttgcgccaggcaacctccagggccacgtcgggcttgaccaggtcgcggcagcggtccaggcactcggcgaagcggtcgtgcgcgccctcctccacgaagaagcgcaggaggtcctcggcgatgccgcgctccccggactgggccgccgtctccatggcgtcctgttcagccaccgccttgtgccacttgaggttgcgcttgtagatgagcgcggccaggcgccggaactcggtgtcctcgtgccgctccagccgccccgccagcgccagcgcgtcgtagttctcataggaggtgatgctgtcgcgcaggcccgcggcgtcgccctcgcccacaagcagctcgttcaccgcctcgttcaccgcctgcaggtcgttcttctgcaccgacaccaggtactccttgaccaggggcaactgcccggcgcggcgcatgatgtccaccacgcgcgagtggtccacccgcgactccaccacctgcgagttgggcaggcgccgggtttagaggggaggggaagggggaagggaccagggcgtgcgaaagtttgcgagggacggggccagggtctcggccgccttcaccttcaccgccacgtccttgaactggacgtgctcccaggcagcggccgcgtgccccaccatgacccccagcgcgttgtcgtactcgtcgtaggcgacgtagaggaaggtgagctcgcgccagagctccagctcctcgcagacgcggatgagggcggggacgttgcagcgcggcgcaaacagcttgaggtgctccatgaggcgttccgggcggtggcgcgcgtacagcgcgcccagctcggtgaagatgcccatgtgcgcgcgctccaggccgatgcccgactccagcagcgcgatgagctcgtcggcgtggccgcgctgcgtgtagaactcggccacctcggccaggtcgtcggcggcgacgatgatgttcaggccgcacagctgggccagcttgaactcgccctcctccacgcaggcatagcacacctccttccacgtgcgtgggctgttggccttgcgcgccgcgtccaccgccgcctggtagcggtgcagcttgaccagggtgctggccaggcggccgtagtcggggatggtggcgaagaccaggcgtgcggcgtcgtgcaggccctcctccgcgcagcggtcgcccaccgcgcggaggtcggcgaggtggggggcggccacgaaggcctccagcgcgggcaggtcgccggcgcgcgcgtaggagtgcacgatctccgtgtccaccttggggtccttgacccgcttgcgcaccatgagcaggtacttggtcagctccgcgtagtcgccgctctcgtgcgccttggccaccacctccacgtgcttgctggtgtcgccggcgcggaggtaggccgcgatggcgtccgacacgcgggcgtgggccaggtaggcgtcggccagctcggtccagacgcccgcctcgtccaccttggtcgcatactcgtgcgcgcggtccaggtcttccaggtggtccagcagcacgtggatggcctgggcgcgcaggccaaacttcttgtagatctcgaacgcctcctcgaacagctcgtagcccactgcgatctcgcccactgcggggccgtcaaagttgtccaggcggtggatgtagtccttcacccgcgccttgtcggcctggcggttgtggaggggttcatttggggg

SEQ ID NO: 8772 - DNA, 1719 bp, Chlorella protothecoides
atgcccttcctccctcctttcctcccccaggctgtcgggcccgtggccgtgacgtccaccctgctgggcaacgggctggagaagatatttggcagcctgtccaccgaccctaacaaccccgaggacccggcgctgcaggccaacatcaactccgcggccatcgaggtggccttcctggcgggggtaatgtacaccggcatcgcactgctgaacctgggctggatcatccgcttcctgtcccactccgtcatctcgggcttcatgtctggcgccgccatcaccatcgccctgggccaggtcaagtacatcctgggcctgaagcttgggcgggggtccacgatccagtccctgctggacatgatcttctccaacctgtcgggcttcaagtggcgcgagttcgtcatgggctacttcttcatcggcctgctctacacattccgctgggcgggcaaccgctttgcgcacaagcgcctcggcttcctccgcttcctgggccccatcaccgtggtcgtcacctccatcgcggtcatgaacatctttgggctgtacaagaaccccaccaccgcctctccctacatcaagcccatcggcaagatccccaagggcctgccgcccttcagcgccaaccactggctgccgctgtacgacgtcagccgccaggtcaccctggccatcatcatctgcctggtggacgtctgcgagtccatctccatcgcaaaggccctggcccagcgcaacaagtaccgcctgaactacacgcaggagctgcgcgcggtgggcgtggccaacctgtttggagccatgttctcctgctacaccaccacgggctccttctcccgctccgcggtgaacaactctgcgggcgccaagaccccctttgcccagttcgtttgctccatgctcctcatgctcacgctcctagtgctcacccccatcttcaccaacatgtcggccaacgtccaggtgggtggtggaactcccaggccacttcatcccactacccttcatttaccatccccccctacccctaccccaacaaacaaccttcagggcgccatcatcatcgtgggtgtgctgggcctttttgattactccgagttcctgtatctgtacaaggtgaacaagctggactggatcgtctggctcatcaccttcttcgtcgtcctcttcgccggcgtggagatcggcatcggcgtgggtgtgggcgtgtccttggtgctggtcatctggcgcgccgccttccccgccatcgtgaagctgggcaagctgcccgactccgcggtctaccgcaacgtcaagctcttccccgacacccagcagaccccaggcgtgctggtcatgcgcgtcgacgcgcccttcttcttcgccaacgtggagtccatccgcgacggcatcgtgcggcgcgtggaggaggcccaggccacgcccgaggccgagtccggtgccgcgcccgtgcgctacgtagtgctggacatgggcgcggtgaccgacgtggacgccacctccatccactggctcacagagttcgtgtacgacctcaagtccgatctgggggtgcagctggtgctgagcaacctcacccgccccgtcctgcgcgccatcaagaacggcaacgtgcaccggcgcctggggcccgaccacatctttgtggacaccaacgatgcggtggtcaccctgtccaccgggctcaagcagggcagggtcgacaaggccctctga

SEQ ID NO: 8773 - DNA, 1518 bp, Chlorella protothecoides
atgggcactgccccccttggccgacgtgcgaggcctcccccctctccccgcaggatccccggggagtacctgctggggtgcaagaagtacgtcggcaacgacctggcggacacccccctcatcgccttcatcaacggccggtcaggggggcagatgggcacccagctgctcaccgtgctctcccgcagcctcggccagtcccaagtggtgaggggaaggggattgggatggtggtggtgcttcagtgaaagaggagtggcacccggatgctgtcttccggactcgatgtgcagctctggccacggtgtacgtgggctgtgcatgtggcaaccccatggacccccgcgctctccaccacccccgccgcagtttgatctgtcggaggacaggcccgagcccgtgctgcgcactctgtggtccaacctgctggagagggaggccaagggcgacaagctggccgcgcacatccgcaggtggtgccctggcctggccttgggcgagggtttctgcgcccggcgcatgcaggctcacgaatgccccctggggcctgctggcgagtgcggggggaagcccgccaggccccagggctgctcgtcgccgtccccttgccgcccggcgcccgcactcggcggcattgcggcgcccgcgaatctgcgcgtcttgtgtgcggggggcgatggcacggtcacctggatcctgaagaccatcttcgacctgggcctggagcccgcgccggccgtggcggtgctgccgctgggcacgggcaacgacctggccctcagcttcggctggggcaatgctttcctcaaaaagtggatcgccgcggaccagctgtaccacacgctgcagcgctacgcggaggcccagccccgtgcgctggacgcctggcgcatcacgctggccggccccacgcccggcctcttcgaacacctgccccactcgctcagcctcgcaggggcgggcagtgaggggggcggtggtggtggggccccagcgtccgccggtgccgtgggcggcggggcaaccgagggccccgacaccccccccggggccacccgtgtcacgggcatgttctggaactacttcagcgtgggcctggacgcggaggccgcctacggattccacgctctgcgcgagtcccggccatgggccgcacagacccgggtgatgaaccaggcctggtacggctggtacagctgcaccagcggttggttctgcgccgcgccgccgctgcgcaacagcgtgcgcctgcgcgggcgaggcgggcctgggggcccggcctggcgcgacatcccgctgcccgcctcggtgcgggccatcgtggtgctcaacctgcagtcctacggcggcgggcgggacatctggggcctgtcggacggcggcgggctgaggcaggggaagcgggtggtgcccatcttcagcgacgggctcgtggaggtgcggggggaggtcagggggggtgccagcggccgaggagggggcggcgtaagcaggggcctgggacgcaggccggcctga

SEQ ID NO: 8774 - DNA, 381 bp, Chlorella protothecoides
atggccaacctggaggtggacctgtccaagatccagccgggccagaccatcacggtgaagtggcgcggcaagcccgtcttcatccggcgccggaccgaggacgatatcgccaaggccaacgcggtggagctgtccaacctgcgggaccccgagcccgactcggtgcgcgtgaagaacccggagtggctcatcgtcatcggcgtgtgcacccacctgggctgcgtcccgctgcccaacgccggcgactaccagggctggttctgcccctgccacggctcccactacgacacctcgggccgcatccggaaggggcccgccccgtacaacctggaggtccccacctactccttcatggacgatgacaaggtcgtggtcgggtag

SEQ ID NO: 8775 - DNA, 465 bp, Chlorella protothecoides
atgagtcaagttactgaacaatccgtacgtttccagaccgctttggcctctattaagctcattcaggcttctgccgttttggatttaaccgaagatgatttcgattttctgacgagtaacaaagtttggattgctactgaccgctctcgtgctcgtcgctgcgttgaggcttgcgtttatggtacgctggactttgtaggataccctcgctttcctgctcctgttgagtttattgctgccgtcattgcttattatgttcatcccgtcaacattcaaacggcctgtctcatcatggaaggcgctgaatttacggaaaacattattaatggcgtcgagcgtccggttaaagccgctgaattgttcgcgtttaccttgcgtgtacgcgcaggaaacactgacgttcttactgacgcagaagaaaacccgttgcgaggtactaaaggcaagcgtaaaggcgctcgtctt

SEQ ID NO: 8776 - DNA, 855 bp, Chlorella protothecoides
atggttcttgctgccgagggtcgcaaggctaatgattcacacgccgactgctatcagtatttttgtgtgcctgagtatggtacagctaatggccgtcttcatttccatgcggtgcactttatgcggacacttcctacaggtagcgttgaccctaattttggtcgtcgggtacgcaatcgccgccagttaaatagcttgcaaaatacgtggccttatggttacagtatgcccatcgcagttcgctacacgcaggacgctttttcacgttctggttggttgtggcctgttgatgctaaaggtgagccgcttaaagctaccagttatatggctgttggtttctatgtggctaaatacgttaacaaaaagtcagatatggaccttgctgctaaaggtctaggagctaaagaatggaacaactcactaaaaaccaagctgtcgctacttcccaagaagctgttcagaatcagaatgagccgcaacttcgggatgaaaatgctcacaatgacaaatctgtccacggagtgcttaatccaacttaccaagctgggttacgacgcgacgccgttcaaccagatattgaagcagaacgcaaaaagagagatgagattgaggctgggaaaagttactgtagccgacgttttggcggcgcaacctgtgacgacaaatctgctcaaatttatgcgcgcttcgataaaaatgattggcgtatccaacctgcagagttttatcgcttccatgacgcagaagttaacactttcggatatttctgatgagtcgaaaaattatcttgataaagcaggaattactactgcttgtttacgaattaaatcgaagtggactgctggcggaaaatga

SEQ ID NO: 8777 - DNA, 1494 bp, Chlorella protothecoides
  modified_base (1080)..(1089): a, c, t, g, unknown or other
ggcgccgcggcgggccccgcagccgacggggcgctggcggtgacggcggtggccacgcgcacgcgcgacgcggccctgctcgccctcctgcccaccgacgtcatcacgcgcgtcccgctgtcgcgctgggacgtggacgcgccgacgcacgcgagcctgcccgcccgcttcggcggcttcctggatggcatcgacgcctttgacgccgggctgttcggcctgcaggccaacgagtgcgacctgatggacccccagcagcgcatgctgctggagagcgcgtgggaggtgctacgcctgtcccccgcccgcaccgcccgcgtggcggtggcggtgggcatcgcctccgccgagtacaacaacaccctggtcccggcctggaccacgggggtcagcgcctacagcgccaccggcggcgcgcccagcgtcgcctcgggccgcctgtctttcacctttgggttcaaggggcccgccgtaagcgtggacaccgcctgctcctcctccctggtcgccacccacctggcggcgggggccgtctggggcggcagcgccgggggcgggctggcggcgggcgtgggcgtgctgctctcgccctcgcccaccgccatgttccagaaggcgggcatgctcgcgcccgacggccgctgcaagtccctggacgccgcgggaggtgaggctggtggggtaatgtgtgcttgctgtcgatgtgttcaatggtttgataatcgccggggccaactgttggaaagacaatcaccttggccccaagggcaaatgatgtgcatgacagcccgaatcgagtcgctcccacccacccaacgacacctccaaacctcactcgcctgcagatgggtacacgcgtggcgaggccatgggtgtgctcaacctgcagtgggcagccgagggcggcgacgaccgcactgccccgctgacagtgctgacggtgatcagggggagcgcggtgaaccaggatggacggtcctcgagcctgacggctcccaatggcccggcgcagcaggacgtgatccgcgccgccctggcctttgcgggctgcccgccgacagctctggcttccctgcagcnnnnnnnnnncgccgccctggcctttgcgggctgcccgccagcagctcttgcttccctgcagctgcacggtaccggcacgcccctgggcgaccccatcgagatgggggcggccagcgcgctgggcctgggcgccgcgaccccggtgcacgtcaccaccgccaaggcctgggtggggcacaccgaggccgccgcaggggtggcgggcctggcgcacgccaccctggcggtcagccacgcgctgacccagggcatcgtgcacttgaccacagtgaacccccacatcgccacgctgctggacgtggccgcggccaagcgggccgacgccaggggcgggggctggctgctgccgcgcgccgcggcgggcgcgcccctgcgcggcctggtcggcgtcagcggcttcgccttccagggcac

SEQ ID NO: 8778 - DNA, 219 bp, Chlorella protothecoides
atgattggtgtgtggaacgtgggcaggagctatgaccctgctcatccagcgcctgtgccgccccacaactcaaccctacccaccccacggcgccctgcagacaaggcccagatccgcatgggaaggatggcccgcaagggcgagggagacaggcacatccccgacctcaaacccaagcatctattttctgggaagaggccacggggctccaccgacagg

SEQ ID NO: 8779 - DNA, 723 bp, Chlorella protothecoides
atgcccaggatccgggacggcacagcacggccccccatcatcccagccagcgtcctggcgaagaagggcctgccccccgccgcgccgcgccccacagagcgagacctgcaggaggcccagggcggcgcaggcgtgtacaacgccgacctgcgcaagcagtacgacctcaaggacgaggcctggcggtacgacatcatgcctgagatcgccgacgggcacaacgtgctggacttcgtggaccctgacatcgacgcacggctggaggcgctggagcgcgaggaggcggccgcggcggctgagtttgaggccctggacacagggctggccgacgaccacctgagccaggcggagtgggaggacctgcaccgcatccgggaccgcaagaagcgcatcgtggccgacaaccggcgcaagcgcgcggcggcggacaacacgccgcgcatcccacgcacgctcgacgcgccgcgcagccgcaccgctgagcgcatgaaggcggagctgggcgcgctggggctggacgccgccgccgccgccgccgccgcgccgcggagcaggtcgcgtgggagatcgctggtgcgcaagcgcgagcgcgcggagggagagggcatggaggtcgacggtgcggagggcggcgaggtcaagcgcctgcacagcagcaagtccaggtgggcagaaggcgcatgggtgtgctgtatttggaagagggtggggggtgcctcctga

SEQ ID NO: 8780 - DNA, 540 bp, Chlorella protothecoides
  modified_base (494)..(503): a, c, t, g, unknown or other
gtcaagccggagccgagcgcggcgcgggacgcccccgcgcctgccccggccgctgcgcgtggcgccgcggtttcctctgcgcaggcccgcacccggccggccacccggcacggtggggcgcagcccacaacgcgcatgcgcgacggcttcagcagcgaagaggaggaggaggaagaggtgaaggtggagagcgatgcggaggaggaggagggtggggagcgtgcgggccccgccgcggggccgagtcggaagcggggtgccgcctccgcccccgcgcccgccagggcggccaagccgctgcgcatccccaagctgcccatggtactgcagggcagggggtcctggtaccgtgcgcgggtggtcaaggacgccggggaccgcgttctcctgggtgagggcccgggggggggagtttctgggggggtggagcaactcgggctcggatggaaagtggttgtggatcgtgatgggaggagggagcgcggtgcggcctnnnnnnnnnnagtttctggggggatggagcaactcgagctcggatag

SEQ ID NO: 8781 - DNA, 252 bp, Chlorella protothecoides
atgcctcacctccccttcccccctcccaacatcccagagttcaccggcttcgaggaccagttccccgccctgtggctggcgcgcgccacggaccgcatctggcgcggctcctaccgcggcaaggattggaagtacctgggcgggggcgcctgggagcccaagaaggccgccggcgccggggcgcggcacgccaggaaggcggcggccgggcccggcgcccacgcggacgcagccgcgtcgggcgagggcccg

SEQ ID NO: 8782 - DNA, 510 bp, Chlorella protothecoides
  modified_base (410)..(419): a, c, t, g, unknown or other
atgcgcctggccttcccctccgccctggacggggcggccgccacgccgggccccggctggatggcctcgcccgggtcggggccggcccgggacgctggagtccacgtgccgcgtgaccccggggaggccgagctggccttcgacgccgggacctacccgctgggcatctgcctggcggacgtgtcggtggtgggcgtggcgcagcacagcgccttccccacggcgaccgtgcgggtcggcgctggcggggcaacggaggacggcggcgcggagggtggcggcgcggccgccacgaccccggccccgtctgccccgccgccctgcttccagcccctgccagggagccagccggcgctgcactgcctgctacaccgccagctggcaggcggccgcggtgagcgcgcgctggnnnnnnnnnngtgggcgtggcgcagcacagcgccttccccgcggcgaccgcgcgggtcggcgccggcggggcgacggaggacggcggcgcggagggtggcg

SEQ ID NO: 8783 - DNA, 972 bp, Chlorella protothecoides
atgttgcgagatgtcgccagactcgtcatacagaaatcatcggtgacagaacccgcagatcgccttgccccaccgctgcatggctatgcactcttccaacctcacctcccacgcaggagggccgttccacagcctcttcgggccacctccccggcgatgacacccgccatcggcacccaagaccttgagcccttcgtcgccctggcaaaccgccttgccgacagcgcgggcgccgtctcaagccgctacttccgcaccccggtggctgtggacgtgaaggccgacgcctcccccgtcaccatcgcggaccgggaggcagagggcgccatgcgggacctcctctccacacacgcccccacgcacggcgtgtttggcgaggagtttggccatgcctccggctccgacccggactggacgtgggtgctggaccccatcgacggcaccaagtccttcatcaccggccggcccctctttggcaccctgattgccctgacacacaggggagtacctgtgctgggggtgctggaccagcccatcctgagggagaggtgggtgggggtgctgggggcggagacgtccctcaatggcctccccatccacacccggccatgcgccagcgtgggggatgcctacctctttgcgaccacgccacatatgttctcaggtccaaacgctgaggcctttgctcgagtgagagatgccagccgcatcccccagtacggctgtgactgctatgcgtatggcctggtggcgcgagggttggccgatgtggtggtggaggccgacctgaagccgtatgattttctggccctggtgcccatcctcgagggggcgggcggcgtcatgaccgactggatgggggaggcgctgcggctagacccggaaaccatcacagaagcacacgaggtggtggctgccggggatgccaggacccatgcgcaagccctggaactcctggactggaggcgctga

SEQ ID NO: 8784 - DNA, 525 bp, Chlorella protothecoides
atgccacgtcccccctccctccaggacatcgccgttttcaagaccggcgctttcgggaaggtgctggtgctggacggcgccatccagtgcaccgagcgcgatgagttctcctaccaggagatgatcgcccacctccccctctgcgctcttgcagtgagcaactttagcctgggatggcaggggcaggttgatgggcactgtccgccccgaggccatcggccaatgatgtgctgctctggcatacacacgcccagtaaaacccctaggagcacgctcacgctgactctgagctgccccccccccccctcctcgcagcgcccagccaagaaggtgctggtcgtgggtggcggcgacggcggggtcctgcgcgagctcagccggcactcctccctggaggccattcacatggccgagatcgacgggtgcgcgtcatttggttctccagggacgcatgcttgcaatagcggtgcattaaagatacctcctggcctgtctgtcgagtgggagggtcaagtcggcggttga

SEQ ID NO: 8785 - DNA, 1275 bp, Chlorella protothecoides
  modified_base (320)..(329): a, c, t, g, unknown or other
  modified_base (715)..(724): a, c, t, g, unknown or other
  modified_base (1067)..(1076): a, c, t, g, unknown or other
atgccattcatgctgtcgtggccagacccaagagttctgtgtgatgccagcgcacgctccattccacgccttcctttcctgcgtgcagcggcgttgtcgaggctgccaagatccacttcccgggcatggccatcggcttctctgaccctcgtgtctccttgcacatttgcgacggtatcaagtttgtccaggtgcgtgctgggcggtgtgtcaaggggcgccaaggattccacagagctagtaggggggtttgggggtgaggacctggaccctgcccgggtctatccgggcacaaccaagccaaggccgggcgtgattgnnnnnnnnnnttgctgggcggctctcctgacatgcccctatgccgcctccccccccccccctccttcccaggatgcggaggagaacacctacgatgccatcatcgtggactcctccgacccagtgggccccgccgaggtgctgttccagcaggtgcgatcacaggagggcgggcgcgcatgtccgcgccaccccgccgcaggccggaatgcgagcctgcgtcccgggattctgtgcgcgttgctcgtggggcaggttatattgatggggtctgccttgcgagcccggcacaatccagcatacatgcccttcgccccctcgctcccccccattgccccggagacacccttccaagcctcccgccccaacaccctcccagcccttcttcgaggccatnnnnnnnnnntgctccccccaattgcctcggagacccccttccaaacctcccgccctaacaccctcccagcccttcttcgaggccatgcaccgcgcactcaagcccggcggcgtggtctgcacccagggcgagtccctgtggtaccacctggacatcatcaagggcctggccgccatgtgccacaccgtgttcgtgggcgggacggtgcagtacgccttcaccaccatccccacctacccctccggccagatcggcttcatgatctgctccaaggccgaccccgaggcccaggcccagctggatccccgcacgccgaagcgaagcgtggacggcgccgacagcgccgccctgnnnnnnnnnnacccaggcccagctggacccccgcacgcccaagcggagcgtggacggcgccgacagcgccgccctggggccgctcaagtactacagcccggaggtgcactccgcggcctttgtgctgcccgcctttgccaagcgcgagctgcaggcctccctatccttttgaaagatcggagggaggcgggtttgccatgtgcaagtag

SEQ ID NO: 8786 - DNA, 384 bp, Chlorella protothecoides
atgctgatggcagaccccgacccggcgcggcgcgcgatgtgggcgccccgcctcttctgcctcgagtcgtacagccagcacggcatcaacgcgctgatgatggccggcgaaatcgcgctgggctgcctcccgcccgacctctgggcggcgggcggccagggcgcctgggccggcgtctacggagtctgggccgccgtcttcttcctgcgccacggccgccccatctaccccttcatggatgtgaagcggccgcatgcctgggtcggcttcctggccatgtttttactggcgtgggccgggtttggcctggtccagggcggcctggccctgcggatgcgggccgagcgcaggagcgtcgctctcgccgccagaaaggtggagtga

SEQ ID NO: 8787 - DNA, 246 bp, Chlorella protothecoides
atgtctcgaacaggcttcgcccatccccccgcccccgggaccttccttccacaggtgaccagccagttcgtccagcagttctacactgtattgcaccagtctccgaagcagctgcatcgcttctatgccgactccagcatcttttctgtggcaaatgtggccggggatggcctggtccacaccgccgtcgggcagcggtggtccgaggacgaggcaggcgcctctgtgggaaaggacgcctcgtaa

SEQ ID NO: 8788 - DNA, 1140 bp, Chlorella protothecoides
atggtgggtccttcgacagcggcatcaaccatatgttactccctggagattcatggatgtctcgcaacctcgacatttccccatgcagacgcgcggaggaggggtgattcggaggacgacagtgccagcagcagtgccagcagcggttctgaaagggacagcggcggcgaggaggaggctgaggtgatacgtgccaagggccaggcggcagcggtgccgccaccttccgcagagcgcgaggaggaggacgaggaggaggaggaagggtcgagtgaaggcgaggacgaaaacgaagaggacgacgagagtgaagaggacgacgaggacgaaaatgaagaggacgaggagagtgaagaggacgacgagggcggcggcgacagtgatgcggaggccctgtctggcgatgtggagctcgactccccactggacatagaaacgattccgctgaccacccgactggaggacctctccgagagcgattttgacgaggaggacttcgaggccatggagcgcctggcggcgcagctgcgcgcctggctgtcggacgccccggcccccgacccggctcggcctcttaagtgcacgctgtgccgcggcgcgctcatgctcaagcctgtgaccctgcgccagcacgtggccagcaagcgccacatgcgccgcctggcagctgagcgcgccagggaaagggcggagcgcggcggcgccgacgccggcagcagcagcagcgaggaggacgaggacgccgcggcgctggcggtggccgagggcatctgcttcgcggaggactacgtcagcgacagcgagaagatcgagacagcggaggagggcgcggcgcggctggccgctgcgctgcgggcggcggcggagggtagggccagggtggaggccaagaaggcgcggaaggccaagcaggtgccgcagccggggaatcgggcggcgcgccgcgcggccgcaggcctgggtgctgctgcggcggcgggcaagggcgaccaagggagccaggcgggcagtgaagcagccgccccggtgcaggcggtggcttcatcagaaggcaaaaagcgggagaagaaggagcggaagcggccaggcaaacggcagcgacaggcgctcaagccggccccggagtctgacagcgaatga

SEQ ID NO: 8789 - DNA, 417 bp, Chlorella protothecoides
atgacgacgatcaagaacctgagctccacgggcatctacgcctacaccaccctcatctccgtcttcatctgcgtccccggcatcttcttctttgagcgcggcgtgtggtccgccatccgcacccaggtcgcgctcaagggcgcgggccagttctacggcgccctactctccgtcggcctgttgtaccacctgtacaaccagtttgccttcaacaccctgtcccgcatcagccccgtctcccacggcgtctgcaacgtggtcaagcgtgtcgtcatcatcgccacctcggtgctcttcttcggcaacaagctgacgctgcagaccaaggtgggcaccggcatcgcgctgctgggcacctacgcctacaccgaggccgtgaagcggtacaaggccactcccacccccaagctggcctag

SEQ ID NO: 8790 - DNA, 330 bp, Chlorella protothecoides
atggccgagctcatccggccctccctctactccgcctaccagcacatcgagctgaccgccccacaccacacccccaaggccgtctacgacgtggtgggtccggtgtgcgagagcgccgacttcctgggaaaggaccgcgagctggctacgcccgcggcgggggacgggcttgcggtgctggacgcgggggcctactgcatggccatggcctccacctacaacctgaagatgcggccggcggagtactgggtggaggggggggacaccctgaagatgatcaggaggggggagaccctggaggaccacctgaagctgttcgagggcctctga

SEQ ID NO: 8791 - protein, 433 aa, Chlorella protothecoides
MGPIPDSLPVTPFPHRKILQEQHAAPIINKYWEKAEFPHELRSKFGELGIGGAHIKSHGCQGLTTMGAAAAIVELGRVDGSLSTFFLVHSYLGVMTLGLLGSEAQKAELLPGLSNFSKVAAWALTEPSNGSDASALTTTARKVPGGWILDGRKRWIGNGRGICDDPLLDAHTSAVPFWCRPLKHLPKPPSPPRPPFPHTATFADVVIVWARSSETGQVNAFIVRKGNPGFRATKIEHKISLRCVQNADIHLTGAFVPDADRLPGVESFADAAGMLAMSRCMVAWQPVGLVTGVYDMVLRYTSQRRQFGAPLASFQLVQERLARMQATIQAMYLMCHRLSQLYDAGRMSHEQASLVKAWTTARAREVVALGRECLGGNGIVADFLVAKAFVDAEAYYTYEGTYDVNVLVAARGQTGYAAFKTAGRANKAPPPTH

SEQ ID NO: 8792 - protein, 189 aa, Chlorella protothecoides
MLAGNAHLAYEASRLLLRLFSPAAARSGLPAWQAGGCAASLLGPGPLPDGLLGAAGSGPDDPPLGAEDSGEEVAAARAAKAVVFISDSRCDALVAPLAAGEAASPLLVLGLVEAVAAVVCEPGSRSTEQATLTAMLQAGGADREREETCAGEAKAAGLQGNGKWDVPGVATPSLSQDARNPCDCPSRTG

SEQ ID NO: 8793 - protein, 334 aa, Chlorella protothecoides
MADQATPEGSLIALIADQDTATGLLLTGIGHVDYRAVDASRGLQIPPTPPSLHRNTTREDRGCLPSPSLPCQNDYNLISLTSMSSLLHGVVAGTIRHLLNNYTKPIPAVLEIPSKDTPYDPSQDSVLSRYALPRLGLGAGRFHRLEFQRLNRRDGTCRRQDWSTSKDSFRFIVWCFGVVHCGWRVETLSSCSEESSMKCTRKLVLVKKSAASPGTAPRLLTSASRWRDGRHGNPCNYWVGGLPGQHQAGRKRLQHQHIELPRVHQHLEQEGEIANPQVGRLAFDFQRMWLVHKRGNRKVQPWLTQGFEDVLQSCDSHTSPAVLPPPPSMSRPPT

SEQ ID NO: 8794 - protein, 306 aa, Chlorella protothecoides
MAAAIASKLDILKANEGLLDAETRVLVSALLDAGQEHLFSGWPEPGKDDDNKRRLLAQLRQLDSSYAGGLLKYISNAKKLLKDSKEGVLPVHAANQDGECLSALPDTIYGHPIFSQGPTPLRAASLLSRKGRSWIPAAMPSSSSRTQVGPRLQSRVAAWIFFLETSLPGAGQLQDGSSPCDTGRNQLNVLVFRSITTPPFLNPSGLAAAGDTAFVLVAGGLGERLGYSGIKLALPVESATGGCYLKLYIESILALQSPPRDVLVVVSALASTSCCTNLQDPHSINAPPPNAPKCQCPCPPFPPTRN

SEQ ID NO: 8795 - protein, 277 aa, Chlorella protothecoides
MLMQARCRTHASTRPHAFRGGAEQVRAECVQGGLRAAGGWLLPLLLQHRPGPHSGPPPPSHYVGDGVVGFTFDALVGEFILSHPDIKVPDKGKIYAFNEGNYGVPCPAPHHAHWLVTPPAPPLSSAQRWEQGVKDYIDSLKDESKWGGTPYSARYIGSLVGDFHRTLLYGEVWLWLGDLEARKAAGGICAVVTLASVGPWTPPWHPSVYPYRTSTGGIYGYPADTKNKTGKLRLLYECAPMSYLAEQVTWRVVRCCITDPCTVAESLDTQGYCRPPP

SEQ ID NO: 8796 - protein, 276 aa, Chlorella protothecoides
MDAFLCSNFVNRGLPRETLAELAGDGPSGGTGGAALLQIPVPPEHRGKPYGVLFHNLLAEQGLICLGLLREKVSQCLPGRGRRQAPLLRKRALRTCVVDCRAVGTAPHTPLIHALPGSVGDPQQPPALRAQPGCLAGWNLGQACTVGARGPQGACHPDWPTESLISWQRLPLRPAMRRSLHPPSLLGLSTGTSRLSCNSDWKEWTVRAGNHLKKDSRYSTSDLDPQKRGTRWWIFSGTRSSTRWVPVEPRPPACRGWRGEGKQTLANWDADETAKV

SEQ ID NO: 8797 - protein, 344 aa, Chlorella protothecoides
MQTAPALRCNAHQNARARGPPRSLRRRQHGHQAMHPEAARDTSPPPTMPFGQVVVGPPGSGKSTYCAALARHLASSGRSVAVVNLDPANDALVYEAALDVSELVGLEAVQEETGLGPNGGLIWAMEYLETNIDWLLDRLRPLTQGEEGCMDSYGPPPQCTSLEGSRGCAGAVPLECSRTRFACVWGHLTVELFQLHAGFKRILGTLERQLSMRLVAVQLIDAHLCADAGKYMAALLLALSTMLHLELPQVNAFSKYDLLDRHGDLAMSQEFYLEAHGLEHLVESMSVGFPPAFQDLSRGLCEVVEDFGLLSFLPLEVESAESMKRLVAVADKANGYYHIPPTMA

SEQ ID NO: 8798 - protein, 752 aa, Chlorella protothecoides
MVQGVLMHTMVPPKRDWGPEGMALVLEYHDCSSAAAAAGLLAVLTEHFSDADWLAKGLGVALVDGRDVVRARQALEALLAAHSRPPHGPASQLAFPPPTSLHGAAVFSLASVQDSTPAMLGMRLHGRSGRLPNADLAATLSRVAELTPGPARFDRAGIFTWAVLEPTLRSFLATAAGAGDGLHAVFLEAGTDAATLDWPLPEPSDRGAMRQALRSMEGSLRALSNLEERLHHASSMYWPAGGRHVVDGAALLAAGIACLVALALELGHSEDADPNPSSHTVVGLPSLAALSLRHALSVHLACHLGAAGALCLPRLSAERIGEAGVLAAAAAAWVLAAGEAAGAPPGPIPLPKLTAGLCLVFGPALLLLNAPLLILMTCGCLWTLRAPSPLAPLPLALAVPLCLAWDCAPTLVFLSAQLASILRGVFLGEGDAAGGWEVPYAAQAMHPEASQSGGLTMITSNMTGLRTDEDMETFLNVNKSKIALFPNFLRLAGEVCERPVSAARVAGLCAIAPLHCSLIGEEPGDGVCRGSGGLHAVCSLTCDLHPDPLHFPAWPEGGRVSRIQPATNSGQGVASERLIRKGTARVDYFSMLPYSSPFSLMIPIIVNVLLALLDELERWCDHGQHEAKNYVGGVVCVKPGWWLATRSKQDNPSSQPPKPSNCCHGRAASDAGERWSLGLCKPGPIPLCPALEQVVGYGIGWRQEEGHAGPIAAIQGAGGAAAVFESLAHVCEKRVVGAWDGCEGRPSAHRLR

SEQ ID NO: 8799 - protein, 222 aa, Chlorella protothecoides
MSRLVVTEAGEDPQALGGQSDETVRPTDRAKVWGPPARQDYRWSIPHPLERCFSHLKHLEHKRISYQDTSDAETGPQLPSNRPLGPELLGRGPLTEDGIIESDSFTHVPSPCLSMPIGYRQVPPKEITDIRRDTASGVTISPTGANIRELVGCLRGEPGSPPLHGVLHETAGPPDTPYAGGYFYVSITLGTGMRMASCPGINARAVYTGKESDYSHLSGLPA

SEQ ID NO: 8800 - protein, 315 aa, Chlorella protothecoides
MTFGPPSLQLLLLLSACWTASPCTGLALAPRRLRLSRGPSDSSPLTITWATEGGLLPAAVCVEWEAALPAAGRGLDQPRLGPGPAPQQRCASGASTPFHDPGVNATTQVVHSMELRGVDLPPGHPFRYRVATVDAAAAVVVAAAAVWSPWQAAHVPGSNDEEVGGVTDATTSSLLPSRPQTRLLVLGDMGLYNVPALPALIQDAESAAQAGAPFHAALHVGDLAYDLHSYGGSRGSRFLEAVQPLAASLPYMVAPGNHEAGPHNFTHYRCVLRACGVWEMGGGSGLGLRGAFACDSDPNSVVRRDLHRFTLQHLC

SEQ ID NO: 8801 - protein, 175 aa, Chlorella protothecoides
MHAAVRARGYRIFFKLLLSLHGCILAACAVPSRLRHHCQGTRVLARPHIPTPSLRGPARPSKHQRPRSFSVNGTSKLSERETAGSTKDASPFTVGRLFTLTTWLLEQEKREVIDSEVAIVISSIALACKQIASLVNRAGISNLTGLAGAANQSGEDQKKLDVVANDVFANCLRST

SEQ ID NO: 8802 - protein, 107 aa, Chlorella protothecoides
MQELHERSVTLLEGSAISSEDLVTAHAEKARAILLLADRFTTDAHQEDLSILFQTLRQSTVTQIRPFLDPSQDIVVSLEQTRYRLLALSAVCPGATTLLGLWREGIE

SEQ ID NO: 8803 - protein, 104 aa, Chlorella protothecoides
MTLKTALLSLQSLLSSPQPDDPQVKLAHQPPQDAVVARQCLTDPAEFQRTARLWTESFAQERRADAAKLGRLTDMGFDRGAAEAALLAGGGDENAALEALLGGG

SEQ ID NO: 8804 - protein, 232 aa, Chlorella protothecoides
PGPTPASRLLVSRRLAGLPPALAATLTQLEVCPQGMAVAEGLARRVAAHGGAALLIDYGQDGPYEASLAAIARHRFRPLLQAPGSADLSARVDFSALRQAARGAGQGVACHGPLTQASFLLGLGMGARLEALLRGADAGQARDLVAGFRRLVGVEGPRMSREAEDAGAAAGGGEARGGAAGAAGHPGPTEGAEGEEEEGMGVAYKAMCISSSDLPVPAPFDVLPPRQQHDAQ

SEQ ID NO: 8805 - protein, 94 aa, Chlorella protothecoides
MDVHVLGEGDVDTEVLDPAHAVLKLNSGHTIPVVGLGVYLCEPGAQAYEAVLSALRLGYRHIDTAQVYGNESDVGRWVPRLGPWEVTEPAWAPL

SEQ ID NO: 8806 - protein, 92 aa, Chlorella protothecoides
MQAYSPLAKGQKLDDPTVKQLAQKLNVTPAQLLIRWGIQKGFVSLPKSTVPARQEVNLNVFSITIPDDDMATLDGLEADFVTGWDPIRDAPV

SEQ ID NO: 8807 - protein, 227 aa, Chlorella protothecoides
MQLDPLLRAAYDPEGDTNDDTGFSPFPVYLSAPLLPQILDAGNINQLIVSLDSYCEELQKKGGVIGEFVNPKYADAGRTSFKSSTRLECMMQDFPKDLPSTARVGYTSINQVWAAYSPVKNSPADAAAKAAGGNPSHSATTGELDYYKANCKVVGETGYRLSPCRQLEPLNVLILLHLNLMRQMLEHVGACIAGPSSASFNGLEDLDFWPRVVWPPAWAIGFDQLKV

SEQ ID NO: 8808 - protein, 432 aa, Chlorella protothecoides
MEDQSFTGNPLVRGLRRGATLETALRSPGARFLPVSERRVGVDPDGGLAWLTPGSLAGAGLRLDPGAEHLAAQGEIELPLYTLGLDREAWHFAVDVSSLGPEAPALPRLAEVRSLMPLLPTDQLAIAGQAVALAQWHAAHAFCPRCGAPTRSAEGGARRQCQGDAAHRLYPRTDPVVIMLVESADGSAALVGRPLNYRAGNMLTCLSGFVDQEILARLDPACPRNGQRLPTLPFVCENTQGESIEEAVLREVAEEAGLKLARVEILGSQPWPIGRGGSCELMIGCVAKATSNDIDMDAAEMAIVQWLPREGEALNRWLEGGMQLPASAMSEIPPAPLRCQRCGILLLLSSQPMGRGPPLTAIPCPHHPLLADVRKALKNSGSAASPLNGGDGAGMPFFLPPPYAIAHHLLKSWAERDGSWFAEAQTPALARI

SEQ ID NO: 8809 - protein, 180 aa, Chlorella protothecoides
MCSEFGSVIAVKGRIGEKKNQAFVEFAELESSIAIVTRYQGPADPARGLPLGVFDLDANRCNVPGNDWHTCGMQRLSASTCTGGAPGRLTMSLRHPGARAPSRPSHMRNTPADTRLPVPSASCGAGRCSWPTRGANTSPMSPPPTPAPPPSSWPASPTSRYGGWGFYSATFLKVVCPSCA

SEQ ID NO: 8810 - protein, 522 aa, Chlorella protothecoides
  MOD_RES (399)..(432): Any amino acid
MLLLDPWRLPGEAPSARGHPYQSPKLRRRCHAGTRPLRSLSSVNRDSSSCPPSHASNPPKELFPPSPLPLKETLAPLLTLEVLNAVFAAFGPVLKMALQPQGPSEVLAFVQYGDAAQAQAAKGGLAGARLPAGAFDPGAAPAAPGDAPLVEGLQYCSARNLVIPVQSAHTRDFTRPELAWGEPNRAYISSLVPAADAGGATRVLSITFDQATYPVTLEGLHTICSTYGAVQKIHTYERDARIVALVQVCGKRESSGSQGTLFVVLPWERGELGNGPWRGGVWTQTKGGWGVGVGGSCTCHQGEGRQAGLPVYAEQSTATAAKAALEGHPMYGDGANVMRLVYSRHNDLVIRPGERSRDFVQYPPGTTPPTPTPTHGAAAPGAAGGQQGGQPAPAQQYAXXXXXXXXXXXXXXXXXXXXXXXXXXXXXXXXXXQAGRPPRHAAAAAAVPGAAGGLPWLPAAGVLGWGDGPAALRSLWGVLSPAAVPGVPPATPAAPPGGSGGRAGCPTGGSAVDAVHNARHSP

SEQ ID NO: 8811 - protein, 429 aa, Chlorella protothecoides
  MOD_RES (286)..(289): Any amino acid
  MOD_RES (311)..(314): Any amino acid
MPPPAHCRQDNDIVLCDGPCNRAYHCKCIVPPLDVSTLTEDEGWLCPACDHKCIAERKARCPPICHPSPPPLHLLYRHRWTSCRSSMTSSTRSMVWRTGGSRSWSLAASLPVTGPRRGRLWPWARAARACWWAAPTCLRRTRRIRISRGEEQGEWYGLWCMHPLHGSTQGQRCRVPICLTCTVPPGLFSDRSDSSSDSGVASQASEDGRRGEGAGAATASPGSDPTSLPSSPASQRSGASSGSSGLDSEGSLGSLGDGVGQDLGRRRPGRPASSLANSSAGVGPEXXXXLTCTVPPGLSSERSDSSSDSGXXXXWGGAARGAPLPAWRPAPRASGPKTQKRRRWWSRADAGVRKWTTEPCMPLCLARWVGARPMLVMAHVSSRIQAFPQHSSHPAITPASQAEAEDGSGEEDEVWSPRTQPGLALESPG

SEQ ID NO: 8812 - protein, 574 aa, Chlorella protothecoides
MPATVVPKPHNSLLQMEPARKAPFSPPPAPPNQGALGRPDAGDWYEPEPVPGLPSDLIGVAAGHYTSFALTARGQVWSWGANEALQLGRRQRDEAYTHSPPGPIPGLPPIARLAASGVVGFAVTTHGELHAWGTSRRGQLGLGPGETAAPAPRRVEALADAAAVTQVSAGWGHALALTVDGGVWAWGWPAAGQLGHTLPPEDADEEALAAACVWAPRRVHALDGRGIVQVAAGYDHSMALGADGRLYTFGDDSLGQLGRREADVGVGVAGGATIVRESGSPRPGQAPLASQGGAAPLPGILRAQPGRPNAAAPTTHTSQPGPADAWLVRGAPAFAKVTAGLGHCLALTPCGQLYSWGWNGAGQLGLGAGEAAEVVATPQLVYGLPRNRFVDRGGTSGAPPRMHARQRIGGPAIALLQASERTAGRGARALGAGHGRTGRAGRRGAEGQRPRGGHGRHVRQLGQRRQRAAGHGAAGGGAPSGAAAHAGRGGGGRAGGGAGPHPHPGAVMSCGSSAGQRHPRNKQKDVGMWACRPPGRNVTLAGTHLAHAHQATRAPAVSGQTSRSGESTVNRHPS

SEQ ID NO: 8813 - protein, 262 aa, Chlorella protothecoides
MVLVLAVHTVKEVSATVPFSTILLQDIVVHKKAPAEHKCRQVASGSVGGPLTRGLTRLAGPLTAGPGCPHCPRSPHCLISPPDPPHPPQLIPTSGSTSTSLWDTPDPAALLAWLEGAVAVDVAHSVHEVQEEFALGLGDVARARGADVVAAAGRDVADKTGRAVLDLDARLHLSEKAGRAADAVRDSAVTKSTVAALNKAGTRVADVTTRVLESDRVTAATDAMGAGFKKLGASFTRFVRPGEPAAAAGAGGDAVSMRCGMA

SEQ ID NO: 8814 - protein, 109 aa, Chlorella protothecoides
MKRRLSVAIALMGDPLVVYLDEPSTGLDPASRITQPRAALGSQRAHRGALHSPPRPFHRRLLWNVIKKARRDKAVVLTTHSMEEAEALCDRLGIFVGGRLSCLGDPKVR

SEQ ID NO: 8815 - protein, 131 aa, Chlorella protothecoides
MHFLTLTSGRASIQPPSPASKQYQTIHPLNLPLALLQTGESVTNTDLIGWVTIGVQHIPRAEDVPLISNFGANFYIKVRCLASSCRDHVGCLGDTLVASLAWSPDCAACNTQLSIPSKTPCRVQPWNYFDS

SEQ ID NO: 8816 - protein, 276 aa, Chlorella protothecoides
  MOD_RES (40)..(43): Any amino acid
GRGGGHVAAPAGAHSRCARQHASRGSGRDGTLRPPTLELXXXXAPAGAHRRRACQHASRGGGRGGTLRPPTLELESCRGALTLVSHVVGEGWAGTTACMAQGWIVNAVSQDRSGSWELWSIGAMASARSPRDDELADDLLEYINDSDTQFHAVEQAKARLDAAGYMRLSERQSWDGLSPGGRYYFTRNDSTLVAFADQAQSAGDLHPTPSLPHTCKRFRLLQPLLQAEAGVQVHQERLCHGECGAVWRPAPAHLVRPGPLSGGPRADQDRGGVHAA

SEQ ID NO: 8817 - protein, 663 aa, Chlorella protothecoides
  MOD_RES (315)..(318): Any amino acid
  MOD_RES (407)..(410): Any amino acid
  MOD_RES (543)..(545): Any amino acid
MSWCGGKNLRAGQARVFARLQALSHQSGFVSQAPAGLTALSAFGHVQLPISPKHLLSSTPPPQDMAHALHPNYPDRHDAAHAPRLGDGIVLKHNANQRYATTAVSATLFRWDRGCGGLDRFEPSLGRAASQCIGQERGQGWWSPMKHGCDWARVCCGAGGPPHPVPLPTITNSAQGGLPPGRRADGRLCCEERHGVRVHHRPHPGLGAGTQDGGRGPAPAVHALHPGGGFGRSLGKHGRRGGGVVPGLEAMAGVGTVETTPLSVPSRRTWHRTPMPASDHLGALRYLAAPPFLAPQMCAVADVGHGYRAFLAFYXXXXTPLCVPLRRTCIGPPCPCPTISARSDTSPPLLPGATDVRRRRRGTRLQGFPRFLPDRQCPGRRTRGCRRRPGLMTTACTPIHGPVAWVXXXXPWTPHSRVPTQARPDYHCLHSNPWASGLGSDKRAHMPAQGQQWSWVRPGAGAQPASAGAGTDPRGRGSAGAARAARAPPPGSCVARRKREWRVDESDRHPRLQPAHLGHVAPPGSPDGQEPYRIPGVPEADGXXXRELSWEEGVWTRPAQGAAVILDSSQHTSATLPRLAARMDRNPVAYLESQRPMVLSSSSPFLKFRSYFCGGVSGDTGAEEPAWAPRHVQPPPPSPGWPSHLASPLTDMPSVSSIALTFT

SEQ ID NO: 8818 - protein, 111 aa, Chlorella protothecoides
MPAARQTCAPNLDPGAEPQPPNLQGPVLFSGAGLSVSPESSTAFVALNAGPTAYGGEPGKAVTVARLAGRGVGLVALIQVGGILVVEWGPHGDRGRENVWRSWWRRREAGS

SEQ ID NO: 8819 - protein, 115 aa, Chlorella protothecoides
MDSPPINNLHVHALDPHHPRPATPAGLGGALDVALVLQFFDAGHDVILALDPAAGPELRELASELGVDVDAAEARVLDHSAYDGALAATAHDVVHADVSVGLNRHVFPAGIHVRI

SEQ ID NO: 8820 - protein, 194 aa, Chlorella protothecoides
MLSSFPCAQLGERFAGCSRAVDDDYVKVKAMLDTLGMSVRGLARWLGHPGLGGGGCTWRGAQAGSSAPVSPLTPPQKYERNFKKGLLEDRTIGLWDSRYATGFLSIRAARRGNVAEVCDRAPVHPGCQAGRRGRGVPAGVSGGDRSHPLSIPSFFVPRSSLAEVRVPPGPRLLILDHVDQYRHLLKPAGPLPRA

SEQ ID NO: 8821 - protein, 255 aa, Chlorella protothecoides
MLAIHLQRDINSTGFNPNKQTECTPLLALQGRAADCGGDRCLGQPHDAALNGACLTAALQDSEGPAVSEGRHHPWLLHILAKELGVRPEDIVDFDLNVIDTQAGVIGGASGGSGMWPLNSSVPYFAPAIPPTPCLCAPGAEGAFVFVGRLDNLCSSYLGLRALLDSDVSLASEAGVRVLALFDNEEVGSASAQGAAGPVLQDTIARVAAVLGGGAEGAVQRALQASFLLSAGAALGACMREGRCRVEQFIMAGGD

SEQ ID NO: 8822 - protein, 93 aa, Chlorella protothecoides
MARPLIMPLMLLACCVLATSASQSRVLVLMDEPSLAETHSRFLGGLRAQGHDLDVQPIDAASLRLVRWGDWIYDKLVILGGRKGEEGGGPGVR

SEQ ID NO: 8823 - protein, 353 aa, Chlorella protothecoides
  MOD_RES (72)..(75): Any amino acid
MLGSTGNDGVKRWAVLLLDPVTTRVFSSAAGIADLLDYGVSRECSSLGVRVPVARSSSGCTRRCQSPRASNXXXXAPAGSGCLLPARPLAALGDVHPHERRTPPPPQRPPSPPAVVDDVLKQREPLTTLSGVYFVAPTPEAVARIIEDFGTSRKPLYRDAYLFFSSPLPPELLQRLRGCPGLLARLRTIKEVNLEYLVLNRRTFSTAQDGALRTFFGAGAELAPAYAYEISVAATRLASLFASLKEMPAIRFRAAIPPGDDFPPGLEIRLLVAQRVALELHERLLILQHAGLVPEADTCELVITDRGADPVAPIIHEWTYEAMAHDLLGPDLGSNNVFSYEAETQGGGGGGRG

SEQ ID NO: 8824 - protein, 570 aa, Chlorella protothecoides
  MOD_RES (67)..(69): Any amino acid
MKQLWCRLPAGQPEAGGRCEPAETGHHDRGPPPAPARGEEHGHAGAMGVGGKAGADQPGRGRSVGTXXXRWEWVERQARASQEGGGQLELLAQGTSGRTAEPLPPALSAFPIPVGGCRCAILTCSSHDYPPTPSSFDTHRRRARATQPGQAVQLAVQRLGGPAARRGAAGLCRGQRGIRARLPADRRAGLQRTGRDLPHALLLPGGRGGEVEREGGAAAASGPHVCHEQSPATAPIHAQDPTPPPKNNKTQSCANLLTEPGRGRVPGVGVPVHASAGLPGLQRRGADHLQRPDRAAAGRVPEALRRSPRLWHALQGGYGGVEAGRDWSGVDLGGKGRVPWDGRAALHTPHYSLTPPLPIHPPTLNPQIATVDKFQGQQADYVLLSLVRTAHFGHLRDVRRLVVAMSRSRLGLYVFGRAALFSECYELAPTFRQLTARPTALALAPHERHGACPRPVGEAPPSPVVVPDVQAMAVLVAQMVAHWEAAAMAAGYGGGGQYPASAPPGDDVGVEEGAAAEGATGEDPDDDGVVEDEDAADPAEEKADNKAGAEEPDEAGEQRAEEGAGPMAED

SEQ ID NO: 8825 - protein, 357 aa, Chlorella protothecoides
  MOD_RES (139)..(141): Any amino acid
MRKQCKARLLGSDQAHWRVTNLTPLPNNILPDHLREAFPECDVSLTSSRADGQLVRPFRVTFPSFREDDAGAKARRPTLHAEAYTAVDPGPYPEDEPPQNNVRFTPVQTSAVLSGVQPGLTMVVGPPGKREGGGTVVGXXXSPWSWGRQVKREGRRDRGGTACEHRGTFSCLRPSLGLSTQPGLSHLPFPISSTTSPILPISPLPPSPPFNRHWKDRHGGADHAYPVPQLPRPAHADHHAQQPGTERPVHQDRGARRPRALSPAPGHGRGRPGDGGGVLARRARECHAGAPPAAAGRGRAPGAPAARLRVGGLHLRDRGPLLAPARAVALGAVSGGREKGRRGGCRGCALPLCRVLC

SEQ ID NO: 8826 - protein, 687 aa, Chlorella protothecoides
  MOD_RES (90)..(92): Any amino acid
  MOD_RES (445)..(448): Any amino acid
  MOD_RES (600)..(603): Any amino acid
MLPRRCILPLAPSSNPHCTHPSSAICRGDCAGPTQAQPPVPDHPGLPHAQLQPVQVRVPREAEVMVCHSCACQHSRCRACLGVPWTYTSXXXCSGSKDSPATRPQFCRLEATYEIREDIADVLQRVQPYLRENDEVGGSTLERSQRDRHGGVGASPVCMSDRNCLVTSIRCTHSPSTAQVGFNGWARMAKNLEGFTITEVQPPKVGEMRPAAVSAEVVVDLSSLREDVRREWEEVKQHDVMFLLTLRPPDAYAQSAAAESGAGDGGTAESGAGDGGTGELGGQGWGMQHSSIIKGMPLAADLGAWHCESAPATAKPSASTPLATGASLMRKYGLDYVRGCEVIEMRDEGESTGRTGNRPVHCLSGGSACLVPSTAWSTSGMAWLVLSHTPLPHADGQLLNDFTGRVRPDQVTRPKGSIRTITVAMDAAQYQGVWVVLYSCCRLPXXXXLAWQGVWVVLYSCCWLPSAPLASSRCACGDLVSATPSVPPSFHADGHGCCRGIGCGGCVRHLQPPAPAQAQGEQLQGGAGEHPRPHERRLRGAGLAPRHPAGLRRSRWGKGECWRGRTGELLSRGLGQEDCILTSLPCWGCVLVVLQQHGQXXXXSRGLGQEDCTLTSLTCWGCALVVLQQHGHSSLVCPLSWVASRPLVHEMPHPSSPAHTSSHPCRCGAVQEHGGHAADHRLQGYLP

SEQ ID NO: 8827 - protein, 1095 aa, Chlorella protothecoides
  MOD_RES (21)..(24): Any amino acid
  MOD_RES (375)..(378): Any amino acid
  MOD_RES (465)..(468): Any amino acid
MHCSTPAQGGWAVAAAPQLIXXXXRHQSAMHCSTPAQGGRAVAAAPQLIPVYLLDELLGEGRGLPTRQHRAAPVFVGQLSQLVLADLRVRCAAWVGLGALRWEGIVWHPTPGTGHGACKNSASGRPRRVPHVQIHVQTMEYIQIYTSAMVRAPDCAALDLGAGPARFGFVLLVFAIATLSPVLGHLVGTAALDAAAARHGQGHKSFSRHSHAARPDLSTDNCRSSGLEAALPLLLWVIDDLHMSWLTVGDAPDTWPAHGADNRSFPSDNIRSLFIEEDIEFDLKDTLLLKVPVEHGCSCASLLCPALHSCSCSQLESWLVLTSNTREQQPQHPCNYNENFDASEVLSMPKTRPTVAPCIWRSPLPMSLHFPPASXXXXRLVLTSNTREQQPQDPCNYNEYLDASKVLSMPKTRPAAAPCMWRSPLPMSLHFPPASPESSMDFLRYFGLRGPLVYRRTMASLGYEXXXXNGFLRHFGLRGPPVYQRIVCTMASLGYEKIEGQDHGHWLLIIARPREESYFFAPTLKALQKQGDTVSVLCLSACRCKESPESCSDVLFVSDRSDHVGPDARGCPCLTQALHQMHCAVSDESLKKSRQQELRDACRVLGIDADRVRCIDDPSLREDAEWATEVVAGHIHEAVNYFRPTGKEKERVLRVKILVSMDYPGGVMDLWSEGINSSCPVRLCALLRKDSFQKSSRKPFPSGHSMTRGGRPPSTSHRRSGIRAWRVGVGCTCLQTMSVTIRLSLPPDRRDRGDGDCWLTDKMHLVYQNSDRTGQRISTGALIQLKPIRTIRGMQQRWLLVTAHPDDECMFFGPTIVGLRQTGASVSVLCLSTGNAAGLGPLRQRELFRSCAVLGVPSSQVTCIDDPELQDGSSWQISKAAVHIQKSLEVVDPTHVLTFDAAGASGHHNHIATHCAVQTVLSCRKDLQLYLLLILPYHWSTSTSTVQPLPKSPHLMAGDLPPMAEVLAPAIPRRLGVTAAPRPSCRWLCTQDHLWRPEPCGALEGHDLPLEPAGMVPLPVAGILRVHGVQPPESGLTQGITRRMCSRVTDSFSRALCTASTRETPIYERRTMHFASSCHPPPRGVSAGSWRAAGA

SEQ ID NO: 8828 - protein, 1527 aa, Chlorella protothecoides
  MOD_RES (498)..(533): Any amino acid
  MOD_RES (553)..(556): Any amino acid
  MOD_RES (575)..(578): Any amino acid
  MOD_RES (632)..(644): Any amino acid
MSARRQMRWYMVAVHVQPWPQDPRPLHPPQLICFWLALLFCVRPMSRQGMFRLGAIFLLASSAGVGLALASLYLIVAIMGGSNDNSAVKVRSRVVTVCRCCRLKCDQFPGWGSRRPVDMLTGAPPCHPVHPNPSLLTPAGRDPADFLPRHLLPGCLPSHAPEPEVPRPDRPHLLCPHRLRRLPHSRGPPAPVPTLPPLLHLRRCGHHLGHHLPHSSPPRRWACRVPGRPCPGLGPSGVGPVTPTSPPLRARTLAGLLARMALANGLRATAGVLADILDLTLEKLNEEGKLAAASGTGDSGALNIDSGLYPRVISIHMASYNSGKRITVRWRGKSSGEEEDVIPGLLRRGGCYSARVHEIVPCQRIRRPLSSTSRPLPYRMLPSPPLSSHQYPRACSLQAAREHSSSARLELDLYRPTHVLAFRPFWKASLLARSLLSAVTVMLYPVQARGGLVFWGGWSGPTCLAAWHAVVVACWLRSQAIGLCTLPQYILLRQAFMXXXXXXXXXXXXXXXXXXXXXXXXXXXXXXXXXXXXRLCSPPLTGLSRHPTSGQSXXXXRLCSPPLTGPSMHPHRDTXXXXLPGMQWWLPAGCTARPWGSAPSLSTFSSDRLSWGAWRVAHGSVWPRVPLPGCRXXXXXXXXXXXXXPPHLLSSSPAQAGQLRLSMVHAHADLFARVRDNARVSLCRAAACLTDNAPIEDGLQALGDLHGALCCLILAFQRLPKELALTPDSMAFHIMATNVLTSATQVRGVLWRKGRGWGPGSSGGWLARTGSVMEEGQRVGTREQWGNARPRVWVPFDQTTVQPSILALGQSVKNSYLRLQIRKIYQVLPAVLAKDQPQSSKAVRSFLLAYPAADMAKIAYTPAPANEAVRQKGLRAMSRLKRRGFTRACPRPGWACRIPRACSSCFQGTNPGRINVMHCPLLSAGGEGGSGRPAGLPHSPRLHRPPLRHRPGRVPAQPRHGRGAAGHAGETVWGWRVLCRPSRLACSSREAPPPCTGKLLTPPAHATLSSRACALRLQRRSVARVEPVPALPPGRWDRLMGGLTARTGITPLHLRIACQTAASYGLVMVLTGVDASYLALWERPIWAMLTTISVAETSIGAVYKKGSLRVVGTVVGMALGLATLYLAVLINGLNHDNHPAKVRCHCAGVRVGDVGADVDAGERFFIVTTICLTCISAVGATCCAWDPGNTFAYMAGFFCLFGSALPGYIGDQELVPLLVNDSNPAPPSRCLPGGYLSCMPLPCPSTARLQVQFPLLSWNQPYAGPAAQPDDGAGGADPHAGGAGGVPGFLPPDGAGTHGGQPGRAGRPGRGHAAPPGAHRGGLGRRRRPTAAHPPEPARGRNQRGGARRGGVGRGGPWPQGDPGGARAQPPGRPRPQDGLVAAWNQFRIEAGPGVISEDPRPVGPVFLDLYKTIWPVSGAGRARASGGASAPVNESRGLAAHKGQASGCCLLQASQAATKIAGMAPLVDALAFEYELFHAPHRLPVRSAFKAQRLFRWGGGLAAGDRDGGVDRGGVHAGLGTKSRGS

SEQ ID NO: 8829 - protein, 220 aa, Chlorella protothecoides
MPITRFFHRPAPQEVFPAFFRAFLALKATDGELHMHERTTYLLFAINAFQSFGAWPRRCPLPPRPHLPSPRSPPLRSPPPCDSANSPNSTQSLEEEAVRKEVLRLVSLPLWHALSPGRLQLELHDHPALLKHWRHAARREARAAAAAGDAHMPVQRRPEASFLPALVDEFLSVLGGVQEEGTDRRTTLYLERFVEFLTDLLSQARSWGGGREGWGVLIGG

SEQ ID NO: 8830 - protein, 87 aa, Chlorella protothecoides
MASSWGGVPNDALPAQCTKPHPCRTPHPQISKDKLTQLANKHWSSAVLAGGEAPAFSEELVQQIYRDELGGGSDSPPSLRRCAAVHC

SEQ ID NO: 8831 - protein, 57 aa, Chlorella protothecoides
MPRHLISDAHEWINEIPTVPIYYLAKPQPRERAWKKQRGKKTLLSLTLVRLCEMTWE

SEQ ID NO: 8832 - protein, 127 aa, Chlorella protothecoides
MSRTTNSVRAHPSHLPSTVCRQNGFSKAGSIRTSTLSIMGLSVSAVRLQSLEIVTPLSTEILVAVECLKAGQKACAADSDGNIGSDNKGKNNFGTKNNGDDNIGEQRMGCTLSTDNSAAAASMARKD

SEQ ID NO: 8833 - protein, 736 aa, Chlorella protothecoides
  MOD_RES (181)..(184): Any amino acid
  MOD_RES (367)..(369): Any amino acid
RRRRAGRLRRRRPVLRGAGRGLVPRRGPVALRPAPAGRRAGRRRRARAPPAAAAAAPAAAPAAAGRHAGPLRPPCRRATRRAGRPRLLGPGTRGCGVRAGRGAGGPGLRDPGRRGRRVPVAHDALAVGLLLRLAAQPPAPLRRSAQGRGGGVHGWHAHCVSQGHQAEVWAARTRRWSHAAXXXXGGFRQGWRGSWPACTLCVPGSPGRSVGHTDTAMVPCSTLAPSYGETPRIHPSSGTPPPHTFLHPPQPQSVGDETLACLFRSFPGMEYCDLKKDRATGRSKGYAYVKYATHDSAAAAQARLNGAEFPPGSGCRMKVMFAEPALHRARSGSADSCADAGTPFNLAGLAGGGAGPGVEELRYLSTXXXRPGRRGGGGGRGGAALPVHAGRRPAGRARRARRRALHGPQPGRGPDARRSFLSPDARRRPLWRADPRRRPLCDADPRRRPVRGADPGRSAGLAAVLRVRGAAAAPRLPPALPPALLLNPRPAVGRRPPGRPVPGRRGAGGAQGLHDPRRRAGRAEPGHDAERVTDVLLARPVARGRRRLRHQRARRWGRGRRPCGRGRPAAAWRRRRPRPHRGLLAPGPPAAGLCAEPRLLALRPRGCGAGAARRAPGHGQVPRRGVGRARGRHAARHRGPGRGARRLRQPPLAVRRAGSGRDAQAPSAGGGRGRPHAPPTGHPKAAASGCAGPHAPAPLVDLTRAWELAGDIQARGPDQRKPVLGCPCTHAPTPSP

SEQ ID NO: 8834 - protein, 156 aa, Chlorella protothecoides
MTGTLDFYPALRLQRLGSVAVVQPVWESGEPLPALTVDLETGSLAASEHPHVTSDFVPCFGVLGMLRLEGGPALVVITGVSAVCWVLSGMDCSAWASGIRVWQSDHKPHACLMKLSLTPCTPPRFPFSGWHRARAPGAQGHLDQGAVRHEPQVEQE

SEQ ID NO: 8835 - protein, 973 aa, Chlorella protothecoides
  MOD_RES (35)..(37): Any amino acid
MEGRRWPGACVWIRCMLGRWMRMRAWVEESHLPGXXXVGGDHQVARGHHRFAAWQDVELRGGDVRGARKECDCLGQVDSSVVACHPDGGRRWPGACGWIRCMLGTWMRMPAWVEESHLPGAGPTHSPHKHTPTPPPPRPPDYHHHQHGHGLAHGQRGVHHGRALSAHLGRVHPVDRGLDVLQRGDGRPDQVGQRLAHRQARHGGGVQQPLERRLADGGGRAGAAVQALRHDRHVGQRRVQRPHRLLLGHQARHAAVHLVGQEALGGDGGEAQHAVQRVSRRGAREVQRRGGGGGPAEGVGLVRHVPEHQLQVQVHGGGRARGRLPVDDAHAARAVDGADDLDAAALARGQRLQQRPVFRCDEQAVVLLVLRAPDLQHRHGGVAQVHRAHVDLRAQRVDDLLDHVAVPARALVVDGQDGVGRAQLHAGAHHAPQLLADLGVAALHRVVVQLRGVGAGGQRAGRAATHADAVSGAPDLDHQHAQAGGGLLQVPVVDLAQPAGEHDGLEPLAARAVRQPLAEGARVPGHQRLPELVAIVRRAVGGVGQDLARVRQGGRIRRVGLLPGQVVALQQQVTHAVPGRGGAHQRPDARGVGVTDAAARPRLRAGVGRHRAGEIVRLRGQQQVQVAMRGRQRGGRAGRVGQQRAHGPAADGGRVVLEGQHRVGGGARQRALHHAHQRLGHGRAVHGQRGAEEPVARVLRVGLRDVEQLDVGGVAAHAVAEHVGVVVQVAVVKGQAHGGVDALQRRPPLRHHGHREDGGGDHAGGEGGQGRGVHLLRHAVVHAGGKGRQLGRGGAAAQAEAAADLHALHLAQAAGGADAHRVGGPGRAEIHARDLEVPPDSNIQRSRTHPAQLKATHLDHGILGLQLEAGVGGEPLRLKGLTQQPVAGKEEEVDVRCDSGASQLEATHLDHGILRLQLEAGVGGEPLRLKGLTQQPTAGKEEAVDVRCDSGACGMRESRVQSLRLNGDDDTMS

SEQ ID NO: 8836 - protein, 243 aa, Chlorella protothecoides
  MOD_RES (196)..(198): Any amino acid
  MOD_RES (220)..(223): Any amino acid
MVEGWWVGIMNAGRNCMLSGHPAAASTHLPRLITPQPGHRPRLHAGCGCGQGRGRQQRHLLAHVLLPLPRVPGHGACEEGRWGAAGGPVSGHRRAGAGLHDTHAPCRMQVDLYEGGTIAIVEAVSPELGNRVQRVRVQLPGTPPELLTKFREKKVDFAAHTQTEDGGSQILGLLGERGERWSWVAQGFRVKSGWTXXXPLREGIYCQPITTHPPLPTLHXXXXGQEVELAGSGAGVGWVRASG

SEQ ID NO: 8837 - protein, 821 aa, Chlorella protothecoides
  MOD_RES (238)..(241): Any amino acid
MACEEVYPLREGTYRQPITTHPPLPTLHPLLPGNLAFPLLLVGGLFLLSRRQGGGLGGPGGGNNPMNFGKSKARFQMEPNTGINFADVAGVDEAKQDFEEVVEFLKKPERFTAVGARIPKGVLLVGPPGASRHGFAGSLCLAVLFSREEEGGGVEGCCTVSRGRQERPSTARPLAVSAATAMYSFPGFPSSWSWPPPGSAQEMQQRSAWRGQKRHCRLPDPPPLKPSCRDGQDAAGQXXXXRGGKSGYRLPVGWLSVVHGGARSDTANCLTPRHSSHRAGTGKTLLAKAIAGEAGVPFFSIAGSEFVEMFVGVGASRVRDLFKKVRRFLSETEGCGCWMAVAAGWLAGHPAGRLGLPCPPLPIEAKENAPCIVFIDEIDAVGRSRGTGVGGGNDEREQTLNQLLTEMDGFEGNAGVIVVAATNRADILDSALLRPGRFDRQVSVDVPDQRGRLAILGVHARNKILGPDLDLKEVALRTPGFSGADLANLLNEAAILTGRRNKEAITQAEIDDSIDRIVAGMEGTPMTDGRSKMLVAYHEVGHAVTATLTPGHDPVQKLTLIPRGQARGLTWFIPGALGCGWRWGKGVAGEHPIGGGDGWRKGRADTRLARRPPMPLQFGMSRTRACIPPNTWTPTNQPHPFPPFPPRRGPHPDQQAADLCPHRERAGRARHRGGGLGLGRGDHRRLLRPAAGQQHGAQHGDQLRLQRDRALLAAGPGRAVARHDHAHDGQELHQREPAAAHRRGGEGHRGARVRGGAAPHPRQPRSHGQGGGGAAGARDDERRRVPRHPGRVRGDPRREPGGGAAAEGAARARAQLMSRQQ

SEQ ID NO: 8838 - protein, 156 aa, Chlorella protothecoides
MGFWLGTLIFALLELLGFGIVQASGARHGNKLCVGSGQGPGVFGGWRDQKIGALTSATHDLSPRLKHTLVGTTVACCWMICTLPGGLSLLDPQTPLQVGHRVHRPASPAHEAYPPGLRCFRGWRMVVPAPLYACSPPHSARSPHPSSPLYRCLFQL

SEQ ID NO: 8839 - protein, 480 aa, Chlorella protothecoides
MCPARIFTLQGPYPASFKPALATGSGTDCRLSVGATWRSARTSVSGRACAPPAGSAPPRASSSHRFPNPPVRRPVKGQEGRQEEDVSRLDARWLALLLLGSRSMLPHTRYPSSPLQCRPLQQEGLVRYPCPQHLPAARCGQDPGDSYRRYQGVMDGRSGKGPGRRAGGIALVEIGRSSGGQASGGGGAGAQGGEGLLWWRSGAAAADRPRGGEGLYPDRCWGAGDGEPGDGPAPAAISLPIGARILPLQLWLARVLGEYTMTTPHHPPLPPSFQQIASDGLKGRVITVNLADLQKNEADAYRNIKLRVEDVQGRHCLTNFHGMDLTTDKLRSLVRKWQTLIEAHVDVKTTDGYTLRLFAIAFTKKRAGQVKKTAYAQSSQIRAIRRRMVDIMTREATSVDLKDLVAKFIPEAIGKEIEKACQGIYPLQNTFVRKVKVLRSPKFDVGKLMEVHGDLPTEVSTAVDRPEEGVVGDAPEEATA

SEQ ID NO: 8840 - protein, 566 aa, Chlorella protothecoides
  MOD_RES (535)..(538): Any amino acid
MSVHSPRGWCPLLHVRGRHSVLQTLKAHATPQAVPTLPGSCPARGGGSRSKIITKALSSGEQQGRGGREVRRYGSVIISSHWKKREQKAEKDYRIGIGGQGIKVAGQKERSDDPAKVNKHRRSPHNGARALPYLARCPLPSDLGRSSIPAEGSPCRDLHQRASTGSGGLKRSNPGARTLPVEVAGKCRCHACRIGYRWAGPIKQQHRSPRFVFWGKQDSWTGVRCTEDTRGWELDSDAPSRRGMRPHKCPQECKIVHKYVQVSKIIIQHLRAWGTWCALEPPASVKSTLKGLPSPAHSAASHIDCHRTALQGWRESDVELNIEEAGATPAPGRPEIGPRPRSATFTPAGTFTPATSRKARETHALQPCVIDPRYNTGGNTPFIHCRRWTGADLGLAVSLHHGRSPRREESPGPWRTWLRSPASSGARKVHPLLPGGASAGRPGLVCRTLPWIVHNYKLEELTTVSQLRRNVNQLFRRFEEVKTPEAVDLLIYKGREELEVRRRIGSAPREKLGVRDTALKLRVALCWRFACGDWXXXXSRKAEREGHCSWIASRTVLEVCMWGLGS

SEQ ID NO: 8841 - protein, 114 aa, Chlorella protothecoides
MYGMALAVLSFALLVVTSSGAASQRPWIEQISWRPRAYLYHNFLSEAEADHVVTLAKPHITRSSVLNDDDSVSDAHEVRTSYGTFLRYLKTWRMGHMPGTKVHHGSVVRVCSSG

SEQ ID NO: 8842 - protein, 280 aa, Chlorella protothecoides
MEDMQVLKYVDGQKYDAHWDERAAEDGIPVGGGSRRICTVLMYLSDVEYGGETAFPGGFWLDAAVQNRTEFSACAAKGPAALARKGDAIMFWDMKPDGERMGEGEKGGTGAVGTSLVVAGGLRAMKRIPPHGLVGCEHAHTLQDDPLCPALGPIPCPSKVSCALPISIPPFPCFPVKGVTLDRYSLHTGCPVLAGEKWSSTFWIHDNPFRRSPGSLLADIDSAPAPACEDQSTTCATLLAGREGAPCSEDQAARCRRSCGRCCQAGDVLCERRAKRIVAD

SEQ ID NO: 8843 - protein, 341 aa, Chlorella protothecoides
MAPGNLVVSAYVGCTDITRITTPDLKAPGASSLLHVDLGAGRRRLGGTALAQVYSQLGDEAPDVDPALLGAAFRATQALLATPDSPVLAGHDVSDGGLVVAALEMAFAGNCGLELGLEGAAHARDAAHGALAPLFAEELGLLLEVAAGREGEVLAAYAAAGVPCARVGASLADDEVRLVVGGEMVLAGGARDLRDVWEATSFELEKRQTALECVESERAALRSAEAPTWVVPYVPAWTPADKLEAGGERVWGEVSFFRARARGRLSLTECCAAARWGFCIQDGGADGAPASLPVRVDALRRAVMETYRPRCPALLRNTHALQPPSPTPPHPNNRQTRCVWR

SEQ ID NO: 8844 - protein, 240 aa, Chlorella protothecoides
MGPKRFAEPRLQVAFTPGPSHAQHLLPLPLTLPRLLKLLAAGVDPKQYGGSLYFSHAGDITLTAQRAERVAADPQTAAARAWQRADLDVTWNAALARPLLGGCAMARFLLGGCLGAANEGVQSGSQQAQPPPCLLEVAVHVAPSSLSTAIPDAGLDAYVPPVFMGFVEQLNGLDFLGGGRQVSLGVTLIARRSRHRPGTRQWRRGADQQGTSRVRLGGGKAWARGRDAARGGSRTAARYV

SEQ ID NO: 8845 - protein, 792 aa, Chlorella protothecoides
MNFSTAWSANAVSICASCGLGKVERVEVSRRFRLRGGASTAQLAAFAASVHDRMTEEVYPTPLTSFASSVVPAPVFTVPVVSEGRAALERVNASMGLAFDDRDLDYYTDMFRDGMGRDPTNVELFDIAQSNSEHSRHWFFRAALTVDGAPVPESLMGVVKSTLAGSAPNSVLAFKDNSSAIRGGPVRTLLPDTPGAPSALAPAHRDLDLLLTAETHNFPCAVAPYPGAETGAGGRIRDTHATGIGSLMGAATAGYCVGNLLLEGYDLPWEQADAAYPPSLAHPRQILTDASNGASDYGNKFGEPLVAGYTRSFGQRLADGSRREWLKPIMFSGGLGQIDHGHLEKTPPGLGMLVVKIGGPAYRIGMGGGAASSLPSGSNSAELDYDAVQRGDAEVSQKLWRVVRACVELGPANPILSIHDQGAGGNCNVVKEIIYPLGAEIDVRAVHLGDATMSVLEIWGAEYQENDCLLIAPKDRPLLEALAARERCGVQVIGTIDGSGRVRVVDRQAPAGAPTPVDLDLELVLGDMPDKAYAFSRSPAPAAPLDLAGATPADALDRVLRLPAVASKRFLTNKVDRCVTGLVAQQQAVGPLHTPLADVAVVAQSLYGRTGAATSIGEAPLKGLLDPAAMARLAVGEALTNLVWAPVTALEHVKASVNWMYAAKMGGEGAAMVDAALAMREAMAVLRIGVDGGKDSLSMAAAAGERTGCLPGGGGNRGGGGEGGWVCVCGENAWVLRRAGETPPPTQACASMFQACTESSRMHQAISSLHLGDMQLLTSQPGPDNRIPSELP

SEQ ID NO: 8846 - protein, 271 aa, Chlorella protothecoides
MAAAVQMAGMEPWDVTMSDLLSGAATLDSFQGGSVGGVVEGAWGPGSSIIFPGGFSYADVLDSAKGWAATIRFNSRLLGQFQAFYARPDTFSLGVCNGCQLMALLGWVPGTGAGTGAAGPLLPDAAQPRFTHNASGRFECRWSSVAIDPDTPAVMLRGMGGARLGVWVAHGEGQALFPDEAVRRDVLDRHLAPIRETQEYPYNPNGSSDAVAALCSPCGRHLALMPHPERCLQMWQNPWWPADTGLKPTDPSPWLKLFQNAAEWAASVRRA

SEQ ID NO: 8847 - protein, 328 aa, Chlorella protothecoides
MEGSSGRFDSTGGHSATIPCDWYGRHPGAALCGCQLSHVANYVETEQIVSDGEGALLSSFVQARGSLPLLWSQTPCLKYKIPLRLAPPSASAPVFAGHADRMVEVHGAVTAINLANQGGREGVLSAAYVAAADAYAASRSGFRLVPFDFHAMCGATNYARLSVLWDELAPDFERYGAFTRDSASGAVAGRQRGVFRTNCVDTLDRTNVVQGLLGRKALEATLRALGVLAPGAALAAAYPEAERRFRVAWADHGDEVSRQYAGTGAMKSAFTRTGKRDVWGLLDDGAKSLTRYYLNNFQDGAKQDAIDLVTGAFVVKTGGWVEWSRLGV

SEQ ID NO: 8848 - protein, 87 aa, Chlorella protothecoides
MAQESVRALEGRRVLIVNAHVGMGADVAETFAREGATLVLTAPQTLALHEVASRCGGMGGFDTLAPCETLELDLTSAEQVGGGCRTR

SEQ ID NO: 8849 - protein, 109 aa, Chlorella protothecoides
MHRLAPATPRPTCDARWISNPTHPFHHTHTQASPASPAAAAVLQKLTAAGPGVLQLYRSPGLSASKAATLLKQAQAKTLPEVTGMDTELCYNISLSQPLTAAEAETLAW

SEQ ID NO: 8850 - protein, 76 aa, Chlorella protothecoides
MLVWERGAGITLACGTGACATVVAGVLEGRLDRSCRVDLPGGPLEIEWRQADNRIYMTGPAELVFEGTTSLTGDEA

SEQ ID NO: 8851 - protein, 798 aa, Chlorella protothecoides
  MOD_RES (496)..(499): Any amino acid
  MOD_RES (588)..(591): Any amino acid
MGSLRYLVAITAFLVVPATSVLLGITLPAGFAVTPYYDAGVPGARSLTLSTAPPPAGQGPIVYVANNKDGKIYALLDDDNDGFAERLVTLASGLTTSNGVAWHDGDLYVSELERLWRFPGIDAVARRGSGEYPADKAELLIDSLPSASQHGAKYIAVSPAGQLYMNIGAPCNVCEPGSYQKNASTPVFQYGSIVRFNLKDWTTPETVAYGTRNSVGFDWHPETGDFYFTDNGRDDVGGSNATVTDASPDDELNVVRAAGGFYGFPYCHTGARGGITEAPCARLSGIGTPVIDPQTNAGQKTLSCDGEGCIQLGEMHGAAPAWGLWMRLMSHRPLIASLAPPCSERGWLHPSGAGAGTTHGRAGHHILQVCEDQCVVVPVFLGTHFGGSVGRLAGAGGMLPRGTQNHTQSPPLLPSFALHRRNASASYAFPEEFDRAAFIAQRGSWNRANFMMGNHAPATLQADPGRVPRGDRGAARRRHGGGRAPLHVGAAGGRHXXXXTVALRGDGTAEGVRPFMSGLLEGDTGLPACPATPKSNQAAVRGGGRVWVWAGLEVLHGAPEERGAGEGAMVRVLRKASGETLPGRLRHXXXXAPPRPSPTRPLCEVGSACGCGRGGSFCMGRRRKGERERGRWDARGVVRVRRCPADCGTLAPRCLGPPPQARRPARGRAPAPRRLPPGLRRHRQCGVQGGLPGAHPRPGPGRLTGSAQGYQSRAVWRVSLTSRVLRPGPVWRGASTTTLHFPVCRLSGTCEWRARPLYLYPDNPTFLGVMLAPLIPRLCSPALYLSLSCLPSCPSSAG

SEQ ID NO: 8852 - protein, 484 aa, Chlorella protothecoides
  MOD_RES (12)..(14): Any amino acid
  MOD_RES (159)..(182): Any amino acid
MRCPCPDIEVAXXXRTLAGLGTHVQALPLPRHRSSSSRVLLNWRSQSAMLALQILLSWAPRPYIRPGAPGSGDPASTEARVYPVLRGVQRLNRPAPLRVVQLQQPVGPRDAALCTCMKRGDETRVGLFGWVRGGPRPGCYIHRRAPIPLFMPAQGPQDXXXXXXXXXXXXXXXXXXXXXXXXKAAPTLRTRHRVQDVEVALLAQTARLQAPPRDVQHAQRDVLHRPVAEGGLQRQARHVGLQRFQLGGRPVCDQGGGLRLRPRVVQQAHPQRGQRGDELPGAAVGAAHLQELLQPHVREHGGQVQVPVGGGGEEARVPLQPALEEGAEGLPAHVGVLAVAVQEVHGHVQRPLRVGGEGEAGVKHEGQAAAAVRVHVGPDVQAPRLVSGGRAVAEGGVCEQRARHVLQGQPDPELLHHILLRLEVQVHLDGAGPEHHVVPQRAHLGHVLAHVAVPGRGWKVWVGGGWGGGGSVMTSATRVPPTVS

SEQ ID NO: 8853 - protein, 402 aa, Chlorella protothecoides
  MOD_RES (271)..(321): Any amino acid
MSQAEREKVLRAFRRGGISVLVATDVAARGLDIPDVDLVVHYELPQDAESFLHRSGRTGRAGKDGVAIAMFTRREAGWMKRILRETGTAGVTLITAPTAVQVMEAAARQVMTRLDGVEEEVRAFFRPVARRILASREPAEALEAALAALSGIKEVPEPRSLLTQEEGLVTLRLSGRRGRISRPAQVSAVVGGLADAAAPGGARVALGRIRMLPALSAEEREEGAAFDVPAAAAPALLAAAEASTDLAGQGLTLDMPDTLPPEEDLYGRDSXXXXXXXXXXXXXXXXXXXXXXXXXXXXXXXXXXXXXXXXXXXXXXXXXXXAARPAAAAAGTGAALRPAAPGRATAAAAIAGAAMAGTSGRAAVATVTGGPARAARAGRPLPGETPRSLGAIGEADCEVLRR

SEQ ID NO: 8854 - protein, 345 aa, Chlorella protothecoides
MEGKAKIGLAHDGQTVTLEPGGQTELSGAPLPDLHAVARETREHLLEVRKACDAVGIDYMNIGFDPKWDFEDVPRMPKTRYRYMREYMPKVGTLGHDMMFRSCTIQVNLDFESEEDMVQKFRIGLALQNVAGALFANSPFRNGAPSGYKSWRLHVWTDVDPHRCGRLPFVFDPGFSFAAYAEWALDVPMYFLYRDGQYTDVGGQPFRAFFEGRLEGHPGLFPTAADWDLHLTTVFPDVRLKQFLEMRGADGGSWEFITALPALWVGLLYDAGAQAQAAALVADWTPAELEALQADVPRLALQAPFRDGTVQDVALRMLNIARRGLEARGLGEERYLDVLDAVAGA

SEQ ID NO: 8855 - protein, 386 aa, Chlorella protothecoides
MAGHEHGAGQASALVCRQRAALGRSLPHRGRSPDHLLSTSQSASPIAPKLLGVSPGRGRPARAARAGPPVTVATAALPLVPAIAAPAIAAAAVARPGAAGRRAAPVLLRGQSVRHVQRQPLARQVGGGLGRGQQRRRGGGGHVEGGALLALLRAQRWQHADAAQGDARATGRGGVGQATDHGRDLGGAGDAATPAAQAQRDQALLLRQQAARLGHLLDARQRGQRRLQRLGGLARGQDAPRHGPEEGAHLLLHAVQARHDLARRRLHHLHRGGRGDQRDPRRPRLAQDALHPPRLAPREHGDGHAVLPGAPRAPRAVQEGLRILGQLVVYHQVHVGDVQPARRHVGGHQHGDAAAAEGAQDLFALRLAHVAVQRLWFFFVWGCRWW

SEQ ID NO: 8856 - protein, 467 aa, Chlorella protothecoides
MTSQQRQLRRGPVEMVRGSCAEAGKGSAQIGNVPPRRREWQNRPVPTSLTWLSVMGRAAILFSLQNMLGRLPVREYLDKKRDLLHTLSPKVTGALGDAVHVFGTGDWQRAYTTTSLRLRQCPWRRDHSECSPGNEYSCINNPCARFSGACNHVVRCLLSVGIIQPRGSVWRVLLERSCFKLALEWDRAIPASFSPYGILCGRAMRHTSVVQLTGAKPALGSIEPASLLTYETMVPARLLRRYKRFLGDVEVREEHSPILQFLPQLRVDAQDEDAAPSTTQAVIHVPNTGPMTGLLDELPSRVALSLSANLKRKYAHSLEWIHLQKEVRWPQLGRPHLVSISSPCTLVGLFNHCQHKRQAPSASHHSPTSQAVWVGVHSARANAMAKELLSTHCLTGLPDYDNITPGQRCDWEGLTRVEFNGWSNSSLPPLWHSCATYDAEGREGGCKQCGNASSGPPSSACKIHMSV

SEQ ID NO: 8857 - protein, 307 aa, Chlorella protothecoides
MWGRGEVMPPIPGLPLELHPSPHGHAGSCAWEGMPCLYGKGLSRPDGMQPQTPTPGHARRPCTAGRFPAGPPLTLPPPHPTLTSRPDRLPDHGRHTPAHRHPLRRRGGVPGVRAPGPAPESQVLFTLSHGRRAHWGGGALPGGRPGRGGEYTRREPAHPQVRGLGVARGLSTGMGAGDARMALPCSNLPLPIPSPPPLRSLQLLGLHSMGFSTGFERLHYLFEGSFDGPELSRKFLKVWGVGVVRPGNGLARTWCDECGGATMALQAPVGLEHTGRVLGIDPPSAISPPGHLAPWPPLLCARILMCG

SEQ ID NO: 8858 - protein, 396 aa, Chlorella protothecoides
  MOD_RES (95)..(98): Any amino acid
MRSICQRSFTSISRLTRARAGASSPAPHPQPMTGSVVKRARTAGCHQHKVGPTFSVPGLCITEHTFTLPLDYSGEGACEVASGCHMLVPTPACAXXXXPFPWTTLVRGPVRLPVAATCSCPHRLVPCAGLISGPQRHASPLPMPSRSPPWQCGCLLQGTGAQEQGQRPQPAVPAVPARCAPLSGQGGFRDVKKWCTAAGIHGRTRVRSSTTPGQHRVDQACLQLLPHRAHGGLWCSATGVLVPPLARRSPCDPWHPPPCLMRSAPHVFPSKHAGPAWHRPVEPHHPWQYREARGRGSAGPAPDALQVGVVTRALRWRCGPHCTSGGAAMPACQWRHPITCLACRADSIVADAEVIRMVLVPGTNHDGRWTVLGQSFGGFCCVTYLSLAPESEPGPV

SEQ ID NO: 8859 - protein, 359 aa, Chlorella protothecoides
MGWGRFGRGPSFGWMTQGVDAGYPHGRATKDLVRRGREAAVDSGGTALMPHGQLLRDAPSTPSNTPHISPPPRQASAKLAAAPPAPSAPAPAAPGAVIRPLRLDAQEAARRHERRARFQEELAVGARAAGVGQRETLVQARRAGAAAEGRSTALEREFLRLTALPALEDVRPPGLLAESLALVKARWVQRGRRWGTAARPSHPVASRPFPRPARGSGSGREPASHHGPPPHPTHPPAIRPAPYASTGPRLCLRVRAAQVHPPGPDRAARHLPAGGGRLRDARARGAGGGRLGRVQAVPRGPAAPLGRRRGGGRAGEQRAVPGACGVMRGGLEVARGWGVLAEGLENVHIIPIRWCLGAH

SEQ ID NO: 8860 - protein, 133 aa, Chlorella protothecoides
MWQFTDILASKEDWPTLYDVDVLEENTVPTAGVLYYEDMFVNFGLAQVGQPGDRDPGTQGGGPPGGGPPVGLAALQGIPQPPTTLASSQETANRINGMHQWVTNEYLHCGIREAGGPVFERLLNLCRGGILPR

SEQ ID NO: 8861 - protein, 378 aa, Chlorella protothecoides
  MOD_RES (203)..(206): Any amino acid
MGASRTSVSSPASSNPPASHPQVVLLLLALSLTATAHTTPRRLQSSCAAEAGCLATSCSDAFDTTNLPYTAFYTTSASADSTTFTILACSEGCSQSSSGCAPLQTLSIRLADSLLANPGAIVAQPTGTAASRCSDAGKGYRWTGAALGKLHTLTPLEVSGTGSGLDAVHAFTPDKPAIHVSGQWNSSTPYPPSSQTLQCTLKXXXXAVHAFTPDTAAIHVPGQWNSSTPYPPSSQTLQCTLKPLITTLCKQAAFCASFQLTIANTVTGTPLGLADICQANLNVLANTGTLLFNSTANPGTCLMNLATTSGAAGYILLTDAEGPQASPPAGPSPPLSPSTSPQPYSPRTPPSSVPPPSPYSPSPLPSPRASPSPKTPPS

SEQ ID NO: 8862 - protein, 517 aa, Chlorella protothecoides
MNVGDEAVQTGVAVGYSPSRPCLARPGDELLCTPFGWERDLNLIGGAVPHQFDVPSPKEPCGWTGHHRHRPRHRVRQSKDLAGQGTGRWGSTERVSKQGARQSLQPLSTPTPLKVPNFVAERWRAVCQTNAHDCGDPVGPELGQISVDKPAAGAKEASMHLSLTHSDTEGLPKTFLMNVATQNMASMAAFAQTGPCSVSAVGRVFQKFDVVVERGAAGASTSGADGVIDPEYRQLSRMRAKAAATKSRTTQLISQPQFTNLRHPMHIGTTKKRVRRVDVIVGWVMIGGRPARWRGSAAGYWLQGGWLCHMMALAQTPFNGPWATLDPTEKRLAKPAEELTADLFRLFERQPHWIFAQLQRQTEQPTQHLKVCGGSVWVKGRAMGSQRWQACTENAAAHRFHRAQGCRGAYTRCNTHCISHCALQAVLLEIAVQNKRGPYKDMWELKKGYRLTGDAVVPRIGAGAFAGIRERLGPRGKPTAVEREYVAHLCYKSHAVCGLGITHIALPRPPIDQGAKP

SEQ ID NO: 8863 - protein, 1004 aa, Chlorella protothecoides
  MOD_RES (645)..(648): Any amino acid
MSGTPPHPSPPGVVRTRATLDPGGGHEGFNPRAISIGASVESLSYSVDLNRVGLRAMRRDAGAPRHLYGYSGRTLIKLLTTVTSGVLIGLTAVALGESIESLVLLRNGALKALLPEHGARGAGALRAVLPALGLQLVVSVAAAVGAAALVQLVAPKAAGAGVTLVMAHLNGNDIPDALTARTYVVKFLGNVAARVAGLALGPEGPMIHLGACVASCLCAAEDRTLRGGAGWDPRSRMVLFPAMLLQTWPEVIVGAVWPLLDARVAPLRHPLPSREPGPGGPRVARGPRRRAELAGGHWRAERRARAKRVRAPAGRGHPAALLAAAPAPPRWGRGKRQLRPERTRQRRHAVHPPRRQPAAPVLAAGTAPPPARRALLQQRGPPRDGVRRRGGGAGGGLRRAHRRRALLAGGGLLPLVTQHRLALLPGRHGGLLHPLPAPPPWPLRHPGLRLHLRAGQPPVAAPAPLHHPRLGPGRAHGRTVQHRAWLAGGVAAQGPARRYAGALAGGGPGGGRHHARHLCSQQPVGHGGEGERWGPGSFCVCTPGRGGEGEGAIVPKQACEAGLAMQPPTPDLDALPHAPGPIVILWALPILFPPQPSSRILTITSLTAPSPLLRDHSVDTLPAIPPPSTTQVPDRAQGVGRRAAXXXXHPLGSSFPLPAKPLQHDSRHHKSFCPLPPSCETTQSTPSPQYPLRLSPRCLTVPKEWDGALLMQYTCPAGQYNDLATILLSTSVYVIRNLLGMGSRSHPVPAACGLDRPCYFSLASLCIASALYLVLMVAAASTASPGGLFMPSIMVGATLGGAAGLALHALLPADFGIKPGIFAIVCATATLGGVFRSSISLVVIVVEGTQGIEFMFGIIVAVVISNAISQLLNRDGLYEGDLERDGTVFYLRHEPPHPLRYKTAADVMASPVLGFNAVESVARVLQVLQRSTHSGFAVYDDSSGRWGVVLWWGVLWGRPQAWGQPCMMRCTPCSPNTPTPLRSGQQNPQKPTGTRCWARGGWRA

SEQ ID NO: 8864 - protein, 469 aa, Chlorella protothecoides
  MOD_RES (196)..(199): Any amino acid
MVLKVGILGGANIANKISRAINSIPDVAQVIVVGSREASKAAAFIERNKLVHASPVAGYDAVLDFPGVEAVYIPLPTALHVEWVQKAASKGLHIVLEKPIAIEDEHVDAIVKAAADANVVLFDGTMWMHHPRTAAMEAALQEIGPVWDVDSAFTFKEGLGMTQCADGMLCAASREHWQLTVRLLSLRLQRVFLSNXXXXDSPAPKLAAGKSMCKQPFAPPMQGALTSWRTMCGSRPTATPWAHWATWAGGYCRREGRGVHRLDPQYSTLSAQSCGCHAARSSIPPPAAGPSYYELAQYCVRAILWAYDFTPPTHVAAHHGALFNEAGVPLNIAATLLFPGGRKARFLAAFDTVFTSKLEVYGDRGSLRLRDFVIPTAEHEASFVMATANGLADGDTRIATVEETRTVRNAVTQEAALWQRFAREIEVVRAGGRAPEYWPRIAALTERVLSAVLASARQGCALLPFEHRA

SEQ ID NO: 8865 - protein, 289 aa, Chlorella protothecoides
  MOD_RES (148)..(150): Any amino acid
MAVHAAAPARQMGLALLTQLQSLGAVGLGVEPLFLEVGSQEAAAPIGSPSGMCAPGSGAQARIHGQPGTALDRELSFKKVAVGGTFDRLHAGHRLLLAATAAVASAEIFVGITASHLIPLWWRLGRGAQAYPWHPPPSRSPPPSAVPXXXWWRLGRGAQAHPWHPPRPLTPTFCRPAADRLLVNKQGREWLEAYEVRSGAAVGYMEATHPGVRVTAGPLLDPKEPPLATTDPSFEAIVVSEETIHGAEAINAGRAERGFAPLVVVVVGLVRGQHSSSGKLSSTDLRLDR

SEQ ID NO: 8866 - protein, 600 aa, Chlorella protothecoides
  MOD_RES (398)..(401): Any amino acid
MSSEGATDLQRLDDAPVAFALAAPARQSEARAQAQPLPLAFGEDATGRGPRADGSRAAAPPQKRSKLEELMAKRLSGPGPWLEVPGQPTAMRGLPALQHQDPALSLRQLLSQTPWRSPCLSSLPQDKLAKAHGAPSRLGGTGSAGQPPPRGQGPAAPPPRKTEAWLVEGLTVKVMSPGLKAHGYYKEKGLVLRVLDKYIGEVELFSSGAGARGRGGWGTGGRRRHRACGPGGAGKRDPHARRQRAGRAGPARGAAGAAGPHRHLGLPGRGRAGGGGAGGSGASEGALGGRGVPDPMGEDAAPGVHPWRLVSSASGCLPAAAVHRQDSMGMATQGPPSGQRRASPLRHTRDGIQPRLDGLLHGRSLGLGGPLLYRYRWGFWPPTDAKPCVSPPPLLQDXXXXSSRASTACSTAAALASADPSSTGTHGFPGLPPTPGPASRRRRLCRMKPDSVSCVTLPAAEGGGEQLQQTKAGSLRCPGCSQEPHLSSRSRPQRWRSTVSAGWLAAWLGLPRLAPWHHAGTRRAAPPRPAAPAACRGTAPDARAWLCRRGWWCGRLPALRRLHPCLPRLLWPQVRDQTPVVAEAGSQSVQFDLTHMGQKR

SEQ ID NO: 8867 - protein, 202 aa, Chlorella protothecoides
MCGKSCRDENGFKCHLTSDAHRRQMEIFGQNPDRVIEGYSEEFEESFLEHLRRAHPFSRVQATVVYNEFIADRHHVHMNSTKWLTLTEFVKYLGKKGICRPALKSSTPSGAPRMAQELLEKKRLKRERAELEESERHNKALEAQVARARASQPGERRGRACSMVCAAVMGAWSWPGSALLRACHRRAGFERALRAIGWAAAL

SEQ ID NO: 8868 - protein, 831 aa, Chlorella protothecoides
  MOD_RES (92)..(95): Any amino acid
  MOD_RES (248)..(251): Any amino acid
  MOD_RES (623)..(626): Any amino acid
  MOD_RES (695)..(698): Any amino acid
MIVCFILGSSRVAAQGCNELHPVTSPFNESAWLSCIDGVEPVVSASTPDALYDLLSNLGAADVTVVITGMHAMAVVVMGPCLLGAASLPGAXXXXGGGGSMLAGCCIPARRPTALGPAMPGRRSIAPTPPAPSSADMSLSDWALKATPVVVSQNQIVVLRAELTSLPDVTQGLPALLAAGARNLSLARLPGLFEVQTGGTLALVGLVLTHPPSAAAYTAAFPAGTIRPAGLDLYPAVLADDRAVVATXXXXGTIRPAGLDLYPAVLADDRAVVATSYTSVDFEDADCSQALINSLTFLRGSALASADAVGEVPGAPTPAYYTDEVGALTLAMVNSSSLLRLPGQFMVQVLGPSLEYCMITADGGGGDNGGGGGGGGGLPAWAIALIVVGAVAAASLAALAALILLRRRRRRRLAKHCGPVSAGVAASAGVPLGGRLRGGTSSRAPPPRPVRLAAPDGGCAPSAAPIAAGLAAEPWPGLGFRDGVEEPAPVPGLASLDAQTCDVDLDADLTRLAALQSTWRGAVASSLDLEFLETLAHNRGATVWRGRWRGSPVAIKVVEDPARAAALAAEGDLIQSLSHPNVVSVYMVCAARGFDLGAGAEEGGRPEARAAARVIVMELCDRXXXXRRREAAPSPVQQRGSSSWSSATGVPSRTACGWGAADSGAPTPHSRTRSVCVWRGREDAECLQEALPIGXXXXWRGREDAEVECCHGTRGVGEGGGVQRVGARRSKDVTNVVPARGTPHRRPVRSPRPRPPTSPARTGGAAATLHRCGDGPRLPALQRAHESMSMVWAWGSEKPSECVLTVCRLDMVRPGGWKLLARPSQDPPAAP

SEQ ID NO: 8869 - protein, 401 aa, Chlorella protothecoides
MLSNCPGTHIGSSSSASGFPFLDSATPLSPTNTAGLKTYPTYAMGGGYVLSGEVARLLVDTHERMSLKFTPIEDATVGFWVSAMDLRQIDHPRFYTWAAPCCFKAPVRKAGRRVVTRFALDPEFERGLCSDDPWLILHKIDSPTKMRHVGARAANCTRPVDGLAASIKEHYPPAAQGEGLGDGWRGGCREGGGTAMGGVTGRKRGRPRHPSPHLFAAEEIERRQRAAQQIAALEGSIEDEAVEDSADVGQADGEGGREAALRHLRERSARRQRESRDDAQSERDRARASGVEAVARMVAARRAAEGAGQVVGGAAGEAEGAGATDEQAAGGIGVNLAAAGGGGGATVDEVAAEDASAADAVAADAGKGKGAGVAVQLVGGGEGHAAVNGQGGDASQGMAAA

SEQ ID NO: 8870 - protein, 520 aa, Chlorella protothecoides
MPRGPSYNDVHPPKPQCTFTPTPFPFSPSRQARQEPSGGPTASAPWSLACRAWTSGMSRQPRWSPCCSVFGRKPQCWTPCGKPSARQTTSPAGGRMASWTGSVPTGAAAFGPGRTWTGCALSVCADGLCHQGAALHNDAGTAALAAGNPGPAFEEFTQAIRLWPSSPAYHSNRAAAALKLARFGVAAEDARDALRLDPGSARAALRLAKAQAGSRDPAAAVEAYSLALQLAEMGSPEGSTARAARRGLAAARAALESADAGRVRDRAEARRGLRAGIPRRPLDPEAAAAALESARAVVGANPGSHAAHAALAEAAIACGRWEDAGAAVAGMHPGLDADYLQAEVAWRRGDVASALTLLGQGGQSGTAAVPDDASDGSRRAAGHEAMAEGSRSAAERGSVIDGQDVTEPGSPEQPARTPGPPPLPDKMKDLAAFLAPISVLLAAADAAEEEEIQEDVADACGAALDHLLACAGDGLRAVLHARRGAARAARNSLDSALEDARAALRLAPGLAPALALQARL

SEQ ID NO: 8871 - protein, 73 aa, Chlorella protothecoides
MPALQIMAGVAHEGTRPPLPADMPPALSSLVWDCWVADPAARPDSLQILRRLRAQLASLGADLGRPRHSLPHV

SEQ ID NO: 8872 - protein, 271 aa, Chlorella protothecoides
MKPRRNGSPRPGWHRYGLAAWLPTIFMALTMLVMFHRSRMVGMGQWQPTDPSPRGTLEVLSSTLPFGEPEPDREPTDPSARGTLEVPSSTLPFEEPEPDREVEVVEGETPRPSVAEPLFLFIGILSGRGYRHRRLAVRDAWSSNATRHGAVVAKFVLSEDERTPQVEKEVDSFQDIIFVGQRTNYKSILYKTYHVLEYAVRHYDVKFVLKTDDDAFIYVAPLVAQLRALCEHPDCEGERIYMGRMAHHSEVLLQQGHKWNNDIFYNHTGGW

SEQ ID NO: 8873 - protein, 65 aa, Chlorella protothecoides
MRMVVNVTPRYAKMFAPGSKKDVIGWENIELISDRPFETMLEEFKRLKAEFPDRSGLNFVPWVVA

SEQ ID NO: 8874 - protein, 77 aa, Chlorella protothecoides
MWPAKLLVLSTLGPHRVLIASIMEEVNRASWEEIVERCQEAGADAFEINFRCGGGWDGALCRIRNREGGDSSFDISA

SEQ ID NO: 8875 - protein, 373 aa, Chlorella protothecoides
MIPPSKHMHSQALHARLQPLLLFYIDAASMIDQEDDSWDLILALAETPGGQRVVRRGGVCNALLLLWLAGQQTHAPEPGVRDPCFPEARGGAGPAGRRHGPRPGGRSAGHDGAAGLVVPPGMLVRLGLGSDAEGWQGELQVPIPCILFARHVGRSDEAHGSVPGCCLQRVPVFSCVPWLGSLQRTFHAHHPPTSQCEDPTEDLQRLRDRLDVQRARHAPWLLEAARRVSGLAPGATTALEGKGEVGEGQAAFHTTIPADITKRARQELCLCKQQAQRVWEVLLYEFLRDAKGQDGADRAMQQAIRQKLSTAISAAETGSKGEAPSCATHIAPRHPPPQARSRRKRSPASSCTSGGGETQGLASVGGQETHAYP

SEQ ID NO: 8876 - protein, 167 aa, Chlorella protothecoides
MPERRMGMAMGQDPDLLSEVCSWVNAKATVPVWAKMTPNITDIAVPAAAALRAGCEGVSAINTITSVMGVDLATLRPQPSVQGHTTPGGYSYTAVKPIALAKGLGKRPSSTASVDAAELGPFERVTFRPPVRPVPPPLLIGHVHRQGHRGGPPGRLAVGPGRGGHGK

SEQ ID NO: 8877 - protein, 208 aa, Chlorella protothecoides
  MOD_RES (7)..(10): Any amino acid
MWVDMLXXXXSRAVLSGIPYGELPAVVERGWEAVGSATGDAWLRVWRTDAGAASYLGARVPLESVVARRGAAAVRRELLVGLDPVAAFVRRLQARLDPVAVVLADLTPGAGVVGLKWRAPALQAAACPVAAAQEAGEAASGGRDAEARALGALCDALFLGAGLVRRVEVVERVLVVTGGENGVNCRTLEEAQGAPIAKRPKTTNGHRD

SEQ ID NO: 8878 - protein, 393 aa, Chlorella protothecoides
  MOD_RES (92)..(94): Any amino acid
  MOD_RES (196)..(199): Any amino acid
MREAERAERGAAHQGAEEESAEEDPDQALLVSHQGFVGGLAAEHPAFTPAVRLAKAWVARHLLSNHLGEEAVELLVAAAFVGPMRPMEGRLXXXCWWPRPSSAPRAPWKDAWWAASGTGSLSSASPLVTRDWYLPDSSAPSLRTALADSSVRAPLPSFQARPPPGCPASSPSCTSCRSTRGVSPRWRWWRWGPGDXXXXLSFLHILSEHPWSVAPLAVVALGPGGHLPAACRSPAHPLSLLVLDGEAAVHSPWTAHRPSAPVVRRLGVLARRARAALHASLVRGEAGVDACAAVFSRELHECDALLRLRPDALPAPGGGLEGAEERESPAGSATTRTVLEAECAALRTRASRAVLSGIPYGELPAVVGRCWEAVGSVTGDTWQRVWRTDAGAA

SEQ ID NO: 8879 - protein, 493 aa, Chlorella protothecoides
MPSKLCMIRSPISATSATGTRRWSRCGPRRVAPGRATGLLMWEALCVAGFSASHEGLGYYVETPSSNAPRRCWNSQLWCSFWGCLPRSHHRPPPSTPPHHQVMLKHIDLCVETKSGRKCKDALINYRNTVQGMNVGSLELVIDHLITTASARAEQAQQAAQVRACVGWGGGQGGSGGVDVWKRGTAMPSASNPFHKGTYPSPPFPGQAGGHCRPGGGCLARGDDAELRVGREVGGPHGPRTGHALVQVPVGDLPQRAGRAAQQLAAGGALRLGRGPRLCLLPGTQALHRVPAPVRHPAQPPVQPAQVRQSGGAWGWGVGEEFGERKRWEWGAERAPPGPDVVCQRLPDTNLPHGQQHRTDLSNSTSWELYMDMRFEQLRAACELELWAEAFRSVEDIQGLLALAPKGAARPRAARMATYYARLTQIFTRSGARLYNAAAWARLAAFSRAHGRLAAPEDAAALAANVVLSALAVMPYDEAGAGVSGAGAMASPD

SEQ ID NO: 8880 - protein, 413 aa, Chlorella protothecoides
  MOD_RES (98)..(101): Any amino acid
MHRLLGIVPCCACVAWVCNDSTVMHSQGACLKGGRLVKARHTCPLAALFRGCGHEGGPCPRAGVRPARGGGHQSRVYATHLPISNSPGTCHPCSGGDXXXXGRPWRRPGLEAVWVLLILAVLLAVKFTPHTCPSSIPLAHATPAVVVTLGPSCQSVDVLVELLAAGMTCARVDLTVRPCVGGLAFPAALLLRPVLAPWEELHRPPQAWGPATFHQVSLENLAKAMHVTGRLCCVWLDTTGREITVRRPAETTEDGWLHHGTPIEIKKGQVGSGDAGRVGGGAAQLLNAGAFRIWRHGEGPCAMLHSRRPRPSSSRSRPSTPAASCLPIERHADTQGRTGERDHAAHNVPWLCRRPGHWADCGGGLEGVGAWVQGGGVVGMDHSVGCKSGHQAPMMGAMQAASPSQHHHRWGVT

SEQ ID NO: 8881 - protein, 144 aa, Chlorella protothecoides
MVVGASAFRRPGCLAGWIGGSKRPCISHFTPSPTSKSIQNPPPLSLAQVTEKQDLDIVTIAQTDASLDGLLTVMAAHPNEANDAAFDMAIPIMTQHDANCIKKFGKVGGDREGLQGQRADEVWNPVGHLGLGGLILQPGLTRQL

SEQ ID NO: 8882 - protein, 330 aa, Chlorella protothecoides
MPCKQRLSGIHRYQSVFAPPARCSARECFLDLLHAYKPLPTQEYEIDYISLSYCSSVEDLTECRAFLDALGMFQTKIIAKVGIKGEQGSGVNASGCGFTGSTSMPTWTDSTLSLVLDLSSSPQDQPLISTPVKLTLTLSPNPTRAQVERKPAVRNFDAICLAADGVLISRGNLGLDYDAEVLPGIAFTRNDSRMSRLVPHIHPPRARMARTLHVSLRPPPRPAADVPAPEAAGGALQPAGQARHRDPLRGHHGQHAAPHPRGGHGCCQRGAGRCGWRAPGRRDTAGPVPRADGADSGSEFIEEQLRAQLGWGAPPSSPTLPNPGNVAKHP

SEQ ID NO: 8883 - protein, 69 aa, Chlorella protothecoides
MLAAPMSSGSDDLLSEAIGLAAENGLCKPLDYVVVITTERGALVVKIVRVGQGPWCGGQELGEKVDALL

SEQ ID NO: 8884 - protein, 453 aa, Chlorella protothecoides
MQTTSPRAKARPSKACHAWTCNSSSVQPLNASNLPGMDMPMLMLMGRVGAVGKTILMCGRCGGAKQSTRTQWCMSVLQGRWVHRALSPSTNPLGPPPPHYTTLAIPSPVSPSPCSMIRVAEWRPAAGCVIKGPNTRAAMSAGFLRLGLMRKAAKCVKTGNNRSTTHGKSRFGLTNGMPIHSSRVRACTVMDPIMSALTHAKDEHAVSYRILEGLDKICPLCCLIDAWRVRKHAGVKHAEATGHPGPMPVSVDLMRPPSDACRNTVSEYQVNPGFSTMSSSPFEAAASPGGRVVIPAPAVTPPPFPSEVREPLLTPRISSYRSQSMQPPSSWEAGTHMVKSILGVALLALPRVFSMLGIGAGSICLAAVALLAYASLHALAKASARTGVMNMSVLAREELGVTGQAVLDMALIFNCFGAWGRARRGAKGEQSALHASSSCLDCCCPWMHSRKEV

SEQ ID NO: 8885 - protein, 258 aa, Chlorella protothecoides
  MOD_RES (92)..(95): Any amino acid
MDHAWPGPSILIHSSPTPQVAQGACADRARLQVCGGADLPALHHAGRLHLPLDPAALRACLGAEVVGCNNTLSMPAEQRLLEVVNAHGWYCXXXXRGGGIQQHPLNACRAATTRGGQRPRLVLLVSPRRSVHTSSTVNTPPFPLSQMQSASSVRERQAQGVSAGAIAASTATFLLISICSYGVFGNATSADVINNYSVETLSKLLIPELAQAGRQRGPCCQHFGGPRLLDENRLTAGVASRSTQVHETVNPHNLVRPL

SEQ ID NO: 8886 - protein, 68 aa, Chlorella protothecoides
MQHSSCPEEMSDFAAFLKRVVPDAPPSLSDLQGFSVKQLKQLLSSQGISIKGMFEKQELLEAASRLAK

SEQ ID NO: 8887 - protein, 101 aa, Chlorella protothecoides
MGGKALDPEGIAESIKYVDDLIAAEVAAGTPTDRIVLGGFSQGGHIALKAFLRHEPALAGCAALSTWLEPSKMPVGREVGGERIWHSQGFPVFRNGVPCAY

SEQ ID NO: 8888 - protein, 225 aa, Chlorella protothecoides
MTGDGVNDAPALRRADIGIAMGSGTAVAKHAADMVRAEGGHMAVVPSRVGVTKAGRCLLVLADDNFATIVSAVAAGRAIFANTKQFIRYMISSNIGEVVAIFSAALVGIPECLNPVQVHVGGGRQINMTHRKAICAEYTCTQGCWMGISHEALTLRGSSPEYASQVHPLCLPLTSALRPLSYLPHPPAALGEPGDRWTAGHGHWLQQARPTDHAAATQKGQPRDR

SEQ ID NO: 8889 - protein, 161 aa, Chlorella protothecoides
MDLRVLHTAAHLSTWYGQFGFDFGRGAYNITREQVRIFWAGLGAARLSICHVGVGLHRPILTVGLCFSTLVETLLPWGTWYLLPGSCGVVWRSTSSHLCDGLQWAEAARAVHAAPLRSLVDDFHGVDDAVVGIVQRYGVRQKGEDGVRQMGPLPSRCPWHK

SEQ ID NO: 8890 - protein, 368 aa, Chlorella protothecoides
MAGAVSPPETLAGFEATVTQWLKQNGSPVTLTKMKGVSGWLLALPEGPTLQVFREEVTPSTPACDQCRILGEPWSRCRCDGATVYRFKLRSRDGRAVTLPAPICDELKPAQGPSCIPCTRLGWSPSESRTLPLHHTSRGGMVGVQGCAEWEGTQTGPGSLADPTSLAAIAAASARGRALALAQTALASPPPDDPAAQSYTAPASVFECPRHVLHGMREGSECCFACLMGWDGGSGATAQAAGGQASGCLYGAWEWVRSPPAGQWRGGAGRGGRLWAPDLWEDGHAALDAAVRPPRSHRHFHRGRLQQGALPAAGTAGESRAGVCASWPGTWHRRSRPGHGVCMSGGYSGCKHHTCRTRLCTVKERFRC

SEQ ID NO: 8891 - protein, 356 aa, Chlorella protothecoides
LGHAWSGASDGPNLDVDYAAEVEPHLGRCLGTGGFGVVHEAVWRGRRVAVKKLPPVGADAVAGTALHAALRREVELASKFDSERLVRVLGASTARPESLCLIMELMEGGNLAQRIHDRHKRRLGYLEILQVAHDVACGLAYLHPAVVHRDLKPQNILLDADGRAKLADFGISRVKDPTKSYLSQVTNDNGTPIYMAPEQLNSDAINEKVDVYALGVILNECYTRRQPWRETSNLFQIIVRVAINKERPALDPGCPEPLRWLITKCWQQEPTLRPSCAELARITELMLQVWGGAGGGSWTGRAEMGGGREGKASVCGRGRQSTQALLPPWPGAVKGVGQNWMITARGSLSQWQAVHQ

SEQ ID NO: 8892 - protein, 440 aa, Chlorella protothecoides
  MOD_RES (71)..(74): Any amino acid
  MOD_RES (372)..(375): Any amino acid
MQVPLGLIGTCRFADHTHVPLPFGNFTGSALSADPGPFTASRKTVTTPFESLDLRRCPWAAVQQHHVSTGXXXXVPLGLIGTCKFADHTRVPLPFGNFTGPALSADPGPFTASRKTVTTPFESLDLRRCPWAAAQQQHVSTRVDTGAAPCPGHASTACTSRHGKEPPGTLHSPATLAADALRRWQGRQWTVYRGQAYDLAPWFGRHPGGGWLARLAVHRDCTALLESNHVRVDRAAAALGSLPRLPDFPAWAVPVTPRPLDSPFLSAVRARVRCEVLQPLGAEAAGGGPGPGRSLFLPGAEESLVAAGAALLAAAGAYAWHCRACSLASGCLLGMAGAWVGTAVQHGGNHGSMSQRPGINLAAGAAADLIGXXXXLGMAGAWVGMAVQHGGNHGSMSRRPGINLAAGAAADLIGGASVAWRSVEGGGLALPCGPGMGRRG

SEQ ID NO: 8893 - protein, 635 aa, Chlorella protothecoides
MVIVVDVTQAWNDAWVEAGDEDETWLYGLLAATLGALGGCVALAALCFHFFAPASQDCSLNLTLISLTLVLVVVMALTSFHPAVEAGSLFPAAAVGLYVSYMGYSALQSEPRDYACNGLGARLGAASGATLAGGMLLTLLSVVYSAFRAGSNTQTFAGAWAGGNGAGAEPLLAGDAELTSAGLDGVAPAAPRGMDRGGAGEGAALPARAQEEDAPVPYCYAQFYAVFALASMYIAMLMTGWGATGQPKASDAAAGCSVGSGGGGLVWLFVGDGSGMAVMGGWEVRRIGDEFVLSARRHRAGLAVGSARLCWGPVMCEVGRDRNCDVSSRPAPSSAFLRPHAADPAAAVSWAPSPQPPLSWVPFPLQTPLSNVCHDHDSHSCSPPTHRMPWTWAGHRCGSRSSRSGWRQRSTAGRSWPPPSFQTGSLADAERVACLGKRRRGMSRSACGWWKGPPITPPILGCTSPRRSASEGGRCVSVSPKDPEGMTKRPACTHAPSHGGKEGHRRCDSAALPVRSEAVLARAVALLEVNLPAHAPARQRGGRVACVGGAQRSSESVRRRGGGPWHPQATAMGRPVRFRTHGHRPAIPYGCIHCPAHDLIPGWCPSPPPSPPTPYPAHSPEYPSVLGPPKPPPPW

SEQ ID NO: 8894 - protein, 510 aa, Chlorella protothecoides
MGDGWSSQSETARVQVDSAMSRGGAGCRADRSCASPPSSPAPGCRRGAGREEQGEEALSDVFYNRYTGSKVSLTVARGWCTASGAKETRNFLTRFPRLMRYTAWAPNHSSEGMEPLLKDLTIPASGGGMGVLRDWDLAPLGLCHAQLLHHPPLNASPHRSPRTWDLHEQGLGKVAQDPCQDHGQREEEAPGQPRAPHHGLPRRAGAHRASACRGSAGYAGAQRSDEEHEAQSPVPRRLQRRPLETKGGEGLSALTTEESAGVAQAAQAAQPQHQKIALLKIEGERGGGFSSRAHPRSGGKLRGEGPGVVCAGVGKVVVQVLDGALPRYDGLDEEAKHGEHGQPPTLASGPAVHAVALHRAHEQHLDRQGGDDGPGVDQAGDAQVLEAVGGEDLGAGLEPGDVVGAVQELGDDAAQRAQQGPAGVDHLDLAVAGKGLGVGGQTCRIPAVVACGVCVCVCGGGWRVTGLEDGRLVQGPMVLIRSEDRVQGGLSAGMTPKGNQNTCHPGTRYA

SEQ ID NO: 8895 - protein, 351 aa, Chlorella protothecoides
MGGSAGGGLHAMLAQAAYQARLAGSASFGSLEGGAGAGPGGGLLRVPSGQALGAQYHQAGPGDAGARYHHQAGAGGDAFGSYGHGLDALGGGAYAPGYSQDLARTASDALASSWMGGGGGSLHGGGSLQYGSGLLHGGGGGSMHGGAGGSLHGGGSVHGGTSVHAGGSMHGGSSMQHGGGGSMHGPASARAGPRIFVGKLNKDTSEADVKDYFGTFGFVMDVYLPRDRANKREHRGFGFVTFETEASIQRVVAHGAHQIRGAFVAIDAAVPRQVFVCEGVGGCRALLLVVAVVAILWEGDEGGQGGRPPDEDPLPPRQSSCMELLAPPNPPPPAHPHRRRSCRRARARQAA

SEQ ID NO: 8896 - protein, 215 aa, Chlorella protothecoides
MPEHALPPPHPTPPLLTPRFTAHHPTARQLTEEETEYKVDAVAHVLADRVVLAFTVVNTVAEQVLEGVSVDLGLEEGWQLEASLPLASAPHDVPGTAYAVLRRPPGAALPATRLGCTLRFVVKEIDPGLGEPEEEGYEDEYSLEDLELGLGCFVAGAPAPAGFRALWDSLPEDSERVDDYALGARESLADAARALGELFNGFAPVDGSDAVPPGA

SEQ ID NO: 8897 - protein, 493 aa, Chlorella protothecoides
  MOD_RES (240)..(288): Any amino acid
  MOD_RES (332)..(335): Any amino acid
  MOD_RES (442)..(445): Any amino acid
MRSPLPAARSNDPSRPHRVHPFQSSPPCQLSEIAREVEGAPEELRETLTGMDSAAAVRQRHRLAAREAVEEDLMLRVPLSREEGKAQRAARRAGLAGAALLDDFREDVASVLEGGLGGDFQRHRTGQRWGGDASAAGAARPRSGDADLPAREPLAKRRAAFDSVAAKKAQRTSGEKSAGGELARTEDEFYASVKASKGEGVRELVLGVPGCKHCTGAIILGRREVAFATGDGLVCTPGVXXXXXXXXXXXXXXXXXXXXXXXXXXXXXXXXXXXXXXXXXXXXXXXXXGAREAVWHLPAAWIVMVERLGDRWTSAKPVHASSGVRLFGQSLXXXXGHERLFGICPLHGLWWLRGLAIGGQECQACACQFGCAAAWSVPQNLIALCHPFAPCSHREESRVHPAPASGSQEPAQEEQVWGPVAKRPPVAHWIKFNEATVRRKGXXXXQMPNSLSCPSPVVIPRAPGAWGSSSGTWVSGYLYASFATRRASAASQR

SEQ ID NO: 8898 - protein, 635 aa, Chlorella protothecoides
MTLLDVTKEELDSKRLPSDWLPDVTPERWASDYCEVRLHATRHRMRGVGQSRKGKANQQEVSRLSFMSLFVHQSTREENVLALAECRGICVVDALPSQNAEPSMPQQAARNPPCRMVFHMARAPPKRGKSAPRKGRAPQAEPPKDSDGSESEELAMHGEEDEVSDVESIEDAVFDIDAASDDDSEDEEFAADERYAALARQAKTLEAKLRIARGEKDEGESGSDEEEEEGKHGEGRWGNKRAYYDADNIDLEVRAGVVVAWGASSRRFTLRRLLEPCMMLGGTVWDTGVQFKDAVCVATRLAVHRCSAPNTPQPAPLTRLLLPKGSEEEDALQEEEEEARRLQSAAVSGLDPEDYGVAEGGDSPSSSEDGSEGEGAGDVEFVPRDIAGLTEAERAAAAAQAAPELAGLLADLRGSLAEVRHRVGPLLKEVREGELATAEGLSYLEAKHLLLLQYCIGIVVYLLLKAEGRQVAGHPVIARLVEIKAYLERVRPIDKRLRHQMDKLLAAAGAVAGAGPGSLAHGPRPEALLAEGDAPAAAASEGGEELLAAAEEEAAEQARVGGTGLYRPPRLNPVSMEMEEGRATERQERHLVHKARRAGRSTLVSRGKEGWMCDGEGGVYGRVWSFVVVWGADVE

SEQ ID NO: 8899 - protein, 241 aa, Chlorella protothecoides
MSLNPFASDWTPGRGKYSAPTQSRDIRSRSKIDANAGKPADPSPFTNTTASPIPMPSPTLGRSQPSLDREGELDFDVGFDSIPEATSGPSTPSGSHEADAGGILSVLSNTSGPQPRPRFPSLVQLVGPSALPSRCTSVEPSPGKAISLLRATEDVLPPEPVVESTAYVSEATTHAETRTSAQASTSGRKLGPADFELLRVVGQGAFGKVFQVRKRDTQEIFAMKVSTAWGCCLPAAVPSSV

SEQ ID NO: 8900 - protein, 1173 aa, Chlorella protothecoides
  MOD_RES (272)..(274): Any amino acid
  MOD_RES (673)..(676): Any amino acid
  MOD_RES (938)..(940): Any amino acid
  MOD_RES (964)..(967): Any amino acid
  MOD_RES (993)..(996): Any amino acid
MDKLRELLASKKKAAEAEFGGKKYLKRSELEELRLRKLREEEEAERARKVRRIEHWLGWAIASYDTCGLELKCDGIPCGLRAPNDSQEDASPASVPADAAGKDGEATASTSKPRPSSRQDKAAAAGSRTGLQTDTPQLTREEVIRRLRRLKEPATLFGESDEARAERLAEAQRTLTVDDETEGGQQANFNIEFARQQRAAKKARRTGEGGTAGPEEAAAPAGAELDPEQQDPPLLGPCPGASGPSLAASAAAHGFPTGHCNPQVHPLTPLPXXXVLVPLALMASFRAAADSLAATNLPLEDRLARRLRSWCADWEADLEARSEEDQASPAGYQATLRYRETVQYLRPLFARLRNRSLEPEMLAGLKMIVEAMAERNYLHAYKIYMGLAIGNSPWPIGVTQVGLHERSAREKISFKSSMSTTVPIVTDCGIQCWPFLPRVHGKVVYRLFAKLSSGYFDASHRRYPTDPSRSVDFDGGSSQGRGAMGGGSDKLALLEALSKGESVAPAPAPSVMEGNAVKIPPRWEHQIRAAMKDVAKQCLERGPGARVPDRAPPGLGKPSEFTPLSALEACSTLSHDAWSGIPAHNDACTPRCLVCQLQVGQQRGCHIGETHKQIVIDAQGSITGSDARRVLGAGQRWKLDVRGGVGSRVTLCRDSLYDWRKGKLCSHSCQAPXXXXLDVCPDAVKVLHTLHVAHAGQEGRRHLALLQQAPVDGPEKGVRLDVRAASGAIPEAFGGVLLEQGLDQVGGGRAQVACSRIWAPKVSRWFLAGDWEPVVNNPPFPAEAVQASQQPPSCSRLASTPHMSPSTGPPPPPSSLSPTRQFELGGGDGLLEGRTRLSAEGRHPAQHLMQQDAHTPPVHSLAMPMAQDDLRRHVLHGADEGVAALVLLVPHAPLGQPKVGDTQVARGVQQHILRLQVPGGWVRGSSMVRRRTIMGTAXXXASGPWGMGERQLHGEKDDDDGHQXXXXTGGRGAARRRGSDAPGPEQSLAFHFXXXXSTHHPCPPPKHPYHTCTPVHKSEAVGDGQHDLGGVQACLRLVKCPRAIQLEEEVPAVDEVQDQVQLERGLRRGGMERAALTGGRGAARRQGSDAPGPGQPLAFHLTCWEQPSGTLTPVSSYPHHFSASPSSTRGTPPGKSSGGSTGEVETAVGQAEGLLHLQKLCLVDFIIADGHRR

SEQ ID NO: 8901 - protein, 517 aa, Chlorella protothecoides
MGNFPDTLESLHTKIYAEDARQQSAMRSVKIHMGQKLGAVDASMSLPSPLQLPRAPGWRSGIPVYVFRTLPCQVINKSGRSRAQPCRARKTGEQSRIEWWMTPIACAALARYHRHPATEGSFEDVSEGPPRPPPLVGGSSSTAEGRERSHGDPPSPRESSSSGIQLPSWVDRDDLNTVAIAVVVSYAIRWWVKAHVISMHGWRIMLAMSLRHAGLLSMLQHSQQPQSGLPSTTRRFVAEPRFIPSLSMYPTFEVGDRFVAEKLTYRFAHPPTAGDIVIFRPPKGIGGNGGWLDDNVFVKRVVAVAGTRQSKGLCSWGPCIAVICAVRGLDRLRTSLQRFSGGSSRASHALQSSPACSRGGPWPPGHTIAPCMGFRFLVPMSHQSLPSGDTVEVKKGALFVNGEERVEEYLAERPAYEMESLTVPPRQQGWALIASVLPLSQSPSPPSSPIPSHVFVMGDNRNNSYDSHLWGPLPLENVVGRAVWKYWPLQEFGPVDRTFTRSGTGLAGELAAPPLKG

SEQ ID NO: 8902 - protein, 229 aa, Chlorella protothecoides
  MOD_RES (224)..(227): Any amino acid
MTLTGAPPLFQQTMQPCQGVTIHDMGHKMGCNGVVSWELQGVGTQVGTCEDQPDRMAWGGRELAPSAAQQASCLFAQQIPPSPLSSPPQDNGKLWFNNVRVPRSAMLDAFSQVARDGTLTSKIPRARDRFLKVADQLLRCGGQGREWEVWVRAGLPLLGLRWDESVRAGCGALCAVCRWFSHGSSLRGDLLPWRASSTPNHPSRPSHCSNSGRICIASMMLSGXXXXWG

SEQ ID NO: 8903 - protein, 503 aa, Chlorella protothecoides
MPCVLCAADSVMVHRSGHDAERGENGADHRHAVCKHPPGRRTHVSRGERGVERESRGVEDVKESGFTLRQWVRRRSQDLAGRRGGWLHPECFTQLPPVVSLDRLPPGFAVGRATHPFWSTSCSRGPWHPSWPPPLPSTSGSTMPQHSTQLQNGHLTVKERWSAASGFGDRLIPADEAREVITLVCSIKPLCGWNTEETATTCRERCGGQGPIVCPRLNATAALNLPSLSAPPHPLRDVSLPPPHLPTSKGLPELQPVWLHHRLCTRRHHGGGRQSSALHKGRQGADRQPARARGQGTAGSREEAAGRHRRQVGCSCRVRRASGEMCRCWHASPHPNTSLRHPPGITPTTHPAPNSLQPVRPRGPAGPLHGARRPASGRAGQRNVGPGLQRGGVRRVDATRVRRCAGHRDRVRGAGGAGRVRACAARRLARRAPTAGALRHAVRAVPAGGRPGLADDGGHGAAPRGRGGAGRSARPVRRAGAGLWHAGAGARRAGAPHRRAHRG

SEQ ID NO: 8904 - protein, 231 aa, Chlorella protothecoides
MWRLKRSGEFKCTAAVRCRVIALKGCEGWAYRRLALQKHPDKNPDNPNAASEFAALQKAYELLCDGDARAALDNFLRNTMHGVWFAFHTCIALEIMTLLQLVSQWFSRACAARIVRTATKDAKRQKMMADLEAREAAGETQRSQVEAARARLAEEVAKLRRRAAEREAAERARTVREQEPAAQAGAAEVAGLDAEDLASASLQERLARTVKASWARSVRAGMGLGEFHLAT

SEQ ID NO: 8905 - protein, 231 aa, Chlorella protothecoides
MAQDGEYSAEELRLVFGRQGAVEDVVLRGGSKKKGSAWVVMASREGAAAAAPSLNGSASRPLLVVPLARIRADGVGRADARNGESPSGAVPGPWSAMDGGDAGRAGTGLSSAQLWAQFDAMLASATLPSSGPGRPLFAAGAAFHQIPQQSTLFPAAGGAASGRAPSPQVQFPAFQSRSYKAQDHDGAQAAAAAAGFPRHEEAILAKLRQAAERKRLAQDLQRQELEEQEKG

SEQ ID NO: 8906 - protein, 105 aa, Chlorella protothecoides
MERQRLPRPRSVRALAPRRASSSCQRCSLHSPPPQTPLKLYLVLDFINGGHLFFQLYRAGTFDEAQARLYTAEIVLAIAHLHSLGFVHRCACVVGVLGRGTGVVC

SEQ ID NO: 8907 - protein, 197 aa, Chlorella protothecoides
MGDEEHQRSNSFIGTMEYMAPEVILGHGHGKAVDWWSVGILLHEMLCGVPPFRAKSRPALQKAITTAKFKLPSYLSTPAANLVKALLQKDPTKRLGYGPAGSADIKAHPFFRSINWGLLEQRKVASPFLPSVSHVESVENFDRIWTDLPPQDSPCVTPRDGSLSVDDNLFVGFTYVAPSLLANLKLADLPKNPESRS

SEQ ID NO: 8908 - protein, 77 aa, Chlorella protothecoides
MEDSTARRISQLAQHLGDPGGAGALTRALTSAAGGQVQHEIQMLLEHDSHAERQKMKDLMNTDLFTPCVTGVGGGHT

SEQ ID NO: 8909 - protein, 451 aa, Chlorella protothecoides
  MOD_RES (150)..(153): Any amino acid
MATIGSSHIIYTPWHRATSRLLPPQSRATALPAMVRSLWTLAGKDSAEGEASVHAGQELASDQHLETAGPKSKVDEPLSAASGHAHGAAEGSEAGVTVVAEQPLRGPAGIVQPELKEAAKSGLEAALLGVEGIGPATFKEEGAGPAPSAXXXXIGPATFKEEEAGAAPPAEAAGQSMPDGKEGDPPADAPASGGLTRQPLQQSAPDAKTASIDPSPSCDLPDALASPAPPPPGTEAAPGGPTPTAGPFLPPPPSAPFQVPDSLAHHPEGLVRLAWEVRDALGLGRGQAAHLRTLMRTGLLAGRSVRFQTKNGRVLLTGRVDGAGQVVCGCRACAGAACVSPSEFEEHSGSRDRRPADGIFLDDFDVSIKTLLGIVNSAELAAAAADLHADACHACALGGDLLCCDACTSAWHLACAELDAVPPGDWLCRLCVADGVVLPARGGAGGGGGAD

SEQ ID NO: 8910 - protein, 686 aa, Chlorella protothecoides
  MOD_RES (382)..(385): Any amino acid
  MOD_RES (628)..(631): Any amino acid
MRALSGGAANSPMLRCPGHLISPVQGQNAQLSAKVQSTTTPWWAGTGHGKASGFRECGEQLLSSGCPDLRRPDWHLSQLPGEVRGYFRYGMGPCKVRSGMSVPLLRTSAREAFARAGGQVLRGMSPRTGQSLPVRQPRRELGGDSLPFFAPQCKHRFDYVNTVSYTKPWSWQCRNTPTPTTPSQVPPELPEPALGINFARDGMDRRDWLSLIAVHSDSWLISMAYFNAARLDAEGRDGKQTSLEHARVLDLGHMAKRAPWSMHAFLTWVVRLSFHSQAFSQYHTPPLARRRLLFNEINSLPTCLEVVTGSAAPGSTTQAAAHISKRPAGVPQADPAPDTKRPAFHPAVSLAVALGQTVCGAACLLHSLLQPVALAPTLYPRXXXXWCWAKPCAALLVCCTRCSGRWHWLPLCTPACSENVFALPPQANQGRPRQGPPPSSAAEESSGSEDAEEAEYEPCPNCGREFKWSCSGMGLSPCTTWRQPNGGSKCIRNQGRRLLDLLRLLPALVRREVCGHDGAACRGLQDVEVPLLYQGGIAKHGWLDGAAPAAAAGPPAEQTELCTWVCRAASRQRPSLSSSVRGDRRPLLRGGGRAPPAPQQHVGGVARRHVDETAGGGKGGCTACLVAXXXXPPIPGKTRFSQARGSPPRCSAPFMICSTVTASLKGRPGSSLGVRRKHWGVPGLRM

SEQ ID NO: 8911 - protein, 235 aa, Chlorella protothecoides
  MOD_RES (137)..(140): Any amino acid
MHLTPRTQVGCAGEVVLRETEQDFEGYAVEIRVKFRESQQLETLDAHRQSGGERSVSTILYLIALQVCAGGGLTCLPGRLPRWNRWPCLAAGGAGPDQGPSLVLGHRRSWHPAATASPEPGSPSNPSPLIIPHAAHXXXXRSWHPAATATPEPGSPSKPSSLIIPHAAHACPGNHGGPLPRSGRDQPGHGSYQRAQGVHAARGGGKQVRWPLFWFWMRLWWVEGGSASLQLRPGH

SEQ ID NO: 8912 - protein, 693 aa, Chlorella protothecoides
  MOD_RES (312)..(328): Any amino acid
  MOD_RES (684)..(686): Any amino acid
MRGCRGASTYWTAGYCTKMNLPASAEEGRKAVPQGGHGHADEDGDTSEPWRLQNLHNKLTISQAIKQGDKRFDFWQRDGPWERMEQFPKYSNARPSALEHAVTRQMTRKKCNVVKGWSVMRGGQSPIWTRSAVSARGGIQLRTAIHFEFPSASPMTIVHDVLPVAVDKHDLIIQLRCLGPTGARGAYSTCWCSSDAQLAMGAGMTLNEVQKQKRSPSQLGLNGYMESDLQPWHLTTICLRRRSSEVVSCVVAGWKMSMHRSKSPESRQITRSADLAPYSSEAAPQGVEMGEEPAHSRYAQHITEVYMFAFLXXXXXXXXXXXXXXXXXQGRRAWCRLEGGTQGLHGRKGWGGWHRDLAPQPDNGLAASSPCASQTYKHAVFNPGPQLNLVLGPNGRSVTQTLMACTPQELGKAPWCALCASASAERQGWVPVCKPDPAWCLGVQGMPAHPNQCARRKPLSHQSANLIPPISPNPQLLGRADEVSNYVRRGADKGWVKITLAGGPEGRETLIQRIMYSSKNSSDWSINGAGVVGGRKTMQGVPEPGCAGKGGLAQHPPGQLVPGDVWGGWGEVLRIGHSGPRPSSPREMHAAAMCSPEPASASHKRLHTSDDLPSAPPQFLPQDKVVEFARLNPQALLRATQASIGEDSLTTAHDRLIQGRKDAARLESVSGGAAPGLNPSTPTXXXTRRGSRA

SEQ ID NO: 8913 - protein, 769 aa, Chlorella protothecoides
  MOD_RES (17)..(20): Any amino acid
  MOD_RES (265)..(268): Any amino acid
  MOD_RES (619)..(621): Any amino acid
MQMGSCQARPHPSTHRXXXXSGAAGGRPGVWRAPTRLRFEQMCVWVRREVDDGQRMISRAGILGVAPWRWAAAQRGHTLQLTGACRDERLHVGLRVRGRRQQGVICAVHIEYLPPDEVGAGGLPLLLLGRGRGCRGGQCSHPLWVEACLRPVCHRGKLIWGKARARMAVEPLGTEGSTPHRRRGATEQRYAGLAWRCNPSEKRGTPLTGEEERQGSDTQVCRGAGCNYRRKEWRMSSECPMLIEPSTVGVNLLMLLTHHAQVSVXXXXSPGAPMAIGTSTRVTTWHALVLGRQTLTAVELEFQLDRISPCAQRSPNSDRRDKPLLNLGRQEHPPLTLSNMAAPMVEIQTSMGSFTVELYERQAPRTVQNFIGLAIKGYYDGTVVSNEGRHVSGHADCHACCFHRLLSWLSVPTCLHGGTPGGDPTGTGRGGTSVFGGKFEDEVTRELKHTGAGILSMANSGPNTNGSQAAVACCAHEDIWHHAAESSMQAEVAREVIHHVPHRPTFTLPVQPPVLHHTSPNTASGRQAHHLWPCEQWDGGDQAVGQCADRCRRPPIGRGADHQGPASLKLKGPASLKVKGEMSLSLFLRELELRLGTVGSAFKERWSSINHIRQASSVXXXRVDGGTTSSSLASTSEAAAQMAPGGERTLAQAQREGAAIGEHACSGTVAAIWARRLRNDGALSTTSNKPAQLRCPDVASMPMDEPAGLQQPAKVLEDQGTTQGGRGQGGAEAGEDTAHPGRAERAGWGGVRRSGAGGKSQLLLWGPAG

SEQ ID NO: 8914 - protein, 171 aa, Chlorella protothecoides
MIVTLQGELPARCLVQVSSRVVFLGAQASHLRARPCFPRGRIRQMDGLKQEAGEKIRRVMQLTRELEAVRQMFHEAYKTGDDALFAQFPDDLLELTEHQQTLETELAGLVITNPGAWEEYQLREDQIASQERELEGMQAQLSACDAELQSVQVRGVLAGGSWPAHALSNSL

SEQ ID NO: 8915 - protein, 408 aa, Chlorella protothecoides
MDDTRKEHSLQALQDVHLQRAVFRKRKAALLRRVVELSILCECEVALLLFTKDDELVQYSSCGMEHMLRKFGKACTTPHEVLTTENVSISFWVGPGSSHEPFKGKEAETCICQSPPCQPLSGIPPYAAEVRFNYSLWRQEGITIGAPGTACHGNINESPRTLKAYGQIYREFDILIQGHPPSTQPLPLLAAAATSRDVAAGSGSDPVPDSAVDSLAHDDEVPISKDNSRISPTPSSYQDQSVPNAPGMQLEERSASAARGLDGIKPDEQPEQELHCIRDAKAKASSAAGQCVYPVEACGSVETLQHGAAQDPAVPSCKRRDWPTSIEQGPPLREVAPSLSTPTIGPGLSAQLGSSEGLCLPIAMPWRCLRRNRDRSDASAQRAAFDEANSGRYVSILPAILPAIECDL

SEQ ID NO: 8916 - protein, 414 aa, Chlorella protothecoides
  MOD_RES (96)..(99): Any amino acid
MASGHRPPEGPGEASHGWGALFLGMVHFEVLVLSLLISLYFLANDVQDTPCNVPDDQLCGWGDPCNVRVGVRGCWDLLRGRHLSVSMNRAVPVGCXXXXAAGTSSEADKCPSRRTEPYLLAVRPAGRSLGGIQTGFDLPLPQSCGEVLHPVIVSLRGHALYRRVQAYSLGSERWAVDARPAPYREDASTPTLPCLQSNPDAITHSIKLIQKNVIRSCLETPPLALVLPMRSCARVVVARCVGAASQPIKSICTDIHTLTGQPAHKAAQRSVQRRDMRRDDLRDTGYLQRHFSSSAMLNEDSGSDGGLQLTDNAVQRLQELQRESPEGPLFLRLTVEGGGCSGFQYEFSLGSSLKPEDRIFERNGVQVVSDDISLDFLKGAVVDFETDLMRSGFVVAGNPNAASSCGCGSSFVAK

SEQ ID NO: 8917 - protein, 669 aa, Chlorella protothecoides
  MOD_RES (27)..(30): Any amino acid
  MOD_RES (453)..(456): Any amino acid
  MOD_RES (554)..(557): Any amino acid
MATTSLATQVSTWRRQPHALSAHPARXXXXHRSPLGVGNRTLSLHTLLDHDAVEEPLRQLRLSGGHGPATKLDASRHQDSPKKKSQPVTFWARKQEVIDGVNDLIEELKDIDSSIANQVTAWDEARCFLDLAWTFMGRWLGNLVPDSLRSGVTLPQVVTLYSVATQAVEHIHANEVILTFGYSRTVLQFLKRAREKRFFQAVVAEAAPTYEGQRMARELAALGIQTTAISDSAIYAMMARVNKPPGRHRQYSPHGTQQVVVTAHALLADGGIMAPIGMHLVAMAAKHHAVPFVVLVGIYKLTPLFAHEPGLNFNELKSPASILPYNDEALLAAGTALLWTLEHIAHHNRSHRVQCSTCSRCDSSFTRADSSSCLDAESGLEFDVDDSVSTSHPYLQVHNPSFDYVPPALISLFITGEVDRRDLHIVFWGTVTPANAMGRGNHIDQIPCTSHPXXXXFLGNRHACKCNGERQTMSIRFHARPIPLLRSRTRLHAKLCVQTAVRVGESSSEAFLRVATRGSQIRKSSLQHNTDHRLNKNSEEYSTIVPAAVVCALXXXXEQAIACGVGSTSHSKAQHLIHGTKRARGPFKSSTLAMLKAAHAAASLYRISPQAQRKNRALPIIMSSHGMSSCKSLASGIRTVTQGPKVQTLMRIVGQQSIAEGDDKAAHIW

SEQ ID NO: 8918 - protein, 132 aa, Chlorella protothecoides
MHLNCSGACEAAFALKRSGGAIRRALFRLERGVCTNPQCKLDCHALVTRLQIIEKGSAGKAEAIAVHIQPPLRISRWEQRRREVLQRLAPSFLHHGNKTLLDSLIRSAVEGNAWHADHVIPVYQVRQQGVAV

SEQ ID NO: 8919 - protein, 98 aa, Chlorella protothecoides
MKSDAKPFRSFEVDEGHPIVSLSWSPSGDAFLAVTGSPQPKVYNREGKEQGQFVRGDMYIGDQKNTKGHVAGCTGGQWHPVDKLPLMCAHRSSCWLAA

SEQ ID NO: 8920 - protein, 65 aa, Chlorella protothecoides
MTCSSDGTVRVWDMDQLVQKTVIKPQLAKPGRVQVTAACYGSTGHVVAAGLMDGTIQLWDVRGGW

SEQ ID NO: 8921 - protein, 417 aa, Chlorella protothecoides
MLRSLLLTRKAAGGLAACRPGVPLLSIRGFASSEEQALLHSSHMFHEAQHTFAHHGIKVSGLEVDVAQMMAQKGAASKAVWPTLRTFAPGAPPRLQTKAVTGLTKGIEGLFKKNKVTYVKGWGSLKSGNEVEVAGADGETSTIKAKNILIATGSEVTPLRGVEIDEEKVVSSTGILELKEVPKKLVVVGGGIIGLEMGSVWARLGAEDGEVRKLFERTLKKAGFKIKLSTKVVSADTSGEGVKLTVEPAKGGDQETLEADIVLVATGRRPFTKGLGLENVGVEVDERGRIKGTAQLAPAPVPTRRGSLPPAVQVDDHFRSNVSSVLAIGDVIPGPMLAHKAEEDGVAAAEILAGKNGHVNYANVPSVMYTWPEVASVGITEEQAKADGLDYKEEAILMLGAWGHARGNWAPSYQHGA

SEQ ID NO: 8922 - protein, 228 aa, Chlorella protothecoides
MNQQVGTTDRNRDAHGLASVTSERGGGPKILVFVHHKAVMAGLADAMEGAGGAESVPYVRIDGDTDAEDRRQAAAQFQRNPRIRVALLSLLAAGVYWCCVGRVLSSRSGCGLEQHLTLPQCSSYPANSAELPDEVGILWQAEARAHRQGLCWPGSSDEQRWQRLHRSLARVNAVHDGVEQITPPPGAGTGVHAWDGDPLQPTPGPSHASTDEASGVPPPGDDRVKMMG

SEQ ID NO: 8923 - protein, 179 aa, Chlorella protothecoides
MELLLPAGDGGPSPSALLWERLKIYCAQAGWCEKRRDVATPVQSSSAQTVVLPGIGLVALQPWVTPGILKAALAGAQAFVAEWRELRAVHAARLADAILGLPLSEAVAGLEASFLTTGMYGLGTSRYLDAQKGEAPPAGSEWRTVTVVHRQCAEKVEMDALCLCPAPRLSGLDSELPRL

SEQ ID NO: 8924 - protein, 114 aa, Chlorella protothecoides
MYREPMPGQRKRKTAESDAAENKQKHKPDLGSAAPGMGAGGKLGSTGGTLLTQYVLKTHGLLKNPLDEDVRASILRHADKADEYSLFTAAYKSTQPDKIYAEEEKDEEDEEEQK

SEQ ID NO: 8925 - protein, 134 aa, Chlorella protothecoides
MCTQVDALRPGMLGDTRQQYAGLYCARRIVRSRTRGGEETTHVDNSGLRRAEELHRLLRYAVMLRRLKREVLAQLPPKRRQVVRLPRLRAKPGRAGEGAGDDEGCQARSAAQATGAGCGTVSVCQTRWLQGLWV

SEQ ID NO: 8926 - protein, 100 aa, Chlorella protothecoides
MPSILPHTQVGKFPFMANSRAKTIEDTDGMVKFISDAKTDKILGAHIMGPNAGELIQECVLALEYGASTEDIGRTCHAHPTMSEAIKEAAMATYGKPIHM

SEQ ID NO: 8927 - protein, 293 aa, Chlorella protothecoides
MGLAWAISEHLMNAIGCPTLFATHFHELTALRGAGGVKNLHVGAAIDHASGALTMLYQVEEGSCDKSFGIHVAEFARFPPAIVEAARKAAAAAASDKHQVWGDTEISVQLCHMQRCGMQRAWCARPLHDTCASADSEVSASKRQKAGSDAALQAALLEFAELPLEGGAESGRAREALTSWQGRAAALLKELEALPGRGELGEHAVDFTEHFPSQRIGKDKREANVPRALGGPIAEDRTRGKTRKANVPRSARASARAGLPGAAERPLRDMIPWPSGPVNSRRNIAMTPAEIER

SEQ ID NO: 8928 - protein, 541 aa, Chlorella protothecoides
  MOD_RES (191)..(194): Any amino acid
  MOD_RES (352)..(355): Any amino acid
  MOD_RES (443)..(446): Any amino acid
MGASFAWSEDLAGPRLPLVWGLCSVRTGVKGRVSPKTQNLRTGPASTSRTPSLEFQPSFARSCTPTPGRRWCLWRPPSARCGSRCAAYSLSWTSWWRLRTSLSPPPGPTSGPPCCPPTVRSGVFGMAVAPELCSARLGSGRCASFHGSCGTLAACMHLGQDMGDNQCAWIPRPSRGASQPSSLDPWYAHTXXXXYAPRPRHGRRSVCLDSSAKRGGGASQPSSLDPWYAHTALATPASWSAATVIHTQALRLTAGGRVELVGCRHPCVELQEGVDFIPNDCVMQRGESWFQIITGPNMGGKSTFIRQVCGRGGGSDPATLGRGTDAVTRWMQCLGDRALGGGIGSLRAAALXXXXATLGRGTDAATRWMQCLGDRALGGGIGRLRAAALGTPCSPWPGLASGRSDVSSSPSPVRPLSFRPQQPACRVAAPQEPNPILKRPTPXXXXLSFRPQQPACQVAAPQEPTPRLKRPTPRVMQVGISVLLAQVGSWVPCTQASIAVRDAIFARVGAGDSQARGVSTFMAEMLESAAILKVRGEGGGP

SEQ ID NO: 8929 - protein, 303 aa, Chlorella protothecoides
MQGREQGFESRGVMNCAMLRRAGIQVPFHKGSVPPVLRAAEWHEGCAPWLARTPMDRVSVKRNDKAAAWRDKLRSECLARVREQRQSILDKLRASREETPAGGRASLNLILHNALDSRKNGDRSLAMDYTLPGPEYEELMQSLEEALWQDATALGHNECDYLDDLEAAEMEASWQAAEAEGSTPTPCPCCGYHALYCGPGGRVSCKACHLDLQVASLEALRELLAVVLQVYTSPRVDPATFPPFLTSNRSTGRGAATTHRPSRHTGAKQESPRAYGPAVRAAACECKFCDAQHPIWPGKLVQS

SEQ ID NO: 8930 - protein, 310 aa, Chlorella protothecoides
MPPGGDPPPPPPSPWQKVLYKEQPWPDNYTSPAFLESLVVNDRVPVRSYARVVSQACPVLEQLATVCWVGALTHNLYTAPWTCHTASRLLPTPSFTRLPVPLRLHPPSPPTPSLAGSIDEHGSPAALRLVLHRRLGTDPHPRPRPRPPARRPALRGGRDATAGRRHGADEPPVLHAHPLHLLGHGAGLRPGPGPGAPLPRRLPPGVLRPRGLPAGLPQPRRHPGGGHPGGEQVGAAGAGARAALTAGMLAGAGAAVWGASRHAGALFALVVVFLGVLCPLWLGGAHKFKAKINGPWDEAVPRLGQDMREA

SEQ ID NO: 8931 - protein, 325 aa, Chlorella protothecoides
MQGVVKSGIETAQHVHFMAVAASYIDRWGVGTSYRRFKLGRAGAMIGVLLAALMPQQMEAPSSAPAAEPQFLASGTGTEPAQPSATGDGPSTSKAQLILTLGRVKTLIKEDADVKFVSSEAYFAIAKATRHSWGDVPAVSGKHQTVPFPPGARSSTSSCPHRLPGAASRSHDGTCCSANAPVWTEPIGVWRCRPGGLQLAVAGLPRGRYPAQDPRRRRATEDAGRQGCCRRGIGVSSMEQSWGWCPFQLCVPWACSHKWMLHILPAPNVMELGPRASQACPWPLLNCHDSAGMQLRGASLLCMCGLLKYHVRPLKVLELEHMPMP

SEQ ID NO: 8932 - protein, 97 aa, Chlorella protothecoides
MDVLARTGAAPAPRPRASFSARNLDQDLQRLLLPGTLEQHRHVLEGHHASAALAGVLAFGELLADGSGHGKYGLDRLDLGKFMRMDAAAQVGGRCGW

SEQ ID NO: 8933 - protein, 123 aa, Chlorella protothecoides
MPPGTATPGLHAGLRTVGLAYVDPGARVLRTVEFTDDDHFNHLESALVQLGVRECAVIKVRIALWVGAGGFESGTPAARFSRRFSVLLMQAAVRCAHRRLARLPNMVPNFQPPPPKNAAGHGV

SEQ ID NO: 8934 - protein, 94 aa, Chlorella protothecoides
MPEEAPLLEVSGVDQSAFENWYASLPQVRRLPPCGDMEGGAWQAGLVRIFDRKSCLSVHGEVAYALAKHLYRSTAQVSRSGVADNGLPGELEAV

SEQ ID NO: 8935 - protein, 214 aa, Chlorella protothecoides
  MOD_RES (133)..(136): Any amino acid
MEYARFIQVSALTPPSSLLAVVVYPPPRLLAQPPCVHVLAQQGAGAVLVVPQPAVQDLHDGQAGVQSDEVGQGQRPHRHVGAQPHATVDVVRAAHSLRCGVGGSGGWCQKLEPMGMAHEASAGPEALVPCMHXXXXGAQPHATVDVIRAAHPLQCGVVGSGGWCQKLGPMSMAHETSAGPETLVPCMHKGESSSSRLAPDYSSSHRPPTLPKRM

SEQ ID NO: 8936 - protein, 145 aa, Chlorella protothecoides
MDQKEEILRFAIDSRLSRGFDPSTNLPIDPPKFLISVDLVSQSTTVRFCITSDCKNNLPLESWYLSAREYSCPTLERITAMPTETKIGFIGAGQMAEALARGFINQNMVEAEHVFCTDPVEARKEVFRSFGTVPVDGNIAVGRSA

SEQ ID NO: 8937 - protein, 182 aa, Chlorella protothecoides
  MOD_RES (23)..(26): Any amino acid
MLPPWRGPGMTPWRSSWPASWQXXXXCQYQAAREGSGAHAAAAAGAGDDAAAEQLASQLAALQATPGGGDSVAAAHGGAAAPAADFEWRGAKFPVPDARTRTALQAAQERERELVAGQADAGSLEKRVALSDRVAAAYGDALSGVKAALALGQSGSVEELRALERAVRGRVLDLTLRRYSLV

SEQ ID NO: 8938 - protein, 190 aa, Chlorella protothecoides
MLTPSPAQNPWQEAAGPKAKIIRVMPNTPCLVGETAAAMCLGHGAGSADADLLQRLFESVGRIFRVDEKLLSAVTGLSGSGPAYIFLVIEALSDGGVRAGLPRDVAQALAAQTVLGSAKLVLETGKHPGALKDMVTSPAGGWAGGPHGEGAEAASGSGRARGRPGGRAGPGVPKREGGRLQGCCLPLGGP

SEQ ID NO: 8939 - protein, 88 aa, Chlorella protothecoides
MQPVLHSGARICMRGDLPGRATTRLCSTCAQVAEAAEVIFIAVKPQYVPVVLREISPKLTEKHLIVSIAAGVTLAVLTVRTGELDLGS

SEQ ID NO: 8940 - protein, 233 aa, Chlorella protothecoides
MRSRVGQEYSRALRYQDSRGEAQPLCRQADSPTLDTLATASASTVCPSCGHAHSDPASWEDFGACDACGHVLSGSDSALLAELTWCPRGHGPLGQHLRPGEDGTTATHIVPPQHRVLSSTPGQAAQRTQAKVRKRLAQLAPLLNLPSAVTITAEGLAARAAKLHIRGLTSGAGLAALVYAACRLEAQPVSIATVAGAAGSDSTRVGHSFLALSRVRRLGMGGPEDPLMLHCAE

SEQ ID NO: 8941 - protein, 202 aa, Chlorella protothecoides
  MOD_RES (49)..(52): Any amino acid
  MOD_RES (147)..(150): Any amino acid
GPFGEEAALAPRSPDNAGTSGAASDVQGRNPGPISDPTSPSLLTTHPSXXXXMAHSGRRQPSLLAFPTTRAHLGRPLMCKAGTPGPISDPTSPSLLTIHPSSPVAGLGPTLEFYALLAKELTAPELGLWRGDGGGDDSGAAQPGGAXXXXRGDGGGDDSGAAEPGGASGKRGQGAAGGDIARRAGLFPAPLPPRAADAEARC

SEQ ID NO: 8942 - protein, 125 aa, Chlorella protothecoides
MSKRAAWWLACLLVAGYWQQALGAAQPHQPFLHATRRSAPHRHVPVHEGCAVIANGPDAIVFSATECKGAVAHASFQRGKHTRHGWSQFSVHTFNTTDDLTQLRAAGFLEGYFTAREIQAVRRWR

SEQ ID NO: 8943 - protein, 109 aa, Chlorella protothecoides
MRALFHSLVEQRPARVGDKESCDNCKVVVLQAVAIIQVGAGAVNGANPKTQADIIEYAKESCSMFPDWQDSCEAYVTLYGPIAINMLVTYLQPQTVCSELGYCPPLSLA

SEQ ID NO: 8944 - protein, 497 aa, Chlorella protothecoides
MLVIKTLRGQRYEVVSEEAPTIRDVKRLLAVQHGAPSLQLFYKGMRLPDDQAIADLKLGPLDTLAGIPSRGAGRVQAEPNHLGNGQTASPCPAVIQVTSEPVCEIPGDSATAPASASPPASPTSLDTLLPGYLSRPGVSPAKLLRRSVGPGSTASAGHAVSRSAPWPDARPSMGEELRRHASEAGEAKLQAEEGSGSGPLGANAGEDADVEAVRAELRVQGVAFMHGGAAGDDCPKEASPEVGFSRETLLREPNQLSDDEAAAPLAADPFDNSGKVRDAESAALIAAMMALAARSPGLLEGICFDLGAEGREDCGSLRMMTCEDQVGLGILSLFHYKAPLHLTNRSSPGRLPVLPQPSWRRVAAGLASLQLPGNITLEDVQAMATICPDVLSLHTHHRWVGALNRGWLRERAGWLQPPRILLQHQHPPAHSLLCSLRQAERTGSGGRLERDARQRGAHRHAGEPGRRPPGRGSVWRGGGVHSEPHAGMWMLQKTRDG

SEQ ID NO: 8945 - protein, 107 aa, Chlorella protothecoides
MTRGRDDRPSPGTPPNPLPPGGIYVGGKDISHVTQASLRAVIGVVPQDTVLFNDTVRYNIAYARPDASQEDIEAAASAACIDEVIKTKFPMVRTVRKWGLLDLGVVG

SEQ ID NO: 8946 - protein, 121 aa, Chlorella protothecoides
MQQLYAPLNFFGTYYRVIQQSMIDMVRAAWRRRDGALGGLRASYSTSTLQTHLPAPQENMFELLAKQPSINDSPGATDLAVTQHDVSFKDVSFEVGTDGAARCEAVCGCCAGRSCPPTQPG

SEQ ID NO: 8947 - protein, 158 aa, Chlorella protothecoides
MGPLHPLPPEASAALECDNPCLLESLPTAGTPFYAWFDSQQQCQARSLLALAAQGGAARVVAALLVLPGAREAARLPSPTDLCTPLHDACASPGPGTHRIIASLIAAGADTQALNAAGQRPGDLLTQVQVRVAGFAGAPRARQSCGNTMSYHQQPIHP

SEQ ID NO: 8948 - protein, 166 aa, Chlorella protothecoides
MAVAPLPVPEMEIPEPASTEPFKWTAGKIVLSIFLFLVASVAEIGGGWLWWQTLRESKPWWLAVLGSGVLILYGVIPTFQPTDNFGRIYAVYGGFFIIMSYLWGWAVDKQRPDTGDWIGTAIALAGVLWVLPSRPSSYHSCSPHIVHVYPILYARHLVNGFARPPQ

SEQ ID NO: 8949 - protein, 207 aa, Chlorella protothecoides
MVSSPRLQGLRGLLPCTASAPHTTLIPLPRSRPPRTSRSTTSRRSSRRSSMPPSRPSPPTPSPSWCAEPPAGIDMTAVLLPRADKSVHAMIAYDSFRASHIRWAQADEVRKQAPAAITAVHARQIYDSRGNPTVEAEVTTSLGVFRAAVPSGASTGVHEAVEMRDGDKSKYMGKGVLTAVANVNDKIAPAVIVSLGFGGLMMHAWEW

SEQ ID NO: 8950 - protein, 90 aa, Chlorella protothecoides
MATPCLPGLVIRPATDKDIDTIARYGAAIAQETEDLTLETKVITAGVSAAIADPSKARYLIAEVGYSSRVWGRGGQGWPGNDRHCFSSAA

SEQ ID NO: 8951 - protein, 88 aa, Chlorella protothecoides
MPHHINPCAACRRNAEYWWIHSVYVVHDHRGTGTFKAMYEYVEKEAREAGAAGLKLYTETTNERAQKAYTKMGMENHALVFENVWLKH

SEQ ID NO: 8952 - protein, 364 aa, Chlorella protothecoides
  MOD_RES (11)..(13): Any amino acid
MLPGSSCDAPXXXLRVGNLRGYQRALSVSGSILLGFMLPGSSCDAPCGGATLPSRVLSHRSRTGSSVGARLGINCNRSANGLSLGILPRKHASWHRLTGCFETGLLFAIQTSTARAPRPLTVAVSLLCRRSVVAATQSLSLGPAPSLAHFLHRYSTETNVPSTSSSDVYVYTSPYGPTVRNVKVCMAELLSRSWGRGPRAFEVEDYTRDPGTQGPILRLSLFSCACALGAGPIILGLDSGMTLAAKGSIAATLGSFGAFTTGLLHWFVSPYVQRLEVDRRTGGVRAETLTLWGTDRCHAFHLSDVSAVSGGHPLTSFQALGKTFYVDPSHFGDKELLARLAPEAAAVATGAAAKEEIEHVNGMR

SEQ ID NO: 8953 - protein, 221 aa, Chlorella protothecoides
  MOD_RES (208)..(211): Any amino acid
MKVACMRGISDPTPQSGAPHYFAHAGLNRAAGQHGGGSGARPRPCQPLLAAAVPFSAGATAARPLQPPRICILGGGFGGLNTAVKLDGLVWPEGTKPQVKPGTCGWHLDGMQITLVDANERFVFKPLLYELLSGAAGEEEVAPTFEKILRPTSVSFVRGQVESVNDGPATGPESKLPEVLYARLSRHPCAFITPTDYCTSCLPPQPPXXXXAGMSGSMAWL

SEQ ID NO: 8954 - protein, 429 aa, Chlorella protothecoides
  MOD_RES (86)..(89): Any amino acid
  MOD_RES (216)..(219): Any amino acid
MSWRRPGTPRSHTSGTPRCGGVVKGELTRLAAPPQCSRQGAPPDYPLVGVCAVHLRDSRGSQERLESVMPVCELVLPLPTVRGQPXXXXQERLESGMAVCELVLSPPHCQGATQMVAASSRHPELAERVSLAVLLAPVLSMQRVDSLLWNFLAKLNVDRLLALSGLAFRIGQLPGVLRCYRMARVSRPSMSFLVPTSTLPDRSSCPSSTVQPAVQXXXXLRCYRMAPVSVLSCPFWSPYPLCLTAIPAPRPQSNLLSRTVIQLACPSGGGLEPILCSSILTLACGFNENQLNMTRFKDYVKYLPGGTSIYNAQHWLQLLRGARRLGRPVFQSYSWGDDCPRRPPFFWWEPGTCNAWCVSGRVAAGMWRKEGLEWGTLMGLLEDRVLKTRSLELQVPEESHWRNQRRSAVRPSAVLAPSWSITSISAGCP

SEQ ID NO: 8955 - protein, 192 aa, Chlorella protothecoides
  MOD_RES (116)..(119): Any amino acid
MDGREARRYNFHYDWRMWTVPDVRELLRQAGFSTTYVWIRPIKGGALKVLNSSRVLGEDAEQNLMSRRAAGQQRVQGAADAHRHHNLILIPHHHRMRLPGTVGARLIPRAARRPRXXXXSHPHPPPSQDASAGDGGRASDTSGSQEASASDSEESEGEADFQPHEDIDPEARQRLQRGWSAYIVAVLAPQPG

SEQ ID NO: 8956 - protein, 338 aa, Chlorella protothecoides
  MOD_RES (189)..(192): Any amino acid
  MOD_RES (216)..(219): Any amino acid
  MOD_RES (310)..(313): Any amino acid
MAPQSRKAPPAAASPKSPILSPPSTRTGALGGPVEVILHLTPVMSATLGVVSLAHEQLWNTLPSSPYFAGWGHCLLTAGIVATGAVIAFLMVWAEFALIGHTSALTFMVAGTFKEVVTVAAAVLFLGERFTPVNAAGLVVLIIGVVRVLVRFCVCWGPGKGGRLSREGPAAHHTQEAAAKGAGGGGGRXXXXSAWCACLFVCVCVGAQGGEADHQXXXXLAKVQEAAAKRAGPGGGGGGRGDRLPAKGRSTGRRPCHRRPRHPRPRLALRRQVGGGGRPSEARQAERGQHIAGGHAQSTEDGVHVSSGMXXXXERGQHIAGGHAQGYVRWNEVHHHHH

SEQ ID NO: 8957 - protein, 165 aa, Chlorella protothecoides
MLAVFPNGVATGLDIGLSNYSLVFISLSFYVMCKSTVPLFLLAFAIMWRIEKWVFGSSCLHVHGSPLPPGLCHHVANRKVGFWVELLARERPGTTPVPLPSLIQALLGSGGRGVRHLHRAHAAGGGGGGLPPRGLPPGHDRLRSGRSALDHHAGPPAGQQCHGAW

SEQ ID NO: 8958 - protein, 379 aa, Chlorella protothecoides
MMGWSSTSSRPCPGPALPFMVRCKTVSAHAPRSHILSCAVCTGAGQGSVQGWWAGICPGLARPPTARARPDAQGVPGGWSPFRAGVARSKLASGSPCHTSSYSTSHPPLVSAFAPVAVSHTSAPAAWHSGLDTAQGPRLLLRGLEAAVPKLGGGVDELQLDLLQRGALGLREERLAQRDHTLLGTGHRALDHDVVLVHHAVMREAAQGGDVLLRHVVLGGGQVARLALHADAVHLLVHLGAVVEAQGTRARHGPAHTGRVPGADAGHLAQTAMGLARQAGYAPARHHALRALALGDGDGVDHLRLGENGGDGDLALEQAHRKVHLGRHVTAVDLDLHDVGLLLAHRHLADLGVGDHANDRGVLLQLQGVLRRGGFVEGG

SEQ ID NO: 8959 - protein, 310 aa, Chlorella protothecoides
  MOD_RES (259)..(262): Any amino acid
  MOD_RES (286)..(289): Any amino acid
MAMVFCLDGVWVQGFLKEGQDIPGRGPGATKAMGWRARGPGRKHDNPPTSCRPPSTWCAGVPASVLFTRTSTMSHRKVSFQWTCRGAASKGLGPGGPPGCAASGHCGRGRLGPVAGRIGDFEAPRHGHLGFLPKKRCKRGKGKVKAFPRDDATKKPHLTAFMGYKAGMTHIVRDVEKPGSKLHKKEAAEAVTIIETPPMVVVGVVGYVKTPTGLRSLGAVWAEHLSEEVRRRFYKNFYKSKKKAFTKYVRKYADGKKEXXXXVVGYVKTPTGLRSLGAVWAEHLSXXXXEAELAQVRGVGCGGLADGDGG

SEQ ID NO: 8960 - protein, 305 aa, Chlorella protothecoides
MEVPAGQDGIQRLLASEKEAQSVVAKARKGTARACALFTTGFIFMLGARAWTALDVSPIAPRPSPRRVSDRSAPLVARTDRLKQAKDEADREVQAYKAQREEDFKRRQTDPKPPSTQDSSASEESARKLIEEAEATVRSVQQSIQDKKEDVLKLLLKHVTTVQGGLGASVASARALAGKAQQLRHRDVALRSHLPQRAHGTQALDRGLGVVQGIAAANLLAETVPHARQLQDHPHGSPRDHAGSLGGRSQEHLRGGRAVAIEQFKVLGVHWAEVVFQHARGVQLNEVRLLVNSGSCIYSRELSHG

SEQ ID NO: 8961 - protein, 232 aa, Chlorella protothecoides
MVGGWSDSAQHSRQSTLSPAHLPLLPGIGSSHTSTPSVAIPVACDSMAPVLQATMSVCGLAPGHAFRPQSALPRHPSHRGVCSPMRTHDQHHSVAFQRPIVTMRAGRGPAQSQDDNNDDDGESGPYVRDTEYEERVIQVRRVTKVVKGGKQLSFRAVVVVGNNNGTVGVASASAKEVAQAAQKAVLKAKRRLITVPLTRNALSVPHAFDSYFSGAKVRGLVWELSACALPTC

SEQ ID NO: 8962 - protein, 818 aa, Chlorella protothecoides
  MOD_RES (378)..(381): Any amino acid
  MOD_RES (607)..(610): Any amino acid
  MOD_RES (750)..(753): Any amino acid
  MOD_RES (782)..(784): Any amino acid
MITSDSESCILQNGAGWVLPAVPRVGGSARRPGRGTETGLLRGREHVPVRPTTLVLQRLPPPSPAPSLPGPQVKISAIHAQHPDEPVLEVYGYPSAIGRAIPASPTGSMHLELAAPPHACAAVSPPALPLSAALVSRGECDFVQKALALAAAGYSAMILVDSAPGCVFMSANDTAAAGALEIQAATITAVAGRRVRDALCASPAGLDVGLWAPAPCGPDLAGPLLWALAVGCVALGSALAAAAQRRALDAPPPKDSDSEAEGPRARADPGFVVSRVGAGGFVVVASTLLLLFYYLDDDWLASLLTFVFMAACWSPLAEALAAAVELALWRAPRLRASLNDPAPLPLLGPVGLLQAVSVVASVTTIEMWREHRDAGWAXXXXSAPSGRHGRRAAGVPAADRPAAGPGHRMHPASPGLPVRCVVGLPPAPGHRRPLGHGGGGRGWRRRAPLPHGAPGSDPGTGGQPRHGHPGPGRRGAAGPPGRADVALGCDAALPGRPALPLRPLRPGRVRGGADRHVRRAASRPIWRRGAARAAVPGAQHAGHDVCAGGGAQRAGPALDRGRRPGEPQERWGAGRGGRGAGAGDPPRHVTQASVSALACTGPLPCTXXXXRGRTWSRGGRPSSPRDPSSFSALACTGPLPCTASAVFVVVEAPSHTATLSIPTCPHTESLRPPCSAPYLLLSSPALVSALTDCLHPPPPSHSPRPTPQPPPARQLSPPECWTAARSGRSQGAGRPPARPPATSPSAWPAXXXXSWIITDDEHLAVKQDPCSPPKKPSSPWLXXXSPVRVEMGFNDKREEHIGFHFSGHTDDAVLDHNR

SEQ ID NO: 8963 - protein, 417 aa, Chlorella protothecoides
MRSLCTLSVSSPGVGPLLPFPSRNNSWRATSSVFTWRDSVNVAMTLLRVARQAEVGEGQKVVKVSLLEATLAALSLLESVHSQHGIGASIQRRVPVRGTGLWKLNAQPRAPISSGGSRPEAPPGPSPRHGLLHRCSLLPHGVCSRHGVATDPPHVPHQLPPINSPLSLPVGHISGRRGHRRQRQPRLHRMLSQHKTHHAAHTLQIELCSGKKIDRKLDGAVCASADQKQRIYEVHPDPEFIWQAGQWSAVHAVTTASLVTLPDSPPSPLPSDVYNQVAYTPSRPSYGLFGSAAGMARPPLAPPTPLQPFAGSAARPLVHSPTDGEMLQLSQESTEGSSVPSPEPVRQRLFAGRVDAPHVARRKAAVAAIRAKAYKPPMAATPHTAPTQNQTSKSGGQQTLFDAWRVTPVPAVEDMEF

SEQ ID NO: 8964 - protein, 514 aa, Chlorella protothecoides
ALARLGAVGAAADRAARRVPAGPGRQRLRGAGHAVRAALGHAPSGPTGRGPCAPHPPRAGPGPGLRRGRARRRGAAGRGHRGLDPGLGDLGRRACRHAGAGPAAGGEGQGARTRGAGEGPGGRAAGQRPGRAYRCAVPAAGGPPAGHHQLVYFLLPGNQPGVGLVVKEFPGRQGTLVCSNVWSALNRGALPVAFNDSAQTHRKAFFLTNPSVTSVPSCRNSPVSFALSFLSASCPQNAMMSTIATPRVMLARPTTSHTRAPRRAVIRAAGGKDKTEAITGVVFQPFEEVAPVLKDTSKSGALNDPRPEHSFARYSTWTETVEAAVNEQINVEYNISELGNCHHHPLPHHPHSSTPGYVYHAISTYFDRDNVSLHGIAEYFRNESEEEKSHAQYLIDLQNTRGGRVKFNALVPPEANYDHPEKGDALYAFELALALEKLNYSKLLGLWEVADKNSDAQTTQFIEDMLHEQVKDIKQVSDYVAQLRRIGKGHAVWHWDRALAEGKVDHRAVESPKA

SEQ ID NO: 8965 - protein, 208 aa, Chlorella protothecoides
MEIQVNGGDVAAKVDFAVGLFEREVPVSSIFSQSEMIDTIAITKGKGTEGVVTRWGVSRLPRKTHRGLRKVACIGAWHPARVGWTVARAGALGFNHRTEMNKKVYRIGVKGEASHLATTEHDVTEKDITPLGGFPHYGVVNEDYVMIKGAVPGTKKRVITLRKTLFAQTKRSALEEIKLKFIDTASKFGNGRFQTAEEKARSLGRVKA

SEQ ID NO: 8966 - protein, 148 aa, Chlorella protothecoides
MPPHQCPWPLSNHPQEPRHLREDFCGTALLAATWCRGGVFRSAVGLDLDRPTLDWGARHNGEMLGGSAQHQLALLEGNVLDPADSALLVPFPEAGPEASDSQSSASDESDGEGGAPARRGSVRSRPCDIVCALNFGVCLLHTRYAGVG

SEQ ID NO: 8967 - protein, 112 aa, Chlorella protothecoides
MLKHNFCPVHTQNLELLDRNCSSATQVLLRPASEGTGVIAGGAVRVVLELAGVRNGFGKQVGGSNPLNNAKAAIEGLRAMRTLRQVAAERDISVAQLLGLPPKKESSDAVPV

SEQ ID NO: 8968 - protein, 204 aa, Chlorella protothecoides
DDPRRLFVRDALPSTAAGAGPGFVAGVLPAPRTPRPAPGEGGAGVSPAAKRGGSGAADDRADVANGDAGDNSAAAASPHSAHRPDSDPDATLAGLLPRLTRPDYYTVPSLAELAAAARSDPAAAAAVPEFVIGRRGLGSVAWLEPVDVRGLDLDDVITISRGGVEVYLEGPAKPPVGAGLNRPAEVTMLKIFKTDKATGQPVTN

SEQ ID NO: 8969 - protein, 93 aa, Chlorella protothecoides
MSPHSDARLDSPLRSLAPAQRVRGLLTAHQAGLHALAASLLEQETLTQSQIKEVVGGRAAQAWIEKAPGPGGPRRMPAPAAATTAPRPAQQTA

SEQ ID NO: 8970 - protein, 220 aa, Chlorella protothecoides
SAGPAPEPGTSAARPLHVTFTPAAEAPPSGLVTFLHSALSFGLTLALLGFISVLGLRATQRAAGVNSSAAMGVAAGGAPAGMAPGEGSAMSAKEYNKGCLEELGVGTGGRRGSRRRNLLPTPWLSAPCPPAGPSTTTPTPVSSQEALAETSVKSFEDVKGCDEALTELQEIVAYLKTPEKFTRLGGKLPKGVLLTGPPGTGKTLLARAVAGEAGVPFFYK

SEQ ID NO: 8971 - protein, 395 aa, Chlorella protothecoides
MFVGVGSRRVRNLFAAAKAKSPCIVFIDEVDAVGGKRTNWEASGGSRKTLNQLLTEMDGFEENSGVVVMAATNLPETLDPALTRPGRFDRQVAVPLPDVHGRRAILDLYFKGKPLAADVDSDSLARRTPGGDQHCWELQGAVPLKLPLSRSHFPHCFTPHTRFPPPPGFSGAQLSNLVNEAALLAARTGRDCVDAGLLDEARDKILMGSPRALSQTLEARRLTAYHESGHALVALFTPGARPIHKATIIPRGHALGMVSQLPDRDEYSTTKQQLLAQIDVCMGGKAAEELIFGEEFVTTGATSDLSAATRTARHMVEDCGMSARIGPLSLSDKLGSETRKVADAEVSDILKASYEAGRGKVLLGGPMGWCHGPSTDSNREGLLPNREGWRWASDT

SEQ ID NO: 8972 - protein, 153 aa, Chlorella protothecoides
MLTTLPHHPYAPPQAPHPSAYAPSCAPHPPSPGLTPAAQQALLPGRVVVEGLGGGGKLYPPLRRVQEDDPAVVAGGMGWAFQGDAGGIHGVGTTRASSWFNPVAASVGCHHAHAPPHAPGRQVVALFHKVAAVHLAVAAGHVASLDGLAWIQG

SEQ ID NO: 8973 - protein, 239 aa, Chlorella protothecoides
MHSVQGLACSRGDPCFSRLAPFHPSISPAPSIASQSARHPRPVPLHAWSEQRAFTFQRTHVGFWDALNYILDSKTKCLNSCIPDDMFRNSYQSGLLSVLYSIGSKPLQLWAPHTQGLNSKRPRKPGPHPDAVEDGSVRRVMDEDIQSSVLELTGANVSTSYISCPADPSKALGIKHPFLVLVVKNLHQYFTFEVQVLDDKNVKRRFRASNYQVGESDEKQADPPCVPVWMWPGINGIER

SEQ ID NO: 8974 - protein, 182 aa, Chlorella protothecoides
MVAVGHSATSTDIVTQLQDELCHVTSLLYNFIGTTQRDAAPSSIKDEGPVQAGCAPAPPVRRRGRFNSMRTQLPSRCEFLSVSKSRKTHHPYHQIDLMAEQLTGALAALGKVIAALPSTLSSEEQQILEITGLQHANVMASQELQASLERAQVVLTESYASHSSLAETLLQDVEGAAQPALL

SEQ ID NO: 8975 - protein, 152 aa, Chlorella protothecoides
MTLDDDWNQIQFNLADFVKRAYGGWQRGAGSMTQPPNLEGTKGGAAGAGLKPHTLLNKGTSYVETLRLQIHANCRLRRVYFADKLYPGDLPPTPSCAESELPADFKLFLPVQRTATLASGAGHPVADPAQMGGGAAVDEAWDADQSPMPQEP

SEQ ID NO: 8976 - protein, 574 aa, Chlorella protothecoides
  MOD_RES (475)..(498): Any amino acid
SASAAAAAARPRRASVPTPPSSTSCTCRSWRRGVWPPTARRWPASSPPPPPPRRRPRGEPASRGHGGGDGDPGRLRGGDVTRGGQCLEYSSQNALCFGMSAPGWVLLCLHRAGAPPGTPTRGLRRSVFHRMPPPPPVLPEPPPLPPTHRLLGPGEVPEGSNPRVKLEVSYALLADSTQAVEVALSNCLVSWPYFDDQSLVNTLTGLFGAPWAEGRGGEAAAARPAPASPSASTKPAAEPRPWTYFNAVLAEVEVFLPVYDVERAREMAAALWDAGEPTSRFHAVGDLALASVLLASLDEGAEAGALPLEARGVLLAAGAARLGHAAGGDGESCLRADLRDFSAHVRDPCARVHTVLLPFSGTATCDQVAPQVAEQEEVDRLHRAAATIQAHWLAHRARRRRDARLAGAFGSGTSSPAASLPTSFSMESEGEALGFPPPSPRSGAGAGNPDAVADSPDAAVTPWHVVDELILDVAXXXXXXXXXXXXXXXXXXXXXXXXQARQRGAQGDGVPAAPAHHHADGGERGGGRAHRARRLLPHPLLARRRRRAAPGRGRRRRRAGLPGGTVLAGRGAGE

SEQ ID NO: 8977 - protein, 100 aa, Chlorella protothecoides
MRAIADPSAPEALIARNAVDRVSAMALELGLGPGVVEIGHQAAEILLMMRPPDEAPSDFQEYTLVAILAVAAHLSQHHLGERYGLEALAARYGQDPDALE

SEQ ID NO: 8978 - protein, 365 aa, Chlorella protothecoides
  MOD_RES (17)..(20): Any amino acid
  MOD_RES (74)..(77): Any amino acid
  MOD_RES (114)..(117): Any amino acid
  MOD_RES (291)..(294): Any amino acid
MEGAWVSLAVPCDLGVXXXXQLQGAAGRWYGCVHVWREPGSVWPCRVNFVYLLRDPYAITWRRMAWIPLQMGFXXXXPPSPPLGALVLFLLESPPPDPSTPPLLLAHQAFLVEXXXXSDYPFGASVLFLLESPPPDPSTSPFLLAHQAFLVEGEHGGVDFVGNRTECALLMLARGWERDYRDVRAALSDDVAMVFNFSSERKMSSVLVRGGAGGGLRLLCKGAAEVVLGRCSRVAGGAGGAGPLGADLRRELEECVTAMATRGLRTLCLAMAGKCAQGEGGITPGIGRGWXXXXCAWPWQASVHKGKEGLLPELGGAAGLRGGILDMWVLHCAPMSQSQPFTSLTLTSGCTLGVKWCCLIEPGSS

SEQ ID NO: 8979 - protein, 573 aa, Chlorella protothecoides
  MOD_RES (32)..(35): Any amino acid
  MOD_RES (69)..(72): Any amino acid
  MOD_RES (179)..(182): Any amino acid
  MOD_RES (377)..(380): Any amino acid
  MOD_RES (457)..(460): Any amino acid
MCWPKVLSRLRGRNASGLAEAECVYNHEPTLXXXXRHVYTLAWYFPGLSGTTTLWVNLDALPAQTLCLXXXXPTLLAAGPDADHAHGCSAGEWQFATCLHAGLVFPWPEWHNGALGQSRCRALHEPFARHLSTHIGPQYPPSLARLSRLSETTRRTPRALPSGWLSLWCPWLVSGGPLXXXXAVKAERDDQAYTEGIAIWVAVLVVSLVGECGAMGRALYWVDATWKEGSWDSTLPKLLGSKAIELLSPDSLLCAPLPRPGAGNDWQKDRQFQKLNSQRDVIEVKVLRGGAQATCLNSEVVVGDVLCLDTGDKIVADGYMIDGHGLVVDEASLTGEAEPIKKGERDPWMRSGTQVGRWSWLLGWCPTVFSGRGCGFXXXXDAVGDAEQEGKALKGGGGWGSLQSCMHSVSEGNTSRKLCTNVRLPTCVSAELCASPGLPKLLAAQALPPSPTIPPSXXXXHHQACLNSSQPKPCPILQPSPLLQPITAGHRGLRPHAGSSSRGAVGLGSDDEHGAGGVPGHPPPGARRRMLELKRGPLGEQRSRQACAWGRQCQDHPAERGGEHTVDLQHAFM

SEQ ID NO: 8980 - protein, 408 aa, Chlorella protothecoides
  MOD_RES (19)..(22): Any amino acid
  MOD_RES (77)..(80): Any amino acid
  MOD_RES (100)..(117): Any amino acid
  MOD_RES (365)..(368): Any amino acid
MLVKANHEHSTCLCTQAHXXXXVIIWSCKVLHFQGMLVKANHKHSTCLCTQAHSISPYFEPTPQLCMKAPCLLPSQXXXXFPPAYAQAMFEGALPSSIAXXXXXXXXXXXXXXXXXXVLEARGHLGSPPPARPVLEVVRIRPRFRPSNISMAEKANFVNVSPSELKFRFELKKNTPVTLTLQNPSGDRVAFKVKTTSPKKYCVRPSNGFVEPNSSKDVQVILQAQREMPASLADCKDKFLIQCVKLPGSLPEQNEIKEITSDLFDTSRVKDISRVKDIRCEGGPGGQARCMDLCANAHMHGECVDTLEGRSSLRSVNCEFVIPGRVCAHPWAQASLTPAGLPSSTVQWNTLVAHPPHRQTKLRVXXXXTPVLNRSKEHSCGASPAQANKAACGAGGAASAPLPSARGE

SEQ ID NO: 8981 - protein, 177 aa, Chlorella protothecoides
  MOD_RES (43)..(46): Any amino acid
MPPHFLPAVVDKATSKSWPGGVGFITKVHGGGHGIADVSPARXXXXDPPPPTLHAALLPTVVDKATSKSWPGGVGFITKVSGGGHGIADVSPHARPARPCFGALARTSNPLAPPPPGPQDMLKQHLPHPGPDSLVLVCGPPGMMGALSGDKLPDKSQGPLTGLLKELGFDESNVYKF

SEQ ID NO: 8982 - protein, 794 aa, Chlorella protothecoides
  MOD_RES (458)..(460): Any amino acid
  MOD_RES (658)..(661): Any amino acid
  MOD_RES (742)..(745): Any amino acid
MPTTYARPHTVHTGPGKAVLRRRAPPAGDGSARLRWRQHHHSARRRVPVGGGPQLLPALRRRAARGGGCRRGGPPGAGRPQGPALRVLGRAPARHALRPGRPHLRPAQPVGQAARGAGRGWVQGPPAGAGGVGEGVCDSQPGGGSVPAPHRALLLRGLRRRSRKALHEGRLWQGLRPGEGGRVHCGGGAGADEGTKAKAAGAPARRPAAQAQGELKFEGGCACRWIACGVGPGQPLPGQGRKSKLCPQLESTVDAEPSGLAGQTVGSFDKGLVTLPSAIAEELGDRVVTGWKLESIDRSGDRFQHDLLFNQRNTSLPCAGSWRSPRPNPSCPHSPSSHRLTYDTPQGRKKVSTRSVALTVPAYTAASLLESRFPKLGKALSSIYYPPVASVALSYPETAILPERLGSDGHLAGMHRKGVRLVGCWSGEATLLGTSIHSGARHIILQVSGSCTPGLRAXXXGHTPRHQHPLRSSPHRPAGFGQLHPRTQGVTTLGTIYASSLFPGRVPEGKVLLLSYFGGATNTQVATMPHEEIVSQVKRLGFVSWTAMELHSHRSLMGPTTSASLGAEGMPTPAHENHLSPPCHPTPLPGGQGSTEDADPKRRRVPTHCERHCVAQGHPTVQRRAHRLDPGLQEFVAKVAWVFSVAEGGIAPEVATLXXXXSRGVSPGGKARPALLHAKSDRVLWQGVCAPTGRHSLHLQEAKDDLASQGWQGLHLGGNYVAGGSWLASVLADSRMLWQADXXXXPWRKLRRRCRTWQVHGGRVQAGGRAGVTCQEPCCLSIHDVKRSVAQCCR

SEQ ID NO: 8983 - protein, 155 aa, Chlorella protothecoides
  MOD_RES (83)..(86): Any amino acid
MRREGTVGQHKCDSAAQSIAGLNSRVQVELHRDGLTPENAVGIVTRYDVVVDASDNAPTRYLIRCTGACLASGCVEVAWLPTXXXXSGALGHAWQVAAWGCLVAHGGFLSRLLLHLHAPHTTPTSMHRISTCLHPSIPCPGPSSAATPVAWLASL

SEQ ID NO: 8984 - protein, 196 aa, Chlorella protothecoides
  MOD_RES (157)..(160): Any amino acid
MGVPFDDELEQLRAENEALKVEVQRLRQAQSSSLPEPRSQNELETPSTHSWDGLGHGLSRDDIARYSRQIILPSFGAQADSEQPLPPTSPSEPAAQGKLCRGSVLIVGAGGLGSPAALYLAAAGVGRIGLVDKDTVELSNIHRQIIHRSGDAAGDQXXXXDTVELSNIHRQIIHRWVLMGMTVSPGSALGCQCEPA

SEQ ID NO: 8985 - protein, 668 aa, Chlorella protothecoides
  MOD_RES (47)..(49): Any amino acid
  MOD_RES (483)..(485): Any amino acid
MVRDALAVDPEVCSRARCGCGVVYGQASVCLPWHRACLYRSALLTLXXXVCSRARCGCGIVYGLASVCLPWHRACLYRSALVTPICAAKTGRCHARADGRRERPCPVGLEQPFVLCEGCVVEWGVLGFATGRCRDYSCCTAAPAAPLLQNPGIQSRDFAAVDARTLRASVGTFCDLLALATRTAEAFPPLEPRCIEPAVHQAFSVQVGTIYTGRCQYLFLIPFQMLPSEPRRLPLPKRCGAVRQRRPPLPTLDSPCQLELDDLPLHHVEEDVVRAEAVEEGVDAPRTQQPNQGRGVQAHAHQPGDRPRLRCEVSSFPPLGESLARGSAAAPPHSPSPGYSPRQVGVKLPHVLRVLAVGVEEDAVKGAQVGDHILPPTWDHGHPGAVGPAPRRHVRQDVWVGLDDGVPGRRQLGDVAVDDAEAKAHGQIWGVWAALQAQAWGVCAGPGNGGRAAGLRPWEPADSPDLRPSTLNSIPATRADPSXXXPADSPDLRPSALDFIPGTRADPCKADLGRAEDAGMLPHQRRLPRHHHRLALGVHQLAVAVCRSFLQVPLRAGGGGGAGAARRRAQHQLGTHRPVQQLPHDFHVPGPGGVLPRAAAVLVQLVPGRAGGCGRRCRGECPVRSPAGTPDLHAENASPPRPCHSHSSAATDSASPAAAAAIRGVWPP

SEQ ID NO: 8986 - protein, 237 aa, Chlorella protothecoides
MRNGCRTHTSTLRTADSQAEQFLLVFSTNIEFFSVFNLAIQTLGLSLIFTKVTCRPSFSTFPRSGRPGARRGPPSHTVVKLGLFRPLLGGAGWASAPDMPGALATSLDEPDRPQRSVSKTLKRAVSSYFVPRGRFKKLLESAENDNEADVYRRNVSGVCNPSRRLPSGTRGDVGVGRPSGHRVFTHADWAVHRKPSRYARHLALIFASRIFRSLIPPITAVTLISTLVGVYETLLKV

SEQ ID NO: 8987 - protein, 150 aa, Chlorella protothecoides
MMPFTLWAAYSWVSILLSGLFAYLMLGIDEIGVQIEEPFGVLPLGSFCATIERNLRELHYSNPEARFAALPWLVPASPTCSRASGSCDGADMAAGMDGGHVGGCACVCVQRWPAMETSGEKFACSARSLDVAHSGPSGQGLPTTSHCTLS

SEQ ID NO: 8988 - protein, 91 aa, Chlorella protothecoides
MGSVEDTSTGSYAYRASKAGVNIVCKALANELGPKGVTVTLLHPGYVITDMTEGRGLIDTATSVGGMLSVLEGGDDIHGKFLAWDKKVVPW

SEQ ID NO: 8989 - protein, 180 aa, Chlorella protothecoides
MQVVINNAGIADMEPFGSLKGKLFHSIFQTNAIGPFLVVQSLHAQGLIGGSGGHTLVATVSSTLYPSPHLSPPYIPQMGSISENRADGLPITIGLKPGGAIPYRSSKSAVNSIMKSLSHDLADQDITVTLLCPGYVATDMNGHSGHIDTQTSVNGMLKVLEENKDLQGSFHYYTGQYIPW

SEQ ID NO: 8990 - protein, 133 aa, Chlorella protothecoides
MSIIEGKTVVVTGANRGLGREKMNPVPAWSCADLMLLPRTLHSSCQLVNQLLERPGNTIIAGVRDPSQAKDLASLGPNVVVTQLDVSDEASIEAWAASLKKDFAHIDVSWGLVGRGDDRAAVVPVADWVREQS

SEQ ID NO: 8991 - protein, 279 aa, Chlorella protothecoides
MALNSSRPATPHQSPQSLHLALNELARRSAGALAEVLPRLTSLRELDLRENELGSRGLVQAALVGLGRGWLARILGIVRGMIRPDLGGVPACPPQITCPLSASSLFVTLLAQGIPRLASLERLDLSANQSRRSGALAVADAVSSLKSLTFLGLDENEFSEEAIAEIDVRGWWEGCLGRRARLAWRAGVALRTPPLTHAGLGEGPPGSQQRSSRTPSMHMVQGILAQHEQSRVLGTLEENMEPSDDEDETEEEDEEDEDEGMADGEDDALAANLGGLGLN

SEQ ID NO: 8992 - protein, 87 aa, Chlorella protothecoides
MASNWFDRLRTGLGMEVEEPEPPEVGNQTLLSQLDEATTLTRTQRAVGFALCAGLGLLLSFLAPLFVLRPVKFAMVYTLGNLLAIGR

SEQ ID NO: 8993 - protein, 394 aa, Chlorella protothecoides
MAEDTGEGVPGMARFESIKLCTRETMYWSGIGSRRPLHLLTRPMTFPGAALLAAAGGGDASQVHALLHQGADPGHQGQGGQTPLMAAAAAGDAESVAALLCEWHGRGILSVKIRGPSWASHGTFPPASPAAAAGAPWHELDEDGCCAGEYASGSGHVEVVRQLLDWAVRAELVLGAASRRASAAPAPGPQGYLQERATYRDGQLVDAEGEAVMMTWEAPLMREHARILCAAKVGLAWICPCSRDEVECGGPEPAPRASSRQHDHRCRAQRTHPTPVLEARPRLPKSAPSRAPNHPPPPPAQGRAARVLNVGFGLGIIDGYIAELAPARHTIVEAHPDVLAHMAARGWTHRPGVSVVPGRWQDVIADLGPFDGVFFDTYGEYAEDMREFHAHLPR

SEQ ID NO: 8994 - protein, 212 aa, Chlorella protothecoides
MPCFVAEPSRDWVREFMPLPVQCGGRGSATDRFHHKVRPLPAARRYTPITAPDARGHFDLAIKVYKQPSPGKVSTFFEGLSVGDSADFKPTGDRACATVPCPPLTGPPPASQGPLPKLSLSDIAKRKEVGLVAGGTGLTPMLQVATEALRQGLPLKLSFIFANVSEDDIVMRKHLDGLAAKHDNFRVYYGEAQEQEGGGSPCGVPRGGLLQA

SEQ ID NO: 8995 - protein, 197 aa, Chlorella protothecoides
MSLGNCPGLRMHHAASLHPQRLPFVVLGRSAGCVACGDAPSITAETLADYDYAAFTGQAPNDGPPRPLRLLNPEQRITVQQLRDRLVLESLGVAGPSTASTDPSAPPLVIDVRPPEQFAICHLPGAEHMPWARFARFEQRLLDLAAGDRPIVVMCRRGNDSQRATARMLELGMQSVVDVVGGVEAWARDVDPDFPLY

SEQ ID NO: 8996 - protein, 66 aa, Chlorella protothecoides
MRLNPTSLIRLLSPGGVYSFFNGLCPDNIFFNMVQGEVVKLELARRVQGGEGWPALAYCPAPLGQG

SEQ ID NO: 8997 - protein, 434 aa, Chlorella protothecoides
MSCSVSRDVRGKAASGSPAGKETGPPQAQNPESPFTHAGLSFTLIPRHATSWTPACLPRPTLSLSLDACIVPSPASPDGARLAASNVLVLDDFVDEATRAGLLEAMIGPAAAVDLAAGRLSRPPAGSWERRTTDAAGGAPSWGMRGTALRALRRGTLGALREVGARLAALYPDAHVAWLPSDAIQGGGGGALVSAAAHGGDDGATETCWPEECNQGNASAAKRAKIGPEAADGATRCPPDGATPQGPYATDPCAPDSSAGEAQAATTAPAADCVPLLANAAVAGDEFAYHQDADPTSFPESSPWVAALGDYFNGEPGQPLLASLVLYLNPDWRRDWGGDTLCLDSDSGVGVGVAPRPRRALLMHQDVVHRLSAPSAAAGGRPRFSLVWKLALVPRRAGRGVDLARAAAWGLPTPFGSAARMAAVKRQLAREARG

SEQ ID NO: 8998 - protein, 98 aa, Chlorella protothecoides
MDTPWSLTAEQRADTVARIRANMASMAFFAKTPLNDAELSAEAAKLEAKAYAVAGVQGTAYISKLSQLVLERLALGSDSSTDASQAAAQPTGVRGLGG

SEQ ID NO: 8999 - protein, 293 aa, Chlorella protothecoides
MVPGIEVLPLEAGDAGSLNAWADEVAKKTPHIDVNHLTQRCKAIHSWVTFLVCSTTHSAIDPVEGDVDREQDNRPDGRESGHWARGATLRYCGFDGEQQDRPFAARACVVQWGAITVAFTGVLIHSAMQWARQLLARPGNRIIAGVRQPDKAADLKALGGSRVQILPLDVSSSTSIESWADEIKASTAHDTIRHDSRREMQPPSRPEVLLPLMLAPSGLAGMHQVVINNAGVYGERQDLGSVTSENMVSTFVANTVGPLLIVQALASRGLLGGSAGPTLVATVSSKVGRVWWL

SEQ ID NO: 9000 - protein, 129 aa, Chlorella protothecoides
MLQGIRARFPTLLAAAGATAAVGGYAVWTGSPVRLGTCSPDLTDARPHLPQATRPALAATPASALSPDEWRSLKLVHKEQLTKTTNPVWLFRFALPDEKQVVGLPVASCLLTRAPITKKDGHPGWVIRP

SEQ ID NO: 9001 - protein, 140 aa, Chlorella protothecoides
MPPSHPPPRQARMLWGSLTNRTRDFVRQCLAFFPEDAKRLREAAVLWTIALPYVVKAHLREGNRLESELEGILTRDEVDALTGATHRPCFVLAALSQVVAAAGLDPQLRQRLDTNLTAFEDCIGGCERILRTPIPQSYTR

SEQ ID NO: 9002 - protein, 329 aa, Chlorella protothecoides
MPAVRLFPRHPVPKSMAQIKFSTKSFGADASAVAARAIARVAETLTHADMADIIAGRPALHAARMSGRSLPWRGRQATLAGGADSCGWPPRRPAHHGQCLTRSHTTPPPAEEEALRSLRTIAEALSRAPLVELDLSDNALGEKGIRAAAAAFANQTTLERLAFGNVGCSVHGCAALDELLPAPAALRALRLYNNMSGDEGARHIAALLRRAPALQEFSMVSSRVGTDGGAALFAALAGRGDTLLSLDLHDNPITHEALPQLLNLLAAAPKLRVLNLTDTGLGDAGTAAVLRTLGKVQPPLEVSHPFWRGLWGLHIKGGVASTQETGAGG

SEQ ID NO: 9003 - protein, 335 aa, Chlorella protothecoides
MTHPPLHTLLLCVRDTRGASFGTMWTPRSLRWRLGSTGTPAPTPMACSTTTRTRTASAPSTGALACWRVRGCCVLTPTPAAASRPSSSRSLPLASPPVLKVRRHRGDRGGLRLHAQGHPAGGRHAARVLAPYRLAWTAARRAGHLALPRHHLPGEPRHGVHAAALALPLGARGAGVRLPADPLRHALRVLRPHVLRRRAAGAHHQAHRHPQALPHQQQVGGVGAAEVRGAWAGVQPFLAGGKQQPRATRFSACKILPSSPRHRPHTSPPPHWKPCWQVKIHKAYGDLYSAIIDKKVAMKIGPGDWSPTSDKVDVGQKEWKLLHSGPNFAVWEAVL

SEQ ID NO: 9004 - protein, 174 aa, Chlorella protothecoides
MLATASMDEGEGPSVDLDNEAAPGQTVLRVTGRRDAASLARVAQVLADQGMSIRSAAIGSQGGGDVYHLTTRAGGAVAADAWPPLRDALLRVLLHTTRSSKPSIHGAAVDVDARALKAVASEADAAALESAAREMAAAAEALVGVEREIIAAGDEVSTNDLLAKQAEVPSLVRG

SEQ ID NO: 9005 - protein, 173 aa, Chlorella protothecoides
MAAMEAILTSRRELLERALQSSVAVPDFVKPQTVQTTGPAAGNGYEIILQAFNWESCKEAWWKKMAALAPRAAEVGFTSVWLPPPSDAVSPQGYLPRDLYDLNSKYGSEAELRDCIAVAHEVGLKVIADIVINHRCAHYQPAPHAGCLLTTLCRLCRASYGSARIPQTAQNSG

SEQ ID NO: 9006 - protein, 578 aa, Chlorella protothecoides
  MOD_RES (333)..(335): Any amino acid
MSVFICVTCAAQYEGQETPSCCRICDDDRQYVGENGSGIQEWTTAGAVEDSGHRNSITQVREGLHVIGLEPPLGIGQVAHLITRPDGNILWDCLYLSQASVPEIQALGGVSSVVISHPHFYTAAASWAQTFGCKVCCWRGAQVCGVHLGTDLTDADREGSHTRHQTVRLPNLQGGHVPSCRSTLSLSHHACSTGVRACRRCGVGDAALPQPAAMDGGQDGSGSRAHSVPSGWPLPGIKRPPVGRAGACARGGAVHRYRSDSMSPAPGSSLRGPMQTRFGWGSGDPSLGLGLRSNHMSTGPQLPPCAQLEFTCPLLPLGQATQSCPLPGGPPSXXXAQLGSWGSKPAPGTAIQPREHRAPAATLRTAGIHLPPPPPPGQATPSCPLPGGPPSSAWQLRAQSDRGERARGGAAVCGPLHRPLGWNRGTDLLLRGMAPSPMQFLRRRCGTASGCEALQALRRRRARPRLAGRRGPGVDRAEAPSGRAASTTRLVRRSQSTGRGGRGHQGGLQGGGTVAGYKIVGLRCLSKAFQARHLFRDRRVLAASRGDSLALPALAPPAGAFEDLPPEVLVLLADLARG

SEQ ID NO: 9007 - protein, 78 aa, Chlorella protothecoides
MAQPEALRILRELQSRPDNKVCVDCDTKNPQWASVSYGIFMCLECSGKHRGLGVHISFVRCASWEGGKWGLAVQRDSY

SEQ ID NO: 9008 - protein, 188 aa, Chlorella protothecoides
MDAWNPDQLKRMQLGGNGACNAFLGKYGVTKHTDIREKYNSQAAEFYREKIKAELNGQAYTPPSPAEARAAAPPRPPLPSSASGTLRRGEGSSGNVASRGMGAGWDSWDEPQESSGTGSGGRPGSRGMQRGMGKGQPGDAQGDLGAEAQLSTMWAWNNLRNCKALGHMGQHYRPGGARRHRKPWVPGW

SEQ ID NO: 9009 - protein, 246 aa, Chlorella protothecoides
MAGGADPVPENQAAALRALRAYRAPDAAGAAAPGPGLRDLPDFLLASLVYILAEHPDLPSAADLAAATAAAAGGALAAAGDADDDGNGGAPSTPQDLLQPFVHMLQVGLSFLLGRGDHCVRRQEEAAGSCKGMCNATMTPHLGPSPPLQLTLVLRTPSAVCAGGAGHPACRRGHPPRHRGSMCWAGQQAPAHPALLRRAPRCVVVVGSHWPWAIRDFWQVGVCEQHGKVEVPLQGPGSTAHAAQAR

SEQ ID NO: 9010 - protein, 228 aa, Chlorella protothecoides
MHAPGKECTKQAAAPQPLQPPPMHTGLHQSGACGVLLPAASHANNCASDAGARLTGVCASETKGALPAHCVDCMLKRRLARGNSVWCPVFCTTTPCIVSHQPSPGHAKAATYHRPSCCMQSYKLTHIKLYDLCLRHASPLHAFIAFIDVDEFLVMASAERATGLPGLLKEFEQHGALAVNWRLLGSGGRWLGYWMGTEACRGGPVCAVSEGVFPPRKQRPTCPDLHRL

SEQ ID NO: 9011 - protein, 471 aa, Chlorella protothecoides
QLGRAGVLAQAGVLAQVHGVHVAVLSTVQGGGRDLLAGPPVRHRSLGGWFNDIGPVLLGAVGMQGSKGHETPRFYAPSPGARQSKGVRESWDTERRKGELVSLVSTACVPASEVWHFAKSNQVGRGEVPFGSPRMFLTLLDGTGPIALAISAFIALTLGRSNSLAYTIYDWKVIEEAATVLLTVDCWWQPRPQQGASTPSNKLCSSLDTASRRHVVASWTFPRLYLRASAGILALHVACQWEASSGPARLGPNCAEARSLLVTVDRRMISKQIHGEQHTCVRMAGERKAELVHTSHRMESGVDGRPQRSRCRIAALLLLAVIACWLPISRGEGLEKSATGGQGLEAGSRVAQVHSLGDGQTLDAGSDARQLPGNAGSAAEKANASAHVKEAKQAQGTPAGQEYVAICAATKDAGPDVREWADYHLRLGITRIYLFDTDNPEPVEPDIAVRLFLLEGGEGLHCRQGGGDVTG

SEQ ID NO: 9012 - protein, 217 aa, Chlorella protothecoides
MECRGGDGEGKEYASPQEFWDEVAAARSSGAGPQWYDQAVRYWDTQEASDDGVLGGFGELSDPDIVDSRKFLAKALLLHTYQEVDLVEPSGVYWAGPLASGAEVWGSMTSPRPHAAALEVQGAPLNPPSNVHSSAHLLERARTAFEGRAGKDGIPPGHCVVNYFQQGLEAFHPEPQRYDALWLQWAVLYLTDGGAELMEAAARGWGRRPSAIRDILT

SEQ ID NO: 9013 - protein, 524 aa, Chlorella protothecoides
MGTGRRLSPLRESAGRARASRWHDRGLRMGSAGQAFPSHIDNDICRVSHSTYTQPPARMVVSLEGDAFARLYPREYYAKFVSQGMRPDGRVLTQERPISIVRDVVAGADCSALVKLGRATALAGIKLEVASPDDERPGEGSIIVQVGAAEVGRGDWAPGLPRTGCANAGAPASDPVQARQHPCPPTPRRFPSPAPPKQPPGGAAAHVLGQQPARPGQPARRAADGGAGRPGRVWCAVRPRPAHPPRRPLGLGGLLRRVRAGRGRQPLRRLPAGHARRPTGPPPASAGAGGGGRRGGASAARHARGARRPSGPAPGAPAHPPNLRRLWRRPGCGPHRRGGSPHGRPGLSAGERRRPACRREQAGGFGTWQGAPRHGPHGGHAPTLGAAGPVDGGAACVALRAARSQSPRAPGKALSASSRGPAPLHPPRAGTGPGIKAMSLGPGGGTAQAVQEGCPSEAARWRVWATQTHSAWLRWGMPAEKGTPQALQCMGHRDAGLNPTWPPIPRKAWLPEHPNSLNTCAPAL

SEQ ID NO: 9014 - protein, 296 aa, Chlorella protothecoides
MSQARGLSSALSAASSACDHIRDWVLGTPGEAGWRVNRGAITMLPCGTVLAPAMGGRVGVSLCMCFLLQGGFKKLWGPGALEHVLPPAVHALPAAWGTQSARGSAMAARHWPQTLDTRRLTFHTHTRAPTEGTFVSMGVLSDGSYGAPKDVIFSFPVTTKDGKWSIVQVWRGSGGERWLTLSRRALGGGRPCTARPHSHASALQAADLNDSRPAALQAYAPGPCLALRPPPSPLAWITTAGPGHRRPLRPAAEDHRGRTGGGEGAGPGVPGGPVKPPLTLRVGLLTNSSCSAGYHV

SEQ ID NO: 9015 - protein, 272 aa, Chlorella protothecoides
MRGSRRSSPLIPSTQPAPTQILVVANPANTNALILKENAPSIPAENITAMTRLDHNRALGQVRPCGGRLEGGWTSPGRCRGVLDRSQARPFPPPPPPPLYPPYRPPQLSERTGTHVGKVRNAIIWGNHSSTQYPDVNHATVDGKPAREVGRLAELLVGGGMSWGPPYRAPSPWPRPGMPFRGTPPSIPANPGGPPSDPAGGQGRRLSGRKGGGEAPPGALEGAAVWRGAGGRHLKGRAGLAAQEACMSWGCSDPGGTWPRMLAWDERAGQAW

SEQ ID NO: 9016 - protein, 101 aa, Chlorella protothecoides
MGFGNKGACAWRQPSRTAATLRLPPDGQRRRTPWVHLPHASPPPLPRQAGMERKDVMSKNVSIYKAQAAALEKHGNKNAKVRAGRVRRRPGVIVPGTSPSP

SEQ ID NO: 9017 - protein, 138 aa, Chlorella protothecoides
  MOD_RES (125)..(127): Any amino acid
APAPDAAKRPAPRPLRAGYAGHLTHLANRLVATAEEEGGALVREALRASPEWEAFVRDQLEPRNALESVFAWQCGRPTMHGGEQACGLVVEEGLGVKEKGGKGRLDGGLTGGWPSQGAQARIGGXXXRSMPPRRPSLP

SEQ ID NO: 9018 - protein, 357 aa, Chlorella protothecoides
  MOD_RES (16)..(19): Any amino acid
  MOD_RES (263)..(265): Any amino acid
MPVRGAELDFVAQHYXXXXRAIPESSSQNFESKDVRERGRARVRGAALPIQIPHRPVLLGIRAGHQSPPAPACSLPQCPSIVIGGRIGGWQGPVQYPRASPPPLVFQPSHLWMDSTHQPILTITSIPSTERYEERCTFTSFGNWLIPGRLMLGRYPFIEPSRCRSREMGEAQLKQLLEAGITTFICLQEELPPQAELTVGGHNGFQAYKPIAGLLAASLAPPPSQEQFNGGVAWERGGDLVKIHIHVLIAVCAAPKHSQIPVXXXQRPHLPAPPHLCAAPEHSQIPAVPLAIRTCIHSLLSLPFPPCSGLRTPDLDKFLPPRRKAVADPEAAAARISRDLTFLHHPIVDLGLPEPDM

SEQ ID NO: 9019 - protein, 1073 aa, Chlorella protothecoides
  MOD_RES (699)..(702): Any amino acid
  MOD_RES (967)..(970): Any amino acid
  MOD_RES (1001)..(1004): Any amino acid
MFVCHFTQALFIVLPYTVSVYMVRDFLVAGAAPGQPVPEQRVGVLTGALGAVSSAAALLTSYPLGALSDRVGRKAVILVGLASSVASLLWYGAAPSLSQALAARALGGAFNGVIGAEKAMIGDCCDARAATRAFSLFSLAWGVGALFAPVLGGGLSRPCAGALAGATWACGDAGAPLRRWPYLLPCAVSAALCALALALCALGLEETLPGKCGDEGLGSGQASLNLSLASSVQLSVRREGGLDSVSLDWPADDRPGQVGPEAEAATLLPQKTDGRTAPGPDGAGAQLPHTAWHKDRLVILCLIGYGAVAFIYNLHVNTSSERAALPAPLRMPCARGGHPSPSSPAFPLHAHLTCTPPSPPASPPQLRRAAPALRLSPAFRGWAGTAALGPGPLKRLWRRRAHPVHPPGPGPRAARAGCAPRHPPRPVVRTALCSPGPPGQRGAPRPRRPAAGHALRWPGAALDVGRHRLHRLPDPGQRRGAALRRAGRRQRRRTGAGLGRARRGAAGGRRPLGGRRRAGRRALVSSRRAAVRALCRVGTRGHAGAARVCAAWSQIQAVPFGALSPSGASCVGAHTAPRSQVQAVPCGALSPSGACCVGAHTARRGAQSRPPTPRRCLEVGRYCDGDTNSPMIVHYITLTNIITLDSVKAGHGGLMRQECWAHPLTASFSQGAHLVCLGTTSLAPHQGPSSAASPGMRSXXXXTLHYPYQDHHPRLDQGWAWWADVARMLAPSPHSLLLTTRSPGLSRYAQPCSAPGSCQRCVTRYAQPSDVAHAFSGSSRFRLLSWRGEEAVPPCHDQQGRRHEYRCMGVGRMTYIGDMRTLLRCTTDCTLQAGEEQHHKPTSSALKGRGRSPVKPDLTNWSLYLGPGSQKELGKRYHSAPRQTGTSWPEPCREGSAANTSGGARYPVYSAARREIEPRAKSASTPSVSAREPLRAECAFQPSMRSAARLLLPRASTVVPAATHIWXXXXVPSPFMQAERLWPGRVAWVLDSACPHQPSTXXXXQPSMRSAARLPLPRASTVVPAATHIWGGSAGGGGGRAGVGDGRGVRAQGPLALACRKGSSVQLQTMPGT

SEQ ID NO: 9020 - protein, 291 aa, Chlorella protothecoides
  MOD_RES (50)..(53): Any amino acid
  MOD_RES (183)..(185): Any amino acid
MMQSGMSYRVTLRSAQVCLATGSVEDAGQALLPCFSARRCKTSLSATHMXXXXGGCGTGHDAARDVVASDAQECPSDQATGSVEDAGQAPGPYFSARRCKTFLSATYVTYVLPKPMSPSRSSTYLMSAGKLVVFFWLRIVFAVASFASEAYLIRWEHGCLWRIDRAILLPLRWPPAPVSLQAXXXGGLTGPSFCPGSGLLLLSPFKGHCMHAPGMAKYCAPPPPPPRSIERRVSPALARISLSLLTASSACFIASTAFLPSTFTGLALAIAVAAALERRVSLTVAVSVAGA

SEQ ID NO: 9021 - protein, 315 aa, Chlorella protothecoides
MIANRASGAMTNLHYRASLPHSLPGSLARRGSAVDRGRTVIPHAHPLLKHQNGGGVRSGSAAREPFQDPVRWIQEAGQAARRQQAPVPAQGAHGAHAGGQDSCPGIQCALTSLSHQPAGSLIREFEREARLDGLSPEELAARRKQLVQELNGFIGLKKAYAHGHIPGRDELMQVGPSGLPTQDTSTVSDLMVSGRKAIKETDASLLRSERIVNDTVAVGAQTAETLQLQGQQLGKVWCVYMCVCKEGGKGRSEDELLLCMEVATCGGGAVAYWMPGMQAAQMDLRGKASGLVACNEPVGLGLSVLQSLLSRTRDR

SEQ ID NO: 9022 - protein, 162 aa, Chlorella protothecoides
MLGWKAHSARRGSRALTLGVLALFALGSISRLAALYTGYRAPPLVFAALPSLQGSGHEVPVCLGAEWYRFPSSFWLPGPRYRLQFVKSGFTGLLPRPFSAEEGGTASSPRQLNNLNREEPENAWATSDGCAYLVTQRWQDPGAEQGWAYLDKPGERVVRRRL

SEQ ID NO: 9023 - protein, 90 aa, Chlorella protothecoides
KKTVTLTLWGPTAEGLGAELESRAAQHPVLSVSACRVSAFNGVSVSTLHRSVLSVDPAGPEADALRAWWAGEGSAAPTTHVGEGLSGAAG

SEQ ID NO: 9024 - protein, 294 aa, Chlorella protothecoides
MIRCCPRGLPSARNLPSVHPPQKQAEFEAFDLADLRRRVQQVERACAAVGSPTVLAHNDLLAGNVMVSDAFLAAGTVAGESTAASPVSTTSARNDMTFIDFEYVDWAPRGYDWGNHFNEEEAAGIQVDEHQRTGFSAWRHVPIDGLRIDGSRDTGRPHRPRGRLRSCTAGATDYGALLQFKFPQRRYAGFDGDYTQYPSDEEAGAFLRAYLAAEAGVAPAEISADAVADAVAEANLYALASHQYWGAWCFLQAQWSLLDFDYLEYARVRWAECAARSEAFLAAAAQRFPVQEGA

SEQ ID NO: 9025 - protein, 158 aa, Chlorella protothecoides
MQPPRHPDAAPQHSWARGAQVGFPRRDKAKFAEALSNTHCTVWVRATRKSRMAREGQLLAFARATSDKALTATIWDVAVSGCQGDLGVPLVLKEGRKLIHEGCCGAQHWAAPLDGTVQKLACPDKQSFPFQHAHRARSRPAGSASGWAGRWWSAYWRR

SEQ ID NO: 9026 - protein, 291 aa, Chlorella protothecoides
MAALDSDFARWWRLGSEPSALTRGRSFLHPRHEPRTHRGGAVPRRSLKAAPCREGTPPRLQPYPDSPPTNIHMPTGVAAASNARLSLADIREQGPTSAGVKPVFSSATATVASINPDQSLYYAANPENNRKVQGEKRNGYVEVKGAAPHTPLPLLSTPRCARARLAGRGAGPRPVVLRVQRHHPAQHGQAGGPALAAGVWPPPAAVLCSEHASSRHPPPSHLPSTPTSQAKVVDESGECFVQVFNDQAQELLGMSADDLAALKDAEPSRFLATLKAASWKDWALRVKASAQ

SEQ ID NO: 9027 - protein, 612 aa, Chlorella protothecoides
  MOD_RES (457)..(460): Any amino acid
  MOD_RES (482)..(485): Any amino acid
  MOD_RES (516)..(519): Any amino acid
MPRSMIKQVLDRGRQAAGAWPGAVQIRRARLPETSPRPARRPGPGPAAHGDMTEKDEEPRDADHQVLAPEPLEDEQRLARRTLLAECREALKPLPSDDLHEIPGRSVVSQGGAQDCVCRAMAVHRAVSLGQVPGILPAPPPPPCTPSHFGSLACRHAAQQSARVVSPPPRPSPHSLPPHRPGVVFAVKDYSKPDTLRELSGKEAARKDAPFLFRAFETGQPRPPQPGSKRAAAPRAFTIHEYLDWTVTAPDPVTLDDLDFGGFRVVVLYPRYLSLWPAPGAVEADVAAAAAEDERLAKAGGAAAAPLRHRRLACSRPAMPVLQTHATPICAATIRAGPGFLEVPFYATHESKRNKGETCRSEGGAGLGSSLEDLCPGAPPCMQWVSNPAIAFIAKTTFPRTPTPQAMAGLCWRPSRPSAGPQASPPSCSVAQVGSCSLRVWTRVEGGWQAWHWRRSXXXXVSLYAVGFKPCDRIHCQDHIPXXXXRSLGRGGWGLFMPGPCYGSFVPGRVQCHSQXXXXSLPWAWWLGSLHAWPMLWLFCPWEGTMPLSGTPSPLLMDTHRPTHNNKPADDPKTRGTWQQLGFQVSSQSQLDALGVTHMDLLHMDNTVQVGQ

SEQ ID NO: 9028 - protein, 423 aa, Chlorella protothecoides
  MOD_RES (149)..(152): Any amino acid
  MOD_RES (283)..(286): Any amino acid
MHGGEMTSIVASHNAPKRPPLSHTVQAATTSLKRLIPDPGKHRQKGLWAKDAVALAHLGPDPAEMQRGDLAVPVGLVNLGSTCYVNAVLQTLYAIPPFRQALYAARPPLSQDPVVAQLRAACSAGAWLYPAVSNMDRAYGALDPTLVLXXXXAPLILGCPWQLALQELGCTLRELFACMEWGRRDPLDPGPLVAALQLDHAVQQDGQEFMKLFLGLLEARFQAQNPLDALLRVRERKGGGGEVRRGLQCHQMSVSMAVLDCPDGSHSPLTVVPADTHSAPVPXXXXPAAPPDERIHGCAGLSRWQALTTHRCTRRHALSTCSGERAGTRRGVADAAVPRPPLGGERGTMSWRCRCRASRPYPSPWPPCWPRKPCPGATAWLASTVAPRRRPRGSCDWPPPRPCSASASSALYLITGYAGGWSG

SEQ ID NO: 9029 - protein, 198 aa, Chlorella protothecoides
MKPRQPPPTLSKRPAAARCTTMNRVLRTIGPAAPSFQTDPARMLRALRLAARAGLALEAGTRRALVQGVHQMTGLNLVGRAGWGADERLCHSPPLGPRRPGRLGATCARPGGRALHLTSHHTGRLSATCARPGGRALHLTSHHTVRPTPPLHPKPAQARVQMEIHAMLAYGSAASSLDLMWRYHAMDVVLPQVAAHLA

SEQ ID NO: 9030 - protein, 1036 aa, Chlorella protothecoides
  MOD_RES (63)..(66): Any amino acid
  MOD_RES (107)..(110): Any amino acid
  MOD_RES (199)..(201): Any amino acid
  MOD_RES (517)..(520): Any amino acid
  MOD_RES (542)..(545): Any amino acid
  MOD_RES (604)..(607): Any amino acid
  MOD_RES (648)..(651): Any amino acid
MLGRRRRGVQGLGPLGFVGTVQLCDGGILQSRFPRSTSRVQPGEWYALPQSPQLYKQMLMVAXXXXRRGGIGAAAGGARWGGGAEVYRDWDRLDLWRRFNLVMEESXXXXVAGGVWRRSWRACSVPGCQREAIGYGGEERDMVSPATLCVPEGCQGHAAAPSPPPQFSCNHTLHAPTPRRWPAASATRTCAPIGSRSSXXXERNVTWCLQQSCASQRGIKVARCFRDEDLRSDRQPEFTQLDLETSFMDQEAIIGLAEGLMARVFATVLGVEVAAPFPRLSYSQAMERYGCDKPDLRFGLEMTYVTEAVRGSDFRWVPPCWGEGGALGRWAAAPPPAAGETVVTPSTCRLFADAVAQGGIVQGLRVPHGSAISNSRLKGKGDIAGTAPSRACCIHDQNGTLSTRSLHPTLSSPGSRARAGGPRLAPCRGGRGAGGRLGGCAGAGAQLPAADGRGPGSAAREFGTYREGSDRWMGQCMTLRHALEVFRPHLSLINIILTDTCQGDLLLFGAGLAATVXXXXKVNAWSGRACSGAGTSGCRRGXXXXCQGDLLLFGAGLAATVLKGMDRVRQHLGRSLGLVKVNAWSGRACAGAGTSGHPAAAQGXXXXREFGTYREGYDCWMRQCMTLRHTLEVFRPSSVPDQHHPFCXXXXLPLPHAQAGLASGIQPSSLPCLRRTLPTPCCGSWTFPCLRGMRKPVAWWPCTIPSPPPTRTTSRRPYLLSSTASTPSISNPLRRASRWQSAGHTPSISCTTGSRSAAGACASTAAEDPGRRWLQDTLQWLGPVQSLTPSLSAKSPSIPCPPSPPFRRDLQQMVFDAIGLSREEAALQFGYLLDCLDQGAPPHGGGLHDTWQSILQPGRGCSCMSWAGFTVFAAPITLRAWSPNAPQPPAPTPSIPHPIAGMALGLDRLAMLLCGASSIRDVIAFPKTTQGTCAVTLAPAPVGDDQLAALRLQLVPVPEKRHVCTTAETDRAGGARKRSTGKGMDTLFMLPRFPPAPPGWRRRLGAQAPAPAPGWPGPGPAGACPWRPRPVCTVGR

SEQ ID NO: 9031 - protein, 280 aa, Chlorella protothecoides
  MOD_RES (156)..(159): Any amino acid
MTFLDVRDHTGVVQVVVDAGSPRALHDVAARLRPEAVVSVRARVRRRSDPNPGLPSGAVEAEPSSIQVLNPVQGGLPIPVSASSPEGADALRDEVRLRHRVLDLRCGWRGAEARWGGDGLGLLQARRSPACVGQGGRGPTPQWVAAVDRLKPPFLXXXXTGCWTSGVGGEGQRLGGAGMGSACSRHAGALRASGKGAEGQHRNGSPPSVDLNPHSFFPPPRRPQMALNLRKRHELTRCMRRYLEDEHGFLEIETPILGRSTPEGARDFIVPSRCEKEVEG

SEQ ID NO: 9032 - protein, 461 aa, Chlorella protothecoides
  MOD_RES (157)..(160): Any amino acid
MMWGTRVRPRDHFLRHLLKQVSALTPQLADGTSRSRDLPRYGWVLASAAVASIAGGTCTAVAEAPKPVSKENKRPVSIPAGMESPHAGAAAKGVLQVGPRVGVGRVEYERKIRDLSPPHKVFEYFASQVGRVFLRATPGAAADRVPASPHTYEWPDXXXXFASQVGRVFLRATPGAAADRVPASPHTYKWPDHPSQRHGPAAWMTAQDVMRSVVPVFPPSKSAVLRAGSLWGEPSPEMKEAAACPKGSAFLALDMDRDGRIDYEEWLLFLALLSIPTEDIQGRAAPGLHLSHACLVFAASACCSLRARTEKAFSLLSTPFPPPVAFHMVDANHSGSIEVLELEALLVSLRKRYCKILPHTGNPPAGDTSSTTGAQPAMAQAECGGAHGVHHGGAGWEPDTGTLCAICQLTAGDVHALQSDDQTQLRPAHCWRPAALPTRDEVMAMEFAFYDVDSKVAGLKG

SEQ ID NO: 9033 - protein, 360 aa, Chlorella protothecoides
  MOD_RES (200)..(203): Any amino acid
  MOD_RES (239)..(242): Any amino acid
MAARLFEITEEDSFLVVATYLGELLDGGEAPAGEQAETPGSRFATESRELYTSDRTAELLDKYVSQLDTVFASAGEDTGAGGVKWGWGSSSTVGHAQPAPAPAHHWRLSHPWHFSPPSTRQSRERAGHPVPPGPTHRPVQPPASPARSHQAGRRPRSRRAWAGGWTWGQRAARVMHPIPAPLPLTPGPCADPFLLPSLPXXXXEWGWGSSSTVGLAQPAPCSRTPLAPVPPLALLPSLXXXXKRTTGWQPRAGAAAGPDHAVQRAGVGGGAARSPAAHAGLRSHHRLRRRAAAGDPRLRRLLGPRPRSGPGEGAGAAVSRGRCAGRPLLHAAGKRGGGAAPAGPHPGQLRGRGRQGAGRG

SEQ ID NO: 9034 - protein, 106 aa, Chlorella protothecoides
MGRSEGGLVGSSARRSGQSCVLFPLGKDRQSTAGNKAWPPPPAPTDPTPAQRGETSLALPLYQRALRIWEGALGPDHPEVAHALTDIAVIFLERVRRAVREGARRA

SEQ ID NO: 9035 - protein, 194 aa, Chlorella protothecoides
MLPRFPPRPSCITSQPCTQGEDAKGRPLLARALAIQELELGPAHPDVVAIREAGTLLRHGDELQPQGCQLVVADGGGRQGHGAGALRRLGKGDDVTDAAGAAQQHGQPVQAQGHACDGMRNGRRGCWRLWCIRRPRTKSDWRRKNCETSPGHTGAPPPRLENGLPCVMQPTSMGRSTLVQAVQEVAELEGGLLS

SEQ ID NO: 9036 - protein, 182 aa, Chlorella protothecoides
  MOD_RES (121)..(124): Any amino acid
MLWETPGCSGSSRVSPAPDTHFQDLQGDHSASYESIPDRVTAGGGLPPGAHHRRGALVSHAPTPFQAYRATRGIISCEESVRIAPVGCVTPKVPTHPPSPASGRRLQGGLRPARGHGPQGXXXXAPLGCVTPRVPTHPPSPAPGRRLQGGLCPARGHGPQGGHQGAGQGGAADARRRCPLPA

SEQ ID NO: 9037 - protein, 116 aa, Chlorella protothecoides
MLTGELPFDADTPLALMQCIAAADYSLPPTVSAAAAATLRAMLCPDPAARAGIEEVWDMDWVAAWQGDAPGEAARARGGADLCPETQAAEALLEPGSDSASGIEEVSEPGSPVVGR

SEQ ID NO: 9038 - protein, 218 aa, Chlorella protothecoides
MHGWLCTVMISPRTPCCHIILTLLSTGNDEQWGIHAALQDRGLPGWSARATRRYQGTTSNGEYMLPFKTGAFLAGVPVQPVVIKYHRVSRDLGHNLAHMGDYSPPPPSLPAFVPPPALCDLPRGNRAIPGAAAETFEYFQKAQRTQKSRIIQDLYTFLFTLQLPVYVPNEAEKADPKLYADNVRKMMVRSSRGVSKCMCLLELQIHGQSASLLDGVFS

SEQ ID NO: 9039 - protein, 105 aa, Chlorella protothecoides
MWASKRTKVPSLSDPSPTHLHTRAQVPITLYFMTHAYFALYHALANVLIRKARSMVGPRSPNLRILAEAVVVFVLAYSTAYAETLTISHFPYYTHKAGVGNGRGR

SEQ ID NO: 9040 - protein, 221 aa, Chlorella protothecoides
  MOD_RES (126)..(129): Any amino acid
MPGSHCRPMLPPHADRNKSPSLQDKERMYTVGSLFYAIYFFVSFPMFFRMDEDPKARHMGVGGAECWTVGLRYQSLKGWSGSVDAWRGGLPLYTLFPIIPRVPQTPQAKPYTLWKVVVDSLAACMXXXXLARWTPSLHSLSNHPPRAPPTPGQAIHAVEGGCGFPGCMHAGHPPPRLLEAGRDSTAGPSLAGLSRLACLSLVAYNETDHVKPHLGSEEGSK

SEQ ID NO: 9041 - protein, 183 aa, Chlorella protothecoides
  MOD_RES (81)..(84): Any amino acid
MLAELVACHDAALDPASASAGADFEALLAAAAEPLLDSIERSSEALDPNASSRWGGVWVPRGRGSPRVPGRTGEGQHGCRXXXXRLLQASLCTASQPFTCLGMLSDACGTAYPRPLLLRLDEGAHLDPSDRGIYLINCLALLLSQLEGAACAEGLAARIRWGVDGADEGFRWMEVQIGCMDED

SEQ ID NO: 9042 - protein, 220 aa, Chlorella protothecoides
  MOD_RES (202)..(205): Any amino acid
MRHHPLEPTSNCVQRRRSHIAKSCTALRHPLDFAASTIPSRQVRLEQCLLSGPAPVLCFWVGQVLTFYLATVSKLLGPQSSLAGGCLGRVAVLRASLALRMPGCRSWPAPEVPRPALADAPDHGPLPLHASRPWSETLSSVRALALRAFREQLRQRKDKSARYPLVPPKDLLPPQQVRGRSFAAALGVLAVGTVIAGTSHVXXXXADLSRLRWGYMRWVW

SEQ ID NO: 9043 - protein, 441 aa, Chlorella protothecoides
  MOD_RES (297)..(300): Any amino acid
  MOD_RES (375)..(377): Any amino acid
  MOD_RES (428)..(431): Any amino acid
MREGLKGAVLCADASAPSAPDLCPRRSRAGHPRQLPRTDVRPAPARGTGADGKHGGAAGGGLRAAVPLGAAPRRRPGRGRRAGGGPGPGPRRGRAARPPRAPGLLHGRGGARAARRPLPALHQGCWGRGCTQEGLVHACSGAACEGLAARTDCAASRAERHAHLLLTAGPLCGDAGGAACTSAADCMTVPPSARFPTLRLHPTPQALTQGPRPIEMQAGDTRRYVGDMLAWLHAALELEAEFLGSLFGDGEAAAGNAAGAGNDAAAGAAGQASGDREAAGGAPEATAPAARSRWASXXXXLFGDGEAAAGDAAGAGSDAAAGAAGQASGAREAAGGAPEATGAATTTDGTVPTLQRVLDKVFESICRPLKVGGLXXXIARMPRGWQGMAPGAVHRCPVHAAPSSGAYEQLRTASQTSYRKIGHRAETXXXXSPGCPGDGKA

SEQ ID NO: 9044 - protein, 632 aa, Chlorella protothecoides
  MOD_RES (21)..(24): Any amino acid
  MOD_RES (380)..(383): Any amino acid
MLRARKMKACCDGDPDGPMWXXXXPLKTGIGFFRDRCNCRGGGRLLFIHIDARQLSPVASYIAGCSAGSAGIVTGFPFDTVKVRLQNQQIGHGTSWGTFKGILRHQGVRGLFTGLSPQLVGGALECGVNYAVRAGSRKLGRRVNQYMVQISWMASPGSSDGKGGPEGSARVSAASGHCPSLPQLFDRPVQVYNESLSYLSREWHAPSALSVPLAGGAAGFFLSIILSPAELVKVVVQGVDAECWQLRTSATPPFQLHTARPPPPTLHSAGCRLLMPGWPSRHPGTACATCSRPRDCVASRVASAVPSLGRSPATPSTSPPTPSVFLWGWCGRERQWVQSSAACCSPVPHTVPHPTPAGAAQLHPRQASGDAFRGGVLQRXXXXPTPAGAAQLHPWQASGDAFRGGVLQRPRVSPHPAAAAGQCQLDGPGRGRGRHGDVGAGPAHGRRQDADAGGAAGIEARSVPAGHAARAAARGQAVHGPGAHAGPRLPGQRGPVGGLGAGRGAAGGPLRERDSVAGGCRVWASNVPPCIPSIPRGSSDRDYTLWTLGTQPHTPSDRLVPCQMHRAAQHARGAQSLLGELVCKVVDKHPLGGHGIWRFCQRQIRDQAEEGALVSSQLGHMHLEWGWFKMPG

SEQ ID NO: 9045 - protein, 682 aa, Chlorella protothecoides
MASKGGRVRHGRQHAGQRRGLSMPCEAGTGSVRTRPMHMPALYHVPPSSFPWLALSHRLAHRAAFFLRCCPERTALAPGSACSCCAGRSSDYWSPASAPPGARPAAASSPGASCGIHECQSPSHMCQATKQAAACLLREAEGGDQLQCLHLSKVGGVAQHVYAGVAAFRGQSTNWPNACNPPAPVAIRAVLLLEGLAQSSALLGDHIPFLRSCLRCPDVLDQIPARQDSGPLPRLFLIHRLTPGGAEACDGEHLGRWWVIIRDDTPRLISEKTRVRQGASAGTRATPILCDGLHRLLGPPQQREVAAGCQIAEDGPRGRPCMPRDQRGVPGPDPRRLLQRWAPLLDHPGHAWASIQHIFYICPCVTPSTEIWPSFDPTPIAPPSFSTPTDARSEKVARGQLKAEVERCIGRQHVVILDSMNAIKGYRYELYCLARGAAVRYCMVHVDTPIETCRTWNEARPADARYATAVFADLAGRFERPDSRQRWDAPLFTVRPAAAEGEAEVQAQLRAVLVSALDLVQHADREPGSEGRPVPPASRALAPTIATTNARLSSQGFAFVLSKWGTVQRGRAQQVDQGGAVGMARCQGSPLRPGQRIMSVLEVGLTSHQSASSISAHPAPRSPPPAATNLLHEIDRGAHQVMDAISAAQELRPGGAPGTVQFSGEIPSLRMDRPVRRVRGCC

SEQ ID NO: 9046 - protein, 311 aa, Chlorella protothecoides
  MOD_RES (162)..(165): Any amino acid
MLAGAGGLGGLNDGSPAILTQAAMLRTLHMHMAGLAAGWLPHFNPGMCPHRRFSPLYTPFPPSAGVTLMLEMCHADPAVVALFRPQVPRLASLLRSLLGSQSYAPDTDVSGLTDPFLQVKGSTDEDLDCADGPTSLTAFKARPPHTHTFSPLHTPSCCACCXXXXFLQVKREPLLETGFAMQGFTDEDLDCADGPTSSTAFKARPPHTQSFPPLPHTQLLRLLRELGRGDAESSDAMGDVLAAVASNTESTRNAGNAILYECVQVRELGWEGLESGWCGRETGSALPLRPALPALPAVVPRPQHLHHHLQD

SEQ ID NO: 9047 - protein, 382 aa, Chlorella protothecoides
  MOD_RES (177)..(179): Any amino acid
MAVESIGGLRVLAVNTLGRFLAHRDNNIRYVALHTLARVAARDPGAVQRHRATVVDCVRDADASIRRAALELVYSLVNEGNIRELAAELLDYLAVCDPGFKPDLAAKICVLVGRHAPDKRWYLDSMAKVRGWASGGGRGARDEVLRARPGRARARMFRKSEPDGAGKWTQDFDEPAXXXRGPGQDGRVPECSGGLTPTALGSGPKTLTSPPPSLPSNPQVLRQAGAFVTEEAVAGLVRAVTDAPALRGYAARAFFAALRDVGPGAAPEPLARAAAWCVGEAGDRLVEARGRLEGEDAAQGGRGGGGGEETWPGVFEIDAPAWPHGGGAKDRAGSVVCLGVACMGERPSAQPLLCAESEAHASGSRRPWQPSRLWRLRAGPDP

SEQ ID NO: 9048 - protein, 336 aa, Chlorella protothecoides
  MOD_RES (200)..(202): Any amino acid
MSAHRSRPPPKTHTHTYTHRRPGQADAVREVTLTALAKLGVRLPALAPQVAELLDRFSRAPAPEVQTRAVEYARLAAARGGLAGAVLEPIPAAEGGAGAEDLALVPAEGEEAAGNGGGTGGAGLLGADPAADLAALLGLDAGAPAATNLPALDAAPVDPLAALGMLDLAAPADPLAELLGGGGAGGLRAPAQAASGHTPXXXGGLRTPAQATPGRTPGAGGTGGGPRRGGADRARHLRPGAGRLVAAGRRAALRHAAPVPAQRHEPGRPGAGADAAPARGQLRAGHQAPGPATAPRLPARRRRRDRPGGGGRVSARVLGAPRRPRDAARRAQVPTL

SEQ ID NO: 9049 - protein, 228 aa, Chlorella protothecoides
  MOD_RES (9)..(12): Any amino acid
  MOD_RES (172)..(175): Any amino acid
MRWSCGMHXXXXEPVPSRRTAPLSHPRPQFNPPYHLPLQDSLDSYLFPDALELRHALGESTGPRFSALNDVIVNLLDEFAMVSFTPLDIGDEESIETALFQVDSAIQVGPGGGAFGVWRPLWRMGPGGNSNLLSRMLCACCCTPHVSHVPDGDYELAAAACSGKAFPAETCXXXXLLSRMLCACSCTPHVLHVPDGDDELAAGACSGKAFPADPAVWGGPGRAAEGVR

SEQ ID NO: 9050 - protein, 767 aa, Chlorella protothecoides
MLTTCICILAVDFHAFPRRFAKTETFGTGGREGEDLWCSMQGHVALARCTAGDPGGAMCTVQTSPAPLSPHTPPFPRPDGRGGGELRCHLSHHQGFQGRQPDGRRSCSQVFQRVRRALELLLHAGRAAAGGVSRRGPGRRARAPGPRSGGHGHPGSAPVCTAAPGLAGLDPRRAAHAGLPPLRQQGGPGLPARLPGTPPPVPEPGRRTEAHGRQREAPGRWRGPGLGPPGRLPLLGGTPAARLPPRLQRALRRLDPGPQRSGGARLRGRRGAGGQRPARGPLRAQRPHAARLPGGQSGHRRGELGHGHAGRGGLDCPRRARSLCFWYPAGCAGWMASGAGRRDMISLPDVCVLECQDADLEYRTTQSNSRCPPGPQLLCNSALRGRSQEGMRAPPPRSSGMKRHKRAGRQRQQLLVAALAFGVPDALHIKNAHSKQPPSPTGIAASPPPSFFRLPFCPSRQSSGRLAHGDAGARHVGLDLGDGHLPPVEDACGQRGGRPRLAEDVGEVGGAARPRAGDHRDRHRVGHGLDQLQVEAAARAVAVDAVEQDLARTQVGHAARQLHGIHVSPLASAPHRALPPAVPLAVGAWDCVVFGGRVGIWGSMNLYGDVLRVLRRAYIHTAWVDADHHRLRAVVGADGLDGGGAVGHAAARVVGLRRQHGVAADGHLVGAGAEVGAGHLQRGVVHPRRIGEAADAAADGEGDENAARGLAQHLQHGQVGDGGVAEAGDVQEGDLVRAVLKVAPRKLHGLAQVAHLALGGAGAGACI

SEQ ID NO: 9051 - protein, 381 aa, Chlorella protothecoides
MSHIFSSQAARVRVADQGRRATQRLAGSEPGQCSTQNGVLLIGQGPVALRCRDSCGHMSLHSTGTCPSIWVMWSTGILPGAERGPCPARRHHPCSTHKPLIHTHVLQCIIGKDPEIHPTLYSLHRATPCVDLYCPCMVDHRALSSLQCAVLTTLHLQLSRACASFTAVISQKESHSRAICPATCIGIPPPCRCVSLWVAMADSWEDQSEEQITYEPQKPKLNPLASSFSFSPGASSFTPVAPAPAPNPAPAPAAAPAPAPEPAELLAADPPSAEVAPAPETSEPPSEPEPKAAPAETRPAPAAPSKGAAVHTGLCLSHCHRGTPAAAPEAIETVTKELKKATIAAEESEAQKAARRAEVDKVLADITANDARCVLGNDCAD

SEQ ID NO: 9052 - protein, 736 aa, Chlorella protothecoides
MAGAPGTPSGKQHAPPRVRACPVGAPPTSDLICPPRIKLPPKLPTLAPLPRVTAATYYLDGFECGAERFQDGAVTINNPALVALQEAQLLWPGTPLEVLVSIGTGSVPCVPRPAAVSSFMETGNILIESATDVERVAETLAATAHLIPGLQYFRLCEGLEGGRRGVLAWEYCPSADSRRRRNEQLPSRARFCCNLGNYAPIHTHSALPLLPLPALPPPPNIILQVLTHGRSVPDGAGRDPAGGVGQAGGGHGGMHPELWAAAGLGRRRVDEGGLCVAVILGDADRCKILVPWCESQGTCVLNPISSACAGHWHGDKERSGLDQGARIVVLHAPELGARKAELTAPLPTANLTVLCTDSFFASPTPLSNGAEAPGPRTSAASGPTHDGEPTQQEEAQESDQEENGQEPESPLNPPPTASTSKDPPAATQGTSQGAGGGLSEYLTSWFSPSKGGAGNADAARAEGGAGDSGGPAPSFLPQSARSRKRARRAVLHPGAASGAGLSLAPLAAAVAAALPPGRTAAVVLDLPVSSAGDLVLSWRSELHAVLGGSPAEAEWEARCGQPLAALFSPLPACTLPGGDQRLSLLSQHAQVVGGGRSVELRLMEHVSPGRSLSTAEASAHGRGMGVEGSGLHLRVRHTYPGTLPLQVGEGALAASLAGSVVFLTRTANPAWVAALLRGGTAAAVVAPAGEKSLTVQDLESVWPLLVAGQPLLPVLQRHGGLHLFTLGTDDKVQRHT

SEQ ID NO: 9053 - protein, 596 aa, Chlorella protothecoides
  MOD_RES (64)..(67): Any amino acid
  MOD_RES (118)..(121): Any amino acid
  MOD_RES (288)..(297): Any amino acid
  MOD_RES (341)..(344): Any amino acid
  MOD_RES (480)..(483): Any amino acid
  MOD_RES (565)..(568): Any amino acid
MAFSSNQASPAPRYSASASPTLPTPPLAGENATVQRAVGRAPMQGRGVRILSMDGGGMKVGRRXXXXRGVRILSMDGGGMKVGGRGGIWRAAARRAGVLWTPPHRMPQRNNRLPPILXXXXQPGGQGFSGRPRTKCQKGTSACRPSSMPAWELNPPPRPPKQGMATVRMLRELEARTGRRVHELFDLIVGTSTGGLLAVALALRRMTLDECEAIYKVLGQRVFSRGGAQDREEGWMDSFYRNFHSRTQHVRAVVVGYKHDSGEGLVGWEGEVGQASTMMILWRRLVGXXXXXXXXXXSRTGFHFEGLLHGTVRQGIPGSPQQSPRHHHLCAPRFRSAGLPXXXXARHWGRAGRRPMTEEGGAGDGERPIPVVWADLEKSRALDSTLRDSFMALVCDLHRIDFTLCTRNDLSHAPLIPSHVRGAPERLLRPQRLPRGAGQVHDRCVGPGRAATWHEGRAELVWCASAEMSRATGRQCAVPXXXXACCHLARGSCGAVGQDIPGSAQQSPRHRHLCAPRFRSAGLPEGGARGHPGLGGAEEGRGGVLQFSIPEQAGTMPGLRGEVSXXXXTMKWAPSCGVGCRRCGRGEEWGSAVQYS

SEQ ID NO: 9054 - protein, 163 aa, Chlorella protothecoides
MSGLPCTSGRLEGLRQPSARGGALSRSSAPVRRAKAIIARASEKREVTLLDYGAGNVRSVRNAIHKLGYTIKDVRGVWCGATGCASDNVRAARHGFPRVAPRSMLIDPPHMLTTSRLCQVSCVKDIENASRIIFPGVGACGQATEAVQRMGYREALIDYLKVC

SEQ ID NO: 9055 - protein, 117 aa, Chlorella protothecoides
MPGHGSGVQTPVHTSPRHQSPPQTHATRTISVDPSKSEDCFRGAKFLHRLLEGLGAEVKLVQPMEGKNPLVIARLGRCPTKPTVTFYGGMGVGGCVVKVQQDAGSLYCVRQQRSVCP

SEQ ID NO: 9056 - protein, 217 aa, Chlorella protothecoides
MGDFSESKASREEAELRAPFVRNDRFGEFGMGNLPTCLKAVLVLESIFILPFRAVGSFLCLFLYWLVCRLSSPLPPQHRAAIVVPMGKLACRSCLFCIGFFKVEWVLDPAAGQGPRAGGIVSNHCSWADILLHMSHSFPAFVARDSTANLPFIGIIRNRTGRNQAVSLGVEALLAVCSLMKTAAHTLAVTAAALTVLSHLRLGCAGCSRPGEAKDGG

SEQ ID NO: 9057 - protein, 332 aa, Chlorella protothecoides
MLPGVPRGLAKRVIACLDVRANDHGDLVVTKGDQYDVRESADASSGAGSSKGEVRNLGKPVELAGRYFEDGADEVTFLNITGFRDSPVADLPMLEVLRQTSRGVFVPLTVGGGIRSFTDAAGVHHPALEVAGAYFRSGADKVSIGGDAVLAAEAYYARGGVPDGSTAIEAISTHYGAQAVVVSIDPRRVYVRAPEDTEHVTVETATPGPNGERYCWWQCTVRGGREGRDVDAVQLARCVAHLGAGEILLNCIDRDGAGSGFDLELVKAVSDAVTIPVIASSGAGRPSHFSDVFRETGAAAALAAGIFHRREVAIAEVKADMARAGIPVRQSA

SEQ ID NO: 9058 - protein, 86 aa, Chlorella protothecoides
MGPEPSSCALREPHSTFEGPGRAGSKYDFVKVRVWLGEDQAHWYTLSRFLISRTLTVTQIPADKACRWEGSAVPEQARASGALPLF

SEQ ID NO: 9059 - protein, 349 aa, Chlorella protothecoides
MRVGGKAHRDGVKRKGRWVLCPGVDVGDDIVRRLEGIGVCGCALRGEDPQLEANRQLHRRRRRPPLPLLPFLPKIAGALAYLHSCGIIHGDLSGNNVLLTAQPNDARRWVAMVSDFGLSRIRGMQSVHSAPHGTVTHMPPELLRGGPMTHEVDVWSFGTLLWEMCAGKRAWDTLSYHQVLHALVSEGQTLPVKSLSGVPPLLQGRNREAWPGGGSRSASCEADDVCQGTGERSTRDGPMAVTPGNTIDNHDPLEYRRQQVQTWMSLPLSPTPPSSSAGADGVVPSHRPQRPPLLCQDRAEARPDGACPEAKILAVTQQPPGMLQLGRSPTMQCRGPRSSLGQPCRLKKA

SEQ ID NO: 9060 - protein, 322 aa, Chlorella protothecoides
MTSRDRISSHVPPAAGAAAITPEATGHAGAVTALAASGEVLFSASADSTIRVWRLPNLTHERVLRGHRGSVLALHLAGGVLLSGGRDAVIRVWDCGTLVCRRTLPGHRGDVLALTSVGIAVPAGGAGEYADLLSPGLASPLASAADISPANSLFLGAGGVGAGNGIGNAGSTTSNLHRRQPLLYASASADGCVRLWDAATFACLRVLGGGPGASPVMACALTETHAAAALPDGVIRLYACDDLFVAAAGRALGVPVEAEEPGRGGVEARTRRGQGAAPKPEAGDVVTKMERELERALRTFIRLRWEERRERKDLASKGGGWL

SEQ ID NO: 9061 - protein, 90 aa, Chlorella protothecoides
MQGDDRPLKRLPDTVQATDKLPDGPEPVAVEVEYPSREELTRVVGSPEQALSTLLSTTLASADWVEVCRALGTLRQLTVHEPAALLEPHL

SEQ ID NO: 9062 - protein, 169 aa, Chlorella protothecoides
MASASRQLSPLLPATSRAPPSLLQLAADSVDPAALSALLLPYTEHKSPKVRGRTAIVLSLAQARVQVQPESGHVVMGGACVDDNTLGGIPVPSLLAASGRLLTDNTPEAREAAKKLLAHVRAAFEQTEAAGVAVPKAAEEGAPAPTPWEAYCRAQLPGSTALAVLRAQQ

SEQ ID NO: 9063 - protein, 213 aa, Chlorella protothecoides
MCPTPITPPPSRWEAALSAPTTPPLPPLSPAGHLAASDPKHRTQMVAQEGALQQLLLMALSDSEQVACETCATLALLASHGPELAEAVAARDVSPVLGLLRSEASPAVTLAALRVLCALALTSTAAGARVAGEEVLDALEGLCTRPGVETGVLAAALEAVGNLCFGERVRAALRRRRPLMDAVDGLAGEAGGAGGGPVRAAAIRVLAILGGGS

SEQ ID NO: 9064 - protein, 74 aa, Chlorella protothecoides
MLLLDERQEVLMLVTNSLKNDLHNRNMLIQGLALCALGNICSAEMARDLAPEVEKLMGSINPYLRKKAALCASR

SEQ ID NO: 9065 - protein, 213 aa, Chlorella protothecoides
MVAAIASGMDAALVAETPVGGLAASRRLALPAHLFAQRPGLMREVTLGCLIGVGSSGRTYRGMWHGGRVAVKIVECWADPGAGALLRQRSVEVRAEQDTHAAVVEAALGRALAHPHIVPTYAYAGTQGEGAHRPITTPPTLPCTHSFTNPPFPHKIETLQVDARGLVHSATWIVQAFCSRGSLIEAVQRGDLAQDGQPNLRAILSTAGEVGGD

SEQ ID NO: 9066 - protein, 267 aa, Chlorella protothecoides
MQAVRIALAVKKDLVDRGRLEVSQEELESALTSALAIHGVGAHHLPRYRTVSAFFQRRAPLIILLCGTACTGKSTIAQLLASRLNLPNVLQTDLLMEVGHAVRLSRIPAARCAPIRPKSTIHAFMPPIKRIPLHLTPAQFFRGSEVVPAQPSVWHAEDEEALVSRFQAQSRQVRRGLSGDLHKECDVWQPAVPAGWPLAEYIRCMAGTPDTRAPPFLCKCIEEGKSIIIEGCHLDPSLYLNEFGAAAVLEDAQVGQVDLGDPATTRR

SEQ ID NO: 9067 - protein, 177 aa, Chlorella protothecoides
MQQADRPFLGICLGMQILFDGSTENGGVEGLGVVPGTIRQFDTSLGLPEGVPPTKLRRGSAGVLCALLRRLPGRGEQGLGPGDGRCAAEGRRRMERESTGALACVPAKHSPGPAPAEYAGEFVSTLQKGNVYATQWHPEKSGAAGLDFIHGFLDPEWAAAQPRLDPSTSRASNGERA

SEQ ID NO: 9068 - protein, 84 aa, Chlorella protothecoides
MSSTCTQTHPHHAHPLLQTKFVKSGDVAIARIATERSICVEKFDVVPQMGRFTLRDEGKTIAIGKIVKLPKARSGEAGEAGEGA

SEQ ID NO: 9069 - protein, 230 aa, Chlorella protothecoides
MDTNEEERARGKTVEVGRAFFETPKKRYTILDAPGHKSYVPNMISGAAQADVGVLVISARKGEFETGFERGGQTREHAQLAKTLGVQRLVVVVNKMDDPTTVGEDGVWSRERFEEVEKKLTLFLKGSGYNPKKDLAFLPISGLFGHNIKDRVDPKLCPWYKDSAAAGSGLACCPTSSRRRPFHPHPQGPSLFEVLDNVEPALRDVYAPFRMPIMDSYKWVAMLCGHGGLD

SEQ ID NO: 9070 - protein, 60 aa, Chlorella protothecoides
MPVARKLEKMLGAPVLMLPMGQSSDNCHLANERIQRVNLLRGKNVVKRLLMEAPRAKAAQ

SEQ ID NO: 9071 - protein, 461 aa, Chlorella protothecoides
  MOD_RES (185)..(188): Any amino acid
  MOD_RES (238)..(241): Any amino acid
  MOD_RES (338)..(341): Any amino acid
MGADSACPLSGLASAISDLCPDPGIHKRQFRPQYLVTMPSKSTQRDPLQGPGLFGGGNQGNFSASIASTISLSRIADLSENKSTDHHDGSGSDFGTPEQGFRGFAGNRQPARFSGWQAPRPHLMGAWDRAQAFSMIPDVISASLHGVPMLTRRLDPPPFHRPPGPPPAPPLLRWVGGDGNAVVHXXXXTANDANVDVDKYVKDLQAKPGVSCREASPGACQPLLPPSITHRHRPLLCXXXXREASPGACQPLPPPSIAHRHRPLLCLQWDKVDNKTSVVVYGVGALVLLWLSSTIVGALNSVPLVSIGSSALSGCIVNGVPCASCLSVVIHLLGRLMXXXXQQDERGRVWRRRPGPALAFLYNCRSLKLRSPGEHRLVCIEGLYCEWGALRVVFGCSDAFAGSIDVSPPVSPQVPRLLELVGLGYTGWFTYRYLLFKSSREELLDDIESLKSKIAGEIESK

SEQ ID NO: 9072 - protein, 237 aa, Chlorella protothecoides
  MOD_RES (87)..(90): Any amino acid
MAAKHPCTTARQLERGSKGGSPRASYPLSPPERRCAGVQPVPGPSSPSRSPTSGPRRPYLAPPPTQAGINRQAFTTKLCVAQSRACXXXXRVAPPGQATLCPPPECRCAGVRPIPSPSSPSRSPTSGPQRPHLAPPPTQAGTNRQAFTTKLCVAQSHACAAPPPPLPAGWSPYPAWERKAADGQDLDRVMGEMSDQGLRGKMYSREELTQQLEGLGEDEEEEGGAGEGDARPAADEL

SEQ ID NO: 9073 - protein, 271 aa, Chlorella protothecoides
  MOD_RES (92)..(94): Any amino acid
MEQNPGRREGAIDYMEQNPGRRSETLAHGACCYACIGHWGFGVHNWYYHPSVRSLESRRHNHPDLRDQGSWSGRHEDTEHQGGKQPAAPPPXXXLIAFAEGPPKATPRRGDIKYIQCALCEHLAKHAWRSGRALLKTSTVDELTLLEHIEKLGTAWRSEGEWLSQLDIVKQGDKLVVMDKGEPRYDSLHATTPTITLNLPANLQLGVCGVACKTLEAAADDILASHDTDIAEALYTVRGLGFRRAVGVDWQAGMRSGRALIPCLQGTVHRG

SEQ ID NO: 9074 - protein, 227 aa, Chlorella protothecoides
MEAADDQPHAIDTPSSALTTSTPSAALASIERLEARATEALLVQEVRQAVVGTAGTAAGAGVAGFFATTILPTTLEDLLALALASAVGYVSVVNLPLRRAEAKRRLEELTLGILEARYPHPSNRALALNGTHPHHDVCDGIAPPQLQQPALPDLNPSVQIVQTDMEADLAQQVEACCAGVREAIAPLEAAAALEEESVAEFQRECGRLGEAVEEVLARVARLHIAAD

SEQ ID NO: 9075 - protein, 165 aa, Chlorella protothecoides
MGTSREGTWGSTAQFLVMSALLISGRPTHPAGQAFITANPRNDSCPLDGALGGTAQPPSDPPLTPTPPRRLRDRAAHVYFSLLQEALCSKSDVPQAAALLAQCIGCWAGEPGKGVHVDADRHVIEKLSGLVATSGQGSGQQAALNWTQVVDLAGTAGLGDTFALR

SEQ ID NO: 9076 - protein, 177 aa, Chlorella protothecoides
MAMVARQSRGGGKPPLPPPTTAARQRDDTLLFETPEELRCPITHDTFVNPVLTAGGHVYERSAIERHLAHRSTDPLTGAELPNKSLTPIYILQSRAMEYREASARACIEAASEPPPREPGAHRPIEHLRRGVELAAGTKLAIPGLPTETLEYVAAHPGNAYDELALVAFARGLFLSG

SEQ ID NO: 9077 - protein, 229 aa, Chlorella protothecoides
MDIRAWHCAHLPPTPFLHTRQEDAASSSGGSASAAELMGSYREAQRSSTSIPLLRSLEGLRAEGPALDSHLASADGAVLAQGSHALVPSVAAALGRAGGGGSASAAVRQAGAPSKQTPGGKGSDDELVERERELLQQDLVRDALSQLDDPFLVVVVGEFNSGKSAVINALLGERVLAEGVLPTTNEISLLRWREPGSQQPEVQQGTAWGGLCYQKCAHIKPVLFLCEAE

SEQ ID NO: 9078 - protein, 157 aa, Chlorella protothecoides
MHVLVCVGQGDTGPAAPGATLYPAGKRQARLALPALLVALDSGSVDTDTIEAALAQGATGIVLVEDTHGPAALYEAAVAALSAVRGRCPVLIRDRVDVASATEADGVLLMRGALPVLVAKRMLGGGGALVGAAVGSRQEASRAAADGASFIVVQVRA

SEQ ID NO: 9079 - protein, 447 aa, Chlorella protothecoides
MPCSPTLPCLPRAGVVFPAAGPTTKASGASVAACGPVTGFRLEVDAGPEAQVVLSTPLAEYILLKPAPGYKKTFGNLFVQAALVREVCLALSPAKGGDLEASLDEVILRLARSKLDHGYASAREALLINAKLVIAQVLVWGSAQEGSGPALHPFGPMVKVQPWPCMHHAASNMHPPVSPFQLSKLDDVSGPKGLKYLLTECGKALVKEAASYKYVGVQRPGATGIHIRDDTRPEAAPADEDAQTLADADFARQLQAQMDATAARAARGGAKPRGPAYVQVSAEEIANDYPAPLAYAKEEEEVDELLLADEEELGGGADPETLPRRLLTDFSVYNAEGWLASLELLPMWAGVDPSVELYASGVVLEDDGDFSGGQALQEESAAPVDEGAGGSSSAAPPAEDAAGGSSSAAPPAGDAAGVRMCLSQVKDWVVEMGPDMLLISLRTDVAW

SEQ ID NO: 9080 - protein, 363 aa, Chlorella protothecoides
MTATATTMVRAVWQSYFTVAGAGALVAEAGEVEAGEQQAQAGVVAREVEEDENADEGEEDAQESALAAVPAVPVAVAKMAGGAHARRAAPAAAVVAWTGEALRTEGGCTFYPSARVGDLELRLGDAVALGPPVDEDEAASGDEGQDAAPRLPQLGLVQALWQRKGGKGGDAEVQVRLLVRGHETHPFGQQPHLSPPTPQHPPPTRPLASVAALVSASRLERAWDQKRRGEYFRADEELRQANAAAAAEGAPLTHFWRRQYVPEEGIFRDAPADLQLGSRLPDPQIPETGVQVQGKGFRKDGVRYLPGDFLFLGPEVFDAVEGARSIVQLPEYLSNSRFHKVTSSCWGGGWGGRRCFSAMGEDL

SEQ ID NO: 9081 - protein, 149 aa, Chlorella protothecoides
MHGVKRGDACSFRVGIRQTVREWAVQPSPPAVHDGCPHLPRCPREGPLPGIKGDGGHPEDRLEAAPQWRVKSDIAMSLDIDDPPNSRLFVVAGRATSAEFLRDVFEQFGVVSFVKYLRDKGEWTAPGPHCPPKREWGPPSCIPGLTRGR

SEQ ID NO: 9082 - protein, 178 aa, Chlorella protothecoides
MLALPSTTPGVAYVKYDRASSAALAIENLHEVTLNDGRGPRLKVILAESPHMRCLPWLLGAEGKGAGGGARAGSRVWPDVCTCLEAGAAPVACAMASTTLQRARLPAWSVPQRGGEGDPIRNATMPGRRRGPKRLRHGKYHLATCACLPGLYRSGEERATQSGMPRCVLSNHPPPLPR

SEQ ID NO: 9083 - protein, 565 aa, Chlorella protothecoides
  MOD_RES (328)..(331): Any amino acid
  MOD_RES (370)..(372): Any amino acid
  MOD_RES (397)..(400): Any amino acid
MGSEEDAPPAHPHCRPKKGKLKVPTLLMWAEDDGAFTPKVFEDTEAHVEDLTTIGLSDCSHWAQQDRCVTDSVEGSTAVGGQSIGWMGGFDCAEGGGHFPRKAGCIAHREALAFRTSLGVFNSSMFFWTPPHIIFNPLPDPSWSTGTSPSSWQAMPRRSAAGSEWTSLRRGELLVRLCVPFSKACGGFPPRTPPASPCHCLLPDSELLHSAPQPIKRRQSTSRVASREARPGQAGSGRSRGQAPCDSKEERTSDLGRSLPHLRHGVKGTEGICAVGGGGGRRVHVLVGLLRRTPVRWSGGGGAEERQASSRRPHPVHADPPPAPAPAXXXXCAALPSGGAAEVVQKKGKPARVVLTPSMPIPHRPRPPLXXXCASANPCLGGEACFFVGCVFVCVLXXXXHCTLPAHLGGGGASSAFFCRLRRSLKASDTPAELAGAWSPPGGEYRAGYSAAGGAGAGTPQDSPNASVPPAGAGACMEGPLPLLVPASFAEAKGLLGAGACTPPPPPKGLLAACCGGGGIWAEGGAAGGAAGGPHALSLKKGLLAGPASGGGARPLPLAKAGAGA

SEQ ID NO: 9084 - protein, 465 aa, Chlorella protothecoides
  MOD_RES (9)..(11): Any amino acid
  MOD_RES (49)..(52): Any amino acid
  MOD_RES (95)..(98): Any amino acid
SSRENDVRXXXQAYLRQAAFYLTGYLLAVPISGALAISKVTRCVPPRAXXXXGAYLQAPDLADSPVPCREARQAITEQYLWAAGTALPSQPASAXXXXDGVNSHLNHLPLSPCATLRFIKGERRPPLAIQASDASARDFVPGLHHSWLVANGIRLHTVRAGPSTSIPPKPVMVFIHGFPEAWFSWRHQLEHFKQEYDVVAFDMRGYNESDKPLVRTRGWEARASIGLPASHSSLSLWCCPARPLQGIDSYLMRLLVSDVVTIIKSVSPDRQVTLVAHDWGGVTCKACRGASQLLGGGLGPGVTVGYPHCLLKASATTSQPIHPLPSTLPLSSRLGVGQGSPRAAESPRRPVCATPVQLPREDDHGANAQVLVHLLLPDVHLQEDGVEKPRSHQPRGMQGYQYEIWRSALDPASGSGRQALTLPTPHPIPKQEIARYKVAASRPGALTSMINYYRALYRYDPRYPK

SEQ ID NO: 9085 - protein, 164 aa, Chlorella protothecoides
  MOD_RES (64)..(66): Any amino acid
MGVGQAKPCPLIHSGMVAAGSAHLVVPRKAPRRSPSPPTPPTSSSPNPTHTKPPATARSLAATXXXTPRCPSQGTALFTVSPHIADLITSPPPTHKIPSNCAQSGSHVKVEHGQHMGETGMVVTVTGPIATIFTDVSRQEIRVFVKDLVQAVAVTSSVDTCGAG

SEQ ID NO: 9086 - protein, 853 aa, Chlorella protothecoides
  MOD_RES (249)..(252): Any amino acid
  MOD_RES (288)..(291): Any amino acid
  MOD_RES (479)..(481): Any amino acid
  MOD_RES (731)..(734): Any amino acid
MACSPNTFLDKLPLVWRRMRKPPGDRRGLLGLTCIALGLVKSRFIDDIAEVDDDDEDDELEVGGIGAGLVSHRVRIPSSHPHRHQEEGLDDLIDDAGEHVHDAADMIAMRRQMREAEMQAAKDEEMNPEELQAYLKDRYGGQSHYPGTGGAGTEDFGAVAQQALLPKPSDPKLWVVRCAEGAEREGASDSSLGVRTGCDRSLMPPAGLLQKCYDLAQKGRSLLIKSAFCQDHLKVGVAAVRKPAQPAIXXXXLIKSAFCQDHLKVGVAAYPFISRRHLPIPPFPPLPXXXXAHETLPRHVCLSSTPSSAGDTCPSLLPPFPDPQGYLYVEAVKEAHVAEAVRGMRAVFNSKKPRMVPLGEMTAAVAVQVTAARGVDVGSWVRAKAGLYKGDLAQVVDLDASGARATLRLVPRLDLAALSARRPEDARANFGRAPRVRPAAKAFSPDEVCETGERGRGGCEGRGFSVVLWVYQGPGCVVXXXFSPDEGGTATEEQNGARPAAAIITPNHAPVQHLRTLPQTSIPSSITSPPPQIQQQQQQQQARQYKTLDVLTQRDRTTGQLVHVLNGSQRFSEGYLIKSVAVKGLALEDGLPPLDDLQRFQAAAQGGGGGGGGGAGDRAGAADLAGLVQSLTTEGEGQGGAAPTRFAKGDLVLVVQGGERGPGWLTGCHFVVGVAVERSSGWFRREWGNCWACLAGHHPRVGARRRPCFPCPVGQSPSVCVVPRPLHLLPXXXXVDGVSLCRGDCGGEELWIVPSGVGYCLACLAGHHPRVGARRPACFPCPMGQSPSICAAPRPLHLLPYSTHSSSRRPGGHPGPRRGLWRGRAAHGRAHRLQAPRLHRAHRPASARDPETL

SEQ ID NO: 9087 - protein, 114 aa, Chlorella protothecoides
MRVRAAVKKLCEACRVVKRRGKVFIVCKENKKVFGIELCPSLREIRRRLGCEPHLARATSCPFHPPYTSQHKQRQGIHTDAMAIAEKQQSLPTPSRSFVDSGASVGVKLWQGIL

SEQ ID NO: 9088 - protein, 176 aa, Chlorella protothecoides
  MOD_RES (106)..(109): Any amino acid
MTSACTLHASHPQGSPGSFVRLLLLRGKVVGAVLIGDTGKSRGPLGVLAVHVASHTATLLVVLRCACGNPRSEHVMNSTQLSFQPTTDLEEAVEHLILDRLDVGAXXXXTATLLVVLRYAHGNPRSEHVMNGTHLSFQPTTDLEEAVEHLILDRLDVGAYGPSLLDPNFELDHVFD

SEQ ID NO: 9089 - protein, 483 aa, Chlorella protothecoides
  MOD_RES (59)..(61): Any amino acid
  MOD_RES (268)..(310): Any amino acid
  MOD_RES (328)..(331): Any amino acid
  MOD_RES (350)..(352): Any amino acid
  MOD_RES (430)..(433): Any amino acid
MCPWWQPTLSSDALEDHCPIPFSTLFHSSCVLVMEFIPAVSIATACETGFLGPKTLARXXXVMEFIPAVSITTACETGFLAPRTLAHVSHDLGRSVSRSECVGALAGRVGGRSVPGRWASPGTQRDSLLESPYPKQIMHRSTHRHRAPLRPLCASNHLTNLIPRRMLCLDMMLGNADRLPIEALGWRGNLGNVLFARTGRWVGRMVAIDAVVQRRPPGRLVCTEVSSRVIGAWGAKQMVLGAVLGPPTAATRCAGVPPTSNSISPRPXXXXXXXXXXXXXXXXXXXXXXXXXXXXXXXXXXXXXXXXXXXGHRGLPAGAVSDGKGSEXXXXGHRGLPAGAVSDGKGVRGXXXDMESSFELAAATPPRALISGGSGVEGRYGGGGGPGPGVTAPSAASGPSGCSPSLLASPGAGAGATAAATPSGSRRASXXXXGLGGKADGPECGSGSTDCGHALRRGASVEQQHLTSATCRTRRASALLSWR

SEQ ID NO: 9090 - protein, 272 aa, Chlorella protothecoides
MGNAASATTAAALDALASVTGPASLQLDDETWQPLLTVSTPLSRWSEDELQATIRPYCGDLGRSSGQLVTACSQEYVIRAVYILPHAGYSVWHLLHPSGVFSVSSAHMVDATSFSSPLPPQSTTVYHNCQTYNLQRLIVLLCRPHGAPHAGAAPGIPVVASPRCELNEGCWWRCDVAVTGSIAPGSSWPRPCLNSCTHENAGLLSFSCLDNSRAVPHITPCTGSPHKVAVERDAQEEEQTPVEQQLVGACLRALVARNDPAARSVWYTGFRE

SEQ ID NO: 9091 - protein, 198 aa, Chlorella protothecoides
MVPWKALRACCTSEQLHSSGALPAQTAAQDSAGDKPVTPRGASALEINSGGLVFFCLFNARDAHIGSCSPRQSPPPCPGPESSEEALRAAAESALAEAAANGRLSPPCTEAAANGRLSPPCTDAGPREVSPSVIEVIPGANAPLAVAKRSAPHGCLVLKIPASRLQCQSELFAGEVARHVGLACPDGRILRQARRAHR

SEQ ID NO: 9092 - protein, 86 aa, Chlorella protothecoides
MAGVEEDTASSMAFELFTHVTSFAGLKVVLLGRYNGQGLENEPEADLISFSRTTPPDPSQARRGGAGRFWATTGREHCAHGLHPLR

SEQ ID NO: 9093 - protein, 205 aa, Chlorella protothecoides
MRSRARPARVPGLTSEAAQRLVSLLALLARRWRRLAADATGLGTMAAAVGDPATAADGTPEATSLAVSESTSAAAAESAQLAHDFLRMALESASAVLERALPANPALVYALLHRGELFEGLPRDDPGLRVPLANILAVIDHFTRALARSLGEGAAALDAGTVMAAIRHDSRAWRGDRLQRGADLHFAYEEGAEKECVGRWVIRGC

SEQ ID NO: 9094 - protein, 249 aa, Chlorella protothecoides
MCQDGMVVVSSWSPPPELIYHIPCPPRKVSCRALPRSSFHQPKSPSAALQGLRTALESLAAVKGLFEMMYEVVRDWMDEFLADMESSFELAATTPPRALISSASGVEGRCGGGWGPGPGVTAPPAASGPSGFSPSILASLGAGAGATAAATPSGSRRASALVSDSPSADVGLTTQKIRHINQEAQHNHSVSRKVAAWRDVFRARGSELRGAVEEWQQKRDASGSRLTTGFLDGVRPVVDVYELKVGCRS

SEQ ID NO: 9095 - protein, 133 aa, Chlorella protothecoides
MPSRGIDETLAEAARIQLDVMQGLDSPERASHASPLSPRSTAWRWLGEHPDDAAELAALLHEAAPKLGLKGDYPVSRRVTPSFPAKTTLRRDEADPEDLGQLLQQAVPIPTGETWSAASLIRVLVSHSTYIWV

SEQ ID NO: 9096 - protein, 176 aa, Chlorella protothecoides
MDGAEGSCVEGGAVGGSDATAGSGVAQARQREGPPGALLGHAVGPTWIKHLAHGQRGGALTLHLGCEVERVSRGTAPGDPGGPWPVALELSDGRWVCADVAVAALGVTPSTEWLGPELERGRDGGIKVDTRMQTSLAGVFAAGDACSAPDFDTPDSQWFQMRLWTQVRTIGGGPEG

SEQ ID NO: 9097 - protein, 213 aa, Chlorella protothecoides
MTSRDYADGTVLELRAGRLELDSVLASATARRQPVLVQFSASWCGPCRMMTPVVAELARAHTGRLVAVKVDIEAGPPNKALAAALRIQSLPTFQLYRDGAVADALQGANRAGLSALVSRALAEAGPAPDADDMAARLAQALGRVKAATSREDFHEAARVLLRFVGNVLDHRDDAKYRRVKLANPVFASKVGLGRIVLCFHRGNGEVREFSNGY

SEQ ID NO: 9098 - protein, 389 aa, Chlorella protothecoides
  MOD_RES (54)..(85): Any amino acid
  MOD_RES (266)..(277): Any amino acid
RGWVPWVGGCLGWGGWTRASPSHACTHSSRRFHSPPLPGAAAGAAGARGGDPRXXXXXXXXXXXXXXXXXXXXXXXXXXXXXXXXARRLHGPRSAAHVALRLGGAGAGEGGRRPLPAGQGGGRGVVGVVRRARRQKRRGAAAAVGRARHPAQQARLARGGDGALAGCGGGLHALLSAARPVPRPGVLGLQPAGRAAELEPVAARAPLLHLRRGGQGRDQPPVLQQHEARGGRDGAVPGALPAPQAQGRRRPAAEAAGGGGGGAPPXXXXXXXXXXXXQTSCPVHELSDEVLRRLEKYHATSHLHAASQPELYPPGRLIFLRPFKGQGVAHTWDAVWVDAATLMGEGILLAPSMLAHHRMFTLADAFAEVLREGHEAALEELSTDPDTPC

SEQ ID NO: 9099 - protein, 371 aa, Chlorella protothecoides
MLYRTAVEDVPTGDYSIPLGQARIARAGSDVTLVGWGQQVLVLEQAVSAGRAGLRVVPEAVPHPITCQAKELAASDGIEAEVIDLRTLLPWDAEAVAASVEKTGRWVLGPWHSQVVIERPRAHWGGRGPRRAPSAPAVCAGMGMARLVVSAWEGPSGHITVGTAPPNTTCQWLPRHSPAGQSPDVPLPPTRGPRVRPYTQAGGESRGPADVRVRRGDRRRHLRPLLLLPGGPAAAHRGLRHALPPGLRAPVPPRRAAGGGWLRRTVPGFQGQTMRWSTACTYRVQFSKRITAGRREEGGMSSRPSTWWVGRETGGCGCAVETKGQQGDGGPGLWSLRGRPPPAPGWGDGVPMSDGPRSRCPHRARPTRHGS

SEQ ID NO: 9100 - protein, 1212 aa, Chlorella protothecoides
  MOD_RES (31)..(58): Any amino acid
MHHTHAASGVHANPYLRRRASPQGPRRACRXXXXXXXXXXXXXXXXXXXXXXXXXXXXRPPAAGELSSRSTAHLRRSVGSGQRGARPRLACTQAWSGRGGRLWVRAAVRCTSGPRGLLDLFQGLVRSSKDPLHHCPPHTASAYTTAGLAMLTPTAVANSSSVRGRSRCLNSQHPRYWPGTTWVTGMMATEWAESARPPHPSSLDWDPRPAAVRGRPPPLHAWPQHGAAPRRCPGHAPGPGEESEDGVRGGWGGSTERGQADAKPCAASFQSAGRGAAALLGIAIHRSGKEAHGQGACPCPNPPAQAFLSGDRPRPRAEAPGAARGPAPGPCTAFIALRVRFNTVPTLPRRTGFWVESYQITQTSMPTPGHETTTPRQASYFGVRALGRVPKREVSLVKCFSTMSWWRGEGGTSAISCMVWGEGGRVGDRDRRPVPKFGANDLAEAQLLMLWIPGQPPATQAASQALHEKPGRPALKRACRSTPALGAPGAGPASDAEHATTGPPPSEVGLDAPWHGGVGICSRWPLVDRFLPPSPTPALDPAPQREPHPADPKEFPTHIQLQAENSAALLPGHRGWGVLAGMAHGRVQGGGMLRDRTGQDSTFSSSHNNLGSAPRRGGPHPLPVDVRLTAEHADPVLGQLAWRRGAGHHNHQPGLQGACRRPCGGSGLGAHRPCLGVPHHVAVAQQHSQCPWRVPHQRLKAVLLHLCRRECESGVGDRPASPLAHPRGSEGLGGRGPRGAAAVRMGWADGFQGQLRQAKTRRTPRTSGLCWASGTVIRRTAGLSSVAARAMRSCCVSRSPSRPTTGRGGSWKPSNSMGLPAPPRGERPPPVARTDTRDHPAPRGCRIEVARELCAGSPGDPRLLVMFHETKNPTDRWKPLFRIIQALVIEPNRITAFEEAPVQDPSLPAMAAILRAPGLGGVWGTVRGLATAVRQAEPATAGLDAKQMNLCSAVNDALHIAMDENPKTLVFGEDVSFGGVFRCTVGLAEKHGKHRVFNTPLCEQVRADQGGIVGFGIGAAAQGYSPIVEIQFADYIFPAFDQTSECPHACPPCQITNEAAKYRFRSGGEFNGTMCDPKIGASNPAYVCCGLFSCSCRAILPAFMYEQQLQHAARTDVHLSTICAGAVGHGGHYHSQSPEAFFTHIPGIKVVMPSGPRETKGCHSSETRTVLRMSLILACREGCVASGSPLHTPSPLPISPPFLQRPPPVGHP

SEQ ID NO: 9101 - protein, 221 aa, Chlorella protothecoides
MQQHSFEALMRHTPGALAVLLRHGDVMGDPKAWAMCSQAAAAARTAARTLQARLMVVVTSPTAPGQLAEDRISMLCRQADVDRKSILALHMRDQVGMAGVLSTLVQAAQTSYLDAAVRHASKHPPTTVAGQECGRVLGLKLDVSRELFWVSRDPGLGLAKVALAAPPMVKDALERRAGRAHTESINQRPSAADPHSSMLKITPNPNHLPARSTAGDGGPPR

SEQ ID NO: 9102 - protein, 61 aa, Chlorella protothecoides
MGAQLIQHIKDQAAKAERGVYLEASSAASTRFYSRHGFQHVREHRLHEAAPILNLMAYHPE

SEQ ID NO: 9103 - protein, 501 aa, Chlorella protothecoides
  MOD_RES (128)..(131): Any amino acid
  MOD_RES (152)..(162): Any amino acid
MAPGLLHEMAPLLSPGSGADAALVRRVLSILRSVVGAMQSVTGTHAAGVKALLTEVLAEWAPLLAAVLAPREVGCHPGSGPDLEGLEEWGTGGGIRLQVLHTVEQALKPCIERLWLPTLFLPNPLLSXXXXGGVGGVGHGGWDSASGLAHRXXXXXXXXXXXQQVPELWAAQREALGILTVLVSSFGRLSAPVLTPVLGTVWHRFSAGLPQYVAAVVEGEADAGFGDPAPADGAEAEDGERAVGLEGLLAQTMELILCVVGNARFRGLIAPHLPQLLGLAVGYAQMTAEQEERWTDCPNQYVADEEDDMSSLRWALVCWVRGRRGQRVEGGSERWGSSLMVGAGPWSDVLGQAASCPAGSSFASHPHQTTTPSPPHPLTPTPTHYRTKCNRASCEMLVDEVFLAFEEAAAPALSRAVGEALARSGTARASGRPGWWREREAALLLVGSAADTLLGLGPRAFDLAGLLSGPVVEDLAPGSPPFLRGRALWLAGRLAAAAPRA

SEQ ID NO: 9104 - protein, 650 aa, Chlorella protothecoides
  MOD_RES (205)..(208): Any amino acid
  MOD_RES (408)..(410): Any amino acid
  MOD_RES (492)..(494): Any amino acid
MRGGAKGSAPLGLVFKVESGKWRGCAAPHAPPLPPSPQTTAEGIAGRKVAEEATNSLLGALQEGYIFVLPTASGAPPARGSGEDQAAFQDDSEGFLALAALAGVPQVRMQAGPAWECERGVDVTGVLKLPPGWGPCCRRRWGSCLGHRPGRWVPTAPPLGRAPAPQRREAGGRLAARCPPPVIPRGKRAPAPATPRPPGLRRARXXXXFGGAAPPARDSPGGKGPRPRDNTAARAEACKEAGNDAFKSGRYDDAVLQYSQALALDPGNAVYYNNRALVYLRLGRYGAAEEDAEASLRIRVSAKALLRRGSARMAMVRASCGWGGGGDGSGRMQISGAGEGREVCVAAVQCRVQGLAQSMRLWWPGCTLQLRRSVNHRVACNAPLLSFSTPSLPLPPLPHRERQRAQPXXXPFRAWCREQLIAVGSTPDLALCEFLMTVDSNSEAAEYLTLYLGKTEAVREFGGEAWGSRLCPAKQGGGAVSPVLGGHRAGAXXXCTTTEAQCKHRVACNAPLMSFSTTPSSPLPPWPHRERQRAQPATLSMCFAWSPIIGRPGRSCVPSSASSPPPRTRLRSNCHQLMPAHAAWQLNPAPTPKRYMLAAPTQAQPFILRVKVSRARSAPYSRSPGLNAVPGGTRLVHTSSLHASRFASMA

SEQ ID NO: 9105 - protein, 217 aa, Chlorella protothecoides
MEGLVACLNSLLSPDPQARRGGENALAQGSQQPGLGVALLEVSQNPSLPTGLRQLAAVILKKHLKEHWTFESGAFREPPIGEEEKAALRARLPRGLADPERKLRTAAGMAVAAVARWDCPQDWPELMPGLLSVVAQKPSPEHVDGTIRCIAMFVDELGEDQILEVRCGADEVEERTDGGGEIEPASTPRAEQRRALPLRYSRLVSLSSVWLCLACMT

SEQ ID NO: 9106 - protein, 471 aa, Chlorella protothecoides
  MOD_RES (429)..(432): Any amino acid
MALRSVLRIRQGLLSSLRILARPAADLAQLDAPALAKPDWQARQARETISAQVPLPRLQHSLAGKEANRPEGSYHIQIVTGSVRGAGTPTPALLQLFGEGLSLRVSGCIRMAAGTRPPTPPTPPPADGESEPYLIGSDGSTMGFESSSRKTYVVCMWVRGDASGAGGSRRNFESVAVASRGTWRTATGHSRCACGWGLMRRVLVEPGGTLNQLRCKSWDLAYSHRAQSVSSPVPPHPCPLADEEAGASSGWFLERIVVVGPEGDSWTFPCAEWLGRDHVTQAIGRGRGCALPAHPMSTPCTLPSPPTPTIPPPRSPLPPFPARLPRARTGPAHGAPVLHDGPSVQPEEPDVGGRLRLLHPAPGEGGGGRARSQPPRRGARRRGRVLHHPRLGDGSGGPGRVRRGLRLARARRGRRRLLARPHGRLRRGXXXXGFSTITSAMKNATQDRHLKKLVRRSRWLDGQRGSPRGHC

SEQ ID NO: 9107 - protein, 196 aa, Chlorella protothecoides
MPEIGARCAEVTRHAMDRTPVPESYHRARTYSGGRAPRKLQVPSRLSPGGAWEWDAGKHSQAPALECQCICTCRHKGLRAPSPHVTRRDPGQPILSVDATAPVPPHLASGINMALGLLESALGRRLHTFHLSTAEFGGCGTGRAPCALWEAATGRVWVGAGVARSWAQGHGVAQLVAAVGARLAGLVEGVAKEVRG

SEQ ID NO: 9108 - protein, 300 aa, Chlorella protothecoides
MAAEPARAFPRPMEPPLLPPPATEPVTKMVSLYNTLAVKLMDAKNYDNALTLLRKARRGGRGGRILQARHDSPSFPAPAVSMKTCPPPTPLAQAEALGEDDGRWGPEEARARPRLRCITFNNLGCLFRRRNAPAEALQYLARALEQGRLGGDARSAASTHLNVCAAYAGLRRDREALGHAERAALLLQRELFVPAASSFAEGLAGLAARLAADRRHTQRTAASVLAMAYHNAALAHERLGSQAEARVALARARAVADRCLGHRSHTAASLHRAEKAFLARHQRPVPAPKGGKKPDKVSGY

SEQ ID NO: 9109 - protein, 188 aa, Chlorella protothecoides
LRHLASLPRLRRLNLGRCAALRDAHLAHLLRLPCLQSLSLHRCPGVGDAGLALLAAHPTLAVVLAPNATCDAGCAALARAPALMRVVLHDCPRLGTAGVQALLHAPGVRQVVISRCPHVDQRQLTGYSLCTGRKEWGKEVCGGIGGEGGAGSVWGPTTQQSGRIERCAGPLQSLLITCTRPLSTPCSS

SEQ ID NO: 9110 - protein, 170 aa, Chlorella protothecoides
MAKKHFVPLESNPEVLTSFAANLGADVSNFQFTDVWGLDPVGDGGGMGPGAHISRWMSVSALGSADGTHSMQLTITPPRICSPWSRAPSLPSSSCFPWRQRPPLAEQPLRQARGVVWDVEACRLCTSRCAQVGLKQCPLPVVILTAHRMPHFPLRQMISRCNRCGTRSRR

SEQ ID NO: 9111 - protein, 290 aa, Chlorella protothecoides
RPASPRAPWVPEPRGFLVRRGCNCDKYRVQPADTPPTACPSPSHPPPPTRGLVNGWRVETGAPSLPKDEALARRQTMQHTMQQRVQTATPGSGQARGKAVAADIPAAQAGTSGAPPRTEEAASAPHPGPASTGERAGCLLCWGGLLACVAVRLSGGRRAPGALTPDLSPHQIPHTYPPCSHARPPGDPTRDEAVAVLAHALAPRRAPLDVAAGLEQQLWLDRKEADGAVGDAYLCALRTLWDVLSPQVGLFMATCVWGDAAPNSRGATHVSSRQAAPGRAAQATPGHCVP

SEQ ID NO: 9112 - protein, 127 aa, Chlorella protothecoides
MRCGGRRRDVYPPFCKTVKAVEETDQALLRHRGTSLGAQEGMACSRAGDSSAPSPPRAFPAQAAAQAGSTAAPEATADIDLHFVTFVEHGGRLYELDGWGRGLLRGVAGRSGSARSGPAAGMACRCP

SEQ ID NO: 9113 - protein, 145 aa, Chlorella protothecoides
MALRQLAHVGRQLLGSQSRGFADLLSRPEASSAWTRGGLYGLSQTASSIATTSGKHGDDAAAQTRVPSGSGDGGEAGKPSTSPRKDLVMLFTCGKCDTRAAKAFSRQSYETGVVIVECPGCSSRHLIADHLGWFGQGGGCARVPG

SEQ ID NO: 9114 - protein, 312 aa, Chlorella protothecoides
MHGLSTHHQHAGGSVLAPRCLRPGAWVQAPPKPYHPLLQTDLESPARCVRASVSLPLYFRPMTVPRKRGEKLPLAGQNASRLPDSKWADTGFTTTIPDRVIMAPGGVGKSLDWRERRQHVEGRQRSGRVRFQDGGVLSRFPINLFHVPPTTEVHWPTFGVGLSPPRQAKSTSGLGQLLYASISTAIRIQDIQFTAQNRVGGQGQGRGCGEAGRGEPQSPLAPPRSIAHTGPSSLAMQEYEMLTKTVDVGQVCALDFKMSILGKFVLFYNGVLAARDFLMGTKEKKGFQWEKFKKLRRERSAVVLNTTSITPT

SEQ ID NO: 9115 - protein, 291 aa, Chlorella protothecoides
  MOD_RES (27)..(29): Any amino acid
  MOD_RES (178)..(181): Any amino acid
MPRCRPTSNPLPPPPTPPQGEFAESVXXXTTSNSLPPSPFPPQGEFAESVRDQFLCERIEYFNALEEALYEEAGHAEECSVAHIARALMAMDSELSYRAASLLAAGVWGDSASELMSVKLAMKRVRLGVEPGTCCAVCHMIQFRGDGIGGDDMVRPSHPEVDEPPCRFQEVRSRRAKXXXXTQKSMSLHAGFKRYGQEGPKESSLQRSCLRAPWKTGWCSQQREVGPGPAERQVSGHAMVGSIEAVHSVVSSGQGVAPDRILLMLHTVISLSYFSYILCQLMYHPQEHVAV

SEQ ID NO: 9116 - protein, 175 aa, Chlorella protothecoides
MPPACSFLIGAQIELAAEFLTLDAGVALEHPTLRPGTHCRLIPPMHHPPHSPLAATFASPGERLGVGTDDLLHVHSLISSVIAPKYAAHIVRGNYGSQGGFVLDLALKDIGHVRTLARDASCPVPIADLVFNSLLSARAQHGPDLDWSGIVLPVRRAAGLGGIRDGGAPTAAQGG

SEQ ID NO: 9117 - protein, 124 aa, Chlorella protothecoides
MPNTCIRACTLQSLRHQYCSPLECHGWYELGASHTATKTLHPSSSRTPQEDLRVALHAYFRVGLPGGKTLQRFDELMQALDEDQPGPSVQWATIFEEDREFNQGEWVVKGLMEAVAMCPECHAV

SEQ ID NO: 9118 - protein, 212 aa, Chlorella protothecoides
MVPVHQLQPSSNDPHLLPVSGNTGRRALGHARLHGRGRLRASAAETEVAQTAEAPLHVTVRPPLPKLPERELEFHSAPEGVSGWLNQARLAFALPWRQISDGSVMAFTVSFGKGVRVKDMLRSILMGRLMRLATQHAVLPRSRPCSPMPPSHTHLQLSGALPDVPQGRFSSAMSMPLLTEALKKAAADPRIRGIAVKIDPLSIGWAKLQVGH

SEQ ID NO: 9119 - protein, 211 aa, Chlorella protothecoides
MASNLHEGLSKGIPGYQDFLQVFNRTSSKTTPLQELGAKVAQSIHDLADCRVVFSVSSNDASAEEVRPGRRCHDLYHHVDPKMDLWIATAKFMQPMTPDYAAPNPQLFLAWLEGRTGECQPAAYIDCSTILPETSRRLANQGAARGVTFLACTVFGRPDVAAAGKLTALLAGGRAELRERLVPLVSTFAGVAVRNLGDDPGLSNAAKLTGK

SEQ ID NO: 9120 - protein, 143 aa, Chlorella protothecoides
MLDAGYHQAKEYAAQGWITGLKYEDEVEELLKQRTGGKEDRVLRAPLRRVAAVGNSVLRKLASRQVIAVVRTAGAINGGGGGGLPSTGSAITAPDVAAVILRIDSPGGDALASDLMWREIQQLAAKKPVIASMVDVAASGGEA

SEQ ID NO: 9121 - protein, 165 aa, Chlorella protothecoides
MNWLRLIFCTSPYRTLVHNLAGYYMAMGATHIVAEPLTITGSIGVVTGKFSLERLFERVGFNQTTISRGRYAEALTGARPQSSEEEAWFDEGAWIAYRSFRDRAAASRGAVAQGRVWSGRQALEHGLVDVLGGIGRALQLAKLAADIPLAQNVPVIEFSRAKVGR

SEQ ID NO: 9122 - protein, 612 aa, Chlorella protothecoides
MATSKDAAKAPKPALSSKLMGLKFMQRAAHKEAVQSAATESSQPSEDVSLLGGVFDMFFKTNCSRAAPQRGHNRVSFGGQNTAVEAEARRSSAKAATGVREEAVDDAGATVSDADLASRLEELQSVKTERSDGAARRAEVKQEARSRLFPPRRCGPTRLAPQIQCRSDINKRIDDMFGRRRRCRGAISPCAHVKARLSGELLCGIVVEGGEGALEEGGSTVPRISQGSLCLFEIGLHAKCNVLLDEARTIRSTCTPHHRPHPNSPRPSGSSSSPSVVEVQASSLQSGQPPPPPNPSGTDRWILQWRNASSEAAAAACAASDCGLRFSRVLSGAAARLPRAGLASFLAVHGAALAALHADSTVSVADAHVQSVGGDADQLAAGAESRAGRWGLDRVDQSALPLDGLYHYADDAATVTVYVVDTGILASHEEFRSSSGNSTSRAAEAYTTLSSGTPGSDCQGHGTHVAGVVGGLSYGVAKGVALRAVRMLDCQGQGLVSDAVAALDWLADNAVRPAVVTLSLSGVESVALDQAVAAAVAAGLHVVAAAGNGDVDACSVSPGRATAALIVGASDERDRRLYAGDGVASNYGACVDLFAPGSNIQSAGITSDTASA

SEQ ID NO: 9123 - protein, 585 aa, Chlorella protothecoides
  MOD_RES (370)..(373): Any amino acid
  MOD_RES (491)..(494): Any amino acid
  MOD_RES (512)..(520): Any amino acid
MPRPKGGRLDGAAMLGKFCARGAEIRMLHQARLTWGPLLARRSVQGAQVLQDRHHQPRRDDESEQKRAEALFPIRAWWVPLVRWGRSSAVPRRPSGFPPSTLPNPGAAIEGSSREAPPKVMYVYRLMKPSEIKSTLVSRTVRPLWACGLAGDARHPCLERKLQCCDPAPRQAVGRYPPGHLYLHKQVYVLWPDEEQANATWYRARVDECKVASKKGDLYYEDTDELETGADLADLVYQGHIAFRESAGVWHRPSNRAVCFSHGCASKVTSMRRGRAPVHRAGGGTNESEPRPLHHDLGRDEVGLDAPYTGRALEERLGHLPVTAASASPESSISDAGARDNSAEDSGDAGVWAFEGSGVMGPILCCGNMXXXXTFEGSDFEVEAARERQSGSKRRRASTGEEDSDGEQVGSPSPPEVWLDRGWDEWAVGWRRRPQTPSPRAGDGRPAVHTPTRHSPGDEDADGSGSDEVPLVARAAKMERRRASRGGARGXXXXSCRMTTPTALARTRSHSXXXXXXXXXAAQKLLRQAQGGASGTPRSKPQSPSDFYGSGTPRRHQADHLSDAGVQEKASARAGSKSVLTGSEL

SEQ ID NO: 9124 - protein, 471 aa, Chlorella protothecoides
MAGRLAPEKLVTLSATELANKSRASAPIHERPRLRCDHGIPRRSTHSAFTPPTWPPPNMCPHPQELTEYRRRKEEEALKMAVLDAEAAARFSTAAALETRESQPRKEAQEAAVREARGGEAARAVGEAAEAPDAGSSPPAEEPGAGGAAGDAVAGAASMDAGVLDHDRNPVPELEPGADVAQSPPARPAPSLDWAQIKASAVESAAAEDAAEDAAEELEGFDGWTAGREEEEGPGDAAARGAGQTDGALPPPPPSPLAHLFSAATAGSSPAPGAWRSNLVLPGEGSVLVTLEGLAGAVSPALLLGDRDVEVRGRVTLARLEEFLLDLRHSRHRAVSAGVAGLAPGASPREAGLWADLLALYRARGRTGVAAPQPGVEAYVLAAGDLAARVLEVAAGSGGAGAAGALRDDQALVLLIHKKDEARLSRASGRRCCVTEAPLSSPQPRHTKVSAVHDPSRHRRTGGPSPGPGCR

SEQ ID NO: 9125 - protein, 187 aa, Chlorella protothecoides
  MOD_RES (148)..(151): Any amino acid
MLMHYWLQSQNLHQRLARWWLQKLECQQLQGQVYRQPQRLACSWLQRLACSWLQTLACSWLQRLACSSLQTLACSWLQKLACSWLQRLACSSLQRLACSSPQRLACLLPRKLVHYWLQKQVHCQPRTLVRYWLQSQNFHQRLARWWLXXXXPKAGVLVAPKAGVLEAPKAGALVLPNKLPAHNGGED

SEQ ID NO: 9126 - protein, 1065 aa, Chlorella protothecoides
  MOD_RES (5)..(23): Any amino acid
  MOD_RES (790)..(793): Any amino acid
  MOD_RES (814)..(855): Any amino acid
MVGRXXXXXXXXXXXXXXXXXXXLLAEAPGAEAAPPVRKQDGSLIMPSSSIGTRSIQVAILELTKLESSKAHGEPSKGVSIGGATGPFPLHKRPSPACNETSTLPGMVSGGALDSLKDRFKEYSEQIYMLQGPARVPMSLEQSRPISLTSSCPCPARSCFLPAHRAHRYRCLHPLRAQYNPDRRDGEAALAQVRRDWVPPSPPPNGSRPRFPPEEPPNPGPSPGGGGPNGLTKAFIAGAFVLGGRSRPAPRGSDCWIGTGMRHPQHPCTPSTHLGSWSHFVTLFSHVHSTHNCAGMGAGIWFDTQVTFQPQNVASTVLVDTKTPNSELCMANGYSSMVFDQRIFLSFNPCVVCVMCEGEGGGELRERRLACPHRAGKPHSAPSLYHFTPAPQVQRLRGPAGGQARVRAAAQQRGRTGAQGPGRRRPGVGLQALHEHLCLCGRPGGAAGGGLRLPQRGRGEPVSAGPEDGHAHAWRGRDARRHRGAGGAAGSRVSGDVWRPAWPLLDPCGALCGLTACDPVTFAARCNLSFALAAQEHAIMLGHSTPGSLGGKEARRTRPRQRGPAQLQVLRSHVFAAPQADPRHPRRSSIAASRQPSAAASASAAWTSENPMPHRAATSSASKGLDQPLPRPPAAAAQARPRRACPCARAAGACPAGACDGRLWTQIGGRREGHGPSSPPGDRIRRGMGATVAQQQTSTPQPGPPSMHLILGTQHTTRLAFSNPQPPMQGLSSCTHPCTTLSQQPCMVCRHDTTNSTPPHHSKSSSSSSLSAAAVRVAAGTGARRFTGRXXXXSPSVNPTHPYRACPPAPTHAXXXXXXXXXXXXXXXXXXXXXXXXXXXXXXXXXXXXXXXXXXIAVRRCGPSSGRHRRAALHGPRRPFLGRRAVPPAAPVQGRGARRAVPARHGAAELRPQPPQDGVQVGQHARQLLLGAGARVARCNFVCVDVVVLPGGPKQNVRWQAGAGEAGGLGITGPCSNHNSHSGENRKRMSARSCTRYALSAAAPCRGRWQIARHSAPHPTPPSPRTQQGAVPPRRCSALHAVLQRRHLSLCLGHLLRRQSIPGMH

SEQ ID NO: 9127 - protein, 197 aa, Chlorella protothecoides
MRYGIGRWVQILATGLLPGKLIQQLYGATQRLLGQQSLAAFTGLRIDLDRVRAENEGRTDAPRKSGLIIYDGRECWVGGLLGSRGAGLPGAGEERLWKCRRWHTKVPNLAGCIEGLGMALAHGQPGLPMEDDFPREGACSKPPQHTLSTAVLTREDKDRLQAEAQERGGTAYAPQGLCPHLHSCVQTAPKPSASQPS

SEQ ID NO: 9128 - protein, 199 aa, Chlorella protothecoides
MHSDSCLGQKLRTHTPSSPFPPSSLTSFTRKLKRVTAEQGAQFVSYDPRTGTWRFTVEHFSRYGLFDDEDDDEDDEEGRSGDHGAGVGQEKPTPVGPASARRGRRRQVVDSDGEGGSPGAADPDSPRGLAGARPPPSAGLGLAWEEDDEEEREDMQQSACCVVCGRRGAWRGACSGCSGGGDGVQLKRRGGIDGLDLRR

SEQ ID NO: 9129 - protein, 344 aa, Chlorella protothecoides
  MOD_RES (26)..(29): Any amino acid
  MOD_RES (158)..(160): Any amino acid
  MOD_RES (243)..(246): Any amino acid
  MOD_RES (287)..(290): Any amino acid
MPHHGRALPSPAVSRSSLNRGFYAPXXXXSPPSPAVSRSSLNRGFYAPDVPLNIVPEVPLDRQERAFEQYGNTSTYNLENVLRQNILTSTYYQKTAVPIEQWQDLVDEIYYRCGSHGVPAMLACRGSRVLVFMPSDDHDRCKGRGDLEVPTKATVAGXXXCELVGVRAGSLHRAHPPGSPHPRLPQRGPCGALDERERARALHGLQPAVPTGSIEAHPQGAAHDAGPQGLALHQSGEVADAFXXXXRSFHTLVQVGFLYLRYTCNPRYLWEWVKDYLEDAERSVPHXXXXDYLEDAEWLGSAVSLTRIYTAPPSPTTHLTGIHTQPPRVGPLGDHGLLPPGHPS

SEQ ID NO: 9130 - protein, 416 aa, Chlorella protothecoides
  MOD_RES (210)..(213): Any amino acid
MRNRGVARCWNPEDRVGVAVDPLGGHPVRREGTTTTMGEKYGGVPDYGHGPCRKVSRAGVGNPACMWERLVNFSQDFGNPRNPSTYTLSTCTQTVCKKWCAIALTQLPCKQISGGEVDWDLYNAKLQEWGPLVAGALFGIGWWCWADALVQVSTGESGAYPFRYNWPGIVATLALLLINALPRKDLAEAAESIEDGVEVRATWSPGGAMXXXXQVPALQLAGALQRLSAAMWHSHCEAAPCPHPPAPSAPLKQLRARLWLLFSFLTAFAAVGGSVAVLIQCTQQSQFVSVGVVRPVRSGAFPVRVGWSGASCEVWCVYDSWGMMDVALGLHWMHEESRDPATSAHYPQRIVDQLLNESCRTHSTLAELFVRAPPPVSKRPSPYAQGSVLQCGFILASALLLWAYRSDDGGGYYTGF

SEQ ID NO: 9131 - protein, 93 aa, Chlorella protothecoides
MRASRHGGLGAEVQRRILMGTYALSAGYYDAFYLRAQQVRTLVTRELQQALRRCDVLLSPAAPTPAYELGQTAEDPLAMYKGEGAGPERVMLP

SEQ ID NO: 9132 - protein, 154 aa, Chlorella protothecoides
MDEEPVTTCDGERVLAQEARRSARLYFLLGFLALPWLWACSVWLYLPALRQPHGDPVVRKCTSLPNYVEEELGRSAFCSMMLAGRCSCQSHLAIPLPTLLIRRASIRNLARHLHDGVLSLVPHVPDRRARSARQKAAGPVSSAKGCMRSWTSEA

SEQ ID NO: 9133 - protein, 299 aa, Chlorella protothecoides
MSRATHASRQGTRLTMYQMQYRGEGRTRHADVAGTGLHWRLPSQGGMMHANPRLLGAELCFPPRAMLNLRGGGCGSCTTIQWTKPPPKHRSNCICSFQPRNVIRMPPFALQCNAHGLERPATGTEYSCGGRPSHPRSQRLQAPCRSAVRCQAGNDVSTGSEAAVHRRSAMLGGLAVGAALSMPMPGPASAGPVLSKDWAIVDLPIDPGVVLLDVDFTSSDPNHGHTARLHSSSCHSFTPAGFLLGTRQTLLETKDGGRNWEPRSVAAAQEEGFNYRFNSISFQGKWARGMRGGGLAEAP

SEQ ID NO: 9134 - protein, 227 aa, Chlorella protothecoides
  MOD_RES (106)..(109): Any amino acid
MRPLTEDETRQVFEKLHKYLGKAIKSLVDRTDDPFCFRLQRNRVFYVREDVMRRATNVSGGGGGGGLGHLGVKRLALPFKKPCWCALSLPKRKLCSFHQVARDKLXXXXQLGVKRLALPSKKPCWCALLLPKRKLCPFHQVARDKLVALGTCIGRFTHSGKFHLTIGALDILAQYAKYKVREVPEVGHVATPYYLKRRQMMHASTFSLQPDTNTGEAWGGNTSSKLC

SEQ ID NO: 9135 - protein, 100 aa, Chlorella protothecoides
MLPAVSQGIPTTTTLYNLTPDANPRHHPTPPQGAIGIACREGDEPVLEYLRTLSHEDTRLAVVCERAFLAALDGSCRTPIAGLAQDLSVPGEANVFLRRL

SEQ ID NO: 9136 - protein, 108 aa, Chlorella protothecoides
MRTIPPLPIHPQNNYPETLGKTLIINAPSMFAVLFKAVKPMLDARTQAKIKVCSSSYLSELRKYVDDENIPSYLGGRIISVGVGELHQTIRKGFMPWALCIAASCRGS

SEQ ID NO: 9137 - protein, 151 aa, Chlorella protothecoides
MLGNWSQHLFLEPAAPRGSLGLAYNCVACADNQRTYNDGYHAVHHLNSKARTSLCTPLTPATLTPPRPAPVQQTHWTELPAQFVATLDKQAAAGTLIFRGLGFFDVGVAVFTGNYDLLHDHLVKYTPALAAAGRCDVEAMLRRRLAPIIMS

SEQ ID NO: 9138 - protein, 118 aa, Chlorella protothecoides
MYGGHLTCICRAGSEGVCLPHHVAEASLLDSSLMFLTHATTTLCTGDEGWIVGKPAILLHSTDGGTNWERVPLSAKLPGTPVLITALEGKGAAELTTDQVPGAGRLAWLSMLSRDHHC

SEQ ID NO: 9139 - protein, 177 aa, Chlorella protothecoides
MSGHDDLDATSSHREVGDLRPADPAPSDARPLAGRRVGVIAETVGEGVDASVVEALQARGGRDWSQVQPNSARGDVRGGLSVSVLAASKECRLKPTVPCSSVGQTPPGTLPIPPRIHSAAHLESLGATVEQVHLPSFASGLPAYYVIALSEASSNLSRYDGVRYGQRAQREGERCDG

SEQ ID NO: 9140 - protein, 143 aa, Chlorella protothecoides
MGAADLDDGPVVPEIGEEYIALALAERQRIRIDAESDTVAGRQEYLWRPPPFVVNWLRRSLVEERDLPAAFMLLNLATTTLPAALLLWSTGCRSHLLGAAYLILTYAAFLQRFMLTLHFTEHRPLFKPGGPVQAGSYSYIASA

SEQ ID NO: 9141 - protein, 114 aa, Chlorella protothecoides
MGFTPSERLWLTTKGGDLYYTDLDTQSKFEQAKLGSRGFGILDVNFANQKVGFACGGSGSLFKTEDGGDSWKRERSTDDVAANLYQIKFTHGNNGFILGECPWSLLYRGGVTLQ

SEQ ID NO: 9142 - protein, 291 aa, Chlorella protothecoides
MASIRRIREGVVSQDTPAVEVVQGFLDRIHAQNASLGAFITVLDKSALERAEQIDAEAREGRPLGPLAGVPFAVKDNICAKGVQVRRGSFMRNKWRCSALIQQPQPNESGLHSHRLSERPLQRRLPEPPPSSPLPIPDIGRTSAGSLLLRGHLPAYDATAVARLQAAGAILVGKTNLDQFGMGSTNENSGYGPVRNPWDARRVPGGSSGGSAAAVAAGLVPAALGSDTGGSIRQPASFCGVVGVKPTYGRVSRSGLVAYASSLDCLGVLAGSAADAAGGLCRWGWGGAAWQ

SEQ ID NO: 9143 - protein, 193 aa, Chlorella protothecoides
MQVVTYSVGRPEPSHALAQTCSPAPAAPQYYFETIFPRIPTKVTDEVLAGLKARGLPCKALGNAGQGGEDRRGIAESAARPASVKQSLSVAMGQRAPNRASARELGRGTGADLQLEQVMKRKERASPVRGAERREARSRSRSPRGAPVPRCAGRAAWGLAASCCRGCHPGDVESLMSGSVGASAVRGPMIPPC

SEQ ID NO: 9144 - protein, 122 aa, Chlorella protothecoides
MYRLHHCIMHHSGNNRWSLDASSTERYQRDNPLHFLMCVPEVYPLGWAAHPACIPTAGLSPPVTPRLGPRSLRSTKRHARLPSLPPPALQVLGAVRSGELVRAPLGGGPGGALGVAGRLPRL

SEQ ID NO: 9145 - protein, 270 aa, Chlorella protothecoides
MSTSDHGTAVDRTVCDPGSRAKIEDYYGVRLKDTDPRALAFVVAQSKSAGNEAFRTHRACGMHPEGMVLLQSLLPAEAIRLYSQAIAGDESDAALYSNRSAAFLAEGLNDQALWDAEKCIALSPSWPKAHYRRACAAMSLCQWQGARQALVKGLELAPGDAAMVRADSKAVHRACWRCTWEFGCNHAGVNPHPPVPPRTHQVARLAEVDWVLTQRGAARRAQAAVERRGVVSRLRELRCQAARQAALRQFKQSMTGPRWDLEDLDWWAGD

SEQ ID NO: 9146 - protein, 465 aa, Chlorella protothecoides
  MOD_RES (81)..(83): Any amino acid
  MOD_RES (109)..(112): Any amino acid
MVICICHGLASSMNVMFHGRARVERGAGMGDARRKLTGTVIVPSGHSVAQQSDAAGFVEVTMHATEHYGSSGGVCVLHVAXXXNPCGITERNFVGIAERIPVKTTEKLXXXXTERNFVGIADRIPVKTMYDASQLLVIAIHLPVCSRKTTLSTSSRAEDPSMLPINGVGVRVLLENENISSSQLPFPRALLFRRAGSGTGGALTRLGRPASTRFQHHTSKSIRARPVMPPAGRSCKDVMSKQKGTAWAAMEMVNLCGACPPIERMDSSILGLKASRHLALSTNSIDKIGPLTGLSLETLSMGRNCLKRIENLEGVAPTLRQLWISYNSIEKLVGFWVLGISWHIKSSPVLLLACGQRGMVGSLCSWAQQPCVVFLCPPSSSKQPLLLLTLVQRSGGAAPGRQPTAQRGGSCRKPDCLPPRSAPSAATPEEAGWHPHRGRGEGGGTCPPSAVVPGAGHGTKAPSSG

SEQ ID NO: 9147 - protein, 210 aa, Chlorella protothecoides
  MOD_RES (96)..(99): Any amino acid
  MOD_RES (183)..(186): Any amino acid
MCRITVTLTTPSSQGPAATQSGGGSPRAPEEGLKIKLKVPGLAEGSAPHDESAPQPPMEPVATPVATMGAPVTAPRQPQAAPFPGQFATPGAAQAXXXXVPVAAPVATMGPPVTAPRQPQAAPFPGQFATPGAAQAAIAAHADLLQRRYGLGLEAFARLAPVDWPSAPAALLSRDVTCALLRXXXXAWRPWTGPRRRRRCYRATSPARCC

SEQ ID NO: 9148 - protein, 212 aa, Chlorella protothecoides
MGVEMNHQVQRARTACSRARSNPAFLHVVTVSLLHLVQHAQRAIERGGGLLGEGPSVEDELAGISDDDIPADFEASGEGERVDERGASMEGLGAAVHTSGPLTLISVLVSRVLSSSKPDEDDEAASSGPGGPSAARRRAWQLVKLRRRQEAARVAAAEAEAAQVERERERDAARGSPPPPTSDFRLAPHLVPRLLAVWEFVQVCAAVGVVDS

SEQ ID NO: 9149 - protein, 578 aa, Chlorella protothecoides
  MOD_RES (143)..(146): Any amino acid
  MOD_RES (346)..(367): Any amino acid
  MOD_RES (553)..(556): Any amino acid
MHTSTRHRIPGGHQHRGDGAHLRGHDEPGVPLHLPHRGGVPHRHRPAVRPGQLPVQPEGGAGRVPAGGPDGHRPAVPGGVRGWQGGGVHPGGNPVRGHHARPRDRAADGHRPGRVPRAHDGPTRRARGRGAQRPARHLPAHRXXXXRAARGAVGANDQPAIFRRIGKWHATATGLAPALLQELGLEDVMDEGGLGGGVGNPAASGSCCELIPGPILHRKGPLTPATPLWPALLMCTVHPFPLHPPPPHTHVRTTHLLSSGGPAAALPRVHLPTLARLLPQRSAVRQHAPLPRPGRIAAGIPRGPGRGVRHAAGQPARRAGVGRRAGAQLPQRRPRSGVGGGRRRRXXXXXXXXXXXXXXXXXXXXXXPGSPPSPRAATEHIRLIDYEYATLNDVAFDVANHWCEYAADYHSGEAHVLDFAALPGDEQKAAFAEAYADAMLAQAAAGAGRLAERVCAGEVDAGCREHGALARLLVQKAEAYVPLSHLKWGLWGVMQVCVGEVVWGKGGGMLSRGGRHEQRPRPPMSTSTTWSMRDRGSRSTTPPRHGTCEISQXXXXCRCVLWGKGGGMLSGGGRHEQR

SEQ ID NO: 9150 - protein, 280 aa, Chlorella protothecoides
  MOD_RES (216)..(219): Any amino acid
MACSSEWIERQGIGRGVGARGWGGELHTTTATTKHTDPPLYYPPPPPSTHTHIHPPKHRQLLEWCRPGATLRQLHEQSVRLLTEGVSDLGLLPGRSAGAIAQGAIRAFYPHSVGHWLGLDTHDVPGVAHDTPLQPGVTLTVEPGLYIPDQERYGALAGIGVRIEDVVQINGAVKSGWVEQGVRGGEVGEDVGWDRQEGQVGTRCSSRGCAGDRQVXXXXGRWVRTWAGTGRKGGLVHDAHRVGVSEIAKSWMPEPSTWASMTVCRPDPIDGKGGERLLSR

SEQ ID NO: 9151 - protein, 250 aa, Chlorella protothecoides
  MOD_RES (15)..(18): Any amino acid
MMSVDRVTAAAVATXXXXLSRVCCTSTRLPYPIPARSVSQAVTSRSRVMVVTRAGYIGSPTNVTGLRLQLWLLHCSSCVSVPMSTCPPPSGPAVQIMVLSTFLPIVAGRLGLAPTATRHTTPGLKLYEDKSAGLISGDPAGAARIGGEDGFASLSPAHKHAPPAPTLPHRVDHLGCAGAGRAGPHHWGGHCAGPAQLWKPVGTAVECPPAVGMPEESGTPAGTVKMRRPAHRIERCQAGSRLDPQPKGLV

SEQ ID NO: 9152 - protein, 84 aa, Chlorella protothecoides
MHSPDGTVLVTHGGVEMGQGLHTKVAQIPLAQVYIAETATDKVREGALLYLGKLGCGVLGCPLNSSSSAVWAWRQAGHGPCRAA

SEQ ID NO: 9153 - protein, 175 aa, Chlorella protothecoides
MVYDVLAVERAATAAAHGFGSYRQQVSLGLHVIVTMAAFYAFGLVAGRATLPPGWQPHVAGLGLATLALLVESLLFVIRSSAPATAQREAAARALRERLEAQARAQRAAAQRDGEAGGRAQGGEGAGAAPAQDKGKAESTPARAGVAEEAGVEPDGGPDKGPEPATLRLRAGRAA

SEQ ID NO: 9154 - protein, 160 aa, Chlorella protothecoides
MPCNPWPNPPLSPNQDIVNAAYLDRVDLSAHGFYSTPDIGGFGSEKPYNYFCYGAAVAEVEVDTLTGDFHVLRADVVMDVGKSLNPAIDIGQVEGAFVQGMGWSCIEELVWGDKKHPWVKPGWLFTRGPGTYKIPSVNDIPVDFRVMLLRNSHCHRTPQV

SEQ ID NO: 9155 - protein, 97 aa, Chlorella protothecoides
MVSTCEPDSSLLHRAVNACLCPLYGVEGAHVVTVEGLGNPRDGLHPVQARLALAHGSQCGFCTPGFVMSMYALLRSKPEPPTEHEIEEALAGNLWCA

SEQ ID NO: 9156 - protein, 95 aa, Chlorella protothecoides
MAPRAAAALVGQPLDPAAVQRALAAVREEVVIAPSAPGGMVEFRQSLVSSFLFKAIVHAAHALAEDVEAYASAFPPSYASVEERLDIDATLCALA

SEQ ID NO: 9157 - protein, 563 aa, Chlorella protothecoides
MAADLQVCGEAQYTDDIPPPPGTLHAALVPSTQAHARLLGVDKGPALLVPGVVGVFTAEDVPGGNDIGAVAHDEELFATVGFWILGGGRGVLGWHGRPNLAATSVLIAAAHGAARPAPPCPLIGSHSKVFLLPPTSTPQEIVPCVGHPIGVVVAETEAAARAGARAVAVRYEPLPALLDIDDAIAAGSFIEGWGHSVHSGDCALALEASDVVLEGWVKMGGQGRAGFVPRCDHSRAMGQGSTCPHLFGARSRPRPGVHPHSYCECLAGHPLPPPAIHGRPLLHKQEHFYLEPNASLVIPGEGGEVTSFSSSQCPDKHHRYLAHVLGLPMHKVTVRTKRLGGGFGGKETRSAFVNAAAAVPAHLLRRPVRICLDRDEDMHITGQRHAFAAKYRIGLSSAGEIRALDVDIYNNAGYSLDLSFSIMDRALTHIDSVYRIPAIRAQARGWQGGWGMGMLIMEQIMERVAKEMDIPLNTLRERNMYNEGDVTHFGQRLEGCQARRCWEEVHTLSGWAAREADVAAFNAANRFRKRGLSLLPTKFGISFTTKFMNQAGALIHCYTGEEV

SEQ ID NO: 9158 - protein, 139 aa, Chlorella protothecoides
  MOD_RES (24)..(26): Any amino acid
MNKTSRLCGRPRVSEGNGTGKCLXXXHEQDEPSAWASTGFRGQWDGEMPQSMSLCHSGVNSPYLWAPVLTAGCDGVVSIWDGEHKKRLAQFTGYPTSIAALAFNLAGNLLAVASSYTFEKVRRACGFGGWIRDEWGVGV

SEQ ID NO: 9159 - protein, 658 aa, Chlorella protothecoides
  MOD_RES (89)..(92): Any amino acid
  MOD_RES (375)..(377): Any amino acid
  MOD_RES (497)..(500): Any amino acid
MEHVEDVPGGSGWSWHPLNIMDACCNLVQLTTASSHPLYRFNRKLLKKVCNSIITCNNNSHPRRQAVHPLSSPLGARDSVFCKGRPQSXXXXAPLSCPSITRYSLAIIGCRGIVRGGGIEHGVAEPRRLYEGPHAGIVAGAIRRLSSAPCAYPFHWNLPTVLLWPGPLSGASCHTLQSCVRWEDGVRTSKRLTAADRWEVHSADEVALTLGEMRLRVIQQVDVEELGKGWSGAGLAAPGHGPRASKKYFLNILFQHLIPLPSAWGPASGTEPWSWPPTSSPSPGTASTACAAWSWAPEWARWASWPPGWAHRSAREGHGWGRPQSGACQTLERERALWTRSPGLNRGSGVGVCTFPSPQGATPLPNVPPTSLLTXXXGHGWGRPQSGTCQTLERERVLWMGSPGLNRGSGAGVCTFPSPRGATPLPNVTPTSLLIPGDHHRHCQGPPAAQGQPGRQWVWPGGTVCGKRMECWDCCKVVPWGGGACTLGLETARPTSXXXXVAREWSAGIAAKLSLGEQALVHWVCRPLVPHPAALRARPAHARHIPSTLNPGGPPPTHTGRHMRARPGPRPASCTGAPRGGWMGSASWRPPRGSTWCWRRTAATSTRTASRPPRPHSWKPARACVGLTPWSWSPLSGGRQRWGTEAGGAGTGGPSAHH

SEQ ID NO: 9160 - protein, 371 aa, Chlorella protothecoides
MVDMILRWAAVPGKHVLPKSHPHTDHNPDVTKWKTKGTWGEDPMKPIETQVRSGWQGRWGRGCCQPAVKSAFTRAFNAQHLRPKTGFKMEGGVKKKGRGGGASLEGGADEFGEEGEETQAGAEEEEEEELDPVVIQQKPWERCIVWPDVARILLVPLLNGQRIMALFLFLPHAPIRPHVIAVDGHEAQGHEPDPQRWVHGSEKQREGRQREGEWRSKLWQGGLWEGRAREERPLLIFMADMEMEEELQAALTLREVTMLIRTNARPDKPAPTVGLAASRRIYYRVPGADSAVRSSQEAREAITACHAMPQYRLIATNDRAKALIGPHGCDIVLYGDTRIGRGVAGPQTFTLPVDWLQFSSRHCRVYSADVS

SEQ ID NO: 9161 - protein, 215 aa, Chlorella protothecoides
  MOD_RES (129)..(132): Any amino acid
MRTHMQSCALAGCREGIATPPAGCPVILPAHIPPNQPPSSPNLPSPLQKGLAGLDAVAVIVDDNHTVWPRNAANLVAVEQYHYFPSSRTRQGLHGPALLDLARCPCCCRVCFLFWGRGAREEWRGMGGXXXXTRQGLHGPALLDLARCPCCCRVCFPFWGRGGPRGMEWHGRTGWDERLRARVPMCILWGLADRGRCRSAPLPPHRPPATHRTQG

SEQ ID NO: 9162 - protein, 406 aa, Chlorella protothecoides
  MOD_RES (12)..(15): Any amino acid
MLIPNFRAQPLXXXXWPSSCLLEASICTVWALPHPSTTNRPDFTHTQFPCAAARAACDWYLNADPLAPDPYNFTTASRQAFALVEFVRKLGRDLPWPATMPAVVPIDHARHSPPLRTVPVGDQGMGRPPRREEQPPADGRRGGCRHARRLPEARRSKGCESLVHRFQGGGAHSGPPVPRVSVCIHAKGVQVPRFIEARQISGHVLAESPLPNRRTRIDFGPNEDVYSSVHPSLNPIRVWPSDLAAEAQHVSLSLSPYLPNIHGGRVDTSHRSARWHITHQSTPTELPAYSCLTQPVSLLADTYGLRGPDPEVLDFCNVTEEIAPVRVASSSDFHGPLMHAEITNARMAYFRFGNRNTTRPPLLVFAPFGFTMGDMPTPAMLALAARQEVILFDHRGQGHSLASCEN

SEQ ID NO: 9163 - protein, 137 aa, Chlorella protothecoides
MPDCQVFTSFTPKIPAEIGGFKGPDPEVLDFCNATEDDQAVRVEAESDFHGPLMIAEISNATIGYFRFGDQTTGRPPLLVFAPFGYTMGDMPRPAMRSLAAHQEVILFDHRGQGFSTASIIPEGKGVQCTAVCRAAV

SEQ ID NO: 9164 - protein, 512 aa, Chlorella protothecoides
  MOD_RES (457)..(460): Any amino acid
MQLLCSTSRVHPSVVPKASTTTGRCLKSEDHRCVPEKLGKGELGCARTPTPSYTYVPVHAPTWLGQPNGRLPGNGPPVPQTRHRYGLLCIRKTRTYLSGGGKGRAAAREAAYVPVPRPAEVLFLIESSFSSLPALPSFHARLPGAVVGQAAPVSEEGEVLQFCNTTAPPLLASTSSKQDLIGPLLHVAISTSIVGYHSFGWADSGRPTLLLIHGFGQSLDMWDVRLLEPLAREQRVIIFDTRGVGATEASGGLWGHLIRAPRVWRICPWGKNVGCDPAWSQISLEEMPQIPHSPPFPRYIVQDLNISSPLTIQSMAEDTVEFIQPVQTPRPANPHLPPQHDPFQALQLPLPPNLMGVSMGGFIAIAVAALHGDAIHRAIPISASAGSLGSEPPTDKGLSIVAQPERRPLDMLSLFYPLNTTRGEAEAGVDSKGSALVGAAISSWEMPSLGMQAIETXXXXGVDSKGSALVGAAISSWEMPSLGTQAIEIIPPSHPSTPSPTPTLLLRCKGSM

SEQ ID NO: 9165 - protein, 78 aa, Chlorella protothecoides
MGASKDLEMSPFEAGRRLLGYEGEGLSLSDQMDLVFQDADLVPLLVQENYINHRPKIAQNDTMRMQVGGCVCVCDYVP

SEQ ID NO: 9166 - protein, 71 aa, Chlorella protothecoides
MPPQIIAKAADAFSAGDLVNRRVRQTQNWALSPFAVVMGTIFPATYMRGGREVLGLYPMEPNFPRWGQFMA

SEQ ID NO: 9167 - protein, 133 aa, Chlorella protothecoides
MGRGLATHGRTPSCDRSPHQPLPLPGPFPLSLTKPACRPTVQQITKRAQEICRAEGLAVNDATLAALIQSANGGDIRLIVGQLQMVRRRSASLSYDQVGCRLGVSDCAIWAEVQCCAPVKSSSWLGRSVALQT

SEQ ID NO: 9168 - protein, 187 aa, Chlorella protothecoides
MAHFHLQVSPTLFLGGQDQRAGGPEGGMRPQRRPTVGLNIGSLDLAGSPVTVWDLGGAPGLRRIWTEYYGEAHAVVMVVDASTPSRFQESKHALDSALGEQVGARGVCNEELFDAPLLLLVHKQDANGACSPEEVAAALGVHAGGEGRLCHVAGTATNDPMGVKNAFSWAVKVSLTGPRATLLASRG

SEQ ID NO: 9169 - protein, 470 aa, Chlorella protothecoides
MSRILARHVGVGCEAHALVCSGGHDDHGARRPRSAYGPRTSAGPGPACSRCFLPSPPCPPSQGLQAFPLQGKAATVPGGVPNPLLAVPDDVRERLYRNMHRLRAVANKLPSPFPPALRACAALAVSLLRQNFFTQGQARILLPLWEGEAGQGGLEPDSTTSPDPGPAASAVKGSGKGNSGPAETAGRPADADQGAPAQDQPGVGRGSGGRPPLPPQQERWRMQGQAPLASCAASGRERDADLAEAAGQPGPSFVLPIDPRRAPAAGRKGARGPSAVASAPHIPDRVASGTGADPRQTRVNSREPPATMAQAPQSGAGQGAGTPALAAREAGSVPEKRPEELDCGKGSWGCRLGQGGSWAWVWRYKVPASRRREGKSEAGVHRRALSSWTLVPPPRCSVRPQHPPTTRRGKLSLVLDLDHTLLNSCTFADVDQQSDRDLPSRLLAHLRCEAAALGAEDRQLFRLDDVQVGN

SEQ ID NO: 9170 - protein, 160 aa, Chlorella protothecoides
MTRYSPRRTALMAAAGLCVAGPAGHVFLGWMEQHVMAATPMSRTAVALKFTLDQVLGLVLWQAAFLTINPSYRAAARNLLRGRETAVELHPTIRGESRQSVEKQVPHSSLLLRKRCTGGEMDGYAEPSPQGGPTKRESGITMLQSSCSRTTDQSSHLKSW

SEQ ID NO: 9171 - protein, 98 aa, Chlorella protothecoides
MLAEATITEAYGRQALAILHYFNVETAVWDALPLVRNPVLLIAGQYDILVPVQSSRAMAARLPAPWLVVIPEAGHGVASQCRDTVLDLVDAFLGSPDL

SEQ ID NO: 9172 - protein, 193 aa, Chlorella protothecoides
MSSRLRRHDPSLSRDPDPSPTPDCQVASRQARSRGGALSSSEAGVLALEGLHRAITPFVLRRTKGQVLTDLPPKVLQDVRCTPTPLQLELCEALRSGGGMTVSWMGGPEDGGGGAEVEGVLKGGGAGVHVCRLRHTPHGSSPCRRLRLHACRWPPGRTSAARLHTHTHTHTHTVPFPLHAPAPASPRNLPQTR

SEQ ID NO: 9173 - protein, 220 aa, Chlorella protothecoides
LEHALASAREGAAARGARVEALERELACLEAQVEQLTAGLTHARGQKAGLEAELAAARRGASHLELLLDAAEGEKEALGEALGEARAEAARLVAAGQALVKAESAIGAAHRAADDEAEWGLGRDGGEVGDVACADADASMCTPPPHRGAAQAGFEEDLRRAVHEKVAALEMLASAEKRMLLSEERGEAGWDRGAGSASGGGAASGGGGAGSSGGGGGRGD

SEQ ID NO: 9174 - protein, 355 aa, Chlorella protothecoides
  MOD_RES (5)..(8): Any amino acid
MRMAXXXXIADLRQGRMAEVAGDRVVREVQLLVYDEIHYLRDKERGVVWVRLLFVLSYWYDMGAWTPGKMSWMPNSLHLQILAGRKHHPGPKMCSICLPVGYHSQCEGVCRVDCQDTRVALPRRVHGVQAHTPGALRLSGGGRWPVHGGRLKGDCLVSYTTWQGRCFSDPDPCEFDDREDNFGKAVAVVNDVTGDSVSASKRQKKGAGGGDPTLVIGDGKEKSDVAKLVKMVMEKNFDPVRQLITPCSWLGDHVALTMDSGFRTLSCPRTLEAQIIIFSFSKKECESLAMQMVAMDLNTAEEKQMIEAVFTRCEDQWGPIADGGSGACWTQPQRCHELQSCSADYHSAVPLTSYQ

SEQ ID NO: 9175 - protein, 224 aa, Chlorella protothecoides
MEEAGTDCTTPINVVEMSGKSCTHEVAWPQGGFPGSGRRRSGACQTAVEHFSSRASPDFSNMTGSHGSLLPPPHSSKPMARQYPFTLDPFQQTAINCLEAGHSVLVAAHTSAGKTVVAEYAFAMALRYAQRHVAVGSLLLIPVWGRLRYSPHACLTASSLSHNQRQAACHLHLSAESLEQSKVPGAAARVWRCWTDDWRCHHQPKCQLPRDDHRDSSEHALSRI

SEQ ID NO: 9176 - protein, 395 aa, Chlorella protothecoides
  MOD_RES (188)..(191): Any amino acid
MSPPKHSHCRLSEGGDAFSQMIPCLSLAIARGRGSLPNRCAAAGCGMSNMPAVGKNMGAAIALVAGQSQWAPLQKFISSSNSLLPLQRARSLADAITVSAPRPAPKMMVHVTERSQEFACRHCRASLPSPHLLDLHLTEMHDSFFAAQAARRLPVRFNASSAGHVSGSATLPVCCPGISFAAHPFPTXXXXYLVAGSATLQVCCPRITFAAHPFPSFHHASGVPLLGGELRAHNLQHRGEKRAPPGSAWGEKGSSEACNCHTGMQGTAHTWRPVSARRREDGNRGRTGGRGRESLEAEPDKCGPGCAKQGRIWQKAVCRPVPTLTGQATRMMLAHLSIPCILTHAACCALQHCEIVACKPLQEALRTETGLRGCTRACPGGFPWPSSWAEAHTAG

SEQ ID NO: 9177 - protein, 696 aa, Chlorella protothecoides
  MOD_RES (23)..(26): Any amino acid
MPFMSMSASKRGRTLFDQSGHPXXXXNAFHVDVSLRKGKNFTRPIRSPAEAPDIGGGQHEVHLCRHASESGVHPRLCAPPGTRKGPGTVPLRFRAMEGAWRPAPAATQLLAPDPPSRGSICRSVTAWPVARPGPHTPPRGARQWCNAFVSPCFDACLECRGPSIAGWEATGHHSGFHLVSRGMCGQPPHPIHPPCRVAGRRSSAQPTQATLARDSGLSEAAAVVSPPREALGPVPYPAPTPLKDWVDRFGDAPRKGSDILVQALEREGVDVLFAYPGGASMEIHQALTRSDSIRNILCRHEQGEIFAAEGYAKVSGRVGVCIATSGPGATNLVTGLADALLDSVPLVAITGQVPRKLIGSDGFQETPIVEVTRQITKHNYLVMDVNDIPRVVKEAFYLARSGRPGPVLVDVPKDLQQTLAVPDWDAPMALGSYTGRLPPAPRAEPLAAVLEAVRAARRPVLYVGGGCLDAAAELAEFVAATGIPVAQTLMGLGAFSEEDPLALHMLGMHGTVYANYAVNDADLLIALGVRFDDRVTGKLEAFAARARVVHIDIDPAEISKNKEAHIPVCADVKPALALLNRMLRAAPVDRAQFAPWVEALEAKRAEFPLRYPTDRDDLIMPQRAIEMLYEETAGDAIVTTGVGQHQMWAAQFYKFKEPRRWVTSGGLGSMGFGLPSGVCGGGMGWGWGNNIREFAS

SEQ ID NO: 9178 - protein, 90 aa, Chlorella protothecoides
MDMDEYVESFSPSLMDTVGAWAQGARFVDVLKSSGILEGSIVRAIRRLEELLRQLGNALRTIGELELAAKCDKAIESIKRDIVFAASLYL

SEQ ID NO: 9179 - protein, 342 aa, Chlorella protothecoides
GGVGGGDTGGCGSWAGVLRRLIGAGSDAQGLSDRKVDPARAHSSGALRAGTSKPPGTCTSVTRTGPVIFAKAAALWMGPITCTISLSIQLLTTSHTTPLSQDVAGGDDGVEEGRQPAPGRDRDHRRAPRRWVDRVGAIKEPSVVGAVVKIPNDPRKLVSGFFCRQSATLPELSAPSAPPSQLPRACERWSFCDGPRDEAGDGAAGDAGADVGSHSAPGCRQHRGRLPHHPRAPEVQLPQVQDGCRNREKNACCKTQESSGALCTGARTHTPPLPWIPRFIILVGDGRDSPWSRICASQADCTLLVADPACTAPQVSEGVVTGRLETPWANSSPLMRRRLVLL

SEQ ID NO: 9180 - protein, 695 aa, Chlorella protothecoides
MDGVPSGTAAWLDARPLLTRHHHIRLGFEPDMARLSRWMAGERGEGWPCRVSFPWLPASWTTSGTLRLSLPTTRPPADRAVGVVLSGGGSRGLAHQGVLNALADAGVPIDVVGGTSQVRWRAWDCDAKAYCAVAREGVGASIGLTGGGRVTAAALRASVRWCSARTWFEGALGSSSLPHSSPTHPPIHAPIPFPRTGRLHGRAVRAEPAPLGYGGRSAAICHRNGIRAEAAHGPHPAHHFRCVRSWGRRRGSTKSGVFKQQPILTALPVFNGAGFDRVVREALGLQRIEDLWLRFFCVRWGGYVHQLWEVTRVICAGCRRALAMGSRVAEGASWKPPMPSQCSCPLSRVPSTISLQTIPVPPLTPPPPLPTLQLQHQPVARRAQRARAWPAVEDVPGQHDHCGPCPARLPRRRPAGGRRLPEQHPRGRYARAGRGHGHCGGRGGPGPVGVAQPHALRRRRVRLAAALGPVVPRGGLALQCAHPALQPAHELADLDEPPADAAPREPGVRHRPLPPAPRLPLPPHGLLPGGADRARGQPVRLGGGLRVAGQDRHPPDRAGGPAPRRQRRVPEVGGGCVCVLAGVGQKWVSCCPDPSGKVLAPHPCGEPRASWAQGGGGGPPIEAAARRRCAIRGAPPTPDSTWPITTTTLQDAQLPHAGGPVAQLGVHDAAAGEAAGPGRLWTPERLAGAAARVGC

SEQ ID NO: 9181 - protein, 500 aa, Chlorella protothecoides
MAASRLRVAVDAGAWEPEPTELDFLLSLFSSEERAACMAFRRDDDKKRAIISRLLQRHAAAVCLGLDFHQLATTRTKGGKPFVKNPRPDAAPLNWNYSVSHEVGGGDVCGCGAAEWHAGAACCTPRTSARPAPSHAGLPEELPGSAHPTRVGQHHGPAARRGGDGGPVPATLEPEGGILQGSGAGAGGATGQGILQHIPRLELRVPLPVWRGAGGLGLQAAQAAAGALGGRGSRAPGSDRGCARREWVARLLEEHRLGLEGEMGAATVFSATLTRTDFEPEEWRGVLTAPEPAFALPLGQARTLCVHLPARKSKKRAGRGPNSALDPAVWTKRHSRGGGEAGALSAAPQARPRRPKLLPHVADGEQDLALGVRSPRALPPLLRPAALARHARQRRQVVGGGWRHGGKPGNAAGPLHGVRAPRPPPPAATLQRQRQRLVRVQCVGPQRAEQVRRLLLQALRQAVCARVRGGEKEVNLTYPGSTPDEKPRGRTRSVKQTVQT

SEQ ID NO: 9182 - protein, 477 aa, Chlorella protothecoides
MHCLPPMCRLAMGVHHTTLRDSGPGKGRGAAWRLVDRGAEARAREKRRGESWHAAPSLSNGGPADEAGACPLPPPQTPALSTLSSAQVEQAALRQHDDAVAVGEDEAVDLGLDGLARDARVLQQAGHVDLVVKVPNVAHDGIVLHGGHVAGHDDVLVPRGGHKDVGGGQAVLQGLHLVPLHSGLERADGVDLRHNHARARSLHGAGAALAHVAVAGDEGHLARQHDVGGAHDAVGQGVAAAVHVVKLGLGHRVVDVDGREEQRARRRHLVQALDAGGGLLRHAAHALGHGGPAPGAGGQSVADHAQHDLELGVGGGGGVGQGAVLGVGRLRLHALVDQQRGVAAVVNQQVGALAVGPDQGALRAPPVLLQGLALPGEDRRRVASHRRRGVVLGGEDVAGTPPDLRAQGGQGLNQDRGLDGHVQGAGDAAALEGLAGTELRAASDQPGHLGLGQLDLQATEVSLAHVLDLELQEYGER

SEQ ID NO: 9183 - protein, 466 aa, Chlorella protothecoides
MSQADFGRLEIELAEAEMPGLIACRAEFGPSQPFKGCRITGSLHMTIQTAVLIETLTALGAEVRWCSCNIFSTQDHAAAAVARDSAAVFAWKGETLEEYWWCTERALVWADGEGSDLLVDDGGDATLLIHEGVKAEAAYAKDGTLPDPTSTTNPEFQIVLRVIRDGLATSPGRWTAMAKRMRGVSEETTTGVKRLYEMTAAGTLLFPAINVNDSVTKSKFDNVYGCRHSLPDGIMRATDVMLAGKVAFIAGYGDVGKGCASAMKAAGARVIVAEIDPICALQATMEGYQVQPLEDCLSTADIFVTTTGNKDIIMARHMAAMKNNAIVGNIGHFDNEIDMAGLLENPGITRQTIKPQVDRFIFPDGHGVIVLAEGRLLNLGCATGHPSFVMSCSFTNQVIAQVELWTERDSGKYENKVYVLPKNLDEKVAALHLPKLGAKLTRLTPEQAAYINVNPDGPYKPALYRY

SEQ ID NO: 9184 - protein, 573 aa, Chlorella protothecoides
  MOD_RES (299)..(302): Any amino acid
MRTRSMATQEGAQRGERSDADPSHHGRRGSRTQLKYPEIVRGAAGKTTLRDSQGERTAGRMSARASLLADLREAEIVLATKRPRRPIKAIEFFGQSLRQVGPPSPVCGAGGGGSGMVPAARPKGSSLHPNFGSDLTHRYKAITCVNCWPPPWAKFSSSHSLPHARHPSAVLSPAMQEYNANIDTPEGQVEFHRFLVNVGSGAHGAWQETPPQKRDLYEHAAANDEQRYLREQHDYKGWQQHALNLQRQLATDGGGVRPGLDPYYARLLQQQQQQQQQQQHYMQQQQQQLGPSSQARESXXXXHYMQQQQQQQLGPSSQARESSLSPTYMQQQQQQQLGRQQQQQGYPSFHEQRAAHVQLHAQRLAGTGSPDVGPTGHGAPGPGPGPEWSVDSRGSHPQQGQGRAGGAPGAQAHAKRELPGGSPDPGDALAAGPPAKRPTPSSEPAPGTNPPGAQATVAVMCGAMHGRLHIADQRVACECQACELKPEAERLMSCTQFEVHAGAGSAKKWKTSLKVPPGAEPEVRAGGNGMPIGRWLDLRGYEAGRGGARPRQEGQGAGGGAAASPAQPATERP

SEQ ID NO: 9185 - protein, 410 aa, Chlorella protothecoides
  MOD_RES (380)..(383): Any amino acid
MEAIDKLVSLLIYVVAAVFSLQALGLDVNSVLAIGGVGGLAVGLAGREILENLFTGLIILSSNPFEVGLWRTRRMGVLEEALVGWQFALGTLCCHQLVLPARTLAPGAYSSSRGRGGTVPPHLWPGGGGHRGGRGLVPHHHPLLRARNLHHPQLRLLAHRGPQRHAQGQGVALLRVPGHPGGGHAPRGGCGQRHAQDPATGGRGSGLAGGRESVGGWEGECRRVGGRVLAGGRESVVGWGRVQGLGLDGIWLVGAEGRCAWSLTTPQTPSIPQDTRVIQRLHRRVFLDKITRDQATIYTSFYVEALNRDSFMAIKQDLLLAFRDCVERNGATMALNRLQLEMLPGGSGSGNELAALSLQAPTAPTVDATRLPALADGTSXXXXAGRAVAAGAAGADRGCHAPACLGRRHV

SEQ ID NO: 9186 - protein, 152 aa, Chlorella protothecoides
AGGGGGGTGPSPFGLLLSQQHGGERSEGPHHTPSFSFANLQGLFGGDLSKIPGLATGLSLGQFPSIPNGMMSGELEQLLAQHGGGDALFGSGRAPSLGGMSKLESLDLPDHPGSSSVATTAADRAGASLSSASRGGMPPKVGVQGAGGGGCA

SEQ ID NO: 9187 - protein, 160 aa, Chlorella protothecoides
MQVQDDLAAGFQRAAVRHLADRTARAAQWAAASDPGVRHLVVSGGVAANAAVRAALSDVAARAGLELVAPPPALCADNGVMVAWAAQEAVAAGAATLAAPPPAPVAERDWEDVKPRWPLTGERHPNMAAEAARSAKKQRIFPSLTQLVAEQAAMEAAQTP

SEQ ID NO: 9188 - protein, 143 aa, Chlorella protothecoides
MWCTQAVGSPCSAGTLRLPRLLPRITAPGSAPPPTSPPPALPRLILGIESSCDDTGVGIVSPDGRILGASLAGQAAIHAAWGGVVPNLAQEAHAAAMEGCIAEALDQAGVRPQDLAAVAVTVGPGLSLCLKVRRREGGLTPSA

SEQ ID NO: 9189 - protein, 413 aa, Chlorella protothecoides
MAEEGTSPEELRANLREYEEQLEQVGGLLLDDPHNDEYKGIYESLTEGLGVGSILLALIPSQVIQLTKELIAEGGPSPSQPPAQPQAPTAAAPLIHPAAAITTAPDLRLPSILPPTVAAQIRSARHRAAFAGQAPAAWAIGAPVQAIYREDGQWYNGVVSAVSVSGKFIVQYEGYDQAEEVEREEVRLRGAEANGGYTGVVAPKKRKVNEEVALEEMPAWLQIKPEGESCMDWTGSGGGGKPWGGAGAQNDEKVKAKKKKLQKSYKSKQRFARMDVQTKEKANSWKNFVSGKGETGVGSCDGLWWYQDDRFLRQDWPARSSFIREDGGRCHGNNWLGEAFKCLHQRQWEPPPPTPALQFPIGSKKKPGFMTGHKKESIFKVPDGLGARVGVVGSGKPMTEFGHARRHDFAADA

SEQ ID NO: 9190 - protein, 113 aa, Chlorella protothecoides
MQFVADGVFYAELNELLVRELAEDGYSGVEVRVTPLRTEIIIRATRTQGVLGEWLGGCHGGAGVGRVRNLEIFVRRAAAQLMLGTSRHGSDWLLGRPFDPTGDLAPSRICRHP

SEQ ID NO: 9191 - protein, 123 aa, Chlorella protothecoides
MLASGVCGQGLLHRPMQHSLPSQQRLSFAKSKSEVITRLEAGSKKAKKDKKPAEAAKDAETAPALANGRGSHAPSATPAQRSVDVGEPNQTLFVENLPEATTADMLSMLFSQYNGVCLEWALP

SEQ ID NO: 9192 - protein, 117 aa, Chlorella protothecoides
MDIPPNQTVYISNLYEKLNKDGEHTGKAAPGDQNLPEKRIAHAKKLLYALFGQFGKVLDVVVMKGAALRGKAWVVFADVGAATDALRAMQDFPFFDKPLVRGVEPLGWWMRVAGAEV

SEQ ID NO: 9193 - protein, 711 aa, Chlorella protothecoides
  MOD_RES (83)..(86): Any amino acid
  MOD_RES (638)..(641): Any amino acid
MLFDWLYPANFPVILACLEAWSGDPVVTTPLLKFVNEFVLNKSQRLIFDSSSPNGILLFREVSKVGGGEAVRIRGGGEGRMSXXXXFDSSSPNGILLFREVSKVGEGEAARMRGGGEGRMDLLKGACVSGGDAHNLAPSSLVQQVLVTYGNQVLSAPRPADVYGGLYKGSWICLSILSRALGGSYVNFGVFELYGDPALNDALDMAVRLALNIPLADILAYRKVWGVEGGGGEKEAFGGCAELGPLRQGPAPVERYSKPGNPGVSACLALLRPCPAVRQHRITRSCSHGCPSEPHNVAPPSPAPPSLHTHLHLPMPSPLPQPPGVQGLLCAGGHAVREPRAAAGSTRHAHLCLPAVQPGRGAEEPGRGRIQPVRRGHRQPGRLLLPAHARRAQPQCRGAGHLGARAAAPRPLPPAAHHPVRDRHVRGLLQHVVPVTAHAQPHPRQRTGAEKGWGGVGGSGARGFGKITNGGEGWWYGASKALRVPCAVAAGTRRDAAFGHVRRGRRKGACSSLQHQPTHQYTPHPTINPPHTGLRACDQARGGQPAPRAAEPPGGVLGAGDGGRDAVSGAQESRQVHAELHHRAARLPRQDMMAGGPATGRPACVESHTGVDSVRLVGQCVIFRQLPFPGMLQDTPGXXXXAARLPRQDMIAGGPATGPPACVESHTGADSVRLVGQCVFFRQLPFPRDVAGHTRRAPACCPGSRGSQAPN

SEQ ID NO: 9194 - protein, 554 aa, Chlorella protothecoides
  MOD_RES (4)..(6): Any amino acid
  MOD_RES (528)..(537): Any amino acid
MPTXXXGERRGGGIVRGSGLGIKRTWLGPSRSGRQASWLESVRTVVQDGLTDDPLDSEEQLQVVWVVGWAPGRRGRGALVDLFTDIECSPLAFTCLPHSPPLHLCASLPSTPLQDQLDSLPYLFRFQYEKMAEALTRAADPLIAAYASRGAGGAVAGGAASSSSPPRDAAVLEGQLTWIVYMVGAVLRGRASASGADAQEAVDGDLAARVFGVLRAAEGPGHTARAGAASRRRLELALLSFLQSFRKVYIGEAVMHSSKVYVRLGESVGLADHAAVMNVILAKMASNLKVYCGAEEVISATLELFKVCVGGVVCGGFLGANACAGCVVGWMAWQCHIGWWDGVLAAPLRVSWEEYLRSETTGQVPQQPTPCLGPDAPPPSTQDLASGYMSGKLLIKLEAISYLLTHHTAGGGCTRGGWDAEWAFKPVCIRCHPQGTRLGESGSPRTATDAPPSSHPNPPEYFPFLAGQANLRARTTFYSTLARLLFMDDTPDRFKAFVAPMQQVWRALEGGLREGVMSWVGVLELDDXXXXXXXXXXTKGAPPHPGPDPSHPHP

SEQ ID NO: 9195 - protein, 508 aa, Chlorella protothecoides
  MOD_RES (179)..(182): Any amino acid
MMMLCASLGASHATRAPQRSRRTRGSGPSSLVIGRGAIARSADHPTRGPDARPAVVGTPPLRPLRVPCRAGLSVGGPTDGLPVSPAGSPPSSPRCSVETTDFLVLGSGIAGLSYALAVAEHGSVAVVTKAAADDGCTRYAQGGICAVLDPRDSVAAHAHDTMVAGAWLNCPEAVAAVCXXXXCAVLDPRDSVAAHVHDTMVAGAWLNCPEAVAAVCAEGPALVLGLARLGAEFTRAAVPAGRGRGGGPGGARAAARRVVHAADATGAEIERALLARARAHPAITFHEHRVGADLVLGELPGGGRACLGADTLDALTGRRTRFLALSTMLATGGAGQLYPVTTNPGVATGDGMAMAARAGAPLEGLEFVQFHPTALVAGEPAAADGRAFLISEAVRGEGGRLLNAAGERFMARYDAARMELAPRDVVARAIHAEMAAAGADHVLLDVRHLGRPAIEAHFPTIAARCAAMGLDMAAAPLPVAPAQHYMCGGVRAGLGGETALPGLWAAGE

SEQ ID NO: 9196 - protein, 127 aa, Chlorella protothecoides
MQAAWNANGHWVLSASRDASCAVHDMRMRRALASFRGPSKDVVCAAWHPIHEDLFVAGGNNGSLLYWLASRPEAPVGAVPAAHEGTVWSLGWHPVGHLLASGGGDFATKFWCRWRGWCVLVGGGAGR

SEQ ID NO: 9197 - protein, 87 aa, Chlorella protothecoides
MRADNALLEQALRLLVATLSFDFVGTCLDESAEDLGTIQIPTAWRPAIEDAGTLQLLWGYYAGNEPPLSSLALESLRRHGGQRGGGI

SEQ ID NO: 9198 - protein, 106 aa, Chlorella protothecoides
MTYTRSGTFLVSGDDGGVVRFWKTNLELVKSVQAHGESLRGLAFAPSDLKFATASDDGTVRVWDFARVAAEQVLAGHGGDVRCVDWNPRSSQLVSGGFRGGGGGVR

SEQ ID NO: 9199 - protein, 186 aa, Chlorella protothecoides
GRGRGDGDRSGRREYDRHDGSGRGHETEKRSGGGRGNWGAEVEAAGEEPAERPPPPEPTPEEVEAAEAARREREEEERQLSLSAYEAQQAAKRASLNSAKGPTYVVDKDQFKGMKSFTKVEEDVGLDLHKNVKTIGANKGGRDKELKQKELVKDVGFRIAGDDAPRGPPAGGRGGRGGRFEGGRGG

SEQ ID NO: 9200 - protein, 433 aa, Chlorella protothecoides
MGCGEPWALALGGAICKLPDVKMVDPCSSRFHTQVSEFSHDKPHLVLHDSREPASREIAKSLNMLFGGIDLDPTDRLFAALLVAEHQSDLRQRSVRHMLSRAGAREEVLGVLMCAALGGTSRYIRVWWPFKRAMVAAPPLNLSLLHAGFITNMQKRGTFITGPQRRDGGQLEHFPEPRPKQSVSWHLPPSPFSTKAADIRPMYCRTTLKLDEGALEEGGHLDKAASGTDSPSLEWVREQLGTRLTLAYRYTPIVTPVCLPAVYCDHLTPQEAADIYSGVWWCAMGLNMHRPGGLPGPSVSRQAIKLQPQSAHPWCPQSWGRLSGVSVKLVSDINSTSWVSLALQASTHLCCQRKSVPEVHEQGVSTPELVQAAELSVWEGTCMTQGWKRLHEQRGRAHRIATFLSPLQGSHSPVITILHFHSPADANTSGGAL

SEQ ID NO: 9201 - protein, 429 aa, Chlorella protothecoides
  MOD_RES (24)..(30): Any amino acid
  MOD_RES (211)..(214): Any amino acid
  MOD_RES (345)..(348): Any amino acid
  MOD_RES (374)..(377): Any amino acid
MITAELDFPLLQNHACRHAHRQLXXXXXXXNSASRGVEKGYSIREFHGTQGLFRRYRAPSTISRFGLCRGVGGSVTGPDEAVLHRRGISSSNLCVPGLLDPTLERLLQRVIVYPNYVNAGRTVAEGRRVPRVPGGALEYAGAEDPTAPEIYDCIVNGLKLPAELEVRMAPHRAVRDEEGLIQKAPTVFRLALEVPVISAITSLKTTTCTLXXXXEVPVVSGIASLKTTTCTLQNKAYPREALLRGRVRVALRGPDGKPLNPAVTSRSKLLREIAALLPRHPARVNRPKQPAGGAAAAAAAAAAAAGSSASGSKQQTLLHQSALLLVHWTSGGMAPGMGRYISGWXXXXATRATHSAAQRPFARHCPASGRGAYXXXXRLSSPYSVLRSSTFLHQSALLSVHWTVGGMATGMGRYISGWYRACCGAAKGN

SEQ ID NO: 9202 - protein, 178 aa, Chlorella protothecoides
  MOD_RES (108)..(110): Any amino acid
MTWLETAGFAKDNRTLCRSPDMPASHRQPLALCAVQGAIHESIKALDARGMAAIASGDAQRFADYLQETGNTICGRHAIAILLQVQLLVDGWRVWRWQSQTSSPRLPXXXSTQSQQGPPLCHRRWPSQTSSPRSLSTSTTSPRPAHAPRTPASATRQASYAPRPDAGQRLAQGRCAAE

SEQ ID NO: 9203 - protein, 187 aa, Chlorella protothecoides
MDDSEFVLPPDEHRTGQSMRPHLNPMITQEACICDRPFPSLFLPPLPPLPSHHLQARASRSAGGQDALAGVSTGSKASPGSPLGDVPVDSGVYDQLKASGAFDIASLSQDEASAVQCSMLLSPALRNSRNFLRGCLSSLTHCAPAVHRTNKQEEHSIEMHCPFIQHVMRERSFTLVPIIVGALSRQR

SEQ ID NO: 9204 - protein, 907 aa, Chlorella protothecoides
  MOD_RES (421)..(424): Any amino acid
  MOD_RES (696)..(698): Any amino acid
  MOD_RES (801)..(804): Any amino acid
MLYLRQRDPRVQIGARIPDSLTGLGAKVCRKASCRACAGPTNCDIRLVDPRSHATRILGYNAVNLRDTIGLRARSTPSALKQGAPCPRFLDHLPLVEFIQPHHLQTIPKAQSNASRANPSKAKNETHALVLPGVFQWAPGGHGELLIEVDLPRPQLYPPPKSPAWVLDSLPQGLEGGARSPRPPFSEIRGILVASLLSAALSPGLSSHYMAGLAHDAQGILVASLPSAPLSPGLSSHHMAGLANDAQQKISYRQGDHRSLLPHTKFSRFISRCTAFFTFDIHNPLKGTSRSVIEDAACCWKPYAGMAGCSEALAPKPAPASHHASLPKPKDTVQRQQGAHRGPGGRVGGTKPHGSSRHQPPAEWTVGAPVHHLRLHPWKESPVLLATQGPYIPDPGCAWGGGVDILLVFVSNGGDMVSCVXXXXGPIYQTLDYRILRHATLSTPPHADNESLRGKNRETTPLFNAVEAELEPISDSEVAVQFKRFWLAGFIPVPAPASARGRLDTTYLDEDLRISRGDKGNLFVLRMNDKNAECVFEQFVPWAAHPPAAEYPIVLRHISYQRVLAWRAVFCRCSGPSPRYHMAITDARVAAAVVGGIALGITLQFLVSGIRGCIVCLPAPKLGKYTLGPSSLVIGLAVSAATGSCFNPVRLRRDACCGTTGGPCSQVSRCLKGLSAQSPPHVRGLSLTLPNFHAGXXXGTTGGPCSQVRRLHVCAGAHARPLLRRRPRVKPGQLMGRRGQVPDRLLGRRVRGYPCHPVPCRGEYEWGVQLREGPAPGSIAHPLQTAPLRPLNFIPSTMPPXXXXGEYEWGVQLREGSAPGSVAHPLQTAPSPPLNFLPSTMPPVPENRGRSPGHAAGGCGGAGRHTLCLGLHVGGRRGRFLLLLMPKPEGFSTCSALALCSPVALRC

SEQ ID NO: 9205 - protein, 263 aa, Chlorella protothecoides
MLAAPVRVRSQISEALSIISSHDFPARWPALLPGLLERLESADEVRLAGVLATADSIYQRYRAQFMTDALSAELDYSQQVVAPLLATLRRLTPRIAERAADPPAQALLLSNIQLVVSIFYSLNSPGLTEAFEETLDGWMSEFHGLLVLEAPGVAEKDPEKQSVLDVVKATGLWGLHAGIKQGLAGYAVHPCSATCARWKSHEPLCPSHSPPPQICEALILFLERNEEEFAKFLQTFVQDVWTLLFSVSQNPGQAGFLGGWWAG

SEQ ID NO: 9206 - protein, 305 aa, Chlorella protothecoides
MSDLSLLPMLCSGFTLSLCAESAARDRLGRDAGVERGKKDRSVPLQSVLERMRARKAAALARAPQPPAPLIPSFDDVLGALPAQPARSKALPAASQTVAADKRALAPEPATPAESAASSDLELVDEEGEEACNIVALPSTLKQRRPSTQVQGSWERAAKWLLLINPPDLDDFEDDVDSEEELEDGDVLVGEGAGAREGSADSDARSAASMSESEESDSDDDGGSEGAPNGGDGDSESALSDGARSAPGSSPPTAEDPAASTAGDDPGSAGAQQESPSLADVLAAGARAEQASSQGVAWGCGVLGN

SEQ ID NO: 9207 - protein, 70 aa, Chlorella protothecoides
MATVRAAYHAGTWYDDRARSLEASIRKWMEDASHPDPVGSIRALIGPHAGFTYCGHVLAHAYKGIDAGSV

SEQ ID NO: 9208 - protein, 140 aa, Chlorella protothecoides
MRKRSTLEPPIPAHPSRPSNPNPTFPPPPRPSLLASESNVVHSYAAIAVDKLLSQREGGALRFQPQELAGCLQGLLERLFACFALPDSSENEYVMKAVMRVIAFVGERGHGGAREGGARGGGGAESGDSPVAPEGEGRMR

SEQ ID NO: 9209 - protein, 89 aa, Chlorella protothecoides
MEMPLCATPGILTPTSHARAAWAATLAADAGYTQWLVLQSGHNGWRFDANVKPYHSYAAGEAPPEPEDVATELPDRDEGLAELAALGLL

SEQ ID NO: 9210 - protein, 175 aa, Chlorella protothecoides
MNWVEYVRRDTEGSDSDTRRRAASELVKALTARYPAQTTELFSGYVASMLAEAGGTGRAARWKAKDCAIYLVAALTLRGKTASAGATSTNDLVNLQDFYAQESAPQPHPSPSHPRPIRQHVAPELAAADVNDLPVLKADALKFATTFRSQLPKATALATFPHLVKCAGGVGGCSD

SEQ ID NO: 9211 - protein, 329 aa, Chlorella protothecoides
  MOD_RES (248)..(251): Any amino acid
MPQRHPGSCPGSASASADSPCERALTSQCLSLPPPLQAYAPQYPFPKEEAWYFILGDTSANAAMCLIRASLVAAEAAGARAVVRAVAAGTDPAAVDPLAEEADAAEDGAAPRYQEVSAAFRAPLKAGRHVLTLACLPDSCLGCDRAVPIKVRVVEATRAEREGRAQRLAAAVAAGEDGEGSWEQVGASDAEEGSESGSEREEEVLIGGGGEGIWRGSRSACVRWNPIGKRVGQRSCLMRAEGSRCHEXXXXSRSACVRWNPIGKRVGQRGSRTGAEGSRCNEGAPWPRLTTRPAFFSFQEGEYDSDEYGTEESGGESEEEGDAPQPGTT

SEQ ID NO: 9212 - protein, 601 aa, Chlorella protothecoides
  MOD_RES (40)..(43): Any amino acid
  MOD_RES (111)..(114): Any amino acid
  MOD_RES (405)..(408): Any amino acid
  MOD_RES (427)..(429): Any amino acid
MGHLGLHLRTPRLHRGIHPCAPGPPLDDNHALNSPPWHFXXXXCTVAFTPAHRNRPWMPATPSTRLPWHLNQGQNAALDDLRRRVLFLHPDLKEKSQFWKRRASIVKVPRXXXXAARQHRQGATMFSQRFCWELLGGGVSPCADLLPHPGASALLQSHPYPPADIYLPPTQFDPGTSAGPRPPLARTHPCRADKGRELHPAKVPGPAQGARRHRLRPAGPGSLTGWRERGWMLWGQLQLPSLHGSRTGRAWGGWSETQLPVFRTAGLGVAGARHSSLCFSSPCRISRRHGRQLPCAATHLGACHLFPNAARVRLAGAGAGVRGDDAALGPGRPDPGSEGRKGRRGGRQPAAAAGLRLRRPSAPGEEEGQDPGRCGCREGGAGIIVHLQAAGWGWPLGQLWSSSHXXXXDRGAEFVPCKRFDSSSYPXXXAGWRWSVILRTPPLPGSSCSTLPPWIVVQNLYLANVSMPLAISHPQPNKPTPPPSTPTPDLRALAPEERAAALRDAGLESEDQVESVETALAALPTLWVRAEVTDEAGEAADGDASVLAGEVLTLRVRLALTRAAHAVPGFDPDTIRGASSLGEGGPPKLVLLRIWEGRGGE

SEQ ID NO: 9213 - protein, 861 aa, Chlorella protothecoides
  MOD_RES (682)..(685): Any amino acid
MPVGGKEALTPQSTHALTPRQRGVLKGAHAAIHVCTHAAAGGGSKEAGGAPAMPRPREPPLKHYAMNTLCAVNPASLVGAGEVPGGQSEGKHDPAKQQHQEDDGGSVLVLCTKVRERRGGGALLSACRNRRQAAGKHTNFRWMLLHAPRLSLHPTSQSYTACRPHQHPCTFEKNHSGRATLQRGERVTWHRQSRPPATGRPAFPCMPCGPPLSKYTPSPCAPDAGGQAAMGWVLCLRRRGSAVWAWPARPSPDRPPRQSVAMSRSPEPMPSPPIPYLGDVVGKVVRGGRVRVLVRMVQEGEPAICLLDVCVAGSDGQLQDLEGVELLHSIRSGRRIPAQHTVVRVEKLRAKLTDDKILWMLCFSEYTAAPERRTRREQGLCDLGVAWVSGFGSRPYPQPEAGPAGEDPHYHTLSSGPLPYSLYKVYGISPRGNPPLGNFERPRQFDTQFSDQYATGREFGQESLPRFAPRAPMLLSWIRKRDTDFEPSSDRISTVLPGSHLIAAHHHNMDRANALQRELREEADAFQAIQQDVNKNHNARQQFLQQQNENEMVFKISGEEGAVYKLIGPALVRQDALEARANVKKRLEFIASELARLDSQLKALEEKQTRKHSQASIVWALGGEWAMMRWSGAPTAGRHVHSGALGWQVRPVCGPPCPPSLLPGSQPLRQMIKLQQEAQRLXXXXPVCGPPCPPSLLPGRLRVCLAEGHHRSSLSSPSGLSWLPCIQSSPPPPLCSLDLECGPDCTQQGMTQSDGLTLASPRPGASNQFAPGRSDSSSSLALLLASRGRLGRRPLACFRGRGDCMGKGGSGRRKWKALLASIVGAHETSSMANAFPQFQTPHPHLRPCPGFRPPFRLPDCP

SEQ ID NO: 9214 - protein, 134 aa, Chlorella protothecoides
MRAGTALCFGSAQSCTMFCAGSSEHSATLSPRMPRFDPEHPGPMPDPERWLPKWQRAEARKGRKKRRDKVRAEELWGGWVRRDKQAVWLRRQGSRSAGVEQRAAANECRVGGHGHHSLWGCADEKEMAGHGRCI

SEQ ID NO: 9215 - protein, 121 aa, Chlorella protothecoides
MVVRVLTGWSCLGLWVRAATKPRHPRYAQVTKSWSTKKAGQSLGERVRYTSSRANAVQQFDPFQILELPITAGDADIKKAYRRLSLLYHPDKNPDPSAADYFANYISKVWYGRAGHGLRRS

SEQ ID NO: 9216 - protein, 635 aa, Chlorella protothecoides
  MOD_RES (281)..(284): Any amino acid
  MOD_RES (404)..(407): Any amino acid
MTHGDEGKGASRPSLRISAMMSTTPPHDDLCWPVLSLITSALHPRHSPDTLPKHHGVVSPACGSRDPCGAPSAAPVHGLEACRIQYRQPPVPAGPALQGVGKAPAHDHNRCCHQAAEGPASPGAAWFMNGDGRPGGSLSTSSWRTLNTGTPRFGLPDGLFKHRNTRRLTSPSLSACPLLSPSLQTLEQGRTPQGGLRVKSASGNAAKAGVQVGDTVIYTSSFFGDELWPADKLASAWRRVLRWQELATYQGPDGVQQVFLSMSCRSMTCVPQNTPTPFHRXXXXAQQASTLSQHIPNLCPSNPPPLLHRSTSQQSFARSAIQAAPSPITLVLVKGENTSVDVKRLVKKSAPPRFGRRLSATEKERATHICLDCGENAVERGAGQTRGTGGGPGGWGGGSLKLSXXXXTDAGNWRGTCGVGWGEFEVIDMACRGGRAMSGMLVTYTGDAHTHACPDPRSSPGSHRSSPASLHQATSTATPRPGRTCPATMCAPSAMRPGAASCGLTPSLERWCNAPRRRFVRFDPESGAVGAGGATVEVRGQGPPCMQAHALTGCSPPLLLRLSAGPPFAACVALIPAHPQRQNPPLPMPRRPAAPVLMPLAGRQWRRASSVWPSWATWASRSSVWPHPSLVNCLG

SEQ ID NO: 9217 - protein, 331 aa, Chlorella protothecoides
MLPSTPSLCPLCVQLADLWSVGVILYTMLFGQYPFAAAQPNDCEYARKIIKAEVGVVGPVGGGAAGRAGEESGGLSSATPPTSTLRWHAARPAPPAPPQYDVPPSVPASADVLDLLARLLVADPRQRIPIAEIMQHPWFLRDLPLGAADMNRFYLDRAPVLHPKSFRVASGDGGWRAYAKLEAWVVAVGERVLSWAIPLGRAMAIPSVLTRATCAVLQLMSLHLRSLPHLRSTCPYLVPPPPAYLPCSLQLEKDIEQMVDVASGPVSAQEAPLACSFDGVRLLSIQMSQGGTSLGMLGSSQHGYLSSTSSARMQSTLGYYGAQPNASLMVP

SEQ ID NO: 9218 - protein, 212 aa, Chlorella protothecoides
MAGGWPANRLACLPFVQALTLPWAASPTLPNLTPGRDPLTQHRPLPPPSKTRRASPSSPGTSTSGPPTPPPLEYIPPIPGLLHYRQMGGLGTGAFGRVILARDTRDNALVAIKLLPRGDFIATFKTYVMREIMHQGSLWHPHVVALREVFTTPQYLAIAMEYAAGGDLFRHLRHERPAQRLPEAEARRVFQQLVIGLDYCHTRVGARGGGGP

SEQ ID NO: 9219 - protein, 267 aa, Chlorella protothecoides
MMRAPAPRTSTGAASPAAEDPAARLRRLVVDLAPPRVGSAPGAPAKGTDEALAADAASAGLNAEQRAAVASVRAGAECTLVLGVPGSGKTSAIVGMVRAMVAGGHSVLVSSYTNRSVTMSGDGRRVDCLVVLRLGWVRGREGRRASAAACGCACVPIAAHARVHGGAWQQQGAAAQARVGGELHRESCGPPFPWRATARMGGELHRESGGPPFPWRAPVLLTVPTRAPQPPATLYELLRLFSEPCHIPNPLPSLPPQCGGQHPPEAG

SEQ ID NO: 9220 - protein, 288 aa, Chlorella protothecoides
MSKSAPGLLARAKSLLEGVKAPWAVTGPLSSPEYASHLPRAGEYRERAPGSQGVRAMVPAAETNRVYDIKYFSECEGNHGGSSSMCSHISDAQWATPPLAFLQHGTLAAHTSLAAPSSTSTTTSALPRRLKPWRWVVQWGGLNGHAVLTSTICWLWHWRQHQPRARSGRGPSSPSSKRTTMGEGGAGWRISLSPEQGALPNVHHVSAAALLTSRVHIQKALLWKGGKTRRWPLTRAVDVSGPYRKVYMAVTILWVRECERFTEAGKTLCLLGAKCSRFCPARSWRRLA

SEQ ID NO: 9221 - protein, 172 aa, Chlorella protothecoides
MQISTRRKPARVGQLSTLTAINPQGLWLSRLLSLFGDTEARILVLGLDNAGKTTILCECFARAPKGGATVSRPSLNLHLHPFADRLHVGEVVQTIPSEVVGVFMGGASIQVSSLHRAPFAWCPSLPPTITLHSQPTAIGFNVETVTYKNIKFQVWDLGGQTSIRPYWRCYYP

SEQ ID NO: 9222 - protein, 189 aa, Chlorella protothecoides
MPSSAAAQTGRRISPAKKRADDAAAHSGQTDEASASRRTGSLPPPSPEAARSLREANRALVERVRASLSAEEFLAFRRESSAWVRSELTSPEYAAAVVALGLADLIPDLAATCPNPAKAQELVQAAPRVKGKRVRRVGVVGWRGCAGAVVCSAGRGGPRPAGVGVAGWRGCAGAVICSAGRGGSSPAGF

SEQ ID NO: 9223 - protein, 131 aa, Chlorella protothecoides
MSRQHSGPLAEDSLPQEDSWPSQSVNPFYHEDDVQLDALGVINALERTCALESALRQAIQDTHPLSTTLDWDFRAADRERKALLAITEHLEFLEDKLREFRFMTASDEENRVGAGGMLVTGASGPCQLACS

SEQ ID NO: 9224 - protein, 400 aa, Chlorella protothecoides
MEDLCIVCAEPLVYTAYGPCGHQDACSKCVLRLRTIMKDSRCVLCQQPCHAVFVTRAMGSYTGTLSADEWEELPERVEQGKAFLLAQAQAYFDEQAHFKTMAGLCTFSHPALLDAQKRLRDVLGRAWRLWAAALRPLPPHRPIVFRTLHALREGVKEALDQHFCGQCLQGRKVFTAEQLLYSGPDLERHLRQGDREGPLAEAGFKGHPECHFCRRRFYGDTELYTHMHTQHEQCFLCKRVDPSKHVYYRDYPDLESESIWGLGRRGRWDRRPAEVEECRIAWEGREVRPPWNKDCAIGLVLGIEPAIVTWTLPGRSPHHALLPVPLRPLLPAALPLPAPQLPREEVCRLRQRPGQQCAVYRGWAFQICPHCLHVIDGEGEGRAALLPRPMDPAMQCHLLA

SEQ ID NO: 9225 - protein, 267 aa, Chlorella protothecoides
  MOD_RES (170)..(182): Any amino acid
MSLRERRCAPATARHAMFQPDHLQGRGPLAPCRINSFLDNVDVGDLMGARALCWGLAAVTGGSGGWHAVFDSLLCHQITGKLAGLDKKLSRSLEEEVMESSSPSELSKSPVGPLVDSSRCTGAAVRVAEHAGSWTDGTGSSAQRQHPHTSALAPWHAVSLIRSRPDLRYXXXXXXXXXXXXXPPPPPPPPPLLQGGEPGGDPGACLSPPPGGRQGGLGVQGPMLVPECMTVSRLCSEKRQEDCRPRRRGPSPLLMEWGGSKACEDLT

SEQ ID NO: 9226 - protein, 147 aa, Chlorella protothecoides
MPGHCLPLVSADHLHTGPCPPDYSSRPENFTCLVECRRAVAQDLGLQEADLALSMGMSGDYEAAIAMGATHVRSSGKGAPRPVIATQLPLLDRVWIRAHDATAHLREQCQGGSGPGGFHGINGELPRLRRDPGLQGAVGPDVASMAP

SEQ ID NO: 9227 - protein, 352 aa, Chlorella protothecoides
MALHLAGAAQAPHPAPAPRSSFSTPPDMRCTPRRYICFTHRITRSTPRSGAAPRATTAQAGIDSHTPRRTAPFPLLRAAAAAGLAALVLHGAGPAEAVLVSPIARVPRSAEAALRRSVPAFNPDARAIREGLESVAFKLRIPQRKPWASMAEDVAAGAGLAADEGRALAGTPSPALSQARRALGEVRAGLATLAAAVDAHDIDRSSQRVAAALAAVGRLELLQAPGLAFRVPGQYEGLPRLTGRAVVRLEVQRRGGGADAPSPDPDMLELTLDGFSAPLSAGALAAAVADGALDGQPLAASPVAVVVGAQTPDDPGVPLEILPAGDFEPVYRTPLDVAAGELPVSHGFGDGS

SEQ ID NO: 9228 - protein, 144 aa, Chlorella protothecoides
TFVYRTSPEPLTRVLRSLTHPDQRAKAGAAPVVYVGRYAQRGSTVHTSLRYNDSRATELRARLTLRSTVRGANNRLAVDSFFSWDGVEGSSHSLLEEGEAGEGAGEGRRPFQRGLNPFVFVSYQQAHKSPLNLPVTQMDYFIPG

SEQ ID NO: 9229 - protein, 283 aa, Chlorella protothecoides
MLLRSCRLCVARVLGILPRSQTPVVGSRLAAWSLVQARPLVRVPQLVPGPCSLRSVTQRAVHEAASAPSEARPGNPTPPASSHCILNFYHLVDIPRPHEVLEQHRAFLEGREVRGRIYISHQGINAQCGGVTADAVAYVQWLAQEQSLFEPLPVGVEDLGRQGTVGGESRGDAANGGPPNRPRDQDRGRHPSFPSSSALPHAPLKGLRYKLYPADDHAFPRLRLKFRPNLISLAGGMAAAPVTDAQARATPLDPLAWKEMLAQVGLPALGCGCGGGACSTHGR

SEQ ID NO: 9230 - protein, 249 aa, Chlorella protothecoides
MGEDHHTEYPEDSYGPLGLLPGLQLATSEQISPCSLMYTCFPHSHPRLPPPSLTLQEIVDKAPLLPKDIRWHFVGHLQRNKVRSLLGAVPNLEVVESVDGEKLADKLSAFVLEEGATALGWCQEGWVGGLTWRGACAGNAAIPWPVTSQHRLHPQPKRKELATLRAPVLAHREPASPIHSPHACAEREPLGVMVQVNTSGEVSKFGVSPGESCVGLARHIHQQCPGLKLVGLMTIGMAGVQGGGGEGGA

SEQ ID NO: 9231 - protein, 182 aa, Chlorella protothecoides
MPSMHRYGFVRFQSFEDAQAAINALDATTTHGQTLQVKFADADAGPPAASPVSGLTPSESVYVKHLPAASTVSDVQALFEGIGGVQDVKLFPCLDHFRGASALVRMASRRDSERAIAALNNTTPAGSLQSLVVRYAESAAEKAARLARRNPVRAGTGLGPGAAATAGVLGAGLGGAAHADLQ

SEQ ID NO: 9232 - protein, 418 aa, Chlorella protothecoides
  MOD_RES (219)..(222): Any amino acid
  MOD_RES (290)..(293): Any amino acid
MLYVANAGDSRAVLCRDGLALPLTDDHKAAREDETARVEAAGGQILFWNGVRVMGLLAVSRAIGDHSLRPYVIAEPEVGGFHSVGVSGGEGVGTACLLHTCEGPCDVCVCGGRGDRSPAAVHSDRMSTHKPSPLPLPSQVTIVHRHPADELLVMASDGLWDVMGNQEACTLARKCLLRARQRGSSRQGVGCRDGGVLGWGPGCEQHGGTGRGGRWRIGXXXXTTACGPTSLPSRRWAGSTVWVYRGREGVGTAWLLHTCEGPCDGRVRGGRGDHSPAAVHGDRMSTHKPXXXXREWGVETAGCWGGAQGVSSTEEQGVEGRWRIGQRRRGHSGRPQPTPHRQSAARVAATVLTRAAVDRGSRDNVTVVVVDLSSASPEEAVAEAASAVSVGWDWGRGGGTCGCSQPVHSIGWSIEGQA

SEQ ID NO: 9233 - protein, 306 aa, Chlorella protothecoides
MGPVALFSDARPSTHALSLRFRCPHKAANIAVKQPAARRGLQPAPRQARTGVWRGRATRCRAAFSPFPFSESDYYRASLQLVQVADGVSRHPRIGVQSLSGAGSEDPVGSGQGMGATGRLVPSPPGCWHPPSTPQHHGPISPLDTTVLGPPPPQTPGSASQSSGHLLLMRDGPRGIEDTERGLILAVGGDTLSGIALLMQGRDGERPLCLDLLWTVLQRGKELSKRDWRLERVAIVELRGMAYIGRLFFGDGAGGAAWDCDCRPSDGCWLSLKVGFEVEGSGERGGGMRGAHPRGSACPSRFPLVS

SEQ ID NO: 9234 - protein, 326 aa, Chlorella protothecoides
MWQRVWASHSKRSLRKAAFIACAGVILVVFFTGFLGLLAAWSGRITADTNPNLYLFEALRGAMNEAGLVSNAMGVVVLLLTITMNESAVDSMQNGLTAAISSHFLRGLPLYWARLAVLVINIPIMVVATKGYTVLQLFLLTNMLCATTAGPVLLGLVERLHPVYGGASLLFTSIFTIFLTSVYGINFAWVDGASRSHNIAEGMHYTWIGNNYDYRFFLVAIGVSIGMVGVTSAFNYLSQTYLIKKKPEVLGFTAPATHPHIPRYHDRLMHAPVQASSGSEGGVDDKIAAGDGLKGGAPHDALTRLSAQLPEALLHTADETPGHRPA

SEQ ID NO: 9235 - protein, 195 aa, Chlorella protothecoides
MRRCVASLNRRVWAESCRRDRAWRVGACARALTTDAAREQGATARAWWAGSLAVGASFGLGAWYLATHPGPALAKDVSSLPEYSKEEVAKHRTPEDRVWVTYKEGVYDITDWVDIHPGGKARLMMAAGSAIDPFWSMYQQHNTQQVRDILEGYRIGSLEGGAPPPPEDPYADDPKDRCAGRGGGPITQAIYRGRG

SEQ ID NO: 9236 - protein, 572 aa, Chlorella protothecoides
MSPGAAAPQVDFLPASCRPSYVPTTPCSHPPAPSSIPVPSYCERCGQNATPDWRYIVSMQVADHSGEIWVTAFNEAVVDIKGTSLHTSVLPLLACRQFVRRSTPYNAYDSPGADRRPSGRAAAAVRGWEPSLRLPRPARESAVWESRTATLFACPGVKGASCGAAAWQRRCCQTQDVPAEVPVHIRCQVLGIAQPRGSLRSRFNLTPTPNSISQQQACFKTYTMKLKVAEDTYNDETKIRISLVSATAPDYGAESRTLLDLIGKLQRGEQIFGPPVPAAGGPGALPGVARGGAPPAQQQGYGGGYGAPAPRPAVGGYGDGGAARGGYGAYGGTALANAGWLQTLSVEEWILESHQQDKGGCWGALQGDGYDEKGTWPRGKGILEQSSTWPASESMAASRCTESESSTTSNPRQAVHEVPSGQALLHVGKGADVLPPEPGVAPRPPCAKQVVSPVVPDVHGLGGLHAQLLTCGLEDAGVGLLGADLCACVLEGGGSGGRNSRGLRCRSLGLGGCEGDPFSRCCCFGATGESEHACKAQCCWAGDPPASRILSDACRFTASTHAPPSFHTPRRR

SEQ ID NO: 9237 - protein, 121 aa, Chlorella protothecoides
MVDVVGVVDSVQDWTSITKRDGGETQKRSMIIRDESGRSIEVTLWGAYALTPGDSLQATTAAGTHPVLAVKNARVGDFNGKTLSTVSSSTVLIDPPDVAEAARLRAWCGILGGKREAEAWC

SEQ ID NO: 9238 - protein, 277 aa, Chlorella protothecoides
TILEQGGQFAGINRKVQLKPLRWASPAEGEPAARPRVAEALLILKHGGVLTHAGRGQAEALGSLFRNIMYPQHGPSGGGLLRLHSTYRHDLKIYSSDEGRVQCSAAAFTKGLLDLEGSALTPILVSLVTKDTGMLDAYGKGASEDIQRAKAELYAQMTLDPETGTSRCAAPHSTTPLVSPPASPKPAEGVGRGGSAESSVHGQARSLSRNASASASTIRAAASALKLAQGTLAGEVGRGKGVPRGGKDGLERPRIDSGEEGCGGEAPVQGGAVLGEG

SEQ ID NO: 9239 - protein, 271 aa, Chlorella protothecoides
MMQQLRHLSHTHHHHIYLCAADSEAEGFVEGASNIEGRPHIFPMPEQPLETLKTMHVLLGALVEDLHQLCVEEQRPNADAGRSYSVLNQDPKDWVFEDDKPCSGERLLLLYDRWRKLAKAFYSEKKSQFDISKVPDIYDAAKYDAIHNATIMGPKIKDVYLVSGGAWVLDWTLLFSLLSAVPSGPLLTHAPQTAKVLADAAIPNEYGIEPEGRLRISTAICSQVWSQRWNWTGWEGRPLGHPSGIESIQDGGPHACCGSRKHCHHAVTAEP

SEQ ID NO: 9240 - protein, 261 aa, Chlorella protothecoides
MSGAVVTRRVHDALCRHQLLAYARMMSGVASLDTLPSSSGLGRPHVRIPYEGVRVAARQQPSANAFLPSFKALLVDAAGTLLLPSEPSAGVSIACGERRDRMGWSGLFSDWPSAGCHDPDFLEEVYAYFAHGDAWRVADGALESLTRIRASGTKLGLVSNFDTRLRPILRELGLDNVFDAVLISAEIGAEKPNPCIFEAACEELGVQPAEAVHVGDDRRNDLFGARRAGCYAWLWGQDVSSFADVEQRLSTGNFMDSLTGV

SEQ ID NO: 9241 - protein, 542 aa, Chlorella protothecoides
  MOD_RES (7)..(10): Any amino acid
  MOD_RES (140)..(143): Any amino acid
  MOD_RES (226)..(253): Any amino acid
MPALSPXXXXRLNACHFELPAKQHQCPSGFWGTGSLVGMKPGTKLPASNNFIAGADHASAVSDHGARQSGHLVHQGGAGGCARGRDCRGGDRQGHHDVSACRAGMIVFGLGAGPAIAMSEDVVGSFRILAPPPPPPPSHXXXXLWGSSEPSGAPPPHHHHHTSPKSQSTPCSFAARWENQDDGFVAKLLVPEGAQGIEVGAPVAILVEEQGDIAAFKDYAGPSSSXXXXXXXXXXXXXXXXXXXXXXXXXXXXAPAVSGPTSYRLGPAARMLLSGSGLGPGDVTPTGPHGIVTKGDVLAALASGQAPRAASTATEGTEPAAKPAGKEGTEAAATAPAAKEAAKPASSAPAPAQDPAPASGRRRKTRGGHTDVPNSQIRRIIAARLSESKSTIPHLYLSADVDMDAVAALRAGLKTQGLKLSVNDFVVKAAAGALAAVPAANAHWDVEGARAVRDPGVDIAIAVATEAGLITPIVRGADAKSLPDVAEEVRELAARARRNRLKPEEFQGGSFSISNLGMYGIDSFSAIINPPQVGWRGNCLGI

SEQ ID NO: 9242 - protein, 213 aa, Chlorella protothecoides
MPPAHAKHLSCNGTIFAEESEEEDTAADDEAGAKSRSSSVNDFSSLDEEAMSGTKWKGKGKKKGKKKGHGDLYALLGLQNERWMATPDQIRLAYRKSALLHHPDKQGIPSGDEVGKQEAEDKFKAIQEAYETLFDPAKRREFDSLDEFDDSLPGEVESAEAFYTVYGQAFSRNSRWAVHQPAPTLGDDTSSYEEVRATVLCCRCWELEDVAKC

SEQ ID NO: 9243 - protein, 59 aa, Chlorella protothecoides
MAVGASRTVTVIGADGALATKSVMRVTLSADHRVYDGEIASDLLAAFKANLEAPFKLLL

SEQ ID NO: 9244 - protein, 229 aa, Chlorella protothecoides
  MOD_RES (20)..(23): Any amino acid
MQPAAHAAARILEGADRAGXXXXPSRAWHTSAPFHHPRHYHHLPSPCSLRRMQLRESWKALTGLASRLAAEAGAPSPPTESDFLWAHAVFWSRAIAFPCPPEALPGGRSTTAGPSPQEGVVPGLDFCNHAMRPVARWTVYGAELDGAGGGRRHVHLVPSVAPPAPGAELCISYGDDKSNEELLFLYGFALPEASGLARLMLPLPLPAAAEDWTPRLHARVALLAARVLP

SEQ ID NO: 9245 - protein, 398 aa, Chlorella protothecoides
AAPPDSLLGRFSLAALHLRGARRVATAWNALLRTLRFEYLEHGAGGPGGGGASREGGPVDLGAALPHQHLQLFQLSVAMLRDAEDGPACLARRASDGSETSASSLFMSAGEEGVADGDLGGVGPLDAGMADTEVAEGGGASGGGASGGDEGAGSLDRGWEDDGLEDGSPAKSGSAERDDPPVLQTRAHGSGSAAGRALERPGSDEASHTLAAVPQGVASILPGAYLLHHPDVPLAVPETQAAPPCTEEALLGAGPSSGQGEDGGGVRASHAALLAMAAPGNAWAAAWQGARACPAARQRPLHQPRREAERALHALETVLPEHFWRALLAVARSTALAVLQASEVAGMAPVAGQLERYAVKGVGGGHWTARRTAEGWPSAGPSARLWEDPGDDALRFSR

SEQ ID NO: 9246 - protein, 121 aa, Chlorella protothecoides
MAVYANASLGARQGWGQWAAQKLRLPFAPQPVSLAAFPLSLALTGQSVAARSPCLGAGMDSGAVDERDAVILYLAAQRRLGPASQLHPWLRLLPKTFTTTLFWKDEEVEWLAGTTLHRATL

SEQ ID NO: 9247 - protein, 620 aa, Chlorella protothecoides
MWDSPSRPGCLLALLRPIHTLTHAPPCHHCGRVPPPPSRRGQHETLLLWREQRGHSSPARCSSSQTFPCVQLRGSVQISLEGNEWLVIPLTLYSFTTRCLLERGHGLQAGRMHATLIPVVDRPGCRADNQEIKKRSTKDCTSLRGCFLRRSSSLHGRRKVGLQPRLEQGGGGRVAPRRPRPRHLHRRGAGRGGEAGGVPGGHAGQHQPGSQGGDASHGRHPALQRAQADPKGCRVLAVLGLCAGGGLGALLEKPGAVVAEFHVQRARERGMASESGGNETSWGATSTSEPRSSIVKDMLTWEPDTPGSCSQPSSASHSRICSRWLAMKPSLWTVRKEARSERGTSERCERLVSTCLCRDSSDIINRRRLSFACALVTPGPGGEPEPSVEAIPGSRLHDSLGLPCGRVCSSSRRAVYSVRKLSSNIPRWKGGIPGFVTAGQSQGVRDLVPACFFLYTSCRRAHPRCGCLGEGVTPADNPAADQAGDGSGLPQRGVPTPRMRIHGDAGWRSQVAGSSTCAPTPAPSHMPTRSIDFCSSPSIFSLTLLFPQTVRDKCFGTCVTKPSSSLSSSEQQCLARCCDRYAEVGSTGWLFCRGFQRSGHPGRHQGYPGDEWLPVILCCF

SEQ ID NO: 9248 - protein, 244 aa, Chlorella protothecoides
MSAGAGWAHGRSTRSLRSLLERAIWFAKAAAAIHVFRNYVAEFTVVDGDGCALGPCPNSLAPMEPPHAGAPASLQPIGLSMSPTFNTHGDVALLERVSVATRSIKVGDVVVARSVQNVRHIVIKRVLGLEGDVVPLPGSTTGRRVAVVPKGHVWLQGDNFHNSTDSRTYGPVPYALLQGRVFLKASWGVEVHADLDWWGVLEAVGLVGSCIRQFGGQAKIWPPQDAGWVRSGIPDYMFPHGTGL

SEQ ID NO: 9249 - protein, 84 aa, Chlorella protothecoides
MCEALSNGAMYSSGPLPPPADRAKFLGPFSEGVTPSYLKGEYPGDYGWDTAGLSADPQTFARYRDIELIHSRWALLGTLCWWGL

SEQ ID NO: 9250 - protein, 254 aa, Chlorella protothecoides
  MOD_RES (111)..(113): Any amino acid
MYSQCSSLLPCARSSQPLWASSFLHKIEATQNCHHPKAHGEDQWEPRKNAQLDQTDSGCLAGHPPDIFTGRSVSEQSILNGDAKEESKTFLTACGCVWWGVGGGGEAVVVXXXAGDDGLDEEAEVGEHGEAPVLQLLHLELVKGVGVVGQAQGVEGAAGVLLVKVQADGLAAAGAVGLRASHEHHLGGQGGHDGLGVHQGGVAQVVQAVGAEDAGASLEPDGGVAGEGDGAVALQQLRDEDAEGSWRAWRRVGV

SEQ ID NO: 9251 - protein, 278 aa, Chlorella protothecoides
MKAVAYDCISQFNLLHTPQPQPKSGLFSATQTEAVQALARAGLRNAVRVNVAVSRAAAAPRPDVEGVAEAAGWEAELQRDELEQRTPGTLSICYHIVEAVDKLAVLAHFLQCFSHVALYTLLDAPPCNTPHPPAHTPHANAQAHPDSKIIVYFLTCACVDHALLALGLLPDTRGLAVSALHGRMKQAAREAVLEAYAAAATGVLLCTDVAARGLDIPDVHWIVQADPPQDPAAFIHRVGRTARMGRSGTWWEGAGSLVAVVSVCVCDHASCRQVEGPG

SEQ ID NO: 9252 - protein, 159 aa, Chlorella protothecoides
MPEVKKAGIRLAGFEPSAIDVDSSEQGLLAGGDAQGIELGRVKFKDKAREKQRQALLKKREAEGPRESAKAAHRAAQQAARQAAARQATEAVGAGARLTAAKRRALEAADEAEELATEYTMLKKLRRGKISQVGLGELGSAWRSVFRSVSCGRKAKGRK

SEQ ID NO: 9253 - protein, 83 aa, Chlorella protothecoides
MTQEKRMVWSTVLCQETATRYAFSPSSPFLPFLCAVEILVLDEADRLLDMGFKVQLDAIISALPRQRRTGQRGRMLEMNAKDS

SEQ ID NO: 9254 - protein, 272 aa, Chlorella protothecoides
MLARLKPVDVSRCIVAWPRGMQGAGGVGPCLRPHSAEPAKAWRRRGLALGKRLRPTTVAYFTSAALLVSYIAWASLGAAFTPVPRHGQGGDHIQHPPHKVALLFLSRGSLPMEPVWKEFFEHAALLRQSPGPSLGRKTWEDGGGRRHARGKDSAPSSIDRIPRASPHPGGRSAGQRTAREAALPQDLRALLDESTGLLRLPDTQAMLSSDKAAEVHDTHNELASGSLEAPFSALSPLDPQGPVARQDLFSVHTHTRAAFAFPPGTGWGRTGA

SEQ ID NO: 9255 - protein, 135 aa, Chlorella protothecoides
MHREHIEGMGAIVVKADAARADQIDAAMAGIDGLQAVVSTLGSIAEPGTSSGGTLGTVNLVRAAAGLSVEKFVLLGAGEAVDHFKIYDGLNYVIIEPRREGPASAQEVAQTLVQALVTDAEDGKVVPSSGAASSA

SEQ ID NO: 9256 - protein, 87 aa, Chlorella protothecoides
MAGRDFRELGGISSETLAVLDKLGFRTATPVQEATIPLFAGHKDVAVDACTGSGKTLAFLIPLIEKMRRLEEPLTIHQVGGGPGIAR

SEQ ID NO: 9257 - protein, 128 aa, Chlorella protothecoides
MPGDALLLLMPHEDSYVDFLGVRKVPLRPATPAVLGTAAADGAATSARLRAAAEADRAFMEAGVKAFVSYVRGYKEHHCRYIFRIQANSGAGQAAKKSVAWESRLGTGPQHQGVASSSSQSLHLAEAH

SEQ ID NO: 9258 - protein, 122 aa, Chlorella protothecoides
MAEAARPVLHLFRIILRAHREKLPAPMRELGDTYVKDEFRKHLRGKTTQEQWRQFMEEWRRYAGTLAASDGPQASGGVAAADASGDIPPEILETLTPDQRARLAKLRAEAQRLRADLLGESR

SEQ ID NO: 9259 - protein, 258 aa, Chlorella protothecoides
MLQVGASNELPESEELDALYDRFLLRRQVAQVSSAQLGNLARLAAGSLRATTQTSADGAGAAGGRLELADFHGTASTAYSAVEVPDSVIDLLTTTRDYLQDKCEPPIYVSDRRFMKAIKMLQVAAHVDGRSAVHEYDCLLLEFVLGSRPDDSQKVRAFVLETIASDPGLQQLELVFLGLFGRACRALEGGNEQDVAEAQQEASQLVELLDLRQGSVGLTLDGGFADLGATIWQSEGSVREAVQVLTPPMTENRKKVGG

SEQ ID NO: 9260 - protein, 253 aa, Chlorella protothecoides
MMMQGQATVGPPRCGSMGTPFRALPIPSPRLPGSVRRSDWVANTPSQTASKACRWKLAAVKSSQTLETADTDLIQLISDISKDVDSRHAGLLRDAKGATPDIEGLDSSLRGKAQTAILSLQSGLLERETEVRLLLLAALCGEHLLLLGPPGTAKSELSRRLAELTGGRYFERLLTRFSVPEELFGPLSMKGLENDLYERQTSGYLPTAEVAFIDEVFKANSAILNALLTILNERLFSNGSARLEVPLLCLVRK

SEQ ID NO: 9261 - protein, 353 aa, Chlorella protothecoides
  MOD_RES (21)..(24): Any amino acid
  MOD_RES (281)..(284): Any amino acid
MSCKPPPLGLPEWVGSSGPPXXXXGTFDVLQGSTPGPSGVGWLLRPTILPRAGTLRAQPPAKVRVRHDPNGFFRVNSRCVVGDIRVSMQSGSACLSLPLDRQARNGGRGSKALPLASARSQLPVLTTVQEPVAGLAEVEDPQCRICWGGSDLEPGETEAVADCREGNPCTACRRSLACPAHASHGPVHHSPSSLSITPGGRLLTPCQCRGSVAHVHERCLSEWLNQALLVKAPHQAYSCDLCQACCACTSSVSDAPFGSIQDNIIHMVVHASCSSCFPALXXXXLLLAPFRMISSTWWCIHHALHASQPSLLSASCPLPSHPPISRLRTMRPAPLSSLSSRPCGCPSRAWRGS

SEQ ID NO: 9262 - protein, 117 aa, Chlorella protothecoides
MQASILSTTRCGPALAGVPPARPGAVARGRSGRVALRTVAAVKDVFMPALSSTMTEGKIVSWLKSPGDKVAKGESIVVVESGGWLFMLMGIAAGRALLNGLCWFMGFTSSDQPLVGW

SEQ ID NO: 9263 - protein, 376 aa, Chlorella protothecoides
MRRVIATPYAKKLAKELGVDLATIFGSGPNGRVTAADVEAAKAGAAAPAAPAAAPAATPAAAAAAPAQGKAAPSAPPAAAAPATKGKAASSASPAAAAPATKVSELKGTTVPLSGLQQAVSKNMLASLAVPEFRVSMTIGTGAFDALYRKLKGKGVSMTALLSKAVAVALESHPLLYASATADGSGVTYAEHINIANAVAMPDGGLITPVLADADAADIYTLSRSWADLVKRARAKQLSPNEYSSGTFTISNLGMYGVEAFDAVLPPGTAAILAVGGSRPVVTAGTDGRIGVEKQMTVNLTADHRIVYGAQAAGMLKGGVCFLGEEGGVGDLHALRTMGLRVGITPDVLGRSSPSPALLTSSSPKSSDNNAAQSSW

SEQ ID NO: 9264 - protein, 107 aa, Chlorella protothecoides
MPADTTQCRAVFHRATSRSTAVLQVRYMSCPLNPGSGHASECTREHAIPSKTCISSCRRVRFQGSRMPRRPGAGSSVGSGWMDMPESTPLPEDIQVFPRLKERDPYK

SEQ ID NO: 9265 - protein, 686 aa, Chlorella protothecoides
  MOD_RES (25)..(28): Any amino acid
  MOD_RES (285)..(288): Any amino acid
MQYPICLCLPIRVCHALSMSERGYXXXXHPLPAYPCTQCIVDEREGIPHPPMRPACGAGTSIGYASRIIHLASRSVEELISVGRVGRPLGAFGLPSLRWRVPVVGMSASHLDADVTIDAVLAAGGETTTSEVCSTSYKTDSHSNNAASCDPAVIWTEGVRHLLSEGLGPARFQAATRRLRVPPLTTCLRVNSARASPADLLRLLRGAAEAQGTPEAALPRLHPLIPEAILIPGSGPHSVDYSAAGARLDLLIGGVWGATGCTAPDFAWLWLQPAGHGCLHSRSDXXXXGSGVQPAVLHQTLPGSGCSLQDTAACTLAAIGYPQTLLLLHVSPHRPSCTYWDCAEGREVVIVRKAGEAVLRGADVFVPGVLATTPGLCPGDVVVVSIALERPGSERYGISRGYRLGSDPGLEASAPPRVRVGLGRCLLSRADMFRHERGVGVALVARVYRPGAPACAVPPGTAMLQNLPSLVAAAALDPAPGSRVLDMCAAPGGKTTALAGRLAAAGQGGTITALDRSHVKVAHIRRLAREAGVEALVTAYRADACRCVRGLAAGSTGAGERGATCAKGAGPAAERGPSSGPPQGDVAGARHPPESQLAAPISEGLRRRLERQALARQRHGQQPILSAHTAEVRGGLRWGAAGPAEGGPAAPHATECRSRSHACRRACADALLDARMPSLICPGQGG

SEQ ID NO: 9266 - protein, 349 aa, Chlorella protothecoides
  MOD_RES (112)..(128): Any amino acid
  MOD_RES (340)..(342): Any amino acid
MDSLGAREVAASTRLLGYEAAGAAQRLDTCRGLRAWVARATGNSATSALPDTEHAAAATPPPGMGASAPKSVGKNAGPARQPAAVPRGRNGLAIPSTEDFKVTFAAAAAGRXXXXXXXXXXXXXXXXXLAAVQSQGSQAWHEARSARLTASAFSKALGFYPGGKSRVGQTVPGLGFVSSEASCRFGVRPARPHPLTLPGVRRQLCRYLPFRSPPVTRDRETLWKEKLGLLPPFQGNDATRWGTGAEARALQSYQRNTGRCNVDAIRSVPRACPPKPAFPVLNVCGPGIRTPLSPCAHPAGQLPSDLPRSVPQGMSCRAAHLPSRRMMRCMAGWAPRPTGXXXEACISRP

SEQ ID NO: 9267 - protein, 823 aa, Chlorella protothecoides
  MOD_RES (487)..(490): Any amino acid
MRAPGWPTPQRLAPLSPTGYVVQGCAFAVKADDAVHGWLGASPDGLVEAGAGPPGLLEIKCPFNKGAPEEAWPPQHAIWYYMPQVWSTGPAHLSACKRTKSRRKTVTCQHCPPNTRPSLSPFNPFSMARLPCHTPPYPDTRTDGDHGPGVVRPVCLDSGQRRRCLPNTARPGLLGGLLRRAGGVLVGARGSRPAGTGWGEGGGAGGHGTPAAAPSHRVAESREPCHHCSSENSRLVGLEPHLGITPPAATGLQTQPTCALGGDHTWVRPPPPDPGIALAWKPWTPPGPDHGASDRAQELQWHGGGHPPPGRHHSEATGCRQGRPGGRRRPGFRQRDTIQECAASLDGSEADRACFDGAQDGTSPYMGAVVGRVANRIAKGQFELDGVTYKLNINNGPNSLHGQDEGGKMGNLRHTSAGNHPGCLAARMKGVMCGACVHVPAAAAIRQVRPAGVCQPRWGGGEANGAKELLTDGPLALPPQLPGHGDXXXXRLSTLMSLLSPPNPHPPELPGHGDCQRAVRAHRRQRAQVWHDPGSPAHHPWVGRLHGAGGWALTCGGTRKGSDRMVGAVHCMCTLGGGPRGGAGTTTPLWTRPRSQRGRLCPWRGRRLTSPPHSLWASALPRRRVRVGEGRLWAGHSVVDPVGQHTAQNMSTFTSCTVPPSPPPERAGGYDHNYVLFGLGPAAKDRVKDGAAFSVAKQAGRACSCAAAKEGRIDSSKPPDSPPPLCHCSPQPAITLVDPASGRALEVCTTAPGVQVYSGESGSPRAASASLVQGTRATTLGQSPEGRRPHRARCLVAPQTPGPSDHCPSPPPPDPQATSWTAP

SEQ ID NO: 9268 - protein, 147 aa, Chlorella protothecoides
MSRLKGFSKAGSVRISNLNIMGLSISAVSLNSLEIMTRRSTEIIVAVECLKAGQKACTADSNGNIGSGNKGKNNLGAKNVGDDNIGNSNVGTANWGDGNKGKGNRCFNKTGDRKTINDCSLLEFRKYAWVIGNPPPPTKKSPPPPAK

SEQ ID NO: 9269 - protein, 90 aa, Chlorella protothecoides
MSLAARRAAVLPHDPDLAFCYSMLNKQLPEQLRDAVCVFYLVLRALDTVEDDMAIDQAEKVPILLSFHEKTYEKCAWQAALLGGAAAGGA

SEQ ID NO: 9270 - protein, 134 aa, Chlorella protothecoides
MLGLQLNSPGPLAHELGLHPLSPDVGLESEEFASLHELSNGMGLFLQKTNIIRDYLVSRGWTGGAQAPGLRPVEAGPGGGLEGPQPNGEDIMEEPAPRMFWPKEIWGKHGDSLEDFKDPENAEAAVACLNDMVQ

SEQ ID NO: 9271 - protein, 119 aa, Chlorella protothecoides
MKCGHGHYVELMEQYPVVCAAFQGLEPQYQEVITDICRRMGAGMAEFIVKEVGLAALRWGKERNAFRKGKPPGPGIPPHLPWHPGTLAPGGDSRGLRPLLPLCRRAGGRRSVQPLCRLR

SEQ ID NO: 9272 - protein, 472 aa, Chlorella protothecoides
  MOD_RES (59)..(61): Any amino acid
  MOD_RES (212)..(215): Any amino acid
  MOD_RES (366)..(369): Any amino acid
  MOD_RES (395)..(398): Any amino acid
MQYVYFDPGPSDTISMGKCTVPVASPRRRRHAKHDRDGLGGLLSSASPAIPCCGLCSPXXXFMMSSLLSAASCRPLPQPFRAAVSARQRPSGRSVALHPTQANVANSNTTDGDWVEIGKLTIPHGVHGDMRVSPSTDFPDDRLGTPGIRWLAPPETKMRRAVGAPQEVTLERGREVLYKVMRGGSQRFSFFFNLLSCQQRIVVPCHPITSDXXXXYKGNPCWLVKLQGYDSPEAVDELRGHRLLVPSSERPPLEDEDEFYVQDLVGLRVLMHADGSPAGTVTDIFDGTGSELLRLSSAPLQSPCSHVYRVSPLQNHTPAGTHDVLQIEVPGRPTYMLPFARELVPVVDLAAGVMRIEPPEGLLDLXXXXLHLSKAPAPISIMSALYQIIPPQGPXXXXPCRGLTPTRTGPARAGPARVERVKPRRAGGGAGAKEREAWPRPPQPCWQGLQRAASAQLDCFFASAGVLSLALL

SEQ ID NO: 9273 - protein, 285 aa, Chlorella protothecoides
  MOD_RES (99)..(120): Any amino acid
  MOD_RES (139)..(142): Any amino acid
MTSEVAAGPRRAPLRVIVREGSSIVRHLDCKVDPGKTNKPQNLTVSVAGIPADLTEGGLLELFGRFGEVQRIALHGTRTSAAVLYTSVDGPRKIWKQRXXXXXXXXXXXXXXXXXXXXXXAFNGMDTVHAFAGWRSTRXXXXNEEPIMLHQALPETPFGLKGWVEEHKAGRPGNAKLQAQLDAWTEAFEAAEEAKAAAARAAAQADDGWTLVQRHKGRKKGVDEAGVVGGGVAARAASSAARRANAEVHANFYRSQLRASRQSGKCVDWYPDCGLEHTAYRVAEC

SEQ ID NO: 9274 - protein, 346 aa, Chlorella protothecoides
  MOD_RES (294)..(297): Any amino acid
MGRLHTPDSSVLQGRTSRSHMQTFDMIYVASSAASLLRGGQGSVTPGPATSAHAPQLTSLRRYARFCDFTPFLPHGRCQQRGGRAPRAESVSLVSDRDPLYLDDAIVPQADQEELLSKYQFFPMVRAGDGRAGGGSSCLPGLVIHAWHPWQGGGIMDHMPLCPGTPTTSCLTHNHKSWSLQDSYVFQVPKDEEGRLDLAGTVMLHRGTGEKGSPEVLGRLPEAPTRFRDLPWDSEFLGNKLEKQAPQTWVWATYLVGFAARDAPGLDLGCVYRLDGMRGRIEQCRVQRFAAPDXXXXRYCAWGGSRPLTGVPARTRGALPLPAMPLALLGAHTLPAPLHPSAGTGR

SEQ ID NO: 9275 - protein, 212 aa, Chlorella protothecoides
  MOD_RES (98)..(101): Any amino acid
MGTLFCLDGCQDWGPELLALLPTRPPSGETTNAEPHSGRQGNRRGLHLLRDGQGTIYGEPVLDLPFKTRGQHGSSVHLSHSLAAVLDSGIHSPRHAIXXXXFQDAGAAWEQRASVTFSGSVIDTAVGKAGDALRINGVTLSISSDAKKEAMAQARRAAVADALATAQLLASAAGVKLGAPVSIVDSNNGFPDAGNVTSCGEREWVQRLSSVG

SEQ ID NO: 9276 - protein, 192 aa, Chlorella protothecoides
MMHISHGCFADQQPQFRRHLRPCDREHFSAWHNHIEIDAAGAACMTENDHPHPRTFRLHRLALGQESIAGTQDALTVLSTRLNGLETQAELFPQQFWVDQQYLAGASPSSISFRLVAATMSSRMPVAASVCIVLMTLQSMNGMTLPKLDISGQLVFDQLLHLATFSDDLNPAVTRILFTGGVWRHRLFDLDV

SEQ ID NO: 9277 - protein, 347 aa, Chlorella protothecoides
  MOD_RES (318)..(321): Any amino acid
MFTTVQFTWEDGHEPRQVLARHARTSDSHPRVAGLHAFRVYRIHKTWRRLYISTLPRLSMHLAEEGLVALHSSVPMGIPGIFLVQPLAQQEAFFLASGVASVTLIAVPLLGACTMRVRVGGRGSVPGCISQATSEGQHQRVVGLQAERVVGGQVVGWGSLLPTLPHASPKKPLLPPSPHPTHLHRVLRGQCLLGDDVVDLGEDALEGLLHVGGLQGGGLDEGQVLALAEGLGILRLDGAQVPQIALVPHQHDHNVGVGVVAQLLEPPLHILKGHCILGRARGELGGCPCVQGVHAAGPLNGRRCSMAWRRGAAPPCSXXXXRRPIKWTPLQSGAATWGRPTMLQAMH

SEQ ID NO: 9278 - protein, 243 aa, Chlorella protothecoides
MLPPALPFLGPLPPLATHAQGLTVVQNKGHNDHVNAVEYADDTGNLIYTGGDDKYVKVGTRAGVGMETEGGWLPGDGWAGLMSAPTRWSPHSPTAGHALPPPLYILQVWDRRMLRARARTKPVGVFIGHTDGVTHVDSKGLPPSPAAVSLGRVLLAQTLLTCVPSQGDGRFLISNSKDQSIKVWDARRMSPSSEVVTAERGGVPTFQWDYRWVDEMVGGSGWVGGCVHGWRGEAGNLRPQSLV

SEQ ID NO: 9279 - protein, 96 aa, Chlorella protothecoides
MLVGNKSDLRHLRSVQTEDAKSFCERENLSFIETSALEATNVEQAFQRILTEIYHIVSKKALAAEDAVQAPSSGTAIKVTEATPEAKKKASCCASG

SEQ ID NO: 9280 - protein, 73 aa, Chlorella protothecoides
MRSQKQTELLRAAVRVLAMVEVEVELQEGSALEARSSGIEEELTRLDEIDRLQQGWWERSAAEDEVEKLLQTS

SEQ ID NO: 9281 - protein, 193 aa, Chlorella protothecoides
MEAFLGLAHFRLPDTMRLIPPLLSSHPPSPSIAQTLLKGSEKLMSIAREREAASLPVAAAPPRGAQRDRAAAGASPAAATAAQEQKQALLATENALVFNEALIEERDAAVRAIGGQIGEVHQIFQDLAVLVSDQGAALDDIEANISRAAAHTGEANVQLVQAERSQRAARGSWCVLLAAAAAILLVLILIIAA

SEQ ID NO: 9282 - protein, 113 aa, Chlorella protothecoides
MTEAGLIVREDTIGNVYGVLEGSDPTAPAVGTGSHCDAIPLAGAFDGTLGALRRAVGFLGAGEPPRGWGADQGGGMGLKLATPSSKLSPGTRCGTAECTLPRPAQVLCQTAPA

SEQ ID NO: 9283 - protein, 166 aa, Chlorella protothecoides
MRALESVRDQVASGFSSLKGSPRSAEGRRAFRADTRGRYTHVGVLMIRPHQLLPWPHRDLFIIFVLKVLESYNYFSLSRIFVLYLTENFGVDDLTAGTLYGLWGTLLVLYGFILGGAIDFLGEARPGREQQMVMGWGSRVVRDGGPGASLATAVPEERLSTRPVLV

SEQ ID NO: 9284 - protein, 309 aa, Chlorella protothecoides
MFTSEEPTRFGLSCSGSRAMAGALEGDYLATLRDVNGSSYLEAARGAGYGAASLDAMLAGARRTRADLGAFLELHIEQGPALEAEGLQVGLVTAIAAPAALAVRFSGDGGHAGAHLMHLRNDASLAAAEFALAVERIVLATGSEDTVGTVGRWEVSPNAVNSVPREAALEVDVRDVDADRRDGVVAEVLAEAARIAEARRVRLETRVVSQDPPAASGEAPLAALAAAVEHLGLTSRRMVSRAYHDSLFMAQVGRGVGGKGRLCLSAKSEGAPGTGRALCGCHRGERRGRRSCQCTLIWGLASRCHTWYA

SEQ ID NO: 9285 - protein, 369 aa, Chlorella protothecoides
MTVEQPAAKMLVELAKSQDVVAGDGTTSVTVLAGALLKKSLELLERGVHPTIISDAFNLAVGRALGFLEAAALPVAAGDRDALVRAANTSLSSKVVHQYSSLLSPMAADCILAVSDPARPEATDLRDVRLVTKVGGTIDDSEMVDGLVLDQRAAKAASGPTRIENAKIALIQIFKALHQCEEAGLGAPGGGAMRGLPPGCTATHCCALPKFPIPSLTHRPMYHVTVPSLPPQVRHREQCHHQRLCTDGPHPEGEPAQTDHEWVCLLAQSCPAYQRACSSRSFSAVVPHFPPMGSHTHPPTPSPLTSHEQEERNYILQLVKKIRASGANVLLIQKSILRDAVTDLSLHYLVRVWGHVMAVEMCRCMRRAG

SEQ ID NO: 9286 - protein, 241 aa, Chlorella protothecoides
MQQDAGLLAHCARGPHARRQACQRGPGGGGARRLRPRGQGDGNRGARSDRHRAPPRLQLAGAGGGGALPARRALRRALPGPEAVPHRRRRVAGDRAGRQVGPVGQDPGGVYCWLRDISWCSLHCPGILGRRLVVRLGIEVKIEGGGCARGTVSSCALAVTRVQYPSAMTPPSNTTPLQGMESVCVRAFAEALEIIPGTLAENAGMNPIEVVTELRRLHAAGHQHHGDLMLFSAHEADGWLD

SEQ ID NO: 9287 - protein, 732 aa, Chlorella protothecoides
  MOD_RES (349)..(352): Any amino acid
MLRNTSSGALPTAFRPRGPFSSHSGDGKGSSCRDSGLHWITAYSGMYTLYTVSASPAHSPTLDPVTYVNAEAVVREFHEALARSSDMAVAVAAITALTSVIRSSSASTVMGLEKELKDAANALQRWGSWEVNVRAFDLCATCHASQSPEWVHVLTRCNDTAISLKAGCDLFLRYTTRTSALELDNFAMVKKKLIERGRHFAGELPVVVFTAPKWVSSVFDCGPAPNLFADTSKRARAAIAEQGQRFIRSGFTVLCHGYSRVALAVLRKAVAAEGRSSGEGMPLCGLGALLDLAGCCSTEISIRWHLEEASPGVLRLRPASPSNHAGHPIQCDRDRGPPGRDRDHNRTRXXXXPPLPTTQGTQFNVIVTEGRPDETGITTARALKDSGVPTSLVLDSGVGYVMEKCVVCEDFAVMLGPWPGSWEEGPRWSCWIPCSWLGLPAGRLLLCRDPPVPSPSFPFLPPLPLPCSLSYPTIILPHPSFPTFLLLARVDMVLVGAEAVVENGGVINKLGTYQIAIAARAHSVPLYVAAESYKFARLYPLSQRALPLERKQIDFGPLLPPQVAVDNPSRDFTPPAYISLLFTDLGVLTPAAVPRSSGGGRCERPCRVPHCAAMQDATVQMEWRLRPSESLAEGCRRPWRWCPDPFPCWFNLPHADSSTPCHCHPAALYKKRRKQPARGLSDGHNVVDLEDHAHALRGQGKRRGGHQQGLHHLLLQHVRHQPLAHIDAWEGG

SEQ ID NO: 9288 - protein, 254 aa, Chlorella protothecoides
  MOD_RES (187)..(190): Any amino acid
MLNRWRSERWPATRRRGLTSSRPSTCWTTSSTPCASPTWPSSTASPLAAGPGFRCTAPSAWPRRVRQAMAIPATAPHPTSRHCTPYRTLFAMPECAIGLYPDVGGSFYLPRLPGGTGLYMALSGARLKVHRAWAWGALLWGRDRSLVACLGLHDGFRRGWVPPNRKTAGDQSSLTSFSTPPQGADVXXXXGRGSGCEACHAGHTLPPLCAAAGAGSGHPGAGAWGLQAEHRRAAGQLPGSHTSSSRGAGRPEVS

SEQ ID NO: 9289 - protein, 615 aa, Chlorella protothecoides
  MOD_RES (236)..(238): Any amino acid
MPVLGHSHLCLTHIRRAFATCSSRPLRVPSAASRRSPKSTWVSMGGAVETAAANPPSESIARKLVGAKGFQRHNPLTDKFPIHRFHHFEFYCGDATNTSRRIPSTPPRSHRFGLGLGLSQVAKSDQGTGNQKFASYVMRSNQLIFTFTAPYNGAGGEASGPDAGSPVPWYDVDAAHSFNRNHGLGVRAVGASAAVVGFGAVSWGELMVGCTSSGRRDELQSFCRSTLAHVRPGVTXXXICVILLGPQPGVRMFARPLLGPLILALSISRACVQSSSKVSRYAFQAPSHSYSPPPSHPHSLPPFLGIVVEDAAEAFRISTANGGIPVQPPTRLADARGSLTVSEIVLYGDVVLRFLSGDYSGSYLPGYEEEARPSPRCFGIRRADHAVGNVPDLGAQVDYLTRALGLHDFAEFTAEDVGTIDSGLNSMVLASNNEMVLLPVNEPTRGTRRKSQIQTFLEQNGGPGLQHLALKTDDVFATLRAMRAVGDAGGFEFMPRPSDAYYRDLPSKVGDALTPEQLSEAEELGLLVDRDDQGVLLQIFTKPLGDRPTVFVEIIQRLCHIQPSEETLRAACATAQACPLAANPDEVGGCGGFGKGNFSELFKSIEVYETDLGIN

SEQ ID NO: 9290 - protein, 220 aa, Chlorella protothecoides
  MOD_RES (73)..(76): Any amino acid
MGAGGACNAGDVMGSPCQLQPRRHILSIQCLSHTLLTRSRRQERHLCASERYLPAQYLAIKAAVLEVQESRGXXXXAGAVPRHQGFRPGGPRKAWCCNPGGRHRAPLQAGGLGVGGSPGSALPALGDLHAPCMLLCKYPAVADPLWPGTKPISDSSTCYQSQRPPHVPVPRALSAGGCAAHATPIRFLQRAGLDLITGYVAIVLMIQLSPKPQLFTVPTD

SEQ ID NO: 9291 - protein, 423 aa, Chlorella protothecoides
  MOD_RES (146)..(149): Any amino acid
MHPAQTSTTTLAPPTHKTHLEQDAQLGLGGGGDDVGEHALLLDDDLEDVRHHATRVPQGVLLLHVVLHQLLVLCVVKGGPQVAGGEDLALLCGALLYQVTDSEKFTPPVSEGARLIPGSILSRRLTWCLPGEPVPPIISLHPMQYXXXXPVSEGARLILTPRAPPPPPQTLGLTNAFRLLDVQPLAVVLQQELLAAGRLSQGDAVDGAGAVDAHARRRLLPAGDVLQLVPGPHPKDGAHGEVGVHDGGAIQGIKGHGEALTTHIQGLGVLLRAGVLAGVGVAQRLEQQLVRQQVHRQLLVAKGVDAGGAAARRGAHLGWGGEGSGASSVQRAALQTATLRASMKTSHAQHESSVSALKTRHAFPGLNTPTPCTPPGSHPAARGREWMLPAPSIDTIQRAAHPSAQHMCCQVLPHTITPNPPPM

SEQ ID NO: 9292 - protein, 329 aa, Chlorella protothecoides
MSSKDPKVNSYLEFKDEVLPRIRCVPGTEPKAVLQALGGGLAGLAVASSSTLDHEEEALGGALAGLAVASCSTLDHEEGVPAPPVLELSIPCTLGIHSFPLHLHPPLPLHPQTRSLGYNAIQIMAIQEHAYYGSFGYHVTNFFGVSSRSGTPDELKAMIDEAHRLGLVVLMDIVHSHASKNTQDGINMFDGTDGMYFHGGGRGFHWMWDSRCFNYGNWETMRFLLSNSRWWMDEYKFDGYRFDGVTSMMYHHHGLQVAFTGNYDEYFGMATDVDAVVYLMLVNNTLHDLFPTAITIGEDALAGGRRRVRLPPQHGHRRQVDRGGGGVRE

SEQ ID NO: 9293 - protein, 191 aa, Chlorella protothecoides
MGLASPPRSPRGTLSVLSSTPSHVPSLLGAGERWGSPDRDAPGDTLSRAASPDCASPRPMSPDGFGSGVYSSVFMDTGVEGLLGYSAPQGVEAQVGARRGRDDHATPAPGPRRRASTSTDSGGREGAQAWLERTPASPGASGTSPDPASALSPPNSPRRRQTTFGATLDFIDALCTASSGLTAFPREGVGS

SEQ ID NO: 9294 - protein, 246 aa, Chlorella protothecoides
MAPQLKLAGTRGVAMPVAPVARPRAVPCSVKHCGRGAVSGAGMDPTSDSPHCPGPTTSPSVRRSPTRLPLCAGECHSRESAISHRRREARECGTQAVHQQDRGLRCAWGSWGRVDAGPATCSISSIDCVRSTYKPSTSFIPVSFIHGAVKKLSGKLSDAGVEVPPLSTATVGSTRTNGSNGGATAAKTSNPEPQDPEDFWSPVKHVPDGVAFQVWREWRGLGWVGENGCSGELKTSHRAHFVALLE

SEQ ID NO: 9295 - protein, 195 aa, Chlorella protothecoides
MLEEKVVQPLLVTSSALSLATECVRMILKIDDIVPRSCQSPSISARSTPPGSSTVQLDELVGDRRGREHAQVGEKEGDVGRRREVARGVVHRHLGRQQWAKVDLLALQGQGALTQRVQARELVRLGRHVKRDRVRPRCDRNLVGAQLVDHAAVLHHCLGAHQHHVHPGKEEESGEAGMGEYDCGIGEGAGKRKWG

SEQ ID NO: 9296 - protein, 137 aa, Chlorella protothecoides
MLLAFNKVDVARHDFAVEWMQDFEIFHEALASDTTYAASLSSFTSAPLASPSTAHLHSILPSHLELAIRSMSLVLEKFYENLKAVGVSAITGEGMDDFMAAVAECRKEYEAGYLPELNRRKAVSRGRGEPLDIAGLV

SEQ ID NO: 9297 - protein, 117 aa, Chlorella protothecoides
MKEYSLGPNGAILTSLNLFATRFDQVIDLCTKPRDPPLDFVVADTPGQIEIFTWSASGAIITEAFATVLPTAVVFVVDTPRCTAPQTFMSNMLQVSGPWWFHGQRLGISHVRHTSGA

SEQ ID NO: 9298 - protein, 124 aa, Chlorella protothecoides
MRRPVEASHTPITPQAYGFVAAEHQWVSRKDEGDKVIVVERGDLIFVFNFHPVSSFTDYKVGAYKPGPYKEGNYDNRPHSMKVYAPSRTVVVYAPADTTDAKADSKPEGIPGLGVKGVGPYFAV

SEQ ID NO: 9299 - protein, 267 aa, Chlorella protothecoides
MEHGQPHTHHDQPALRRALRGELAGAGAGGLFGLKLVASPEAAPSSILRPPTSSVPLALAQGYAESHDQALVGDKTIAFWLMDKDMYERMSLSGPRPAALWPCLLHTKAPRSDAATPGLCIGHLPPLRQRSHLDTSPHKSHPPTPNPTSSGAVDRGIALHKMIRLITMCLGGESYLNFMGNEFGHPEWIDFPRDDTYDTSTGAFVPGNGGSLDKCRRRWDLADDPSLRYKFMAAFDRAMNHLDKVCAGWLPFLTAFVLGGWGRRRLR

SEQ ID NO: 9300 - protein, 319 aa, Chlorella protothecoides
MHSHPQTLSSSPFCQADEEILLVEGVELYGLGNWEAVGEHVGRDPGEARAHYMSVYVETACFPDPQPSPAMAGVDIQALIDAHRSTTLNKMASARIALASPAATPRVKSESTPGAAAWDAANGGAMGPGHSVAPENLAAALLAANPEPRHAPGDGAAGATASGRPSPGSTLSTAAGHALAGRSPHAPAPHDLAQPQRAADSRAPSSAERAPLESVRKLEPEANILQDPLGAGVAGTPAAASPAEIGAKVWRVVFLRRLRRGGPTGTRPGEAAAPAHPAPVQGHAFTWDALLPKPVLRPRLTGSAGGGSADGVQPEAKRV

SEQ ID NO: 9301 - protein, 162 aa, Chlorella protothecoides
MSTPGQVLDVRFETVRKETIEQLRTLNRVIFPLNYSDRVYADILACGPVSQLAFDRDGEMVGAIACRLENTSEGPVLYILTLGVLAPYRRLGVGARLLGNVLGIVTRDLPEVVAAVLHVQVGNGAALDLYRHAGFSVGPVVPGYYPRLNPPDAVLLRKQLRD

SEQ ID NO: 9302 - protein, 180 aa, Chlorella protothecoides
MEFREEDSEEVVAQKLELIAIYNRRLDERDQRRAFILDRGLLNVKRQAGPLMSSVSAPTPTANASCCPHKAWSPVPQAVDRRRSAAERAMAGQLRAFARYLPQAQYEALADGMLVGAGAEWRGGRVASAGGAGHEAAARSPARWIAASSWAVEDSGLVAACFPLPMPSLPPQSHPSILAG

SEQ ID NO: 9303 - protein, 102 aa, Chlorella protothecoides
MTSPDEALQRLTLNDDTAAPSTLGETAPTVLLIIGSGKTTFVQRLASHISATGKTGYLLNLDPAVAKVPYNSNVDIRDTVRDGSREQGHRFRAIPELCCMPL

SEQ ID NO: 9304 - protein, 345 aa, Chlorella protothecoides
MQLFVRLNDHEHVVNACPRSDSKEVISLLCATSNPGPSYEGLVVRHNGRSLETSLEEAGVKPWDVLEILPRLLGGGGDGGATGAESRSCYLEMYLGRKPDKVNPEEERLARWTTCHLSGEPLSRPIVADELGNLFNKEALLQALLSKSLPTGLKHIQGLKHVVELKLEEAGSKDGSAHFVCPVTGLDFNGKARFLIHFKTGLVVSERGWKEVPKVVEELAASPCTPESWIPVNPTGEEAAALVSALAARREAQRASKKEKRAVGVAASNGGTGETAAEPGSKRAGPPTATLPAALAPKKSKVSELAPANANKKIWNSIFTHASGLGPAADGYMLRGTASRGMKMA

SEQ ID NO: 9305 - protein, 92 aa, Chlorella protothecoides
MDSARVQEETNDAKNAVEAYIYGLRNALRGSHAAFETEARVTSILAALEDAENWLYEEGEEESRGVYVAKLAELRALGEGAERRAREAAEAP

SEQ ID NO: 9306 - protein, 129 aa, Chlorella protothecoides
MMHLRGMAVAPDMQRAVHHLGVAARRGHILAGYDLAMLHLGGHTGSRAACPDAVALLKEVAERGWPTLQEAHEEWLRGEPEWALLNYLKAAEMGYEAGQSNAAWMLARGHGGVADAGAADAAALALHRR

SEQ ID NO: 9307 - protein, 332 aa, Chlorella protothecoides
ALRLAGATGGGGAHPRHDPGQEVLHYQWFADFGHVEAARAVALALARGGDDDMVRAVGYLRQSAEAGDAEAQAHLGHAYAGGVGVARDNATAAHWGGGCGWAASRGEEGEIDVAVGVPQGVVASGKSQRKAQPAAKECSSKRVRAGLAGHVHHHHPPLGRKSLHTLPHQKAGHPSGYFGLGYMHLEGSVEGASLQRAFSYFRQAADAGGMVGQWPGHADAHFFLGERIKLYQKGVVSVKEFKSIVLTTPPQQRGCRGWPWNPGSAFLLCLNSSSLPAGFEPARVSPMDAARITEWREAVFVPYDFAFCVCGMAWSIYEILPWKRDGATPTTP

SEQ ID NO: 9308 - protein, 152 aa, Chlorella protothecoides
MPAAHTASAMPSMAQGFSSLPMPRPMRASAGNARPLQSRSHRRCRATPPRVTASGQNVLLLGSGGREHALAWKLAQSPDCGRLFVAPGNAGTALEPNMTTVSGLNPSNHKQVGARETGEKKERAERSMTSVQDVAGCSCCGFTCRPPLPVIE

SEQ ID NO: 9309 - protein, 317 aa, Chlorella protothecoides
MPDCSGTSVRPALRAVGSLDAHRVHTQAVLRLHINTWTLVTPAPLRHNGQRRMDRQALEYTREHYNKHSNQYGSTQEALAARASGPGAPLKKFHNYIKRHLINRHAGSRPGDDDLGLCMNDRMSQGHTLFALCRFAKGAPRLLDLACGRGGDIWKWIDAGIPCVKGIDLSPHEIEEARARWEGKELCLVIPSRVLASRLASRLIDRDAWLCLCLWLNRTLMRCRESCSMPRFSEAQARKSELSLDYSFEASPELGLSEWKESERYDAVTCMFAVHYFFVAEKALKQVGECFWSWGAGSPIDLWPRPHGLPGGGVPKC

SEQ ID NO: 9310 - protein, 230 aa, Chlorella protothecoides
MGDDEPAMLAASKVWSPCRVPCSTAQCLMSAKREHSALLAGSFLDDTQAVLMPSEDLPSDSVLIRGFEFGKEACTLDALMSSMLSTGLQASALGQAIVEVNRMVRKRDGDLRMLVVGDVEFDSQGAEGLDWRLSDEHVLDTDAVVEPAERASVRAKLFLGYTSNLVSAGVREHIKFLVQHKLVDVLVTTAGGIEEDFIKVGLLSYEPAGLGRSCVALGTPNLLFHSSGKA

SEQ ID NO: 9311 - protein, 282 aa, Chlorella protothecoides
MGKGSAQYGGVLWRRKPWGNGIMPTHNLQALTAAGLSPRRGRRHHSTPVRRLHGARPGLQHLRHGPLPGAALPRRVHRPAEPEDAGTARGRAHGGPTPQHDVPGGPGPGGFGVPRHARHRGGHPLHLPEQGSGEGAGQGRRRGHPPVLPPHRRLPGGCHQRRLLPETYLLVRVLCFCGGVETTLPGREELQFNIPGGRLVACSPHTPTPPRSLEEEQEFKEFAAQPGAMDRIFARIAPNVSECMARGAAGWVGARAPCLYMVMLYGHRGIRRQAVSAPQAAC

SEQ ID NO: 9312 - protein, 455 aa, Chlorella protothecoides
  MOD_RES (292)..(295): Any amino acid
  MOD_RES (442)..(445): Any amino acid
MATRRLICSSTRCTSARCSSLKTRVSMSPDLTASMVEALNSSSAARTWVSPATACSPILASASDTRTMASSWRTVMGMAGTSAPSALAARCASPRRSTYSLASRRAAESVMRGEHEARTYSMYRFRNSSSLCVDTLEEGGGRLGPGERVGSRAPPTPAPHPPRALKPLLPPPTSLPQTHPDLLLIHLRAPARGAVHAQNVLRDHLVARHGALVLDDEDEVEAGEDGGLQVDVLLRRLHVVIPARRRVGRRQHAGPAAQHGGDPGLGNGDGLLLHGLVDGHAVLGPHLVKLVXXXXCCSMASWMATRPDDAGRQPRGRGALAGGVHGDGRGLGGKLEELGLGSAGVAQEQDIDIAAAIGAVGHALARAAEEQGRDGALDVGVPEDLRRLRQLVVLTWPGAGSHGVRTKSPCTDRERARPPTLPRPSPRIHSRWARCARRCGPXXXXRSAAFEVQVI

SEQ ID NO: 9313 - protein, 220 aa, Chlorella protothecoides
MQGRPFRGVLFAGFMIEGSQVKLLEHNVRFGDPECQSLMVRLRSDLLSTLHSVIQGEPITLDWDPRPRAVGRGRELLRVRWKGARPRRRAWGQEVRWSGTPLLHDRTQLPQSHDCQHRPAPSILPPLRPSLTVVMAAKGYPGSYRKDQPITGLDGVTGAKVFHAGTRLLEDRRVVGAQGCRCRGGRYQQSGVGVCQGLVPGWDDGMAMDDLCMLPWDASG

SEQ ID NO: 9314 - protein, 291 aa, Chlorella protothecoides
MRPEDRVAIHEAMEQQTISIAKAGITTMLRSRTSVLAAANPPSGRYDDMKSAQENIDLQSTILSRFDLIFIVKDERSMARDKMIAQHVLGVHRAAGGRPEVDEEEVRGFERTRRMGSGGGGCTAAHPLACLPLRLHQPSHDPAHLHPPSSFPCRYIEYVRASCSPRITDSAARLLANEYVDLRGEAQRAASAEGADVPAIPITVRQLEAIVRVSEALAKMGLQAVAGETHVRAALELFKASTMDAVKSGLMDTLVFSEEQRAEVHRVEEQIKRRVAIGSFVSERKLLDELS

SEQ ID NO: 9315 - protein, 389 aa, Chlorella protothecoides
MRKLQAGKLSKGDRLAPADHASIAYAPFRRNFYREPEALARLGEEEVARMRAELDGVRVRGRGAPRPLANWHQAGLSGRLYELLRRDGFEAPLPIQAQALPAIMSGRDTIGIAKTGSGKTLAYVLPLLRHVKDQPPLALGDGPIALVMAPTRELVSQITREVRRFGKPLGVRATAVYGGSGVANQISELKRGSEAVVCTPGRMIDILVTSGGKITNLRRVTYLVLDEADRMFDMGFEPQIARIVNNIRPDRQTVMFSATFPRQVEGLARALLADPVEIQVGGRSVVNADIAQFVELRAEEDRLWRLLELLGEWYERGKLLVFVASQERCDNLFRDLLRHGYPCLSLHGGKDQSDRESTISDFNQHHVIPSPPHAHPTHTPPQWRRGAWT

SEQ ID NO: 9316 - protein, 447 aa, Chlorella protothecoides
GLDQVVLGRGELEARPAEPGAVQLGGARPALGLEGLGQGGEVGGHRCPRLAQRTHHVRRVLLLLRRDEGDGGARAPCAPRAPHAVHVVLQVVGHIVVDHQHQVLHVQAPRRHWGGGEAGVAVAQEVAEEVVAPLLAGDEDEELAALVPLAQQLQQAPEAVLLGPQLHELRDVGVDHRPPPHLDLHGVGQQRAGQALHLAWEGGREHDGLAVGADVVHDARDLGFEPHVEHAVRLVQHQVGHAAQVCDLAAAGHQDVDHAPGRAHHGLGPTLQLRDLVGHAGTAVHRRGAHAQGLAEAPHLARDLGHQLPRGRHDQRDRAVAQRQRRLVLDMAQQGQHVGQRLARPGLGDADGVPPRHDGGQGLGLDGQRCLEPVAPQQLVQPPAQPRLVPVGQRPRRAAAPHPHAVQLGAHARHLLLAQPRQGLRLAVEVAAEGRVGDGRMVRGRQA

SEQ ID NO: 9317 - protein, 46 aa, Chlorella protothecoides
MDWDELEKEAAREDKAHHHSEDEDDERPRKRKGEGGAAAGSKRGRH

SEQ ID NO: 9318 - protein, 336 aa, Chlorella protothecoides
MTEGVETPAEFAVGCSVRLRVEGNQELSGEIFAVDPTYKVVVLKTLGADADLPDIAILNMDSVTEIVEATPRKTAPSEDSDQLPEVDPKRGIQREARAVRLAQQDAQRIGVGVSRRGQAVYDAISKTLPCHWDSKTIVVLDEVAISEPYEVSSCRNLHDSDSPLLERVRLVVSGAGLQQGGGLVYGLRMQLLSQPVWWYDDEAGARPMTSVHGCQVSSRRAMLHVLLMPLVPPAPFATPRMAPHCSLLHPLEVLHGYTVAAPASADGCNPTPSLCMGGDSCRAFGPTHSSLLSAGGAGRVPGSGGRQAPRHVSSVSPEDHAPRQPPHLVRSSHRGH

SEQ ID NO: 9319 - protein, 268 aa, Chlorella protothecoides
MCVVLSEVSTFSASWAGLQETASIVSCHDEDRVTAMSPGLQWIQASTCSIRPLGHCPSNVFRCFRLPIYRRGVAWRLPARQEGLQPSVVWPEIPLSRLDDDGAGGDGDESEFERRTALGIYQTQEEIDEDEPERQRWHRQLAILARSGKYNKAAEVLDEMLRNGLTPGPRACHALLVAHASAGDAQGACLALELMQLAGGSGRRQWCGAGRAWAEAGGIEWNGRTCVLTPSPRHASSRCRPNAPAREPLPCHSALRRGGGAGPRRRGL

SEQ ID NO: 9320 - protein, 347 aa, Chlorella protothecoides
MVEHLQSVFSRVVSELTFAGVQPNKKLISYLVAGHLHFKDCRAAWKEFEKLVLFRKPYLKHLDDEQISELLNMLSASVKSQEMLFVMTLMLDEGRVLTGADFGKDNQGRSVCTSWLQQRIQNLKTFGEGRVDGRVHQHNDLAKEMKCAEALHSAQDAPHILLKVCNLIPTTCPVSLCSSGVESEAAGKEWLIGDGVIIDVANDSVVDKEGNMIDIAAMNVRELKAELLQRKLQVSGSKTVLVKRLEKARRGGFDGAQKAPAAEPEKILILEGQEFWRNGKLVEVTVRQAEADDADADEEDDDFLPDATERDIDDVSVGAPGAAYWVPQWGCINNTTFRQGCLVARGG

SEQ ID NO: 9321 - protein, 84 aa, Chlorella protothecoides
MKSTTLYVGRIAPSVEDSVLRELLEACGEVWKPTLDPDTSKFKGFGFCTYAEPEGVSIAIRVLNNLNVDGQQLIAKTNKVLRRG

SEQ ID NO: 9322 - protein, 489 aa, Chlorella protothecoides
MSRDQTQGTVCLPRGAPCQGPGDCSPSSLPLSPLRSRLYFGESNVDGMLDTLLPLHEMMKENGPSTLQEIAFVQVQSSGMGLGRVHGGGDGWVACWRWSSGVLHSPVPLQPLPATDTRAPSAASSPPPKLPHCTSQQAYGRELDEAYEWCLKFKQSRREAELHQAWDLYYHVFRKINKQLPSLSVLELQYVAPALVRAKGVGGRRAFRSEEKQSSPACLPSCALGVPVSLPGVPAAVCRDRAHPLSSSPPLTKNLELAVPGTYIVGEAMVTIGSFRSQLHVITSKQRPRKLTILGSDGAEYMFLLKGHEDLRQDERVMQLFGLVNNMLANDRVTAERDLSIARYAVIPLSPNSGLIGWVPNTDTLHSLIREYRDARKIPLNVEHRLMLGMAPDYDHLTVIQKVEVFEHSLNSTSGEDLHKVLWLKSRSSEAWLDKRTNYTRSTAVMSMVGYILGLGDRHPSNLMLDRYSGGWGVWGGVGPGEGGLGKQG

SEQ ID NO: 9323 - protein, 176 aa, Chlorella protothecoides
MRRRRRPTLSPGQPSLHARREWERSALFMVACRPNHAVAGVWEIPISRSSDHLPAPKCLPYERTPWPSTAPWHRREPVKTVGVREPDDFVSEQVTEQMQALLEEKARLARENARLLLENAGLKHWASSSSPPGGELSDLEQCPLLGLIIPNWPSGVHHQLHAWAAGAAGVHPCSPD

SEQ ID NO: 9324 - protein, 113 aa, Chlorella protothecoides
METHRRVQSPLSPRLQATQEYLDWVEREKQHQRATPGAAAAAGGEGTPDPTALENAALEKVMGILSQRAPQQLAEQPEPGEAVAAASDFLAGLQSTSTPTAQQEPPGCVVSYG

SEQ ID NO: 9325 - protein, 374 aa, Chlorella protothecoides
MLKTPASPSAGKLLHIDFGDCFEASMQREKFPERVPFRLTRMMIKAFEISGIEGNFRCVEAEVETERAPRAPARSVCGPCAGSTPGRRARDLPAAAAPSPAQTITDPHPQNRATCNEVLRVLRSEKDSVMAMLEAFVHDPLINWRLLNANDGAAFEAAAAPDGELPPSPPMRESSRQEALASVPGDAAEALNERAVVVMKRLSEKLTGRDSGQDDRDADTVSQQVQRLIAQATSAENLSRSERHRGKEGGGRSAGNRGGHGDGCQILEPVTLGTHSAAQPSGVTVPSARHAGSPGLCAGPARSWQHILLAGGLERGHAQAGGQRLAQLLPLLGQRHALDDGVEVGRVVAEVGGGQLRRQAVHHDGPHHVLAERA

SEQ ID NO: 9326 - protein, 284 aa, Chlorella protothecoides
MITVNFPHNPTGFLPSHEEWARVVAAASGVGAYLFADEMYRGLEAEAADRLVPAADAYERGISLGGLSKSVGLPGLRIGWLACRDPEGEALSWWCGRGLGPGTTCRRQGWEAEPSPLPSRTQTGAVHAHPRILHPRTPRPVIKRALEVKDFTTICSSAPSEILALAALRRWDLLMHRQLGILRTNAAALCRFGERWARLLGVYATRGGTIAFPKVLVPGLSVDALADGLLEEEGALIMPGSVYEAPQHAQRLRLGFGRANFPEGLAAFDRYLERHYGEYAVVSE

SEQ ID NO: 9327 - protein, 137 aa, Chlorella protothecoides
MPQPLRPFGLERYLAPREFKCIHPICVSDTETWKLSELLEHADADTLARWNDLGLGYTTTQGLEVLREEIAARHFTKTGKDDMLLDAPGDAMYVAMRALLRPGDHVICTFPGYQSLYETALSIGCEVTHWEAQETCV

SEQ ID NO: 9328 - protein, 128 aa, Chlorella protothecoides
MGSEPVLAGTPTLPDTVGPPGTNTPHQAAAEDIEEAENELMLAEDEEVPYLVGECFFHLEKEVAEARLQEGGSRGAKWGGGLLAPALGTIARVVREGVISRHWVSKHTFIPSPPSCQRGHEPVCRLVR

SEQ ID NO: 9329 - protein, 254 aa, Chlorella protothecoides
MMFNHLIGFRNELNCARWWLSGQVHGSITPRPSHRHPLHRKDYYDLLHVSRHADAAAIKRAYRKVALKYHPDKVQGTEEEKQAAAKTFAEIGHGGWVGGCCFERLPGVADQQMSPLISTDHVAYEVLTDEKKRQIYDQYGEEGLKQMGNSGGGHHNPNDIFAQFFGGFGFGGHGQQEEPQTPKGDDVVINLEVSLEDLYLGRQFKHHPQRRPPTRQVCEDCPNVKIVREREEVTVSVEPGTPDGHRITFFEEGG

SEQ ID NO: 9330 - protein, 185 aa, Chlorella protothecoides
MLASSGDSHHVVLGDSQGGVEVWDLVEARPQPISVLGGTNQSAIHALDTCGGCSGEPGPPEVVSGAADGRVLVWDARQPERPVAQLCGGTSAAAWAVALGGAGTEQDRSVLAGRQDGTISLWDLRVGTLLWSGSMEGQGVCGLAFDRRGIVMNKAYAAGMGGRLATINLRPCQPDHGRAMEVQQV

SEQ ID NO: 9331 - protein, 206 aa, Chlorella protothecoides
MGGTALQATCLGPTHALLLPLSACLASRISPIHTWCAGEPRVDGEHGDLIIQLVTTKHPVFERRQSGLLAEMNITLLEALTGFTREVGAGCGVGGSECVCRRIGGERVPRAVPGVSWAACRGRNARAHRSNGHRSEAPFSCALSSSTWMGTRSPWGPRRWYAPASSAGSRAKACPSWTRWGGGQGGKGGGKSGAGCFRGYANPSAG

SEQ ID NO: 9332 - protein, 96 aa, Chlorella protothecoides
MDYCFETLLHHNLGTADDGFYNTGNKNIGDYNYGNGNTGNFNIGNNNTGSHIVCNNWAADSPCQVEYLRTSETVYIPGTPPPSPPPPTPPPPNPPP

SEQ ID NO: 9333 - protein, 207 aa, Chlorella protothecoides
MVAWIPPAPGNRLFYSFLAPPRLVVTAAPQLGSRLLKYSAHVARVSSLIEQRVRMAFTRNIVFPGEAVRRRDWDQTGGGPGAGGPALGAEWEGRGLGSHACGRRATPAPPEAGTPRRNVSSRETSRRTAGPVRLRTAHCPSTLLRRRWGHPAAWSTGAGGPRRGCLPAGPGAAGGGPRRHGAGRGRRGAARRRARGGRGSGGRSRGR

SEQ ID NO: 9334 - protein, 346 aa, Chlorella protothecoides
  MOD_RES (59)..(61): Any amino acid
  MOD_RES (311)..(314): Any amino acid
PPPLQLVKYGVIRESELERDLTQWNSLYCAGRLQKPVAWVTAPPPGLHAAAARNLASAXXXTPAEAGRLGHCPPTQAARGGRPEPGQRPAGLPPPPAAHLWPARPAACTVRAELPRRRAHGLGRGRGQAGAPRGGAGAGAGQAVRAGAAASHRRGGHAACAGPWGLDQRAVRAPGRPPPPGPARGQGARPEGGGRNDHACPFDCIWAVSGQCSPDGIMACTRAVAWQTWVHPPSVIAGTPAAPAGGGGRPPQPARNCGPAGEAAGIRPSPCQAQRAERPGQHRAGLQPPTDGPGPLERGGGQVGAVWTGQXXXXQTALGLLSGGVVKSARYGLAKVSKAWARRQAL

SEQ ID NO: 9335 - protein, 240 aa, Chlorella protothecoides
MSAAALGDAGANHLGYYTGVWSPCGSAAAAHGYTGSLHVWRRDGQAPGAEGPWHPVPAPTGHVAAVVDAAWAGDCLLTVSEDQTARCWARCVGVENGDGAARGGTREAMAGGHRWREVARPQVHGHDFSGLAVVPEAAAEASTSGEVAGESSRAPPCYASCSEEKVVRVFTAPRTFTATLAALTGRGSGAGAEAEASLDAGPEQALGAALPALGLSNKAVWEEGAAAGADEAGEGRGGRA

SEQ ID NO: 9336 - protein, 350 aa, Chlorella protothecoides
MNWMTCNCFARASAPQCLAVGQCAGASPGGRTQGWCVGRRRRSDPTVPMPGPGMHDCTRLHGAPARYCDVPSACMCQDICLRAWAPGLVVPRLRAPWYLALGRPGSADKSTTREPGRIRGRTRIRRPHRLGLQSRDISLSRRASDLRADLEMSTGQWPPMYPGMAGGPMYHHPAMGWNVMNAQMAPQMPAFPPGHPMYPPAPPGQAAPPYQPATTSGELRTVFITGFPPDIKERELPNLLRFLPGYEVGGGRHDLVGILGSYKGIMEWSGCSRVARAVFARGPEAASHQGLKLAVAAHSWRVHPSSRLPQEPLHAGLPAAHPRRRAPRLRAVQQHPRSAGGCQGPQRPRL

SEQ ID NO: 9337 - protein, 261 aa, Chlorella protothecoides
  MOD_RES (128)..(130): Any amino acid
MNESGGPGRWAGQGASALAGNSSPTRDHPACNTLYIGNLGDATEERELNDLFGHEQHHCQGQQSAPRAGPKMNGHFKLMGAALSLKGVQRCARGLRQHPALHSPPPHLTNPTPAAPMLASSACASCGXXXGLMGAALFLKDMQQCARGLRQHPALHSTPPTHQPDARSSYAGFQRLRLLRGSRTVSAFVVFEDTATASAAREGAQGSSVPSSDRGPLRIQFSRNPSSNKRDAASAQLPQDGGWIAGSVQRPRQGDYAAAGV

SEQ ID NO: 9338 - protein, 189 aa, Chlorella protothecoides
MGHQAAQCTTGTINWRQMYGDVAFRIQPTVFQSDIDAIKKAREVDHAKLAEVAAAWARSFGNLYAPDGLHALPPDPEQKRQEELENPQPEPAQQAPSVAGGAAGEPSEVFPPTGGPDAAARPGPAAAAQAVAPAVAIPPPAGPPPAADPTQGLPEGWGATRDGSGKVYYWHKVTKKVQWDRPTPDTPIS

SEQ ID NO: 9339 - protein, 560 aa, Chlorella protothecoides
  MOD_RES (89)..(92): Any amino acid
METISEPASTSLVLMAPIKVSRTISGQVPAAGWAGRVGSGGRAIEWGVDQQPSPHALRSSKGVARPPLPALQAQPTAHPPSHTLLKCTXXXXSKGVARLPLPALQAQPNAHSPSHTLLKCTGDRRRAAARQTEYREDHPRPPLLGVLHADGLVLGLADLEHERPVGPLGGLARGRVLAVGQAQRGQLGTALRAVLGRVVGEDGGAVERAVVLGEIEPALEAVGALAADACGADLGSERVWDDGRGDAAAAPTPDCGAASPGEQDSSCRGWHLMDTCWVPPLQRIAPRIAPVTGRLLTHLPMPAAPFHPSKGPPPTHTESETQARPLTDAHDVGGGVLQALGQVIAAQPAQGDVQRDGADQRVVGQLAPVPEGHRLGRLVDAGHGLGGTVALTLRGQERGHGLPDAARAALGGEAEDGVGPPPRVLLVVDDVVDGALHVHRGHTLTQPLALHERGGHRPDLEVVGAHEQVGDAGAHDAQDPLVEVGGLALGHRVGHLGLHAASQAPDLVLLVQGGDVVLEGVGHPPVLQPDVGHALQCVPGVLAAAHSWERGGGKAGVCVG

SEQ ID NO: 9340 - protein, 181 aa, Chlorella protothecoides
MGRCVGGVPRHWSNPLQGGNPACVHEVPTSARGILLPWGGRPAIRRGGRCCVPPSIIPHSLRTQICSAGIRGKCPHGLKCWLYFPEDDCPFYRTTVFSHYAAKNCPEGGSKLPTLCLANGEDPASGEAAEGPYWSLMFEISESQYKPVSMKDTKLGGSAGVGRGRGCERGGEIPVTRGGLG

SEQ ID NO: 9341 - protein, 173 aa, Chlorella protothecoides
MALPPEPTLPAHPAAGTWPEIVRETLIGAINTKLVEAGSEIVSIYHRRWAGSSAHAPHRWKAALHPTAAAALCWLVTGLLPTTHPLAHGALPSTARLEHGYPTPSVGRDAVLKQALPELKAAGIWSRGRFGSYKYEVANQDHSLMLGVESVDNILFGTQELTLEYPNIVNPRK

SEQ ID NO: 9342 - protein, 224 aa, Chlorella protothecoides
GKDAWNTLERVSYVWLKNRWVAYPFQNNISALDKEDQIRCLAGCVEAKVANAVAQGKPANFDEWILRVMGPGIADLFMRPYNFKVWAVPTTLMQCEWLGERVATVDVERAINNVIHNKEDAGWGPNAVFRFPTEGGTGGIWKAVAALLPAERQRYGPAQTVTSIDKAAKTVTFRDGRKLAYDTLISTIPLDISLGWLGRDDLAKGLQYSSTHIVGIGEWACLCL

SEQ ID NO: 9343 - protein, 291 aa, Chlorella protothecoides
  MOD_RES (44)..(47): Any amino acid
  MOD_RES (107)..(110): Any amino acid
  MOD_RES (285)..(288): Any amino acid
MLRAFHSWRSEAAQFASSLQSYIALEVIEPAWAEFGACLGKARXXXXRAWVVKGGGARDGLGGGTARGDAGQAGGELLRWSSTPPALSCGCFAVGTHVHSPLLLANXXXXLDEVVGLHEGMLAKLVEVRGVWSGSCEGCGGPCGAGCVWPASQSFSDGLPLLPLCLAGVSRVGLTSTAHSSWPILALQCSPTHSRFTPTPGPVPGRHGPRPGRQLPGRAAGGICGPGPAHWPPSGAHLYGRPAGEECAALSSQACRCRTDCVVVSVRACLAAGTMPVPACRDETXXXXLSR

SEQ ID NO: 9344 - protein, 125 aa, Chlorella protothecoides
  MOD_RES (119)..(122): Any amino acid
MHPCLPARHEARSVIHSLPTTRRQGHLDAALRASTASSQDTDVADRLTVRLARALEGDSGWDVFSLQYAVDGALAAVLAPSAMACEAGGGDFVMGAGCREGCGVWLGVGQPGGGGEGRXXXXHGM

SEQ ID NO: 9345 - protein, 345 aa, Chlorella protothecoides
  MOD_RES (60)..(88): Any amino acid
RPRRGPSPRLHRDDGTAAAGQANASLFTVLVTDAPVEKLHLLRLGVFDFARGAPAAAGAXXXXXXXXXXXXXXXXXXXXXXXXXXXXXGVPAYTAAQDDFALALDVGRDGGRGRAGRATECVGLGAGRGREPCAGASADGGAPVGQRWRAPWDSPGAPQSDHEALASIRRRMTAARHFRRGGERLVDGVQPQHARAGGGGGAAAVARGALAPPAPAPGPEVGGTRHRRPPAAWCAGRRRACLVAPGWWCRLGSVAGTAMPSLVPLSTRSYTDWRRDVQWAMFNKRVRVATELFTELFGDDFDAIIPIYPTKVRAGGRRGPARRVALGPGVSFWYLRSGPFGNQAI

SEQ ID NO: 9346 - protein, 818 aa, Chlorella protothecoides
MLDNSSADSLCRSEGYSKAGSTQTNTLDALGLSVSAVKMSPFEAGQKACAADRDGNIGTGNKGKYNFGDNVGDSNIGNSNKGDLNWGFNNKGTNLRCNNAVGTRKGPNMCDLKDLRKSVVRDFSPPPPPPSKRATPPPPKQTTPPPPKKPSPPPPNKASPPPPKKASPPPPKKASPPPPVKTSPPPPAKTSPPPPAKRPTPPPVKTSPPPPAKEPPPPPAKNSPPPPVKRSPPSPSPAQPFTLSPPPPSPIYPSPYPFSPPPSPPPPSPSPPPSPPPPSPPPPPPVLPVPVFTLTINDNNTYTFGITASVAFTRFFIVKNGKTVWLDNIDPPATSFIDSPVQAIAVLCEGNASRGHPPPVPVVAPDLVILACLQQSLLPGTLPMQMTQVHPWSATTLPLVLSRAHHPDLCKASIHRQPQHTCQGTVQERTAPTRRIVAVHLSSPISSLTLCHLLAHSALQTPSWDDGTQSQGDFEGACTRCTPDRVAEVHTLQCHTALPSSRAGKMTDHMWYEAVYVPTVEQRWSLVPRAVVVSQSPRAPSSIKRNPSGGCTPLTTKMGCTPSLGRCGKAGVRDEGQGRPEYNCVARRRAAQQMPHGSAAEVLHLSIDVIVFCTDSAVSNWIELRSGRAALLYQGRPPSGEHIGNKDSKDYQDDALGSLPSSARGGGTPSPAEEDDPGACRSVRAYPLAARCAFHVHVAAHFVKTSNLGTWHASSSGVPHEVGVGHGMTPPKWTRNARVSLSQVRDLPLIWTAPFLAVSFLDCHGIEVGFSRSRPQAQVLDVKPYIPGNMTTTPYSPPRLWLRPPEPGQQPRPPQVVC

SEQ ID NO: 9347 - protein, 495 aa, Chlorella protothecoides
MSDTSRKAVPSGQEKHTVSSPIPPEDSSVIPAGDWVLGMDDGRASQRLAVLTRHIAQGQGAPCGHIPADSEALGSCNALPNAELGSRAVICPSPTSSYERMHGRGSRAPAAWTSIPMVAGVQLKETLYKKADGEGIARVSVPSLARWATGVAAWEGGEGLHGVAASWEDRVNLIVPTLQRGPNMPGAFNFFPRRSASTAPSGAMPSRPSQVCWGACIDAHFPVWLHASQFSTMTNGTAPQSQHTPSPSSHDPRTVHEMGLCLRDAQDDPAVGVIILTGGNRAAAGTLYPFSDALVAAWRVSLTCHPVGLARSAGHCQCVPRRPSSILTASEHACRHPSLPPPPSLQHNDAGEGDAAFCSGGDQAHRGDGGYVGADGVPRLNVLDLQIALRRCPKPVVASVAGYAVGGGHVLHLLCDLSIAADNAVFGQTGPKVGSFDAGYGVSHLARVVGQKRAREVWLLARLYPAQTALEWGLVNAVVPLDQLEAETLAWCGRG

SEQ ID NO: 9348 - protein, 110 aa, Chlorella protothecoides
MRGAGELPRRWVGCARSRRRMPRPWSGRRGPHTTPNAMHPSPTRSRCREIMANSPTALRVLKSGLNADEDGAAGMAQMAGDATLLFYQTKEAKEVGGGVEEQGWVQGVVK

SEQ ID NO: 9349 - protein, 203 aa, Chlorella protothecoides
MELALLLGAPPPAQILIPAQLMGKSKVLVKVNPDGKYVVDLDKEIDPTTITPGARVALRNDAYTLHVLLPSKVDPLVSLMKVEKVPDSTYDMVGGLDQQIKEIKEVLALHSFLSTSLIPTQSLTPQQVIELPLKHPELFEALGIAQPKGVLLWGPPGTGKTLLARAVAHHTDCTFIRVSGGELVQKYIGEGSRMVRELFVMAR

SEQ ID NO: 9350 - protein, 74 aa, Chlorella protothecoides
MVKPTGEGLRAYYTSKIEDLEIEIRDRQHALQRMQAQRNDLNTKVRLLREELQLLQEPGSYVGEVIKVQAGCQR

SEQ ID NO: 9351 - protein, 97 aa, Chlorella protothecoides
MLGGTILGELRTFLTEPGRIWSALGSAIPAASNFFINYISYRAFVMAFFRLFYPSQAVVTSIGRLIRLIPVNEGKADGPAYEEGGQLLSGREAPDAG

SEQ ID NO: 9352 - protein, 203 aa, Chlorella protothecoides
MASQAVTFTVLERLAKRYGQQYTEQNVAMSGTHTHSGPSGYLQYLIYGISSLGFYTPSFDALVDGIVEAIESAHESVGPASLHVAVGEVLGANINRSPTAYLHNPAGERARYRHNIDKEMTVLAARGSGADAAATAQPRAVFSWFPVHGTSVNNTNTLVNGDNKGLAAQLLERRAPGTVAAFCQANVGDTSPNTLGPRCRDTG

SEQ ID NO: 9353 - protein, 255 aa, Chlorella protothecoides
MRTLPPLPDGLQLHTLSDGRQLAYQILGAEPGPSTLTAMYHHGTPSCYMEGLALEEAARAAGIRLVAMDRCGIGASTRRSRSSLATVAGDTLALMDALAIPRAIQIGNSGGGPYAAACAALHPDRTSALVLMAALASTSGPDRGLLRSLGMMDKTTFWMAKLPLGGLWAVNWGLKYMATNHAETLIKHAPEGLAKVDGELMQTDPRVKEMFAGVLTVRRWDRGGGGSGHGTGRGRGKRETGRGGRGRGWASACAG

SEQ ID NO: 9354 - protein, 122 aa, Chlorella protothecoides
MAQGLGRDGLFNTLSSLIPSPPPCAGAFAQLTIALCGNPAAGTASAGSDLWICGETGFPALLRNLITSLGPSILLSIYNMVILPVIIYYLAQVGGWADWVGEGEGLDGIEGLGAVMGKEHGH

SEQ ID NO: 9355 - protein, 441 aa, Chlorella protothecoides
MPPFYCFWFSWSTRAFELHPSTPSSPHRSPHPPSPQHCPPPQSLLKTTTEALRSNIPRVYHEIAHAPPPSPPGSPSTPSTPGGHLVKTEALTTLVPSSEATPIAADLEIERITGAEQATLSSVQNEVLLPLQAWLDAFTRLHAQKKEVEAVRLEVDSRRRTVADLTVKEASKQAAVQRNQDAKHTAALEEATALLKHKTDKLNATAARFNEAEASLHAELTALIQDTVHLRNYAANALRILGEGLVNLAQLVSGSVGDVPITPPAAAVESSPAPAVAGTVPAPAVVGSADDNTPRSAGAGVEPLGHLTEEGGLSAGESSGYAVGGTSEGTEGSYAAGNYAAGGAAPRFFGEGKQHGDGCEALSGGSHVTTPDHTGAQALSHIPGVEGPVRHEHSGREAAPESAGARVLDCIPGGTEEAVRHTGQEEYVSQGVKGLSLNIPA

SEQ ID NO: 9356 - protein, 219 aa, Chlorella protothecoides
MASLRVLRTLRTQPISGRELQRAQRTLAARHETDLKDNGYWLGLMANLQAPGVPLKTLDCLRDLRAMYDTATVDDLYDMHQKASFGCMGWSGGMERSERGGSSQGGASRYSAHADERLQSPITPVQGSKLLPQNPHLYLMLNIPQFNFDDDAIFSCIGVSGREAGAVKDHPLLAALPAQREDGAGEAVVDVKDADAFFSAVKVFMQQMGSAGPGGPPKP

SEQ ID NO: 9357 - protein, 461 aa, Chlorella protothecoides
MSFPSDRPEDCATRIGMGVASGAVTGAFLGAVASNWGDIPLVLRNKPLPALLRTGNVMVNYGATLAVVGLTYSAVDVRRGGVCHPMLWETCDRGGAWLFIPSCIVPSAKVTGAVRPIHPSPLQTQCVAESLRGKQDWVNGSLAGLATGGVLGIRSESADEMLLPCRYVVCPLWLGSVGRWVPVTRCLFLRHGTRLIDILLTPGKHTPVTQSYGLMGMWTMAPPQGAQCTPMMPKVSAKVNVDLCESSRIRPNRCHKEVLRTHCYQGVGVNTKTNVRTRKCNEEWSARPTKEQNNKNGAPHSPWELGFGRSLLARALLSSSRLASDLQPAPRPQYWAKGRGRVAADEGPLWARNLDQLTMPGHRSTKVLIALCIVIVKSTPIMCIHPSADSSLINPGLRSLHCRHHILPRLVHGAKARDDRDSFDEFFSSEDIREVSQYMPDPDQQLFGDGGQGGGAGGQAC

SEQ ID NO: 9358 - protein, 671 aa, Chlorella protothecoides
  MOD_RES (69)..(72): Any amino acid
MEVSGWARDAARHRPSLPGCCLFFTACQRSQESAGFDHPCLPVPQRASTPTLACTQKQTPQGSVCRHRXXXXHHGDGVEEAFYTTDRVMTVSFHKYGDFFPGTGAVGDIGHDGGKLYAVNVPLGDGMDDESYKSVFEPIMAKGSLRRELHARHTSYYELLMLQPELSLTRVERLTLLDRSPWPGTPTLHPEAATVISQALPPSSPQVMEMYQPSAIVVCGGADSLSGDKLGCFNLSMQVWGAGVLRSSLGLGSEGPEEHTENMATCVFWAHIPCVSAAQLPLPQPHPCPHPACPVTSPRPIRAIPTALSSWRGTTSRSWYWAAAATPCATWRAAGASRPASCWASSWMTSERWGLGGLGGTRVAQDRKNGTAALGRRCVQWEGLQGIQQLTSRRLAPTWSHIFGILHSLMPTLCPPYSPPLPIQTASPSPRWGSTTTTWTRTSCALQVGRKPHAVHTAGVPVCGWREQGAHSCPTGHPPPPSTSSPPMLRSEQHEEHQHARGAGAHQGAGSGQPGLAPARALGPDGPPPAQDRAGSDGPGVQFAADGRAVVSASSPPPSSHPPFPPQPDMPEVDMDARGGGQAYDDKRVAHDNDYASGQYCALYLDGGAWKERLQSTSRHSGCCSQQGNMQHMYHVPINLIPPATPPAKPGDEDVQPARDLPVRPKEVRGL

SEQ ID NO: 9359 - protein, 258 aa, Chlorella protothecoides
MATVKRRECVYFYDEEMTNYNYGGGNPMRPHRVKLTTQLVNGYGLTDQMQILRPVERTREEIMLFHADGTPGGVGEREACSPCASYLHPPPLSAPRGPPDYVDFLNSVTPDNQEEFMMQMRRFNLGPVGEADCPVFDGMFEYFRVRSGSAHSALLFFRRGTLSGACLLLLTALCSVHYYTPIPSTANTLELSSSPPFSFQMYSGGSVGGAAMINDGQANLVMNWSGGMHHAKKGEASGFCYINDIVLGILELLKTHQR

SEQ ID NO: 9360 - protein, 230 aa, Chlorella protothecoides
MGAWPCSQHTPRSRDSPQVTVVGVVRHGERAGQFVPPNDLEACTWYYVNTAELAQAAGRDADTPLVEAILGEGGRRGAGLSAVGSGRVGEGPAGGGVEVRTAPARRPVGMRSASESSHSLTPRRYHACAPLPPVPARPLRHGCAPPSQPPTAADAPTVVKPPSAMEVLGGRARSLPAVPDVVPLPKTLDELCSFSVMPRDHTNYAATWLTLSAATAALAVKAVRGTMRRA

SEQ ID NO: 9361 - protein, 92 aa, Chlorella protothecoides
MIGYLEAHFSPKKAEPGASLAIQGGSQGARLTHSHERQYTYVLQSLTLWREISHEMGEGWEGVSLFAGTGRRGSERHSRDSRSWHAPKVVAP

SEQ ID NO: 9362 - protein, 233 aa, Chlorella protothecoides
MSFMVLRTMRLPGLAARCEQGITSGTLKAATRALEEAVAALGLRATQGTPRPPPISSRAFASQPHSVPAPRSGGVAARSGSGSRRTPWSAALLGIPSLLAAYLGNWQLERRQWKMRLLEERREQLLAEPIDLFAVDELPPEYSRVTLTGTYDHAKAAFVGPRGRPSSAGVTEQVGVAAGCPMAGVRRECGRCLLHGQARPSPCELYPYSPPKRRRATWSSRRSPAQTASARRW

SEQ ID NO: 9363 - protein, 341 aa, Chlorella protothecoides
MAEERAGGDLVGAVTLHLAWPDAVLPAPLPPLRQLRACICNLAVAPRSSHRPEGGGNVPPRDEPHDAAGPALLKNHPGSNAPPRRRGVARLLLQRCEEAARWWGQDSVWLQADPWNEAALDLYHTSGYATVEDVPWHRPFRVVMRKELPGRRAAGPGEPDLLPGNGAGVFIWKAVLFPCGTLGHIATVEHGWLLAESVCQLYTCARISIHSTPGCHALQALCRLYACDHNLPRTITPDRSALPVYCFRTMVGPVLLLPFEGLQPCTKVWSTPIPRMWPSCPGHSSTPVLHCYTSPDRITHRHRAVSATKDHTRKMPQQPTSRGVARPGPPRCRRSPSSRRP

SEQ ID NO: 9364 - protein, 318 aa, Chlorella protothecoides
PPPRSPFSLLSLPRRAHQSRPLLDGARQRGWAQVRAGERARPLPPGPGRRALCAQRAAGPGGALAALGLAAGEAARRLLRLRGLPDAAARASRHARRSPGPGASAGGGAPAPGRRPRRARRGAAPHQGHAAGGGGGRLPRHRAHVGEVGGIFWGGGAWVEAGQGRWGMGRLGEGRNEGGKGQEGLGSHACALQAIAEYQQSRPPPHSSPRRGGAYAAGLLFKSYEAGDENGAALLYDWETGRLEVVFGVPPHWATTHLPGLATQGPTPTSAAGGGADQRFAPAWEHVDPALLLTTPRLGSASGAATPGFFSPGRDDAG

SEQ ID NO: 9365 - protein, 164 aa, Chlorella protothecoides
MAIDKESEGKDYEVSPAPQQPGQLSLACRRISNVIRIATQTSFHLPTGSSEDFGGPDFLATWRRELENAGLTIVEAKLGVDLEKVRYVVCFNPPDGLLAQCPNLRLIHSMGAGITHRMLRDEVCPTHVPMVRVVDPLMAQRMATFCMWAVINVQRKWSGWGGGV

SEQ ID NO: 9366 - protein, 148 aa, Chlorella protothecoides
MQHLLPPKILAKAEFLNPGGSVKDRVAAQILEEALASGALRPGGTVTEGTAGSTGVSLALCARAAGCSAFVAMPDDAAREKADTLRTLGAEVRRMRPVSIAHPDHFVNVARRAAAEREGAVFANQFENLANFRAHLRTGEGGTRAVWD

SEQ ID NO: 9367 - protein, 219 aa, Chlorella protothecoides
MPAVPSDIKPLLEKKATFEQGVERLKDLLPTSGGSVVDDPAYSVLLARVHTLLQSRYNSTAFWARAQTLYRAALASDRSGNLATQLRGYLASCAAHLEDEPATATLAAAPPPFSFQGLLSHAEPAAGPESSPQSAAALEALMAHLQQMQNGALGATLEGPEPHLLDADLLQALEDSMADVPRGAPPASATVVQSLPKEVLTPSRLAELGGAGTRCPVCM

SEQ ID NO: 9368 - protein, 142 aa, Chlorella protothecoides
MFTREEAEGRRLRHPADTITEGIGINRQTANFGRALVDGAFQGSDMEAVEMAAYLLRNDGLFVGSSAAMNCVGAVKAARLLGPGATIVTVLCDGGARHLSRFHNAGFLAEQGLAPVATGTGLAFVSDGPYRPAIGQVLPTHT

SEQ ID NO: 9369 - protein, 218 aa, Chlorella protothecoides
MMQNQIPPCSDAYLEAQKDCRWDKSVENFTIRDNSSVRVGILGLGNLGAATATLLLAAGYPVSAWTRSARANDQKNARISYYHDREGLFELAREAQILICLLPLTDETAGLLDARLFATLPPGAAIINVARGGHVVDVDLIQALDSGHLSAAVLDVFHEEPLPKTSPLWTHPRVRVFPHVSSVTQRQEAVRQMKENFDSMDAGTDIPRDRFIVRSRGY

SEQ ID NO: 9370 - protein, 687 aa, Chlorella protothecoides
  MOD_RES (7)..(10): Any amino acid
  MOD_RES (344)..(347): Any amino acid
MVPPGLXXXXSPQSLMASPATSIINIVDHNDLVFPKLLQGSAEAQERNNADAGCLCELRPHLAISCLGSVHRLKFAVLDFPCASVIVGEPRPMERNDWCPSNPSCLARRPSGLQKNGPSRFGEVNTACATSATLSTPAPSTLMAEWCWGMPATPRDPEARAHHSPCAVHCHPAREPRRWEVSRYEFLSWTSQGWDGADGCLLAGRSVSTHQGEASHPPGFSLRPIRRPEPSRPTTATSAVAGYAKGISLSPSLASQQLDDEHGEYSLNAPPRKTKTVCTIGPTSCDREAFFRLADSGMNVVRLNMSHGDHASHQVCWGEVWEGKADPPMHTYLPPSPPPPPCPXXXXRPRLPPGLLGEVWEGKADPPVHASGPRPPCPRSRSPLAHRSKSSIWCGSTTRWAGATWPSCWTPRGPRCAPVTSPSPWSCGPGRRSPSPSSPAQTAPTIASEVWVGLDGEEEGSGGAPMGALIACGTGPSLPTTKLLDPRNIPPLNATVNYDGFIDDVELGDILLVDGGIMSAVVRSKTDTDVVTEIVDGGSMKSRRHLNIRGKSANLPAITDRDWADIRFGLEQGVDYYALSFVRTADVIYELKDWLARAGATGTSAIGVLAKIESADSVANLDAILDAVDGAMVARGDLGAELPVEEVPYWQSKIVRGCRKRGKPVIVATNMLESMIKCPTPTRWVWV

SEQ ID NO: 9371 - protein, 69 aa, Chlorella protothecoides
MTPFPLRRASEQIEGLGAGFIPRVLDFSLLDEVLRVRTQEAVAVARKLAQEEGILCGISSGAAVHAAYK

SEQ ID NO: 9372 - protein, 81 aa, Chlorella protothecoides
MQRPKSPPSWTWIYGPSGVAQRPENAGKRIVVVLPSFGERYLSSVLYSQLWTQDATEEDEMPAEWRMHNGLYVADRDPPKL

SEQ ID NO: 9373 - protein, 460 aa, Chlorella protothecoides
MLALHLPAKQQQVDSKPGARGTGGRQREERSEVQAGRAACIGPQRNAATGGQVFVDWAPRDWQARAPFHALAGSGADPSPACARHPPARSAGRPSAPAPRSLLDGLHQAGGQLGHGVQALCGAGGLAQRPHKGRADDDALRAPARQLARLVGAGDAEADRDGLVGLALQLGDEALHARLHGLLDPRDPGDGHEVDEAGGATGDGLHALGGGRGRGQQDQLQAVRRRHVGHGRRLLQGDVGDQEALDEGDREGRLRGLEWAEHMPILLEGHGGETWHGAERGVCRGHADACPHSLQTRLTLGPRGNCLRAELLQAPGEDGVEVDEEQDGGLDGGRHLGHQAQHVVQGGAVGQATRGSGLDDGSVRHRVAIGHPQLDDRGAQGIQPADGLHRGVPVRVAGHQEGDECHSVGCRLCMRVAIPMPMPRLAPGTRPRPCSPALPFQGLHGVGDAGTTRLSALQGS

SEQ ID NO: 9374 - protein, 204 aa, Chlorella protothecoides
MYDPQDAPRLVFVTLKDAPHRRRVAIPLPENAAWDKFTASVAAKLKLGAVDGVFLASTGEVITRLDQLQDIDDLVVTEDYGGAMVHRSPQGMAVSSCTQSTGHSSSLQFQSPTLCSTQQAPAQLATSTSGVAPAAVQRTSSTPFRGLGGGSEPAVSPLQVEPAVHDEDGDSKYQKRHSALQRTLQPLFPGLFSSSNGRLPVTTK

SEQ ID NO: 9375 - protein, 97 aa, Chlorella protothecoides
MVAAIEKAESIVATTPGAYMLQQFDNPANPEVCRGGGLYRGLPAHERPHGCRHDGEGDRPDAQRVRQRSIPALPARWPGVVLPNPRRHAPQPFPGPL

SEQ ID NO: 9376 - protein, 65 aa, Chlorella protothecoides
MKMLISAGTVCLFHVGGGLEPGEEDGVGAPRWDFFMGDAPHAASRRTRQPIAQLAEIEKHAASGV

SEQ ID NO: 9377 - protein, 625 aa, Chlorella protothecoides
MEHRRADRGPFVPLGKRTGGRTGCAFRWSGGRSVDDLLPPARHRHKPDAPPGETVLSDEAALLLRTKCSLERLDEGTHRLVAPGSDPVMPLDDEGEPTACYAPVQSTPSADAAALAYLPPMQRIRALQVGGRCDAEGGGATIRIPQGLGCTVQEGGAALSCMGTVRMCCAPGIDVLCRAQVLDDSSQNRPGVRTSSTPTRTSWIACHIPHPHPLQIMRMHVPPERAAAGGGGAHRLHQRDAALHRALPRLPGPVQAAAGVVGTLAGAGAGAGVGRKGAGELHGAGVLAVGRPPGVPLPVSLARSPELAQGQGLGGRAPGSSMEQGSSPSAGHLAASVDMQPNGAAPRPSSRGAETAPYDPEDNPSTRSDARGGDGGSGSASEALQREGGERGASAGGDASAGGDASAGGDASATTASGNASATTASGSASAGGSGGTNDRPADVGAASRCPAAAASRVATPPPLSEEEEIACVQRTLEVVQRRMRQYDGCLLQMRCDEKGFLAICAFGLPGNSHEDRAVRGVQAALSIAAGLRRHGLATHIGVTSGQLFSTLVGSQRRSEYTLFGDSINLSARLIQRRAEYTLFGDSINLSARLMCRARDGLGEVLVDRPTRACASPSASWPPSL

SEQ ID NO: 9378 - protein, 134 aa, Chlorella protothecoides
MAGCRGPGAASARALARVDVSGGALTGDPTVHPGLPRTSQVTSNPPTHPHKHPPIPPRQACHEQVPPDVLEPAVRQLVDQFVHDRARPEVITVGLKTVREICTRCPLVMTPELLQVEGVVDGVVGRLLAGVEGV

SEQ ID NO: 9379 - protein, 423 aa, Chlorella protothecoides
  MOD_RES (18)..(36): Any amino acid
MRTSVLPCTRPPFPLPPXXXXXXXXXXXXXXXXXXXLTSYKKTRDKAVSSAARGLIGLFRELAPSMLEKRDRGRGADLAAAPLQFGQTTIADGIDGLDLLRRAEAEGRFNSDGELVSDEDDDDDVQGGTSSSEGEEELEEGEEASSDEEASVSGADEDDDDDEEEMASGSEASGSDAELEMGSGEEAGSGSELDEDSEEEEEAAPPAKARRTPQTGSLTQMKKRLQATKAAAAAVAAEATEPWADRILTSEDFEKIRQLQHKRLVDHAMQVRARGSGWPGRVKTSRGRVRSMLPFPRCGSAKGLDHTIVCEHSVEVLPFDASSVSSHPCMPLIAPHQILHPSTEARPQVGQQAREGHGSGRGRRGGDHGPARAAGQHARQPRGAGRPAGHAQVQEGQDGAHGDGAQGCAQEWQRVLGGVDSRI

SEQ ID NO: 9380 - protein, 153 aa, Chlorella protothecoides
MVGMDQPPAPGEQGQEHTWSATLREVKHQFCLYASFEQREEGGWVDLDPAETAAASDPHGSSLWPQHQWHAAFEILFALPPDAAAPKRDDMLFFVYLPWLHRKDPVLVRRRGKELPADLSLGGALAGDIDWRASALLSLVMHTRYTLTVMVSG

SEQ ID NO: 9381 - protein, 263 aa, Chlorella protothecoides
MPPPNVTGKLHMGHAMFVTLQDVLARYNRLRGRPVLWLPGTDHAGIATQMAVEKQLAAEGLTREGLGRAEFERRVWAWKAACGGDITRQLRRLGASCDWGRERFTLDEGLSEAVVEAFARLHERGLVYRGAYMVNWSPGLRTAVSDLEVEYAEEAGTLYYFKKAGRAVVIQPNPPSHSPRRTDHSPGGAEGEYLPIATTRPETILGDTAVAVHPKDERYRHLIGRQAQVPLTDRRIPIIADEYVDPEFGTGALKITPGWRRLP

SEQ ID NO: 9382 - protein, 107 aa, Chlorella protothecoides
MQHATALLRSAPCISLRAFTSAKRPGSRAGLHVRAAVASKTATPRLVLKGGKVHLFSRHRNPVVYGGAVDNIKGPAPALGDAVLVCDGAGAAFAWGFYNPHSMYRVR

SEQ ID NO: 9383 - protein, 214 aa, Chlorella protothecoides
MSHALPPRTPHPGHDVNDYEIGKRHKLAIINIMDDDGRLNAAAGAFAGVDRFEARTQVWQGLEVRTRVGEQIGGALWGGLCELQAAGGPCQGNHLTCDQLHPARMFPPPYSRRQAAGLALRTEAHTSRVPRAQRGGEVVEPLVREQWFIKMEGLAGPALKVILCGEGDGHSWRVLALRHWAVQSGTQPRQRPCPTPPPPTGPGRGEAEHRAGAL

SEQ ID NO: 9384 - protein, 292 aa, Chlorella protothecoides
MISEPREQSTGSASISERQPKIDQKGVTYTALEGNAFVLEFRKTGTRVLVDPWLIGPLDFGGGSHLLYQGTKRALRFTEASAIELARSCDLILITQSINDHCHKPTLAVLPRDIPVVAAPGAATIVQGMGYTSVQTCDHGQSVEAAGGRLSIKASQGALTGPPWAKRQNGYRLVENTEQGARVYYEPHADFVQDSVSELGKVDVVITPPTTISLVGYRVHGGSPQNLKLLTMLAPDAVIALKNADFEEKGPLASYTKQGDVASMRVDMAKIGALADTQLYEPEPGQPIHVML

SEQ ID NO: 9385 - protein, 101 aa, Chlorella protothecoides
MASRAARAPCIASAPTFQQPPTPFPRCRIMQMLSSPEQKAPSDIQALLRAKIQAAWELRRALDLPSQDTDVYRLVNRCVRLLGFLLQLDLGTTDGVTRGHR

SEQ ID NO: 9386 - protein, 295 aa, Chlorella protothecoides
MRYRAEITRALTEVLQQQGTAGGAEPVIVWQPAVTMLTREEGWTFDDPGAAGVQGVATNGARSRAASGEDSGEEEEGDAGEDAGTDIAASPASPADPPLIIREHGLRYSLDAEGPNQKTGFYADQRDSRLVLRQLSKGKRVLDLCCYTGGFALNAAAGGATHVLGLDSSHRAVHAAAANAALNGLDQVLTFERQDMKAWGRGSQPPPGGWDLVVLDPPKLAPGKKAMVRATRQYTAYNAAAMRLVAPGGLLMTCSCSGAMTQSDGFLPMLQVGLCVRGVCLFVVPFCSEVAWAGR

SEQ ID NO: 9387 - protein, 354 aa, Chlorella protothecoides
MPALLHESPVSSVPSPLHPCLQVLSVARLFESEPQYVTDQPRFLNSAALVRTAQTPLQLLDSLKAIEGRLGRDFRGLRNGPRPIDLDIVFYEDAVLSSERLTLPHPRWRERAFVKAPLADLAPQCPPDAETHATSAGLPASLAEVAAAWRRAGGERQLGGAAAGLAPWIPLPRPGQDPGPRGLAWGGELPPRVMGILNVTPDSFSDGGRSFGDVARALRNARAMVQDGADLLDVGGQSTRPGADPVSEEEEEARVIPVIRVCALTRRRRERGRRGPRGEAASRLHSDLPIPQPSQRAAGVRGPEGDPAVHRHVLQRRGGAGGAGGRRHSERRLRRPPRSGHVCCGEAGGGCLRL

SEQ ID NO: 9388 - protein, 286 aa, Chlorella protothecoides
MLCPNEAHACQSVPVACNTLAAWFRRFLSSSNVVHASAFPGPPLGRVESPRMPDGLSEDSDDQPLPPGAERVNLEAWPSTSRFPIDVDGNLAKGSQNPIPTYPDICFEVSTFDTVFKSQILRDGNTCYSVLLHARVEEWRCQKALAAPASHPGGPPHPPPGPKPKVCAFSGFVTQARMVEAGVMGGPLSVLGPRRAQRVLMNGPGGEGRAEVAVLRMLPPGQAREADRGKGPLQKLTRSLGQVVRQVASEVGAGKGGGGGPLELQCSLILLSLPVQSLTRSILDAL

SEQ ID NO: 9389 - protein, 451 aa, Chlorella protothecoides
  MOD_RES (76)..(79): Any amino acid
  MOD_RES (104)..(107): Any amino acid
  MOD_RES (194)..(197): Any amino acid
MSTYVWTAVEPTRLPLVVVSMTNHPSPPSQLVQDPDAYFSHPVGFISYDRDIPQSLLDAAAKVRRIRSRPLFHIVXXXXGADALGGRWISDCIGEGHEMACHTXXXXSLLDAAAKVRGIRSRPLLHMFVHRQWGPAQGHRFHAAPLRPGQPPAVPAADAIDPGGGAGGCGRHPALHGGRDGLFIQGAQWDCAGXXXXAAILPSMVAGMDSSYKAHNGTVPGSRLRLPYPAPSDQIIDMREMEERMPGRWREGSFLLKPRATSVNASVLVLTVCEAGSDVTECAAGDAKAVPEHDQIRILPNRSLAQLRTALSGVFSKYKNPPPPPSTPNAETACEGRHTAPDGADAQRVGGLQQEAQPPHVQPLLRGRQPGPHRVCGERMVVGGVLGNGLEAGSLEPIWRLEPPPPLTHLFISVLFQSNTDAGMTSSGTCLATETAMARWCRGHGSQCLWK

SEQ ID NO: 9390 - protein, 582 aa, Chlorella protothecoides
  MOD_RES (424)..(427): Any amino acid
MPMLGAGPKPAGNLLAGGFLSEQDNLDPRSKQHRTAAVSRGLARLAGRMMASLMGGRLGARRMPGPQARVLFCIAVAVVVMYTASSRFNLARAGINVASVPTPLRGEGWEGLLELALAQLGWLGWSEGLPMQCSTSRPGSSEDPVLILNSTFAPSHDHTKGATQAAGHAGRDTSPSASGLAGRTFNHSLNPTHELTKVHSQVRTIMPHSIPNHPGSYLPWWRLISTSYSHLQTGTGCAWWRIWASFICGLPHHACIWGWDCCPAEAPSGMCSLSDTYQNLHICSCSDFIENWVHYMQATGCKAYLVGENERNWRSTSSRTGCTTCKQQAARHTSSVRMSGSGALCVAFLRDWASDNKTLDWLVEREIPAFYVHAGSQSTEMWQCLQGACSRHAPRITRAQVDAGDSDSCCIACAHSPDISSPPXXXXSKAFLGLMTARIAVDLKILQFGYSVLSTDADVVWMRDPLSFMLKGQCRSFKHAEHLSKIRGPQRAASGCSVANPTPFPYTMPPQYPEADILMSNDQLITTAEGEELEHWPASGWSANAGFKLFRPRAAQFVKVGYGTAFQDAHCFSGTPSPQPWV

SEQ ID NO: 9391 - protein, 608 aa, Chlorella protothecoides
  MOD_RES (221)..(223): Any amino acid
  MOD_RES (271)..(273): Any amino acid
  MOD_RES (387)..(417): Any amino acid
MDRVNMSIAILPMAEQYGWSSMTTGLVQSSFFCVHQSSITGFPQCTPNHPRGRGYLLTQVAGGVWADKYGGKLVLGLGVLWWSLATALTPVAAHMGLPALLLARACMGVGEGVAMPAMNTLLSRWVPVAERSRSLALVYSGMYTGSVLGLAATPHLIHTVGWPTVFYAFGLLGVVWAVVWRARAASSPGQDPFISDAEREFISGGVAEQASGREDARKWAXXXAHCGTRNGTRVRVCHCRHANRRGTGGGRTLQQPPSYTHIWPDRPLNRXXXGGRTLQQPPSHTHGQTVPSITPPPYRMQRVAGIPWRRLLSERSVWALIVCHFCHNWGTFILLTWMPSYYNQVGVCVCWGGGGGETKRKGMGRMGFFMGAVPSGCTQAATLLQRXXXXXXXXXXXXXXXXXXXXXXXXXXXXXXXDPRPLFPLHHCSHDVPPSHPDPFCPPPQVLGLDLRASGFFSVLPWITMAISANIGGWLADTLIARGVSVTTVRKVMQTIGFLGPAFFLTQLGRVHTVRGAVACMMASQGLDAFSQSGLYSNHADIGPRYAGVLLGLSNTAGVLAGVLGTAATGAILQSTGSWDQVWGVAVGLYLIGTVVWNLASTGERVFD

SEQ ID NO: 9392 - protein, 106 aa, Chlorella protothecoides
MAHLKKGEHDQVLFDRLIFSNAEVIPSRSDHLFRGFDRKLIIGSLPVSLFCSGQTYKERMPQNMGLKPYAVHATFQACTQAKINRLREYDLWKVGGSGCFGRAMEK

SEQ ID NO: 9393 - protein, 128 aa, Chlorella protothecoides
MHMGTAVPRACEDASLDPDNSPPRSRLFLVVPKSADGSAIEAAMSAFPDLQYCKTDLVASKGIVFVKYARSSSAAAAMEAVQASGQVAGYRVKIMLAEPKVRRSPSASSAAGMLGGGGAAAGHARAAA

SEQ ID NO: 9394 - protein, 161 aa, Chlorella protothecoides
MRLESGKPGVEIGWFGEGLLGAGLLEAIVGCSPVFLPLLCATRGPTLILSALFERATHLHLPAKKMKFLFKRWLDFEKAQGNAEGVEHVKKSAMAFVEMKQGAGQQQCSMTSVCRQPEPTAARCDGFCTSRCLAGRVRAAGTWSRSIPVSSSPPISSSKRE

SEQ ID NO: 9395 - protein, 383 aa, Chlorella protothecoides
MAAAKKAKVSHDATLAPLSKQQKVLKPQLDTETGWEELETGPSPDELVAGEEETAKVKLSKHQKLQRRKAEETAIREAELRRLQVREGPPSPSALQGDAAPTSAAEYEALLLSSADSSFVWIKYMAFLISLGDIEQARAVAQRAFSAINYRWAGGPARSPGEDAEKFNVWVALLNLENTYGDETTTLSTLGRALQHTDARRMYLAATDIFQRSERTSLLEQCCKAMSRKFSASTEHHIAACAPTSQGKACTAHLQVTHSPSPSLQITAFPTDLAQDRQAEAGPRRRGGCKCHSGAIAAVPAQVGACAHDLPHRPPRVQAWGRRLVDLGGVGRGRLLHQAISSVGASTSSTCQGGHIAFGFHLSTHQRGEGASLRASSGTTPSD

SEQ ID NO: 9396 - protein, 346 aa, Chlorella protothecoides
MLGRLKLHEHPLDISLTAGHVVVGQALSVWTRGSTHGLHLWYAEQIHCLWHILRAMMVQALMPSPPPPPATPGSGRRHAILVGGLSDGMLFTAYCTPLARRLNAAGWACVQPLLSSSLSGWGLASLDQDAAELHLLAAALGREHGAEGVAILGHSTGCQDAVRYASLYAGGKDGAPPLMGLVLQAPVSDREFLGKQQSTAALAQRAQRMVEEGRGEDLLGRADALGGTPITARRFVALACGGGDDDMFSSDLSDAQLRVRGMLVEDGEQCLEGGLPARHPFQLRVTMSTRLREADPLDNSFDSHCAPRILLPLHITLPGALEGRCLGAIALPPGRSGRMLPGWLRR

SEQ ID NO: 9397 - protein, 228 aa, Chlorella protothecoides
MATGLALLLELPGLPISSIFRVHVPLAPGSSCMTDAEKDARARGALTAIKALSSTAVPFLARIADAWNLELVCSKARLEGEGELLPLPFIVDVPTGTSIAMPHPDNLLIPMQAHVGAIYKLLLAQQAGLGIAMSRDVRAHVQVGALAGAQAATVARWVAESALERAGWWRVAQEHLLSACLLEAATGERLGQCLRLGVEAVDCVSPTALRVFLRTGGMRMVPEWVDRE

SEQ ID NO: 9398 - protein, 222 aa, Chlorella protothecoides
MAGNPALDVLLDPDQGILGVIARGLIPLSGSQMNTSHSRHSPPPHPGPLGLASSSGRPRQAHTLRFQPPVHSLARFRGQAAACPVPSCHPATWQTLQQALDMEAIRRAEAGRLDAGDKGSARSDAVAASREDTPPGLGPGPTRPVVPLTLAERLQLAKTAPSAALKPQRSMSWLDGLKERKRPMGRQTVGGKDGAAPHSVLYCFHEGYTNAVRRPVRMADLL

SEQ ID NO: 9399 - protein, 239 aa, Chlorella protothecoides
MQGKPTCVCLNPPAPGTPHQPPAAIAGRASEAPAARQSRLLTLLQDFGEHDLVLRGTGSPTPPSLPRPFNPGSLQSSHSGVHENLLSLRYFDLACSRTAWALFALCDADRLLGSCYASGSWGAARYVPAALLSAAGEVTSVERWVLGWESLERPGKACHGVAKERSGCKAEAGGAGGAAQSLAVCHVAAGCRLPCPPKPGPGESKLAGIDQAFSCVAAKALSAAADCHSRALQGPSDLD

SEQ ID NO: 9400 - protein, 80 aa, Chlorella protothecoides
MQTERLAQRLAYLCACEGLRCEKSTLRTLAEMAECDVRSCLNTLQVAPERGWGKGSGGKAKGMRLQHPHAQPDKTRTGGF

SEQ ID NO: 9401 - protein, 274 aa, Chlorella protothecoides
MGSALAFTPSPSPLVPLQASISGARTLNAPQQTRAKVAKPVISCSALPSRQACVGPAAAAALALALGLGAVEPAQADVAGLTPCSQSKAFAKREKNEIKNLNRRLKNGPVSHAGRPCATMLRVPPLPIPHPPSHTHRIAQYDEGTAPAIALQANIKNVERRFAAYGRGNLLCGNDGLPHLIADPGLALRYNHAGEVLVPTIGFIYFAGWIGYAGSKYLQETKLAAKPFNREIIIDVPAAWRNLWEGFLWPVRAVADWRTGNLLADDDKITVSPR

SEQ ID NO: 9402 - protein, 190 aa, Chlorella protothecoides
MGPAAAPDPLGRPQHKIILLAGPPGLGKTTLAHVAAVHCGYRPLEINASDDRSAGALGPRVAAAATMRSGAGAIAALLRIVQAPPVARAGRGLVPGAGAAGSRSSHEAADAASSDGESDGEEHPAPAGPEKRPKGRGKAPGPLLRPIIAICNDLYCPALRPLRDVARVFHFRKPTVRVGAWVAGCGFAWR

SEQ ID NO: 9403 - protein, 285 aa, Chlorella protothecoides
VLLRGDDRVALFDVARRAVVAELAAPGVRYVAWSEDGTRVALLAKHCVTLAGGRDLADPASVHETLRVKSAAWDGSRVLVYSTLNHLKYALPGGDGGTLRTLPDPVYLVRAEGGAVHCLDREARPRALRVDTSEVEFKLALAARRYDAVLALIRRGALAGQAIIAYLQEKGYPEVALHFVRDERIRFGLAVECGNVEVALASAQALDDRDTWYRLGVEALRAGNAAIAEFAYQKTHSYDRLAFLYLVTGAADKLAKMAKIAERRGDARARLQAALYLGDAGEQAR

SEQ ID NO: 9404 - protein, 271 aa, Chlorella protothecoides
MPNPPHVGGWTIRSTGPSTSSPSTSATTQSGLVPSAWRSIAAMASPGSCCARFPRPLCGRGSPIATPTSWSRTTTSSCPREVPRLPGWAGLAITSPCRPADCCAGLGEPRLTHRNPPLPPVPAINVAFDVASQYRLALSQPSVCRHPDSYTFWTQVYQDPEKVLRYTAFVELMAPIFDMPTVTSVLLPNLDEDTATGYGEGVVWCGENDKVAQMESCASLAAQHGPSPPSLDPLQPDTHPPIAPLAQRWTLCGPSSSTTRGTGSGWWMQPA

SEQ ID NO: 9405 - protein, 447 aa, Chlorella protothecoides
MAARRPTPCPFSGRDLVELHASSNHLVVTWSDWDNRDFVRNWVYHLHKAGCSALLVGATDTQLLEWLFEAGIPAFFIEQKVPSVVSQQGAKGKGRVEAVHPMRVHVPICSHVDPHQLQPHLRLSCSIWQSPARVSLLRAFSELGTNVILSDVDAVWLRDPIPFMQMYPDADILASSDAMEHGSPSEKLESSTNLEGPASLAVLFMRPSARKFIMLGVQGGGHGLGASGYPEGPCLCLRLMEWRPFTSTLPSRQEWESALPSDGRSGERAAFNDLFHRELVQLTRRNDNLARWAAGCSPWAGCGELTHDACHPLRRKSAQCASQTTAPPFGSVFRGTLLGGILSTSAFCSGQAYRAGLQQRIHVRPFVVHTPHPGPGAAAEKFVLRELGLWRVRRGCGACCEKVCAEGAGPVAGEARLRDMVHTCAWDGFTAAAAHPEPQRIERADSH

SEQ ID NO: 9406 - protein, 371 aa, Chlorella protothecoides
MSRWTWCSPRWRATFCSWTSHPPIPPGKGARPRTYFPPLFKNKSQRCLNGFQVADCWAIGANWGCDPTPEHLTHADTHDSCARRTSPPTASQGEQEKILRNLQTQARSCQQLVLWLDCDREGENIAFEVGAQARPSSVVHSSQQQAPQGSLLTHLPLPGHPSMFEGQPTSSSKARSVLRWVRVVPLSIGTCPGVQHIVFERGSSGGMPSAVRYSTVVAASVLQQTSSRSHTLLASPAFRPSPFPLAALVASDIMRAVNSLGPPNERDAMAVDARQEIDLRIGAAFTRLQTLLLQNKFDWSGLLPAGRERMLLSYGPCQFPTLGLIVQRLWWVEGAGSGAWGDRSCRGPAACQGGCTLVRGHGHRTVVGTDG

SEQ ID NO: 9407 - protein, 267 aa, Chlorella protothecoides
MEQHGIGTDATVADHIQKQVSGGGGPDGQLPSFHPWAEAAGAEGGALKDAPAGGMSAPLTMGCGAIRAACPSVLTHPTAHSPPTPPSNRSLNSQLERGYAVKDEAGQSQTFSPTPLGEALISAYSAMGLTNLWQPQLRGAIEGNILAVAQGARTKASRVARPAAAARAHFLTEAPRRTPHPLQESVLAEAILAFQTDFGSAMAQAHVLEAEVREVVFGSVARGAGAGAGARRLDAGERQGEPGGPGLAPGSQAFGGCSCGGQLVLSR

SEQ ID NO: 9408 - protein, 78 aa, Chlorella protothecoides
MPGERIMRYAEELYQAGAISYPRTETDMFDKQYDLRVRALGSERHGGRTRGCCSSRDVCLVLLGDWYKIQDPGQAGPG

SEQ ID NO: 9409 - protein, 146 aa, Chlorella protothecoides
MTEKEEAATPPAGELLVCGATDYWAIGRTKDVRADVYPNLQLPHKFKAMQVWVLVWEWKGAALRSVLLPGLDLKQAPLLTHHELRRASACYTWGRNDKGQLGLGDTVTRNVPTLVPGLKGKKVVGGGCGRHHTVVFTDDGARGFAL

SEQ ID NO: 9410 - protein, 431 aa, Chlorella protothecoides
MAFLEQHVPQPVTVLGASLGGAVAVDFAARYPHAVNGLVLLDAQVGFTATTWQGGTGGPASSRSTCLPLQMQAAAFQVHRSTAVGTGPPTTSPPSPLSTGDEGWHRHAEQPAPDRGAAGREGAALALAAPERLRHVVPRPGCGCGGGHDRDRAAAHARRRLGGLHAGLHALRGLPRARQAGAAGGAQPGPVGQAGPGAAGGEERTAAGGGAAGRAAGVGGGLRAPGACGAPGRGCLPCAGVCRCEGPGCACTACWGRFCSRQWLQVRGGGAQGCQWLGSPAVSSGRSFGSIDSQEESENAGQRGRADLKLLSAKGWARIQGQTNLLGVRNLAGAAVGLLLGYVSCLDRSSSDLRQHRREITRANTSLDRWGEGRASEFHDQQGRSIVCSAQQDVSNRIAAPRPQGISELRPEEPWCRLVTYTYSPPPSFPS

SEQ ID NO: 9411 - protein, 140 aa, Chlorella protothecoides
MRLPHAAWTALPPGAETARGGADAALVFDGLQAALRYAEDQYVSTAVRYGLCRPPLARLTLADLVRAHLDKLPVVAPGAADDVAATLVQYLDSRVLQYGEVLWRLDAPAQQMFIVEKGSLRVSGGCGCCGAALAPPGAGI

SEQ ID NO: 9412 - protein, 179 aa, Chlorella protothecoides
MGPPNAKARRRKHHHPHRMPTCKVGEGVASVDGPPAPAAGVVPQEHVAAIRDPTAHALLARVQRVVVSHPRLGPINTAFVGPRQPDPSRPQVLLLHGFDSSCLEFRRLLPLLEGHVDVYAMDAVGCGFTGSSGLPLLHPTTLGEQCRGTTLRLLLSEEPSGLSTEVASAEECLSRTLTV

SEQ ID NO: 9413 - protein, 433 aa, Chlorella protothecoides
PPRAATATRKLLRRALVDTIQASPAPDLDVQCACDLCPGALPHAEVLARMRDSRFCLVLAGDKPSSRRGSEAALSGCVPVLVGPPWHTVALADDIDHGASSVFISVRRADWVVANASLGVPDNHPDVLNSWYLDAHLVPSSVIQVDSLAEVLGVLRGMPPEVLAAKQAALARQAYRQYWLPPPGETRSQLGEIVVKRLCDHAQMLKDKGPLSRMPAANPVILNSCSWNTARPPRPVCVVDNGVHRLRLSECPRGGLPVPTIIREGQDGTLSRPTLIEIVAGKVCCVAVTSTERIRVPGHEGKWPEQAQEPVSQRSLRAKHHCECWISLLSFQSSVLSGDPLDFDIPTATRAGPEESCGISPGSTNVRLQVGTRHVIWYRDVGGGDPPWLRPVDSGGIGPGLGLPRDPVHEAPTRCRQAFTACGTHPLQIWVVL

SEQ ID NO: 9414 - protein, 299 aa, Chlorella protothecoides
MALPAALLSSRASPANLAVHTALPPFPPWPPALPPGLCSCTGVRLPYFNPPSHASCQPPHTLPLPTHTQPRSKIQRRAVVQALTALNKPDLDLSCACDICPGALDHDETLRRMLRSTFCPVLAGDAQTSRRQVEVILSGCVPVYVGPGWHTLPLADAIDHAAFSVFVHVKGTVPWIVTDPAKRTALNGPTLEREWYMDAELGPGQVLEVESVAGIEAALRALPPEVLAAKQAALREAYGQFSYRPAPGEIQSGAGRIIVENICRRARAVKRRRQLDNAAALAAEAAKVEAAAKAEPAKP

SEQ ID NO: 9415 - protein, 73 aa, Chlorella protothecoides
MPVWPFKAGKRDPPTFFATDAWLGILTAMVMGLQHAMAMVGGLITSHAQTASGLRAAWRPDQPKTNPEDSNTP

SEQ ID NO: 9416 - protein, 164 aa, Chlorella protothecoides
MAPATKLIRTVLVCVAASGHSLPTNCTQFLASSLPSPPPPHPHPIPLSSPPAFLLWVGRALLCNEDLALPRVAPSPQAQITGTPDSDASCSIYVLDPVQDLGLPRCNFADPAVWPFAAPNNKLQASGPLQHWEQQHAVNYWVAQAIAMSGYQTNDRHGADMVRG

SEQ ID NO: 9417 - protein, 157 aa, Chlorella protothecoides
MTTFLFANVIASGIKIMISQHFTRRNRFVIACALALGIGVTLVPNWAQNNLWNNPNLSEGVQGVRDALILILETGFTLGALTAIVLNLLLPDEKGLTVPEPDTPDLSVQGAEPSVRYSSKPQGKDPLQSQDTSMHMTKDYSTDMQKVCVCEGLGQSF

SEQ ID NO: 9418 - protein, 553 aa, Chlorella protothecoides
  MOD_RES (410)..(413): Any amino acid
MCRARNSAVACTSTRRRDGPKRPTHTCMQRADNLRKRTLLALQGGRRWEENFTRLARGLAAGIGSVDGGASPLFRKGSYHNALPLRPRAMGSNRKPTPAASVSNSEVIPPAQMPAAGGQRAREGTAKPHQPSNSTEKKRKRQGTGGEPAAAPAPLHAKAIDGDSNEIDDLFGKLKSKQSAHPKAPSCSPTCFGHNSQGSQAPKATADAATAPTTSTSMPSVTVKGSKDDLFGTEPGQGRKRTEEGYAVYTEEELGWGAGQAAGYLGGPWRSIIIPTFRMVTHLLCAHRVFDYTPSQLATGEDSIPSKRGLEQRQIKGKAVQGRSLPGRGNKGSSGDKAWCACTVQNAGKGDSEAAGSGGSGRGRARRRSFCNGRRDDGGSGTQSAKSQSRHRPKGSRPVLVQTHDVSLGXXXXAAGSGGSGRARASRRSFCNGRRDDGGRGMQSAASQSRHRPKGSRLVLVQTHDVGPGACQAVPVLRGGQAWLAPPPHTSPVPRRRSAQEGDDEVLEVEQLPHVHVAGGEGGDGSQVHLARAAHEPGRGRRLAGGGREAQAT

SEQ ID NO: 9419 - protein, 502 aa, Chlorella protothecoides
  MOD_RES (58)..(60): Any amino acid
MQYDIINPQDGWKGAIAGHACLDDVGGLHSTGWVKWQARPPSPARCIEGDGGRDASRXXXVVALDDDSQAQHAALRETEAETRAVLSGSKRGHGEVDAAPESQPVPKTEADYRTAVKQAAAALEKSAGSVAPEPEAPQRGAGDWQHYQPPSAVLQAVKEAKTARALPPALAARLAARGIVQRKDDTGGPATSSTAPAAAAGAAGAAPGGGPVSSLPPGWYSAVDATYNTVYYYNPGTGERSWERPAVRPRLPPGWEETRDPTSGKVYYFNAAAGLTQWEHPGKAGAVAQASGGAGPQQVPAAQAGPGAQAGTTVQAGPAVQAGPAVQAGPAAQAAPAFQPAEAFAGARPGAVFKLGPMGLGYYADAPAPAHALGEDWACVGWASCCAKQPGPLQRRINALHNIPQRTLMPGQGCAQAPGQASRGVPPAEGGGQPGAGRGSGARASGRDRGPKREALDPMDPVSGGEVFRWSRGGVEESHARSLVCAFLGRPGCAFIGDGPHP

SEQ ID NO: 9420 - protein, 603 aa, Chlorella protothecoides
  MOD_RES (339)..(342): Any amino acid
  MOD_RES (431)..(433): Any amino acid
  MOD_RES (595)..(597): Any amino acid
MLRQASWALQRACRQGRVAAGTCWAAPRSFTEAAVQSSAPGDTQDAIEFRESVRSFAQEVIAPHAAEIDASNSFPKGVNLWKAMGDMGLHGITVPVEDGGLGLGYLYHCIAMEELSRASGELEPARLSRTNHDSSLPPPAWHEGHISQPPHLPPPVSLRRPGAVALSYGAHSNLCINQLVRNASPAQKARYLPDLIAGDAIGSLAMSEPGAGSDVVSMRLRADRQPDGAFLLNGSKMWITNGPSASTLIVYAKTDAEAGPQGITAFIVERGMPGFTTAQKLDKLGMRGSDTCELLFENCRGAPAPRGVEEGIEAGCRPIGGCLPARARGRPFLPSINDXXXXGALHLGVWRRGSKLVADQSEDAYPHEPAAVLSSLPSTIPPNTDHHHPGRVCADERAGSGATGPLCWTPGTHAGGASMVWQCFGGWRDPXXXRADERAGSGAPGSFCRTPGTHAGRASMVWLWLLHAHGDAGGPREDWMPVQAWQCFGGWRDPAPRMVMWSDISRLPSHPFPGMSGHRPALRPRKEAVWKGHRGVPGVWGVGRAVRVTRGCWPQASRPESQVCASARDRSVQDSTGMVQQGSVLPWASVQPPPXXXGCGQSS

SEQ ID NO: 9421 - protein, 150 aa, Chlorella protothecoides
MYATSRATRAFIYATAAAADAGHVSRKDCAAVILYAAEAATRMALDGIQILGGNGYVNEYPTGRLLRDAKLYEIGAGTSEIRRMLIGRELFKDSAAPVPEPRSAPLARRAGEVAGHETKYTKMHTLCLLWCPAAPQRSDTGGLAQCCMDF

SEQ ID NO: 9422 - protein, 642 aa, Chlorella protothecoides
  MOD_RES (193)..(196): Any amino acid
  MOD_RES (257)..(260): Any amino acid
  MOD_RES (354)..(357): Any amino acid
  MOD_RES (513)..(516): Any amino acid
MFTGVLREQNFQIPVAGTVRPSHVSRLTQVRVSLCHPRVHRTSAPDAVPRPGRTCIKLFVNAYQGLSRSEHINALLGIPIYYESGCMLTLESHRAMTSRNVPKAVGHLVLAATLALLWSEGALAVSVEEIMGATLWDCIPPYISSDRVILHVTCESLVNGALCVWSAGILSVSIVAHSDSSPPPCSVRHGACXXXXLLPQYYVSLGQVQTAPIASAGVKAGMQRRERMPSRCSGVAQGVQKAGGIHWRRICSHLLPXXXXPPNRPINRMEGFTGAGSVRTSSLTATGLSVGVVRLGLLEVDSSPDAEVLVAVECLSAGQSACVADEDGNIGAGNQGRRNFGRNNQGDDNIGTGXXXXIGERARTLCWQSTALRGNLSIPSIRDRLSTKHLTLHGAGNSNQGSVNWGDSCVGDNLRCTHVAQSSVPAKEATHRSITQHALARGREAAPFSRRLLQAASGQEQAVRLTKATPPSPKKASPSPAKRMPPPSVKKQPPPSPKKQPPPSPKKQPPPSXXXXNWGDSCVGDNMRCSHVAHSSVPAEVATHRQEDATPIREEATAFPQEAAAAVSQEAAAAFPQEAAAVFPQEAAAAIPQEAAAAVSQEAAAASPSAHAVTSSSDCSVAPPSVHPVATFTHHIAASTTQ

SEQ ID NO: 9423 - protein, 157 aa, Chlorella protothecoides
MSPPTPPVSLILHSTDRSQDAHALVRESVVAQLRRQPGMYQEYVPQEYRGYCDDMAQPQAWGDHVTLQAAADCLGLRIALVTSFPDTAFLEIAPRGVLRSSRVLWLSFWAEVHYNSIYPKGEAPALFMGPSAMPMSQPGRSQAKFLGSKRLHHLLIG

SEQ ID NO: 9424 - protein, 198 aa, Chlorella protothecoides
MLPLLERLLHRSRRLAAMYVLVLTPVRELAVQIHSMTQKLAQFTDIRAALVVGGLSLQAQAASLRTSPEIVVGTPVSGLTRRASRGDDGEGRRTWGVHRGGAGWVLPCARPGMLPMGSEVETGEAKARSGQHPMPITSRRWSQGRVIDHVRNTQSVGLEDLQALILDEADRLLEMGFADEVRPKPVLHEQLLRVILHC

SEQ ID NO: 9425 - protein, 283 aa, Chlorella protothecoides
MTEEVKKLVAVSLNRPVRLAADATAAAPKELTQEILRLKGAEASQKEAVLLALCSRTFASGRTIVFFSTKQRAHRMKILFGLGGLASAAELHGDMTQAARLQSLEAFRRGEAAFLLATDVASRGLDILGVETVINFDAPKQLPAYLHRVGRTARAGALGRSVTFVEDEDRALLKAVVKGTGVQLQQRQVPAAAVAAWQDRVERMSDDVRSVIFEERDERHLRRAEMETQKVRGLGGGGKGGLGILRGRNAHAELKKVGQASLWCAGERAMHLATLPPPDVPVL

SEQ ID NO: 9426 - protein, 223 aa, Chlorella protothecoides
MEGRKGRPRARAGRHPPIGRHPASIPSSTPRGAGAPCIQTIPLAHLVHLPHHVLGRHPAILKQELAGVRSAHAKLVQLLRGGEAGHATLHDEGSDALGPRLGVGLGVHDERGGGGAVGDPHLGAVEQEGAVGLAVGAQAHGHHIRPRPGLRHRQRADGVAGDKIGQIPRLLGGGGVAHQLVDAQVAVRTVGQRHRAWTAEGNGWREVGGLGYVSLMPGRGGEG

SEQ ID NO: 9427 - protein, 66 aa, Chlorella protothecoides
MWADDGLKLVPQINSYQPGQGRQPLDPTSAGRHRLQLRLDLFGLSERPVVGDGACQFRALADQLYG

SEQ ID NO: 9428 - protein, 183 aa, Chlorella protothecoides
MHLATLSPPDVPAANLIEHESEIFSRPARTWFQSEKEKRSAAEAARVADTPLTGKQQKNRDKYQKKVDMKARAAAEAAERKQGNRLMEETEGLSRTIRAIKSREKTLRMTGIGGAKTGKMAAGMVTGVKKKQGKKKVRGDSGGRRRKGEGASLSVGILGGMWWRGGQEVGAPWCQLLAAIRKL

SEQ ID NO: 9429 - protein, 542 aa, Chlorella protothecoides
MQKAILVPHPPFKVRKSFNTTNNQYHPNLLLPVWPECVSYAILHQQGYGRSLSGEYWRLERDAVSEARIPLLKNYGPSKRLSHTYIQMFTELDRYLPRSVDEESSRASGRSPRIWQTAERSAALYRGDLAANVRNGNSKDDGSSQTGIRFPVVWASFMYHHFGGEDNMCSVYAYCGEPSSTPLEPEGPPSHPFCRNHVPPSSSLSPVPCRQSNVLWGVNYFIHGIRAGTGFPRGPSGQTGRCLSASCTLTAQRSFAGVMSEASMGSAASPTKGFSKSGGLRTTTLDTMGVSMSAVRLNSLNILSTRSTEMIVAVECLTAGQTACTADANGNIGTSNKGKRNFGTRNTGDDNVGNNNTGTSNWGDNNRGKGNRCFDKVADRKVVNDCNILEFWERAIDLYYPPPPKASSPPPPTKRSPPPPAKKSPPPLPPKKPLPLPPTKSPPPSPRKSLSPPPSTKKTPPPPSPRRSPPTPTPGKSSPPPTSPKRSPPPPVRFPPPGSARPPPPSPMLPAPPPAARSPPPSPARRPPPPVKAFPPPPAVRP

SEQ ID NO: 9430 - protein, 273 aa, Chlorella protothecoides
  MOD_RES (31)..(48): Any amino acid
MADIKGRAVALHTCMHVATPGEERTSENECXXXXXXXXXXXXXXXXXXSRVKRYHRRLDAGDTPPVGHRLNPLSAQCVCGQEPATMGEEGSELWEGGARRGAATVRSAGRTGSFHEGVIADSTSMKLQSLLGCMVGSSDAAWGKGRPPMAGGARSRTTIPSQCLQDFKKSHLGSEWKKPFAGASHAKGIVLEKIGIEAKQPNSAIRKCARVQLIKNGKKIAAFVPNDGCLNFIEENVSGAGHLSFCHWARRLDRRAWRDAKPPNPMPSRRTRC

SEQ ID NO: 9431 - protein, 628 aa, Chlorella protothecoides
  MOD_RES (7)..(10): Any amino acid
  MOD_RES (502)..(504): Any amino acid
MLGTCSXXXXREFPDLGQIHPNPRAAEGTLRTRARRDVRHVPDDVRKRARRFTDCSKPKYPNTVCVVVCDTPCHMRVLLFAALALAGFAAPASAAEAVPLPEDYTTACSRDVMWNITSSDHTCSETLTNYLDPVPSCCETLATYYGPKSTLPSRNCWCVPEYFAEQLALSVVHYISVPTYLAGCDTRLPCSPVSQRHRRKLGYPIYYYQEGAGPCAGVSAADGAATTGAASAPVEGLPMRSFGAWVRGLAQYKWGAVMFTVAILAGGEKVMSPPASWALPLTGHAMSAWDRAQHPTWGALPCRVALRRRAAVHCGCASRAGHWLTAWTPAPPDPTLLSNLCSHWLLPHGMGLHLRCRHPVEQERDAVLTCPNAGLDCSPRGGFLHRAHAWHAVASTGQEEWLNGCWLSSLAPPSHAALGTSQPAHRPLCWSSRICVDACPMSEGSIFRWLHRPHPATPRPLRGNLEFQCFSFQTAPTVTFQPVRVVSNLGVLPPINSNRPRXXXQTAPTVTFQPISVVSNLGILPPIKQQQAPLDLDTSGCVQGDLVYRQPSYVASPSCHGTGPAGTHQPPSPPARMAMEGADEQSGNRAVGPWWRHTVCAASMQMTRHEEVLRGTPTARPSSSHHKP

SEQ ID NO: 9432 - protein, 61 aa, Chlorella protothecoides
MSLTVDMAELFLPPLAVTARARRHEAAVVAATLLCADAAPQLRDAARASRVIVLGGLRCGG

SEQ ID NO: 9433 - protein, 95 aa, Chlorella protothecoides
MLNILSYTTGHSVEKLDKVQWGGRLQRSGGMASRALGCSPALLLGPSDLQRPLYMQPKDAIAYGVCDGIVTPERKIVDDVKKPEEWDREAGLVQR

SEQ ID NO: 9434 - protein, 304 aa, Chlorella protothecoides
  MOD_RES (157)..(160): Any amino acid
MLSGAVAAAACNPTDLVKTRMQTAGARQGVAQVVRCVVAAEGWAGLWRALAHPALTPHPLHPNCQARAALLTAGQCATYDEVKLLFTRDLGWEDTLGTHFAVSGVTGLVTTTLISPVDMVKTSMFVGERMRPWACAKGVVERHGLRGLFRGVFSAPXXXXGWRVWVFVGEVNGDLVGCQGVLSTSARPCRGVIRWEGDVCCYMSRLGAGTMSRIRTTPACTRSRHAEGQMCHPCGIGIERMLPDSYACKLCILPWVSVSLEDRVPSHAPHGARARGSSPRSKSRTSTSTNHRCHAQCADDARAT

SEQ ID NO: 9435 - protein, 584 aa, Chlorella protothecoides
  MOD_RES (104)..(107): Any amino acid
  MOD_RES (551)..(554): Any amino acid
MQRKDAGPGLQNGAQILQDEESEVYDLERPMEDAGKFIDTKGAGLSLFSPGWLTQLGRLWGGSSVGLGGVVYETANPVGLHIEHPAPSHPAGYTGCGGKASRHXXXXMMTHFPAQHCPREGYSGYCLLPVWFNETANPVGPHIEHPAPAHPRRIRRLRRQSQQTSRTCSVAHCSVPSTSGWRRVGRCTCCRQGIPENVALACTVLSKRTSVTALPIPVETGHSHLPHTLLALRPGPASSFLVISDPQAAKHVLRATDNPARPLYEKGLVAEVSRFLFGDGFAISGGDAWRVRRRAVSPSLHKAYLSAMLDAVFGPSAQHMTQKLEVGVRGHGLPPRHACPAPAQPSHPVITPTPCCRSGGGAHRRLPGHGGLLLPAHPGRHRQGGVQLRLRGADAQLPPHPGRVHEPEGDGVARHRPGPHLEAAAGGPRGAPPAPRGGRREADPGHHGAADRAVQAHRGRGGGAGAGDGGGGGAAARQGRPLRPALPHRLARGGHQHPDDGLGADVDAAPAGPEPRHAGQGGDRGCGHGMGRPLTQRDPMSSRRIGDLDRXXXXRAAGGSTSSCEGPVRALCPPVPSLAGPPPT

SEQ ID NO: 9436 - protein, 110 aa, Chlorella protothecoides
  MOD_RES (12)..(14): Any amino acid
MQLRDDLLSMLXXXSSTAGLEHGVVSPESLFPPSPTPAQAQEEIDRVLGASPYPDLAQYQQLQYLQRCVAESMRLYPHPPVLLRRALVPDELPGTWLAGECGASDVSRAG

SEQ ID NO: 9437 - protein, 123 aa, Chlorella protothecoides
MPSEVLIVEHHRGMDGMSDSDVLQASDIEPLIRNGIQATVHGDWNEEEALVWQEGIGTACLKLLAGLARPYKFAVTTHLSQRAGAGLCSATAAHWNPNTDGHIAVIWTSDTVFVCVTVFWSAV

SEQ ID NO: 9438 - protein, 82 aa, Chlorella protothecoides
MPCAPVPASHLCLHHLPTPHSTTPRASGGDLVDGARAVLAHALKHRTKDDVSIVLARVLPEAEWEARSPPRSFSSGPIFGDP

SEQ ID NO: 9439 - protein, 151 aa, Chlorella protothecoides
MGAGLPDYVIFNVGPVPLPPDMEVSLQTLCSARIINPSGREARLPLKDGSILAGPRSGTIQVLAPLQSSEHQILGNGKLTEPRTYRAAAFSESARASIEAAGGQAIIEPQKTKWRRGAAAWAKAAGEAAGTAPKQRKSRAVKKKEAKAGAS

SEQ ID NO: 9440 - protein, 185 aa, Chlorella protothecoides
MLPGAGPCPQRWLPPRGALQPCPAPLATHARWILEADPDAGLQMFTSLPVDPGALLPILNSHAPALAGGWRGGLAGFVPCTGRADAALLPRPCPMPAFAPMPKPLPCRGRALDCPAPSLPPPWQVPTWRRAAPAVYQQQLAALYLRHVVQHASEDPGDPEARGLAETAKLKQLVGWGGFLGGGDE

SEQ ID NO: 9441 - protein, 104 aa, Chlorella protothecoides
MDVEAVLALKLDVLAGPCRDASYVTEDDTLEVTVGRTPGNSLALRDGEVSGRHLAVTWSSLDRCWQAADLGSLNGTLLNGEPISVGARQRGPDYRLSSDDILQV

SEQ ID NO: 9442 - protein, 325 aa, Chlorella protothecoides
MGSHLELAAAVVPRCRGPGSSSAPSRAPRSREYCCIAPAQSGVAHLAQHASASPCVTPVSASQVLLSLGAESGLFRLPDGPRPPHQTASLAWSSPPASVAVAAPFALGALGPDAVEARPIQALSGAALVQTLALEGGAGGAEPAGADAGKETSAASEGTSGPALLCPWPLADGSCLVARAGGRLVRLSQRPALAQAAALLELGEYEECLAVAAAAPAADLEARRRLEDVAHLRYAAALFWAGEFEGSMLHFGASGAASTLALLRLLPSLASPGHLEALAAQAGEELGAPGGARWGWGEWSAQLAACGHTGVGRLSCRRSSARRNR

SEQ ID NO: 9443 - protein, 198 aa, Chlorella protothecoides
MSAGLKNGDLQILKPEEHAAALTAAGFTTQTRRGLTSGPVLQLQTDETRSMLFCMGKQGVRVYRLPRLLLKAEVAGTRGCRAFAWHSETRTLATAYRKRWGGGEVGNGWGGGASWCGRGSWLQLLRYVCLAQHPSFPSPAFPGVPSLPRVYFFTYEGLEVYFFTYEGLEFVPSREVPMSDTVVCLAFVGAQLVVGLSG

SEQ ID NO: 9444 - protein, 141 aa, Chlorella protothecoides
MGPVLWPQGEEFARAVAVVLPHLLSQRNREAGASPGGVPSPAAVAVDTAVLRALLALPDSGALLHFIQRPNHVDLEEGRAALRAAGRYSELVALYQVCVGGVALVRTAGLGAIAGVIRGSCRALQLDSSLAGVPAVEFMVN

SEQ ID NO: 9445 - protein, 177 aa, Chlorella protothecoides
MPAPQRRASREDCHQLWLSGVVRRARAGPACPAAALPHSGAASGPMLAQLPLQPSLTPLNTEKDVACAQCPLPDPGRLGEASVSLFCVFDGHCGRGAAEAAAVALPEEIGVRLPACEADMLEQRGAVSALRPAFLATDARIRAEEGCTATAVLAWSPRKGTVCLQVAGGQWGFVCLQ

SEQ ID NO: 9446 - protein, 94 aa, Chlorella protothecoides
MATASEWPEESMGERLRLHNLSPQPGSRKARNRKGRGYGAGQGGSAGFGMRGQKSRSGSGMRPGFEGGQTPLYRRLPKLKGIAGGEGSRHVLWL

SEQ ID NO: 9447 - protein, 1220 aa, Chlorella protothecoides
MHGVVQYDTLTGKQKKGSGGPQSYTNYFADALVAEAKRDARVLGIHAAMGGGTGMNRFEAAFPDRVFDTGIAEQHAVTFAAGLATEGLVPFVAIYSTFLQRGYDQIVHDVSLQSLPVRFALDRAGNVGADGATHAGAFDVTYLACLPNMVVMAPSNEAELVHAVATAAAIDDRPSAFRFPRGNGLGVDLAAAGVSDDLKGQPMEVGRGVVRRGGADVALLGYGTCVNACLAAADLLAAQGVSATVVDARFCKPLDTALVRRMAAEHPVMITVEEGSIGGFAAHVMQVGFLCVCGGGVKCDQSISFSRCVEGRGPVPGAGGAAGRQAQVPAHDAAGPLHRARDAGGADGGGGAHRLPHRGHRAERDGREARRALHLLHLKRCQMRSWRCADGCGEECTLRPRPIVGLAQSSKSQAPTIALIASKHACMGHRLRCVSTGGAPRREPFPFLCLHRACVTPRWRCEGQWCRVVVRAGRIQHRSLPASSVFTAGLVRSLAFQAGKGKCRCKQCAGKLVQGIAVMYARMGRRLPLTEPRARSEVKPGGLVTPVVCGGERGQHGADEALVAWKGRHGAQGPGEVEARQQGSKDDHDAARGWKLRGQCNVRRPAPDDDGGVDAGGVHLPVAGARVRWRLLVCRVEEAGQRVGHFAQVPSPWAVSAWPATQAPHQTASRTWAEADAAREMARNNRTAGAARSRRILAASGECSGKCSGGYALAQVVVVGVQAYADNAKLLPAVQLQELKLSKELKGRRLGLRSNTLRRQLKLGIVPFTADDHWSTLRRVAGWVASKTLQMSDLRHPSKIFGSARSSFRQPVHLHLQPRLSPFNKFAERALASRNFIPVEPGRSQEEDREAESSGEVVHTALLLCCTPGLADTGPMRRGLEVHNTAPVTVPSSESGDASPARYIPIPRHLRIRPSWAEPLPVAFGGPPPSHFCGADAGLPALSRPAPIQAPRVLTAAPGLPTLPKHLQPHAHGPRRGPLAGDSVRESSSDSVYSRRDGVGPPPATLPGTNAQPAACRDRGALDIPVGPLARAAHGQPPSLPLSGGAFKVQGGVARNEARQDSAKCPVGGPAERQSLRASILALPQVPARWAPPARVPQLKDRLLRAATTLDPGSTADWVGPQQTCDLASHAAAVEGRRLAREAEIWQAALVTSQKNQERRDAPPPEEQRASSIIAGRPVALVPCEEPGLSQQAVSRPPSAHMLPRPPQAPAMPPPPPPPP

SEQ ID NO: 9448 - protein, 127 aa, Chlorella protothecoides
MPATHPCVPQHLPPSTHSDTPSNIKYTTHQANRQLRELREIAKGVTKQLPDVIQNATAKIDEYARGMISGTGSTLFEELGFYYIGPVDGHNMQDLVDVLSGGFEDGLKGRKGQSRKGSVHPMLCGVV

SEQ ID NO: 9449 - protein, 212 aa, Chlorella protothecoides
  MOD_RES (159)..(180): Any amino acid
EGADVERQLGALQLSLEAKERAALALAGHAALRDALSSQLAGLAAERDGLARERAVLLAELERLAHAGEEERARLADDYRRRLAALDRQLAALRQKERRVRELERLKARAEETCARLERDIAGIKTAKAALQRRGEAAAREHLEWQRAREREVATLRKXXXXXXXXXXXXXXXXXXXXXXPSLHRLQALSAKQQAVLRRKTEEAEAARRRLK

SEQ ID NO: 9450 - protein, 470 aa, Chlorella protothecoides
MGDVIRNNRMCDDLGDEIPAVIGPGLVSRMDHFVPTAACPSHSPSSRPSFISIPPRQCLQRPRTDRATVVLYSFWSKLYRHAAGIFVHRAGLHLRRGAIPAPAPGLSPGHMHGQEEGHPHHCHSRVHRSSGRGQDALPVHHAKGSKGALGWRGGIQASQAQCARSSLARVNMLSSSLAPSSRQNKRNTPERLEIMKYNRFLRRHTLHKEGGEEKVRGLQGWCVTHRVGIWSCQVVRCLLPRALPPEIGPAIKKGCDERVAMWERRGREEHPVRSRPPRRRAARPRLIDAPRWSGPPSLLSPSPPPPAAHAPLAPNHPPSNALLLEDELVAQGQRDALGLGPDADEAGEATVRAPLQRDVDQRVLTKHGARVQVCGQEPGVAAPRGGRGQAPHVGGGQHVVQVGRLVGEGGGHRHLVLPLELGPHGAEGRVGAGRRHDVVEDVDVDVVQHHHAGVGHGVGRDGRWRGRGRH

SEQ ID NO: 9451 - protein, 300 aa, Chlorella protothecoides
MYLLARRIKALGIKVVLSGEGADEVFGGYLYFHKAPNPAEFQAETVRLLCRLHQWDVLRANKAPFSFGVETRVPFLDKRLLEVAMELDPSAKMCDLADRPDGVHPRLEKYVLRKAFDTPDRPYLPDAVLFRQKEQFSDGVGYDWVDGLKGHAEAVVSNADWAARHKRFPEHTPRSREYYLLRTIFDRHFTHPSAFDTVPKGCTTHGEDRRVHECPAASPQQARPVPSLPHPDPHQGCSTLSPAHTTQGLSIACSTPEALAWDPSWENSHEISGRAITHVHAAGHGFTYQKPEVVNGFIHG

SEQ ID NO: 9452 - protein, 260 aa, Chlorella protothecoides
MRKGPVGCAFQGLQPRGLAPVSKDPPRPGKPDQARLLTPQHTRSPDGNGGDEGGVKPAGEEDAQGRVGHQALHHGIGEGLAQEVEVHGGAGHAALLHPPRVVVSLQLPGTPLCRGIRACGGWSRTPHLPRYTRRPPTTLPNHLSAHRGEDVQGFEVLQGLHLRGGPDGAVLVLAPVQGADAQGVPRDGELAGGLVPHHACEDAVQRVPQLVGVAMGLHQVPDDGGVGLGGDVDARQLLRHHLLEVVDLAVPAGVQGDGGA

SEQ ID NO: 9453 - protein, 445 aa, Chlorella protothecoides
MQSGCSSGFATLIPPPLNPPRTPTGRQRGATWSQADLLALRLSSPTPSTHHAPRQGGNGAYGLKLDERLRITDSIKLRAAVGRLLTKMGTHYEPGTAVAADLKLRNPADDSARVCGGRGRGPEKRGERDSSLPHAHHTARNVAGASLPSWRKVMHAGNDHSFCSGVCAPSCISDSLGRTQHITQLLLGGSAQWQGRDKRAAKQSLVMGGNIAGEVRLPKMDGTGMKSDTQVSANAQYTTRGQGTLALRINSHDVPQLAAIMLVPVLRAAWDKCFAREVQRPAPVAWSPLERSGPLQCTIPMPVWAAPVGTPLLLHELNPSPAVRRTFLPRTEVVEDGCQRRSTSPSDHRGLGWGRVRGKSCDRDGCSMLEFPFQENGEWQSYLPPLCLILPYRCAIQCYKLILVDLQHENYCRQVLRGRWSAEQQGDRKSRGALRRGTVPVSGAP

SEQ ID NO: 9454 - protein, 513 aa, Chlorella protothecoides
  MOD_RES (190)..(193): Any amino acid
MELPTASIDGLGSNRARLFSCVWADGHSEGDLCPEAPLALLPGPNFTYHHGQPGPRTGSGCPGLGADPPDRQCDPHEAPAAVRSEAHGRTQAQRATKAGGRAAEEHSGPQRPPPCQPRLHLGGGIPPAPSLFFWQGVGICAAGTASRKTGCGFRDTHRSGVLSVCATHLGSTNQAVPYSPQEGVLQQTFXXXXATHLGSINHAVPYSSQEGVLQQTFPAKGLNDMMGNPDAMQGMLKQQMGGLVPQVGFENAFCCSWLLHGGACCQGQLLGCILLLDAWSALPQTRAGGRCLDLTCKCLLARCAGPILPFSQVPAHASARHRPARPGPLLLHLPVLLHHGPVRAGGRVPPHVCGGRDQRRRADGPDADGRDGRRRPAHPGPGQGLRGRAASAGRGEDPGGEGPGERGQDTCVCARWPTVVGCFHCILRLSPGSSVQPWRHISPSAACMQHLQTQRRWGGKELLDCRKAPERPRSLPCQYISICPCSMMLSTTILALQQPSQCNRCPPQRTDAG

SEQ ID NO: 9455 - protein, 1074 aa, Chlorella protothecoides
  MOD_RES (28)..(48): Any amino acid
  MOD_RES (260)..(263): Any amino acid
  MOD_RES (806)..(809): Any amino acid
  MOD_RES (1033)..(1036): Any amino acid
AAAARAADVSGYPAGTHPATLDAALSAXXXXXXXXXXXXXXXXXXXXXGWDAGGGPRRAVAPHLGAACGDAAGAQRAGRPALLHGAGRGVRAAGYLRAAGRLGVRGRQPAHPRRGHEPVRGGAGRARPATHLPGAYPGRSRRAVGRGGRGGGRQPWRWRGGGGGSGAGCWPPPACHVGRRADAAPPSPGENVEGSGQEPLLGHGGGQADAGPHCAPGRAADGGGPGFTWWHGAQEVPGGRHRSAGEERCVCLHCAGVFAXXXXRSAGEERCVCMCTVLVSLHGPMPHSIPSILTRPLPSVLHSPHPETHLHTKTPLPNNPDAVACDAAVRLPVHQRHRGLPQHGGVHRPRGGPGGGLQRGQRGGGPGLRRVGQPPRAAPRRAAQARRRGGRRRCRREAVGPAQAPARPARAAPALPGRARRGQRAGRLLLLLAVPGLEHPAHLRAGQGQRPHRGRPGAAQRRRHRARAARGALPAGRALLRRLRGHGDRHGAGELGPGGRPRPGGCRKGHRGGFGKWWIGVPWEGGGLVCIEVSDWSGWTWRVGLPGSGRIGLQASLGCDGHAHAAADPGRAARRPCRHSGGHAGAGGDDPGRAWAGRGGHRRLHGAPARERAVEGHGLRPEDRVLRAHLARHARRAALGGGSQGAGAARGPGHQAGQQHLRPAPPLPHGAAHQGTPGLLPGQGPRHVHLHGRRAAGRPPARPLLVRPVRGHRGDRPARRPLLRPAPGRPRHEPDRHGAQSQAGALRLDRDPEPRRAQGRCVQPGHPRHRRLPAEDGGEGPRPAQARGGPAPWPGRGGGDGGHGGXXXXLRKRVEAQLPGLDEEAVTAAMEAVAAEHEVAPLNAGARALTLTDGAWGAAPVLVVCADANGGTAGLEPVLAALEMPAFVVKLPQDSALLESPSVPELARLCTKALRAHVPASRRLVLAGVGFGAVVAHELALQAAAASDRVLGLVLLEGRQAVRASALAWLPPARAAEVGQVASLLYPTVQAAAEEGGAAGGAPGVEAFATRLGSIQGFDGQLDYIALFRPHHXXXXRAARRGGRRVWRPLPRAWAPSRALTGSWTTSHCSGHTT

SEQ ID NO: 9456 - protein, 455 aa, Chlorella protothecoides
MIPPPYPNPSPLGTQEKTKDWDERINALLSRLAYFSSICAEYRPSDVFLGQTLAVTCGAPAPIGTVHAAWESIAFLVQPLESASLGAGARSGVSPGTALATELQGLLWDVVRRAEERAAQASETAQTPSASTARVSRRISVGAASEALPGGDGPVDTYTLVLPLNRLCPERRYILRRATALHSGTPAALAAAPLTRIPLWVLHGERGDLSSAQKELAALLPLPVYGLAMGPDADACATLAELAARYAAALRVLQPAGPYLLLGSSVGGVLLAHALACALRAEGAAVALVLVDGCVGAPALPLHDVSWYALFYLLREIGGLRGSMGEFVDVVRGAGSPAAQLKLLNSFRPPELADAEEAWDAAVYTTLDRAGLLKRLSRGPAATPPGVFDGPVATLLPEDRIGALFLAATTPHCDVDRVLSLGLTSRHTECLLTDRARRETAAAVVAALKSLLPQL

SEQ ID NO: 9457 - protein, 120 aa, Chlorella protothecoides
MFVLCTLEDKVRLAPKDLRLDTADAVTAVLEKTYLDRVIPDLGLVVTLYDLLEIGDGYVFQSDGGVHHDTTFRVVAFRPSQEEVLVGEVISQDERWGRLAWGLCEVYRLCTYMAASPHRW

SEQ ID NO: 9458 - protein, 200 aa, Chlorella protothecoides
GGAADEAALREAEEAEAAGEPLDFGAVVLVIGLRGTGKSATIDSLLGRSGDGGAGAGGAAASGGGYVPTRRVSLERGEVAGLRLTFIDTPGLEASAGAASRNAATLRAIRRAFDAHKPHAVLYVDRLDASRRDASELHALHAVSDTLGADAWFSTLLCVTHALAPPPDGASGQPLGQDAYLQNRQQQLVQVMRAVAGDSR

SEQ ID NO: 9459 - protein, 301 aa, Chlorella protothecoides
MMNPVALVENSPACARGAGGEPVLPNGVAWRRHLLMLCATTRVLNEASTLLKPGRGAKSPPGGARAPPGFGGGSMKVPPMAWLLAKLVEFRAPRKFPEDERELMRDDEIAGLPPAQREFQLRRRRVYLRQRADEARGEENAVPILAPEPALGPSFDPEVNNHRYRVLESPKALLTRPVIGEGGVDHEDGIDSVQVEKSAILRKRTQFLGGVPTLSWVQVQKDKNSLTFQGESDAALYHSTYWVSYASVNAQSLQRDVLYTGRLESRVRSKGKRQKFTVGLLASKLGEDFTLPPIKVGVCVA

SEQ ID NO: 9460 - protein, 404 aa, Chlorella protothecoides
  MOD_RES (141)..(159): Any amino acid
MGFHPHPPHPTYQPATTRCREFLDPAAVSQFNVEGTLEFSGLLYIPGGARRCSPWLTRCIEPDKARCTSCSLPAGAELRSPILFPRGCSSPVRGWVQPGVDDFCRKAAWRAACACHRLLTGGVIAVPPKKDTSLLNQPPPXXXXXXXXXXXXXXXXXXXDEFDEDLLPRWAGFVKGVVDSSDLPLNISREILQENRIVRAIRKQLVKRTLDMLNGLAEKEDKEVGWGRGVGRLRGQGTVLDLGCLGKAAAVRGDSEVDWRESANRPARWSELQGSEGRPEAVKWPRCRFLDPPITDSVRERPPPPPPPIRFKSSNSEEGLTSIADYVSRMKEGQKNIYFLIGELGCVEGWDADGRLALALLVNMLGSVRFPMCSTQPACMVLGHPPQQCVSISPIPPPPCSFQP

SEQ ID NO: 9461 - protein, 194 aa, Chlorella protothecoides
MQSIHQAKEEELRWDCGTPRWEQGRHLLITCTTCGSPWLLTQCAAVPQEFEGKTFTDVTREDLEIDESEEGKKESADVEAELKDLTSYVKKVMGRRVAGWHRRHGQLPSACPGRQGGEGGALQAPHRLPRHRRALQVWLVHQHGADRTRTGEPPHPLLCGDDVLGARAAAAPVAAERTASLYSCARPPAQASQD

SEQ ID NO: 9462 - protein, 132 aa, Chlorella protothecoides
MGDAQQAEYMRGRRILEINPNHPIIQSLKEKDSRGPGDLDMIHPITGGTAHVHPPFPPLAGCVGVIYYARGTHLSIRSHHSCLARAHPPTPRMALVLPGGYDIDSPKDFADRIYSMLAGKAGTAQKVEAEVV

SEQ ID NO: 9463 - protein, 233 aa, Chlorella protothecoides
MGKNCSPLHLCRGIVGCLVADWLSSCSRSVSPPLTQEFNPDCHLVKLGTMGEYGTPNIDIGKCVWLDRGEGVWQAAGTSNAAMHPPLAAGHWWKHSVLCSGRWWSDGVVLSPSQSLKCPPSCPAEEGFLTVTHNGRTDTLPYPKQVGEKEEDQCWECPVRGWHGTAGHSDLYAASQAQGPRCLISALAPSTLLPQGGSFYHLSKVHDSHNIHFATKAWKLAATDLNQASWCRR

SEQ ID NO: 9464 - protein, 206 aa, Chlorella protothecoides
MGPESEYAGRADQLPHGTVDGPGDQPHCCSPPPPSPPPPTGGDGYCGWATALHLSARGYSVCIVDNLVRRTYDLQLGLDTLTPIASIHDRVRKWAEVSGKHIDLQVGDLCDFEFFSETFKVLVLSCEGDGWQSLCPALSCVHLYNNKHFAPQNPQSFNPEAVVHFGEQRSAPYSMIDRQHAVYTQHNNVIGTINLMYAIKVRPGWE

SEQ ID NO: 9465 - protein, 564 aa, Chlorella protothecoides
MVEGREGGPGPRGRPGCKGQHGWAVWNCACSSDISWWHSRAPGGILRAASFLVTTPSSPLDSKPSPSPGHADCHDPVEDARAALDLALLKFSRGPDFGLPASPDARRARLADALHAAGRACTFVDAGASLRQFMGAAGAGVDASDDGEAARRLAREAGKPGVPHFLFGQLRGLHASQVAAARRAAGDARGGDCARALRLRLRRVGEGWVGDAPEATADGGQGFTADGAPEAVADGGRGAAADGAPASATEPATAESEPPSLAEAPSPLAPHDERAALEGVVRAVRSVHSALIPGALLLVVAPQGNTALSAALVGARREAQRGAGDVAAWTPESEERAYKGTARCKTGRRHRPGQYSIWGRGPCKFHTWPVLKRGIWRDALIRWDAQASWATRHSPGRPRAEWTQSPILTSASHDGKPKRPRYGAHRLVPVLVCRITCWKVPEFRPPFGRCLRRGPEQWRICFCEIMRPRWGYEGWVRDAALACCPLPSTNPASNPRPGPPAPPQPQGCAPCRVPRRHLAAASRSVDLGCVQPPHGLAAHRSRPSRPRLPPPPRSMRETAPAPAS

SEQ ID NO: 9466 - protein, 276 aa, Chlorella protothecoides
MQPLLPRLTALQNQDEYKSGADLEIRIKVDKEAGTLTIECVGNLVGVEGRPGVIASCPSPFGTMSHSWISHSWMHCPLAPSFPPKVLFNYPTPCRDSGIGMTREELLSSLGTIARSGTKKFMEAMQDKQDANLIGQVRQEANGGEGLASAPPHVAVQFGVGFYSAFLVADKVTVQTKSNASEDQWTWEGAAGAHSYKVRRDAEVDLKRGTRITLHLKEDAKEFADAAKIEGQEVMGQTGCEWSGVAPCGVLPRSRQGCSCANESCTALPRGAKGQG

SEQ ID NO: 9467 - protein, 144 aa, Chlorella protothecoides
MLHSIVRASSGRPEDFHSAPAPQASPRLAGAQCCRVRPSAALPAPFSSLVAGPSRSRACGAVLGRSLHQGVGVRAAATPSAVEPAEETFSYQTETDRIMDMIVNSLYSNRDVFVRELVSNASDALDKMRCAPVWRCVPPGPDDR

SEQ ID NO: 9468 - protein, 229 aa, Chlorella protothecoides
MPYAGASTQEMMITYDYHMRSRIPSTYTSMDTRTVLAFSAGTCIGAGACWWAVRHGLPSKRTTEYGSGCRPPLPPLPHPGEGPFDFSKFEEDEVVAEHLTRNVQFFGLPSQKRIAESFVVVVGLGVSDYQDVVGGCLIQGGGKGLVRDAMHPWTTWLSTASSGSQCREARGVIMAPVRAARVCILYDLITLIPALFSCREWAAMQHTFCSAPGWAVYASLTLTRCRFRP

SEQ ID NO: 9469 - protein, 231 aa, Chlorella protothecoides
MPGTKVQEHTGSEKSMVWSCVDFASEEQRMELFCIRFASAERAQEFKAAYDKAAEDMGALLGDAPQVRGADGWTPNPHDSPKNLSRMPVGPLGPGALRACAFGFGGEGGRSGPHARATLRQQRLSCRCIPLHLHNVGRSRLPVHWPLHHRRRRVRRRRSPPRLTSWPPSRAGRVGRLGARVQQLMLGYKWRRAANLGSAGPVRARSNPLSRVGRLRDRPGWRLGEMLRPPG

SEQ ID NO: 9470 - protein, 548 aa, Chlorella protothecoides
  MOD_RES (15)..(18): Any amino acid
  MOD_RES (156)..(159): Any amino acid
  MOD_RES (289)..(291): Any amino acid
  MOD_RES (329)..(381): Any amino acid
  MOD_RES (442)..(445): Any amino acid
MPSFLRDTTHVIVAXXXXRRVPVPPLTYPPPLPTPLPMPSFVRDTTHVIVATDARGVVATRVMKLCQALAVGCWILAPAWLEACMEAGAWVPEQAFEVKASARIRVHAVAGKGWLRQDMVHLLLVRHTTPPAPLPTPPPPPPALRRDLPYAAHRGXXXXKRGGCAKTWCTLLWARKRADRGCPGLFAGRTFRIVGKGGVKGVGRHSAPHPAPMPPGRAPIPGPRPNKGVLQRPHSWTLLPPHPPSAGPLHAAGLTKAIELAGGSIVTRSLPGACLVSLQNDLEFLSKAXXXAPHPCRRGEPLSLGPAQTRASSRGLTRGLSCLPTPRAXXXXXXXXXXXXXXXXXXXXXXXXXXXXXXXXXXXXXXXXXXXXXXXXXXXXXGCAVPGWRGDDAGRPALACLVPLALSSSCFNALDVHDEGHSRCREPSGPSTSHALPPLSQXXXXGCAALGWRGDDAGRHALACLVPLALGSSCFDALDLHDEGRSRCQEPSGSTTSHALPPLSQKSWGVQPVTSSWILDHLSRQEELEPVQQDPQEGSALSIDPLSV

SEQ ID NO: 9471 - protein, 195 aa, Chlorella protothecoides
MAPLRGAAPHCVFRALRLPPEHMEGPNPKSTLPARIGTGLGAAWSVAPLRGAVPHCVLRALRLPPGALGRPDPIVHPPCQVEALVREYWRGRSARQAVGSNDKGLGRSIGHLALTRWDAGRPASPGNLVLLTQEEADAHDALAQGSQGSVHDALAQGSQGSVHDALALQALRAREPAFCARVEAVLGRVRAQFGC

SEQ ID NO: 9472 - protein, 621 aa, Chlorella protothecoides
  MOD_RES (469)..(472): Any amino acid
MAANGAAPRQKRRKWDVEEPQASQPVDVARSIQESAAAAARIIAQQVETGLPYASSCQALNRLGPSNPAPSAGTPAPSPEASAAHPSASFTDISINASEPHHRAHLSKRSTLDSIEQRWGVSVVAKGRYYPPGVVPPTGSDPPIFLRIAPGTELAKKVRDPCTGGWRMCSIPESVPQDSTGDVASRLSACAAAAADIEALLRGKPLPGAPPTLPHSSQPHVSTAPLPAQDASPYPISGPGFHCLYLGIPASCPASWDLAGRVRGPDNAYLGHIAGACACVAALRGAGSATVPETREPLHVFLAAGDGAALEKARGLTTSLIDTVRADFVTAFPGLPRPPGSGSYLPPLPPPPVPMPVSVPTGVVGGPPRPQQGHRRAVPPPPYGTVPPPQYAAVPPPPYGTGPPPQYDAVPPPQYAAVPPPQYAAVPPPQYAAVPPPQYAAVPPPQYAAVPPPQYAVGPPLHPAAGPPXXXXVPPPPYGTVLPPQYAAVPPPQYAAVPPPQYAAVPPPQYAAVPPPQYAAVPPPHHAAGPPAGANLPRSHQQTSQCASAHPPVACTAPPAVRDTHLDTGHIAAPAARKRRFSEAPAPDSRAPQVRVAGGVGHRVQDYEAPQVWHATPLLVT

SEQ ID NO: 9473 - protein, 680 aa, Chlorella protothecoides
  MOD_RES (121)..(153): Any amino acid
  MOD_RES (414)..(417): Any amino acid
  MOD_RES (572)..(575): Any amino acid
MRPSPDEARAATYNSACALTALGRYQEALAQLESAVTVHDLALRVAERDPDLAALRLAPGWPALRSRLEAARGAQSSTALRAEARSPFRTLRLLGLGGVTLGAGLGAAVLAARLAGFLGRXXXXXXXXXXXXXXXXXXXXXXXXXXXXXXXXXQPGGDRGGRLPAGPGLGGGATWRGTGGAGGGAGRAALPSPGAGRGGRATCAAHAARQPPAPGPRRAPQLHGGRPRLGAAARRRAGAAWHLRPAGGAAGGQRDGGVAGGAEAGVCGREGGRRRGGVCRGALAQGAGADAPLDHQSLPPHHATHAERSTLAAGARRPRPVEGVGHGERAAGVPFGPIHRPRDRVHRAGPGRLHLGVWAGASRLASAAGRHTHPQAQGECSKEEGGLRDSTLSGDVCSIFSLRRLSTAGLWHIXXXXRPCLEIAGAREEGGQTQNLCTVVHAHLNNHGRSEAGARNTREHQASSNGTRRHHGPGPRRCAWAGRERRQVEVPRPTVGSQQVDAAVGLIRHDAHVPKLLGLGGLQLVGLRGGACEPGVLEPALGGKEDGRDSRGKPPLWCHSTVESLQKLECSXXXXNHHYGATRLSNLFKNLNAPAPSRPTYRWAVDTESELVHVALLDLLHAVLVGAVHILAHPILQQVPAHRHAGWVKLVQETTGIAFHAESSQPVCAHGLHGRTGMVS

SEQ ID NO: 9474 - protein, 249 aa, Chlorella protothecoides
MWIQHFTRHPKNVWVIPRTAHAHAPQGHRFHFQHLPCPLLQEEAEKERQDREQEAARHAREAATAAAEEEEAFKRRQMGYQKELERLAKANAARAETDRILAEQEAAIAARREAIQQREAQREAAKVTHRELGSGGGRVGLLRCSFRRPSCSPELPSPGGADRGEGSSKRTAAATGGGSHRHHPGEQSPEDGGEDQGGPGSLGGGRGSFQVGVMWLLLSVGGRCVAQRMEVVEYSFHPDGRIPPCTLRG

SEQ ID NO: 9475 - protein, 252 aa, Chlorella protothecoides
MTMPCSAACKAPRTLSTLNLPPGPSSSRALEAARQAEDEEKRRRDREKEEQRRATYEDARRQEAERVAEVLRRAADKDADLAALAREREAEAARKALERRLQLKHKAEAVEQMKRRDAFERAEALKRIEEETSHAQALLAQRSALQVCDGATMRGRIVSRWAADGCHGAHLGASSRVWQACKLPVTLASAPNGFFATTPSGQPGSVGPEAACGGEHVQAAEQRRLGKGPGPGAGCLVPAAQVVAAASVQFCS

SEQ ID NO: 9476 - protein, 733 aa, Chlorella protothecoides
  MOD_RES (19)..(23): Any amino acid
  MOD_RES (120)..(123): Any amino acid
  MOD_RES (385)..(387): Any amino acid
  MOD_RES (583)..(586): Any amino acid
MVCGNRSESPCLGQEGAVXXXXXTLLPRPGLTTHAFLTPIPSPERSLLVKLKTECGYQFTSKLESMFTDVKTSRDMMAEFRAHPAACAGNLELDLSVQVSKGVGWVSGQGVRGCCGAFVXXXXGCRLGVRTGGLGLLWGFRSGRGAGLGAASSCCLTLRRGPRTAPTPIPPFPPTPSGAHDWVVARAKQSGRALRAAARGGSRHRRLPPVLHLRALRACCPALTEKGTAGSVGGGRQGTASQGPAACAFGHPSQPPSVPPFPPGRKLTWQPGMGTAEIKANFGGKRHELSCNTHQMVVLMLFNDSDRLTTREILAATQVPDAELRRVLQSLACVKHGRPRLEETSCLGCTPCPPIERTPLCPSCQLAPARLSHGAPLSRGRTSSXXXAAEPGLCQGARQGVGWHGCPCASCVFADGLEFGCSMDAPDWRRPLAWAAHPARQSSAHRFAPPSNWRLPDCRTWHPSPGEKRPSQGANEQGDWGRGRVLRQRLLPIAPVQGQDRHGGGPDQAWHPDLCELFGATSPRPTAHWPCAPPDQPFQPMAMQRESDEGKEETRERVEEDRKPQIEAAIVRIMKATLASVVXXXXANRRSRPPLRLLLPLSHAWQAVSPASDHPYRPTLPQARKQLSHNSIVSEVTRQLAVRFIPNQQTEVVSLHTSRLPPELLYWRGQHQLKTCNAEPPAPSFTGDQEADREPHRERLHGAGRDRQDAVPLHSLGRRVLGCRVSRPGAPPP

SEQ ID NO: 9477 - protein, 117 aa, Chlorella protothecoides
  MOD_RES (13)..(15): Any amino acid
MSDRDPLLPSPPXXXWGACRWRPHQSPPDVPHHNPLPTTTPGQGTSEEELESALDKAILLFRFLQEKDVFERYYKQHLAKRLLQGRISSDDAGMAGKRSCVRGKGRWCVEVALTALV

SEQ ID NO: 9478 - protein, 99 aa, Chlorella protothecoides
MDMVEREAKRLEVLRRRQERELQQMVAHEVARREQEQKAKAKGSHSTIPPNRAPLHQIEALERRTEEQRKAREAAAEEWSRQQRDRALAKKQVWFRGSL

SEQ ID NO: 9479 - protein, 261 aa, Chlorella protothecoides
MKYPLPIPLTAALVPARHTLFRGQKPVQEWLKELERVKVRLTGLGDLAEQCHLRPGYWVLCPPPHCGHRSSIHHDALSPLEVLVSTSHRQEDALAHPSKPRLTLQDVADRAMDSSFRGRLVPTSPRSIDACLRLGIDPASLRHIPLEAYAKWERDPELARLAYDSEESLRQARMTVYGSEAEGGTLLALGRDTHVEISFKPCVAPAHRADSSEEPVGRKGAAGGTGPERPASRQGPLPAREPRSRRRGAWTRWGVGGVQGA

SEQ ID NO: 9480 - protein, 178 aa, Chlorella protothecoides
MGGKAFTAALAVLLGAVCLCGVHAAVVVNTHNGMTFFYNDPHKTVPRTATVASLETAEECICSDADPRSDDTLTVTYNCYHQALFGNCEAEFMKGALEELVESDGEVVRGFWVYVPYAVHVTIARFLPSPSSPPSPCDRPPPGFCQMSCNNCTCCDSPYNVIEKTGNTRFLQVTWTGG

SEQ ID NO: 9481 - protein, 120 aa, Chlorella protothecoides
MPVCRNLLKNGVCKDVDCPYKHSMEEIKECNMYKLGFCIYGPACRFKHTRLAGPPAEPNQLEAAKPKEFRNVSIVADQANRGIHLLGPHGRPRDLNLPALTAGPGTAPRSRAMVPSGAVR

SEQ ID NO: 9482 - protein, 269 aa, Chlorella protothecoides
MHGAVEAMPGSTLMPRAHTLLPNAVARLIAFRDKYRPVGWGWQYAFRTWNVRFEEGRGPRGFAKSCGAAAHMAVRCVIGTTLFPCPRPPHHAVSHARKQQRQRVRSLRPRVVGGNDRIPGEGWVTNIHFSLTGAEGTPPRDLCGFVHAKEWDFKVCNLNGTLPTYLGGDGSCMPLLEEWDFSRNHMEGPIPESVGTIERLVRFKMQGNKLTGPIPANFGDLKALEWIRVFGELVGLENRTVLDHFMGLHGLKQPIGKASMGRQRQCLVP

SEQ ID NO: 9483 - protein, 226 aa, Chlorella protothecoides
MGDGGGTVGGGVTLSAGHRGQNTKEGPGALYSAHLPLTVPHKSSDTHGPVDKHTKHQHLPQVADESPVVLNGFGTVVNALGTRAKPYLPQIAGVIKWRLNNKSAKIRQQAADLIARCAPVMKRCDQEGLLAHLGVVLYENLGEEYPDVLGSVLGALKAIVNVIGMTRMTPPIKDLLPRLTPILKNRHEKVQENCIDLVGRIADRGAEFVPAREWMRICFELLDMLR

SEQ ID NO: 9484 - protein, 375 aa, Chlorella protothecoides
  MOD_RES (21)..(44): Any amino acid
TAQSLGRHARRRGGGRKAQPXXXXXXXXXXXXXXXXXXXXXXXXPAAVAGGVTPAYGATPGYGTGATPLGAAGLETPAWGGEGAPGAGAGVPMTPELYHALKVERETEARNRPLSDADLDALLPGAGDGYRVLEAPPGYEPIRTPARKLAATPTPYGGTPLYGIPEEDRGQAFDVPIALEGLPDLKPEDQQYFGKLLQEVDDGELSVEEAKERRIMKLLLKVKNGTPPQRKSALRALTDKARDFGAGALFNQILPLLMSPTLEDQERHLLVKVIDRVLFKLDDLVRPFVHKILVVIEPLLIDEDYYARVEGREIIANLAKAAGLASMIAAMRPDIDNVDEYVRNTTARAFSVVASALGIPTLLPFLKAVCQSEEI

SEQ ID NO: 9485 - protein, 685 aa, Chlorella protothecoides
MNVRTAAIPQFVSNQQCIDVLRGLQEEPHRAMSPLQTITKEPHFCLFTGVRSIMSIQADGGPFTGQLKTSWLIPVAQAEVIGTVMSPPSRTAHMDPVVDTPGEEIFKVLANGCIPFERGLAPTIPDKVPQKAKYVQRGGRASESGPGFPFPFWNSDLGASLVSQTAAMPVRSSSFSCTAQLRRGLRTSRCCLAAPGEMGHPAEALLDTYTPPVGLIFYATVQCPVAESILAIGSARKRKFRFAYGLRKKGRSVLLEICQSPRPQSAQQPCPHLSASQGAGKRNPQPVEHVTMTSACMIEASDLGAGLPDKETSVIRVVSMGIRIVHVTGAAGCGAQDTGEGSGFGVFCMPVFFAAAPVRCRSPNPQEVQADGNCFFRSLSVQLHVSQQPWLPGSGHEDEHAELRSQVVQHLRDNQEVYEPFIGAGCAGLGFISLLSLLGHPPAIFVPTLHPRTEDEEAWVDYCERMSQDAEWAGHPELHAASKVLRRNIRVYQAEQPAWQLTTWGEGEASGPALRLSYHDGNHYNSVTDGDQVGSGAAEPEAAADNSEHDEAVGPCVAGSAGDLHGATSAKPAPVPRGRKAKKQAKARPLQGGRHARLSPGGAGREGTVRIALEVGDGDGRVKLRLMWTEDSGAVPIGKAARVGCPCGSGKKGKACCRGRVQPPRIVASRDFNENLHHALQTLEI

SEQ ID NO: 9486 - protein, 202 aa, Chlorella protothecoides
MHRLHNLRADRRTGEGHLADVARGVKANLGMGSLAKHSSSDRIPGSKQFPLGENVEQSNLGRDEDFNKAAEEAKTLPEATTNDEKLILYALFKQGTVGDVNTSRPGVFDLKGKAKWDAWDKQKGKDKETAQKDYIAKVRGNPVAMVDVHHGCGAQGQVCLVELTCVHAERDNSGLFRHVCTQNSRKGRLAQQQEGVEICLSV

SEQ ID NO: 9487 - protein, 249 aa, Chlorella protothecoides
MLRAAVGSLARKVSRSHLSHSAACRISTTSSCQKDVDYMDFPGGKVPFTEDLAWLGPGFTPRPTIPCYRALDSQGAPLPGTSLPHDIDQALATRMYETMISLQAVDTIFYEAQRQPSIRSPCSRLTPPITPPTGALLILHDEHGGGVDRRRVCGRAEPRRRRLHAVPRAGRADVARVHPAGHGQSGVWAMPANFVKGPIVCEPMPRRGGALLPHGACASCLRDPPPAKLDNLRTPVPQTNNPPATTLSP

SEQ ID NO: 9488 - protein, 203 aa, Chlorella protothecoides
MGAANSDATLYDEEIQALAKAHPDQFRVDYALSREQKNSKGGKMYIQDKIEEYADEVFDLLSSGAHIYFCGLKGMLPGILEMLERVAGTKGIDWPEFQQKLKHAGQLHIECQEKGRKGRLAGPSVRLGPVWQGIMCGCESGEPLDARWSPMWRGAPRTYCIPPLSGREHPFSGTCPLTLSYCHLSEWRAGDRRDTPPAPPTAP

SEQ ID NO: 9489 - protein, 497 aa, Chlorella protothecoides
MARGRVHTPDQTSSQLEGRSRPRQKVIRNLGCSIEVIVQRGPGAIRGTRSAPRTENRGTGWFGMQRSAQSTTTHAVFPRRSAALTPLQLRAISSSPNENRTRPRAGLRAASSGEPGLRPPSEPLQLSAHVVDSIEEISRTEWNACARGTEELNPFVQWDFLHCLEASKSVVSLCMTMNILGQRSNYCSALLTNRPSLSASAVTPHETVNQIPSKGWMPQHLVLRDAAQADSVVACCPLYLKGHSYGQKQQRYSTISASIISLAAESLPPFPMCHLQGHIPLLLPALRRVAYPSRPCQAHDCWSNRGPTRKTSPGHSCKLCTRYCYGPGWPRVDTWEVSPRAQSTALGTKSPVAEGMNVSSLHLTFCTQVGTEVAEGLTKRERPAPAQEAACTCEDPNYQPTPTHTHAPPPCEWQEESMCMAGRAGGQYLHRTGIQYHFQNKGYSTFEAYLADLRQSKRKAVRQARPGWLVEVFAGGIAAGSWVAVRTESSLQYTITT

SEQ ID NO: 9490 - protein, 1029 aa, Chlorella protothecoides
  MOD_RES (388)..(391): Any amino acid
  MOD_RES (616)..(619): Any amino acid
MPVEGISMPLSACTTVSRYAVVARCDQQGPGNVRSEVELPTPTLELPPSPADQVTSRPQQGAAHGPAPGGTMGPPVPLLLRLVGAALQLPFAALSTVLHAAFVIARTGSRGAAAVLPPRLVHAVSSEFPVPRHSEGTPWFGTGTRGLRCMYDFPQLWNTERGSGASMNVLPACTGLPPILTFPSPWPVQPAPQPCPPACRVLARQPRRLRRPGSLASYKQRLAAPSTGRRVAGKRRRALRQPRAASSLCTSMPHATRCGPGPGPHGVGCMELGTVPQAREPGVGPAGGLFSERRTQMPLRCPLNASTVPGGDGCPFFFVPGHAALSVGHAGRPQRDDLHLPAFLGLGGECAGAGRTRAGSQPGGRPLPLHSPPGWLRRQDTPRFLSDXXXXPGASEEGRGAGSSQSCELSLSSEGVVAHGKPGAASGSKTQLLACTEGFCSADELMTTLQPCVAAHATVSCIRSRHAILRSQAARDRSEHMLWRERALRQERVSQGGVLSGKGGRVHAIEHPSCWVGCLFGAAWQTPDLSRRLREEQDAEFNSSLEADRCRSRGSQAGGRGAKKGGGGPSSKVGLGGQEVGTAQAVPLQPFRPRGTQTGHPTPLLRAICTGAPKVXXXXQRAESEAAAARAAAEEELRSRREAKCAALPTEPESSAPHVATLRIRLPDGGMHQRRFRESDDLQVWGLPLSGSYAGRLRGLGVWAVESCSAATLPSHSHAIITPSQVVYDFVDSLDSEAVRHVIILDTFSTAVRLLMIASGAPLMVAPRHPARGIPTSHAFSSAQMRQSQQGILQPKCAEKVVKSNGIAWRSSVAGMARTEGTGLRRVLQSLQARILSPERTAWYSTSLADDIVPAEALPRLAERIKARVARWLPNVACNPRMQKNAAYGRSSMVAADLEVYLARGGEIKPAILSALFNMYARLRSPEKGDALYARVQSHRQGPMTPANYASLLNVYAKAEHPPYGVPRRWAIRAAQGAHAAGTWRAMRAALHSQEAGSMSVAVAGTDPPPGMSLLDQAMITLLIPRHTD

SEQ ID NO: 9491 - protein, 337 aa, Chlorella protothecoides
MGLFSKIKSFSARTGGIQIRSSSSLDTGLSATAAGRNLQLQRPTWKHARHEADRSNPRDHPDRSTMPRPVLYADMLSQPCRAVVVLCQQNGIDVEIKPISIGRGEHRSADFKAVNPLCKLPYLVDGDVHVGDSLAILIYLCTVNRVPDNWYPGKDAGLLLRVATNHRHVRARLSDPVKQARVNTVLGWHGSTLRTGSTVTIFNRVLAPLRGTPSNEPLVKDFGLPTLQTALQNPNLPPPQTINDVWLANDDFVAGSDVSIADLLLATEVDMAQLLDAAREGPALEELLAPVPKVRSWLNRLSQRCAPHYEDAKEQLGKARIRFIQVLGGSDEDKAKL

SEQ ID NO: 9492 - protein, 373 aa, Chlorella protothecoides
  MOD_RES (214)..(217): Any amino acid
MSKPVIYYYFLSPPSRAVKIFVDAAGIDAEVKTISIMKGEHRGEAYLAVNSTGKLPFLKEGDFALPEAGAILAYLADTQPGIPEHWYPRPHPFPLCAHPPPEDARARARVNSALTWHGSTLRNGSVTLLSTHVLEPVMGAPAREEVTQQHALPTLKAALKDLETYWLAATDYVAGGQVSIADLLLATEVEELRLQDFGGKVHWVSTTPPAVIHXXXXLPLGKHAFRALEEGLTPQPMHSAPSRPCVQEPGYESLLADYPKVRAWLARLASELGSAYTRLHDAIPVAGAKILKAIKDKNQPLDVDAIDSIVNEALLYGARALTLQPETRGRWDPYLATAWTLRLVVIIVCDKRLNGDGSAAEFPAQRRREDVKA

SEQ ID NO: 9493 - protein, 260 aa, Chlorella protothecoides
MGLHGGARAASMCRILWPLPPHRLTRSTLHPGTQVAVRRAPAYRPRQFPRMQISATATVGKINITDVSRAVSSKQKVPAEELEKIGLPMNTFNIKKPFKAKVISVERIVGPKATGETCHIVLETGGEIPFAEGQSYGVIPPGTKINSKGKESYGVIPPGTKINSKGKEVPHGTRLYSIASTRYGDNFDGKTASLCVRRATYWDEEKGAEDPAKKGICSNFLCDAKPGTEVTMTGEGLRMEGAQACRITDGAAWSRRPLGR

SEQ ID NO: 9494 - protein, 150 aa, Chlorella protothecoides
MRVQVEVEGEVFSGSTPTAPFAKWALARGHVDVVSGLMAFGLLDPFLQAVLRAAAGLRGPPPGLSPLGPVPSIAPSLANWLPFSARSGAAMGTRQLSEDLMRGNPFADKARTPLWVDTRPAIVAEARPLASMPAPETTNRGATCLCELHR

SEQ ID NO: 9495 - protein, 178 aa, Chlorella protothecoides
MGGACLGLWRPWWGSAQPPSVPPLGGGQVWQGLDCLHRIWHGDARCCPGRQPAGHCHGDREGVGHAAEEGGHAREFAIGLWAPCSSGPESPFHSLPRLHSQLVGQRWAQLSSEERQHYVDMAARVRKSMRASQAEEEEEAGAKRARSDTAHLADAGTERPQRTLRPPSRYTSADLGVC

SEQ ID NO: 9496 - protein, 228 aa, Chlorella protothecoides
  MOD_RES (124)..(127): Any amino acid
MEVVGAGDAGMEVAGAGDAGMEVAGAGDAGVEVAGAGEAGVEVAGAGDAGVEVAGAGDAGMEVAGAGEAGVEVAGAGEAGVEVAGAGEAGVEVAGAGEAGVAVAGPGEAGVEVARYGYGVAGDXXXXGGGGGRRGRVGGGKIWVRGCWGCEGGSGWSRGLGGRQALGSFRQTVLALGAGSRCLREVQRWRIRDDPWAVSRRAGWLANNEGNGQHPPCNSPRHWRTRWS

SEQ ID NO: 9497 - protein, 512 aa, Chlorella protothecoides
MPSRQSLQGGFSFRCAASTSSRPCQLIALSRPRCSPWAAQPSRCARTGRQRCSSTSFPHEHPQVSPDAVIQPVFVDSAKGIHHAAPSLPPEDGGSPYKDRASLLRAAIKAPMYSVGIMPILVSARADHGEGLRSLSPPHTRIGASSHVHCTTSHNSPRPPSRPSNPQPHHRQVSAAAVFATTGQADMLRTLGLCLSSILIIAWLNLSNDYFDSLTGVDTHKYESWVNITRSPRTIFVTAHASLLAGAGLLFWLLSQVRCSSLNARRGCSGQQGAARSLWGAQSGRPRGRPLEITWPPRLRGVSGNSLFYGRSNPTFPPLPFLPTHSPLPLPARCYMPRYAAATCTRARPSASRIKVLARPSALWHSGRWLSTHFILHRSDLAAAKWGWGVAAGIPWSAAVISRVPASQPSLPARSRAPVEPPTQSPPPSPSPRVCRGPQPSAPSPASYRSWWVSPPAPSSSAPTSTKSRAIWRRASAPPLYASAPRPARRCLGSRRQQGGEGSEWLRRHAVL

SEQ ID NO: 9498 - protein, 291 aa, Chlorella protothecoides
  MOD_RES (207)..(210): Any amino acid
MISHTSPASHACFPTPLPTPQSNTRVADLEAALKLELDAEEYAAASATLLLLKQARLESAAAREAAEGAMRRTLRWGAYAHGVGAVVTHRRYGYRGVVAGMDPTCLASPAWMAAMRVDALSQGRFQPFYHVLVDERDRPGGVTTYVAEVGRAGGAVGWGWEVCREFPPIHARGSGRSALQNCAVPHNACRHPPVTPTTPGTLYSLDXXXXRIVLCLTTLADTLQSHPPLGALCILWTAGEPGGPSGGQADPAPPHGRALPRHVQRRGVQPQHEAAPPLQEEARTTVTCLRF

SEQ ID NO: 9499 - protein, 256 aa, Chlorella protothecoides
MSSTPCQVTKAMDISVTRSPGALLPRIAFKDRLSYTQSRTDEYDAEAMRYLSYALYPLILGYAVYALVYQTHKSWYSWVLNSLVGAVYTFGFILMCPQLYLNYKLKSVAHLPWVMGASGPAGASRDQSCIRGMTLHPGAALSHVIMVGASQRQRQMSYKFLNTIIDDLFAFVIKMPLLHRLSGAGRACAGRGLVCWHGAIPAMLVGPCAVFKAGHCGLQATSDTPHPPSCSVPRRCGVPGVPLPALDLPGGQEACK

SEQ ID NO: 9500 - protein, 229 aa, Chlorella protothecoides
  MOD_RES (123)..(126): Any amino acid
MSTKEAASEFPGVMASVEEQKWVFRDPSVFSSFLDGQESLTNAPPNADTHHRGKFDFLGKFDFLYLPVDFRNACNLGYAFMNFLSVEAMVQFYQTYHGERWRAEESSTKGCLSLKVDRGEERXXXXETGQLTGQDGCNGSAPDCLCWVCEITYARVQGFEALVSHFKAAKFPVGDASALPLVFAKVENGVASCPLPINQYIDTSGGEEEAPSVEGTSECGESDVLGTSP

SEQ ID NO: 9501 - protein, 350 aa, Chlorella protothecoides
  MOD_RES (109)..(111): Any amino acid
  MOD_RES (273)..(276): Any amino acid
MRGCALAMIPKLMDYQDEVQENGRTGGAVSPLMLPAILAPSWGVFERGYEKMAASWWLPESAAPSELLLIDANACIGNNHKTRRGALHNSEVRQALRLFDREDEHKLPXXXTAPSNETNTPGLSTARMSTNYLRSFIESGSLPFLPGFLAFGSGDAHRCAASSCSFLTRPSTKFSLPGVSDVPAELERWFRGMRELDERAHGLQVQLEADCQQQLRLAAEQQQHGNKRTKGAGDMDAGPTPPSQPGNEPVDLDQRIEDTTAELLKLSAEKVRXXXXGNKRAKATGDMDSGPTLPTQPGNEPVDLDQRIEDTTAELLKLSAEKVRRSCCRYLEVYGGGALPRSAVLCRALP

SEQ ID NO: 9502 - protein, 170 aa, Chlorella protothecoides
  MOD_RES (66)..(69): Any amino acid
MEEVSLHCLSGHVGGPGWGADGLAEMLNGTERVACATARHAGCRTTSIDSPPPSPIAPHVMTSEEXXXXACATARHAGCRTTSTDSPPPLPIAPHVMTSEELYQAALAAADASEPTYCYCKRISFGEMIACEHPECLIEWFHFECVGLTAENRPKGKWYCKECRKLMGKK

SEQ ID NO: 9503 - protein, 509 aa, Chlorella protothecoides
MAEKTHRKKQSGTKAQKRKKAVNKKKGVDDKERKKNPKAFVFASRGRAKIQQARTADRDQKRMHGEEPLYVQRESCAEGTDDIYTLRRATGSSISKSDPKPRAVPAVEKTPSEPPPFTVLVHGPPGGLYDLSGMSQPQTYYLSAITPGGQDHPHQGPHQALDAAGCQGRQGTHHFGGWESQEVGPGKRWVPECCTPGRPAPPHPSFSLAAPHRLTFIECPQDLSATIDASKYADLVLLLVDGAFGFEMETFEFLNMLQVGPEQRVHGQILHCRQGTSLYGAPSSQASGPLGNPAGHGGADAPGWLQGHQGPEEDKEVPQAPLLVGDLPRHAERMCGSWAGPLRSCKGLYCTMYLRGLEDSRCPTDCPLHLMPAAQGQALLSVGDEAWQVPEEGDPQPGALHLGDEVPAPVLANGAPLPRGRQVSTACVLAAAEEAGAKKGGRNWFEDVTDPASIKADPKADRDVTLYGYVRGTNWRAGSRVHLAGVGDYQASHEKGRGGKWQGCVPSLA

SEQ ID NO: 9504 - protein, 959 aa, Chlorella protothecoides
  MOD_RES (760)..(763): Any amino acid
  MOD_RES (956)..(959): Any amino acid
MLSDPALSCTPSHCRVVMGLADVLQHRLRRSRPEVSLPVFPTQNTRTAARKRRKLLREQKAAGLAVPQKVRQESDDDEEEGVALDADDIGGAYKTLVSLLADDDSESDVGPSSQEDDSEEPASDEELDSDTDATSEEDLAAEASREKLTNGSVARSKGVTTEALDDDTAEPADAQTSASEDEREDGAAEESPAPDPDSRTANEKRDGGSTFETLATDTVQLHLERCGCVVACQGMQGLEIDRPSWALHARWRFEDGPRASVHLASESRIITCTCLCETRVLTEDEVASLAPGSRPLHPAPKAVQSEVGRIWPEAQLLASDDVRLPAFPPSTSLASYGIKERLVTRWRTVQGATAGAELASGCQAGLFALLSSQADILHTARPYPTSADPGTGRGLVPCLAVPGMHPPVHAETPVRCETITPRAPQSPLPPAAVPDPELDAILLHILQHCASNADRIRKNNERLKTNPELDPPRDQGFTRPTVCRGGVGVLAGIPAYPPGVLVVYTLRRVVSCGRPSGAYGHNEYAAHGYITWLHSRVLSLHPTPSLTPLVKPHPTPTHPQKPPGAAAAAHAQHGAAGGAALGRAGAGGGADRQRAAPRAPAGGVRGGGGFRRAAGGGAGAQAAGAPRALLRQYRRPLPPGRPAYARDGEAVRRLPHRRRDRGQPPGAGHQADRPGRQGGRRLPLLPGAGGHGPCRRGAHAELGARRHRSCLPETYTAWHIVSVSAPQPPSCHLHPPPLVLPPHRRPSSTLSSTHTQSSRXXXXSPSPIHFFLHTHAVFKALNAAPRQQHDVDIMRVREWQLAGRARHYRQTVVLSSLAAPEMGALMRRCAACHAGALRLEARGAGGVLARVLPQLRQEFERLPRCAPAEEPDLRFQHFKESVWPRVKENGRGGGQLIYVPAYFDFVRCGSCVYTGAEGKGWGGFQVVCKGGVTKNYVKDVIWALPTVRPIPSTLLXXXX

SEQ ID NO: 9505 - protein, 315 aa, Chlorella protothecoides
MGIAYCSPDTKHPPGLVPPPNLDAPHSPLPTPQIHPSLLRVRNFLRSEDASLLLLSEYTDSGDAARARAYFRQGRRKILLYTERAQFYNRGRTPGIQVRVVVEGGMVPRCGVLPAAHPPPVLRGDLEPGAGERGGRPAHHHRPLLYAGRTASRARRRQATGGTHAEALFKLYLPVLLKWVGHRNRTPANIKGPYGICRGYTVNLAWAPTTVETYCARYTRGASQKLLAAWDGEWAGAGATGQARSSLIVWCGLTVPQYWGPPSLQVPQSLYIIFREAFGGIQILWCNIIGAVWLWDVWARVLLRDQGRREVHTAG

SEQ ID NO: 9506 - protein, 171 aa, Chlorella protothecoides
MPDVENLHYDDLSAVATLVTTERYQCILEATRQALADDEAGTSEQQAWSGPTEDDPTYKLLVQCNQLSVDVDAEIAAVYNFLRDHYRPKFPELESLVQNPLDYAAVVAAIGNELDVTAVDLDALLPPATVMVVTVTATTTAGKALSEEELRWGKGECCDASREDCLGVSVW

SEQ ID NO: 9507 - protein, 210 aa, Chlorella protothecoides
MYLLECPWLPSSPRTAAVCAPPLAPCLACQPCPHLSSAAQPWPSHSHSIHPPPASHPFHHLPSRFDAVGGVSVEANNDSVAELTGIDPGDILLAEWSNSTYRPCHYVAVDRANRCLVLSIRCGCGVGGGWGLSGGLKHQVHAKVAHLASMHGRGLQMSRRCPCAQQVSIIHSPLVQRVLGGGGPALGHGRASHGGQPGRPQRLGARSGSV

SEQ ID NO: 9508 - protein, 282 aa, Chlorella protothecoides
MKTFFGGQKSTPIPSATPGSTDLPALPAETLPRLARSTPVDVHVYISEANDWQASAKQGPPLWSATEFELGTGSTQATALVYAPSHAVQNNGSVFFHAVFTPSGASPDPADGFHDAALTFAKSQPLNVYLKKPRVGRAERPGRVGYCMRIWTSWGRLQIRVDHPQAGAGTGINLLTGKNSTGNEAAPEDVHTGNDTVIVSFLRPNVTIAVVDDFKKYQLRQIPPQYKGFVDMDEVTLTYAPFVWYNNFWLLRDYLWACVMGGAAGNDGQTLDIGAREQTNDP

SEQ ID NO: 9509 - protein, 107 aa, Chlorella protothecoides
MAGLQKVRPYQLQLFFSNKYAYAQIWKVSGDKHTVAAAASTIEKGLQEGLESTSDKGACARVAQTLAERAQAAGIDTVSWQRKPRQRFHGKVAALVTGLKEAGIKMM

SEQ ID NO: 9510 - protein, 396 aa, Chlorella protothecoides
MAGPCICFAQPVSYHLTPPTLATSAQILRHTAFVSGMFNSELEAAKFEGAGIRTGAKDGTFRATFEDKPLLSDMIFLRAWVAVDIPRFFNPITNLLEPRAAPAPRAPKPSKNRKREEEPEREAAAMLPQGSRGGEVAARDHGRFEACMAFKGARPGMVFKLGSRGMGYYQDGDVEAAAAGAEAPAEGAEGASTGAGQGAAEPGSWVGMRTVADLRREQGVGAPRESDSLYRAIERKPRVFNPLKIPKNLQVRGCEERRGVALDCLLWNNGLRGREGVKVVVEGSASDCHAHYAALPFKSKPKTEAARKRKSLEQRRAVVLEPEEKRAATLLNQLNAIRNAKAGVRREARQKQLKQLAKRREAEEAWRAQFNKEERKKRYVEQGQQEKRAAKKARAN

SEQ ID NO: 9511 - protein, 306 aa, Chlorella protothecoides
MSGWRKRGRRCAESLARPSVAPGNAAQAGPKPSAFPAIGPDSHDPAAEESLPPAARLLFDVSGVAVGLAPAAADVWPEEDGPAMRGPPDPDAHGLTLREACRLCRSSSMPQRVAALRTLRNGPQLTRDAAALLAAEGLEPPSQTQLGRELLSGARATTVLRRALDETVPAVVAAAAGAVLALVDLSPPGQSPKFPRLLPSSEHAVLEASDAYPLSGCPSLGIRHAQRPSLGAAWVTAPLADDPKTGTPETMDGEHEEEPTDWELLGQADPLSALLGMGLLDRVAYLLREAATFSGATTSLLALLVR

SEQ ID NO: 9512 - protein, 191 aa, Chlorella protothecoides
MVRQALREGVHQPLLHRTHMDKEDDSLPGAVDLYHTLFRDSTRSDNPDRNTRVWLHIDEHGIPSDVEARAGLSQGSKMSEPAGEFPAAQPRPETLLIWTGNSFHYSQTQVDKHVLVYELGVRYRDLLTLDPTLPLPFPAAILIRNRALIINLETVRMIICANQCYVLSVPDVRAARWFLRRGASQCPWGAA

SEQ ID NO: 9513 - protein, 131 aa, Chlorella protothecoides
MPRPSSAPQRRDVSLPPTQVLGNAKGVVAVVTSVLYFQNPVNAMSALGYTITVAGVVAYSQRGAAMGGFEGRCRWMAALHNPPHTLPEGNPSPFVPLTWTGQEAHTEGGVRAKACRAGACGADQDRRACGV

SEQ ID NO: 9514 - protein, 157 aa, Chlorella protothecoides
MNSLVGSVVEREVAGPTPPPTCSSTVSAPAFPAAAHRGPGASRFSRARRDPGPTGAGASSPAIKGPEAALEPGSVEEASAALLSGMSLAEREEARQDLESRLKPETLAFLKARGARRQMQGPAAAEGKRSVEAGMAGPVHDDKSRPTAAGGKAVRRA

SEQ ID NO: 9515 - protein, 215 aa, Chlorella protothecoides
MVACSLLGGALAASRLIPVQPIASRPQMAKITLLAAIFCFTVVLGNVSLKTIPVSFNQAIGATTPAFTAALSVLMLSQREPRAVYLSLVPVVVGIVIASGAEPSFEIVGFLACVAATAGRALKSVLQSIMLDDPADRMDSMSLLLYMAPIAVVLLVPVTATAEAGALQAALVMGRQPGFWMLLILNSGMAYFVNLTNFLVTKYTSALTLQVGGEG

SEQ ID NO: 9516 - protein, 445 aa, Chlorella protothecoides
MSRPLADACRPHVTSVILAADIIPHLSYASVETLLLELNQSSLLPRAAKGLGKKLSSVLGLGKDSGDTKVSEAVAKRRSEGKTQAQGEWKSVRRAAGSSPRRPADERGWGPALLFGRGDEEALAAAAEATSHTLEQTAREGGASQAQGSGADTAVSPRPSPRLIPVIEMSDPDAPPQAGGEGSQVEDSDAADQEPSSATDLLPYLGGMEDGGGATSAIASAGVRDKEMGTSPRSVSQPAHLYPPGEPAVSGVLWIGSRGLWHGSDGGCWQVSSEELPKHQHAYPLIVRVREYRDPSLARVRHPARHRCAGRIIWIFPADEDKSSLDGSTAGEEQGPPAHAGEQDTGGEAPRKEPEAPEPSPSNGDGAAQVSMEEAVEEVEAKGQGPSSKEVAAAARESGDPRASRGKAVPVAVEAKATSFERLLLLPDCFNDHLPDRYIEVLQQL

SEQ ID NO: 9517 - protein, 397 aa, Chlorella protothecoides
MKGHGTPPFVHPTNPPPTHPSISHPQIEELTPLPDPCPLPATSQSGKRRSLSEKDRLLYAPMSDVGGLLYDADAMYIDIPDWKVQYSAAGAANGRADGETMIRELASTRHGIDEQLQGAEIQVFKGAKPLPADGAASSDEEESEDESADESGDKDASTGGSGSSDDESEGGSDSDEEGEPRQRDSLPGQEAVLAADGRHRRRAVFSTTLEPRAGSGEDSSDENSGSDSDDEPGTAPRSRGALEDDQEGSDSESGSEATSDEEGGGEDDDGVEDEEGLGAAARWKAAMLERAAALFSHRAADLQAAVYGERAVCPPASQQLPRAEPKAPSSDGDEDDDGDLFRPREAARGMQGPPSGLEDCSRAWAAWDATIAAWGDDAAVEGLRDRFVTGALRRPAP

SEQ ID NO: 9518 - protein, 214 aa, Chlorella protothecoides
MISRLAADKALMLRLVQLRMDRIAPNLSAAVGTEIAAQCMGLAGGLLALAAMPACNLLVLGAKRRTLAGFSSTAAASHQGFVHGSALVQGTPPALRPRAARLVAAKCALLARMDAYGQDPSGARGRAAREDMAKKIEKWQEPPPAKQTKVLPAPDANEQRRRRGGKRYRKEKAYLGTNVGGSEGRGELDRAMSRSVRLIGMPLGPVEAPACSLA

SEQ ID NO: 9519 - protein, 201 aa, Chlorella protothecoides
MDGYLISLNQQLTPVQDWCRANNAECLAVQPPGRNLRSKHAFADSAASLAKELLPVVASRLASTPYVIVGHSLGTWLAFELLSAARDAGLPLPLHASLSALCAPDIPFDQRPWRQQRTLGEEDFKARGSGLREECRGWSVSEILFTPALWPTYQPIMRADFRLFDEYEFTRAGEAPFDFPIHAYWGTGDLRIKQWMGEVRE

SEQ ID NO: 9520 - protein, 1509 aa, Chlorella protothecoides
  MOD_RES (314)..(317): Any amino acid
  MOD_RES (339)..(341): Any amino acid
  MOD_RES (365)..(368): Any amino acid
  MOD_RES (1001)..(1004): Any amino acid
  MOD_RES (1170)..(1215): Any amino acid
  MOD_RES (1254)..(1256): Any amino acid
  MOD_RES (1414)..(1417): Any amino acid
MPGRRRRCPAASTIPWPSWPSERPGEGAGGSSSSGTPIPSSIPCIGRGGPGTPLAGNPADSNPTDSLPGAVGAGNRGRDRVITLAAAHGPPRSGRPLGEHPPEADLGDFCGPVADTRSAVAPETVPERSESVHPARLQPRCPGPGLAAHRGAAGAAGPHHDAPESSTGLHEAVATLHQGGRHPSPGWGRVVGVLCVGAVTHEAVPARWTLPLSWAHMPGATACQESPAPTPTHPSRPTHLTMAGAAGHPRTGPPGPTPAAGQGGGGGGVGSRRRGRWRAAGGGAGGGARAPPAPAPPRPCWAARHCPPTTTKTXXXXGAAAPLLGGDALPPDDDDENAXXXGPGPDPLLHGSHHRRGEYRPRPRXXXXSESHKGAHGDTPTVSTLVRMASSDTPILALAFAAGAAAALGQALIPYYTGRIIDAASIDPDPAALRRFTLRLLGVAGACAAATGLRGGLFTVAMTRLNVRLRAALFASLLAQEAGFYDATRTGDITSRLSADTTTVSDQVCLNLNIMLRSLTQAAVVLAFMFDASWRLTVVTFVMVPLVLAICKRHAQNTRVQPSPFNTHTPIPGVRFLLPQAEQARAVGAGGGQQRGGGGAVLHDHGQGARGRGLHARGLRGQAGALLLAPAARGGGLRALHGHQHLPGRQRGGGRALLRRAPGAGGVHVRRRAGLLHALPAEPVRRLPGPGRRLLRAGRRRGRGRQGGGADAEAATRAAGGARRAAAPGGAPGPARRALRLPRPPRSPCADGAQPVGGAGGGGGPGGPLRRRQVQRGEAGGAALPPLRGGGHAGWPGCGRLRRQVAQAPRGPGQPGAGALRALRRAQHRLRPGAGGRRAAGGGAHPRRHPRRGQVGRRGGWEGLANAHDFILALPDGYDTECGDRGVQLSGGQKQRIALARALVRKPAVLLLDEATSALDADSEVLRGGHDALACHACVVRTRQGGETGVWAVDGVWSAPQRPPVGCLPLRSVAHGVRPMQGRGASTFPPPHPTTPPLPPXXXXAPQRPPVGCPPLRSVAHGVGPMQGRGASTFPPPHPTTPPLPPCCTGAGAGGAGRDDARPHGAGHRSPAVHGAQRGPHPGDPGRGRGGERVARRAAGRRRRLRRAGAAPAGACRRGGRAQLRQPGGGRRGGGGRGGAAPARRRRRRPGVAGGGAGASPRSAGAVSGXXXXXXXXXXXXXXXXXXXXXXXXXXXXXXXXXXXXXXXXXXXXXXTSPRLRLFIAPAALANQAAPRHASVSHCCLPHLCVLHLXXXAIGGEQGQSDRRRAPERSAASRARPCFERPRAVPDFPLHPLRAGPRSAPPRASGFSSCLQRLPTRLRRDTPAYRTAACRTCVCCIRGKLSAGCPPKPLLPCGVVPTPNCTAASCPSPAMHCAVRATVLPSASAPLSRLAHVMPVQNTAASHACRAGIXXXXGAPQRQCSPASPGSRNARPEHSSEPCVQGRDERTCPAPCNMRPQILKGGPAAFLLESPEAQGVLFQRSGVVRCGRPLSSIRSTSNWSGHGRP

SEQ ID NO: 9521 - protein, 489 aa, Chlorella protothecoides
  MOD_RES (280)..(283): Any amino acid
MRLDSGMEEMPRVQVPGLEITSGHKGKGAMSPFTTISSSSPQLHYSESGYESQYSGREDLGVGQTSGLADNMYLMRTGSQPAALERPHCLAPAGMFNPEMMRMAQEMMSRMTPEQVLGGCRARMAEMQRQAASMSPDMMQQAMRAAQGASPEDIRRAQAAAAAQTPESLLQQAQTAIPQLSAREKMVLSASETLKQDGNALHRAGKYEAAAEKYARAVNNLTGEYLLRGYFCEGLAISGGKSLWANCPALAPPGGLLQSTVRHQAPAPTDAALHPPPIPXXXXSGGKSLWDNCPALAPPGRLLQSRVRHQAPAPTDAALHPPPIPNFPLAGRTDAAAVSLRLGCQNNLGSCHLALGRWSEARADCDAVLAADPANRKALYRRGQALLALELPELAVRDLAAALGLAEGDDRDVIAAKLAEARKLAEDKAPAAQAPRGGVEVEDAPPTELRGVEAGQPRKVGDVVIEEVTAEDVPGVDEPTAEARGPAAA

SEQ ID NO: 9522 - protein, 206 aa, Chlorella protothecoides
MALMLRHGLSSIRKLTQRLAGPVGIPKTAGLPAPLAHESRRWSWSRRNIHASMARAQPCTPLPARTEYQYFGNRRPVLSLSNPNALRVLAGLGGGGLVVYVVAQQEVPYTERRHAILISQAAERELGRQTYRQVLEEARAEGSLVPSHHPATKRVQRVGSQIAAAVNRGQGGGFQEHMQGLEWQFAVIDSPQVNAFVVPGGKVVVY

SEQ ID NO: 9523 - protein, 168 aa, Chlorella protothecoides
MTGSGKSSGWPPSSTNRATTSSLSCSRSTWKVGSSSRDLPCVAHPPTATRSRCTAPSTWLSPSISTEAIKLARKDDMDWILHVDTDELMYPAGSPGFSLQEVLGAVPSHVDSLVFPNYEALPEREDVLNPFLEVTLFKKNFQHIVSGEAVGAEALASCNLPLCIAVSW

SEQ ID NO: 9524 - protein, 250 aa, Chlorella protothecoides
  MOD_RES (169)..(172): Any amino acid
MLAPSWSPCSWVCQGQIPDRTLNPPPLHFPKAATTGMERALGTILGGFSGFLVFQIGELFWNEQTDGMVLTVGACVVSFVAILVGHKLKLDTSARLYIITFLLVIFGADRGSGVVLILILSILVFPKSASIECIRNVETALESLKELNSLAWTSYILGPELGEASVVAXXXXEVPGNDVVLIAAGMVKGLCSLHRLSPEATPTSRSNKGYMSIGAEDVEAQVPGSAAAAAARAAAEDAFESKVEKVRSAR

SEQ ID NO: 9525 - protein, 635 aa, Chlorella protothecoides
  MOD_RES (205)..(217): Any amino acid
  MOD_RES (502)..(505): Any amino acid
  MOD_RES (606)..(609): Any amino acid
MEARLHTAVSSGEEYSTISAGQEPGVDGGMPQAAGRCAMTRAGHGDSHPPILVTLCATKTKHTLPPPITLTRAQVAALDGAQVLLVALRVARVLVQHEGVPRLHLRLHDSKPELLRLDHAARPAEGWDAGGLATARGRHPGQQRRPTCVVQGNHPHPTSIPAPCQEEPMPTQSLTMPPPTPSSLTPHASSWGPTLRHKSTNPPCXXXXXXXXXXXXXPPPPRPPPPPTPIKFTTNNNPTPSPALPLVACVQGLELGAPAVCHARGLVGAEEGPGLIGLDALHEEVGDPERVEEVARTRLLLAVVLAQVPGGAWVFEMSSSGGPGGNWDWMQRERRPCMPAMPPHAQHSATNTPATALGRPDTNSPATPTHHSDSQPVEDVGMPGLEVHGKGALALAAALVHVARGVVEDAQHGHDAVAGAVGAADVGPRGTDVVHAQADAARGLGDGRTLLQRVVDALDAVGLHGHQEAGGQLGAGGAGVEQRGRGVSEPARRGCTPCETEXXXXVGESRFDCGGVSSTYVVGQRLHPMRDREQNGIHSLPALGQEVVGVHGSVHVLLVDADGHAHEHVLRALHYGPVDAQEVGSLQRLPVRGGKGRWGWQWKGDXXXXVCRSGGGRGGGDGGGRANQNAGYVQD

SEQ ID NO: 9526 - protein, 106 aa, Chlorella protothecoides
MLYICRIKIMYNHISPKNGDRAPLIADDVFEIIIKNAARLDSEIVYDRDFDYDYFGFKTLERSYLLRVNGAVVERPQHMLMRVAVGIHKEDVDAAVDTYHLLSQRW

SEQ ID NO: 9527 - protein, 104 aa, Chlorella protothecoides
MPCRSTHADLYFKNYVSVAHGNPNYFVTYANGKAAARIHPGLRPNGAHRWSSYEKSMEEWTSEVAAVLHYTYNRFSDLKGRRDRCDCAPTEEDAKRCFILPFDR

SEQ ID NO: 9528 - protein, 90 aa, Chlorella protothecoides
MKADSIEGIYDTLKECAAISKSAGGIGLSMHNIRATGSYIRGTNGSSNGIVPMLRVFNDTARYVDQGGGKRKGAFAMYLEPWHADIFDWL

SEQ ID NO: 9529 - protein, 590 aa, Chlorella protothecoides
MSWCCGGVGVGAAECCGGGVCRRVLCVRWHGRHAGSALSLHPVPVPSWPPTRAHFKHPRSARDLRKNHGKEEARARDLFYALWIPDLFMKRVEANETWSLFCPNEAPGMADCWGPEFEALYTRYEREGRPRRVIKAQQLWFAIMEAQVETGNPFMLYKDSCNSKSNQQNLGTIKSSNLCTEIVEYSSPEETAVCNLASIALPRYVRDASGREGRKLIGSLDAKGRYFDFDRLVEVVSAATRNLNKIIDVNHYPVETARRSNMRHRPIGLGVQGLADTFILLGLPFDSPEAAQLNRDIFEALYFAALSTSCALAKDLGPYETYEGSPMSRGVLQQDAWGVKPDSGRFDWDGLREQIKSHGVRNSLLVAPMPTASTSQILGNNECFEPYTSNIYVRRVLSGEFTVVNQHLLHDLTRLGLWDGDMKNELVAGNGSVQGLDIPDALKALYKTVWEIKQRTLVDMAADRGAYIDQSQSFNVHMSDPNFGKLTSLHFYAWKKGLKTGMYYLRTRAAADAIKFTVDQQQLARKKEERAARANVAATLEELSLAAGAAPAKPKPVLDTDAAREAALAAMDLGMVDGGGVDCLAGIMGH

SEQ ID NO: 9530 - protein, 348 aa, Chlorella protothecoides
  MOD_RES (26)..(29): Any amino acid
MLIWVRSGSGISRSCVDGGHRPECAXXXXVVLVSADHELMVAIDRSARHPHRAAMGHLRLWPSCRAHLPLRPAQLHPLLPHAATLSPCPVAPHFPPAPSLSDPWKTLGVGHSASEEEIKRAHRRLVRQHHPDLHAPGDEAVAARFISIQQAYEIVMGRALGRLPESSQHGGWNFHDWWALGFWSFARRRADEGVPKATGPPRREQWEQQLHLLRRKAAIKRGAYAHGAATPQAPAPGRSAHPEHEEAVPGTNRVAPAEQMNRAPGGGAPSAAGDSQPPDADAECAEDTGAGGECLQTPAAAAPGMHSEPPPPPRIPFRSSQDTREGVTIQLAGLRRRAGIKKDLTPAP

SEQ ID NO: 9531 - protein, 175 aa, Chlorella protothecoides
  MOD_RES (170)..(173): Any amino acid
MFCSTRYSWLITLRGEASHSWTEVHWALAPEFFALPSHRGQTQGTGRKDRCDRRLQGVHWRPFLLGDFCTQSEVLLLLTQLPEVHDVVECEAQLDPRPQIFKDRLTLPLLNCPCAHYPWDQVGSDIAHVFCTQGAATVIKGYSPELIVHPYLPAGEDRDDTEKAREGPGXXXXSS

SEQ ID NO: 9532 - protein, 66 aa, Chlorella protothecoides
MQRGQESWAGDGTRQGPPAALLACYGSSLIVRKAAHRAYACKGRAMGAPDLIDQLGPVVDDLVGDH

SEQ ID NO: 9533 - protein, 131 aa, Chlorella protothecoides
MVNSAPALVKGEEPCGGGKHGAIVLTPNVVELGRLAEALGVEAKGADAARRLARALDGPAVLQKGRVDVAADAHGQLECEEPGSLRRVGGQVSIVTKMWVVEGLGLSRIILVASHLLRGVCRCSWACLPPV

SEQ ID NO: 9534 - protein, 147 aa, Chlorella protothecoides
MPPISCMAPAPGLRLGPTAAQGPAPHPAPLPSLPSQRGNPVARLAVSDLATPAIAVFDARSGGDEELGRVTLHSSPVTAMKFSPEQGAVISVDAAGGASELAWVCTCSGQGLRPAVRGVGKRLSLASGSLATARPGQAGRSPRCTHP

SEQ ID NO: 9535 - protein, 161 aa, Chlorella protothecoides
MVQHLVAHAGTPVLLDAAGPTMISAIAWIPKGVAKAELEQTVLSPEELAALRAQQAEAGTSDEESEWEEGSSDEDEVMDEEAAVAKAQAMAATVKGLTPDPEASGPAPGPSDESLAAAMAELDMEHYDDSDPEEAGTSSMNRILGSSGNPGGCETLVWSLD

SEQ ID NO: 9536 - protein, 725 aa, Chlorella protothecoides
  MOD_RES (366)..(369): Any amino acid
MVAAQAAKAAEASASEAKARRIVQAKRKQQERRAAAAEAAAAAAAAEVTPPAMGDGDDQPTAAAPGGGPAPGGEVADNDGDVKMEEAGVTPALGSTADPGSTAPPAAPATTAAPAATAGADAREPMEVDEGAVKEEEAGEPASAEATQASVQAPEDGSDAAPGEATGDAADDATIDAEFDALRQPVALQRWACAMTMTGNHCQQRPDSPPPPHPAPTQDAYKPLIPAMASVPGKDKELQEYKGLLQTVLSCLKSVLYTLVAFHSNRGLATPLSFPVEPWSSRPGDLAVVSRILAAGLPTLALYRAWPAAAAADMREQFADLFTVLQDGRDFCDVLAPRLPALFDAVAADAWYLPVVRHLVDGDQAXXXXDFCDVLAPRLPALFDAVAADAWYLPVLRHLVDGDQAARAGVNRHMVVALLRHLVGERLGALGEPGSAEGALAAQLLETCFEALPRMQAADAAKAAQVPPAPAAGGGIEDAVLPHVLAFTQHVYARLSLDGPDAEVWEWDVCLCVVSREQVGGGAHAAVALALLRAGDGQVFEGPGRLWAHRAARARDRPDPGHDGGPHPLPRGRRAVRGAVPPGPRPTGAPDPGDAAPGGGAGHGAEGLRPRRQRGTACAGRVGGLLQPGVHREEHGRTHPPADAGAVVPDPAAACALWRARGRDPGQDGRAIAALAAGPGAGGAQGHPRVRLARDPVLPGPHLLPGAPGPLHALRAGRAGCGRAA

SEQ ID NO: 9537 - protein, 470 aa, Chlorella protothecoides
MMHGHAGQEVGRAALGLQPWGQGRRAFHWRGLRPGPLRCRRGPTHVLVHCFATLIHAAIVPPSLPSPAIAQRIMYDVHKIYKLSLEDQSIPFFEWLKQVTACRCLGDGGAGSAVRAWCVARHTRQQMRMQSLGPLPPPRRSHPSSAQRAPPQTPLQLYESMPAAYERFIGSRLEDLGPAGSPPPLVPARASFKLAAEVAVFVVFLLQSYPKRMHQYAAPLIPVIVAAAGIRGPDPGATPPALAGAVYDLRMAQIKMLAFLTVMARPANLQAAMLEHRDAVCAALVRVMTTVPEVAGIRKELMIAVRNLLATKLRPGLLASMDVLLDERVLMGTSRACIESVRPLACSTLAELVASVKAEMTLPQLTTIVDIFVRNTNDCTAPAALQSTSMRLLYNLIETIFQRRSGKRAEGLWVGVWVGGVRVWRGFGCEREGDGGAGTVLDWVYAARRGAGTLWEAVQGMLWASGRGAH

SEQ ID NO: 9538 - protein, 355 aa, Chlorella protothecoides
MERSRGTRKEVWAWKHRITRKPYSGMALCATCAGSSSQRRDRPPILPRISATRAPKGAGGGRIRDHSACISGRMCAAMLFSMNSGLKESTHTSSTRSATLAARSEPFSAVTSAAARRGITGIRCSSRAGARRHSSAHSSPAAGEGVGPAIMPRVRSITRTCSPVCPKAAWTFKNLPVASAKKSERNSRITASSMPPPAAGAGGTCAALAASAACMRGSASKQVSSSCAASAPSAEPGSPSAPRRSPTRWRSNATTMWRLTPARAAWSPSTRWRRTGRYHASAATASNSAGSRGASTSQKWRTTGRYHASAATASNSAGSRGASTSQKSRPSCSTVNRSANCSRMSAAAAAGQARY

SEQ ID NO: 9539 - protein, 144 aa, Chlorella protothecoides
MQDSLRSHLRSLGTVLGQATKTATNAAMEVSRAVATEVGGARCLQDYALQAQVATGGPQGLWRIYSAQAKKSGGAGCLKTYQSHVLPSIPLLRSAGVVSAWILDKRALTESDAGGGGRQGGLTRPSTKRLEAFLEQCRRDVQVT

SEQ ID NO: 9540 - protein, 231 aa, Chlorella protothecoides
RGRAGAPRRRFVDLACVEPTAPLSTALRLLLETGVSCLPVVDDARTLLDVYARADICMLAKGAPALRCGVVNIRRSVCCTAWKTQDPHPAYQPMPPLLSRVQGNAYSRLQQEDVTVGQALTLASAPTAPTQVSAWSQQALTLASAPTAPTQVSAWSQQTATILLPSTFSHAQSQHLGPKQRVWICTADDSLRTVVERLAVPGVRRLVVVDGATHRVEGIVSLSDVATFLMV

SEQ ID NO: 9541 - protein, 129 aa, Chlorella protothecoides
GGGVGLGWGWSEGGCIERWKCCSGIEERGAETGGRQLPLPLPLALPNPEIPGAWLTSPAPGSPLPSSQLILQSPTPRRAEVSDIAIAVREGADAVMLSGETAHGSFPFKSLDVMAMVARRTERAMLSYE

SEQ ID NO: 9542 - protein, 167 aa, Chlorella protothecoides
MASSRFWSMSRPRAGALRWPSRHFPHLALTATTLAALLYIACTRAPSPCGSQSPAVNAALLSYPPHGPGVSSQNATFEHFKRRSEDDLRRAAALLASWPENKPKAAYFVLARQADLQGVIQSVGDLEARFNRRARYPCACFRRHGGDLLRHRPRWCRLGLGAVGVER

SEQ ID NO: 9543 - protein, 413 aa, Chlorella protothecoides
MGAGGRPACLPACRRTGLAPSEVGTAHSAARRLAQGPLPPPPTLAPCEPSQTTTDSDITGRVVEDCVRWMSGHALHREGLFTDPGHVDGKKLLALRKAYEAGKRPLRRSCGPHDPLTVSFGSRQWGRRVGFQPIPCLCSGSYSLDPFQSRSSPRPGPAQVANFLLLWLSSLPTPPVSRGTASRLMEAAAQAPGAGPGRQELLRRALRGMDGAAQDTLYALFEFLHHHWINQRDRRQALCQLARLFGPLVVGARRGATPAQPACHAALEATAALIADFRRLFVQPMKLQRYLADLDLPDECGEAGAGATDTSSETADATSGLEQESCPDPELVAVLDGMLGDILGVSLAGAAKAAKEPWSPTGIADAGAFELDGMSESSSFSSAEDGEEDSPQRRLWGSRGGCVAGGPPLRLVV

SEQ ID NO: 9544 - protein, 290 aa, Chlorella protothecoides
  MOD_RES (97)..(99): Any amino acid
MLQTMLARPTPPFSAVSDLLLWRDPVKSGVVLTLATLAFAFLRYAKFNAIVVTAYTLVAIVIGSFAWNSLRAVRRTSEASQTPFLSVLNPAKCPDPXXXVRPVRQQVSWLVTGWKGVNTRAGRAGCGASGVPLRPSVSFSISSEPCEVPRPRTVSRVGQMHGACHWWAPVPVPEVLKRGVTEQEVQAVAQRGTVLINRVLGFLKRVLHLTDPIATGQTVAALYAVARIAGLVSPVTLAFVLVLLAFTLPKIYELRKPQIDDAVATLKVQVSGRQGRGMGAHVGAMVSRAV

SEQ ID NO: 9545 - protein, 238 aa, Chlorella protothecoides
MRVDVEGNERLHRFGCLQAQPHPSPELLMSGQRALPPFTLDRDEVFWSNLSAARASLKDWPAASAAAETAIGLKPRWAKAHARLAAAYTGQEDHVRVCGRGVCVLVACFSVRPPPARHLPEHRGSRTRVLDPPPGVGTAPAGASRFNDEGARHPLQAVERYERALQLEPSNGQFQEALSRARVAAGKQEAEGKHRFKRKASAAAEERPVALAGSGKAPVKKRSTILSFSADDDDDGET

SEQ ID NO: 9546 - protein, 240 aa, Chlorella protothecoides
MWLLRSSATRAGGVQCRLACIPPRPMPLPRHRPGPPELTQAVLRVHSRSARGPDEKDSSRRTHSAAVALDRALDALSAGLLDFWRWCEFVGEAAGLAAMHADAPDSAARRCVAAVARQLERMLDTSAKGAQPRGDEALRVLTGFMSSLRNPTLARPPAVEDMLSWNVLTPHYEEDVMYALNAASVARHFDLQPSAATGMADLVRENEDGLSVMQWLKSAYAREWDHLLERLGPALNGLEP

SEQ ID NO: 9547 - protein, 408 aa, Chlorella protothecoides
  MOD_RES (148)..(151): Any amino acid
MSPQMTAKVLSVPDEPSEISAFPSSPATTRAERQKPSALPGTPLMRSRRAPMPHRRPVMNSFGSLHAPRARRPAGSLLGGFGGVEGCEVGVSHGLLGGEPLSVVVSQQLVDEVQGVWCHQVLVLRRHKPGPGLAGVPGILVRLPPLAXXXXLSPPPITSSLSAAPTSRSLLKSLLPLSPPSLPAMPPPPPSPPHTHTRFLNTPLRPPANHGLQLRIQLQAILGKVAIEVVGAQHLADLDQLVVVVLAVEEGFLAEDHASQHAAQAPQVQRIVVVLQVHQQLRALEVAGRHPHVVLLARVVELSQAPVDEAQRAALVVDHDVVRLHVAMHDAAGVGEVQRAQDLVDVVPDVCVAQRGVKHLEVGVVHVLKDEGGRLGCRIAHHVQQTDDVGAAPQVLQDLDLALDLQEG

SEQ ID NO: 9548 - protein, 267 aa, Chlorella protothecoides
MKRNSQHAQGLKLPFPSSRRNQDDYEVVRKVGRGKYSEVFEGINVKTNQTCIIKILKPVKKKKIKREIKILQNLRGGTNIIGLLDVVRDAASKTPSLIFEHVNNTDFKVLYPTLGDADIRYYIHEVLRALDFSHSRGIMHRDVKPHNIMIDHERRALRLIDWGLAEFYHPGKEYNVRVASRYFKGPELLVDLQDYDYALDLWSLGCMLAGMVFRKEPFFYGQDNYDQLVKICKVLGTDDFYRYLAKYGLELDPQLEAMVGRWAEWGI

SEQ ID NO: 9549 - protein, 251 aa, Chlorella protothecoides
MDVQEVYTDPGVHRWHCTGAVLCPRRFLHPRQPATSFTNGHCPDLNCQPHPSTVFPPDPEKKLDTLTPRLIYCLVNGLGLAYACYRIYGMGLFPTHLTDWASTIPAPIVTEDPDTAQHVGPVSVYQPRPCRKVDPSLLPHAHGAHEARGASQDAPLQGIGGCGRGRHRQRRVGGLLVSACAHGAPKSNQSNRSLRPDNPPAPLPDQVTRELRRCSGVLQSQGAERGPAPYHAPGVRHVGEGVPREADDHRE

SEQ ID NO: 9550 - protein, 245 aa, Chlorella protothecoides
MAGNTWVAYKRLPWDICKVQIQTRLYRFDASYPSHGQSSGVTGQGSRLPSGALQAGFWDWPMRCLFVKPNPVKSVLRQDSSTKFGVLHIFLLSESPSGDIHRAYWRAMAEFRKFKVDLDSNSLVTSKKTVGDPIGFDLSFARDQSELSGASSRRSNLANRQAALFSLAQSPFKNVAMMSFMMWMAGAQLHLFSIMTTASGVYQPISAILKSGEGRGTVLHLGPMLDLGSLEGRWALGKEQRTLSF

SEQ ID NO: 9551 - protein, 145 aa, Chlorella protothecoides
MRGMVDFVTSRGMLDVAFRPQPAFAAVKRHYTHGLLGRARDGSVVELECLSQLPAAYPRLAREGVGQDELLAHLMFTYEYVFKVLDTAPLPGGKTYKIVDLGALSMGDLRSEGFKFISKVRGARLGVEGYAPPWRDFDQRTPASP

SEQ ID NO: 9552 - protein, 428 aa, Chlorella protothecoides
  MOD_RES (14)..(17): Any amino acid
MHGLLPGIVCSTNXXXXASGSQLATWTPHASPLAALAIVSGEAHVATAGKGERSATVWRMAPGRRGKAMRFTAAATLSLRVPARALSAAGMQGQEGGVVVAALLQDGSLEVFVAAELPTKKGLPAVQATRVANTGEGAGVLSATIKSADASGECVCFGTGKMGMRVTGWRASGRGWTMGTAYRECREGVLNGCTLLLASGPAAKPHFQTQHVAFSTDASAPTIIPIMSDEVGGMLHGDWGAFQLTPQRILYWESQGPMLCAECRGHGCSGASVPMVQVRSLLVSSTAAIASTAPAAGPGKKGVSIVGVSDVARSMVATPSGPGSKRGAAQASDDEDESMPEVRGRQGRFDPPWRRAPTGSQASFLQPFPPHPAPPSQALGGSEDEAAQAAEAGPTLGERLAALQVSAGVAPAPAPAHGTGLPARPSAA

SEQ ID NO: 9553 - protein, 308 aa, Chlorella protothecoides
  MOD_RES (288)..(291): Any amino acid
MAPPSPLLDPTQSQLATVSGDGRLKIFGVASQRLTVDLTPAVSGAIGASGASVDIITSISWGNKVGLVVFNYFVCKLRSSKGCKGAVVCVYEIDRLWGDWMIALAHASLSRGSVSVGNQHETHHLQGRIVVGTASGTVKAVDSASTSQAWNTTPTGLEGGVAGLAHSPDARQLLVVGRVGGAAVLDAATGAGVSSFQVRSTASVSGVDGGSLSGGMRRHGEWEGSGGPKGPLTGVSVLSEGRALISGTTTSLVDMASGSQLATWIPHASPLAALAIVPGEAHVATAGXXXXAQSPALARVRERGEAEV

SEQ ID NO: 9554 - protein, 384 aa, Chlorella protothecoides
  MOD_RES (216)..(219): Any amino acid
MQGGRWGCMHDWKFLPAGTGREGGPQGATIRPFYCPARDPPTIGQRYEMGMHARGSVFSKLCFTSRTPSFRSYRARPSGDMAACQGIGVSQHRSLIGTYGRFPGDPFVRRSGPCNMTAHRGSPTTIAGGSAWRMRPRLSPVRAHPGTPPVDDGELVTPDPAPEVLPLELGDAELREATGLQDGLAGSDFPAQDAADERAEEAAAAAAQDVDAAATXXXXDGLAGSNFPAQDAVDERSEEAAAATAQDVDAAATRHWVSLPSLPASLAERPALRYAALGLGGFLALNVVLVGVKALRKALSPQQRRHRTVNKNQLVVTTLAQYLPSNRAGLAGSILGSLRFRTGFNNVEIFRKYLWYLLRERAFKQEAVDDLLALKAALQLTDSE

SEQ ID NO: 9555 - protein, 349 aa, Chlorella protothecoides
MLRSVLGTPRSESDGNLLQLAEKSNGEESGGDEGPLAVAPGARRTADSSVVDDDGEEPPRALPTGAEAVITQVNTRQGAPTGPALGQMVTLPSTPEDTSDLRASWRNKVRWRPQPMLRPPDSPSHLLTSPPPHLPPAPPNPFPPPMILPRNIFCCLVPGPGDQYTRQEEGPVVIRPVAPPPPSWADPVIGPPSPADIGKKCLVLDLDETLVHSSFRPVASPDYIIPVEIEGRVVDVYVLKRPHVDAFLAAVGDRFEVVVFTASLGKYADPLLDLLDPAGVVRWRLFREACYPYEGSYVKDLQCMGRPMESLIIVDNSPHSYVFQPENALPIGTFIDDPEDQASGRYSFH

SEQ ID NO: 9556 - protein, 154 aa, Chlorella protothecoides
MPDGPVIISPDGLFPSLYRGGPRLAKPPVALNAGAVPPRLAACQDRQTHSRLPCLQVILRRPHEFKIRCLEDIRSLFPPDWNPFYAGFGNRDTDEISYLAVGVPPSRIFIINPKGALGLGQASDLGSVVCMPWSKWLHSAFLSFGMIHGTSHSG

SEQ ID NO: 9557 - protein, 901 aa, Chlorella protothecoides
  MOD_RES (729)..(732): Any amino acid
MGGSVMRHCTPRQNTCWASLLAHPLEGPRRQRLHTAAPCAARVVSSHPPSPRTCILACVSSLDTTASSLEASLRTYWAGGWVVKLGSMWRPPPRRVIRKGHTFFDGLLDLYLFGLLLCLALPGGPHQLLARELEVEDLVQQLVIRRGKHYRYRNGISGMRGREMGVIALVKHTLATRFRREQGFSGARARSQTRAQICDRGSRSSYGRWAPCPLGNIPDPLISTLVHDFRASGMGVGRSPEVAGTTTGPVVPGRGTCLPRRARTQRGPSRAHLISCRAYTGTRGAPDGDPAATERVLRYPDGQERRIRYPLPTTETSEETLVEAWETLNAYKSSTGWSPRAQPALRDEVRPAGCGADLLWSSVYRCHLLAASCTRPVADSPTHLPPTHPVPSPQANSQVPNSPLALLKRMTSPEFLARAVAEEEKLERSYRVHEGCPWPAPRPLYVLALSEGGPASGAPGALHTLRTRLPLAGVQDELNQVGVVRSFLLSFGWLGLDQARTGDSVQGHGACLARRVAGRGQVSRSSSSRISPVTPTPPNIAGHGLEQPAHRLQPGGRRRRGFPDPGGGRGLRGGAGGGAGAAPRLSGGGGDRVARPLPQHGRRTGGRRGAGRRSGRQRAARTPAAGGGAPAPDPGGAPQVVLASPLLSKERQQQRARGLAAVCARMNPPGCAHVTVPRPAVPSAGFPVSSCTASASIFPTPSRSRGPGGAHGTEEEEDHSPKPPPWDKXXXXHRGGGGPLTHAPAPGQLRAASGGGRGAASALPHHHHLVTRGGMHESPDRHHQPGGKWRQVVQLHDVEAAREVLIQGGGHVAHHRQDAGGGQDAGPAGIHAHHQVLGPALAGDVRQAPLHHRALHQRHDDVAVGGRRGAAARLVRGRAHAQDQDGAGAGAFVPGRGPVRE

SEQ ID NO: 9558 - protein, 327 aa, Chlorella protothecoides
  MOD_RES (295)..(298): Any amino acid
MHDAVAAWSCNHGLCWGKCLTLLPFLGTPGAPKATCRCALSRVGGGTLCRCLYRPAATPQTIAAQAPPLKSTQPRRRRSPQAPPHPNSTSSHPPLLTAGVPAAGQRGRVGPRPRRPPGRRWHLRQRVSLRPGRARLLDGPPPARARHGGQQPRRAGRRDGHCPRRRRGAGPAAGGVRGRVRQAGLCGRRLSRGQHPPQRHSPQEEQGGLFFIAGGGGGCGDVQGCMAAGDGRGGAAAFLAAAVFCRACDIPHHLALPAYTQDNLILGSVVAVCLLFILIYWVNKCPWSRLNSCHXXXXSTDGEGAAGDRLSRPDVALAWRQVARGPD

SEQ ID NO: 9559 - protein, 54 aa, Chlorella protothecoides
MPAVLSTARHPPRRCKPKKCRQECKKSCPVVKVGELGLRNWPTPSGRPWALDMA

SEQ ID NO: 9560 - protein, 190 aa, Chlorella protothecoides
  MOD_RES (165)..(168): Any amino acid
MLSGPDHEPQLHVPCLQPSHLTFSLAAPKVETGKEKVTLQRDEVVGDRAIGAGMAGALAFLQSRGDLDTAVEWSGRTNDSKKVNVSGQGGRDLDCSLLICSTSSDIEQTCNWSPGSSVAALAPPCLPPPPLPPPSTQHADPRPRRGVLWRPHRGQAGAERGGSAXXXXLVILVCKGRHVPHSGVPLAGLE

SEQ ID NO: 9561 - protein, 317 aa, Chlorella protothecoides
MSRRGPVPLFRQMTTIHAEGDSPIARPPCKTHNHPSRPFFGKSAPSWLMAATLKLQTRRLPPEVNRMAATLKLQTRRLPPEVNRALYVRNLPFNISAEEVRGRVCLKVPFGPACIPVAHPPRHPPSPEPAPSHPPQMYEIFGKYGAIRQIRVGSTKETRGTAYVVYEDIFDAKNAVDHLSGFNVQVCWAQRQWDGSGESVASFSRPALMGVCWRAGLHASGGKSVSHRAVLQPGQDEGKGQPEGAGGVAAQDAREVWGGWPAAPCASAMRPLLDAAFAAGVAPLRLCWVRARVRAGSVVRRLSLGSKCTRACTHAGL

SEQ ID NO: 9562 - protein, 146 aa, Chlorella protothecoides
MCPAPTTSSSPPTARTIWASPPPTPLLVGAGRFELLCRVVQGLWDLWTWGSVGCGMYGRGDRCCVARLLPPFGVLCIFGAHMWYELMPGQPPCPHAALLTPIPHQPGAPSGAMGGARQVECTINGIGERAGNASLEEIVMAIALRG

SEQ ID NO: 9563 - protein, 231 aa, Chlorella protothecoides
MRIACSRTCKQTPEPAPRPPACRCGRHRGWLPHRLARRLRGRALNCHGGGQQCGRRRLRPGHLRPVSVAVRGGGGGLVGQCPHERAVLVLSKLYRPGAIFGGACCALLAPRMSHYHCPRPHAKCNALLLPISPSRSEADLERAWDAVRHARHPRVHVFLATSPIHMEHKLRMTPDQVIRQAVESVKHLRSLGCKDIEFSPEDASEPRVGEGCVCDVHSCWVGGNLRGCAST

SEQ ID NO: 9564 - protein, 624 aa, Chlorella protothecoides
  MOD_RES (50)..(52): Any amino acid
  MOD_RES (247)..(250): Any amino acid
  MOD_RES (270)..(273): Any amino acid
  MOD_RES (315)..(318): Any amino acid
  MOD_RES (577)..(580): Any amino acid
MMRPALKPSNTFSWFAGGVFVIALISEATARISNTSGMKGIPSLQVGVGXXXFCSSGEGLQGFQQYVWDERDPLSARGCRVIAATLLGLKIIDASMLQPDNIAIIIYTLSTTCVGIPAISQDLRSPCGSTAQRRTRLDGYCAARILRSGVWGPSPCTDPGEVFKGGHSSVPPHSRPWDLEWLWVCSSRSRKHCPSCELGLFRGQRRVRKRGGQPVHALGTTSVPHSHAGPWIFKDWEAWSRTPGPSXXXXAGPWIFKDWGPWSRTPGPSXXXXGGGVGGWAGCFAVQLGMSHPVRPQGCVNNARSGQCAGPNPPXXXXPEASGGPGGGVGGWAGGLAGLLCSWELVTLYALRVVLTTLAQANVRAGPPHSPLILPSPTPPHKLTTQVVETRVADYVEKGTALEAGLKAGVASVLPQGIKDAIPATLRESLLGRDTGRGSGDGPASRAEPAAAEKPQSFANNLLQRQQPAPATAPSSNGASAPGLATWTITTDEEDGVARPLSPGADVSGVGDAPPAILAELAEVLQGVGALKSTLLALRTNGDPALGTMSRLNVREAEVGLSGCRAGEGGDCAGCRXXXXNVREAEVGLRGCCAGEGGDCTGCRMPQWAKSPGTGDVLPHCLLH

SEQ ID NO: 9565 - protein, 138 aa, Chlorella protothecoides
  MOD_RES (124)..(127): Any amino acid
MNNCHVFRYLFSIPQASLCYSIATSASPATQSCQDGTAKPSTLPASGGASSSQAGFTPPPGPLGKGATAGTTSQAGPGPSGQTPGQGPGGGGLGANYLAKMLEGYRAAKGDKCVGCGDVLGAAXXXXGRQGRQVRGVW

SEQ ID NO: 9566 - protein, 179 aa, Chlorella protothecoides
MPLLIQQPTNQVTDRNVENLSGGELQRFAIAVVALQEAGVYMIDEPSSYLDVRQRLKAAEVIRGLLASDKYVIVVEHDLSVLDYLSDFICCLYGKPGAYGVVTLPFSVREGINIFLGGFVPTENLRFREESLSFKVSDTTVDGDEGAKRFLSYKYPTMTKTQGNFKLHGCVVWCGGGGC

SEQ ID NO: 9567 - protein, 137 aa, Chlorella protothecoides
PGARPVLVLRVGAASHEARGRAAAAAYGDVIVTLVQGAVMEGRLADVPGEGRPQDLVVRVDAGGASVLSSTRILPVVRYVATTLNQHFPGRLYVMELHNLPPFATWLVVAVRGLMHATTRDKVVVVGEGGRRAAPPP

SEQ ID NO: 9568 - protein, 134 aa, Chlorella protothecoides
MTHDAPTHDPTFRLSYVPETPQIINKSMVGIVKSLDSALKANNLEKVAATMDQFEKQFENLDVQSEFVEQAMGNQAALSTPEDEVNLLMQQVADEHGLDTKLGLPAAGAAQAAPTPAQKEGNDLAQRLAELRGK

SEQ ID NO: 9569 - protein, 394 aa, Chlorella protothecoides
MTAQCVRLLFFLAPLTTGRAKEKRRQEELLKSTKKLGETGDDVDNDTLQWIERVEAERKKKQAAAKPIRAMNDSDEDEEVGAGMTWGQAAVAIRKWFQGILCGGSMAFAVTCIHSRATHPCHRRRMQRQATLAQTWPGSRWVARHSVDDLEAGESVILTLEDRGILDDKGNLVDDEEAALENILVRETKQREKAYRDSGKVAKPLWEEDGRQRTLLDKYDEEEEQVIQVRPGPVDGGGLKTALGGPSTPSSLPTELLLVTISHFSSILLLPFLTWTTTPKPQLGGDGSVVATQQQQLQGDVNARLKAGLALLEQVKPASDYYTPEEMEQFKPKKTKKVRKLKKKALTAEELEALAESTAAAAAGEDLGSRASREARAAAKAAAAGEAEKERRER

SEQ ID NO: 9570 - protein, 81 aa, Chlorella protothecoides
MLPSFTTHPPAQYVLTHADNHEGAKIYAQNAIRKRAEALNYLRLASRLDAVVSRLDTQAKMQVRGEGGWEETTRAAQGAAV

SEQ ID NO: 9571 - protein, 101 aa, Chlorella protothecoides
MQSPPDWADILTHFRGSELQNYFTRILEDDVKAIIKPQYVDHIPKARQGAGQWSRLHLAVLKAVRGNVGVVLEEKDQRGQKEALLRDLDLEQVRQSACAWL

SEQ ID NO: 9572 - protein, 91 aa, Chlorella protothecoides
MHSKKTAFIVEHDFIMAAYLADRVVVYEGQPSVDATARTPQSLLTGMNLFLKNLEITFRRDPTNYRPRINKKESLKDREQKSAGTFYYLGD

SEQ ID NO: 9573 - protein, 619 aa, Chlorella protothecoides
  MOD_RES (29)..(32): Any amino acid
  MOD_RES (300)..(303): Any amino acid
MVACASIILQESTARFSAAHVPPPTPLHXXXXHSPLCTHHSAPTHPFTNPTAHMPVASYPRSTYFCPVEALSRDLETHAFGNPHSVNPPSLLTDARVDSARRRLLALFGADETTHDLVLTRSGTGALNLLGDAFPWTPESTYAFTRANHNSVLGIRSVAGQYGAQYGALSEEGAEAWLADPEMRHPPFLPGGSEHAGPRRARAAAAESAHRPTYSLFAYPARDNYDGVMYPLKWVQAVQAKSTPGHKWKVRLFWRELIGSKVVDLGRGLTRFGRAGAWTGCAGRTRISREPLVSWGVSSXXXXRLGRAGPWTGRAGRTGISHEPLVSWGVLLDAAAFAPTAPLNLTETPADYVILSFYKLFGLPTGVGALIVRREGAAPLRKAYWGGGSVFLATSALDWHHRRLPPASLEDGTLPFLDIVALQYGLDAFERLGGIHAIKRHVGTLAAHLYDRVRGLRHSNGAPLLRVFGKHEDPRRAEVQAATLNFEILTPRGGIYSYRTAGVEAAAAGVYMRLGCTCNPGACYAALGVRDGEVADFAATKHDNWTDWEWITVTRGVEPGGAPEQVVLPLGSIRASLGALSRWEDVDALARFLEAKYVDRPEGGGGETTGGPIPPIDYC

SEQ ID NO: 9574 - protein, 574 aa, Chlorella protothecoides
  MOD_RES (534)..(537): Any amino acid
  MOD_RES (563)..(566): Any amino acid
MSVSRRLGFLLALLAVAKGQTSWTPVTVGSAASGGVRWIVRGETSRAAGSARVIEEATAAHSPSSLPRLSRTAQLAPGLAGTGPCPLQAGRMTPLPWSTRTAPSWPGPLPKGAAPAWRSSVQTRGRVVGQPVSMTLKDLQSPAAPHQLAKHECARPCCASARNILSLLRGSPRALFPAAGVWQCRRRLHCARDRQLRRLRPQPDLRVPLRVCQELQSQHRPGNRPCHCGASWAAAIWRFGGKGWKAFSVDPVQRGCKEHPMTEERLIKARTACPGATRLKMPSPTAPQVPCAPPGDIVVRIDTFRPTLGGYLRLVLLSVAGQGPIDSVELRTSGSQVLPEDCKGASVTLRSGPGRGARGQASHSDQTLEGAPGGCVGRQLRKPHRYHGLWHRDSHPPIFTQSCTTGRLGSPGEVVRCGVGRLIPALPALGHQDHPRRRHADRPVSPWTGKSASDANFKLQPCGSTFRAPHLSLDAGAPSPKRVSWATFRPACRRLLSPRPREWCSVSSLPACKHAWDGVGGCMCLSSGNGASCXXXXALPPDLSTGERTLRQRARESRREGAXXXXASSGLVNG

SEQ ID NO: 9575 - protein, 138 aa, Chlorella protothecoides
MTYRLRISLLLAWAIAQACLSPASAAWQGLPAFGAVQLCVPYNVQVRPGTTYALSVEGDQSVASAITTGVTGNVLAVGSNGFTSSQPIQVVITLPRDKLVGVYQNGLQAAAYVAPGIATTFHTGHGGGHRVTSLHGQA

SEQ ID NO: 9576 - protein, 129 aa, Chlorella protothecoides
MHRRGKLQRACADGGSDLPSEKMAGASICLVLPKQRGPSSEYRRDDIWILSNDAWLGSRAERAGRPMDRLHAPWVALARSLWHGPNQEGRVEGSSMVPVPPSHALRMRPRRLPPKAPRPPHHSGWRSSS

SEQ ID NO: 9577 - protein, 232 aa, Chlorella protothecoides
MWFPAPRQPQNPPLPGACPHLSGAWTLWVGQVHPAGHPATLSSAGPNRGREPPGGGTHSGVQWHQRCGGPGADGVQLRWWGLPGACARGWRNSAAGRARGAAERPLHVSWNPRTGLLEAGCTDFLRLGPLKRIDRRLLPYSLHARLVARGPLQGSAQGGMLAGLAGCGGACESPYSVLTAGQLIPSSTPPAPACSKTKATGISELREMIKATTSQAEACLLRAELLALEAGA

SEQ ID NO: 9578 - protein, 156 aa, Chlorella protothecoides
MTPPEVRVQRAREKEMEKMDRDMRTIFAYNLALRAEEQDLFGFFVAAGPLNDIKIIRDRASGRSKGVAYVEYQRKEDVMAALALTGRPLLGQAVMVKMSEAEKNLAWEAAEAQKAQAKDMEARYGAPGADGAAPATAGLVPGLAAAPAVDLSDPAA

SEQ ID NO: 9579 - protein, 294 aa, Chlorella protothecoides
GGPRSESGGVRGKLWGGVPARACRGGFCRPCPDHAQTRPGGGSSSQPGLPRSWLRCGPFPHPPHTPSPPSLKGTGKESGDRHPKIGDYVLIGASATVLGNIRVGEGAQIAAGSLVLKEVPPHTMVAGSPAKEVGKITGEGWEEGVLRRGVGMRRRGCGCRHPTLLMPGGGGVPSCSGRIPGAQVILTSKHHTHLVAGLPSILMDQWSECCPRVVAEVRERLECSMLGAGCGCGPGWTFWGGGFHSQGQATAMGVPEAPMLPKGSFTPQHCQLPPSQQQAVDALTRPGGVDDFVI

SEQ ID NO: 9580 - protein, 152 aa, Chlorella protothecoides
  MOD_RES (139)..(142): Any amino acid
MQTHASAGGASTLQKLARVFREKAAEDAGRMFKGAKKSRERLGVVNEILTYWRLEDADATLEDLEDALIVSGLGSYTEAQAPREGGAGFLHLLIQWRPERNAARPDAECLLGTHLQVAREALDSQIITSLPANPNAPPXXXXGTLHDWTLNF

SEQ ID NO: 9581 - protein, 334 aa, Chlorella protothecoides
  MOD_RES (14)..(17): Any amino acid
MITPLPANPNAPPXXXXNSPSSYLQSSDFGPQTAFKIVDAVRERVRSGALRTPEDIKAALRDSVLSLVARPSGGSSELAFAPGSDAAGVAGDAETGGDAAASDGAAASGTPGTPGGSPTVYLIVGVNGGGKTTTIGKLAHRFTSRGARVLLAAGDTFRAAAGEQLRLWSQRSGAEVEAASAGARPDAVLFRAAQRAQREAFDLLLCDSSGRLHTDPGLMAELAKCRRSLASALPGAPHEVLLVLDGTTGVNMLAQAREFGASVGVTGLVLTKLDGTSRGGAVVSVIDQLGVPIKLVGVGEGLEDLQFFDPAAFVDALFPREGEGEEPQGGGGEA

SEQ ID NO: 9582 - protein, 248 aa, Chlorella protothecoides
  MOD_RES (164)..(167): Any amino acid
MGGKHWQMGGIDRQPCQRTYALRLCPTPCACACPVCHAGVGVLDSCSARHAHPGIHPCPFPVCGTSKSPTSRPHPTMQGAEAAFRMAHRLFAERQYAEALDAGLRSVRADRGWHEEAGRKLLLRMFEALGAGHPAPSPCRNRPVFQDSLHTVAVWVFGGAPASXXXXEIDPSFRIHFPLWQCECVGVLLPAQGVHGRRSPAGHHTRATAHTGRQWLGWLEFYSMLALGGLGDAATGSGAPNHPDNVGR

SEQ ID NO: 9583 - protein, 587 aa, Chlorella protothecoides
  MOD_RES (2)..(5): Any amino acid
  MOD_RES (437)..(440): Any amino acid
MXXXXASDDVVENNGYSIAIACSRSMEAHGVGICCDDLLRCKVLTPRPLPSLGTTGAMAEPHPVVEHLLDVFGYRDTVGPTELYAAFKDYQKDVRLCPDTCDEAAVSAFLQWFMERSDPATGGCAGGPVPADSLPSMYVQRPLATLNATMEAAGEESDQLLLDLVSDSSSEEEDQEVCEVQAESPWRTRSPLSEGGRGRSHDADDISLDAEDVAPHFFPRPTQARARHRHLLFEASSAQDHRTPHCPPRGSPRGAAGQTAPISRSLTPQEHAMDMLDFANWMQTIKRLCSAGAKHLHRMPTTAVAWPLRVWQPKLSSPAAGHRGGGSQRPRLLRPYADRWREVADLPGGDGGLTWHASRFSSRHMHMAPGRAVQGADCGGDAAALPDARPGPGAVHAALRRRARLLPVLPAGCGRDQGGSAWALARRGPQAWTPLCXXXXLSHASLQGAVFMELAKPNPSLKLLYVTPEQLVKGERLKAALTSLSNRVRNPGAAGGVCASWHAVGLSSIPLGPAPWAPMDCGILGAGLREGHGISVCTVHHPLFITRPHTLLPYLHQQGHLSRVVVDEAHCVSAWGHGEAGGKFTHS

SEQ ID NO: 9584 - protein, 80 aa, Chlorella protothecoides
MAGVVDILQRADELPTNEDGEVELDLGVLSPKTVWALYEYVIGPAAGGAPRKAAPGAAGDGAGFQLAEDSDYAPDDDDDD

SEQ ID NO: 9585 - protein, 125 aa, Chlorella protothecoides
MSHHLTRLLTPHISQHPWVTGQQSAEPLPPIVHERLKDFATMSRVRQVAMLVAEEQISKVGIGAFDPGVCGEDLGYLLDAYHGRGEIGLLWGRLLGILDAVRHMQLQALAGQASSGRQSMHPPTH

SEQ ID NO: 9586 - protein, 206 aa, Chlorella protothecoides
MRRLPALGALCRRLIASDLPRVATPSLALRLIGTSESGFNSIAHCCEVASHASRTFSASTGLEPPSPVISTLSDFKALTDLSINTPIVVYATASADAEVDPELVRAVHASRGSVRLAQLDAGSAQLSRLTAQLHITNLPATLLLFGGRLMDSQPGVPSGQELRDYLAQIQKLADDVARHRAQQADAAASGGGTGPNATPAQLLEQG

SEQ ID NO: 9587 - protein, 206 aa, Chlorella protothecoides
MLSGHPHVASLVECIEDELAVHLVLELAAGGELLQRLGCPHADSPSEAQVARHFRAMARFLAHCHALGVVHRDVKLENFLLSTPDPATAEIKAADFGLSQFLRPGHSMRAVVGSAYYMAPEVLRRDYATPADVWSLGVVLHILLSGLAPFWGDTEAEVWAAAERARLDFSVEPWPRVSAPARALVKSMLRRDPARRPTAAQLCRVS

SEQ ID NO: 9588 - protein, 139 aa, Chlorella protothecoides
MRDYCEEEKQCRHARLLRYFGEEWTQERCGDRCDNCLPKPKPTAKGGGAAQGPQGATKATQLKRKGERGTGREALSDVGFRSAAALLADAPPPVPAVSSSRGAAAMAKAKAARSGNERPGIAAFLSRGPAMAGPPPTSG

SEQ ID NO: 9589 - protein, 210 aa, Chlorella protothecoides
MQECGRGCLQVLTCGLMTYGKARPPPWSEPLLGPGAYPQSTHPADAPPKLQDMHGSPTKTDAYLRTHNILGRGHSDLEARYQLGRVLGRGADGVVREAVHLVKETRHACKTIYKGWLRRRSQVEGLRREVHILQVGLEVRGRGEREWRLGRGSCGGSFAAQSHGVPAAGQLCCCWDGGAPRAGSWAAVPGHPSSTPVPMLLSKARPCTRP

SEQ ID NO: 9590 - protein, 311 aa, Chlorella protothecoides
  MOD_RES (121)..(124): Any amino acid
MESPGSQALMRGSMPPPSPRAPRRREAVLEEDEWVARAEAIIERDFFPELSKLEGKVQWLEVRTCLWSVVRCEWVQPGRAWARGMQGAQRMPAPPPHHHTHTCLRPCLTLLPRHRPCAAAXXXXSQTTLNSHSHATGRAQRRPGPNARGAGGLCGPAGGPAPGHLDGGGPPLHSGWHGRTRPGWRPAHPDRRPVHPGHPPRRRRRRTRGVRRRPGPCDVPGRFHARAHQRGQRLLRRAAGHGEWEEGGGVRRHCRPAGVWGTGHQIRRGSPADRRVRNGGAALRPPRAVAVRAQERPHVRWEPAGCPGPLR

SEQ ID NO: 9591 - protein, 360 aa, Chlorella protothecoides
  MOD_RES (7)..(9): Any amino acid
  MOD_RES (276)..(279): Any amino acid
MPLQQPXXXAHVRWEPAGRPGPLRWGLFVLLRSCVSLALQCRCSNPHSHPLGSPPSPLTTSPTSLAPHIPQGPPPFPPLHTLSTDKERAAQVQGPPKAIKHRNTRFPGPQALSSCGDTTPASSATGTQPGSPGTRHGAAFVGVDGLSYPVLATPSFDPGEATPFMTWGDIQATPLRIEAEDLPAGDLNAGTGHGLFMSKREQVYVFRAMNADAGWPPGAGAAWDVARRCILRCHAAILATAPFGQPRVECRVPPPSNPLLLLCVVCPQAPPSSTSXXXXGSRCCVERRSSLHPALPCCHPRHRAVWPATRGMYSTSTINPPPPPPLRCARRRRQVPHPRVVGARADGARPGAAVRPGGGR

SEQ ID NO: 9592 - protein, 111 aa, Chlorella protothecoides
MSNLGWAAHVTHHSSNDYNLSTALRQGVGESMVGGRCNCVYSWAYYLILAPFAPLKVFALHKGANVVIQVSLIARPWVLAAGRCGVPLLRAACSPPAKPAGWDGVLSLRPL

SEQ ID NO: 9593 - protein, 92 aa, Chlorella protothecoides
MAAPGLRDDPIPTVDLGPGGPVRCAECKAYVNAYFRFVADGGRMVCNFCGAEQPVPPGYACPLDMEGRRRDAADRPELCCGSVDMVATAEYM

SEQ ID NO: 9594 - protein, 747 aa, Chlorella protothecoides
  MOD_RES (146)..(149): Any amino acid
  MOD_RES (282)..(285): Any amino acid
  MOD_RES (455)..(457): Any amino acid
  MOD_RES (532)..(535): Any amino acid
MHVGWLPSQAQCMTVLETPTRSSHHAWRPESQDLPLVAERKLDPSICVPVYTSQAACVTGGAAAKELSLVHGGWCYQLSGRCLFPLQDLDLPSHAIFQTLLVHALSCSVRCNLARLFGGLNFLQGCTGATRQSSHISASSCSQRPXXXXLSDPPGACSVLQRPMQPGSPIRGPEFPSGMHRSSTAILAHFSLFPLTTTMQGPVWPSSWATPPRTSCPRMPRPGAFCRARCPWVHWLRPRARRAQTRWPCPLSCRPQRATSTRARATRRRTATGRKTLLMWMXXXXFVVPPPKSDVDKGKGTAPENGNGKKDAADVDADLEKAVLAAQVAFLKACNWLLVLFGKGGWVGRVVQHDDRGDLKDGSEEERSTYQRLWDRVFEANKGHLPLLTERLTRLDARSDKDSLVEVRRGCMLTEHGWAHGKCGTACPRPGPYMLGPSASFISAQGFTPNIPTTXXXMLTERGWAHGECGTARPRPGPYMSGPMIAAIDTTKLAVYLAQKSPETGPDKDSRKKGKRELTLVPLERCVRCRHXXXXDVSYFALPGSFEGCPLQCVHCRHRAAPTSRVLWHHRTDFELQRDAIIQALASKASALLTKYPEVVTLPCPASLCSDHSLSWALPNTSSSVSAHSGVHMLISIPPLPCTCLIQPAETETDEFEAAFVELQKWVDTSAEGTHANLNAQRLARKGQLALAYRALDKALADDKLASKHKGMLETRVKLLKQLGWSHWEAGAKARLETSFPATFPLF

SEQ ID NO: 9595 - protein, 302 aa, Chlorella protothecoides
MLPTRLTLHPPTTQSGELCAAAVINLPRRDSHHTGQGPAPERRGRNCKADGPCTSGARTHPAQGVLCMPAGFCVWPGALAVLGVGLQRDGHAGKRSPPATESSPPCFQESSHLIPFSDRPTHTSQASLTTLCIPLCPTAAELAPLSAPRDALPRSRLTHQLTLTYSLTLAEGGTVTPRFPRLNRLVYDGILDGQMHVVTDANKKVLGWGDIYPEVGLGRGTGARREGVCDRGGGVCLRPYSPSEGCGVEEGCSLGRADGCRAAPRIILTTLPLKVVILPNQPAAGNQARGGDIRHSRGAAAH

SEQ ID NO: 9596 - protein, 768 aa, Chlorella protothecoides
  MOD_RES (106)..(109): Any amino acid
  MOD_RES (329)..(332): Any amino acid
  MOD_RES (521)..(524): Any amino acid
  MOD_RES (733)..(736): Any amino acid
MTSRFAVQQAHRCVPSRPSVGRTVGGRACSQLPARAASSVQGQRTSNMDSDTGRQAAVVVSDMNEITLGDQLLEEEREGPPDPFAGAMPKKDIQADAFLKCQPMVXXXXRRGHAEEGHLSRCLPQGLKLRILSLRDEHPEFDGRGIVVAILDTGIDPGAAALQTTPNGRPKIIDVLDCTGSGDVDTSTVVTVAADYTIQGVRGSALRLNPAWDNPSGKWHVGSKRLFDLVPKGLADSIRADRRRVWMQEQRDLLAKATAEVAKGCPCCGVVCESVHFQDMSLVTKVPAQWCLLLGPSCTPIPCPVPVTRSPDPNQANTCCQTTMHFHAXXXXDNPSGKWHVGSKRLFDLVPKGLADSIRADRRRVWMQEQRDLLAKATAEVAKVCWAFACVLRGIGPDPHQANALCQTTMHFHATHCAQRSCTALLTPQALLRPPMLQLSTQGTPKVTKEEREELEARVALLSEFAEKVEDQGPVLDAVVWQDASSVWWAALDLTELRGPARGALADFKPMTDFKARRQIXXXXGARSAAAEESRGEGVLPARPAQGAGSKEGRLCRSGKWSAETCTPSLLYGTPTVNLFAARLSLTDRTPTPLPLTFASAAPACAVHGILAVRRMQLCRQHLRRRQHPVHRGGCREPRHTRGRHHRRLRCGSAPPLRRGPRRATHLLQDRRHAAGVHGDGAGAVQGPGRRHSAQGRHHQHELWGEHGHAQQRWGFWMGWSRGSGGESRAGLXXXXATPNSGGAFGGGGVEVLKGKVGLDCRYPTVQQ

SEQ ID NO: 9597 - protein, 238 aa, Chlorella protothecoides
MINILPHPPHPPPSQGRFIELAEEVVHEHGVVFVSSAGNSGPALCTVGAPGGTSSAILGVGAWVAPEMAAAGHALREPLRDGQQYNWSSRGPAPDGDVGVALCAPGGAVAPVPRWTRQRRQLMNGTSMASPCAAGAIALVLSGLKAQGVRPSPARLRRGLEATCLRTSWDADSVLSQGAGLIQVADAHAFLLAPCSPAASQPWEVTLQRTDAGAAAGGGKRGVFLRTGQETAVTSTHQ

SEQ ID NO: 9598 - protein, 192 aa, Chlorella protothecoides
MRGIQAQTARGKPRPNRPSPPPSQEVFNETRSILEPAGAVAVAGALAFASRYRLRGKTLVAVTSGANMNFDRLRIVSELANVGSAETMLATALPDEPGSLLRLMDILSGNSGPLNITEFKYRYNMHSDGLARMLFSVGEAPGSKESRALMARAQAAGIRVQDVSDVELAQTHLRHMIAGLGGNVPTEEIFQA

SEQ ID NO: 9599 - protein, 495 aa, Chlorella protothecoides
MSYSCLKPWRTTSFVTRSTVGAYCSDPRFASAFDCAASCSADDASAGCPADSPPQLQAPPPPGAPSPEDPADAACTAHQPCGDGGGAAAGCGCCTLAVDAGTLRAAHAVPTAQLATFLVGQALTGVWIAALLAALARFKRSAARPVLSASRFSVLLRGKRLEDGPLADWARQYGPVAACAVIPAVGGVLRWGREAQVLRSRLPAAPSTRQWCLRIGYLITHPQPSTPALRRPQNSCSLAESAAQQIPPPLGALKRWLFRCAALGCASHARLAARLARAERRVALYSQPRHAGRPTGSALVTFEYAAHADAAIAHGGAGGAVGWVLDAAHGVVGCCCRCCGAGLASGPAGIRLAGSRVRVSRAPEPSDIIWRHAASAPRPGALAARRALSLAATALIAAAGAAAQYGLCVAAEAARRRRVARFYLDPSLAQGISFDSWAAFAASAGDTVRLSLVSATAGLAVVVVNLGVTAAVRQVGRLRGEGGGEWCLGNAPRLK

SEQ ID NO: 9600 - protein, 118 aa, Chlorella protothecoides
MEVRAELSSERSSFVSHPKHLLLYATGRSFEIQVDPRSLEPGLHHTEIRGTDTSDPGAGTLFTIPITVAVPTPVTAGGSQPGADVEIEGEGHAELQRPHTFDGGKGMVVFWVWLAWRL

SEQ ID NO: 9601 - protein, 125 aa, Chlorella protothecoides
MPTNSPEIKYQAVERLGGTVELVGESFYETAAHAVARGIAEGRTFINAYDDPYCIAGQGTAGAEILRQGDIDKMDYIFVAVGGGGLIAGIAAVVKALKPSIKIIGVEPTGASGQRESRVYCASLS

SEQ ID NO: 9602 - protein, 150 aa, Chlorella protothecoides
DWLAASAALPGGGGAQVGPLLRLLVAGLGSPEASSAAALSIRRLCEGAAAQLAPELPALLRMFAEIQGSGDVAQNAYEQYDLDEEDVQQVDSLFSGDHWLCCVVAVVSRGGGALCRCWNPPEMHANHTCTQAGTATQPSTSSAPPPHPSS

SEQ ID NO: 9603 - protein, 309 aa, Chlorella protothecoides
MQAALARAAAATRAGAEPGAESGLGLVVPLMERTTTVFRSSSDRAAVGQALVQLWPTIEAALGACVGGRRGLGRVLVGGYSHVEWRGSWVSGREGAVDSPTLQDHGSPPHVRGWPSPPLLPIDTHQPHSPSDTPYPNPLIHSRSIRGRPRGDGAHPARAAVRSAQRRARRRGRDPLPALLLPRALRGRPPPRLPLRHQRGDQGLRRRARVRGGHGAHLRRAGRRRLRAAGQPGRGGGQPRPGRRHLPAGGAGAGLLPGPGADAGDAGAPVRRRTGGPAGAAPRGLLLRAGFPRAPAGPRAGRALGAGGG

SEQ ID NO: 9604 - protein, 361 aa, Chlorella protothecoides
  MOD_RES (12)..(15): Any amino acid
  MOD_RES (44)..(46): Any amino acid
MNHGEGQPMRVXXXXEWGGGGGFSFFPGALRVNHGEGQPTRIRXXXREHHSDINKPLLQPLTDAVVGPVAKGEEVARVHDVLLALRAKPVRVEGVGVREALHVGRNDGGDNHGAARHHVVLRQPVVGVDHGGDHGRRGPEAQHLLHHLARVGHLRQHLARDGGGQVGAQGRLLRAHARQHLRPLLQQGQAPGERGGAGVLAGKQEVQHGVRHAVLGGVGRGRHALRRRLLDLLQALDGPEVHEAARLAPRAHVRHRATGAGGQHLEDVQPPLLALPHSGAGQAHGEGLRCDLGGEEGKLEEMHAGQAWWGRRRGCNITEHVTKRQAISGRQQSGSGGAGELGHVIGRAALHRHVRVPGGVA

SEQ ID NO: 9605 - protein, 500 aa, Chlorella protothecoides
  MOD_RES (221)..(240): Any amino acid
  MOD_RES (421)..(456): Any amino acid
MRLMGCQTPRGLALARMPVLLALLLTLLCATARSSPLRFFIDASAFAEGETDLLLEAIAASNGTASVVGVSRGGFLAHKGWHNTSMWDMYWTGREVGRSGCGLSSFVGIIGGSWLSFSAHSAALASRTTAPWARRSRSFPPHTHTLSPGLLPRLPVPPGPRPAGVLHPGQPGHHGQGQPGGDHEACLRHGRVPLRPRVLRPARRLPGLCPRRGCGGGRPGXXXXXXXXXXXXXXXXXXXXTVTAGAASRCCRRPPRWPPRGSVGWVAVRSATWWPSASSPASSWCGAARLFGSRQGADDGSDGDDGDGVADGGLTGISAQGADASGHQAMVVNLWQQDRAAARPWSLRQLWDHLDSRFGAGAATGAWARMCLGVAAALAAGLPAQREAGAALPGYQGGNAEVLGVDFLLDGALGAHLVEVXXXXXXXXXXXXXXXXXXXXXXXXXXXXXXXXXXXXRGGGGLPRRHARALRRAEGGLPGRRAAPAPRQQRRGDGHRPGPA

SEQ ID NO: 9606 - protein, 142 aa, Chlorella protothecoides
MLMSLHPSAKNILGPNNLAFMHGPEHKNIRKSFLSLFTRKALGLYVEIQDAIIRRHLTSWLAIPGEREVRDACRDMNQMTSQEVFVGPYLDDPEVTAKFSKAYRVMTEAFLVGALEGVVYIDSGDEGGLHVATRQRAGLAVQ

SEQ ID NO: 9607 - protein, 86 aa, Chlorella protothecoides
MTPPFPPAPRRATSSGKLIPGPERPFPLVGGIVEMVMNPFAFWEKQRVYSDPGMSYNSLVGKFILFITDAEKCREVMSVRGAEREI

SEQ ID NO: 9608 - protein, 238 aa, Chlorella protothecoides
  MOD_RES (201)..(204): Any amino acid
MEEQHQHPLSPPSHTKPKALIRFVLELGQKTGSGSYASRGALPFYAAVVCEYLAGLKQVGVQAVKGVTSSQSECDCRVHGVQSCVSLWPGPQSCASPWPGPQVTEDTANLLLPYLVAGLGPEALPDYRAATLMIIGQLSARAALGTDLVTGVSVCEDCVDGAGLRLRGPARACDLAAGFRPRVMRQEATTVMPRLAGDEKXXXXGPARACDLAVGFRPWVMRQEATTLLPRLAGDEKL

SEQ ID NO: 9609 - protein, 576 aa, Chlorella protothecoides
  MOD_RES (363)..(404): Any amino acid
  MOD_RES (495)..(497): Any amino acid
  MOD_RES (571)..(573): Any amino acid
MCKSLSHIPPSACSTTLFITDEGDGQFSEHPHHWRIWGREDGDHQVCNAVPSRSGWGFRHGGILLCFGDGRIIWLPATQTGHDASVLPCWVLSVTDAFDMGPRANLSCLSTNVSAKVGSSLPFPFIHPLFHSTTLQRRVLDSNPLLEAFGNASTLHNANSSRFGKLTTIHFDDRHAIAGATIQTYLLEKSRVVSHTVGERSFHAFYQLCAGAGPEERAALGLPDAAACRFAYLSGGESTPPALGPSDAAGFAQVKAAMEALGVPAPPVLRLLAAVLWLGDVAFCDDGQGAAGVVGGPRSPALRHACRLLGVAPEALAAALTTRELAAGGERVSRRLSPAAAAEGRDALAKALYARLFDWLGRXXXXXXXXXXXXXXXXXXXXXXXXXXXXXXXXXXXXXXXXXXAFATNSFEQLCINYANERLHQQFNAHLFKLEQAVYRDEGIDWTDVEFVDNQSWDCGRAEGHRHDNGRNKEVKRWVTVGSLMAGSPDAQILXXXSEGHQPDNGRTKRLKGGLPWVHQWLARRMPKSWAKTQPHGLGQVCHAVQVCTTSRLLEPCTAEPAFPPSQPRPXXXCSY

SEQ ID NO: 9610 - protein, 506 aa, Chlorella protothecoides
  MOD_RES (148)..(151): Any amino acid
  MOD_RES (186)..(188): Any amino acid
  MOD_RES (371)..(374): Any amino acid
MSASIQGTHLVGGISRGWTPVRPIHRHNPPFLRAGRCLSQALRCQGASTAAETIAKARVVRDGGTRDASMHHLEGGQPQPHCLPGLEIQTQEHPQCAGLRPPLILSSRRRSASRPWTACPSYRRRCPTCSDSGARPWSSMIRGAQAMXXXXRFSALDRVSILSEALPYLQRFRGKTVAGVVADLVXXXWHGSDGESVLVASVIRGAQAMVAIHRIRLQPGIGRRGEMAWNMLDTLDRAGVVADLVLLATVGIRPVLVHGGGPEINIWLTKLGIEPNFKNGLRVTDGGTSMGGKGEERSSRSVHGRSPWAPRSHPLVCSCSTTPRDRPGAAVLCVHEPSPSSSSILIFQFPPSSRAPVLSSQRRPWMWWRWXXXXQPPACMLMFHYPSGQAWAAVLCVHEPSPFPSSILIFQFPPNSAHPPCPHRGDHGCGGDGAGGPREQVPGDPHPAVWGAGGGPVRQGFRHHPGPADGGEGDRLRGRGHRRPLRPDQGALVRRAWGWVTESALQ

SEQ ID NO: 9611 - protein, 464 aa, Chlorella protothecoides
  MOD_RES (2)..(5): Any amino acid
MXXXXPGQEEREEQAAGSQGFPLPLPRLGLTSMFIPQPPPTPTHQAFNRSTTKYWIRTSDVSAVKRTIIENMPVFVFNAENYSGDAQLVNSVYFDNDSLELYHGRLDKKPGALAIRVRWYGPNDPSLCFVERKIHKESWKGEKSVKERFTLPEAKVVPYIEGEYTAEEYEEGLRAKGEDELKVECECGWQPHSHSRSCQPNVQGKSEDDIAKASKLFREIQLTIDSKQLKPFVRTQYMRSAFQMGHDRSVSFTLDTNLVMLKENPEGAPTCAISGRWFRDPALPVSRTEITRFPHAVLEIKLALPEGESPPEWVADLMESDLITEVHKMSKFIHGTATLFPEMVRVRSKKGGRGCLSCGVCDAVGRVVLSTCLQKCMEGSPGYAYQFEPLSEHPASPPPAPSPHQAVPYWMDDESIRASILNSAPDAKQIDSRWATHAGLLDTGDPGCGSGELAGRGQGDFRGL

SEQ ID NO: 9612 - protein, 663 aa, Chlorella protothecoides
  MOD_RES (75)..(77): Any amino acid
  MOD_RES (482)..(485): Any amino acid
MGLELSAPVFDRSPHSIWPAKCRSRAGASTASLSISSLAVRRGPTLIYVASLSSTPPLAPHDSTPAQCFTDIVVXXXDLPRVPALHPLPRTPRFHPAQCFTDIVVIGAAHALAIVCSLASLHASLLDSRTSKYRLGTSDRRRHVAAAVLAGVALLVLALQLNARLAAHALPLVQGAAAPFEWAAYTLAALSWALLVALFATHARAFAPASSPALWRFPPFLVLTGNLAKLRFVLQSEERSDYFAALFYAYVGLQVALCLLLLWLAPDCRKMVLVEQGTGPDPDTAAYLVGGLEESGLPNADAGVLWNSPSDACLSQQPGCICGRLLAPHHRACLHHLVCAFSSPSWRPPTPLPPLTPVPQWQPLHDDEDVCPEVRAGPLSRLTFSWMGPLMKRGYRAPLTFADVWRLPPADRSATLDQRFAHFWAAERQRNPENPSLVRVAGVDCWAAGSLESCGDAGTVHGGWTRRSGDGQRCTALWTLRXXXXVGLVEVGMVRGVQPCGHSVCHVDPPSSVISNSLFMPIKPPSHFQKPLPHKQTLVCWQAVSHLFLPAIPVKMISDAAQFVAPVFINLLLSAVSSGAPDRTGYLLSLGLLAGLLTGTLADNQQFQLTMRAGGGAVGLFGRGRERQERAGSGVFSLALEEFVSGWFEELAAGLLHPCAVDL

SEQ ID NO: 9613 - protein, 1027 aa, Chlorella protothecoides
  MOD_RES (212)..(215): Any amino acid
MTGLVVTHERLNTRQPSMPSLHRLPSPLHADTRCVPQDPLPDTQCPGPVLQRPSLLCHWVGCGHAAEPEPGHPGLHQQVGGWQDLPRDHARVDGLLAWVESRAPRDAPATPKSCSAPCIGLIPHPPPILQPGPNHRRPGPALLPARHCCHHRRRLSGPAPPGPGDCVAGCVPRCPFVTAGCQIARVEAHPPSRHLQSPFPQQPSVPGHNTQXXXXCTPCHCRVSDCRGLAGEASARHPARLPGRHRRARQAGVGAAGRRGRGQVLRLGGQLPGPHPRRAGPGAVDAVACLLHRLLQHRHHAGSARGRGGGRLWHLRAADAQGPDPLPRCVESFAFTSLSLLAVLRFPIASLPQLVASAVQASVALGRLQAILASPEQGEVEHLPPAGPGEAAVSLHGDFAWALDLPPSLRDLHLDLRAGQLVAVVGATGSGKSSLLSAALGLLERLGESPPRVRGRIALVPQTAFITAESVRGNVLFGAPHDPVRYAAALRAAALEPDLARFPAGDETEVGERGVTVSGGQKQRIALARAVYADADVVFLDDPLSALDARVGRRVFRDCVQGALAGRTRVLVTNQLQYVSSADRILLMRDGRIVEDGTYAELMAAGGEFVGIMSRAETEKEAGEEEVEEGAGGEESGEEEHVQDGEQSDAKNGEAVARSKLSTSTKARGPRSSPANASRAGGGTGGPSGGGGGTQHRQGVLGHHAWLHHRTRRATPRSRPPRRLHCRGGGACGCPALAAALDGGSGPDAWWAGVWVWGAAAPVNSARGDDQRDGGHTKRSIGFYLGAYEEYFSRLALGDFCAVDVLIPELSPQVSDTMHLGSWPGVSTGVMLWETIAVISPACSLVYTPHRRHDPLFHLSCRPKPLYCPQISPLLSLLSGMYAALSATQVVFTAISQYLARYMSLLASRRLHDAMIARLVRAPMSFFNITPLGRIVNRLTKDTSELDKNLTDYSAFFMRSVFQLASTVILGGLRRGGSTGSGGGRRPLTDDGAACAAHPPCWGGLPERVCLVGCSARPSPDLCPCCP

SEQ ID NO: 9614 - protein, 88 aa, Chlorella protothecoides
MYCWTSVPSIPTPPTCRTAWTCWRHGRQRGNDTTFGEKLRKEAGWHPRFSFDARAPGTDFCIHHSSGSVVYSCAAMLDKNRDTLSQGE

SEQ ID NO: 9615 - protein, 68 aa, Chlorella protothecoides
MATALTQQLRQLAVASGQPAGGKRLRGKPSLIWSTQEAADVDVETVYSIGREGEGLGCPECSRRAGDW

SEQ ID NO: 9616 - protein, 247 aa, Chlorella protothecoides
MRKLTGLQSVGPGTLAAEVLRNVYSHDLASCGPRQLVLDGVQDPGNMVGGWEGCGDRGQGGLWVGPTAYSGANQGPSTAAALSHPRALDPPFVAGHPAAHGAGPGLDRRRAVAWLLRPRQRQGASLRLRLVATEDVELAASWKATGRMAFAAMVPEGTAVGRGGGAGKKGRALPSLDVANGYPDGVALVLGAEGRGLSASLARACLHLSVPMVPGSVQSLNVAVAGAILMAACSGAWPHLGEPQDGR

SEQ ID NO: 9617 - protein, 197 aa, Chlorella protothecoides
MGCAHDPVLGHGLPNTLLDPMRADAALHAHPSWPLEPAPLHPIPPRTHPRAAFRQLCELDKRYEAFQSTLFSPSSITLDRSQQSVGVGAGIDAAVTRLCTLLSSSFLLPPAFPVLEYLLRRYAVHEHNVDSLMLAALPFHATNQFVRLVQLLRLRGTLFEFLEPMQESGAALPRSTLVLRCITDKVAQRVWGDGFLG

SEQ ID NO: 9618 - protein, 60 aa, Chlorella protothecoides
MQYGPCDPARTQNIGRSPPQFGKYLDEKKRALWAPHYVDYKALKDLIKDCAAAAELVGRQ

SEQ ID NO: 9619 - protein, 201 aa, Chlorella protothecoides
MPASQNDGWQSSQVTSLSVTRFSSRDLPEEQFFKRLDQEVSKVGKFTAQLVTTLRGRLQKLQDSVHKDLKPGERDELLEVRKMGQISEGKTLEMVVYRVILQTSNQSTPWELGTIIETRCSPTLSPSKQEAKAIGDEFLQLEKYVNLNYMGFHKILKKHDKALPQTPCRQFYISHLHQQPWVQVGAVAMGLWALAASARAL

SEQ ID NO: 9620 - protein, 91 aa, Chlorella protothecoides
MHRPAAPLLPLSSHACPTVGDAQSVLEVGLDPQLGEPDVDFRAASMHQHGSDAHSGQQHQVRHDAGLTIKQGMSVMPNSMNRYHRLGTTDH

SEQ ID NO: 9621 - protein, 176 aa, Chlorella protothecoides
  MOD_RES (11)..(14): Any amino acid
MPRCTRPTSEXXXXPRPEHPRTHPRAGKMIEDAAMHEAYVRVITPEHSPSEETEDVCYMLQEAMELRHVEWRILSRMRVFQWPRMGAGLRRFLCCMPRAWPRSGCRGGGPVTGIQAAAQCMSIVHAFHPQASDELACQSQSDPTLNPHMHVQAKVAVQAGPIPRAAVAPGRGQGAV

SEQ ID NO: 9622 - protein, 193 aa, Chlorella protothecoides
  MOD_RES (82)..(85): Any amino acid
MHWVHTKYWKMGPEGNDIQKTNVPALRMRFRSVGGWCYRASTGQGLVWQCVARHPHSQAGRIVILKRSRSCSLAHQPMPTGXXXXYEQGHPHSLAGRTVILKSLRSCTLAHQPMPTGCGNVSQRTEQLLSPAPTLIMELVKCWRVGSVPAGAVPGPVVTSDRQSGAIVQMLCQINAPGSPLPGVHRPHRASQR

SEQ ID NO: 9623 - protein, 325 aa, Chlorella protothecoides
MRALLSNRALAHTKARRFEKALEDAEAAVALAPSWDKGYWRKGVALEGLHRIADAVQAFLRVWTINGGEADPGMVGGRICGIPCSLPDELPPSAGDSESTARLQAVVRKLTREQLGSGMLGLIEAAVQEGAIPKATVECVPVDALHEAAFLVVKQAHHGVPSPGPYYARYLSWLTSGISPPAALIERSRIHAAGRCFLQAAADAEHSVRLLFKADIHGIELAQAYACQGAGYLAVQGHADRAPAPAAACFLKALDNDQGLLSVQASLEEAVKDLTKEEYDQVWLGYPDAGALEGFAGLCKEGGEAWAVPSIRGPAVPQTLGDACE

SEQ ID NO: 9624 - protein, 149 aa, Chlorella protothecoides
MPGEAGDVDHLAVTFMAAENIAHGINLRKSPSMQYLYYLAQSGAPGRAPAACPHGVVAVRFAGHCMQSMDPGQLPHPTLGSGGPVHEPLVQQLHLPGLPPQPFPNLLRAGPERQPLHRRPAANPPDKGAPGGGVLGRCPGEEGLAGPAD

SEQ ID NO: 9625 - protein, 209 aa, Chlorella protothecoides
MLDVHADKNIFQRFDRFNLKYNPFGQSRLREIFIKQDNLLHGRFLAQLTKEVFVDLEASKYQHTEYRISVYGRKPNEWDTLAAWVVQNRLASDNNMWLIQVPGELFARGYVMGLGGGRAPGVGRRSGAGPAWSLRACAILANIVSAVQGGAIGLRRGCWCVRGDVDCAAGRRRHKLSLPVVITRVFLVSTHTDPSALQCVQGVGHHRQL

SEQ ID NO: 9626 - protein, 228 aa, Chlorella protothecoides
MGSAKQQEPASTKALTAGVRQALRAALASAAGLELRRVTLDRVSNPRPDSPYLGVRLEAAVGGNEEAAYQILRLVEGTPAAQEAALESVLSAVSSLGPVDHGASSADVVDITPRGVQPLDAGGPDSAGPLVPATPPKMELEVPYRMYRITRIDGSTVDRVDKHPFCMSRVYYDAAEKPEELWAELADGSCRWRQTGAEVKVCVLKVPHTLRPRQLSVTLEPYSIKGDP

SEQ ID NO: 9627 - protein, 411 aa, Chlorella protothecoides
MLVVRVARFEHRWFERFGGSTGLGTFYCEPVLDALLPNDHYVDGLVGGAQPIYLAFQPRRLYSQAEQSRNICTQQLDMTLQRQLFKHEMGGTILSEDGILSAREWYYRTPHGFRHDLAAEGKSAGRASMPLGSTSPGNAQSYSGKCLASSNPSHSSFRGRAYSHLHTGKRFAVTSRCMGHVGMIARSPPCLQLPLSGQHLIAARVLTLSNSPRIQNRGFPAALLDLKARLTANVQGLPSEQPGSLWPKTSLGCLHDRQRLTPDQLRVLLDLCAKHSADLASAASLRVRDAQLVVHQCRSLERTLSVQSVPLRPAREGEGALPPREQEERVASILAESGAPDYWFAASRDGNRRAHYADAHLGVTLVHFLVGPEELLAAVRRFRRAVDAALPGTYHWFDDAALHVTIRAVVT

SEQ ID NO: 9628 - protein, 100 aa, Chlorella protothecoides
MGLGKTAQSIAILALQQQSGGVAGPFLVVAPLTTLGHWQREIEAWTALDCVVYAGSAADREAIQVHDLWRAAGPAGGRAIRPSIVLVSFDTMLRDKALFL

SEQ ID NO: 9629 - protein, 108 aa, Chlorella protothecoides
MQVAALHAAALAEDAAVFDYDGHYDAIQEAREEPKRREKKERQSRYIAGLLEKAEERKREQDVLYERQMLKERAAEDHLFGDKERFVTAAYKKKLEEDQRYVANQKRM

SEQ ID NO: 9630 - protein, 167 aa, Chlorella protothecoides
MEQQPHSLSGPSLATAWTPLPFPASHAHELPQPLHPLATHHFPASASQEVQIETGDIQVLLKQRASLLVMSEAKKWEDRGRGMLTLRQPRSGGQPFLVFTTDTGRVLVNAPLVRGMKPTGNPKTPRNLVMALHNAVGGGPPAHGMYIFKAEDAEAAKALRGAILQHV

SEQ ID NO: 9631 - protein, 103 aa, Chlorella protothecoides
VWTAGAEDYLHHSKQLLADFQDVLQAADQPAPSALGATKPSLPAFGGLSTPAATAATPLFNFGAAPVSFGTPGPTPSAAPPIEAHEEEEDVQEEPEVSGQAAC

SEQ ID NO: 9632 - protein, 242 aa, Chlorella protothecoides
MGRRRGKKGENAGENADEADTKTAADVQGDPLRALIAISPTSGSVAVAAGPELRVLARSAAGWVAMCQHGECWQGWLGGVLHAQQPQPGPSAIRTLAFDGSGEFLLASTDAKVLYVWRTATWELQNTIPHWRLWPLSKPRCSCLFTELTAGTSPALPTPAALPCACLPHTSKLPKRATSMAFTADNQHWLLSDKYGDVLVAPLASKQSGVCRGAAGRGEGELAGGPVPPHVGPLTPHALPAP

SEQ ID NO: 9633 - protein, 573 aa, Chlorella protothecoides
  MOD_RES (141)..(144): Any amino acid
MQLLSTRPPGAASFLPCGAGSGVCNGQWFRPVLPGLAPSTRLRRCRPLPASTRASASMDPASLEPPRKQGFLSALLQPLRDFGLGATSLRQATNGLFVIAGISESARMGCGRPWHGGQGQSGGEGCMGSLPVFTSGVEVAXXXXIAGISESARIGCGRRWHGGQGQPGGEGCMGSLPVLTSGGGGCPGGVYIPGMVAGASVHPRVLHFAMPLLTPPRPHTPGMAFMLASWAKGNNMGRRGQSYQAILEFPVACGISVGTPVRIRGVPVGGVLGVQPSLEKVEVLVEIRDSTTVIPRNSLIEANQSGLIAEPLIDITPQLPLPEYKGELLCEGGGRGGTGVGAAWYQGTCTLGRSAGPRQPPLACPPRCSGNPLDDSCEEEGKVGCAAVGRIGRVPPSRPPSSPAAPRRAPPLRKAPPQPPGPPRNKSFLHSHPLPRRGHGRPGVHLHQDRAADGCRGARPHVLCRGRGPGSAGGRRAPSPARHGADRAGVRRLPCWMCACVESSGRAAVFGPSVMRSNHPSAGGAEAGGLAGQRGGADLGGGRGGSRHSAAAGGGLFDIPVGERRGMVGAASA

SEQ ID NO: 9634 - protein, 180 aa, Chlorella protothecoides
MQAPPAHIPDFLPAFPDRHTYCETHELPLPDADPAARHLAGMEAQQAAEQALVKLHARAAPQDPVLASALPAKEEGPAAAAEGGARAHPDPAVPALDPWSAPPLPDDGGPPAPPFPGGTPAEEGAPVEDAADTDMPDAKPEPSRDPEVAAALGATLAPAFQPWDWQARLLALAAQAQSQA

SEQ ID NO: 9635 - protein, 85 aa, Chlorella protothecoides
MSDQYALAVARIVVAKLADGSGFDALQTSSASILSELLVRYMEEVGVSSHAYTELAGRTEPSAMDVVSGLMGSIMMHGGRSCPGG

SEQ ID NO: 9636 - protein, 136 aa, Chlorella protothecoides
MPVGVAATQLAHWAAQTCCPTPPLKSLSLRPLSGTGILLAVTIIYNYWEMYEKEKAQMGNDHGDSGVVCAALQRGRALGRRRSPSHAPRGWPAGPPALRGRGHPPSDVCFALRPAKPNLPACPSASPALDPPRACP

SEQ ID NO: 9637 - protein, 69 aa, Chlorella protothecoides
MALRASGLVGNKTLHEVSGCVCDLCGKVADSEVSEVTALDCSYQNCDAMSAIYHQACLEKFLKAQKCER

SEQ ID NO: 9638 - protein, 797 aa, Chlorella protothecoides
  MOD_RES (300)..(315): Any amino acid
  MOD_RES (424)..(427): Any amino acid
  MOD_RES (672)..(675): Any amino acid
MRVIDRATSHSRREGGRSRGRAGVPASAVRRRGLGGPRSGAGLRVEGWREFRAANLPSPCSFAVRGRLDGAKMEFNRLVNEIKELRKAKQDATELQEASKAMKGGIKELEDREKELAEARDSALLPIGNLVHDTVPVSDNEVLLPGGRDDTATERGAGVGKRGGGEGRRRRPVERIPCPPCRISQMMKFTLLKDQPSDCASTCRHTRVLMAACLAFLPGMTGIVLFCARSPPHALRVGPCSRIGRTLLTSSHSFTHPAGQQCGGEGGGDTRPRGGHAQPRRPRTAAGHCRAGPRHRGGRXXXXXXXXXXXXXXXXVDQQGVWCPAPSPGKELNACPHPAAVAARSHPRVHRRRQPRVLPEERGRAPEPGADQLRAAGSVLFGGGRRAVPRLIAPPDRAWPHSPMPGAHNLDPTTSHRAPPPPPXXXXPHLTEPGPTGPCPELTTSTPPPHIAPPPLAQFAYRRGFVPVQTPFFMQKDIMAECAQLSQFDEELYRVSGEGADKYLIATAEQPLCALHRKGWFEPGELPVKYVGYSTCFRKEAGSHGRDTLGIFRVHQFEKVEQFVITSPAEDASWRAFEEMITNSEEFYASLDLPYRWGWFWLEGGGVGRMEEEGGVGQRGALQDAEEGESYSRDEQQPGLLCSLPFMVVNIVSGELNNAAAKKYDLEAWFPXXXXSVTKTGREGGQHRVWRAEQRRRQEVRLGSVVPGLPDLQGAGLLQQLPRLPGMETAVGRGCVSEWGRLRQGTLDNSGGTSQGSYSVSKTRGKVLMGTFTLHRQCYWCPHTEVMHLVASSQPVL

SEQ ID NO: 9639 - protein, 431 aa, Chlorella protothecoides
  MOD_RES (191)..(194): Any amino acid
RAQPRVGVAAARREFAAAGTKALAEQPAFLRGGRLRDYQLDSLNWLSYSWARGVNCILADEMGLGKTVQCAALMGWLALAQRVSGPFLVVVPLSVVPNWVREFDKWVPQLDTVVYVGDAASRQVIREFEFGGGGGAGRGGAAAVPAFDVLVTTYEMVIKDAAILRPIRWNYLVVDEAHRLKNEDSALYREXXXXYLVVDEAHRLKNEDSALYRELAAWSFKSKLLVTGTPLQASPSRGEGGCMEMSLGLKKDEAVTGFAVKGEQARAVPLPMTGSSCPPLQTQLQNNIRELWALLSFLEPAKFPSAEEFIAKYDTTDSEQVGYWDSWQGHWRWASSVTSEVQHQQRGMHCRLSWHDDTSCHPPFPPNPSAFAGGEAARYPAPAPAAPGDQGCGEVAAAQDGAHPARRHDAAAEAVLQVDPVQELPGAEQGE

SEQ ID NO: 9640 - protein, 444 aa, Chlorella protothecoides
MVLLDKLLKRLYESGHRVLVFSQMVRVLDILADYCRLCGYSTQRLDGSTPAQARHAAMEAFNAPGSKDFAFLLSTRAGGLGINLATADTVIIFDSDWNPQNDLQAMSRAHRIGQKDTVNIYRFVTSGSVEEDILERAKAKMVLDHLVIQRMDTSGRTVLGGPQGGQSGTKLFGKDEMAAILRFGAEDLFKEDEAATASQGQALYEEDIDAILARSEVVASAKGAEGGPGAELLGAFNVATFQTSESDAEFWKRLIPESEAAEASQAAQVGAGVIGLMRHRRARENNPRVASGRRLKLPPSQKPLHPDLPPVPTINCCRTQGEEEPGIRTARLRLLEPGGKSLAEEDDNEDGEEGEAPAWNPGPRKKGKAAKAAASVEGAHARISRWPPPVDAAGFAPDQAAVGPPPSGWPSALSKKDATAFLRAARRYLHPGRLAEMAGGEGGG

SEQ ID NO: 9641 - protein, 240 aa, Chlorella protothecoides
MEFWSHSHDVSIVGSTLVIPAVTVASLGQLALDVLIETQQADKIGNLHHTALLPCAGSKSFDHVKDAGPALAMEVYRSGDLVLLQQRAPVAAGCQSNFAQSIASWAQEQGLAQVLLLGGLDATLRRGEQLDGAQQLRYWQAGEGVLSGALHAGAVPPLEESWWEEQALREWSLPPWPLAAACADLGLPVAALLRFAAEGNNAADAVELAGAAAEALGLGLAARDLRTPSTWQHVFGMPPR

SEQ ID NO: 9642 - protein, 255 aa, Chlorella protothecoides
  MOD_RES (69)..(72): Any amino acid
  MOD_RES (193)..(196): Any amino acid
MAAAASLLPGRRLDLEDVAPGLLHLPPGLLCMPGGRGTPIIAGGWGGGPPPPAPCRFAPPITSLCHPPXXXXIIAGGWGGGPPPPAPCRFAPPITSLCHPPRRLQIHAVAPPSPLPSPSPPPGCEHVRVAGFASGTVDVLQTKTRPKLVHLLGEDGVARPFLLKGREDAAAHAWLLRLADLARRAAASASSPXXXXARLAAAPGGLDAARGGLGLAHAARRRAGLRSAAPGPPRRSGPVAAARHAPHADALPGRR

SEQ ID NO: 9643 - protein, 746 aa, Chlorella protothecoides
  MOD_RES (492)..(495): Any amino acid
  MOD_RES (519)..(522): Any amino acid
  MOD_RES (576)..(593): Any amino acid
MVVPGTLRRPHPPLRGLHRPARQPGRDLGATLGVPGWKQPVSIGVPWHGPSVPTCASPPAFTLPPRFQKVFFGAEEVAIPQYGSTAEAAKAHPKADVFINMASFRRYWGPGRRGEGVGCSGTVSVDRTPGASNGTLMCMGISPPPFPPHPTSAYESTLEALQLPTIRTVAVIAEGVPERDTKHLIAVARRGNKVVLGPATVGGVQAGAFKIADAAGTLDNILACRLYRPGCVGFVSKSGGMSNELYNVIARAADGVYEGVAIGGDAFPGSTLSDHCLRYQNIPGVAMIVVLGEIGGRDEYSLVEALASGAITKPVVAWVSGTCATLFATEVQFGHAGAKSGGDDESAQAKNAALAAAGAVVPASFEDLEATIARVYRGLVDAGRVTPARDDPPPAVPEDLAAAKRAGRVRVPTHVVSSICDDRGEEPTYNGVSMSELMQGDATVADAIGCGGWWWVGVGVHMGGECMLLSRRLPADMAPYLAWGAATLLQSXXXXPWIHTHTHTHSLFSGCCGSSVACXXXXGGRMHAALEAPTCRHGTVPGMGGGDPAPVSAASSAPCLPSEHLIRQYSTPHTPXXXXXXXXXXXXXXXXXXGYATKFIEMCVVLCADHGPCVSGAHNTIVTARAGKDLISSLVSGLLTIGPRFGGAIDGAAQYFKEAVDEVRAVRERGLVGRVGLPMNRPGKSLIAPGLGAGRVCGEDEEAGDQGAWHRAQDQEQGQPRQAGGAAAEVGRGARHDLGPGHGGQA

SEQ ID NO: 9644 - protein, 108 aa, Chlorella protothecoides
MSITSTSSPFPPNPGVFDESILPLAHLEGTLTRMLTCLPRPEVAAARKQGELAAVLTVLSCMASSGRVMQALDSMHAAARLLHFGHATLDPRLRARALSLVKVLNHSA

SEQ ID NO: 9645 - protein, 525 aa, Chlorella protothecoides
  MOD_RES (483)..(486): Any amino acid
MGCGVGTNQSCPSTTIQCVTPRHTPSPVHDIVVQTSLAQFTALYERSIDQADRSVVPAKRVLHITGALGCSLGGGGGVCTHMWGPGWKTLCRYHIPSTVPPIQLTDHFTYAAFLYVCRGLFERHRAVFAFALSCTLMVQAVGGRGGHLVLNAGTDGMAVFGWGIGMHLHDHMSDHFCTHPLSLCLGGSWPGLVGRGCSAPGCAPCQERRPAKAKGMAVQARVAPSAVSPGPPGPVRHPGGPGQGRCRLARLGGRGDAGEPPPARAGRPGVPAAACPRRLGPEGGQSHDGRGTLRESHAGGALHRTPASWLGGGAQGERPLHPHHLPPLTRQCQRAGSGAKLLPHIATPNNTRPPVITPRCAGADPTEQIETRAKLAKAKLSILSMGQGQEVAARRLVSTAALEGRWVLLQNTHLNTQYLAEVWLGWWGEGVGRAPSVGSMAQACGLDGMPCSHSPTFKNLGRVGCEACDRPLQRILLHMGMRXXXXTHLLSRILVAPDVKHVIALYNAYCFTWACADHTSHRNTP

SEQ ID NO: 9646 - protein, 344 aa, Chlorella protothecoides
MELQHTCAAIQCAILKRQIPHWHEGLRSSLLTQPTNELTRQLLSQSSYYSLEKPIGDLNFVVDVCGVHASSRSRVAGHPLPAQAPVCHLWAALAFRGEREQHVWRSPGGPVPHRCRWARGRGRRLEPGRRHPGSAGGGPGKLAARPVAAALPVLPARRCQGGARMGPSTCLRQACWGPFTFAPAQTLSTSTCDSPARGDYVPLACAASTALSHLGLYNHAGGSGNAACQQRPRPWQAPRLIATHLHRWAVAERGVASVWRQAGVCGRQGLPCHRHCIAARQAQSIQIVRSSVHYCGAGWSWRSWGAGPVRRLHPGASGGEAWRSPGAAGVHGHPAGRGVSENIH

SEQ ID NO: 9647 - protein, 75 aa, Chlorella protothecoides
MSSQIHSIFSALREQKTSFLFTDGTTIPLDPRVGIFITMNPGYAGRQELPENLKVRPLVSAYARQAWGNIPSMGH

SEQ ID NO: 9648 - protein, 548 aa, Chlorella protothecoides
  MOD_RES (165)..(168): Any amino acid
MPEPHEGLATTKVDPCPVLASAVCLWTSSRLWTSSVPCPGERLPARLPLCYNKLPPSRAGAKPSPRQGSGPSARQGARLTSLKRYPAFQVSGILPLLHRTCLRPSSLTVSGSGKPSGAAGVQGSAQEPVRHTVSGPRPGKQLHQAEVGLRMLKGVLREQQPALKXXXXKAWQTAPSGQGGPENDEGCASHWQRLQELCGTPLPSDDTGLILGDLLNAQLSAHWEELEELFSCAKREEQIEQKLGNIEAQWTTECFVWVDHKLRPASILKASDTSELMERLEDALLGLTSLMSNRYSACFRPGQVSQCGRDAGGLPGPASYNTSGLGKGAKALRLGNSLQTSRPGPPSCPPSATLWSSGLWCRTCGLKRGSQPSIICPSCSGGDIVRQLPQEARRFAAIDKSYENVHWEGGGRGCGCLCATQHCMHTWHAGRHSPSLVPATTPTLLPLFAAVAPRPREPDLPGSLLQLRCHAAHASQPGTAAGGRAEEPVGLPRWGWLCVRSLGPYRTLMHCRRGATASVTCHSTLCRHLCVKLLVHSTPLLVCREQEV

SEQ ID NO: 9649 - protein, 758 aa, Chlorella protothecoides
  MOD_RES (321)..(324): Any amino acid
MLIKLGHPPIVTNLQIDVLVELTGHTANNRLGTMAACPSPVQVTWIGYPNSTGLEAVQYRITDSICDPLDTTQRFTGWFWCFLGGVCLQWLDSVLLVTSKEGPLKTRALASHGPCTPVWHAHTAVSSPLSQPDAIVGWVLTHQEPRALNPAAPATHTRQCPLPECGEHPSRQAPHPMAPTAEQLVRLPGCFLCYTPAQDLPDVAPCPAASRGYVTFGSFNALAKQMPGVLQTWARILRAVPSARLVLKNKPFACDPVRQRYWQLFEGLGVKRHRVRGLSWRQGGGTLERARAWSALQELVSQTPSPHHPLPRSACAGGPPXXXXTGLECPSGTGQSDSLPSSPSAAFCVCRWTSFPWPSATGITWRSTASWTSAWTPGPMLGPPPPPRPSSWVRRTPSLHRFLLPNPSTPPRRALPDPGRQVPRAQRGRQPAHRRRPPGGMGGARPGRLCCSGRAGRRRRARAVRAALWAARPRARIWMECLACQCCHAKAIAATSLQASCFRQRFLPATQQCSHRRRSSGCRSPEHLDGSVREHVDACAGAKRAAALHMQGQGRHRPLLTPEALLLLAIEVDLQAWEASLVLGAVHRDHSCLFTAFIGLGELLPGGRQLLAVSTPAEGQPYEKPREQVSFRAEVYPSSCHERHTHPHTGNTLPGSPGACDISMLAFTHLTKYTFPSDVTSSKSVLVRCLTLLPFAASATPISARMMRLRDVSAIVKGPFQPERCWKMTAIMIWEFCLEGDRTSICRPPGDLRGGNAN

SEQ ID NO: 9650 - protein, 418 aa, Chlorella protothecoides
  MOD_RES (415)..(418): Any amino acid
MASGRRSLAEDIADLLEPVAVQGMSRVTRIPSPRSFWSRCASLRQLCHAGSAKVRKPSAPCCCNAEAEPDAHVVLDGVPTLEESDEDLAGVVGMGRARILPDIALDDPAYAGVRSSRATAFESEDFTHDAAEEPAESPRGSDASTSQSEDERPGHHTEPQDDDEVAALERAVEDLQAGDGDTAAYLAERANREKRKALAVQSQRRLWEAGLEIRILLQRLLKSAVRFPQVRIGRIAEQGRRKKIELQMGGSSRATWTPVGKGVLAKTIQASDQGVAAAVEDIRAESAGAISDLLEVIKGLHETNPAIAATPPKWQRKERRDSTALWRCADAWYEATKPFQDASIDRWQRKTLVAGGAQGFAWHRLLALEQIARPIQCRSEDIQAGDCCADYVSMFCTMTLSLDIPTLAGNLKALXXXX

SEQ ID NO: 9651 - protein, 342 aa, Chlorella protothecoides
  MOD_RES (311)..(314): Any amino acid
MVCMLESLDDLLEIAEGPKLLGPEVLGVVFERFASVLAGYEARRGERLARASTEDFDAEEAEALEEEHERESELLDGLAAALSTVLRLYGDAALPGVEGLMPAIGALLGKGRFPEERRIAICMMDDVLEHSPAGAARHAPSIMPLLLAGAGDRDADIRQCSAYGLGVAAARRPEAFRPVAPAALAALRAIVAAPDARADGNASAAENALSALGKVLEHAPDLAEPGLGGAWLAALPLVEDRAEAKEVHAQLLRFIAAGDARVLGEGNANLPQAAKVLVHVLGKGEKLLAADQIPNAVAMLKQMQVGALRVXXXXGGGLELKEGRGQIREDSTVVPAGGWGCV

SEQ ID NO: 9652 - protein, 410 aa, Chlorella protothecoides
MQSDACRCVVGMASKGAAALEWRSQQQGLGEALSDAEDCLQYLEVVQELMQGLRSGTLEEAIEGLPNLVSALATAQHISRHFSQPASFATVLQVEAHLRREGMATMLASPCHGAQLPAFPRPQSQMVEEELVAFCQSSLEAGGRLWDRKPCDLLMACQACQRLEAQWQVCWGWGVAEGRSHPAAGLIRQVRGACTAAHVGVTWRCVQPHQREQYTPSPSPQAALMEERLNRYAGKGSAPPAAAAPSPLHAFRARCAGVELISQRAAWIELLAGFTDLEGVPELVREGQSALDRVRRQPYNVLDTSKQQFGVEVEGFAAHMARLEAQFEVTGACAARGVGVPDAGGGGMHCMLWCGTQADRLKRQARRNTASRTGASQHPCTTPHTDHHRGSLFVLALHHGCPGAPAAPVQ

SEQ ID NO: 9653 - protein, 371 aa, Chlorella protothecoides
MLDSWLAQRRTPEAMVLRPLFDRLVAPLLDHDAATRCQKGAGAAFTCPNRSAAQKRLVHSHSCRSACTPIMPVEACGLVGTLLTLLTGMLDGVASSAPDGGAAMTPTQAPQLESVVLFCLAWSLGGLLENADRTGFDAKLRNLSQAAPPLGSVGVCTAPPQTYPTQCGATGVTEVALPSADSGPAAAHIILQDGSGLSTIYDYVYDVAGARWTPWVQLVPRWSYPTPGARVALSKTVVPTLDSTRYGYLMKLVHAAGKPVLPSLPDPQIVGQPGTGKSTLVRQYLSRAGEGGLASKTLVLSSLTSPGALQYSVERSLEKRQGRSYGPPTGRRMTMFFDDINMPAINEWGDQVGQRLGCIHTHGLLGDGAPA

SEQ ID NO: 9654 - protein, 96 aa, Chlorella protothecoides
MVIGPAGAGKTSVMESLAAAHTRLGAKTVLWRMNPKSMRVEQMFGQVDPATGEWTDGVFAVLWRRAARAQHQHTWIVMDGPIDAIWIENLNSVSGG

SEQ ID NO: 9655 - protein, 90 aa, Chlorella protothecoides
MALTSRSLIILALIGVALAAKGSSVRHLTSTDFDEVTSDGKVYFVKCGHCKKLAPTWEKLAKAYEGSEEAAVVSVDCTKDKAVCNKAKAS

SEQ ID NO: 9656 - protein, 593 aa, Chlorella protothecoides
MRAPARARRNTIERALWCRRPSGEQVQGYYIHREATILKDMYSMESKERLKEDVPQTSPMPSGPSSQLPHEASPAGHETSATPCVPPADAQDLEIVKSQVLILLDQCNRAPDVLALLSNLPGQAVAARPDLICLRGRALLALGNKPLAGPQGHSSCQALQLSPTSTPHTPHPPPGPAQALAAYLEALLSHPTNIDALLGCASVYTASALPLEALKCLERARGLAPTRADVVQALANVLTDLGTAEKLTRVPGWRGRYEAALEACPSHAQAHYNLGVAAGEEGRAEEAAAHYRDAVRAAPACAEAWCNLGVVLRSQASCCGAGALLVPGPDRDDACDAGPRVLPAVLLRVSHTKPTSQGKLEEAVAAYEHALAVAPNHDIVRVNLAVALSERGSVVKLQGERGDLLGWVQAGSVRPGGAHPGWRLGPAWLAVGGVGWCQLAEHAPPYLGYLAPTLAPQTPRSRSPLSSPPGKQEEAVALYERALGLYPLHGESMYNLGVAAMEAGQMHRAIFMYESAVRVLPACAEAHNNLGVVYRWAMGEEDCPAEREGKGCSVRRNQGRAVTLQGQECPGGLVSYDTQSTWGRQLDHCRPYL

SEQ ID NO: 9657 - protein, 69 aa, Chlorella protothecoides
MGNIDRAVTCYLAALNARPNFPQGLNNLAVVYTARGQSEEALQLLLSALSLAPEYAEAWNNIGVLQVAS

SEQ ID NO: 9658 - protein, 164 aa, Chlorella protothecoides
MAQTREDVASMQTQLASKTEKLEAAASEAKALLHQISVSTSQAEKDRQKVAAIVETVTAKVGGRGGWSSAGPQPCVGGIESTLQYPCPLQAHDIAAVKHDAERDLEEAQPALQAALAALNSITPTDITSLKALKNPPNIVKRIFDCVLLLRWGVLAWPEGQGLG

SEQ ID NO: 9659 - protein, 59 aa, Chlorella protothecoides
MQLLMRALRDMNVSKLVGDDLPLFLSLVEDVFPGQKLERMQLGDVQAMLKTVRAAVAGA

SEQ ID NO: 9660 - protein, 193 aa, Chlorella protothecoides
MDVNTNALSADPWTSRAEDLVAMNARGPGCFDFRFYTEVGQGGLRGQHPEAEGPGILRMLRFPSAPPPSPVPLADPTLPVSRQRLLNLLSHTPSPPRLQNNPDLAGKAGSPLELWEHWLLLGQFQGRTHRFSCPVQMGTTYRIAYLRARGGSCFDHNYYLRHNPDLRAAGMTSSSELYGHYTYFGQFEERAVK

SEQ ID NO: 9661 - protein, 70 aa, Chlorella protothecoides
MMVPNRQIIMKVKLAACGYQENDVLSRRFHTLYGLCEQQLSRQPHYDFGLRNILAVLRSCGSLKRQNPQQ

SEQ ID NO: 9662 - protein, 165 aa, Chlorella protothecoides
MLVTLGETEVEVATGFRLYITTRLPNPNFTPELAARVTLVDCTVARVGLEDQLLSRLILKEKHELEHQRRKLVAEAPGCSSQDAGCAGPEYQGVLRKAPPGLSGPLLPVSQVQNYHAKISELEEELLQRLSNCENLLEDGDLLNILARTKQTGCGAGAWCCRHAT

SEQ ID NO: 9663 - protein, 99 aa, Chlorella protothecoides
MGTCALVTTPVSVTTSLQALDDLVRKKIKDPSDFEWQKQARFYWLEERTLAQISICDVDFEYSFEYLGEPGVVVLCVPPSDGSAGTGTQWQGHGTSALP

SEQ ID NO: 9664 - protein, 196 aa, Chlorella protothecoides
MRTHAAHAAHAFLQFDAQPLLAGMIDELASWKALFTERLRVQGSDALQVRGGLIWGDGVFVLQGLKLTWTLPIPTGSPAQALSKRLAGLLLDLERPVEDLEDYRHLSACLSIVHDMEFSFGDDVEPIEYTYALLGRVEAQIPKQELDAVADLRYSWQKVLHAAAGMGEVLLQERVSRLWGQGHVNAGMLSIGACAG

SEQ ID NO: 9665 - protein, 93 aa, Chlorella protothecoides
MNSFDGEAVRLSRPIQARGNVEVWLQQLVAGMQETLRVLARQALRDVYEQDLETFLFSHPAQIALLGLQFQWTLDTHVRGRKEWHMWASDGDL

SEQ ID NO: 9666 - protein, 110 aa, Chlorella protothecoides
MERGSAVLVGVGGSGKQSLARLAATLVGASVFQITMTKQYGVPHFLEDLKVEEHSGGTAAYQEHDACLALLPLYSHFETEADPACLSPAPGALQSAAGKESAHLLHCDRC

SEQ ID NO: 9667 - protein, 282 aa, Chlorella protothecoides
MVVQARLSRMVSNVESMGAADAELARILVAENNQGDLGAHSMSQSQAGATYFKRPPVDTFVTVDGVLARKCPEAATAGTLPPARAASTLVFYVYNAVDEEQMGNFDFFLKFGLSANDTVTYRIIITSGGAVKPPLAMPELPPNAKYISTTACTGTWGALGAIEEQVDATKFPFVVVVDSSVRGPFLPPYAAGVMHWTEAFTSRLTKSVKMVGSAISCEGAPRAGHAALEWRRNPYVLPYAWAADAVRVRDLLVLGVCLSEPVGRVQGLEWACCHHMCEYAPC

SEQ ID NO: 9668 - protein, 225 aa, Chlorella protothecoides
MCLHVGHPCRGRSARHVRQSRLHPNTPTCHLTARDRPPQLSQVHIHPTSPDPLHDREEAQRDSDSEALLSSFLHASILAHDSFPRALAFILAARLADATLLPSELSEIFRAALASHPSIVAAALADLAAVRERDPACSGLSQALLYYKGFHALQVQRIAHVLWHQGRRMMASALQSRSNEVFAVDIHPAARIGAGVLLDHGTGVVIGATAVIGANVSILQNVTLG

SEQ ID NO: 9669 - protein, 321 aa, Chlorella protothecoides
  MOD_RES (211)..(214): Any amino acid
MLMNGTAAFQAAGWFGATYPYEWVPWSNKILWNTMGCCNPDTNEFWSLIRALFGYQAMPTNIQLLYYCLFWFVVLSAMAYRAWLGVLTDEHRFAAEDEEGRPASFNPTYDGEGKLAKGVEGASGSDSSPRQHSSERASGDKFEDAAVAEPSSAAVPAPPVAAPPGAPTGLHVRPPFRSLSLLSRRGEPAWRACLSACLAPAPAQGLGPLAXXXXRGAPGCRHAWHLPLHRVWVLWRKFVATAKSIGVGCSCTNLRRRFIHEIVSPSKLSARSNVSWAMPHPKDLCPERGNRRAAPPHMHSYIFESLCCPKQQSFWRPSHPV

SEQ ID NO: 9670 - protein, 152 aa, Chlorella protothecoides
  MOD_RES (128)..(131): Any amino acid
MQASGIPAARWSVQENYRGESGLVMAAELARSGALGRLVKADLVAELPMNPGSRYYASAWRRQLPGSFLLEGGVHFVAALRLVCAAAGAGEAGRVSALLTRGSEGVPEPDTLVGWARFDGGVPAGVSXXXXACLGPIPWSAGRGLTAACRRA

SEQ ID NO: 9671 - protein, 253 aa, Chlorella protothecoides
MYAAAQHDTVRRPDGYITIICARTVSRVFQHQQECSPEPAGPQDRVFVGGLPRTVRPALPARKMALRAVFVVACLCLSLTARGAKHSFTAGDKVTLWANKGGAGLREVKPTSTTTCPSASLRTRTTSCSPWGRCDSWEPSPQIPRWRHCCWKHPGPAQYDHSASPQSPPGCRTSTPPPSSQVVDGNRMVATPYDLSFRVDKDKATLCSRHLGAEDIKAFRTVSRWVLALADCSTLVFHVEASGMVALAWVTGI

SEQ ID NO: 9672 - protein, 855 aa, Chlorella protothecoides
  MOD_RES (522)..(525): Any amino acid
  MOD_RES (697)..(700): Any amino acid
MPPKRRGKPWRPAPPRCVAAPAPPSPRAPFVMFCLLKTSPCGAGVTLGGTPNPRPCQWKFESFRLETSNSGRETSLRVTHLLEVLPPDPRAAKLLYYYIFIHSGAMPGERFNVRLAPEEGGSPEPVVVEVGLEGLNLLAPGSGRALRKYPLHHISRWSMRGSSLILFAKSPVGSGEARGLGAAWPSWPRGACIPHCVTEHMTLRFPPYTCRWTWRTGRWSCRGTSTPFGLCWTPLPPAACSESSGWLGRVPGTMVPDCCLEDPAGRGMWAVQGACPLQVPVAILGRSARGNPWSQCDRLPPLHPSTMPKDGGVAAERPHRPRHLGRRPGRLLPLQPAEKGKKTGAAHRRSGGVLARPGEGGLDALPGRGHPYLAEALVRPEAGLPVPLLRAGRHRRQPRARRGGPLHHHRRLRRRPSHGPPQLHPPVHGHRQDLLPGRQRDRAGGVAVGAGGLCCGHPPGAERVGGGGRGGAGQGTARRPRARRLLFRPGQGAGGDAAAQLRCGVCCREGAGGRQWAAGRRXXXXSDPGKALEETLQRSFAAESAAAKGPVGGSGRRAAAPGMISVVNYAGLSGGSSRSEPEPQYINVDYGAGIAGFLLCCLGESCNDTLCMRGLERLPLRDQDCRLHCSLHPTACISSNLGYAGTLDPLASPDPGASQLPSSGARYGAQPYGGGASAGYGGHQAYATSQGYGEGPXXXXSSGARYGAQPYGAGPSGGYGGHQAYTTSQGYGEGPGQHCAPARHGAPPQYAPAPHGGVLQHAGPQQYEAQQQRYEPQQQVRSTWCSHTALRSFSRDEAAMIRTLPTPVAGCPQPSTIGTLANSPHGGGQTLLLQCGHRHHAVGDTGGVKDGTAAP

SEQ ID NO: 9673 - protein, 134 aa, Chlorella protothecoides
MAITKDNVSLTIDGVLYTKVTDPYAASYGVENALYAVTQLAQTTMRSELGKITLDSVFAERDMLNSAIVASIQPAASQWGLQVLRYEIRDIMPPASVRGAMELQAEAERRKRAQVRGRTGGWNGGGICTDWRTA

SEQ ID NO: 9674 - protein, 79 aa, Chlorella protothecoides
MHHANQSLTPPPGQEQAAGYKKKDFIQAKHDFVDRMIQFAGVSNPGSILDVGCGIGGTTRMLASRFPGAKVAGALTLGL

SEQ ID NO: 9675 - protein, 334 aa, Chlorella protothecoides
MANLSYRLPALLALVATQVTLLASQVSLPMLAPLLLGTGMLLRSLRANASFIFPRIGLMVVLLWALWFFQGVVQNTVAYLRKQEWGSSLLSGSETEGLDGKGGWQGCQQGCSGMAKALKERAIMQRRPDLMPDSAPFLGAPPLRQGALDQRLAGGIITTSEISGLLAAVVILLSMLGINVSALLLPAGVALAVAAQDLTRNFLAGFFLFVVQPFRLGDKVAVGVAGGGPPGSTGPAGPWFEGVALVRGRVREGGPALHLYPLGAAPPHGAQLHLHGARVLRDGRRARRRRCRGQPKHARARRARIRGAAAAPAGAGPALCGPRMAAGPGPARAR

SEQ ID NO: 9676 - protein, 204 aa, Chlorella protothecoides
MTGIPPNHHGDGLVLLSALPLLLVDTVWIGAAAGVGVALIVGVVFIVLFYVANNSIFTGNAENLFKGFIFYIAVLLIVYVSFHMLKFYNLEKKWRYKLEQAFKEREVGAGAGLEGGCMHAGCLVVGANPTTHRVVHPCLRARHHAGHEEELQVHRRLPRFLGYGIESVLFLTGVSGGQGITSVIIPGIVGAILGLIAGCIIFYT

SEQ ID NO: 9677 - protein, 135 aa, Chlorella protothecoides
MEAAHLEDWAKYTLPSWRHSIWVGVYDPWIVVSKVGRRKAGMGGGRGKCEAECHMLERKAGSVHAPMERQGLGHASHSTTEVQPHKSHPVPQSWQPHLWYKCARDGVTLERFHRAFVDGLVQYGMIRAVKKKAAA

SEQ ID NO: 9678 - protein, 336 aa, Chlorella protothecoides
MSIVRELRQAVVDCNARGLMESSRWAAQQLAGLPEEETGTGEASLEPVQPVWSREDDRHALARCHFDVKVLCLVLCLQRWALLADIEGESLSRMSLPSCVPHSIPPHLPPLQEYRSAAHVLSDCTSPKSTFLRLYSLYLAGEKRKDSTRSADPCPAGIPVPGSPHLPTSREERAEAAGGRPPRVSPQNAELEGLEAELSRLCAGPADGFLLYLLGLVRLDGASLDGARQALVAAVRAYPANWCAWKALQRACPDLPAALALGLPEHPARAFFLASLAVDLHDSGEALGWLEELAPRFPASDVLVQLAAEAHYNLQNFDEAQALFEDLLARDPHRLE

SEQ ID NO: 9679 - protein, 170 aa, Chlorella protothecoides
MQALPVAHTTPSARAVTSQWSTAPRRASAVTCRVTGSEQHSVSHMERSSKRNSDRVPFAAVTPTARAGPVLLGTEVPTPLVAAVALGGAALGLRAIKKVFDTPSRTYDGQNVGKEYDAWTREGILEHYWGEHIHLGYYTEEVGHWGDEGRRDYLRKSSCHAQSIHAARMG

SEQ ID NO: 9680 - protein, 127 aa, Chlorella protothecoides
MTPFATKSTPANTVLRIVPQQMAFVVERFGKYSRTLSPGLHILIPVVDRIAYAHSLKVRACVRGAGGVASLLQRAQADRHARRPAGPLLSGAEASFSETLPAPSPCPILVFHTTTTPPSPLTLSLCS

SEQ ID NO: 9681 - protein, 172 aa, Chlorella protothecoides
MGWGFWGGRRHSGVLRRVCAGLLLPGRPRLAPGHEPESIPPQPPAPLNPEQSTSGQDPDDAEESGWKFVHGDVFRFPPARSLFCALVGTGTQLLVLSFCVFGLALVGAFYPYNRGAMFTALIILYALTAACFVVGGVATQPCQCRQRVGADDGNGWEKLTGSTWGQWAPPTP

SEQ ID NO: 9682 - protein, 195 aa, Chlorella protothecoides
MGAVVLPVAGLVVGTTQLVRGLANTPEAISAARAGKAWDEERRTWVDDPGSALALEDEGAAPARAAWQAAAMAARGEDDLYALLGVLPGASTEEIRKQYYVLARRNHPDKNPGDPEANDRFQRLGQAYQVLGNPDLRARYDAHGAEGLDVNYVDGAAFFTALFGSDRFEHLVGELVLAAAARAGGGGRDPGAAVA

SEQ ID NO: 9683 - protein, 66 aa, Chlorella protothecoides
MPLNTPGIVRPGRKLVLLGDTAESTAIATLARGADLVSHEATFCARESMGSFSRFPGGGGVCLPVE

SEQ ID NO: 9684 - protein, 368 aa, Chlorella protothecoides
MCPRAVYSATDPASEPPWISLEARLWSDVDPPGGEPIADVHAVESHVSLSRKMRAAWALVRRREALTIVCTNSRRAASSAAQATPKQESSHRLVVYESEQPWCESKCNRCNHFDLDPEPRQGLYESRPPPDQSGGPPRRPRTASAGCGGCRQPAPGQPPVICRAAARSVHGSRSPGVSWGGARRQGMPAALGVHIREVEGVNRWVGKQEQHIAVVPLMRPGGCRIPASCVDLWPHRVALPTHQVGAVLVSMNPAYQTAELEYAVARCGMTHLIMSPGWRASDYVGMLQDRDKRAHRVLQADRAARSASQPRKPLLHRASGQRCPPCGMWSCWEVARVHQASRGPEGALMGRPSMPSACDLDCQGSLAV

SEQ ID NO: 9685 - protein, 95 aa, Chlorella protothecoides
MGQRDYIKPLLEAQGTVHFGKVCMKPGKPLTFAEVPREGRYGEMGLVGWGQARWCLGKMVWFAAVPAMLAAAPEVCLGGVGLWHGRRHPQDGHRS

SEQ ID NO: 9686 - protein, 147 aa, Chlorella protothecoides
MEPVRTPAANYSMVSVAEAVETVLGATRPLPPQEFSYIDALGLTLAEDVLARDPIPAYRASIKDGYAVRAVDGPGIYPVAFEAFAGAEPETLPPGTVAYIGTGGPLPEGADAVVQIEDTLDQGADDRGQRLVKILMEVPGPGGSRGG

SEQ ID NO: 9687 - protein, 127 aa, Chlorella protothecoides
MAALATRAPHVPFRNSRLTQVLQDSLCGSSKVLLVCCLDPDPASAPESLSSLAFAARAARVELGASTPSARATPSQGRAEGGTPGTGQRAGTPLTGPGKDEEGRRRAPRTPLHDLLNTPPPALARGR

SEQ ID NO: 9688 - protein, 179 aa, Chlorella protothecoides
MRACHARHMFVLLSRCGAATPYHHQIGSDVAQGEVILPAGHHLLPAEIGILAGSGAVTVKAYPRPRVAVLSTGDEVKDPAAVALGPGQVRDANRAMLMAAVSEAGALAQDLGIAGDTEEESTAAFRRALDGGADVMLITGGLHLETMGAGGKRVGTRWGTGVGGCLQTPGREAWEVPWG

SEQ ID NO: 9689 - protein, 116 aa, Chlorella protothecoides
MCPCQQPRRPSLQDPGLRRVHARLSFDIKQDPARPEYHRAIGSWRRMAGGDKWELVAQSTGGQISSRLLSLRAANLLLEIPRRKGVLVAGTQVSALIIGDLGCMPVHESVDTTPGF

SEQ ID NO: 9690 - protein, 174 aa, Chlorella protothecoides
  MOD_RES (34)..(36): Any amino acid
MEGGCFGAGGGVCVGCITVGVEGLGGLKHDRCTXXXALLRDMAAARRAAGRPLKLVLMSATLDFGALSEYFGGAPVLSSPGRTFPVTQRYLEDAYEATGYALAEDSHCALRAGSDAALRARQAAIRRAAAGSQGVLAQGWGDDGARPGAVLNPHYHPGLYGHLRCAGWQVGAAW

SEQ ID NO: 9691 - protein, 308 aa, Chlorella protothecoides
MHHQPSFSSLRSSVSGENLGGEETAAATAAAARPGPRGACVALSLKLAGVHWWYQTPSHAAELTAGYYNTPERDGYAALCALCARHGAAATLTCVEMCDAQHPPEALCGPEGVLRQVREAAAAHGVPLAGENALPCFMPASVDEAALARIVHNSRAWGSPLEESAGRGAGGGRDGAGGPPYQARRPWSSSVCELFRKLRLQLALHRQHPSSGTCHARGISAAPAPAAPPFPHPLEKNQQNITPILFPTPITAAAPEGLHLPQADPGADGALLPGALGALHGTDEGQRWARQDADPDQAVGPGAGHRRA

SEQ ID NO: 9692 - protein, 168 aa, Chlorella protothecoides
MKEAVDLDALPLILDAEVVAVDRADGNRLRAFQELATRARVDVSAAAVQVDVAVFAFDCLMAAGQSLMRSPLTERRKLLAQALSGAAPGRVELARCYEGAEGAGADPSADPPSTGTVVPATTAEEERAAALQAALLEAFAQGGEGLMLKSLGAGYEPSKRADHWIKLK

SEQ ID NO: 9693 - protein, 122 aa, Chlorella protothecoides
MARKVFPVRRKGGCSIHLVPYSEHSSYLELLEYVEFLRPHQVIPTVGVEGDSGEQAMRKMQAQFRHLVDETKDKVGVGLGWVSSMARLHSTFRCRRCLPQGFPRCAWRNYPTGEVLGGFHKA

SEQ ID NO: 9694 - protein, 224 aa, Chlorella protothecoides
MGVLRQRLHQLYSQLGDLGDVAQSCRATQSMLRRPDPLTVPGVFRALHDMAAHRGTGAGGRRQHAVLSLLRACREGEVRYVVRTLVQGLRVGASWRSVIPALARAVLMHVEGTPRLPRARLDAAAAAATAAFHVCPSLDLLCAAMRSHPVEELERHVGLVAGVPIKPMLAKISEGVADAIAQLKGASFLAELKYDGMRSQIHVLLGGECIRAAVYHSMRVEELA

SEQ ID NO: 9695 - protein, 162 aa, Chlorella protothecoides
MISNIFTLSGLGTLEACCVLWYGAGQASVRLGAPKITGIMLAGVLVGPSAINLLTAELAEDLVGLEHACLALIALAAGMELAAEELARTGTQVVVLTLCIALGSWLVTAAGFLGVVALVGPEALHLEPGLVWPAASLCGTLALARSPASAVGRAERVGKWVP

SEQ ID NO: 9696 - protein, 171 aa, Chlorella protothecoides
MRYAPHLKSDPHLQRFVGADAVFLDTTYCNKRHTFPPQEESIAYVVAAEESIAYVVAAVKRLLAGQAGEAEPDAPDGPEHADDSAAAPGADAPAPKTPAGPRRVILISTYGIGKERILSAVAATTGLRLAVTEKKLAVMRCLNLPGLDVDGIFTSDFSSTPLHVTPWGFIG

SEQ ID NO: 9697 - protein, 180 aa, Chlorella protothecoides
MGGGSGLRDVSQVLHAGLAAAMPFVNVLFFGLVGAHLRLGLLAGLAPFAVLLAAARIAGVAFGCLAGGVAGRVPPALRTRLWQGMVTQAGIALGLCQVIARRLPDWGLHVAALIAGSIIVNLLVGPLLFKVAGQGMMRRGMMRLCVDLGGVGRGPSPITLPLICAWRVQTIQLAQIVSVP

SEQ ID NO: 9698 - protein, 555 aa, Chlorella protothecoides
  MOD_RES (211)..(227): Any amino acid
MAGQRPRVLSPHASKSPQSPPAGGCLFPYYIGVSGALRDGQILTGAQARRAEGKAVSILGLLGGCALPTRLAMSPWPPSLRAPRPVPHRAANTKVGGSSAGSLLAVCLTSGMRLDDITEFSLRLMADCRLHGTRGRLGEVLARTLHKHLPEDAHTKVQGKAYGLDATGGLGEGVALEQQPAAWLPWHAADILIAVPRSLQHPSTGKPQPRXXXXXXXXXXXXXXXXXPPPPPPPALSTLQIGVSKAFPMLQPMLLSEFQDREDLIAALLSSCHIPYWLDSSLFTEFRGSYVMDGGMTNFIPIPPGTTGVRVCCFPSRQLSPIYRRARRPWGNMGAWRALLCCTVAAAVRLSPIYRRARSPWGKMGVWRAILCCTVAAAVRVPAQARCGVLVRGFVLSTTPPFAPRHPQDWHQSRHLHAMAAQPGLHGFLGPGAGRRGDGGVADRQGPGRCAGLDGEHGAGQPGRKRSHRGRGGGGGQGGRAGDARRHGGEGPRRAAKSHPLSATQPGLPLLAGKVIFKNWVSLKGSNPLQERALELQTQMNADLFHTHIHCVTLQ

SEQ ID NO: 9699 - protein, 460 aa, Chlorella protothecoides
  MOD_RES (157)..(159): Any amino acid
  MOD_RES (239)..(242): Any amino acid
  MOD_RES (426)..(429): Any amino acid
MHVPEGPLPRLGPRATSLHPGGEAPVPPGPHLRSNLVWFQAREASHFQERVLEHPVAGDLAVAEAAETAALQGFPRPGSRSPGAPQHKSPPKLPAMMPENGAPGHAAGRAAGGVKADLGPLSPRGRGEKSGGPNGAGDDEEVVSLAGGGPPGERSGXXXIWLFPLPHTCHALPSIVMGHVQYPRTSPAGPPGERSGLDDGEAACPKVLQAALVLAVCHPPLHLRKPRHPGGVPNGMGAXXXXVILVRGPGIEEATLGLFIGDGGHAMCTLQAALSWGMSSSGGCSSSWQDSPSSGAAPGAVVVNETEDCGLNPYIAVAAPLCHCMSFPIDLLPRLLPAHSMLRYFGDFVTWAAVWGVEKSLFTWKNALYFAYAVRVRAGSVWFILAERDMPLDRRDHSCLPFIAPAHACAALPLRPRDLSNPHNAXXXXVRPGPPNNVPRHCVVLLCQGVTSGLCVKRPQ

SEQ ID NO: 9700 - protein, 194 aa, Chlorella protothecoides
MSSTAVAAFSLKNFNNNGIPSTSDVGIAASLRKKVDDATFTFSFTDSSLKEPKLGKGVVLAVEKPLAGVAAGWGVWEGRWLSEPGQQRVPAPCIALLKPPSLDPTDGLKASLAHDFGASNSVASLTLNRLVNGSDVQVKAIYKRAGDVFIMEEQWKVDKNTRINGRCVGAGGLGGGAGGGGGIFGTQSVQLNES

SEQ ID NO: 9701 - protein, 363 aa, Chlorella protothecoides
  MOD_RES (203)..(205): Any amino acid
  MOD_RES (300)..(303): Any amino acid
  MOD_RES (327)..(330): Any amino acid
  MOD_RES (359)..(362): Any amino acid
VSAAAAAEAAAAPPPARSVVPLIVKADVAGSVEAVCDALAALSCRELELRVVHAGVGPVSASDVQLAVPLRARVVAFGVRTAGAAVDAELRRHGLTLHRHDVIYKLLEELGEVMLGEAPRVEREVVAGEAAVLQVFDVKATRWAGGEWLLCVMEGGHPWRVQSGFGRGGRMVSDRGSWGVGMSSEGTGPMHRQGRHALWWERXXXQVFDVKATRWSGDECCLCVMERGHSWCVQSGFGRGGRMVSDKGSWGGGWHVFRKNRGHAAPGAACSVGGAPLPRCGSGRPTRCFAVPEDAPPCPXXXXLPRCGSGRPRRCIAVPEDAPPRPXXXXAAEARLRSPQSARRTSLAAHPARPKPRSXXXXE

SEQ ID NO: 9702 - protein, 74 aa, Chlorella protothecoides
MTQRPGEPAVLDPIPQPHALPPGWKFWVPAASINFFAIPLQHQVWYMSACGLLWVTYLSYSATHKQSPLAPKTA

SEQ ID NO: 9703 - protein, 86 aa, Chlorella protothecoides
MLQASQAWHVKNPLPSPRPPITTFTAILAPVLEESVFRGFLLPSLTRVLPVPLAVLASSAAFGLIHLTPRDFPQVSSPRNECGQGT

SEQ ID NO: 9704 - protein, 172 aa, Chlorella protothecoides
MAQVPWGLGETALGLVSWSLTFAATGLFSVTLLRWTLGSSVGSLPMDVKALFILLNQMLGTGVTLGLLWLFTRRHTPLPADLFSIDPRRARCRRRGIAAGAPFRPSDGWLLWALVGIALSPLVVIASATAAAAIWGSAPSDARGTVDSISQLINVDGSTRAALLTTTGESVC

SEQ ID NO: 9705 - protein, 287 aa, Chlorella protothecoides
MAAEVPVPPQYIPQPVTDFRGFPDGPRGFKVGVTKKGVLGQKRRLEEYEEQVHAHPGRDPPTMCLASAASRRTHIGLQVEKEQEEQAMAGEVQPFGPRKKVKHNTHGLAKVSGRSWKQAGERAGTLRNPKLSTSWDEKMRIKAEKASFLEQKRDMDSSVWPVVTHLRALTPPQKLSPPSPDAQVPARGGAAQEGGEPQEERGDGVGVQRHGQEDAEEQEGAEGAEDGGVRPRANGSRAGAPPNLTHPVPKLLRPLLGHSPSVRVHVCPHKQRGGAETGLGVVHASAC

SEQ ID NO: 9706 - protein, 219 aa, Chlorella protothecoides
MAGKECVAIASDLRFGVQLQTLATDHKKVYKIHDQLFLGLSGLASDAETLSQRFKFKHTLYKLREERDIKPSAFAQLVSATLYEKRFGPYFCQPVIAGLEPDGTPYLCGMDSIGAIETAKDFMIAGTASDALLGICESLWRPDMGPEELFEVTAEALLSGQGRDCLAGWGAVHEGPDHRPAAQRADGVERACAARLASLAGVPRPEFQRSPNKKAVGVT

SEQ ID NO: 9707 - protein, 269 aa, Chlorella protothecoides
  MOD_RES (34)..(38): Any amino acid
  MOD_RES (119)..(122): Any amino acid
AGRDVVVAGYPTFDPAASGLSGPVLTAGALSKAXXXXXDGVLGAGSDNVAGGTPGGCMWPDPRTPACLQGSRLLPPRTPRPSAWAWSPSPTPRTHRNPPRLHRHAAQVVALRGRPAMLXXXXRNHPRLHHHAAQVVALRGRPAMLLTSASVRSGASGGGLLDRDSGALLGLVTSNARHVLGTTYPHLNFCIPASLLRPTLAALLEERSAGPDWAALDAPDPALSRVWRLGSHEPPDKQGLEPPVPRALQELLAEQQGEGGGAGKARPRL

SEQ ID NO: 9708 - protein, 243 aa, Chlorella protothecoides
MVGHTGKLKATVISCAAADRGVKTLGCHLLEQNAGSWLEPNVRVQAEGEHHDHRPWCAHCPPLAGSQVLLDAVEEVGGSFLVTADHGNHRKLVLMWVVPGTHWLERFPQSCAHAGALHAVMIDLLYLEGLWDRKHTLATVTAGDSSMSHDIMCCPPPGNAEEMVKRNKDGSPKYTDGEPEVLTSHTLNPVPIAIGGPGLPKNIRFREDLPGAGLTNVTATYINMLGFEAPDFYEPSLITTDKP

SEQ ID NO: 9709 - protein, 371 aa, Chlorella protothecoides
  MOD_RES (353)..(356): Any amino acid
MHLHPAPPLPTRTTSGKGNRGLEGGVVPTLFFQKRSPTAPKNIAVHLDKDDENFHHTSSPHSTPKRGQRPAAAQHASTTPGTGLKSLMKQAAMAKRAAGPDFVPDSELHLASLRSTTGAVLGLAWSADGDALAAATDGGSLQVWRLPPGLDVAAPGGRQPPHSSHELRQGASDVAFGAGPSSLAVLTRGEGGAPAVTLLTLPKGPRGDPEPAWTRHGAHAAANEGRCLEASAGSKAGYPIIISSSNKTDIQAAGNDGDAHQHDCARLHAEYQDHHPTTRSVYSGSGEDLGTIDTGGFEVRKCGDGRHGSRCSHWLGWGIVQRPRLESAGGRALGVSLLPIACQHARLHQHPGXXXXRRGVGCAGGAAWHCI

SEQ ID NO: 9710 - protein, 540 aa, Chlorella protothecoides
  MOD_RES (418)..(421): Any amino acid
  MOD_RES (456)..(459): Any amino acid
MTSRQVSGLGVSRACALCRRVTEAFAAPYFFKLYLFVTTLTPPLLNPLVTDLRGVIRQAGHLHRPAQGHGPEGPCRARAGPGLLPGSGALRDGLRRRHAPAVEHRRALRAGRGPQAAGDGAAAAGAGPQAARAAGVGRRGGDRAVQRAPPRLLRRGGGRPPGQRARRAHRAHRRAGLVPGQADRPGAAHLDAGDGGWGRQGQAVALPGAQRGQEGLRACRCLTLSTCSATEDLLFAPRSVFQDTEAGVRPCPSPSTPEFMLYGTVRWDPLLIVVQIVAFQCYFYGTLGLLLFLLTGARPYVPDVNLFHVFDWRWIQLKTFVGAMVILAFVITSVLNAVFLRLMVWRYCCGLVHDRPHRGVPRNCPLPLHIYNAFVQIRRAKKCLDFTATLYGIHLILVWSTYGLPRTKTWWVAAQGVXXXXVVVGSCTTGLTVAFRATAHSLPTLTMLLCRSGAPXXXXRVPLRNMVTCILIQYGLTYSAIIPLNRWICNLAFLAITTGLGEWLCMQKELQDIPMSSLSTAGARIEQELVRQIPVVTILS

SEQ ID NO: 9711 - protein, 146 aa, Chlorella protothecoides
MPQNAAGECLGLVVGVGLGAHRRRCVQGSAAGAAISFPLTQRPDASGASASPPPYPEAIEVYTTRPDTLFGATFLVLAPEHPATLAVATPDRAAEVQAYVAAATAKSDRQRAASGVTGVFTGVGVERREALGMMMELVGPCGMGMP

SEQ ID NO: 9712 - protein, 265 aa, Chlorella protothecoides
MALAVLDSPAGPLPPAHPALPQPARCCAPLSERYKNTKPRPAHHRPVPGTTVCIQAVALASGGSAVPVGVKSSTSGRTRGSSDSGMATEDAGGPVRTPHVHHPPFGSYIPYLTTNPSTGLPLPPGPSISAYLIRAAIGPQREHDGEGLAPVALPREQPVAQFVLRPAPPRPPRLQPVDHGAAGLRPAQPVQGQTRRGGGAGHRPARLAVPHHRAAGQAVLRGKGRVALVVGGHGHYGARAVCAQDILGRPDGQGLARGGVQRIRA

SEQ ID NO: 9713 - protein, 381 aa, Chlorella protothecoides
MPALHASGPLLGAAGPRSGTVRCALRCARTALTPWAGVARAPFSPRVPCTPLRSASTATTQPETETGPVPESGTGPATRHAAYPFAELEPKWQRYWEENQTFRTPEFKDLDTSKPKFYVLDMFPYPRWVCGSVGGGALLLWMLGGGLGSVCGSRSTPRSVGHPVAALFPGGHHLPPHTSCRAHPSRFSGSGLHVGHPEGYTATDILARYKRMRGFNVLHPMGWDAFGLPAEQYAIQTGTHPAATTATNITRFRQQLRALGFSYDWRREVSTADPAYYRWTQWVFLQLHAAGLAYQAEVPVNWCPALGTVLANEEVVDGLSERGGHPVMRMPLRQWMLRITAYADRLLADLPTLDWDPAILDQQRNWIGRSEVGRRGGVFSG

SEQ ID NO: 9714 - protein, 166 aa, Chlorella protothecoides
MDRAGAHWASNTRERATASQSALCVQASPRSPAPLSLRAPDPAPDSRRARVTLAHGLAARPSVHGVLHLPQDHALADQALEGLGRADVAQIEEDLVPEAGVEEVQHSVLGAADVQVHGHPVGLCFLAHQPRCRGCQVEVSEEWVMSRVVLGSQHQTQRVNVSFGGV

SEQ ID NO: 9715 - protein, 176 aa, Chlorella protothecoides
MLLWLTEGVLGSRAAHPGRDGYPPRQQQQVDKRYLHTSLPQIFIVSLDAAADEFPLFENKAIQRKLSPEARSLLLEDLAASGRGRWLGPDRRRLLVLWRGVGEWADVIHAWARVNGLEDSVVSLEELLGGEDVRGSELAGMPRELLSAALRTLEERGKARVFRGDANDDTGVKFFA

SEQ ID NO: 9716 - protein, 138 aa, Chlorella protothecoides
MELYRNGTQVLIGCGQKGMVAYDLVSGKSTGQWETEGMGAVALRGPLSGGGYLAASPAGKIFVMDGRSRSVRPGTSLTAHVGGFAAVDAAGSLVATAGYSIRGGHPVLERAVKVWEGSGRVLSGACLRGEGGLSNKNN

SEQ ID NO: 9717 - protein, 203 aa, Chlorella protothecoides
MLPPLSALGKRARVAHAPLHRAHDDLLPPPRPSYSCHPSPRPHNPQSDFVGVIPNPFYDPAAPPGTAAAASARLRAERAQPACVPVDVAARRAERAQRRAAEGGVVLPDRYRRVLVATQQAAAAQSWFQDYDYSACNASPFVGLENDLANSYCNALVQALFFVPGVRAALLRHVPRSNDEFCLAGELALLFRLLQTRGAVVCR

SEQ ID NO: 9718 - protein, 157 aa, Chlorella protothecoides
MQSLSSSRGVTVASFPSTRRAQRTRASRLPVVTRAVVAERDPPAVNETSSKSSDKTRVGINGFGRIGRLTLRAAMQNPDVEIVAINDPFVNPEYMAYMLKYDTGEQVHAGIPGLNVLHSAGHRRGGARNLRNIDRISGVPPSSPCLTCSPRKVQGRH

SEQ ID NO: 9719 - protein, 685 aa, Chlorella protothecoides
MAQHPPLPFPCHPPPWPRGPRAILLTASPLPSPHTRPYHNTPATMDGVLRAINRVSAIAALAGDTQAGDETRGGGGMPSLARQLPKIVVIGGQSSGKSSVLEAVVGRDFLPRGTGIVTRRPLELQLETSPDAGAAEYGEFGHLPGKRFLDFEAIRAEIEAETRRHTEKRGTIVSPVPMTLRIVSPQLPALSLVDMPGLTKVPIDGQPKSIVTELEAMAREYVRHENVIILAVTPANADLATSDALRMAREVDPTGERTIGVLTKIDIMDPGTNCRDVLDGAAYTLRNGWIGVVNRGQADINSRMDMGRARQKELDFFQAKPDYQGLRNIGTGFLSSELSTKLVASVRRQLPNIAAFVNKNVAELQKELDGMGGPAANSRGEMIHLVLTLCRKFETGFAKLIDGGKGGGELILTVFEKRLPDAIEKQPFKKLLEVNYVKRVIEEADGIQPHLVAPEAGYRRMLEEALGYLKDPTEKSVEEVFVLLRRMVDSVAGSEEVRFEWWGGWGLDQACSHTRIPATLAGDVHLGTLTVRALRRYPTLRREIVTAAYRALERFKEETRRMVNIMVEMERNYITAEYFRAIQMGRMPDGKVLYTLDGRPVTEEPEGTIEEKHYKRIINQVSGYVREVCGQMTQTIPKAIVHCMVIQVGGGVASLGEGGWGKRRAWEGGDARAGGRDLPCGPATS

SEQ ID NO: 9720 - protein, 541 aa, Chlorella protothecoides
MLRHLPSSAQRLRQPCAGGAGLLDFRFFSNKNPPGCEEVPQGHKDSELTPHTCHAGLLRRKELYHLRHVQLQVDGKTLSVKDVFKVSARHPGVGGWGPAQYRMLDFTNRVKPAAPGGSTAFLWGACSSSAQAHGASNAHHPASKAHLETCLLALLSTSPLPILGHTPQGGLQIAFGVPDRGKVCSEQHAPGFAKALQRFKELEVQLPVLCVSQGTPREAEQWASKLGLKPEEVRQVVDVGGRLTRYLGVELGIGEEGGPKSQRWAAILDNGVLLNLVCEGGGGVMVAGQGVMALPAPHSWGRPARPLRACAFSPQRTSLENRSTPPSSWTRRLQLWTCPAPRTWCRRWRPCARRRRGCRRTLLVPQPPVALLGLLRAIACRAWMQGLSHAVESCCILLILMIGDRAPRRVPGEVGGARSEISRALVHTRHGEQLPWGYETVPRRPRLATKHLYLAFVGSDSLDIALTVLLTHVAEVNLRLRTNTLLTPAPPSPTLAPLILAPGVHLAEWGRARRDETSGAPTRSQCHPRPRDPRGGGSPSK

SEQ ID NO: 9721 - protein, 272 aa, Chlorella protothecoides
  MOD_RES (74)..(76): Any amino acid
MTRARPWRPAWTATTCVWHSTRLTRCLDFRLLRGPGEFSSGWPLGFPGPRSDMGAGYTTAPPALPKSSLPAPPXXXIFFGLAAGIPRTQVGHGCRLHHRPPSPAQVLAPCPTPQAASKGEVPIGAVLAAADGSLLASAHNEVEATGDPTAHAEMLCLRRAAGVAPSWRMPDATLYVTVEPCAMCAGGALAARLAAVVYGARSPLMGADGSWGSLLGRGPGAPAHPFHPGLEVRGGVLADECQRLMVEFFRARRRGEVRGPPGAGSPVQREAS

SEQ ID NO: 9722 - protein, 330 aa, Chlorella protothecoides
MDYKFSNLLGAPYRGGTLLIHGSELLSPVGNRARLPGALALSGGLSFSTCKLQRPCCPAHEPRAPAILVPSLHLRVPTPHISQPLPQIDLTQSTSSTLPFENGHQVRTLALSPDGRLLVSIDVEGRALVINRRRRALLHHFSFKDRVRSAAFSPDGAFLAVAVGRLVQVWRAPELRKSVAPLALHRTYGQAHADVTVLAWSPCSTWLAAGAEDLVVRPLSLNPIQGYRVPSLMGHRAPTVAVQFSSAAQREAAGLLGLPTPHLWTLAQDGALYTWTYEGGGAEEDHAGDGGGAEGPHQSHEFYGGHWRLASKYYFNQVRAGMVGVIYGVR

SEQ ID NO: 9723 - protein, 185 aa, Chlorella protothecoides
MPFLAGVPAACLPTLRTLAMEEVLLIDLDTLGSASPPPGGPRDDALLLPHADALEAAFDDLRDLQRSPAEAASTPKAAEIVRAWAVRVFGGYRAFLRPEDAAGAGAALGGPGQQGLVHVARSTGSVQRARSDTSIRRNEGKGEGGVEATGGGRDGRMRWKGVRSSEVKAERKCARVQASDSVDEG

SEQ ID NO: 9724 - protein, 246 aa, Chlorella protothecoides
MGRLGLVRLRPRTSLGTRPRQHALVAACFAASLFLGNAAYLGLSVAFIGILKALAPVATLGASLALGLERMSLPVGLATALIAAGTMLATAQVGWEVGPVWHSRNGGPGGVAGAGGGTELPRMACGGGSSSHNEAASSHFSVLAFAAFATSVGFEALRVVLTERLLAGEGAAPRMSAAEVLVYIGPLTGLMLLAGSVLVEGPHILRRVRGLRAGFARMEGLRRFDVARQEAVDGDGAERECHGGLR

SEQ ID NO: 9725 - protein, 666 aa, Chlorella protothecoides
MAHAPVALEEDSGEATTHDPPVDLSAVDRLLLIKSLGRACGSLGSTDAELRRDLAAELSTEAVAARLNIQRLDELFTIEQAHTGSRCVGSRGGVSPKPGTARVREPTPDRGRRAARPGYQDYILAPEQGVRALLAECFSTWQLPAHALVGAVHALLARAMLAAVAVRAAPRSPELAEEAERACLRFLGARRDATSAHISATLAAEARFPSSPAFTRLRAQLADVAGLVARAQREAAAIRRAGEDATLAVSAAGTPAPAPLPRKPSAVPLHSYYMGWLEKRSRHGRWQRRWVVVSSGLGRMWYMHKPGSNATRGVLGLLGATLAGGESVLADTDIGGWHGVGHGEQGLLVPSACTMGATGMKVGIGGARGAANKVPGLASHEIGCADGAQASLALQSIDSRSMAMPLPCLASRAQVRHSAASHVLTTPPCRHPAASPTVFVVLAGGLAAGSERPRLVLRAESPSARNKWVEAVWAAIEGPHGDVPGLKDAALALPRTLALESTEGAELDAPVGTGVDRKISTRVFDEAELRGGGAPAEEGAEAQAHETEEGEERGLRGGGSPAEEGAEAQAHKTEEGEGRGEPGSPGRTLSQQSHDEWAACPGAAQSAIAPEERAVLQAVLPVVRTYVHETCLQLASQVSKVRGGDGGGGGRQNVGHEFYGGVYCTG

SEQ ID NO: 9726 - protein, 196 aa, Chlorella protothecoides
MFRTCFAATIAEVKGARQAFITSRFEIDSKGLPTDANILEFCFPLGAAAVVPKEYQAVEVGGTPVHHGTRPGKRMAARDHGTQDCSSPPRTSTSCNSIACLTRPSPSHSPQEFLFALTGGGGDRLYGFCRHSLPPNRPGEGNGRGIAKLQRYPQALCIVSPHPWAQFFFRVRPSGESGCQSRDGPAQAPATSAAGP

SEQ ID NO: 9727 - protein, 451 aa, Chlorella protothecoides
  MOD_RES (160)..(163): Any amino acid
  MOD_RES (216)..(219): Any amino acid
MAKPRTRPPKERKVLEPLSAEGDSKFARALGSVDGRTREAGLQALAVWLSRRQEVDRLDLLKLWKGLFYTFWHSDQPTAQVCEPRRARVAAVPACMRHGMPCIPSLHCPCQCLTPPNARMLAVSSGGEAGRPPPSPPTPGSTRISKTQPMVLRPPCSSQXXXXRQVSPEYRRPSPRSSDLHAHPNTRPSDQVSDLFYETFVQTMRREWFGIDRLRXXXXYETFVQTMRREWFGIDRLRMDKFMMLAPRLPHPPPTPPTCPPRDPAVIRKTTSFWLEEILLPTDTLSATGFAYHLTDLLLPELQRVVTSAAEQPSAAALAALLEPFCQALAQTGNPALQFRLRCEGWHMISLLGAEALSGLSNLGILGASPWATYRVLLPALNSSAHNGCCFLPTAISFGGGPLGCINSNSPQTVMDTQARRLPDHAQGDPKSLAASAPAAPGHHRLCGSHL

SEQ ID NO: 9728 - protein, 130 aa, Chlorella protothecoides
MAAASVAKAAKAATATASPPRTPTVPAAPHDTPDTLAKKNVRFSLRRNLVMTIGEPPAPSEVRTPPSSKPKGPALKKASSLGSAPGRLTGKSGGAARRLSMQGMGTSASGGKPGKGRSSLGPRPRAADFF

SEQ ID NO: 9729 - protein, 155 aa, Chlorella protothecoides
MQCGPNDGRDRPLALGTRTLALIAGDELVGEGQPRHEPPLLHPVDGAEGAGEEDALHAGKGDQALGESLRARDPLQRPVGLLLDHWHRLGGVEQHVLLPRVLDVRIQQQAVHLVVDVLDGDLEAVEGAGLPGGGFWDGGGKGKVSSIVEGPSSQD

SEQ ID NO: 9730 - protein, 353 aa, Chlorella protothecoides
RAARPPAPAGPRADPGRRGAVRRGARRPRAAHPGAGPRHPGLAAQPALPGQAPAGGEPGLAGPAGGPALPRRVRAAVARAAGPAHAGLGGGGRAAPAERAAPLPRGPGGPLLRRQGGHGHESAVCGQDGARRAPAPAGAGLGAGRAAGAPGGPRGRGGRGPPGPGAPLARGPPRGPHRSAARDAAAAALARGGRGRAARRRLLRARGRLGGIGAAPALLLRPRRAPGLGARPGGHRQHGLELNFVRAERSAFHWSAGDVARIRAAGHAVHDLPDSGHWVHVDNPEGLLAILQPALRRATPPALLVGSGSEPAGAPAQQPPQQPPHQPPLANIVARPAPGPAASPLADQALSFP

SEQ ID NO: 9731 - protein, 174 aa, Chlorella protothecoides
MVPEKQPPAPHCWAPFSLAPPQARRSVALHAAAPRDDRLSSVAVRQQLRKLIQSLDGVLPYLTLAISAVGLLSSAGVPAVSPSRYAQASHSLLSQQLPGEVVYSLDQVAWYRQSSLRPQAGVPPQMSEVFPLCTLSLVRGQAPFSFQLSIQQGLDDGRFHDEEESAESIALQVI

SEQ ID NO: 9732 - protein, 381 aa, Chlorella protothecoides
  MOD_RES (88)..(90): Any amino acid
MQAPCPCQKVGVTERANSFAALRSLARQTTGAQVGSVGGQSAGARCLLNLFPITFAWRRSNAGQGYPIWPSLPPLQGPSCTPYPCSSXXXRQTTGAQVGSMEGQSAGARCPLICSRLLSRGGEPMLGKAILSGHRSCHCKAHSVRLTPAHYACIAELWSERREEQGHPLGNALLDCKASTVVDLGQPPAHSPPTGPAPFLLEIGCEELPPADLQHALTQLRCSFKEGGDRGGRCGDSRVVWLIWQHVPNIVHIYSASQTHRQGIPQLLKACRLSHGAVTVAGTPRRLVVNIADLAPQQSAASERIRGPPAKVAFAPDGSPTPALLGFCRKNRIEGEIVRNYAVKDTVLEADANGADYVWCALEHSQAAAWQVLLTDFCSDG

SEQ ID NO: 9733 - protein, 299 aa, Chlorella protothecoides
  MOD_RES (168)..(171): Any amino acid
MGVLWCPAGGTFSPLTGGTTADRDNASPSSPEAQVGAGTMNPSTFLRVLGPEPWSVAYVEPSIRPDDSRYGLNPNRVQRHTQFQVRGPGMLEWQMDTAHCLMGLRGDPEARPWQCSGPVPGQPPSAGSRHTAARREAGGSTAWELEIFDLGAESCAWLKWSSSGLVSXXXXAGGSTAWELEVRFVEDNWESPVLGAWGLGWETGRCFQRATPSLQCAGLAQWDGGHPVYILSTGRREGPGGAVCGDHLWPGTHHHGHPGTVWDPLRRGALQTEPRVPSSRVCRHAAMDLLEFCMTIALL

SEQ ID NO: 9734 - protein, 479 aa, Chlorella protothecoides
MLAPGGQCYNYSGCGNTLNCNHPVVSAFILDCLRTWVLDFHVDGFRFDLGSILTRAPSMWTRPKGCGGGGKHEDAARGEAAGARMSGATSPPPPQGPRHMDAGAGSATGTPLSDPGLIEAISTDPVLARTKLIAEAWDCGGLVQVGAFPHHAGRWSEWNGRFRDAARAFLKGSPGAHAGAFAAALCASPDVFLHAAPEGDWWGRGLGAAWRGGRGPAASVNLVTAHDGFSLADLVAYNEKHNEANGEGGRDGETHNLSWNCGEEGPTRDPGVAGLRARQARNHAAALLLAQGVPMLVQGDEYGHSKGGNNNTYCHDSPLNWLDWRAASADEGGLARFVRALLALRAAHPALREKGWRGGGDLVWHGPVAGEEPGWGEDGRFVAFSLPESDGGGLYVAFNAGHGAVTAALPARAGRVWEVALDSGRAPPFDVLTADSALSADQVHAVRAAGEPWRRAGVLPMLPYSCAVCVSVPDPLTSA

SEQ ID NO: 9735 - protein, 75 aa, Chlorella protothecoides
MEDLVIYEMHVRGFTAHTSSGVGAPGTYSGVIEKLDYLQDLGISAVELLPIHEFNELEYYVRRGWEGWSGVGEAI

SEQ ID NO: 9736 - protein, 252 aa, Chlorella protothecoides
  MOD_RES (26)..(28): Any amino acid
  MOD_RES (179)..(182): Any amino acid
MVCAQGMAAPAVCDEGTGYPQDYDPXXXTGWQWSVPKGRQRQQCVTEAQATRKTMTNRQSPDMHTEAGFPLPLGASWNEATGAVNFAVYSSSATSMFLCLSTPADHALGRLTREIAFDPIVNRTGDTWHLAVVGTGWHGGGDELGSSKWCMLFTTQALLFTGTQHSREPALNCAGLTRXXXXLGSSKWCMLFDAQPPLFTVTQHSREPALNCAGLTRAAHAGPIRPSVQVSRWSPAAASPSWMVAQQAPNPG

SEQ ID NO: 9737 - protein, 120 aa, Chlorella protothecoides
MASVIARRQEDVVWAGSQRLAALHDAEELRPWPSCPTLPLMPQLASASEHGAVLLDAGILVDVAERRASIWEACQSAAASINGSIPEATTHDLLEEVADLVESPTVILGSFDPEFLGLPQ

SEQ ID NO: 9738 - protein, 337 aa, Chlorella protothecoides
  MOD_RES (112)..(115): Any amino acid
  MOD_RES (176)..(179): Any amino acid
MLLGVVLAGRTAEERARLRAASDMLALQGLLPDSARLLLGDGSLRDVPAHAVARGDAVVVLPGDVVPVDGVVAEGRSACDESSLTGEAMPVPKAKGVLGGCLGGTRGCAFMXXXXRVCWEGVWGGRGDAHPRGRQAAGRNAGGACGRPPRWVWARRGSSASTPHPESHPNQPPPLXXXXAAGLLRVNPPSRGRLVVVAEAAGEATTLGALGSLIEAAQSRAAPVQGLADAVAGRFCYGVMAASAATLAFWAGPGAALFPRVVTAHAPAGAARPALLLALRLACSVLVVACPCALGLAAPTAVLVGSSAAARHGLLIRGGDILEVRGGGRLACFCCSV

SEQ ID NO: 9739 - protein, 218 aa, Chlorella protothecoides
MTTAHRPTWAPAKGGEEQGGMRIFAPSKQQSVKDLPSQTRLKFRQDGQSKAEELSQKDLRAELEEKERAHYLKNKIHTFEGGMVGLQAVDAEFGCPCCPRGCGACACVALLAHSSSPPPHCGPAEEREDDLRLLQSASHAREEPPRTLIPKAADADDEDDSDAAGSSDDDDDDEVQVLGLLTLGNSPRDSCCTAVCQPVYAPHVPAASFSLHLEDTCS

SEQ ID NO: 9740 - protein, 233 aa, Chlorella protothecoides
MRGTCFHQRALPVMYLMLGKLEPARSVSHSTECPGPSSRSFRFERLDGTMSVDARAAAIAKFSADPETEIMLISLKAASLGVNLTCANHVIVSWGRGFMSPTCILKGFLLALFHHSITSFTLADVTEPSPSRSLFPPQLLDPWWNPTVSRVQQAPKHASACCAAWSSTIMRGSQMDKSKPQSCEVTPRMSHPHQQVEEQAIDRAHRIGQTRTLHVIRYLVKGTPVAVGVEGWD

SEQ ID NO: 9741 - protein, 957 aa, Chlorella protothecoides
  MOD_RES (336)..(339): Any amino acid
  MOD_RES (476)..(478): Any amino acid
  MOD_RES (627)..(629): Any amino acid
  MOD_RES (654)..(657): Any amino acid
  MOD_RES (812)..(815): Any amino acid
  MOD_RES (850)..(853): Any amino acid
  MOD_RES (879)..(882): Any amino acid
MTHESPTRCVVAARQAGKRGRDGEEQVVRRPGGDLFAIRWHRLVLDEGQCIKNAKTLTAHAACALRARCRWCLSGTPIQNSINDLFSYFKFLVGAIGGDVLMRGREGWEAAAGMHPLSDSAVCRKGACLAWATNCRARPVSPLRPVEDLPGIHQGDGAARERRQGSAAPPRHPPGVQSLGVCTASAPTHVWRAGSSSTCYMSSALELIHPSCKNPCSYLAACPAAADQAHHHRRQAAAVAARKAHRADDADLLQTGGGVLSAARGGSQDRVSEGSKRGGSDALQCAEHAAAAAAPAPGLRPPPARAQRALRLRHIHAGGARASAYVPPSPPSLSEXXXXWDSSAWGCWTEPVRAPFHPPCPARASIYVPLRRPPSQKAAAVRLTSEKRLALVELLSHGPHGTSSGPAACWGGSVHDGGESGGPPASLARRHTCVLLRSRAFAGKASLHKGCEPHREAAIVRRVAQSVDSCLRHGRXXXHKGCEPHREAPIVRRVANSVNSCLRHGPSRIPTRCAHSTAPPLSPAPSRNPSPECTICHDLAECPVASGCGHVFCSQCIASKVTEAGHGHAGFVYDCPTDVLQGQQPALCFAWKSFMTQFPTPPRRERASVSLPPVRQRAGRARRTLPXXXRPREGCSCAPDRTSATLPGFFDDWXXXXGAGGGGGHCARGGTARHRGPDRICRLESRCGPAAQRQDPGGDALPTPSAARWQPCRWEAVVSRDGWEGDRKAGRILGLGPAAGHEAPVKHEPKPEPGVEPKSEPGVLPKLEPKPEPGAEAPRELKPEPGTEPQPRPGRACSGCPASVLRLEPKFXXXXPRELKPEPGTEPQPRPGRACSGSPAPVLRLEPKFXXXXHAQPAGGASENFSVCLLCSGGKGVEXXXXEQDVWDLFPPSAPKAEKEAAERDKVIIFSQWTSMLNLLEGPLTISAYVSCVLGGKGSTASHPKHADGWICRVCLG

SEQ ID NO: 9742 - protein, 194 aa, Chlorella protothecoides
  MOD_RES (118)..(122): Any amino acid
MEHKLPCAVPLDPSSWQHSAPAMCTGREIFQEEGFVAADDLAAADDSGYLREVDEEAEFARASAAARERAAAAAAAASAGVGRAEEAGQGTTAAAGEKQGAIAPAAPQVQLSKAEEAXXXXXSWLILRFTMCSKPTQRQGTITAVVEAPLQQCTVTGQAEHGALGNRNRQGASAVSRCARGAADKSGPLMAIAG

SEQ ID NO: 9743 - protein, 125 aa, Chlorella protothecoides
MSPACGTLTIPSPPLLAYQDDEAELLAELARIKAERAEEAARKAAAEAAAAESVNQAELLRGNPLLKEKLQAAAGGDASFAIKRQWDDDVVFRNQTRGEPRAQKRFINDTIRNDFHKRFLEKYVR

SEQ ID NO: 9744 - protein, 159 aa, Chlorella protothecoides
MGSLQRTGVSPAPHEAFEGVNAGISHARAPPPSLPSLGVDPKTVLCEFHRHGKCTKGFKCKFSHDLNIERKTAKADVYSDNRDGADGESGGMGEWDMEQLEKAIAEKHGLENKNRPTAIVCRYFLDAVEKKQYGWCVEMASPFTDGRAAGLPSASVWGN

SEQ ID NO: 9745 - protein, 122 aa, Chlorella protothecoides
MKSQMKELLEAEAANQPSVEEIIEEERAKVDAKTPINNEVCRGTLVDAHEPTLHSHASRHAKGSHPSPQDMTAKHVTQKMLTSAPAHIPTDVSAVACWEACCQDAGTGGEGGGATKKGAPHR

SEQ ID NO: 9746 - protein, 247 aa, Chlorella protothecoides
  MOD_RES (193)..(196): Any amino acid
MRGQRRRRSRRRGHPTSLHQSMPLKTQHAQELERSDSISVCACCPICKRSLQDNSATWRYLDSIAASHPLPEEYVGWQAEIFCNDCLCRDQINTPLGPTDQHAQCSITLWGSSAEGVARTTRGGWRSCRLSSGDPAGRTSKVRDVCLRSTGMLAVAAQPRAAQRTPRGVCCNQTVRWCHYYMGPERPYGIAIXXXXPAEDSQGSMSQSNGTEIVRRSRDQAMHLEERWSSEEDRQLEAYRGSPEGSD

SEQ ID NO: 9747 - protein, 76 aa, Chlorella protothecoides
MTEKDYARQRDLFEAIFSQHAAAPDVTSGPLEEGAPRWGAYLLQSGLEVVQHDRRFSGTKAVFNAVLRLANDNFRQ

SEQ ID NO: 9748 - protein, 272 aa, Chlorella protothecoides
PPPCHPPPHPPPEIRGRAELFSLVNQHPTVYEVVTGRVPRTKINKRKQPVYGKAYAGAMPAPASRGTGAGPTGRLASRPRAEQQAPAADRPLPTGRKLTYDDVSQALVGRQAEVRCDGAPGGGPHGPRGGDGRHGRCCGAAGRGESPAAPRPALPPCISGRTPPSSPLPLRLPVLELPPPFPPAQLYWPDDGKWYLVEIHSVDPDTMEAKCVLNRLGAGWDARAGCRAPPSTPPPNLPMPHVHCRVQYATGEFEALDFDEVIPSGHMSLLAG

SEQ ID NO: 9749 - protein, 145 aa, Chlorella protothecoides
MSKVGVEFGSQALAQERAKVPVVPLPCWHDALPTTVAPSCHGPVEIAKPDTYLDLRGAKIDMVNNSMRLAVAPGGSMEAVTGHTFNPRTDFNLSLIEFELVLVPREEAGPSPATVGGIDPARGPSLTGGAEGTEEPSQAIPEEEG

SEQ ID NO: 9750 - protein, 153 aa, Chlorella protothecoides
MIIAVPTGIKIFSWVATMWGGSIELRTPMLFAIGFLFLFTVGGVTGVVLANSGLDVAFHDTYYVVAHFHYVLSMGAVFALFSGLAGMPRRIPDYPDAYAGWNAVASYGSYLSIAAVLFFFYVVYKTLTSDEVCPRNPWETTPGVSPTLEWMLP

SEQ ID NO: 9751 - protein, 275 aa, Chlorella protothecoides
  MOD_RES (195)..(198): Any amino acid
MGVQPSEDALGRLLDKNRKLYGQVEAQRGIIDRLESRICKLQEDEEVQQETLLHVNRAWDELNASIDFLRYRAGAAPEPSADNHAAAQLPSTDTLLLACSPFLARLASTCLKSDALDSAELEEGEPEELEVALCARSAATSAAAAGLLDAIEALRAGGVPGKRAEPDAAAEPASVSEQSAATQPIDPAVEPQALXXXXAAEPASISEQIAATRPFDPAVEPQALLTLVKAENRRLRSVALASAARVKKLQTSLAGCWSRPAKPSAVGEPAYEYLC

SEQ ID NO: 9752 - protein, 437 aa, Chlorella protothecoides
MNLTGRPSSRGAPHTTQPHCVPLPLGHPIAQAPLTILGSLPRTAPSSALHTPTTHATPARGTRGCKRPWMKPGQHWASHGPMWRANPGEAELAYGRDLYITCVHPFKDPIPMPRNRSGRRGRWASTSLSRRSTGGAANHLSGRCTYPVSTPACPMQFDWVWIWGGPLAVANLSAPWGARRSCTDRRPGARFPGPSPAHAGPSSPSRCDGEAGDGSICDGPLHRGKLAPCKGHASARMPPCPQMMERRAALGLLAGTAALLAGTGASQAAYGDAARVFAGKITNKSGFVPYAGEGFALLLPAKWNPSPERDFPGTVLRLLCITCAGTFGVCGACMSLPSIVERCMRCMPSVLLSLSRTLHGLVCTCKVQISSPPMHRYEDNYFPVNNLMVIQRPVGKNSIEDLGAPDKFLSDNAFLFGESAAWKGEAAEAARVGGLMA

SEQ ID NO: 9753 - protein, 87 aa, Chlorella protothecoides
MYINSPGGVVTAGLAIYDTMQYIRCPVATLAVGQAASMASLLLASGEPGHRRSLPHSRVMLHQPSGGAQVRTVGKGSWQGGGVGGGF

SEQ ID NO: 9754 - protein, 387 aa, Chlorella protothecoides
MDLVASYGSSPSGSAVSEGSAHVEDDGELTSQESKEPSPKRLKVEEARRAARPQRPAAARSGVRKPCKCCLKLLPACKCHRNRKGIDSTFTPISPNPPLTAATAPAPAPPTQRIRAFPHVEGQFAVHVTLSAPAPPDVTRALRAALPRLRAALPTLCGLDLGTGHVSLSHTAPAVGSQLESLLRMLTAAAWRLAPFALDLRRLACLANEDASLAFLAIEGQGAGGAFARAVRAVDAVFRRHGLPTFYVEPRPHVSVAWVPGDALERLEAVLKQQSVPLPAWHIEMPSGPISRLLHLPIAHTLSGNRAGASSTAAHPVQPPCPVLSGGPRVAQPPVSGDWRPQSQGAAGVCILGWITSSTTPKSRASLADMKKSRSRHSSAGGGRKAS

SEQ ID NO: 9755 - protein, 251 aa, Chlorella protothecoides
  MOD_RES (90)..(93): Any amino acid
  MOD_RES (236)..(239): Any amino acid
MARGGLLAALYLTSVIYAIEVCAWTRGRAVSEWGDRPVHVDGAIPVHEMLPNAHMRNPSADILRSGRLQYSWPSITDGQGSVYSLLNYSXXXXRPGPSITDGHGSFKITGSCGFGFQWPGIGTGFDVAAMTDAAPDFTDSCGRCYEVQCDPTPRLLDGFGDLLDRSHVCLDEAASVIVRVTDSCPCRYPDNAYSNQKWVMEVVTRHSEEAGGHELLSSVPGAAIDPFALQPEYSPXXXXGCRVMEVVTRTQ

SEQ ID NO: 9756 - protein, 478 aa, Chlorella protothecoides
  MOD_RES (38)..(40): Any amino acid
  MOD_RES (204)..(207): Any amino acid
MKRARRLAVSVLPCIPFAQHYPGPSPAGFLLCLASPRXXXPSTLHNHACNNVSCMEQARRLAVCVALHPLRSALLRSLASRLPAAPRLTPRALPNYLSITGAVTVSGNVDAAPPSDKITYESTFKGGLAPNSVPNGSTTASAGSDSSSSSTSSEGCTDNAPDTGSCQQQLDWGKVSGGWGRHSCREMHYLLGCAVVCGVVTLAXXXXRHSCREMHYLMGCAVVCGVVTLAIIRHCCEPCNDEWLTSGNFCQTTCGRCSSSSSPSSPSESSSSPSDASSSSPSSSPSGSSADCQDTAVPYTISYGSCQDQKNWGKVRRHAWALLSMILGAGGSLLLRFCLREGQTANMCVRWTVLPSAFQYWRPSDSTISPCPSHYKPFLPQCGEQWMIDGSYCASTCGRCGSSDSGSSSQSPSSSGDSSSSSPCEDAPVPEEAECWQQKQWGKCSEITANGYCKATCGACSAPTVSAYDSSFGQGRRL

SEQ ID NO: 9757 - protein, 422 aa, Chlorella protothecoides
  MOD_RES (37)..(40): Any amino acid
  MOD_RES (152)..(155): Any amino acid
  MOD_RES (391)..(394): Any amino acid
  MOD_RES (415)..(418): Any amino acid
MTTWSTLAQTTETYSRPGSPLFWLQPGVTLTTSSSAXXXXHDDLPGVTLTTPSSAGGLLTCPSQPSPPCSADNRMASHTMLPLLLMCLSFSGALAWQKGRAVSPCLQLRDRAAGVTCLSSTGHPHWDGGARLPWAWPHAHTACQPVRSRVHXXXXVVGHPHWDGGARLPRAWPHAHTACLPVRSRAHPRSPVAWGAHQPFLAITPQTGSCGFGYQWPDVGTGFDVAAIADAAPEFGGSCGRCYEVKCDPQSAVPDGYGQTHERSSVCYDSSKTIVVRTVDNCPCDYPNNAYSNKRWCCYDNGMTHFDLSIWPALVSASPSPRHSTHKWCSPDHRAYERLSDVKWGVMGIQYQEVPCTKAADNPAPPIANPTPPEEPQSWMVKPSEDTIYVXXXXTPPEEPQSWMVKPSEDTIYVXXXXFDPA

SEQ ID NO: 9758 - protein, 707 aa, Chlorella protothecoides
  MOD_RES (64)..(67): Any amino acid
  MOD_RES (292)..(295): Any amino acid
  MOD_RES (412)..(415): Any amino acid
MLSVHAPAAMQLSGAPVKGKASGAPGNRLAAPRSRRQRVDPCVPRAMSSVTHEASESPDAPPAXXXXLLGEPHSLSAPAWTHSPWPQSPDAPPAERRYSTETTKQRFRPELRASGLQAGGHPDLPVHSARAQAPCKPPCSLTLHMSPPNPLLPSPSSCAALSMARYKAVEIEQWRASTPLSKLAEQAKRAKPARDFIGALRAQSEARGGCPGLIAEVKKASPSRGLLCPDFDPVKVSAVHCRCTTARGQAGYSRTVHLESLKGKGFSHAVMRWPRPAQDPPTHALAPSQIAXXXXSAVHCRFTTARGQAGYSPTLHLESLKGKGFSHALRCWPHPAQDPPPHALAPSQIAQGYEAGGAACLSVLTDAKFFQGGFENLAAIRRAGVTCPLLCKEFIVEVTCLLSLGMPRVCAXXXXPSGGLASPARSCARTACPGLILLKLMPATACTFLCQALLCQSATMQLFESPPWPPIAVTPMPCPAGVPDLQGSGLWGGRSPAHRRRPFQSRPGVPDQGHPILGDAVPDRANPADSPTPSPQVHDVPEMQRMLDLDLTGCMLGINNRDLRTFKVSLQNSADIMASVPGQEVGGGCVRRCLAKGEGRRRDGYLRALFVPGCTLSFDPHPHGSRCLSRHCPPLLLPPQTHTIFPGPAPGPPGGRRVRHLHARGRAGGAASRLRRRARGRVARAAGRRRPGGAHPAGGVRHQGRIA

SEQ ID NO: 9759 - protein, 515 aa, Chlorella protothecoides
  MOD_RES (58)..(61): Any amino acid
  MOD_RES (259)..(261): Any amino acid
  MOD_RES (399)..(402): Any amino acid
MDLRSAHGAHWGDWRYRTSILLDIMRHAGERERYGSVDSGADGALPQYSKGEAAGKIXXXXSISCDMPERGKGIGPWTLVQTALCHSTAEAKQQARSIWRRHSHCQGCMVQFQELFPAPQGFKIIWEGKKLRSYQADGDPHRSCRIAGPQSFRMRQEVCLELLQITVSTVGHTRRSLYSAPDESLGCAPGAPSFSPSVDRQQRCVLSIPSRIEGRGRRPVSLPRRVRAPRGVLGLEGAEQLRLHGLDVSRTPGRCSPTXXXRPAGPRPASVSRDSWAMLPHPPTALQGGTMVQAVIKKSHGPKKAKKALTFTIDCTKPVEDKIMEIASFEKFLQDRIKVDGKTGLLGDNVKVSRTKSSVTVTSEIAMSKRYLKYLTKKVRVGVSWRGPGGPLFLQTEEXXXXIAMSKRYLKYLTKKVRAGMSWGGPGGPLFLQTEERLLIVARARPLPGQGQVPSLGTPGAPIEPPALPPPSPQYLKKHNVRDWLRVIASNKDRSVYELRYFNIADQNEDDEDDE

SEQ ID NO: 9760 - protein, 72 aa, Chlorella protothecoides
MRERGPACFDFDFYKLRNPDLPIPPWTAAHMWDHFVDFGQHEGRVFRWARRTEVERREGGKCGVGGGLGGGG

SEQ ID NO: 9761 - protein, 137 aa, Chlorella protothecoides
MRRLLPALAHGGCAGSGDAHGLVPPSLRYSSTPHPQTIPPSRHTHSSNVVERCLKLGGGETSSLLEERDAVVEELMTSPSFGRLLQDPYANYVMQSALSVTSGARHAALVEAIRPFLPALRGTPHGKRILAKIAIKV

SEQ ID NO: 9762 - protein, 136 aa, Chlorella protothecoides
MPWRWMGASSGGALLPARTPALPRPFEQGFPGTAAATARALTLALRRLNPYAEYMYDGINLSPFEVMFVKMKEYLLEANWTTATEIKKYTEWARDRVSGGSEGGRGGDVGEHRPPPLRPSPGKGLGPRWLGVAAAH

SEQ ID NO: 9763 - protein, 103 aa, Chlorella protothecoides
MTNEDLGFVYAAAADHCLDIATHRHGCCVLQRCIDRADAAQKRHLAHRIAAHALILSQDPFGNYVVQYVLEQGNGEMLAPILAQLKGHYAELAVQKFRCGEGD

SEQ ID NO: 9764 - protein, 566 aa, Chlorella protothecoides
MPAGPLGHVTRSQSHRTSRTQRPTHARFPMQTGPAVRLLMGRPEQVPREYACTHCAFPLPHSVPHRRHDPEVFLVEGLQVACGRDGGGILRDPPAPSLSKLGRGGGEGSFQSLGRGWVQVVLWPPSSRACMGLGGPGLVGYHQRRHGTGAASPSPTWDGHEWNPGHVSTLPRIASHPAVCRVPRRPSPRPAGWRRPRGGWRPSGRGPAGHPRSHHHPISAPSSAGRRATPPSASAPGCSSCRTGATPARRLPQRRRRKGAPTPAWTAACCPAPAAHRPPRQGPSPGRQLAGRQLAGRQPGRPGPEGTAPLPGKPGPERPGPGGTAPLVRLPAPLPRQTLLPAAAPPRGPPPGPGAPRCPGLGLVWRRSGGRLPAWAAALSALAGLAAQGQRPEALERRPGLGGRLHARRRGCVHGRRPGRGEGCRTCRRCFRRPLFCCGRGGATGGAGLGVVAALWRSGRCPRLAAPCGAGGRRDSARRAEGSRGCRRCGRGAPNSCVGGVGSSSRRLTTRLCRRWHGRDRGPRAGGWSGGDRRAFSRCLLRMLRRRGVHVGHAGTCAARRARAGS

SEQ ID NO: 9765 - protein, 497 aa, Chlorella protothecoides
MQGDEGARVRRSGSGQTRCKGVWKIRWAYPGAGAQVDAWAQETSGRDAPCRGAQVDARAQETSGRDAPRRGVAGTQGTASEALTPILVAAGAGVARAMGLGLGLGCGLRPLLLPLRALHLGAQDGGRLHHVAQAGQDLGPAPRLEAAVGVDPDAARVATQDARAGEGAQLVHQELDAGDDGGVHVVDPGSDVASIPRAGQGQHHLVVRPRVLDGQHVGVHGVDGGQDVLERGVAQVGHHLGLIGGGWGWGGSAKATGSLPVRTSAGATTLQPTLPPSHPPTPTFLTASDHGRTPPTHSLPAHPTPRPQTRSPHLRLGLGAGDGELEGVHRPVQVPRPAPLLERQALAQRGLIHLHDAAARALQVLHLLAQGQRDLEGLHAACHVLAREGPVEHGHRAGEHALDGARRHRLRQAVLVHRHGPGAGNVPGHDGRAHVAGAVALHPAVLGEGVAVQLQAKVLHPGRAKGRDGWLGRSELSVWGWNGAMQQEHEQTAWPRV

SEQ ID NO: 9766 - protein, 103 aa, Chlorella protothecoides
MVAAFAFKEGRCFFSNRFVRTKAYTEEQRAGRMLYRGAFSAGNPGGKGFFNPFKLDVKGIANTGVVRWGGRTLALYEVGALDVLEACSCALIRAPKIPGPART

SEQ ID NO: 9767 - protein, 59 aa, Chlorella protothecoides
MARRQAPVPRRARLQYKRGTISTEQYKEQIGVEIGYAIGLQDALDIDVPVHGEPERSDM

SEQ ID NO: 9768 - protein, 515 aa, Chlorella protothecoides
MSWASIAKKAAPAIPSTDIGPDESVDVAVLDANAIISGQGLLLLAKLANRAVTTPEVLAEVRDKKSRATLEALPYTLEATEPAEEDVKAGMQCWAGRGGMCMGRGGGGDWFVAGQRPSPLTSVSPPKNIPRPVLAGTCVFLHQAHNLPAPPSTVLRFARATGDAHALSSADVRLIALTRMLEIARHGPRRVRDLPPPLKIVSRRVKETRTLPGWGEGGDNWAEMERLNAAEEAAEQEALAAAAGTGSHVAAQMQALALEERETADGDTEAARAARALAEAAVAAGSSSGGDDSSDDDGDREDAEGGDGEEEGEGCEAEARSQSGDDAGPSPAAASSVCILTADFAMQNVILQMGLRLVTPDNRRVTRLSRWVLRCGACFQVSKEVGRVFCARCGNAAMERVQVSVSPEGVEQYGVRKRHVLRGTRFALPKPRGGRAKDVILAEDVLMQRTGKARRRAARKAEGEVDPFAAEYTTDTWHQAAGLGAMADKGAAALLAGWKHNPNERKHVATNRRRK

SEQ ID NO: 9769 - protein, 511 aa, Chlorella protothecoides
MVSTQISSATIGFPRIGPNREMKKALESFWSGKSTADDLRTVAEQTERVAWLSQKDAGLDLVALDSTYYDQILDFITYLGLIPKRFQHLEPGFAQYFAMARGVHGAHALDMQKFFDTNYHYMVPELEASPAVKADWSGLLAKVERGQAVLGSDVAVPILIGPITLVSLARYPEGTDASALVGALLPAYVEVLGRLKALGVPEVQVCGMGGPPGRGRGVDVMHEPVLALGTAIKLQADFESSYSQLAGVGVPLNLVVYYDDVEEDVYSWLVRLPVQAISLDFCAVPGAAHGCATAATIARLGFPEDKRLGAGIVDGRSIWRDDGTAVDLLAALRARLGPNQAIVVQSSAPLLHLPYDVRAEKNLPGELTARLAFALQKLEVSRRRGCGEDASDMVGVGWIWSAPTTPGPLASLLLQRHPCAQPHNPVARLSRPIPSSRPREIVAVAKSGSGTAPPALETFGAAFPSDEGRSGIDASKYHRSEDYATRRPKQPQFRPFPTTSIGSFPQTEQIR

SEQ ID NO: 9770 - protein, 126 aa, Chlorella protothecoides
MLILILMLCAGRQFPLIPASDIDNRAKVEGPDTVYGREENRGSLTRLSINLASGKVDQRVLIDRSVEFPSVASTVVAKPHRHIYMVGDRFNSPDTWGPVQHLRGHREPEPQGLPGCVLPGQVLLGA

SEQ ID NO: 9771 - protein, 235 aa, Chlorella protothecoides
MAPKVIDEGRVTCGRDRPGPLLGPAWANRSAGDAVPDVQLVHLVNEKPEKVSLRDLFKGKKGILVGVPGERVDGSGVGPQVTSLSCPTPSSRSLPRRHPHHPLIPPGRPIHPCTGAFTPGCSKTHLPGYINDYEKLKAAGNEITVLLTVNDPFVADAWATSAGAQGKVDVYADPAGEAVKALGVEFDATPFLGNVRSARFSAVVQDGTFKTFNLEDGGGLTCSLSNQILAQLKDA

SEQ ID NO: 9772 - protein, 107 aa, Chlorella protothecoides
MPYELESPDLKTLGTTDADGALKDTDPYFGAHYRITTDAGGMDGAFGFYHDFAMTEKYYVFLQNPIRLNLYKFVTQYMLGKAGVAGGQAELDPGGAWKTFQLLVELV

SEQ ID NO: 9773 - protein, 216 aa, Chlorella protothecoides
MLSKRPTARPDATLFPAAACQLAEIRGILKVFPIPEDDGPRPDLPDKQAWTGAALSQIDDLHTLGFTQSQCLEAVTATGTLDRDALIEWLLLHLAPKDIPRVFALQSASESGDVAVLRKADPAARESACALGAMAREAPEPCGPALQELKAETAAHEPASDQKAWILQHLEAAGSSSGDSDDSRSRVGHGLRVSSSWVSLLVGPGEGQCMGQQDMS

SEQ ID NO: 9774 - protein, 608 aa, Chlorella protothecoides
  MOD_RES (429)..(432): Any amino acid
MAPTVTTAAAEYEQLQDGVLLAAEERAPAPADPRHLFCMSLPQCTNGGSVAAFLIEPSPMLLSPFNQPGTLHEPTWHADSIVSITHPRCLQVHGLFGSRANWKVIAEELRDAMREEEGILFYISEVNEFKKPLPSPGQVPPLAYCSEPQSSCSLGTDLRGHRWVWGAAGGGDPWAHGPVPPAGGDLHPGPLHGRPDRALRHGPTVRRRDGAHRRQAAPRPLHRHGLPAPGLRHRPRPRPGGQSPAPIPSPSPPHPSPNPSTWQVPMLKWMEAWPVVGPVVAGAVSSVAASFTRASFKRSGEQFFLGDREAGAPPLIWRLARDEGPGAAFLPALAAFQTRTAYANTDGDHLVGWANASLRRLEELPELDGVSGKEEYPGVLRADPLETAWGPRYGRGQTLPSGTEGALGDDDYDLPGTGPGRGDEDPPTXXXXSGTEGALGDDDYDLPGTGSGRGDEDPPMLKSAPTSFTGAPPASPSPLCGAIELHPSPQTASLPGPLRHQVRYRSAALGSAYDAALHADRTELVEDTLRALRTLSWRRVDAGFAHSALPLLAHQHIQVQRLWVNGAGVPVARHLAHSLRGMEEARREGRRGARGRGGAAAGRCLGAR

SEQ ID NO: 9775 - protein, 398 aa, Chlorella protothecoides
  MOD_RES (185)..(188): Any amino acid
MSTYGHQTACAIRVNMAQEEELPHSAGIHEDGCAETAVKRLAGVLVPPPRKTRPRERSSPPWAGPRLQPQVPTRIARYWNMGPVSPERTKSSIAKPGAKVSLNTFVASAGAMTMALTSGPYWRLAVALSLAFAACTVPGARAQGASPRAACPWPPLCYILLAGSASLACADSRRGSLQGVSSPPXXXXAVLVLHAQTRVGALYRAFHPTPPPSANCRQLQRCVPCGHRTCKDLLEGLKGEETQSKVPNVESMARDCMHAESKLPFLGMRGITLPGFSAHYLPALPTWQVLINEILASNTAGLKDSSGTASDWLELRNTGSSTEDLGGYVLSDGENSWTIPSGVSIPAGGYQLIFASGKGSKSGETGMWRHRHCKLRCCSPHRVKVHSCAAGQAWSTSG

SEQ ID NO: 9776 - protein, 550 aa, Chlorella protothecoides
  MOD_RES (167)..(170): Any amino acid
  MOD_RES (266)..(268): Any amino acid
MPVGGDEESLRPLKAVCIAITPINCLPSHPSLHLCVLTTSAPAQGFQAPTSILDPFQSADAQPSSYRLNLGSVSGDAGGYVELVNPNDFAMDLSDAKLSGAAEFTFAKGEEMVSLGSLKPGTRSKHRYPSLWPPRFPPPRLSPHGRSPPCKPTGTTVAAGDSVHVAXXXXPISVAAQVPTTPAIPSRSFSTLQTHRHHRRGRGLGACGSRRRSFCQGQGRRGPVCGGPLLGVHPGTGRKRERAERGRGLPGRLRHPWTSVPVPVPXXXAELVISDSRNPCPSLFLQQPYTIQTSYSLDLRPEFDPGSAYWTVLCRLSAGRDNPGDRSCLGKVSSHHDRPPDSPDPAVVTSPSTRWGPRCRREAPLNIIMGCRELPWLAVLCTLAMLRPSTCQSPGASTAWARAGRGGRERDNPTGRWALRPIFLGIQLVVGDAPSPAPSTASSQVVLTNKNSFTDANGDSPSWVELYNTAGSPVNLQARIRGRDVKGHEYIRCNMCRSSTSRPVPHVTRTGVPADGQQGERQGVGMDLSCRSLRAREWVPAHPRRWSGHR

SEQ ID NO: 9777 - protein, 150 aa, Chlorella protothecoides
MRRVGPWAAASVPCLCAVAGNARLRARTPAATSALPTLCAGAQAAGAGLTIGQGHTDAGSWLELTNPGAEAVDVSGWALTGDVDFTFRPGEQLVKTRSAHGTVVDAGDTIVVAADILQFKSSYGGQGKYVVGPLPQPLTSSSPSVSLVKA

SEQ ID NO: 9778 - protein, 696 aa, Chlorella protothecoides
  MOD_RES (279)..(282): Any amino acid
  MOD_RES (311)..(314): Any amino acid
  MOD_RES (387)..(390): Any amino acid
  MOD_RES (417)..(420): Any amino acid
  MOD_RES (674)..(677): Any amino acid
MVKRKRQRVDTSQSPEAGEAGILSVVVSKVEADPAAPEAPQEAVLVEEDVPDTCLCPLCQEILCHPLITACGHRYCSFCFHRLFAVPRPGDAGRARESRSRDCPMCRSRLVGCGGLKDLLHEPAWLPPCWPNTGRADSTIGGAGAFLRSHHPSLSHRQPISLQSGTHALADEERLRKDYPIAYAARELAISREEADLAERGVQYLVLRFGNRHTLIPRARKNKHEWEFFVGLDGGEETRFIDHVEVRLHQAYRPSSLRLEQPPFMTRWVSGDHADLAVXXXXQGGPGLATAATQPCQMVNSLGRCATLGHXXXXQGGPGLATAAPQPCQMLPHWGCARGSVGGPLALVPKSENHVECRRRVPGSLWPGRHDARARTVVGSVRCASPXXXXRPSSLRLEQPPFMTRWVPGYHADLAVXXXXLWPGRHDARARTNVGSVRCASPCAPCMLAKLSHSGLAFHSHRTSTGSEVRALVTFRSEFQRPPLWLVWSLDLQGNGSSQTLEFELQKGGLPSNHDLETGGRVVEGAKDVCCWSDAHGQCGVRAAHGVARRRPCRRGRGAERLVGVEGEHAEHAGDAGLAGRAAGADVAVWSVVGPGRGERGEVFGGEGNRLESMLNGSKLSEGPLLCTRGGEGAGGAAHKPPSGEVAGRPGHRKIMDATPPQDDSWTPGEGEEXXXXWGSSAQAPVMRTCRQAWSS

SEQ ID NO: 9779 - protein, 195 aa, Chlorella protothecoides
MGVDYLESYQSHVRFNGAYFGRFIYVEDWTPESLKRNGYDTSDIGSLFKSESGEYSNLRWDLPKETCCTLLAPRPHCCPELPLGPLSPNAPADQVPFYWGQDEPKADESALLLELTRGLAGAGSKERENYLFDGLNLPKVRQAQCGRGQGGRSFSPGRRACHRALPAGVLGGGLVPGCSSHQAPLGVQLCIEPAR

SEQ ID NO: 9780 - protein, 380 aa, Chlorella protothecoides
MCERCPEQTADGKIDVTDHTAESAVHPLCVDSTVTIFCIPWSWELVQIPMATEVTPAASEWTREFTADAAAPSATHGPSPWGEEFASFQARAAGTGGDWADAFAEGVAGEWASEFAGPQTEDWQAEYDAELERLHGAQAPSAHGGYVMAENNPFLSDTDSMAKGWDLFKRVRIWEGGEGVLASPKVRDSGPAWLPRVRGRRAVLTPLPTEVPPFAIQSSRAQGGLPALHATLTCHFLHPGRGVPACASCHVDLSFPPPWQGVLTEAVLALEAECQRSPNNAEAWRLLGNVQAENDDDQQAIAAMNRALAIDPSNLETLLSLGVSHTNELDSSEALQYLGQWVSRHPTHAPVVAGIQRPADASQSLVHVVRDWLVGGEMGT

SEQ ID NO: 9781 - protein, 308 aa, Chlorella protothecoides
MGVESLLSFHVHVRFNGKYFGRFSLQEEWSKDALEVLSTPVSHHGGPPQVFRAVNVCAAPFHLSLLPQHSHALPTADLPVVYELESSKSKQDAAVQALEAFTAGLAGGGPVARSKYLFDAVNLPQVINYLAAQTLILNQDRCTKNFYVYLDASSGQWSMLPWDVESGFGIDRGLGGQPAPDYCTLACEQWNSPLYCDRNHTQDLVISTPYGRISQPVTLGATSGTPASRRRRLSSLQTALGTPRLGRKLLQSLFQDTTVDTGAGQDLDSDYDANLTSGRVVGSRVFVHLLLTSAWKRGWGMSRGVCMV

SEQ ID NO: 9782 - protein, 78 aa, Chlorella protothecoides
MQLVRHLRQLAETNALTQRRAFLPRDSALATAAIYSSLFGKEGEPEQGIPATFQARVGLCGAMEMGVGPGGHEVVPSF

SEQ ID NO: 9783 - protein, 195 aa, Chlorella protothecoides
MPTLSPRLPTDHPSLFRWSAPCFVKLSTTGFGLGFGRVHSASFTVCMNSRVRDTLEEHRRRKFSGLDALVVCGSRIMDQADFISAPATSYATVGAHTVTGASFDLSFASGQLMVDGEANAAAYGPDASATSILEGKVDVPAEMQPLYGELAEIVHSVERVSAAPSLTRSSLDRATLGHDPNQGVVLDDGTVIREA

SEQ ID NO: 9784 - protein, 160 aa, Chlorella protothecoides
MTRAHLGQGRLPAPAPAPRTMSSTALYRRMQPTLIHPSPPLSIAPVTEDPAPRPNGGSAIPISAVVTPQQATVAGATLTYVIGYGSPVSVDMAATGGTYTADIPAAEAAAGQLVRWYVTATDAGGRNTVVPAKDSNGAVQYFGTIVADPTDSASLPILEL

SEQ ID NO: 9785 - protein, 312 aa, Chlorella protothecoides
MAKAKEILSRYPENYQASAMIPLLDLAQQQNSGFLSLAAMNRVAEVLGVAPIRVYEVATFYTMFNRSPMGRYHVMVCGTTPCMLQGAKGIYEAVSRHLGVVYGQTTPDKLFTLSEMECMGACVNAPMIAVADYSGGVEKFTYTYYEDLTPEDVVGILEDLKAGKKPKVGSQHRHNAEPSGAVADGKWVEDSPGANITLRGPPPGPYCRSAWDGRIIVMGGGVELCVNLPASAQQIAYWPCASGTLPGRAQLLPCVSIVVSISLQTVTLSSLPLPTTQESGRAPSRGGPSATKVESRRAEGKAVHALVTPLVP

SEQ ID NO: 9786 - protein, 171 aa, Chlorella protothecoides
MYKQEDPPGGPTTAPSPLLPSQDEVADRLLDRLKDCTRAFESVLVLGGAGRQVAERLEREAPGTRHVTHVDTSQAMLDALARLHAASARSTPHTYVHWTDTRNETLPVAPGTYDGERVGRLRRAHLCWDASPERKGMQCGAGRAVQSRPPFSPLPQLSLPAWDSTGSTMFP

SEQ ID NO: 9787 - protein, 96 aa, Chlorella protothecoides
MLGGTTLQELRIACTLAQQEREGGVAPRLSPLAQVRDAGNLLTRAGLTIPAVDVDDIQVQYRCGWVVSWGTGGNRGAGRIFCPATTPLEAFAGPAK

SEQ ID NO: 9788 - protein, 184 aa, Chlorella protothecoides
MCMRIWPRLRGPPGLPASIVPAEAQSGTPIDDAPLQAPARHPSPPSEPPGVVWFRGVCAALGADPGHAFRATICTLCPDVLRGPFEAGARAQVGLPPEWYDPGCWPEGERERLAEAVRARKEGALDGRTAAEVQGGGRGDTARGPQTALFSSTLQDAENLGALRARLEHFVAGETARAAPASAA

SEQ ID NO: 9789 - protein, 205 aa, Chlorella protothecoides
MEFVEAWTSPEGSQVVRLVTSPDFGAWVPKALQSQASFQKLEFHDVRSWTCGRAHDPVAGRCRWVGLCLALFGAAVGSTPSHPPPPAPLSTQIIEYAPSDLARPPYSLSAPLLPVRVHREPHAGAQGAQHAEQAWESRVGHELPALDLSPSPPDLQLDIRLRLTVAPTSPDACRQTLEGRIRVGIFGLGRIVEGIVKDQLAATYR

SEQ ID NO: 9790 - protein, 118 aa, Chlorella protothecoides
MQGEPERALPMFAQTVQTAQAKGLLLGQPSIPCRDHSKAPTHHAEQTDDLKARALVAQASVHQGLGEVGAAIDVLREAAQYDDKVRGVGVERGNTNLVSWLFRARDGGLIWKTARSSG

SEQ ID NO: 9791 - protein, 203 aa, Chlorella protothecoides
MNHGSHPRLPSPSPCRRLPSDDAGTPRWSAPCFLRLETTGLGLGFGRVHSASVTACMTPKLRAEVQRRRHRTFTGIESGILCGAATRVRRDFLTSPAASYGTVGSGALRGASFDFSYAIGLLTVDEAANAAAYGGPVAASALLEGKVEAPAEMQPLYDQLAAAALATPGLSDVQVVDKAAGEQGDVEQGAREEAPPAPRPGEL

SEQ ID NO: 9792 - protein, 445 aa, Chlorella protothecoides
MASPCLTACHRVQASHSTSRHRIMTPQLFAPHSVPAHAPARRWSGRRVAAQGATVEAVTGLDPSLTPLIEAALDDCLTETSLDLPGTHYVVGRVGERVQAGWKGPALLYEVQYPCSPFVPRLTVRSALSSSGDLSHPLITPSAHPTPSIQGKVRDTYDLGDRLLIVTTDRQSAFDRILASVPFKGQVLNQTSAWWMQATRHIVPNALLSLPDPNAALMTKCEVFPVEFVCRGFMTGSTDTSLWTHYAAGERTYCGNTFPDGLAKNARLAQCVITPTTKAATHDVPITPREIVEQGLMSQADWDTASTAALELFRFGQAEAAKRGLLLVDTKYEFGKDGAGTIRLVDEIHTPDSSRYWLAGSYEARHAAGQEPENVDKEFLRLWFRGACDPYNDPVLPAAPAELVVELSRRYILLYQTITGRRFEVPEGGRPLHERLAANVAAAGL

SEQ ID NO: 9793 - protein, 228 aa, Chlorella protothecoides
MLHSLAHVELNAVDLAWDTVARFAAAPLPRAFFLDFARVADDESRHLLWCLQRLGELGHAYGDMPAHSVLWEGAQASAGGCLVWRWGGRGEQVTDEEGGSHRDQSMQTGGWMPVEEGGPWRGGDQALCARDPGEGMDDPLQAGPSARHAAGDVGSRLAVAGPGRSPCCRGRGIQAGRRAHVPGGEGPGCGATPGGPSGGAGGRPQRRHRATHRAGGERARRRGWVGRG

SEQ ID NO: 9794 - protein, 181 aa, Chlorella protothecoides
MLSVVPRRPEPEVPGFPVSRPAPPGAPSLSTPGTRRPPPPASHWRLAAAWASGSRLSAPPARMPLRATGNMTPRTLTASKERVAHQGRPSVECTASSPAMQTCRGPQGSAAALEEVLATERASLAASNALLPVSRLGSGGRLPLDSQRRDALDTRSLETCLWSNAIGAIMPIHGHLEVLDE

SEQ ID NO: 9795 - protein, 271 aa, Chlorella protothecoides
MILLRLPPSLGSLACRRLRASRWVSSVRCMHSDARIDLISTGPEASDRLAEFIASASAPGDAFLLYGEVGAGKSHFSRAFIRAALKEPCLDVPSPTYLLQNTYEDATGVVLCGDVVLGLTILPQYGLRWPLLASRPTPPPCTLDQSSPVPPLRPVPPDRPLLPGTVGPALRPRRRHLPDRVARASGRLRPCPPRHPAHRLRGGGGRRATPVLAFLPGPGRGALGAGRAGPEGPGPSGRPGCPGSIRGRPGVSPRGTTVAFISLPSVLPTPA

SEQ ID NO: 9796 - protein, 983 aa, Chlorella protothecoides
  MOD_RES (439)..(442): Any amino acid
  MOD_RES (473)..(475): Any amino acid
  MOD_RES (715)..(718): Any amino acid
MVTRGPPSYRAREAPLAAATLAEAEEKKDAAQTGVAPIPDEVRDLHRAAGGVPCCGNFPEPWNRTHRSLQVQVGGSPLYVVERKLGKGGFGQVYLGRRTPPSKDPELAGVNQVGRLGGERRSIWGCGIEMAIGDTWDHMATSAADWFLAGSTETGASQQQGLGRRSSLMQTAAQRSAVSMRSGHLFSAGARLLELPFPDLPMPSHPQPGALAPRMSALSISPFPPHPHRALGDVEGVPKVHFKGRQGDYYIMVMDMLGPSLWDLWNGQGQAMSQEMVACIALEAIAILERLHEKGYVHGDVKPENFLMGLAGTPVEKKLFLVDLGLGRAEVLRIYVWLPGEGGVWDVRLPQACSVHTQIATADGLTSPITGPPQPGAPLRRTSNPVESFPPCRPLTRSDSLARLRLRYPCGVRPAPRRLPRHGAVCQRARAPGPHRQPXXXXRPHSTRRSPPTHIESSRILSPMSSPHAQRPXXXVPGLHPALPAARAPALAGLLLPPLIHAPTHPPTHPSQPISPGREQGLHGVPQEDEHLARGAEPLRARALPRVHRDGDQPALRRGPSRPVLPPTRVGSKRSREEGSCDGAGGERGGGERASPAPALVPGRRVRLGMPATQWVTVYNAHRPMKQRYHYNVADNRVRQHIDKGVEDGLAISTVACCQDLWALIMDAGGGFIAQVYELNPVFLPKDWIMERWEEGYYITTMAASSGPRDAAWTXXXXTTSPPWQVGGLWGDGGAGEGGGPRFSKLRSPERCMDLRDSWYRNGPSSPSRPTHPAQHPPTPTPSPRLGGRQLAGGDEQGHGLHAAVVQGLRLLPLQVDQQEVEGGVLRHRHGQRRVTLGGGHVAQRRFRGPGGGAGLPVLLRGHPPALGRGVPHHRRRRHLRPGRLCALRAQAPAGGRDAGDAAHLRLPLLPCQSARRSVCVVVVGGWGWHGGVIHGWECRCEWQDKLYSRASVQQWEGWHEGAWIKLACYHVASIHSVLPQRP

SEQ ID NO: 9797 - protein, 150 aa, Chlorella protothecoides
  MOD_RES (72)..(75): Any amino acid
MRFASQTVLSGLGSLQFVLIPVASQALLGVRADRSAALGVLVVVAGNVLIVWHGPGDVEYSVAALRALWQAXXXXRPRRRRVLGDCAASAVADTHHARLPPGHGAGADGAAADLVGAARRGQGPALDRALRHAGSADGARRALGRRRGGV

SEQ ID NO: 9798 - protein, 525 aa, Chlorella protothecoides
  MOD_RES (205)..(233): Any amino acid
MYCLLGSLHSLGFVPSCGTPALRPPIPRLPRLSRPAAAHLLRALPIPACPGSPDQVTPRPTRHSALLGHAHGLAAATGGLGVLPAHRQAPVGAQPTVVPDLLQALQIVTQLGVQHGGGHLEVLAVLDVLLPVQEPVGDLVGAGVGHDGHDGLQLLGRELAGAAWDVRRTGGWGEARWRSLSNRKPGKPSGLRVSELRRTEGGGPXXXXXXXXXXXXXXXXXXXXXXXXXXXXXPSLAQPPPAPLPAPHAPAGQVDLGLLAADVGVAAADSADGGQGILDFLLAVDVGVQHTQDLALPTWRHPPPSPEPVLHPATASTHPHGVGSILRPDRAGNRAEKRARPLSCCLLVAKLYKAARPGTNKGALRARSEHWSGKRFRYEKRARPLSCGLLVAKLCKAARPGTKKGALRARNEHWSGERFRYEKESRKRLKKALDSLVYLPTPDSTEVPSKPAPAAKGQTWDRKDLFTRLQTFRSATWFAKPAGITPADCARHGWENTGVDTLACEVSMQVGSVWDSAGCTPCMSF

SEQ ID NO: 9799 - protein, 553 aa, Chlorella protothecoides
  MOD_RES (141)..(144): Any amino acid
  MOD_RES (446)..(483): Any amino acid
  MOD_RES (511)..(514): Any amino acid
MSHDLTPLGVVLFSIASAISGELINWILVYRTSSYRALKENLSRHAKKLEEAKSSGSGSKNIKKLEARLDTWKTEASARVAGINMRTGLIVRGLEGGRAASLAEQRGHQGCGGFGRAWTGGLGRVQHMIHLDVYCCVKAIXXXXWGLGRAWTGGPGRVQHVIHSDVYCCVKAINPSSLPSPPADRGCGHAQFPPGIAAVWRRAGGHPALPPAALPPKADPPRPHRRRPTAVLCGEWDWRPLVGIPGDALPSGRLQITAQLRSSHLTPALTTTHADVHLHPVPGIHQGAGHQAPGPGPWARVGDHQAQHPNGPERQEVTVPCRYQSRRGRGQKRGAGLPVNSRPPGKGKGGGGAVVHRRRGEGRRPADDQAAHFSMRRGSSSALARRRRLVARGQALVLGSHDLESLDGLAAEGAGRHQVLARGAQLAGAAEAQLVAAAGHGHRHAXXXXXXXXXXXXXXXXXXXXXXXXXXXXXXXXXXXXXXGRSCQRGKQERLGAHRSCSQNHTQHGDXXXXAVQQRVNLALARRLTRLRTTCCGVGGGRGEAVSAASRKG

SEQ ID NO: 9800 - protein, 150 aa, Chlorella protothecoides
MLLVKTTATGMLAAVLDAAIEYRSRQLLAAAEEGEREGPAPSRLASIGLISRPGVAAWKARLLQAIDEMERRAERYGLAFLTPSHCHDVVGPSSRLAAEAQTAAAPKDKGLAHGPHGCGSLADFEADAETEAILSQTVQQLQELMRQSGE

SEQ ID NO: 9801 - protein, 85 aa, Chlorella protothecoides
MTIVANPRAYKIPDWFLNRQKDVKDGKYFQMTSSMLDTKLRDDLERLKKIRNHRGLRAYWGLTVRGQHTKTTGRRGKTVGVAKKR

SEQ ID NO: 9802 - protein, 336 aa, Chlorella protothecoides
  MOD_RES (301)..(304): Any amino acid
MLACVQLIGRTSRGSQPPRAAGICRGCTSHSRTPPPPALIQPRAQVFKARKTGSLATVAVKLITKRGKNERDLLGLRQEIDILRTMRHEHIIQMLDAFETATDFCVVTEFAQGAGPAGQESGREVWRAGCLLAALPRTLPRLCTHPCLSLGTPADPRPPLLLSHSRTCPGELFQILEDDRSLSEGVVRDVARQLVAALHYLHSHRIIHRDMKPQNILLSAAGTVKLCDFGFARSLSAHTLMVTSVKGTPLYMAPELVQERPYNHTVGWRGLGGWATKGGSVESPIYFSTAGPGSAGRPEFXXXXGLAWVGWVGEERGKCGVTQIFQHSGSWICRAA

SEQ ID NO: 9803 - protein, 312 aa, Chlorella protothecoides
  MOD_RES (95)..(98): Any amino acid
MSSALGLAPRDEVEDAAGPSGSAAQALENAHLKWRPDLRLPVSGPQEPMLATRGVDELTKQVWSACKEWVLQPVHGMYRRLATSRGRGTASHINXXXXPAGQWSPGANTRYKRSGRAHEAGVECMQRVGASACAGDAQATGDQQSKKARRAAQAAAPDTSGKSWFDMPATRITEEVKRDLRMLRLRSAFDPKAFYKKFDNTKFPKYFQMGTVVEGAADFYSSEARGRGWGMGFAMAALRSCVVIPLSWKSHRSVYMHGSSTWGEAGGLVTESADKDAKITRTPPWSTAAGTPQTVWQDAGGEVQVLAQGAQD

SEQ ID NO: 9804 - protein, 241 aa, Chlorella protothecoides
MQVKQLSAASYHVWVHSPVPGQPRFFASDALECLTKVQWWVVPLLWIPVACAWLAVAVRDWGLPTSACYAAAGALSWQGVEYGLHRWVFHARPHSPAAVCAHFLLHGCHHKFPQDVDRLVFPPLPAALIAAGLYYMIRLALPAVGVWRGVGQAGQIGWYLTRQAPGGSDAFFGGLLLGYVRYDCMHYLMHSGRLGGRLKAAHMHHHYSNPEEAFGISGGSLDWVLGPPAAIGATRRSLVDR

SEQ ID NO: 9805 - protein, 228 aa, Chlorella protothecoides
MTPSDLHTTPQMKASDAAQGRAARVLPTSLASVYDFALTPRASTGLEGVTFRFVPEPGEVAAALQLYNAAGVSAGGFMGVPLFQAEGLTVMSEGKRCTPLFFSKADLDVALGTAAGQKHEEMLGLTRQRAEEARKDVQRIRDEVASAGEDKAAKAAAERQLKPALEAQARYQARTAQLEDKKVKVPRVDLGSLEEVLGRMEADARGEWADVLFIPSGTMTVTGKKKGR

SEQ ID NO: 9806 - protein, 515 aa, Chlorella protothecoides
  MOD_RES (19)..(22): Any amino acid
  MOD_RES (229)..(231): Any amino acid
MEFAQLRARYPRKRYVWLXXXXPHDGEGRGSDLITKFNLPNCASVVKRQKETHPGSLPCEVTITRACPEGLLKEHQCNMALMRSTPGGPRRSIPWLIYHAGAMAAFMYILLQAAQTLTKDMGAAVQERQSARSRSELQVQANTGQDRHSLWTPSPERDAKDPELAAFLRKVRLLPGYRYPADASCTPCKLVLVALPVVQGACPESLTPISSNAPKLLGPSTTRRLRLTXXXAGRLPRINDTSFFKRPKTPRPLHYTQVAIKNEVLMAVSNINYARKGGMLDMWIQNVLRAGVKNAMVLALDDETKKNAEEMGMAAFRMQLEVGWAAERGVGGVGIPKAQQGNGDNHAVSAMKFRILSHFLELGYSVFLSGVLPNLRCHKLLPFLPDVDIITLQNPFGFLARDSDVESMSDGWDAATAYGYNDVLGGFRGWAWQRVHGGYAGSARNVSTSTSLRRYLLPLYSWASTPARFHGRIPAHLQTTRRWVGRGMPTPCASLSSTAACSTSGAWAVAHCHNL

SEQ ID NO: 9807 - protein, 210 aa, Chlorella protothecoides
  MOD_RES (13)..(16): Any amino acid
MFMQASARLWRTXXXXDQGHNDDEIRVNPLRSVMLMQASARLWRTNLVDWRAGFSTTMGPGMVYLESLRNHEREGVPSGAALPPSLSIPPTRWPQTKMHRLLAQLGDPQDAWQAVHISGTKGKGSTATMLASIASAAGLKTGCYTRWIVMLCLPMQAWSTRPAHGMRFASPSEAAQELSNGGPWARASILPLTVISTFPTPSQPPRGVPA

SEQ ID NO: 9808 - protein, 114 aa, Chlorella protothecoides
MELHYGVHCPAHADVPPPRFSPPAPPPKDPSVTRRVLDFELFMNSKTLFKFLRYSGQKYIDHRPVMIHVNYHSSTLAVARGWPGPADKFERMGAVVKRYVDGDLKALDDFPVRS

SEQ ID NO: 9809 - protein, 199 aa, Chlorella protothecoides
MEGVHQLSNAATAITAAAVLASEGILQGLTLEGLRLGLSRAQLPGRFQRCRLAEHRAGPVLIVDGAHTPEACAALAASLRRAFPEPSPVALVLAAAADKDARYHLGCGVSLTSALIAHLPRPPHPSCSGMCAALGALRPVAVFPTEVEVAGSGARAMAPGSIMAAWQFNGAGAWGIGVRVGGHALQVMPGCLSSGACGP

SEQ ID NO: 9810 - protein, 101 aa, Chlorella protothecoides
MVQSPAVTSRIMDYELFLNSLTLFRELRHTGQHYTDFLPAVVHVNAHTGAKERGVRRTMLPLHSAATPPQGHKAERMEAIVDRYVKGNLTALDHLPLGSGR

SEQ ID NO: 9811 - protein, 219 aa, Chlorella protothecoides
MDGKPITSEDLDQALAAVQPTAQGLSHASPELPPLSHFEVLTAAAFAHFAAAGTDLAVVEVGLGGARDATNAFRPAGLALSVVTPIGSDHLDALGGSVRSVAAAKAGVLKAGRPLVLAPQPLHEAHQEIKREAHRLGCPVIEVADEVELEFARGGEQHPAAPAIVRVLGSTVAAALGLQQGDCIGGHRERGGTAEDAGCLKMSAYLPSQQPSAPPHPLA

SEQ ID NO: 9812 - protein, 197 aa, Chlorella protothecoides
MPDRTEANPNELNQDDARYGFRCCHLKNIWTAPLPPETELSRQMTTSTTSIDIMGLQAAYANLHTDQERDYFMQRYHDVISSFGGKTSYDADNRPLLVMRSNLWASGYDVDGTDQTSLGQFSGRVQQTYKHSVPRFFVPEHGTMFTLALVRFPPTATKEIQYLNAKGALTYTDIAGDPVLYGNLPPREISMKDVFRS

SEQ ID NO: 9813 - protein, 360 aa, Chlorella protothecoides
MESERWRCVGAVFTGPPHICLDCSGHRRDPPPPQVFLGWPGEAHPPGLAAGHGAALVGLEDLHLGASPAEGASLSPQGDGASPAASIRPPPLPRRLTYAVVSRPVRHTRLLSALRHVLAAAWESAAGGRGPAAGPRCGGAADARHAPGTCLSRAGGDAGGAPPAPSPGARAAARERRAGMRLLLAEDNAINMKVGGCKASLGVAGSALCCLRAVWVRAPEGALAAVALQGAAARGSGRWNASLPHRSGSKHMLPSAPLKVALRLLGRMGYTQVETAQDGEQALSSLVEAGGPDAFHAILMDLHMPGLVSRGQLAGPRWTGCAARVGGEGARGPPLPPAAAVRMRTGPTPLRPPPIHPGWN

SEQ ID NO: 9814 - protein, 247 aa, Chlorella protothecoides
MAYYLAPSVPATVITDGPRLQQVLLNVLNNAVKFTETGAVLLEMWAVPAPQAAGSQQSGDPARAEVGGTRCAPPALAARQSFTLHFRVQDTGIGIGQADLSRLFQPFSQVDASQTRAFGGSGLGLTISMRLCEALGGSMHWHAGLPRPAGCAPHARLCTSCQCEPPSYRRTRSHAQSRGLGWGSTFHGHIRIEAVPEEDDHAASSARKPSRTPSAERPRSNPKGLRGLRVLLAEPCLVVRQVRRRRF

SEQ ID NO: 9815 - protein, 167 aa, Chlorella protothecoides
MKNYKRNGDPFVNYLSVTPIFSAKGRLSHFVGIQADVTDLTSHKQAALAATHAASLASAATEAKSQFLARMSHEIRTPLNGMISVGQMLAGTTLDPTLLPLSSHTHAPTRILRNTHPCQRDLVDTIRVSGETLLTLVSDILDVSRIEADRMVGVAGAGLGRLDVGNS

SEQ ID NO: 9816 - protein, 444 aa, Chlorella protothecoides
MPSGQLANPFSAMSLDSQASQDVLRSRPGNRVSPPDYDGNEGMATCSQAEALGTQDYITPVDQFGTEADAAPGARLARSPAQLSPNRMKRARRAGTGRGLLRAARAALPTRPPQYPNLHLTHRAGTPPRQPGPGAGQRLVRVRSPPCYRCIFRDADAEEGMSAWSSKRDAASFPTSRMRCGAAGQQPGTLLDRTELGLLGQGNYSKVFRVRHRLDGREYALKRSARETRPDSPDFAQYLQEVQVLAHTPPHPGLVRYHGAWVEPVSPAGLHTYLLLERCDVSLGTHLALSGERPAPAELARLVRALAGALAHLHAHGVAHLDLKPDNVYLLEGGEGHGAGGPAPPPPEYKLGDFGQAARLDGAGPAAVTEGDGRYMAPELMNADHRDLPAADMFALGATALQLASGEDLPRGGAAYAALRAGKLPLLPALPVGLARLIKWGLYG

SEQ ID NO: 9817 - protein, 372 aa, Chlorella protothecoides
  MOD_RES (48)..(51): Any amino acid
MHTGAGAASDAGGLCVPRALAWYRGALSLFAHPPPQPPLRPLDDPRNXXXXPQTQVGCACQVPWRGTGVPTRCLHILPRGPHSGLSMTPESGSPALLTCPSPPTHPHTSTPPFPKGPSVTHRVVREFAGLHRELADVAGVRVNLFQHSLAHGTPDAVFPNNWFSTHAAGEGGGAAPSSLVLYPMKCPNRAAEAREDVVGVLRALGHAAEVNLAGEEGAVAGGAGRVLEGTGSLVLDRVNGVAYVALSERADAALADDWARRLGYDRVVAFSSGDGAGGAVYHTNVMMAVGTDLAVACLASVADDGERRALRQALERHHTLVDITRDQMAAMCGNVLELEDGRGLPGADGGLVVGPRHALPANHPSSSSGTTP

SEQ ID NO: 9818 - protein, 183 aa, Chlorella protothecoides
MRGRGWIILCESLPCRQGGMAPAQRGLSATPVPPGSQDAAPPQTPFPLLLLDARFKVPRWAFSPAPKVNGAVVHLELLAPEDRPPVPSEAAFLTLVTVRQVADAVAPTPPSCLMPSCPQVPAERTGYHIPTPHITPALSGRRPAAGAIRLPPAPQDAEEHPGAALSPKPDRGGPLAPGTGCRH

SEQ ID NO: 9819 - protein, 837 aa, Chlorella protothecoides
MMVRLALSYGISGEGGAHAGLPRIAHPAVGPPSDESTPALPPSSSPMLPWRAVPPGFEDVEVNEAAAKLSSVQVGRVMDAIHHASAGEGALAARSSFSTESPPPSSKQVSEAAPDAGDEPDTSLKTDSLVERDTEVKKVLADDTLYTSGGVPAGPDSLVGPACQSWDTEAHAVVSVPSRVPPPCPPTSSWTRRDAAPDPHPAAPLPHCASPQWEREDHLLHPGHAVPGGPGPARTAGPLRLSHPRVGHPERRCAGAAGQVLRHHHDLHRRGRLRHHAPRAHQRADRGGDARQAARLDEQAGAQRRGHEGPGLRRGGRDAQGARNPAAGGDIERGEPAFLSSHQDHRWAAPLGMGSPGLATDPTSPGGFSADSIGHGAIVVGHMHSLLSTLLQQEGFLDDSVRMMRQLQAANKDLQILLFSATFNERVKTFAQKAVKDANQGGEVRHRQALPLRNLSISEPPLAGVCPQGGLIPGRHQAVSGGESAISHVWTDRNAPTSTVSISSRSSGITVVYPRAPPLLPQYCPTSADKVKVLRDMIFPQCERLGQTIIFVRTRETARDVHRLVGWQSINGMASPAVDRHLQRLAPPPFPPAQMESEGHKCTSIQGGMDHTARDRVIREFRCRVWGLTWGEGSQDGTHSPPCYGGGQGLSCKVGSHEGDGTTKILISTDVLSRGFDVTQVCRGREGKFAACRAHLQCAAPVDSPPRHLACPPRIPLCPLFTGHAGDQPGPSRGEGRAHPRLRDVPAPHRAQRAVWAQGRGLQPGHRGHVPDFWRLATPHAHQSRHLNSTITHANQERRVIDEIEAYFKHPIPEVPYDNEEEFVNVLRRAGLTEQEA

SEQ ID NO: 9820 - protein, 946 aa, Chlorella protothecoides
MVAQQAQQAVCTILQWGPRDVPIGNGELSASVILLQSLRALQQRDEYHTSHLLHPQQYITYLTLCSQHPCLLCMVLSEDVHPMESVVAAMAIAVRAGDIAGAAQLASQASFPLAISPSDISIVSALTHGGQATVWSAVFRDPSASQDQPPSLVALKRPSLRTTTDLDAFRREVQLLGSLPHPNLVTLVGARLLPPGYFMLTALEAGGDAARLLHREGWRPSLALLCHLGSQAASALSHLHAHGIVHRLLSVAQGMTLDMCVAWGWVPHDTHGRAGGGASLCHGNAKRSAPPHFPSTRLPTLLRDVKPANMLLDAGRAFLKLADLGIALCSGSRHHEEAPRAPGTGQPSGGFHKLHMVGTLEYLAPEVLLGARHTPASDIYSLGICLNELATAQLPYSDAERDDPLMQTCLEMGYSRCEKMREKGIKWGGEGTGVAMKYTQAVRAVWEPLWSSSRCSLWAPSPYTTSCPSFLGLMAMPPHTHRQDLRVAIASGGLRPSVAPDAPPELTRLISQCWVAGAGERPGAAQVAQDLARLAIELAGKGEEAGAPRGGSPGPPVLVAGEKAESFRHTPSPLERGTDEIATPENGGLGLVPPWVQAYDRDGPGHAQPGAPLGLGAKAVAGRRGEDRMEDRHFILPDVLPRGAPGPPQRSRHALLGVFDGHRGPQAAQYLAERLPGLLEGALPGSSGAAAWLAAGLAAADAGFCSEWGAGRERSARGGGPCPGSTALLVLLSCRRAALAWVGDGRAVLCRGGRALALTAEHTPGLEGERARIARAGGRLTGREGGLRLGAAGLSVSRLCTRGRGSTKPTLFPPRPSIPRAIGDLDLRQDGLIPDADKLEVDLRPQDDFVILASDGLWDVMTNQEAVCLVQDTVKHPTMCAQHVPTYQGHGGCPVFQVPNQGCNLPSPSLPPQPWTAAGGGGPGAGIGGQHHLHCGHAGARGGKHA

SEQ ID NO: 9821 - protein, 248 aa, Chlorella protothecoides
MLAGAHHMHACRSRLTRAMAAHRSPSMQMVDVTVDLRHSSPPGGATCVDTSAPSVTAPPPHPPTPRFPHPPRLPLLQGYLQATDHVGLKILQGTPFASGVFSCHQNWLVGVRWSEVGASEAVLRAGFNIGSLMLRYAGVDWRDEGVWTCNRGMNPLLDRGYDGANAHPLEVMFVKVQHHQVVTRSPAVVPALQYHVWRLENRTAGARDVARNAFHDMAGVHLAGITAKGPACFDAEMYIAAAPAEFAG

SEQ ID NO: 9822 - protein, 984 aa, Chlorella protothecoides
  MOD_RES (69)..(72): Any amino acid
  MOD_RES (236)..(238): Any amino acid
  MOD_RES (860)..(863): Any amino acid
MVCPHTTAADLPDPAPTCAVLRAHEAALEALRTLAAALQRAAPPGALRSPPSPALHRSLEILARPLDAXXXXRPALAALAGLAPQPGDPGHATGCIAHAGRQPRRPGGRRGAAERPGGPRRLAAAPSQSSPASLLHVTPLDPPPLASHPAQLPSEWVVKAYTAKTGAKVEFRVGLGGVPGAPGPLEAMHELRRAAPSAPRPPSPVARPGSTGPPPADPALRPPPHRKSPLLPSPPXXXARPGSTGPPPPDPALRPPPHPKSTLLPSPLPQLRAAYACGSLEGRRALVRQRLLASAVYFMSGSTPGELAAHCSADPAFASELVGLLAPRAGGPTVPEDIQVLALRAVAAQMGDRPRHAALVPSLAAGAPDSVLASILGRVAAALGGSSDGGGARDGGAGGIVGAGAGPTDPAPATGTAAGPCDATHTPAPSGDSLAWVDAALSAVGALVSCSPGCAALEAAGLVPALLPLVRAAPSALAPQLASLVRIVENFVDFSPGSAALFRALDGFDALAERLAAEVALGVAEAAARGVGPAPDAPGGGGGNGGGGAAAQEGEGAGPMEAAGEGAGPTPGDGDATGVVAATSAATPPAPQPAAPAAHPYQPGTPSPRLIPYNRRLLLKALLRGAAMASYAPGAAGGAGDTPAHLAMYRALCAIFRAAPAFGGGLFSLAASLVSDLIHHDPLSYRLLEAAGVPEAFLAALAAGVVPSADAVAAVPQTLVALCLNAGGLRRVREARALDCLLPVFTGEAYLRALQGESASILGAGLDELVRHVPELRPAVVQLVTGILERLCELGGGRSVGAGVARGGGGGEAPAAARDEQRHGSDAMDVDGPPEAQGAAALEAPALAAGASAPAPAGAXXXXGRPRPRGPPARRRSPRPGSCRRRRRRLPRRLPGGVRDLRLAHAGAAAGAERHRRGLCGGGRLRAAAGAVPPAAPAAQLRLHQRQPQPAGHLPRVCHAGAGPGPRHRPAPHRARAGERGDGG

SEQ ID NO: 9823 - protein, 576 aa, Chlorella protothecoides
  MOD_RES (5)..(8): Any amino acid
  MOD_RES (379)..(382): Any amino acid
  MOD_RES (521)..(544): Any amino acid
MGAFXXXXTYFSLITVLLESFECPERQWEPSSCRLSSDCMGGRDVGKMIMLERARQPVLTPCGQPLAARDPSTDHPKRHRPTIHMSFAEKGMLRAPGPSPSSPYFTRSKVVNDYKAAGVLPIALYEDRILVLLGAELERTGPKGKYLKYLWRDFGGQREACDEDSAATAARECSEETLGLLASCGVDAGAVAAAAAALSATLRDGARSVRVVHALRRGAYHMFVVQVPYVTALMFRLASDQNAATAAVAGAEKTAFAWVPLHDLLRAVARAAPAYHLTCRGAVCGGRGTPPCGPAGVRAFPLHPCFANSLRRAWWEGGLRRLALRWPLCCDGDGEPACGGRNGNGPEDRHNESLTQPALVPTPVPKDQMANPPVAGSPXXXXGELAGGGGNGKGPGDRHNESLMQPAVVPTPVPKDQVANPPVAGSPAPPDTPCSSESTNMRGRLNSLVHCLAQADVAAALEPLREATMRPLPARSSGHAARHGQRLGWAMEAWPLLTAAPPVRKKLSRRQRLIRKRRRWXXXXXXXXXXXXXXXXXXXXXXXXSSIALRHDPVGLLADCYIAGHPPSYSAIPTPL

SEQ ID NO: 9824 - protein, 817 aa, Chlorella protothecoides
  MOD_RES (256)..(259): Any amino acid
  MOD_RES (383)..(386): Any amino acid
  MOD_RES (446)..(449): Any amino acid
  MOD_RES (479)..(481): Any amino acid
MDEAAVGGHAVLTAMLQRAGGGAPGSSTRPLLQYAAGLGNLAAVRMLLGDGADVNGGYGRHAGCMLRGTANDGTTALHAATLAADADCVALLLESGAAASVADAKGRTAADLAEEQDRQAAARAKEEAERPPLVRPGDAPNPPPLSRAALARVRALLADAGARRQRRPAAASGSSDEQAAALGPREAFLALAPGDRLRKVERWASLPPDDLDAVLAGFEAAVQAEVQSRLEALRTTAAHLNIHKVPLEGRWERELXXXXGRSPEHPQGAFGGGGGEGGWIICGGPRWRAMCLQSHMGKVSEGPSWLAAGPGPTASRHPCRAWHCILWLPMVRGTSRCGTMPASGAPRPCSPAIDIPKTGWPQTKGLGYLPQRTVPSPRTPPSXXXXAVQPGNRHTDNRVATNDRPWPLASAHCHLTEDTPLPIAQAITALHEDEEFQADAARPEVXXXXAHDVAHARASHEHGSVLCGRGPCMFDVQVXXXPACTTPMHVSQGPGGSGLVWVLEARMMSPMPVPSVNMALCSVGGARACLKRRLPPVVPALAQEPLPAWIQADRALPAFLPGDPVMLSVLQKLRRVHAVSSANKQRTVDLDLLLNTPGEPRQPPDAVLLARMEAVRAAHLAAAAAAVVAPAKAAQAQARAMYDAVLAGAAEAASGEASVDGATTGESLVGQMAGTPKEAGADTSLPDEGAGAGPEAAAAPSARRRVHFAEGSKPPASDPGPSTSGGEAPSRPARLARTGGDDGSEVPDWLRDGFSWPKVWAELWRQCQLALLILAVFLVTSSVLRGKLPWAAREAGPGDRDALDLAGLLLGQGRGEL

SEQ ID NO: 9825 - protein, 142 aa, Chlorella protothecoides
  MOD_RES (138)..(141): Any amino acid
MAQVEALIERGAELDCRDRAKLTPLHYAAGRGRLDIVRALKARGVDLDPESPDGRTPLHLAALRGHAAVAGFLAGSGAWVGAFDGSDSTPLHLAARHGHEAAAQALLSHGADPGLTNKFGLRPVDEAAVGGHAVLAAXXXXA

SEQ ID NO: 9826 - protein, 258 aa, Chlorella protothecoides
  MOD_RES (52)..(55): Any amino acid
MRLWEEVTVVRQLFVKGPGLKGLGSTHHTYSPHPHPPSPPPHPTPPTHTHNXXXXTHPILIPHPPHPHPHPTKPMQPRLCLQPPPPHLGLTAVQGRGADVEVADDEHGAPSACQRVPTRLQRGVEAQLEREARRRRLVVAGRDGRAVEVEEDKGAVVGDHAAPLPVQLLQLLGHQPQGLKLGVESEEALGVPRPPAQAAGEALLAGKGQRNARAHVGGRAAVPPFFLRAREKSVPGAGCGGSRLRGGEGGPGAGAALV

SEQ ID NO: 9827 - protein, 255 aa, Chlorella protothecoides
  MOD_RES (225)..(227): Any amino acid
MPDGGTRATLKAFFKPRTPGVASGDDPASTDAEAPVEGDPGGHPGTTTQPSIAHPALSDLGKPGHGLAGEEHGATPPHPNRAETCLAAELAAAREAHERHLAAAKEAWSRINGRMAAPRCRHGEPAALKKANKTGENRGEEGWEAHYPGWNTLAAVEGPRGDGFTPVHGLPGPHHMATATFSSGWRRGVDPVALPSRSASRGRNGVITAEHCWQEIQTATTGNGXXXRWGGEREELEVVAGRMGSPSPWLEHARC

SEQ ID NO: 9828 - protein, 117 aa, Chlorella protothecoides
MLSSRLPALLCASLKLQPRLPHLHNAFSLTSLLHGSASPEALTDNLPDSIALQDGVSLRRPTEPEPYECCGRGCEYCVWTLYWEELKEYQQEVAKVQGLEVKEKDPFEEFEKRLRGG

SEQ ID NO: 9829 - protein, 328 aa, Chlorella protothecoides
  MOD_RES (26)..(29): Any amino acid
  MOD_RES (207)..(210): Any amino acid
  MOD_RES (239)..(241): Any amino acid
MVAAQSQKALGRALSSGPAPIAAGPXXXXHGTAVGLPSDADMGNSEVGHNALGAGQIVDQGAKCVDKFLETGEVWSGEGWRAIQDNARGGTLHLIGLLSDGGVHSRYDQLQLLIEGAVKQGVRHIRLHALSDGRDVGENTVGGRGVLGLWRWVDLKGLSFGLWLQTQDWRGPILGFYSCGVDQGEDFYCCHPWGWLQRTCTESRNPXXXXVQRHPRCGDAGDGRAARQRPRPLAPDQGXXXGGRGEAGRAAHPPARAVRWARRGGEHGGWGGCAWAVGVGGSEGASFGALAADTRRARADPGVSLMWGGPRRGLLLAPPLGLAPTDLH

SEQ ID NO: 9830 - protein, 213 aa, Chlorella protothecoides
MALLHRDRARGPGGACAGLGTPSGSGQVVDVAISESIFNMMEGAVPEWFTHRAIRPPSGTTLTNVVPSGAWQAQDGKYVIIGGNGNSGESMGVDRITGWGARRGAGDPASHCTCDLSPDQYRQSLPPPKVTPPLPFKVYNRLVAAMGREDLGLTNPRFATDAVRNENEEELNAVRLGIVGGYLWVGSGLQAGVCEGLQGSAHLAPLFPAPCCP

SEQ ID NO: 9831 - protein, 159 aa, Chlorella protothecoides
MSVLRAARVPAGPILNMADIAGEAQYQARGMFQPASPPGGRPKERRKRMHPAADQGAPCEVILPSGKLVAGCAWHAAACIWGGETRAGRWRGGGAAGHEPRAGRYTRQDALGRAGPGPAHRGGAQGGAWHDAGGGSRPEAVGGDMNPVVTDWACLSAKL

SEQ ID NO: 9832 - protein, 115 aa, Chlorella protothecoides
MPPCLHSTSQPPRTHKQAVKWVTKAQGDIDRWNSEHGIDIRIASGGGRMHVTMDRYESDWAVVKAGYYAHVLGEAPNTYTSAIDAVTDLKPGRDTWDHLKSGLCVQSARRLAHLT

SEQ ID NO: 9833 - protein, 206 aa, Chlorella protothecoides
MRVHAGVSVKQAWLWQVAFMHTPHFQSQNPASNVSVITQAPPLLPAHPPHLSTDSHRNLPQGRFFRKERGYSGTATYVRTGVALPFASEEGLTGCLGRRAGDPEGLLAFHPELEALGLMPEELQELDGEGRCVVTDHGAFVLFNLYGPAITSSDDEAAAARFAFKLRFYAALQARWDALARAGRAVLVVGDLNICAAPLDSCEPKV

SEQ ID NO: 9834 - protein, 110 aa, Chlorella protothecoides
MVEISKALEYEEFDHFDRKRWPKIKFAGIMQYDGELKLPSIYLVPPPLIERASEQYLVGSGVRIFANGNRSGYLDKNLEEFVEVNGVGWCREAIFGGGLHHPIAGDFGLC

SEQ ID NO: 9835 - protein, 185 aa, Chlorella protothecoides
MQLPAPTGTLQLCEDPPPWSPASNLLRALRQSPQALALGLVEGVAGERGAGDIEVEATKERSLARRVQALSRFLLEALHRELGGGAPAGPRASAGTAPRPEATPGRGPGPGPAPASPVQAVFGMRVASQLACLDPPGRPPQSRLAQRHRRHACLVRPGGAVHGGAPAQDGHRAAPRPHHQLRGRG

SEQ ID NO: 9836 - protein, 374 aa, Chlorella protothecoides
  MOD_RES (32)..(35): Any amino acid
  MOD_RES (278)..(281): Any amino acid
MCHPGIDTRRELVSKGRDQGADVLRARTCMLXXXXPGVEPKSGPTTSSNCGLRQQQVKEPHPMTGERSRCRCTQSKDMSLLDVSIRSVKPRVVGEVQKEFHAACSFVCGWWRPSDPARRASRRRLRISYKILAAPVAVGAPRFLPTASHFSLEHSCNDCQGWVLTASLCVVWDQGFCIRILCMDWWDIHVKGGPLVDISVVETVLGSGGADLLSPFLPVSGPRTRPLKLLWGALFGALPPLSTCIRALCHAFVAWCNVLTPKPLTVFGISSVTFVIQXXXXRADAEKAYVRTTSTACLLSEPSSRVAVQLALLISNLARFDVPRPWDSLVGDLAASAGMDSPTSLESKLRSLRALKHCVRGLKGELRQGRVWGC

SEQ ID NO: 9837 - protein, 133 aa, Chlorella protothecoides
MDSINPASFAICNSRATPGCMAIGSIQCLPNGVPACAMDKDHNIGTGNTGKYNVGNNNVGDHNYGSRNVGDGNVGNELTGDSLLCNFVRSNDQCYRNWLITKDTITLYAAVPPPPPSPPPPGEYCDPRNKFFA

SEQ ID NO: 9838 - protein, 111 aa, Chlorella protothecoides
RRVATNQRNVRSCRETHRARTSAHKHDLRASVHGMCPTFHGKSNLLNLHAQDPASCTAVTTSESASLPGAAYRACPADEAVLPTIGLLLTSSPQLTSYIAALRTAGLGNIP

SEQ ID NO: 9839 - protein, 208 aa, Chlorella protothecoides
MGLLLLAALMFPCMPHDRTGQSQPCPAPNHIPPTQPPPSLFTSQSAPLPRQVTPSWERLTAAIEADTEVRDRLGWVREMYAFSLALVETGIKVELRSEGQSPFIAHLPGQAGLGEAHAFHYTLCTIYKTMDGGDAWGFDKRFYTEPQHALELTRIPPMPEFEAGKYKFVEGPPVTLEKHNAIKQMIDQINKGMDLAVPLPEAAKARAF

SEQ ID NO: 9840 - protein, 122 aa, Chlorella protothecoides
MIESDYVFMKPLGIPSTPPEGYAGWAFPFNYINPIAVPVRHLWGLPFGSGNGPELSFPAWFLHSTSPPIFLPLPQNEMQKLSPGVDVKSIPPTGPAPIVLSLQDWIKVRPPAQLAGAMPSSA

SEQ ID NO: 9841 - protein, 438 aa, Chlorella protothecoides
  MOD_RES (89)..(92): Any amino acid
  MOD_RES (388)..(391): Any amino acid
MQMPPRPPTPAPHPPIPVGVLEFARGKHHQDGLDIHYHSNGRVFVAAEEDRILDVDVGQLGRGFAGCLPKNLLGAADGIDVQGGRRDRXXXXGSSGGLWVGSGEHKGPPQSHPPPNLAVPRLPSPIPSSPPEPDDAFSGTMLLQHAPPRPRGQQQMLVGECSVDKSFRRRHLPRIQALGEPIGEVHGAVEASAPKSLLIYAAGAMITRPSRQHTWNIVCGDAISTVWASQRTASQASHDLGFWGIGDARTAALRCQPFNPAPHSALQDSTRLARGCEIPALTLSPCNGHPRTLATYRCRGPTYRGSSGARSTPDTALPWYSSGSWTSHTCFSSSRTSRPTSGRAWGSPCVWVCRSWERHGESGAGIAGRIAGSAREGGACRNSRSRWXXXXWGRDRGGIFITGSSLMGAAQRVPRITSKNLIRQVWGEPWEGAPSSVS

SEQ ID NO: 9842 - protein, 365 aa, Chlorella protothecoides
MCPTPTCDLWRALVGGRARQAGREGMLTPASHPQSDRAPPFPIHHSYGGGHGAPVCALVPAAEAGTCLSSCGKEGTVLHWKGGPEDGLEVGARQELKAPWAAWVTCAAARSPDRAWALGSMEGRLLVAATDQSAPSCSAAGPHPAPLLQVRQGWLGACPVHSPCLPHAGWKHAWAVAQWNGGLCFAKGRGQGRAGARGGAAQGTDLETPSICTDFAVQLAWHPRRQHVLLSADARGTLAIWSVESAKVCLVWSRSGPVEAAACVAWHPLQGTCFAAGGADGKASVWDLARSTRFPLSTSTLGCPVTTLAWSPDGRALVCGGEAGAITALAWSAPDLTEGGSQDGAEGNDAVLRVLTESRHESSRM

SEQ ID NO: 9843 - protein, 271 aa, Chlorella protothecoides
MASGAVRLRVGEANDGRLVLLQLPPVLPLLVPSGAPGPGGVAVDPRPAALADLPQTLVGKLQASGAVRLRVGEVALELAAGTPCLHAQEVCLLFPAARQAVSLGSLSQRIVAVPDLGALLRRARDEVPRSITCCSRRLHGTGPAAHPALHPAASRRRRMPPRQDTMSCLPTLDPPHPRLQRGAAAGVPEVPRLPGAGGEGGGRPRRGQEWGGVARGESPSSPMEVDLVEGDGTVAEGGAADAQRLVAIKPDPGAVASPRRGARRLVMDEDD

SEQ ID NO: 9844 - protein, 447 aa, Chlorella protothecoides
MLGPGHVPGNSGQAATCAAFDPVNATLAVGCAGGQVALYALAELLDPGVGVPAPVRTLSQDEWGLDPNALGAAACLRWSPDGRALAVGQARAGLSVWTASGCRVLCTLRQHAGVEPGILEVGLVSGWWGFGDLRRDRRRRGGLRAVDPRRCRTVGQEGGPGHTQCSTITSLSLAPHQGPVTALAWARHGARLLAAEGGSPQLLQELRFARTLAGDHRAILRRRWTGAQASGSELPPWLDPGEEGAGHALLVGGVGADDGPEAVTGQSLLSRAWALGQHSLNALGLWPFGSQACYATQLPCVPRQAEDRVLLVGPCAAVGRGARGSGPRPELALEHLQVPEAYLEAAYPLVCEGAMGPRVRACADLRSRPHVRRAGPTPTVHLAQVRAAVDPASGDVAVAGGVGFALHSRSQARWRLFGDAAQERSFQVGGRWAWMLGARRILGRGLG

SEQ ID NO: 9845 - protein, 393 aa, Chlorella protothecoides
ARAAALAADGTGPSAAARLETFAAFSRKTAAASARSPAGDAGTARLGAKSNGKGAAWLSRAEPHDVPSLVESVLRPMFKAGRISKDQYKDIARKAVARLAREKVSAGEQFLTPKRRAKVADLIERQPTAGHLSGVRRLPVEQGPISPGSTSRPVTTLERGSVALPRPKLPVQKCRSQAACRPSACAASPSQPATLPGLQPPPLGLREADEEDRVLSSTPAGRYCMPVKKHANPCKVCDGTGRAMCGVCSTPAIVACTHLYRASPFMKWQPEAHSTGPMSFACSNALLHIHTIPLQGKGSPEFRRGGHASQGRLARVVHCLPCLRKVVLRGMPGHRDAQVRHVAACFELPVSDKGVLICRGDVCTCHPSIPPQPCRGPMGFRLPKAEERDVKPE

SEQ ID NO: 9846 - protein, 277 aa, Chlorella protothecoides
MASQVRGRRPPQRGLGAGCGQGRRVQVGQRGGAGVTHWTALGELRLRLPGRHPRTGAQVPLYGIRGLVIDPYNELDHQRPGNMSETEYVSQMLTKIKRFAQVCGGKRCLFGVGGGHVPVSSHPSAHGPSAAACFLHAPLHAPCSSPYPWAQTLPPPCPLPKPGQVSGVHVWFVAHPRQLQQWRGEAPNLYDISGSAHFINKADNGIVVHRNREPGAENAAEVQILVRKVRNKVAGTLGEAVLEYDRVNGRYIDPGAVGASAPQTSARVGRTGAAAPA

SEQ ID NO: 9847 - protein, 603 aa, Chlorella protothecoides
MQSHVATQGPPAKLLTAQQPSMSDITRRMAPVRTMMVRSQCFHPANTPSRRWHGGTGRPRRSPRRLPPSCRSSLEPEAGAGMPFPDLVLADVEPELALDQPAAGGSAGWPSTVADTPPLETPAGVDGTEAPRTPPPRFQLPPRLLEVLAFAGPGLGMVLADPLMSLIDTACVGHVSSAQLAAMGPNAAIFNAVFSIFSFLGVATTNAVAADSILDPALSEREREAARARVERLVGTTMVLAVAFGFLALGALWTQGQPILARMGADAEVLPHALAYLRLRWVRGGLAWKRVSKFLGWEQAPPDSQCVFLLGHRARSVRMDEVAHLPRNSPLPTLLDFHPQSPLKSNRALAAPAVMLGNVAMGVCLGQQDTMTPFLVFMGAGLLNLGGDILLIFGFGMGVAGAAAATAASQVLSTAIFMLYLWHRGQTDSRRLKIRWTVRWELRGGGGGLGLRRVTGGRGWPEAAALRQFQKVRSEVGHAYVPGAERYWVAYGWPVMASHLLSTSMTGRRGHPPWHCNPKPHRLLCPPFSPSGGCHHDHAYRLWHGRVLQHGRQRHRPRRDRAGCAPGLHAGAGGGFHTGGVCGLWARPLDHPSGIAGDCVHLA

SEQ ID NO: 9848 - protein, 258 aa, Chlorella protothecoides
  MOD_RES (222)..(224): Any amino acid
MGSEALIAHTVTLHLCVHLDPSLAPATLNPVVPPLRPPALTGTRGPLDMMEVPSHVFEHYARDVQGLALLLDRPAAELEAAVRAQQAQRRTFSALTMLHQVHLGLLDQVCPGGGAGGGALKRAMHSSRPPDEARLAGATAEVLGRHSPLADLGPHLPVYPQLRFGHLVGYGATYYSYLAAQSLSARLWRRHMEGEPAGRAAGEALRRNLFEPGGALPAGEAXXXLRRLLGRGAGEAGEAAPATIPDPGDLMLELGIEE

SEQ ID NO: 9849 - protein, 210 aa, Chlorella protothecoides
MSKADSEKTVTADVYVAALDVPGAKRLIPQVGVSVCLEVMGTSPGNNQHAMVTGKVDGGLFLLLHSENHEHGAALRRLGHRAEGGQQQGRGARWAEQPAVQVSGLDWTLPRHAIILVWACSGPKWCTVKMSTAEGTYISMAPLDDPLPPCLSADADFSCFADLALTSPVDYFKEGQGSLMQCVLTPAAKYMPMENAEIAAAVDAQVGGPR

SEQ ID NO: 9850 - protein, 478 aa, Chlorella protothecoides
MEGATLSGRQCAYKILGNAPELLEGRPQQAPTQEAQPEADSVAGWMSRLLPDYIPGRALAVQSSGQRDPVLFTRPLGVNPPLPPPLNGRALLRHPQALAGRHASGWSGGEGAGRGGASLPGHDHSVHSPLYRARHFLGHHGRSHSWTAVPGQVSDLIVYSNSLRQSANLSACMFLVFRVDLQVIKRSVSIVEGLVHARAGESTRPAAWEVLAKPHYLLATLLLCNSGAMETLPIFLDRLLNPVAAIIISVTAILVFGEILPQVRKLGVVRFGRYWLHQAHLCMLFAQLEALPGQPGMSPPFSPRPSANDMGCRLEHTFPTLAAAESSDARQVIGSLAPAHPMMPRRCPPGGQELGPCTSNDAPPVSLPSSPQRELKALVNIHAEPEEDGALSVLTHDEVQVRREGVVGLCHGQLISARRMLAGIGGIPSLPGRGMIVSGSRSTHWAPPDLPQVIQGALDMATKTADTAMTPMSKVCGG

SEQ ID NO: 9851 - protein, 330 aa, Chlorella protothecoides
MPRWEAWLRFDGCVAAPCMQLFRCTQARRGHLMPDWFRLVPCAGPWSPAPPLAANPPLPASTGLRGVHRRRDRRGDAAPRHRAWPLTRARLRPLARSSSLPPHLPDAHAEHCRRGPGQGAGAGGDGWPQAHQGHEDTRGPMPQVGWERSDVGESGSGHPAPVTHSREGPFHHRSDIPLYDVLKIFRTGKSHMACLTKVSGKLEEILELHVLWDGVPAAPCEAQSSRSIRGHWPVPLHDTCGVLRTSTLPTSSASEGSLTLKGGSIGMVSGPGGDTTASGVGPSPGLWLTLRKPSAYVTDLASCPDIIGIITIEDVLEELLQQEIVDETDL

SEQ ID NO: 9852 - protein, 472 aa, Chlorella protothecoides
  MOD_RES (321)..(324): Any amino acid
MVTACEAALEMSQGLLRELRWAGASDISEEVHSEASAARESLVSRQSEAPSHFHALQSYRTTMAVLRSQREYISQLYQQARCNVLVLLLLGIFLEAEEAELGGAVDGAIRRLDATGGEQDVGKPFAQSGLRCGALMAPSFASEPQLRRLLDAARLQGKQGLVGSGMATERLCKLLSRLLEGQPVSPDQSHSPSAHDPSHCHRPHEDAGRDLEQRRLGCRPCAACGGLGRGDRHHCARRRVGGGGPPGTLHGQVEEWCVCRGVEQQPLTNRPLISSQALRAPPCCPFSKGGTGHPPIPSSLAPNTHLMPCRASASCTAPWTXXXXSGAAAADKSSMNGFSGIAGTLLLALLERRHRAPSCPILPRAKHTPHALQGVGFVYGALDLIMGGATSPWRRSVAPHVNALGQGPQVYTFPAASLAALPPACQDDLLIQAAAEVLEGTEKDLNRDTRWRGSGSGSGELICASAGDERDS

SEQ ID NO: 9853 - protein, 1263 aa, Chlorella protothecoides
  MOD_RES (217)..(220): Any amino acid
  MOD_RES (413)..(416): Any amino acid
  MOD_RES (440)..(443): Any amino acid
  MOD_RES (471)..(474): Any amino acid
MNSTQFNEELAHALHSIWTPETYRSFYDEAYCLTNNVTLKSRSNAEGNEHVEPTARSASEPVRPSPPVIPVTNPPSPRAESFNYCSVPLEDQDSILFLALAVLFTAGLSGKLALTGVLVAGGVLGVVNYYVNLGHLGNAVSIWLGIQPPDLFLYVFLPPLLADAALRIRFSLFRKVGWGFGSWGCSGCIPSTVGTCTKHPIGSGSARCPPLWNPPVXXXXVGTCTKHPIGSRSARCPPLGNPPVKPKLPFPYQPGRAQHRHPGLRHGHPERAGADPLCPACPGLCWAGHGLGPWGSVCRHAGTHRRRLGVRPAESRCGLGEGQQSKPSQNPHPANGPELLVVLMEGEALFNDASGALNGLHAHPPEVLLRKRRPNTSHPLPHPRPAITLYSIFAEVLEEYQNQPLPPATALLXXXXNDASGALNGLHAHPPEVPLRRRRXXXXHIVVKILKWDLDLAVLLPGRMGACIKSXXXXHIVVKILKWGLDLVVLLPGRMRACIKSSLHDEMACLPCSHLPALVPHHLFGSWPSGSPDFFSRPHHQAHQHRPGHRAGIRLLHRLAHASAEVARHSRAPGCHSHPGHCLPFLLRWAGARTGGLHAYDGSGIWSSMVLEPKRCGTLHETILLPIIRIVLMLEDVLTTGALISFAPTHPPLQSSGVIAVAVFGLWGAATSLWGRFALEEEEKVWFAVWDSVSAVANGVVFFWAGVASLNFLVRSSDYLISPGWVYGSIPIIFLFMFLFRFVTILLFNPLVLKGGTCERSVGRSASNCEAHHGMQSTYAEGLEACEPFHSPHAVPSSTRPHLRVEPGTGSVCHGWGPPGGAILDPGGGPHHHIKLPLIGCGCELVAAGLPRHELYTAHVQLRALLGNTRKQRPAASQNAPTPNPQMSAARKQLRLHGLSLLQKFTDNKIAALRTDHSFISQVVDLVLSLVLPPAGANWEQVAEMTSHLAAMTSFEKASGGTSTSLPVGDRDSSATVGASGGTESTPAPTLPESGGGSDRSGRFASLQPEQAGLKSDEILLPHGQLAGMFPRSLLLVLTWLNLSTSTGVEAFSHRFAPKMLGLCFEAWTTQILLSLPTDLEAATPGQPQKSGMSRLRKLFSAPDFLQHFHRAGVASAVVPAHHESDPVPAEETVVLLYDSSNPQAPIDAQAWEAAMQTHGSLAKREHGAPARSVAVHQRMPSVPGGSRLVSQPKLFPHLDPSDLKCKGPSVLLFASGNLDHASSDSALERTLPVPATSSLPRSPASPAAPRLAATRRASAASC

SEQ ID NO: 9854 - protein, 157 aa, Chlorella protothecoides
  MOD_RES (73)..(76): Any amino acid
MLYGELGQANGSGLYVSPCRPTPDPGPSPAPSPVTDAIPLFSGYIAPGSQFIGPLLSQLAASPLRSSLEGFLXXXXRGPGSMSRPVDQRLTQAPSSAPSPVTDAIPLFSSYIAPGSQFIGPLLSQLAASPLRSSLEGFLASLKSELAVETRGRNFGL

SEQ ID NO: 9855 - protein, 840 aa, Chlorella protothecoides
  MOD_RES (532)..(535): Any amino acid
  MOD_RES (637)..(640): Any amino acid
MASTPRPWSPPSRSPARDGWGLEWVPNVVQHYRCPFRVSCTLDRVAWAAIDSAPLTVACLALPTASSSFPQPNAEGSRVNVRGLAPAPGGGLVASLAVTLDDAPDAEAALEEAQYLAAVLRLEPGQVLSPDTFGRVVAVGAPPAASGHSPATHSVAAVTAGPCEVAEAGPGVGPGDGAVGRRGDGSPGEVAATYAPAHLSEDDWDLPGTPMPGHSAASAAASPGPAISPDAFASLPTMVTKAPRPTEGRLRWSEEEEAGAAGVHTPETSPALPTAEPARRARRVSVHVPDTSVEAWEAPRVERTGGLFRRREVAVPSRQEEMLASLRSRLPDDAVVEVRGGPGAAVPGDLEVEVSVTLPARPLLESVASSEQPSPGTAAVLEAVTSSLPRGARLLDRERQSAGRARELQLQRAPASLDKVTPQDGTNKQGSVEGGVPAAPPCTPSATGGGAALGATPARSVRGTSAGTAGAGVAVLGERAHAAAGRAAAAMPAASPGAGRESSGQATAVLEVEQSEGRPAPAVDSAQGSPGXXXXEVEQSEGRPVPAVDSAQDSPGDRLAELTRPGQDWSGRTLAEVVRSHGRGAEGTAGTRCTGSDAGINCRPSQSLTLPPHHAPPPMAPSPPPFPGGVQPGPGRXXXXDPVCGLLRLTPMCMQEGPSAGGSGVREAPQASTADPLDHSHCHLTRHPLQCPPLPPPSQAEYSRVLAAELRRRLADGGANVDDVAAVQAAVDSLPPPPRAAAALEVGQALGAAGRHAEALTSFRAAAAAAPRDPLAHFRAGNACFALARYVAAATEYRAALSLCAAAGEAERPLAVKVHVNLGITLEASGLLMAACEEYE

SEQ ID NO: 9856 - protein, 133 aa, Chlorella protothecoides
  MOD_RES (55)..(58): Any amino acid
  MOD_RES (103)..(106): Any amino acid
MYAAPRFHLLKPEYIYGRMKALQRAYRLRVLLCHVDTEDAVGPLGEVSVGTPAEXXXXFAVVCSKAIQLSLPPLAFLYVTKAAIGLECTLICGFSPQECARYXXXXLLGDQGRHWTGVHPHMWLFAAGVCAVH

SEQ ID NO: 9857 - protein, 232 aa, Chlorella protothecoides
  MOD_RES (43)..(45): Any amino acid
  MOD_RES (68)..(71): Any amino acid
MYSFIITDCNLNSYESKPADSIQKSVGSDFVSTATAALTSLRXXXTQSWRTMYSFIIADCNLNSYESXXXXGKQDRCQDPRRQVPEGVSGMDTCKLTQKLRPWNLPWRLRVHRDGSQCCIRFGSMAALFSASKEELALCPGLGPTKVKRLFEAFHEPFRNTLVPQAAPEVRATSLGRPSQVFQLVDAQAAAEVKVAVAAPPDTQAQPGPAVTDPAEDPIPYSLEDEDDDDFA

SEQ ID NO: 9858 - protein, 1171 aa, Chlorella protothecoides
  MOD_RES (1064)..(1067): Any amino acid
MHEHLDLASTHPSTPLPSPTIAVLPKVLHYGLKIEVPNTPWVFDKHYHYDFDAMMCPPWDLNLTPELSAMAATVLSEGAVCHRHTPPSAPPQPSTHHSDPPAGKKGGLFPRTPHPDSFKGSDSDVLRDLLAIQTVVVLNAAFCERHEKACPPSEQLSTECAAARSTLDALQRRMKEQVDRMPDPCRNSDTRCEGWAKAGECQKNEGWMADYCSLACAGCKPKTPPARPGTKAPVLTDGEGAGLKKGGGVGLLRGATDAGVLAAKDTAKDAGAATADAAKDAGAGATDAAKNVATGAVDAAKDADAGAATVDAAKDAGAGATDAAKNVATGAVDAAKDAVTGAVDAAKEATAGAVDAAKEAATGAVDAAKDAAANIATAAEDAVSGGDSGGAVPAERVERLRARCTRQPHWSMGAVKACLAAASKGREYQHPSEASRGAGVGSETVRTLGERTRRLVAGAGQSTAGAAGSVLHTPGILARNIPPHSCTHLPPTHSPRLRGVGAGAAGAARIAAAGAQVAGHARGAGKPHLLRAAGRQVGEERVRGSDPASPNLRTPVAYHEGPSPLSRALPRMLCAIPCLQPSLHGEWEWRGFEWLRPFAWTRGRKGQARHHTSYSLRLVGRGRISFAAEQKCRPPTAGVQHALPAQASTVLSAAACVGVPRRRSPRRAPRHHAGSPWAAWRSLPSPAASPAGRARPPEALGQLRTRPRLHNVGVGGFINEGSGWGKASDALRESMPPAPTGPHPGLARRRRGFRRIPSRLPDCSPARSAPRPSSNASRARWSSCLAVSHRSSAATRPAATATAACASCGGEREDRRAALAASVRHAQASAAKPPLRPLQGGHVEPRPRHDPPPRDAAAVQSHDVRHPAPQAPDHELAVRRRALKALEHQRRAEEAVQESGARARRAGAHQVEQVAQAAGRPDGDDAGLGGGAPRCGLGVRQGHGQGGVCASRRRGDQRPRQLACRVEAGNIALGGTPVNGGGYEGEGGMQGGTKEGLQEQGGMYCWVSQVQGVKEGLGGEPPHHQASAAWAPICAALHIILPPSVNGNDRMSRPSPTCLYCAVXXXXPPGLGCLGTHLHHAPHHPPPLGQWQQQNEQVFTHVPVLRGVRLGQHVWHGGRVRQRGDQPRAGRHVGDHHHVQQRAKLGGGDARQGRVLDGGSLGHHAHQAGVA

SEQ ID NO: 9859 - protein, 87 aa, Chlorella protothecoides
MLPHTSAIVVPRPVSPLSPASQSHSTPRHTQVLLVAAHPWDVFAAMREGLQGAYVQREALAHWPTYLPTTPRYTVRSLEELAALLKP

SEQ ID NO: 9860 - protein, 245 aa, Chlorella protothecoides
MRQPRASLALVCRLAEARRSTARLMGHDSFAAYQLTDFSLAQAPSAASSFLEALGRRLAPAAAREAAQLVVMRDATEPRRHLAGGGPAPGAPLDPWDVAYFKNLARIQRRDQSPPHRGSGTTQGPAPTFLDTPHPRPQDRQREDAASAWALSCSPRQALRGLDRLMTRLMGVRVRDAALSPGEGWAPGLAKLRVSEADGALLGTVYLDFQPRPGKFPGAAHFVLRCGRGHGTDAVQVGGVRVMFS

SEQ ID NO: 9861 - protein, 219 aa, Chlorella protothecoides
MRQRLTGGRFRWLNEQMYTSEGADAQRLMQQHPAYFDEYHEGFREQTRSWPQLPVETALSWLASCPKAWRVADLGCGDAQLAVRAAQRVFSYDLVARAPGVVAANMADLPLGDAAVDAAVMCLALMGTDYPAFLREAVRILKPGGILWIAEESGQGSILEPFIAAVEGLGTELKFRDEKNPYFLLLRFKKKSKAAVADVELDEDEAAWPTLRACQYKKR

SEQ ID NO: 9862 - protein, 62 aa, Chlorella protothecoides
MYGYSYAASKSDVWHHVDHSAMLYPGYNVKGALGGGWRGRWGPWASARSPVWWAGVRCACSP

SEQ ID NO: 9863 - protein, 63 aa, Chlorella protothecoides
MDPVREQQWQKVAGLRPADLAVVTNLEYLGVPVYKRSKGMVSLGFGRKRHRAIRKVCDGGFVG

SEQ ID NO: 9864 - protein, 265 aa, Chlorella protothecoides
MAGTPPDAPSSMPSLHPITPCIPPHVTSTGQSPDVVRQLTPVIEQLLPIYTDIAKGTREFVPSPAECKDMIREGKGVNGERISVDPWRAFGGHPWWRCGVPGSNRYGVERNLLIRFASDPIDDTPQLAATLEMSSIADLLDLQQVTLPGTHVRPLQQEFGRLTSDVGKYAQAARTQSEALIDQLAQMARGAGVPAEATDGLSGFARAATGFAGAFGEAMLSSTTELDISSLADECGVFMGIVVPPPATALGVSPDAGRAGFTPRT

SEQ ID NO: 9865 - protein, 122 aa, Chlorella protothecoides
MLRGQQAELGFSLHVPDRGIVWGVLYYFPFQDGAETVPLEGPSAGPRPDAGPGMTQQYGVNPSQAPTQSLAPMAAAGSLASQADLEVGASDDDTDGELEGGRGLDTVLGGPKWTQGNACTMA

SEQ ID NO: 9866 - protein, 319 aa, Chlorella protothecoides
MLVSGTPRTPRLALVRWLHSPGFAGMGLVACPKDWETLARPRTCFATLEFPLPLPCISRHGARVPCLPATPPSHLLPTSLQLCQVLDTAEFCRNVHTDPAWRQAATAACLSLGSYVQGLNTHRGMYAALSSALRAPGARAGPPETRAVGLSLARDFERYGVHLDAGGQARMARLTAEAQSLGYELGQNLVDPGALQGFDLPSSLAGVIVVGAQGVWFLFWEVPGWSLSEGPALPVTSVSTAASAEQCTLFPGLGSGVVRGLNLGALLAQAIECLKVTHLHLLPFLCALCQQMSPAPCPAVRGCWRAGARGSRWRRMTPA

SEQ ID NO: 9867 - protein, 91 aa, Chlorella protothecoides
MQEFHLTDFTRPLESDVDLRAVPADTILHVMGHSGALAAPGQETVSFQPHPKTLTMAGDYEYFAAQVSGVALDAGVLTFFSMLIDAQAQQL

SEQ ID NO: 9868 - protein, 514 aa, Chlorella protothecoides
MPELLHLHAPPGLQGSNAAGGTREALPPITVLLADQHGNTLAPGPGDDHALPQPALRLLAGDGEAELPVELESSCSRDQDPLRIVDLVAVPRQSGLLEAQAPGSPDAPVQGGQGAGALLRTLDGVLEVCVASGGAPGLTARLPLRLRSGPPITLGLLPPHPWEGLGEGAGLEVTAGATLPGFEVQAWDAWGNRSPALPGLEAAVRLAGPCCSDAPAAAAVFPLDDDGAATIADVALICAPGTAGQAQELELRLEASAATPTLEAALVRCRAGHDAEAPALACPVVAPALGCPVVVHHSLAPASLALELHGEALQRRPDPRGTGPDLLLLPGLPAGSSLPGLRLALLDGGGGRVERSVAGRVTVSWHRGSKRLAWKGEARSVAGRVTVSWHRGSKRLAWKGEAVRLPTLPVPETATALGEASVLDAAGDLNAAGAQDATPASTEWVRFASDDGTLLLEVGLLLGVVPGPPKAWALSLVEGEAGEASQEGGEGVGAVRCGQPFTLEIEALDAHNNR

SEQ ID NO: 9869 - protein, 146 aa, Chlorella protothecoides
MKTLQDYRVHLKHRDGHFEKVPYFSLPANDLNDVIAPSCYACFDYANAAADVVVGYMGVPSLGVDMTQHLQSLGPCPDAVGLPWILFGNPSLTPPNLPPPIPSPVCHCEERARGCPPQIDRGKSGEEASGVGGQSEGAGPPDRLGR

SEQ ID NO: 9870 - protein, 236 aa, Chlorella protothecoides
MLPLSVRSRLPEGLLRAQLPVVRSVRAEATPPIIDLGVASAEEGARLDPGELGGCTQGYSSVDRRLAAGRQGWREGGGEGEDGSARLGTFKDSLGKVPTLPTLLASPAVGHPGPLYCLPALTSIPFSHTNLPPREQLSKLGAHVELATRLTASVDASRLTEFGKLEQDLVYGDATSKEVIALLSQSGSIPPAEKVGGDSERTRGDRLPARTDLVGRGPLCDMLQRSSTRAGPVGVS

SEQ ID NO: 9871 - protein, 151 aa, Chlorella protothecoides
MGLSFIDGMQDAVLTPAECPVHPSKDGIRHVPPRPSACRPNVPAAVDTVMAALTAAHPFPDVGPGVNALQAAGLRISVMTNGSAALAKAVLARAGVEPGALGPLMDINMAVAWKPAPAAYQFAVEKLKLQPYEVSANRWRERQERMRGWCV

SEQ ID NO: 9872 - protein, 130 aa, Chlorella protothecoides
MHHPTGAWRGRGRRCSTVQIHAIRDPPPPPPGPPAQPPVFNRMEDMIQNRLGSDGPQAGSRWREVAGAWVLNPPGNEPSVVVHFVGGAFVGAAPQLAYRPFLEALAARGAVVRRLAALVWRMGRETRGCL

SEQ ID NO: 9873 - protein, 390 aa, Chlorella protothecoides
MLRQGADWDAISQMMSYISDKAAQACRARAPVCIGQGDRGGVLDDGQKLTTSVATPTPQSRGLFSRGLGSSRPAGGANENTPPHPQPPPPLPPHQSPARGASSVTLGARTPRSQLARLGYDVKAVTAAVDVPVLQHLAPLAGVKPGDLVAQAHDGNVASLKQVQAWCLATLQTLGDDIAAGSRATPSLAAISVHHPPLPPSHNHTPGQAAEADACRGAAARRAPRHARRAVPAHDAHAELEGAGPARPRQDRARRPGHAAHGPCGPRDRAGMPQGTGPQAPASLSLHAPMRADPPPCRNGGARGRVMAAFDILSWKKGSAGVTVQDAQAYVATLRRIFSPGHEEGGRRDSGDETSDSPTLDEAGFLAAVTNAESGFAMYEVLPALCHSLA

SEQ ID NO: 9874 - protein, 178 aa, Chlorella protothecoides
MSQAGHLALVTGGTGFVAGELVKQLLEKGYQVRTTVRPGTDASRLQPLKLLAQALPEQAFHQAVAGAEVVFHVASPFFIEADDPQAALVEPALRGTASLFAAVAAQGKGAVRRVVLTSSCAAVKGMHPAPPKDGRRYTEADWNTTSTVEGGQAYWVGKVRQQNTWVCRGKGDGVQLAD

SEQ ID NO: 9875 - protein, 406 aa, Chlorella protothecoides
MAARARLVAALADTPAVPDMLAQSHTAQYRHDDMERGADGCPGRRGLVVGWLTTQTFLHTLHLGHPAIHSSLFLQALFGPTLHPSLPLVPPSIHRGPTQGDIPGFHAAGELARALVASASAGTDPPLPVPLPHTKAAARGAPAEAGIIPIWPPGCLGYLFNLVRPCTPGTRAALLHGLFGPALVFESLESAAAYRELVVRRLRGGVSDIVTLDCRRITGRGIVSGSGFNVPPLERAEWRFGSLGGGQACVLPGASRAELRGTLACACLTLAAKAARRSSRSPPQEAQAAVAVAAGRVAALERWLTARQELQRARDAFEEGRGALRAGEQSGRRDGMRRKPRRRRARPGWGPDEYAAAQEPLAAELDQLGTQLGTVEIATQPRGTRRDAGERVEETAAAARPRKRRR

SEQ ID NO: 9876 - protein, 218 aa, Chlorella protothecoides
MGVTTEVLYARVKPPVPGAQWTGVVTQVRTREPWVVRRLSHESCKASPVASLSPSLPTKSTVQIAVQALETGLVEAVVCVQSEPGDHLAPLPVSGGIRGGTEEGELRRGVRPGSASVQLSHPPTGSPTDQVVARSVADIVAARGVKPSLSPNLNTLALVESLGIKRLLFIGVGCQAWAHAIPTMTILAIPLSSQGASAEACGEAPGAGSAICPWHQLR

SEQ ID NO: 9877 - protein, 398 aa, Chlorella protothecoides
  MOD_RES (258)..(261): Any amino acid
ARRPGRRARAGAARAAGGAAAAPPDRAPAPHHLRLRLPRRVRERAAHGLAGARRGGRGRGAGARWPPGHRRGAGAGRRAERVRGWLREDLAGPAPALAQRRRRRGLAADTAHARVPARAPAGGRGQRHHLQLGVVRAARGRLLQGRHRVRAGGAPAPGVPGRQLRRARGPGRGGQAVPQGGVERYGGAHPRLQVPVPGRGRPRRPAGARAPRRAPPCVHAAGPPRRPAPRPARRRWAGGRAGRGVSVRVGGHRGGLRXXXXGRRHVLRDVVGLEDGLGVECLSGSGAIAGAYARAFREGWTLTLVSGRSVGIGAYLARLGRRCVQRREQPIILTGYAALNKLLGREVYTSQQQLGGPRVMGANGVSHHVVEDDLAGVAALLRWLAYTPARLGDAPPAL

SEQ ID NO: 9878 - protein, 166 aa, Chlorella protothecoides
GRSGAGGDEDDGSDDDYEPGGGQAHGGGGAVPDAGPASGRIVVEAILGWRWAAEDQALGDARRSPGPAPEYLVKYSGRSHLHDEWVPEAVLLQIAKRKVLNFRKRAGGAPVVLADPAWCRPERLVARRASPAGPGWEVLVKWEGLGYEAATWEAEGEPLLTAPEAA

SEQ ID NO: 9879 - protein, 264 aa, Chlorella protothecoides
MTPPLSQARELLERIEADQKLLVQFAEEKVQLAMQGYDLLDTHLLSLDADAAALAEELQANASLNDAFGPDAGFGGNGGAFDDPGTAPRTARLRDLSSYDSLEAVTDPRWNKEQAGLIQAQARCQAHRAWWNGNAGICRGSAGPSLIASQSLMDPSTAGLSVHRPEVDAGPLPPAVGGRHDAAGLRRWRWHGGWPAAAVLGRTCVWRGGVEVLRKRGGERTGGKTYCWQGARQTDRVGCKVCGRTAACMSLRPTLDAYPGMPAP

SEQ ID NO: 9880 - protein, 608 aa, Chlorella protothecoides
  MOD_RES (246)..(249): Any amino acid
MERCKAQSEPVEEEQRRNRVPGARLRAPGRAPKAQQLSPVTSETPSHAYITALHLRGIHAAIRRDVSHALLKAELLWFTMAPPLEAALLGRPGAMVEDNYSTDAYSTFMGGVDRPLPGVQVTATTSSSPSTPETLFCQVLLGAGHRHARYCNSSEPLKGTELVCRCKRFRLSPHRILEVLMEPGGHFGVRASRSSMELVDLGQSRCDRLALPCPPPQYQQPLIGVQRRQRDTEKPMRRTTPSTLTXXXXSVRQTSPPMPAAAVPAAIDWGTASTAGHGEADEEDDPFNFDDLDASLDALEAERKARAPSDMSHGPPHEKSSAALDSREEAPAGASAARADRVAAPLPRPGHPDAEPATPGTVCGVQPRAQLPCFYLVCEEDGAAGQARQQGHGNSVPGPQSDSEEGPAAWEGEAWEADAVLRPGGPDAAYLRFTKVLGRCGDQCIRYGYVGGHGGNRLGWPVSRGCGNGGFTQQWMSTHGLAVEPFGGRVCGWMVMTVPPICVCPHPHVWVLHKLHPRFNGQLEWPEDARPQPPPCPLCGAERVFEFQVMTPALVALDEAASWSGVASTIPISWSWMTVAVFTCSAACQPSGGDQQGCCEEWTAVALE

SEQ ID NO: 9881 - protein, 234 aa, Chlorella protothecoides
MGSSCPASLPTCHPNPDIMQLACSSSVRLTGPRPFSATPSRHGRSRAPCPRIYAEDGAAAKKVAEKKPESKKPFSPPTLDPDTPSPTFGGSTGARRERRGDLGFTISPPLLPGGLLRKAQVEEFHVITWNSKKEQVFEMPTAGAAIMREGPNLLKLSRKEQCLALLTQLRTKFKIDGAIYRVFPNGETQYLHPKVHWAVQRLAVGAGLATMAGDHGGEALPVMWWRACARELCT

SEQ ID NO: 9882 - protein, 401 aa, Chlorella protothecoides
  MOD_RES (127)..(130): Any amino acid
  MOD_RES (246)..(249): Any amino acid
  MOD_RES (308)..(311): Any amino acid
MPYFATLVWVAGLLLNPAPRYPLPKDGVYPEKVNPGRKEVNAVFRRIGSNTNPAKVKFTGKVGLCMPPGATVLGGRVCSWGSLAVGLWGRTGGRAADLVRGALFLWSNHSGRVCSGMHGPPGLSFVXXXXRPGDRLFWVAGCAHGDRSLWVCVEGREGAQLTLFGECSSSDVRGGGMGAVSHQEQGGACEGMHLSGSSRGHLRPEPPQFLLSPLGVHRQASAWCRVTSMSEAAAIGERAWDTRGLXXXXFAADVRGGGIGAVSYQEQGGACKGMHLSGSSRGHLRPDPPQFLLSPCIMSSCTTLCREXXXXSKPGLVREGFLGSLRWALPHPVPCTPRPRALGPVHLPLFPKLGRELLVRLQVVLRHCRPRPEQHLFEIPERDLGRVHLAGEESSGGAWVS

SEQ ID NO: 9883 - protein, 247 aa, Chlorella protothecoides
MPQDRAPDWFYATCEGCMVPNDLVRPLTWRTRRDLRSEGEPSAPWNSGLYAIRAESRASRSHRGHTSDMRVRSGNPHRLQGQDHQALGGGRRWGVHRGINVCESPGLVGRSWEPAAAHDKLFCLKCAVAFLAARATSPDSSRMQVGHTDFVSALAFAPASSIHPDGLLVSGARDATVRLWNPVRFTELQILEGHKYQVGGGKMGVQAGQLGTPALASQLSHSSHYSCYFADLRPHLLLPQPLLLPRL

SEQ ID NO: 9884 - protein, 341 aa, Chlorella protothecoides
  MOD_RES (63)..(66): Any amino acid
  MOD_RES (90)..(93): Any amino acid
  MOD_RES (129)..(132): Any amino acid
MSGFCEHPSPRAPASPVRHTPSARHMGAGPATPWLCVDGRVPAGRRPGHGVRRRRGAPVHAGXXXXDFLPDSDLVTGCADGVARLFTQDXXXXPPWKWGAHRVAQSGVLHAGVSISGHSTVGASFSHGXXXXPHGRRGPRRCRCAARSGGGGGRVLGEACVLQCPWKWGAIVWPSQGCCVEASASLGIPPSALPSHTAHAIAPLIPSFSHCQVFEATLAAAAEAAAAKEGAGEGGAAAGLKLEDPSVLREPGTHPGQTRVVREGGTGMAYSWNAARCGGGVVEGGGGSEGVSMGGEEDMCWVDHRSVGRARRGAGWGSRGVEWRWRPAGAAPTCKARRAEG

SEQ ID NO: 9885 - protein, 61 aa, Chlorella protothecoides
MVDDIIAGWASELEARSASFTKHAAALAEWDAVILSNRRSLLALEQEVRKVRGEGGGGKEL

SEQ ID NO: 9886 - protein, 222 aa, Chlorella protothecoides
MLGATNLPYSLDQAVRRRFDKRIHIPLPEAPARASMFRIHLGDTPNALTQREFDDLGERTKGFSGSDVAIVVKDVLMQPVRKTQVCGDRVGVEAGGRLERSWTCAVHRSVKGDEVKRLLLRPACSTGVASNASLGFPASLPLPSPLHPLPTPVFQDATHFKKVQEGGKVMLEPCSAGEPGAFPATLQSLADKGQAQLVLQQDLLGLHFIGRHERSHRLTSVA

SEQ ID NO: 9887 - protein, 210 aa, Chlorella protothecoides
MLTSCPTTNAQHAPVYTIGKRGSSRDFRSTPDQIRDLGAIIHSSPRGGEVTFHGPGQLVAYPIVHLRDRQLGARAYVESLEDALIDSLREYGIKARVGANGAACGSGRVPGGTGVWVGDRKIAAVGVRISRGVASHGIALNVCTDLSWFRHIVPCGFRDKGVTSIAAELGRANVGVEEAAAVFTEALGRRLLYGTLESVGEAIPAVVGAI

SEQ ID NO: 9888 - protein, 160 aa, Chlorella protothecoides
MSRWGGGVVTWDDVAGLESAKDALKEAVILPVKFPQFFTGKRKPWSGILLYGPPGTGKSYLAKAVATEADSTFFSVSSSDLVSKWMGESEKLVSSLFALAREKAPAIIFIDEIDALCSSRGEGESEAARRIKTEFLVQMQGVGHGDDKKRVRGCGAGTAL

SEQ ID NO: 9889 - protein, 81 aa, Chlorella protothecoides
MAYHHLSAECILPPLFLFLQVLHAQEALERKLAMLDTHQRGIHETLTGMEHEAARLALEEAGLQDEGTRCEAGEGILWKGG

SEQ ID NO: 9890 - protein, 94 aa, Chlorella protothecoides
MHLGVQVLGLAVGEDTVDGTVDLELGAQLGEERQALLLTGQLQKVGALTHDGRACCGHLEHLLLLGVPGDHMELLHLSLAEQATWQERWRDRET

SEQ ID NO: 9891 - protein, 818 aa, Chlorella protothecoides
  MOD_RES (231)..(234): Any amino acid
  MOD_RES (599)..(602): Any amino acid
  MOD_RES (659)..(686): Any amino acid
MDRTVKGQRGRMLVSPSRVLGLWGGLLSSPRSKHLTRAPGAAHRSRHDLELDRKSYLRLSWMSLKAARDRKPAARRAVWVKAGASAGRKTLQHAPRNMQPCTKCAVSHMEGQWHASRFLPRAGPRPPPLRALLLGEVVELIQARLSQLLLLPHGVSVLGCGAQQEGATEWLCGAGRARGGISCRQARARGGARRCGACCGCWCGGGGTHAGIIRTPSARSSLFIHHSNESXXXXIIRTPSARSSFFIHHSNGSCLTGSAVHSSRVTHRRRRHGRSAPRLRSACRSGGGGVVAVGVVGGPAPLVLAHILDRQLGLPAQLALGGVGGGPHRLGVARPPPHQLGLHLEPAGRLKTLQSRWLKGMKGGGGVNTRGSAVRAATRDACFDRRSTPRGCLEAPQAHTPTSPTAWPRDAAPPRPPHRLPPPRATQITLMHHSSPTHVDHLEDGGALARAQVVGHGAQALGLLGLAHRAHVTLRQVHDVDVVADAGPVLGRVVGAVHRQLGAVAQGHGLYPGHQVVQLHLVLPDATLRNGRRGGGGWGGWRQGASPGGKDGASGVRGQMGAASSTRAHQGAQDTRDTTAHGLEPRHDRPTLPARPHGXXXXASPGGKDGANGVRGQMAGLNDQAQTLGGNQAAGRDDLARRSCRRREQPRRKHCPGCXXXXXXXXXXXXXXXXXXXXXXXXXXXXPPSPLTRGVCADGVEVAQEDDAPLLVAGVQVTEDVLVDDLGAAVGGDGAQRVALVDGDALGVTVHGAGGGEDQLLHAVLLHGAGQVHRAANVVVVVSKRVLHALVHILASRKVHHRGEPGYFGGGKGAGECG

SEQ ID NO: 9892 - protein, 640 aa, Chlorella protothecoides
MPVGSLVLGVDLVPIRPVRGARTLIGDITTTETRAMLRREAAGALFDVVLHDGAPNVGGAWASEAYSQSALALEALRLASDTLAPRGTFVTKVFRSKDYTPLMYAMKQLFRSVEATKPAASRSTSAEIFVVCQGYKAPARIDPRLLDPKHLFKDVAEAPRNAGPDALVKQKVTQRRFREGYEDGLSSLHRTLPAADFVLLDAPIELLGKYTVLDLGAEAGAGGEGEGRELARFVADHPATTPEVRLLCGDLQVLGRSEFKQLLKWRLTLKRDLAKRAPAAAEAGASVKGAEDGKTAEDEEEDAETRLLREMGEIKDRMERVAKKEKKKRKELRMKARLRSAQMAEAEGIGEDNGPESMFSLASIKGSRQAVERLAAAGVPDTEDLDSGSEAGDVAEDPGTESEVDSEDEQRRYDAVMDEYLETSYQSWKERQRIRGKGGAARKRRRRVGMEGDLSEEEEEGADAGDEPVVLGGYSDDDDDDTPGDGGGLVVELDESKVGVATSAAAAAAQWFSQDIFADADISAAAEGDDAGGASGDMSGVEAAPAPAPAVKKAGQQRAAVPAAPEPSDADPEPLTGGRSGGASRAGFEEVPAKDSDSDSDSDSDSENELELLDDDAKVGRASFVECGSLVGLVYKLLCG

SEQ ID NO: 9893 - protein, 1239 aa, Chlorella protothecoides
  MOD_RES (71)..(73): Any amino acid
  MOD_RES (92)..(94): Any amino acid
  MOD_RES (169)..(172): Any amino acid
  MOD_RES (215)..(218): Any amino acid
  MOD_RES (383)..(386): Any amino acid
  MOD_RES (901)..(903): Any amino acid
  MOD_RES (1119)..(1122): Any amino acid
  MOD_RES (1144)..(1147): Any amino acid
  MOD_RES (1169)..(1198): Any amino acid
MAKHPMEGFDFDTDKEDLHEIREKLDGGSPDVSTSSLDPVDLNGGNGLEKNGQGSIKALHVVAEEGGQGGXXXSWSPLIYQSDPREAGRWVXXXHRWGASYKDQLKILFQRSIRTRRFQVRDCVPVIAVDGVVQFEGGGKGFLRHAVFVCGMLPMHHHVPLGKRVQLVXXXXMAVDGVLHFEGGGLGFLRHAGCGCGMLPMHHQIPLGKRVQLVXXXXAGNVELLRARHRPADGDRRALRPLLAAEGPGRHPPVRSKHHCCCQIVFAHSTIKSPPTPQTLSHSPGLLFFEIMFLAFRMLFVALFTFPEEQRMMLKERASGMYRSAARQSVVGGVDGRCSCVLIEDLGVRGGSVTQQHRGRHLVGRPQLGTWRTRSPTHFCLPXXXXRQSVVGGVDGRCSCVLIEDLGVCGGLSAFYFARLMSDWPMDFTIPTLFIIVVYFMGGLRYTAGAFFANYFTVILSMLVAQSLGGVYRGVACGSVTAHWHDGHEPQDGTDLRHHHHAGHGPDRRGACAACGQPQPFHPIPHCKGFFVVGLADWIGWLKYLSFIYYALGMVLYFEFQGRTIYSCMEQGTDTCVLTNPSDPSTSPECTPVTKEGAAFWNILKLLVQGVLPTNTTPPPPPRHANTACRTRCSCSRTPTARAKPSATGSSCSASSSSSASGATMPCGARLRGCEGPEARPTLHGTVGAGGSARRSRTCSVGGATPVHPNSTRVLKDVLIHLSRRDTSVPHLDIPSCHPTLVPETSAHASAHQCMSSAEPVSPRHPAARLHDDVENMKIHRQLFLNLAVCKVQWLFGSLPGFILFGRSGVWQEQEACHPITESSNGKSCRPDELPLYRRSVHHAPLSQPPASAVPPLGFSTSRAGVALRYLSSLGQQQGRLVALVPQGSVLYIFGSTPPRXXXSCTPFTVACIGSATPGAQYLQSRRSPEILEQPWTAPRATGYTGSSRQRPLHIWLNPTPEGLHVDGAVSRDIDELWESKTKSYGYHNTLPIEEAALIDLFTEYHGKLPTCGRLEFKMHPDRIRTPPQGSFKIELQEGGGWYHLGCGVRSPASGSHEILRRTGCDREGHFIGVKDVRKCQNMPPDLAEAACHIRNSGHMEKRPYSYLLPAPPLTALVXXXXSDAGPSTTGQCWCCNCIITANXXXXQTLGPAPKYNAGAATASSPQIXXXXXXXXXXXXXXXXXXXXXXXXXXXXXXVPPDLAEAACHIRSSGHTEKRPYSYLSPAPPLTALVQAASP

SEQ ID NO: 9894 - protein, 255 aa, Chlorella protothecoides
METPHLSTDAACPIFSPWGSPLPPPPPPPTTPSSIPQGRIGEDQVKLNNLMPWVQAVALGHRPELAVYGTDYATEDGTCVRDYIHVMDLAEGHVGAVRKTEETEGLGTVAYNLGTGKGTTVLQMVHVSGRGVMHEGDLGGTRGRKAVGWARRGGIARPRCGHPRGVERLSKQASRVAALTADPRGFEAASGLKVKTKLVGRRPGDAEAVWAATDTAERELGWKAKLTVKDMCEDQWRWASNNPDGYDTAATAAAR

SEQ ID NO: 9895 - protein, 176 aa, Chlorella protothecoides
MALAKKMLRRRVKDDIVEAAYNRYAFHDTGLPKWFEEDEKKFMRPAPQVTPAEYKEAREALRSVDARPMRKVAEAKARKAKRLGERLSQARQKAEAIAKSEDGSAGAKVKEIEKLYKVARGRGRGKKKPSRSDQYKKKGPPLDARMRKDKRGTDRAAARRGEKKPSRGGSRGGKRR

SEQ ID NO: 9896 - protein, 380 aa, Chlorella protothecoides
MGIDEDQKAREAGTPRVVPSGTSYGSDGHRNASFLERTHTVKLQIGQTDIGNLSIIESIPPNKRVVVQINAVSAHVPNFFSGPSWTSKLNPATWRKSSAATPVDDRPTMRQGRIEPGEVLALMGPSGSGKTSLLSIMGARAQKLMKVSGSVTFNGAPLTKRLKRQVGYVLQDDLLYESLTVEETLGYAAALRLPREMSAADKAKRVDDVITALSLEGCRKTTVIGGFFRKGISGGERKRTSVGHELLINPSIMFLDEPTSGLDSTTAMHLLQMLQFLAKGGRVIVTTIHQPSSRIYQTLDNLLLLSQARGPVDNNLPPILPQNPLTGHCMYHGKAHHAVDWFDALGYTLPYRVNAADFILDLASADVSTEGGRDGEETRK

SEQ ID NO: 9897 - protein, 842 aa, Chlorella protothecoides
  MOD_RES (190)..(193): Any amino acid
  MOD_RES (778)..(781): Any amino acid
MEDEQEPPPADPACARRPGICAIGAGTGAPGQHPVHGLPLFPPPNMHSLAAHSAFAQGKPACPPGVLPLEVSAINSSAHPLSQMAIGHWPEVLFPAFSSLQLQPGFRPARVLLMSLKRTHLMAWARTFMGVALSGTQPTDDLAPIVFQSESDSVWHQIRASGRGCGECSLRLPPMQGGDSRALALRSLSXXXXIRASGRGCGGCSLRLPPMQGGTAGALHCGACQTGGQPGGQAIHSLACLPLVASVEPGGTGGVRVALHQQAPGSPGDGPRRPPHLLQPGRRTPFPPAPLCTGASERGEHIVGRGLSPSLRSALNHASTCLGMAVVRLSWHRFGALLHPSNSCAVWVEASHPAQSACGAQHHPAPKDLQSPNPESGGARRHAAHAGACPCQGLGWHSASLLDPSTLLPTQVNMVEHSNDTPMAEQMRSVASTSVLVSVHTSALAIAPMLRPGSIVVELLQRNWRYQHLDESFKVRVVGGLVGVMGEVGGWLERGAPSVGGSCPALQQALIGCTACGGLRGNAVPWRPQFHPWCGAWLCLPAFSVPTASQVSPRVTGSAFGASPACTPVPRTSSPSPSKPQQAQTEVMGDIHHFAWRATQPNQTVYLNPRDAVRFGDWTTEMVRGDSRTLLDSVWFWGLVGVLWRPVKQDLAGLGVGLGPRVGAAATRKEAACLQAWRAWKLDIAASAPHVWKPCVRHGGVRGGAHHSGRGGRRGGRAAAAHRPTGPDTGRGKRGGGKPPLAPAVAGWCGRWGVRQESSRDGPAIAPWPYLSLSSGQXXXXWCGRWGVRQGSSRDSLAIAPSPYLSLSSGQGTGWLQGLLKALHELTCASQQNPLYLPSTRG

SEQ ID NO: 9898 - protein, 311 aa, Chlorella protothecoides
MKFGGSSVANAERLREVASIVCSFPDHLPCVVLSAMGKTTNLLLQAGEEALHTPAGEVGALAPLAAIRDLHLATAAELGVDAQAVRGVETLLTQLEQLLVGISIMQDLTHRARDSLVSFGERLSTRLFAAYLRAQGVPARQHDAFDIGVITTDVFTSAEVDYEASLPALREALRLPGSGGPRPLPIVTGFLGRGRGSGAITTLGRGGSDLTCTLLGAALGLPEVQVWKDVDGVLTSDPRIIPAARPVAQLTFEEATELAFFGATVLHPQAMQPAQEVGGMGVRVKNSYNRWRWDCCGCWVLGGRLCGNGGK

SEQ ID NO: 9899 - protein, 234 aa, Chlorella protothecoides
  MOD_RES (82)..(85): Any amino acid
  MOD_RES (226)..(229): Any amino acid
MPRSLKQFLHECTPFPPFSRSTTTSSPTAGASSTTRMQCARSLASWGRLSGAGRIPKNGCSECSPTPPPCTSHRRNTYPGTXXXXLGVGMTMPLRACVFLHHLELSFVRIDELRIPKNGCSECSSTPPGLAPTAAEIHTPVRRYCHVGHAVRLLGDGRVEVQRDTSLALGEGTAMPDIMPAVAGMITAVVPQFTSKAVSGDWRGGWVHKVIVRRVSGRESPKEMEXXXXPPSLA

SEQ ID NO: 9900 - protein, 99 aa, Chlorella protothecoides
  MOD_RES (5)..(8): Any amino acid
MVLSXXXXVPLKTKVTPAMFVALCALWHGPLLLHTRAPRPLVHAGAGHAYYFLEDVYPRMSGGRRPLRTPGILRALFPANQVIPAAAVQQPPAAAGPEG

SEQ ID NO: 9901 - protein, 645 aa, Chlorella protothecoides
  MOD_RES (53)..(56): Any amino acid
  MOD_RES (441)..(444): Any amino acid
MVAPPAPQVFLGRPLPASVTIVEVWASLFAGLGRYGVEGHPPPCIPFIGAPKXXXXPSLRVGPRDGLQNEATPIPTATKVELIERLAAAGLPVVEATSFVSPKWVPQLADAAQVLAQVRPRPGVRYPVLTPNMKVRGCCVNRALYCGCPAANLQPAALGRETASLPPAAFSRDQRAKNGGPPACSTHRIPAPTLTPCPAFYLFYTPQGLENALAAGAQEVAIFTAASEAFNRANTNVGIDDSLRRLADVAAAAQAEGVTVRGYVSCVVGCPYQVTQRGRFRFVGVSAGRPSGNACVWRGGCAARAQRRPPLPEAPDAGRACPLLQPTGSRKDARLAARHQPPSFTTLRPPPRPAPSSQGHVPPQEAARVAQALDQMGCYQVSMGDTTGVGTPASVAAMFEVGRGAWGVRPGWVLRTAPIPPFILTVMGSLARLACSHPSAXXXXCGQLRFPLSSPPSWGVLLASHAPTQALTSEFLPQAHPHPHPSSPFLPRFPGMHQGMHQGGARLPPGRAHARHLRPGSGQHPGSAAAGRGHPGRLGGGAGGLPLRAGRHGERSHRGCGVHAGGDGRGARRGPARAARRRRLCVRRPGQGQRQPGGHRAGEAAGQGSGGACHRSGLRKGGNVGCGVGSGCERARRVAVPLTDL

SEQ ID NO: 9902 - protein, 264 aa, Chlorella protothecoides
  MOD_RES (3)..(5): Any amino acid
  MOD_RES (79)..(82): Any amino acid
  MOD_RES (133)..(136): Any amino acid
  MOD_RES (193)..(196): Any amino acid
MPXXXSALELVSTRPRPSPPLHSPSNPAHHTAAEGGSFQWCAPEAILGEPSTVQSDMYSYGEQRWSAWITRVVCKQGGXXXXPAKSGKARVSDTPAAAALSSVLAVCTLLVRAFTRDSSRRGCLACPSNLATXXXXHSWTLNKGRSILYQTSTTLHMPGVVLWELITGEVPVRGHTREVRTPEECPAEVAAFXXXXLTYASTSARMITALRTSLQLALPCRTPEECPAEVAAFMEQCWERKPSDRPLAQEAVALLRRLYCPDQE

SEQ ID NO: 9903 - protein, 785 aa, Chlorella protothecoides
  MOD_RES (649)..(651): Any amino acid
ARRPRGGWPTTPPPAARWRGGAARRGAGPRGGNGRAKRASRPSSPRPCGDPSSTSPARPPAEFLMGGPCSILNPPALDNPFPPSITTHVDVGCLPYSGVSQGRANRALTVYARFNGRLSSRKCRTVVDMLPGSFVCFFFRRAAGAAQRYWLSLRRLLAISTSQRSPIDHSPAADARLWPWTATPRSISSLPFPSNPPSALPPIQPPTSNPAHLVALGGVLKVGPLHDGVHGACLLAEAAVDTLGHVDVVARGPARAVLPLLRLDGDGLGGADGLAQLAGDAALLAGGVAAQRVLAAEAGADGRLLEGVVDGHLGLEEDLEGHGQPTPQLREEQGLGALVQHACQVTGGLALAGRELFGAQAGSPSNACPELEEVWAWGRTAGTWIHTQGNPTPHEALALWKAPPHPDAHAGAALGTNRLPNCRSMARLCGNRNRDLQNATFGAQAKTGPSAGIEHRMPIAPESANPLMQKRWSRCLYLLAGVGGSLCYAKLLDEGSTSLRHDGFDRRVCEPRLGPHTVAVVSSTATTGSLRPACRLQAGIPTRELCTSSSRRKHFPRAVGCGGACGPDLHRAAREVPGHQVQPGLHPQRADQGQGDSGPHEGDGAIGALYNGAAHLPPEGGASAAGGWGGSSVVRWTVVPPVPPFLVRXXXQHIYPQKEVRWLPVGGEGRLLSAGQLSLLCPPSWCMSSMAPPSPNFAAPGLDSRRPGGGRAVSLPSRVLPPRRNGHLARLPRLSTLPQLLARHGEQGLQSPCIPLCLCFGRLVGPPSAPCLPWPALPPTNSGVD

SEQ ID NO: 9904 - protein, 91 aa, Chlorella protothecoides
MVVTERMMGGDLWHALRRGEVAWAERGWRLAMDIASGLAYLSTRRIVHNDLKSSNILLDGEGRAKISDVGLARIIPDSRSYLPSRSGESGM

SEQ ID NO: 9905 - protein, 258 aa, Chlorella protothecoides
MLRQLGSRLVPRAAPACASGCGGAFHSASASCGVGLPATPNPERLDESGEARLVEGLMIHLPHPGSGAWTLSMDPGACGSTPCPHLFQLWTGIGGTAGLSSKEFATSQREAPRDLAGVLDESSQTLFLTELWRGLAMTLKVFFEPKVTINYPFEKTTISPRFRGEHALRRYPTGEERCIACKLCEAICPAQAITIETEEREDGSRRTTRYDIDMTKCIYCGFCQEACPVDAIVEGPNFEYTTESHEVGGVGSWGLYRG

SEQ ID NO: 9906 - protein, 128 aa, Chlorella protothecoides
MQRLLPHHILATPSTIAFQVFAGRLLNGEPVAIKCVRGPSPGAPLQLVSEGCLAEEARILKHCRSAYVVSFVGMAVDHTAGELYLLTQRMVGGDLHGAIRKRRVAWKDGGWRIALDIARGLVYLASKR

SEQ ID NO: 9907 - protein, 170 aa, Chlorella protothecoides
MQPALAQRFSALEELEQGSATSGSGGLSAGAIVGIVLGSLALALALAAGLVLAGRSEKARQVFAGHLMNGEPVAIKCVRGPYPGTPLQLASEGCLAEEASILKRCRSAYVVSFVGIAVNPGAGELYLLTHRMAGGDLYALIQKRHVTWNSGGWRIALDIARGLVYLASKR

SEQ ID NO: 9908 - protein, 190 aa, Chlorella protothecoides
MEALPAVAETVLPGGNGEAEAPLDKNPGLRHYDPHRDVILRVEWITDQAMQILVLTGAVLLAAVVALKEVKGNDLVFMPTIPTMNLVFGTGCMLELLFTCAIFYARVVIANRSGKRWWVQTGEGGRGSEPMQPATLACRDPKRRRAVVLTEIELGTQTLNMAAFLTTNAIQLADRCTFFPRSIVWLGLVQ

SEQ ID NO: 9909 - protein, 286 aa, Chlorella protothecoides
MSNLQVEIRTSMHPDRVVPAKFLTTSCYSTMYALDGLLPLWDRWQDIPPSEPAHFPRVNEDLLFSVDPTCGAGDAIVGRYSGLEELAGDSALTGSGGLSAGAIVGIVLASVALSLALAAGLVLAGRSDKARRLASEESLAEEARILKHCRSAYVVSFVGIAVDSGAGELYLLTQRMAGGNLFGIIRRQRITWNDGGWEIALNIAQGLVYLASKRYVADQGTGLLFVDVERESGMFFLLVGCVDCERGISQAVKLSVLRFCDVKHNSRITASPHPRHNIPAASCTMT

SEQ ID NO: 9910 - protein, 305 aa, Chlorella protothecoides
MAAACLFLASKISDEPRSHQQIAAELLKEWYGRPLARARLQADPDWTARLFATVLDGECLLLHTVGFDFDVDLVHSRLVGLLRSPRFRHLLAVPALHQQMLSSCNDILVHDSGLLLEYSAGEVALTILYFFLKLHRQQGGEAVAVLEGKEDAEGRPWFVQDGLAPERCQAIVNRFMEKLYSRVGGGGAAEQGGAAGADSAASSQADATPGMAGHDSRGSAAAWPGPEAREGDGGDGAAAPGQAATGLKRGGGAPGGEEQPPKLRRTGDSPQHRPGVPPRIPPGPLPHPGPQPDPESSPEEGELPC

SEQ ID NO: 9911 - protein, 185 aa, Chlorella protothecoides
MQVDPDADLVNGILHASSFTFDLDPETKQRIVLGAGRFGQVVAGRLQNREPIAIKCIEAPPSGPSLALEPGSLLAREVQILRHCRSAYVVKFMGIAIDPGAQEVQLITERMAGGDLMRLLSGRRIPWRSRGWKLALDVARGLVYLASKRWVRSRPSRQGRAWVSPRGTPGLGLVGSWVCRPRLAW

SEQ ID NO: 9912 - protein, 270 aa, Chlorella protothecoides
MSGVLIVGAGFAGLAAAQTLRRAGMSPVILLEAGSHVGGRARTLRLDRGLALEMGATWIHGLELGGGEGPNPVLRAAQRAQLLGARPRLSVWEDSHFLVQGASGLLTQEQAACIMHSIAAFEEGLDAAGGAEEGATLGDVLQAAWDKRSSGQKVAQHADLARRVWAWRESLQRAIDGTDCSGDLSATAAARYAAAVQNTNAPIPGGFQAVAEAMAEGLDVRLHRRVTGLDWGAEGGACATCEDGSRHAAAAAIVTVSLGVLKVLEGEGGG

SEQ ID NO: 9913 - protein, 151 aa, Chlorella protothecoides
MAQLRMGTVDKLFLEFYGAEDSALDQEDGAAPAAAPDSGDGADVVTYALLWDPASTASADSALPDWAQGVFSIGFGGAEVKQGAQEPGASPRPVGVVWLAGEAARAVEAASDEEVLGTLRATFRAFPGAVLPAGASWRRDGDCGQAVPGVL

SEQ ID NO: 9914 - protein, 338 aa, Chlorella protothecoides
MLLGEDLSLDFEPGPGDDQVLISIPARPDLPPVAGTFLTTACFSTVILLNDTLRMWESAADIPPSPTLDPVPAVDQAALFNVGPGCGGGAPTVAVLSSHRGEPEGTLVEQSVQMPADDSSSGGSSLSAGAIAGIVIGSVAGAAALALLAVFLIRRRGRGRAPAARDEAWGDAASAKGGLTDHSDALSEQWAWGRWKGRTGGFRGPPWDQVHAHWSAGSASRPSLCASGAMVRGGALPPVCAADRCDLRSPPTRPLPLTPVLPSVVPTRSLLRQAVAVQLGDAAEHPLWGLRLQPGFAAGVQPNVRPRLRGAGDPGGGTIRQGVCWADRATRAGGHQVR

SEQ ID NO: 9915 - protein, 100 aa, Chlorella protothecoides
MSLDTVWKRGFSSPPHSSAPSIPDPFADAGDNDVKGKDAKDYVHVRVQQRNGKKCLTTVQGLPKKFDLDKILKALKKGECRHAVGAAGRYLIQECEHASR

SEQ ID NO: 9916 - protein, 457 aa, Chlorella protothecoides
  MOD_RES (220)..(222): Any amino acid
RLDVDGLDLVVPRPDHLPPGVHGGHGFVAAQLDHDAALVVADGDGVGAARVGHCPHPLHAVVQAVLQAVGGGVPGLDAAVLRPGQQQRQLGVEPHRRDVVGVPVQGLDAGLGLVVPHFHQAVVGAGGQVRAVACGKAHDPCVGKRPRIIHTPFHTSGVVVHAVDALLVALQREVGHVAADAPHLLGEERGKGLGIHRLYCMVGTVTGPFRGLASANPPPXXXIHRLYCMVGTTTGSFRGLTSAPPPSSNDRQLPGDQHRLPIYFPPASQQPRALTVRSREAEAKLDQHVVRAGEQVGQRGVHRQVPGNQGWGSLGCLDGWSEEYDRVVSPQRTQRKTIDEIPTVQLPFPPLPHPSTCDVRSPDVVGVCLELLHLVHGVVVVHPDVHVVGAADHPLLARDELGGPHRQVCDLKGLDQGTLHVVPDVHIAIVQRGKDPGGVGEARVGDPHPANAHGCPS

SEQ ID NO: 9917 - protein, 277 aa, Chlorella protothecoides
MAHGPAAGPGTPSPAHENMLPSPQAVAGAALDCFAALPRTGKPQAHEHTVLAAIVLSTPTPHCPPTLCVAALATGTKCLGASARDPGGAALNDCHAEVLARRAFLLFLHAHARDLGSQGAVDPLCRDEEGGGGCGAPRLRLRPGVGVHLYVSQPPCGDACVHDADGREAAHGSAGGTLGEARSQENAASASDDREVLGKTGCTLSEKHKQDNPPPTRRPVAHPYSAPHRRQAPGTGVPGTGPGRRPGHHPRASHPRTGLRAPAPQARARGGHAEHVV

SEQ ID NO: 9918 - protein, 161 aa, Chlorella protothecoides
MPNFTLEGHEKGVNCVDYYTGGDRPYLASGADDRLVKVWDYQTKACIQTLDGHAHNITAVGFHPELPLLLTGSEDGSVKAWHSTTYRLEHSLDHGMERVWAVAYTRGSNSIAIGYDEGCVMVKLGRDEPVASMDAGGKVVWARHNEIQTVNIKSLGDAHEE

SEQ ID NO: 9919 - protein, 167 aa, Chlorella protothecoides
MGIGWVRIPNPRLSHTSRILASLYNGNVYIWNYVEGALVKSFEITDLPVRTAKFIPRKQWMVCGADDMHVRVYNYNTMDKVKQFEAHTDYIRHLAVHPTLPYLLTCSDDMLIKLWDWEKGWVNTQVFEGHSHYVMHVVFNPKDPNTFASASLDRTVKARGCWDAGGK

SEQ ID NO: 9920 - protein, 84 aa, Chlorella protothecoides
MLPGWTGNSGPGWARSYVVRFTLHPVLPAPHLPTSSEYCCNGTVVEDKELGKVLQLQGDQRKNVSAFLIGNDLTKKDAIKVHGF

SEQ ID NO: 9921 - protein, 242 aa, Chlorella protothecoides
MNSAASLRLLSDLKAISREPPDGCSASPIAEDNLYVWVSRSDPLASRRHALWLHRLHAPPHLSPTPTERHHLGASRHPLVGIVHGCHGLAHLTSSVWEINTALSHDACREGGVFQLRLTFGDRYPDLPPRVRFTSEIYHPNVYRASSLRRHDPVDAVPLLWPLTAPSSPFSAQADGTLCMDIIQDQWSPCHSVCSILTSVQSLLTDPNPQSPANPEAAQLLTHHLADYNKRVRRIAQKSTEE

SEQ ID NO: 9922 - protein, 676 aa, Chlorella protothecoides
PPPSPLPASPQRKCDAYYRAQLERRWEHGRIEEYESVDNADFHVGIMGLGVLGGALAEALLRNGYPVSAWTRSRRTEPRFPCHAGRGELPAFLSCVNVLVCLMPITAETEGMLNADLLRLLPCGAYLINAGRGAIQVEADLVAALDEGQVGGCVDFLGALLATKVLGVAGAAGGRVAAVDAPRRPRVPPRLLLHAQGRRGQAGAGELGTGQGRQGGAPGAAHAAPEGVLRARPGRAWPGGREGGGDPASRVDGTRVRAPVLPGGTTTPNHPASGCTCVTSSASCPLFAQCGLLSEFAMAVWADGPASHARYRFVLLQDVGKSKKQELDACVYCHPASCRCPGGPNWCEPEKVSVAQVGPQAVPHPTAITPPPGTPLAYHASSTPIASVYAVPWAITCPSTSPSVSRRSGGGGASGAGAGPAAVMRYATAVSGALADLATWTYLDPGGVEQCLQTPALTTAQWPSGHWQSRDPLKPPGPLTTLQLVEHEARVHGVRPQRAQRSRHAPAARARHLVGDQHRDAAAPGQGLESRRDGRQLLLPGNDALDPGAVVEAGQLGDAVHEDEGEGEGAGLQGLQPGQELVGMAGSQHQHRLQQPLLVSGGEPALWTTLPRDLLQAACMWEGGVGRVGGLGHAEDSAWGGDGDLERRGSAGHAAAVCWYPPKANFLGVRSEGRCA

SEQ ID NO: 9923 - protein, 204 aa, Chlorella protothecoides
MLRQQGDAAHPLPTRLPDLDRALHGGFPCGSVTEIVGPAGEQVPCISLLVGCTRKRVVSPLPLDADIKCIGKVECNSRPSSCRTGKNAGMERNRETKKCRLCLAWGGNLSEVGGGLAQSLCPIDRLRGFLLGSNNFLTGRPLGTAGEKCSPCDPDQLHPTLPRPRSTVLPGGCGRHLLLDPHPRWSPGPVHRHRAEVQLSSVRC

SEQ ID NO: 9924 - protein, 840 aa, Chlorella protothecoides
MFFTRPSLPAGSASPVQRRGAQTPAADCYRIRSNPSWLTPMLHVLQNQAGISSFSRVVVFRDCWMVSMVELSCAIWSASAKKSTTARDYPPPPPHPQHPNPSPPSLLSRSSLTWVHILLLQETWQAQLLVFSQQRLGDLTRTGECVNVRYGVSPGVQKRSPEPQRLRPLRKRQTRSRRHRPSQLWEKGCAIHVGWLLKWVLKGNNSGQIGIPWVTANPATRPRCLEHHPVAATPIFRLAHLETIWDLRGAGAGLESAAGLAPKTWDCLRKPAGITGKGSDETRDPWAGQMFSLGNASDTSMSLWDGGHGADTALHPARLSCVSGEQHARREVMLGLGFRSIPSDGTGSWRLCCLASRRGALPPAFSCIPPAVLGAREFTRRLTPASLRMTATQKPSTHVDLDECMRVALEAATAAGSIIREAWDKPRQYALRTASVDLVTETDKQCEEEIYSRLRAAFPDHAFIGEEGSASQGFTAELTDAPTWLVDPVDGESAISFGYVRWGSAHSTTNPGRCLATTHCCWRVGWHVLCCAQSASMIPLFPPQNPPPSPFPSCTHTGTTNFVHRYPFTCVSIGLAVGGAPVLGVVANPILGEVYRAMRGGGAFLNNEPIHVSATPDLQSALFATELGIRRDDAFLDAAFARIRELLRGARSVRCGGSCALNLCSVAQGRRGRRGSAVAWLCVGGGGWRAGPYRFGVALVVCIDPPLDAFFELGLGGPWDMAAGAVILEEAGGKVLDPAGEGHSGVMGQHPGVLQGPGTIPLFPACSDLRPGACCVSQPPGEQACHAGSCVDRPDRGIPAGGPFNVMSRRVLGTNGHLAAQVSSILAACPLAEGEPRPLD

SEQ ID NO: 9925 - protein, 185 aa, Chlorella protothecoides
MPKPTNPPHSTLPHARSLEEIARQRSPEGRLAPGDKERLLESVLVLRPRHSHELLARLQALEASPLPLSLVLVDSVAQLARLDHGPGVKGVVARQQQLAAVAARLKALSRRRGIPVLVTNQVAGAGGGGVAAALGPLWAHAVNTRLMLHQLEGGEGSGGFEGVPRLPVSAGPLGGRERRSLEALF

SEQ ID NO: 9926 - protein, 129 aa, Chlorella protothecoides
MVSDYPGFALLRMPRAPPYQTPSIAKHCLNLAHDSGKSAAGQKLSTALSYCFFDTDDMIVALSGKSIADIFREEGEEAFRTTETAVIQVRRQHCQGLRRCLGGGDRPWGVGELPPAHTSLCASVQFKHR

SEQ ID NO: 9927 - protein, 157 aa, Chlorella protothecoides
MDSRQLDLLLAGLAGALVTYGGTRLLRRVAGEGVPTPPARDAKDMNGSIAALRSTTPHPHWTPPNPLPAPFSDKYHEVDPATTPSAVIYPLVISAIVPRPIAFISTLNAAGSVGNLAPYSYFNAVAHDPPTLAIGFCASSIRDHRRKDSLVNIVETG

SEQ ID NO: 9928 - protein, 382 aa, Chlorella protothecoides
MPPSLSHRLSFPSLFLQPARQGLRLLSHLAAPDTRWYRFDPESRIALLGFGPGGARLQPLQFLPAGPARLPMLDLGPPWVSSPVRGSGEDPMPRAGACAAHVWLVTLYGQVHCAHHDPPQRSLRLFRMYRDASSLAAEYRLPGGGGPVALSVVDNLLAVHLLAAHVTLLYDVAAPGAEPLCAPLPIGGARLAPGGGVAGGDGGAGGGGGVDDGDGGAPRQEVGPQAADRGLGGRALVPGTHSGGVQGGTALADAAQECGEGYAPDSAEGLAVPHEHDGTPSPAASWDGSEPGTPGQSPPRGGAPGPALSALQLYLPDWALDVERGAVYRLTLDLAAMAAMGSAWDLPALLAFLQRRHSGGAGARDARRITLAIMRVGRGARG

SEQ ID NO: 9929 - protein, 86 aa, Chlorella protothecoides
MECKVVHSYEVRNAAGAVSTTVILAQVVLMHVADGVAGKLVVDLAKYAPISRLGGNTYGRVKETFDLPRPDRTPAQKHIQYTSQPE

SEQ ID NO: 9930 - protein, 115 aa, Chlorella protothecoides
MQTGVVVWLRGTPELLAQRVVGDGTQSRPLLAGEQAAVAKLEGLMKARQALYEQADIVIPLDSPGSSTGASLEEVVWRMLCALRDRLRDDAASKPTPPLQQDHSGMSSRQLQAEE

SEQ ID NO: 9931 - protein, 242 aa, Chlorella protothecoides
MQAYTLPPTLFLCNCSDPGQLVCGTTTVRPRLVSSAMSATELSGSVFAEAEESSPEGQPRPACKKEGPMKAYEEGVACGALRQVRQSQTMSYGRASLDMGGACKSGQRCSDPLFVPAAEGMALAAHPLHSPNPSSPQDPRQALTARRLQRVFDDLWDVRGLPPSGSNRRGRGLTLVHAAEPTPAPRGGGWLSGFFGGQAASPPPQAPAPRGLYMYGGVGVGKTMLMDIFVSVAPPEFQASRP

SEQ ID NO: 9932 - protein, 419 aa, Chlorella protothecoides
  MOD_RES (77)..(80): Any amino acid
  MOD_RES (109)..(112): Any amino acid
AGRAPAGAVRRRQAQRHPARGRVPAGRAGRRGAGGRHGCGARRGRRLPPRVWRAGDGAGPDRGGGGVRGTACGADPXXXXPGVGVGSGRLRARSVECTTGIGPFPWPGXXXXFRLEYGALETGLALTEEEVGVEARRAGLTPAAADRLLLLLLMLPHGVIKHSHTVPGGREVLVGGKEGPGVGVGSGRLRARSVECTTGVGPCPRPGVRLRAAPYAPRSSGHLPLCLVETSSNLASATIKRRTPESLTVELVTCTRSSLDRALEDVRQGIARLGRAAGATVHQEGRVRPPGPLDLGRGKNQGPRPRRQTRVGPHPPTDAQTGRRLPRLGARTGRAGGACRGGGHPGGDGQGPCCQGHPRGAGVWHHRAEVARRAERVLWPHHPRGPQSRREGGGRHGGALLRGHPGPAATAGAGRLSGA

SEQ ID NO: 9933 - protein, 188 aa, Chlorella protothecoides
MHAAHGSELARDGPAFEAALEKYAALEKYVTRAVLSGRPREEWRADVGARYRALAASSRDEAQAGFLRIIRSLPYGNAAFFAVRKIDDPIGLLPAKLILGINKRGVHFFRPVPKEYLHSAELRDIMQFGSNASAVFFKMRVAGVLHVFQFETRAGDEVCMALQTHINDIMMRRYSRARAAQDGGDDAP

SEQ ID NO: 9934 - protein, 143 aa, Chlorella protothecoides
MSYPGPFKTFTMNTLNPATFAICDAIATPGCTAIGSVQCLPDGVPACAMDKDHNIGTGNTGKYNVGNNNVGDHNYGNNNVGSGNIGNELTGDSFICNFAREDHCIRLWLVTGDTLNLYAPPPPPPLSPPPPGQNCDPRNKFFA

SEQ ID NO: 9935 - protein, 438 aa, Chlorella protothecoides
  MOD_RES (95)..(105): Any amino acid
  MOD_RES (169)..(172): Any amino acid
  MOD_RES (197)..(200): Any amino acid
MACTSRKEALPGIGAEVVAGYASVLLSERRHSQGSALRWWQGRRQYSDACLWAPCGPESQGAWVYSTKPSPRSGPGHPHASSTRSNPQAHASLTXXXXXXXXXXXSACRKWLGHRGGRTGRRRASWRGAARDVLTFSCSLPVLMGDGVCGVRLHVGCSELAYVALSGFXXXXPSRSPSLNPLTPSDTVMVAQVSAIXXXXPSRSPSPNPLTPSDSVMVAQDVAILEANRPWPGAAEPSGHSTDSAATGPPANGLANGGSAHSTPHSHHRPAEATYSVFAVFDGHNGAAAAQLAGDKALGLLEDRLPWGAPPADVAGPGARAWRCAIQRALVETLVELNWLFAGHGVVAGCTATIVLQVGWLLTAAGVGDSRALLDLGSEVVHLTEDHRVASHKGERRRLEGAGARVAPIHVSGEPGVWGRAREGGGGVRESREGEWRS

SEQ ID NO: 9936 - protein, 187 aa, Chlorella protothecoides
MWGGGAALAALCPSYLEPGPVRYGPAASANEGIGPLRVWPGGLCLSRAVGDFDVGKVVLPFPHVKQVGGLYTVGGVTVWRGTELSRMGSGGDGKEGPPGRSSMQSHPAVPQTPSANFHTHHVHVLQSAHAAPPFPSTHPTPTHPRSWSQRPALACMWPLTGCGTRSSATPRSPAWHGPGPRTPRRAA

SEQ ID NO: 9937 - protein, 121 aa, Chlorella protothecoides
LAGAAPAGAGGEKHDPASPPAPALADAATAVLARLRPVDLDQEVKEGAIAAAAALLAALGDALGLETQAVGELTREFAAMPKARTSKRAKLSGGGAEVGAAGGAAAGPSAEVREVGFLGGG

SEQ ID NO: 9938 - protein, 144 aa, Chlorella protothecoides
MWSHPSLKHSLVHLPVLEKLVRDLTQLLKKSSRSLRLAALRTLKSPRPPRQIHLRMQALVAREGASLPADVLAEVVAEAGTQLSEAELMHAGLALQLAVVALESQPEAALEAARSKVRGMRGGRRGPWGADRGDVRCPGRTHRV

SEQ ID NO: 9939 - protein, 356 aa, Chlorella protothecoides
MNSLPLCTRVQVLPGALTLAASPLLQPSVLTALQSFFARLALASGDAAAFAELRESLMQKGLTAAGAAPGGHLALARCVAALCALCATEDERVQGTLQHLLHTLQGGRSEAAARRLALGVLGEIGRGRDLGQLPQVLEALLSALSAEDVADAAATALGSARALEGGRGRGRTRQSRAALCHRPVRTCSHLPPPSCWPPAHGPAPTHRPPHPQTGVTSGALGARLDPLLGLVRDAAATPRLQYQLFRALAEVLHSEAAEELTPSQRQSVLDLILAAVAEEREESNAVLAECLGTLAALGAGACTAILTQPLQSSSPGLRALALAAARHATVHLGARATPSMDGVAGPMLACLNDPDL

SEQ ID NO: 9940 - protein, 370 aa, Chlorella protothecoides
  MOD_RES (34)..(37): Any amino acid
  MOD_RES (267)..(270): Any amino acid
  MOD_RES (319)..(322): Any amino acid
  MOD_RES (364)..(366): Any amino acid
REAALVRREGGGSTEEGGVGGSEHLWCARRARGXXXXSSARRAPPTPTWPLAQRSWAALPARGCTGAELIPSLESQQHPGVLPPPAAPLNWRRRTSLTPPLSHLPRPKNSNINRLHRPRTLAVWAELERRRVKLTWDLPMLRGKLLPLLLDWDLAHSGEENGAGERGAGETRPEFWAREVQKVQGGAAAGPRKAAGAAAAPPRGWRYVVRWERVPSVAAEAYPPLLAVRPRERRGRGAGGEEGPEPASQSRGSQGAASQAEGADAAXXXXAGQPEPGEPGGAEPGGGRRRCLHPHDGARWRGAASGRLNARCMAARNAXXXXAVARAASGRLDARCMAARNACSARIVHGRMRAPDTHSHTHTXXXRADV

SEQ ID NO: 9941 - protein, 240 aa, Chlorella protothecoides
MAWTGRLGVWTWEVLDIPHASMSWPVHSLLPLLCSSTPGCQPCLSRYFEKVLTGNLQQHQQAIANAAAAGAPPPLHEAPPVLLTGLQIADIYMKTQPANFVACGANQLALMLEPALTCRQSRKPATLLASCIGELVQRYPTRGTAPLDPTAELAYKLLARTNEVLHRFLAALSNSSQQLVPELFVYASNCLLVMKAAVEARPNSMQPLIGPLLAAMHRVAKDHNQQPAAGILGSKSFPPS

SEQ ID NO: 9942 - protein, 799 aa, Chlorella protothecoides
  MOD_RES (172)..(175): Any amino acid
  MOD_RES (315)..(318): Any amino acid
  MOD_RES (452)..(455): Any amino acid
  MOD_RES (745)..(779): Any amino acid
MPGWFRGNGSRRLKPQMNSEPRPMSRGMVKPCNMIPMRPPMRREIIKSVQRCASQRASIEDFAVLGKVWQLPRACRATSTSNSSWMIGALRAATRVARVAKQTRQFSGKVNIEEEIKVRREVCMLVWPGGTLEHVPAASQCPRHSSHPPSGNEQVEDHHLCRHPRVHRQGCXXXXHCTCCRHLHCIPAPPPRPVQPRVLTTCPTPPTMTLRSPTTRSSTVSGRWGGSASENVLACRDWAGTTTFFCMPQVPPPWPSCAVRNKEFPWGPDGLFEQRSPDVAPGYASGAWHSIMFIASTVGRSWQACCVKLHPRKFXXXXYASGAWHPIMFIASTREVKLAEVRLFQPAYLSRTLKTRYVARRIVIVDWLGGCTVPILKRQFSLFLRNWILAVHLLDDCPPNSAPTATWGGSAIATPTDHSPITTLVLHLEISPLCCPPPLDRRSTSVIKMRRXXXXDSDVGGSAIATLNDHFPITTLVLHLEIHSCVALLVLIAAPPASSRCAGCSASAPAPCSPGSGSQGARCGCRCLLCGVHQGEQPGFDLLTDVIAPMYLTEAELHALGLPLALCITPLGTSRSLPTAQPAPRQGNEGDGQPHAPGRCGCCGAYVCAAVGFRPEGWVCALCGEVNDFSRGDNWRYMPGPDSTSPVPLPGLDASPAAMDLEHTGAGAVEVDCRPMLLALVDVGGPAPCVAASCAALLAGGEAAPAGTLFVLMTYAGEEQEAVFCADNSAGQEALRPAPLRQLAXXXXXXXXXXXXXXXXXXXXXXXXXXXXXXXXXXXRSWSWRTRRLPPQVPAGVTW

SEQ ID NO: 9943 - protein, 315 aa, Chlorella protothecoides
  MOD_RES (37)..(40): Any amino acid
MPVPKPSDGGHSGRQAAVDRGKTTDQGNIEILPLGMXXXXKPSDGGHSGRQAAVDRVKTMDQGNIEILPLGMIDKVAPRVVAFQRIPWSRHLTTAAPHSEGFRRRSSYFDSPVEPYDERSDWRGSRPGPPDTYRDRGQGYKGERNDGPPSRYKRGSRDNRYTDRPPRRSNGYSGARQSSPGGINWRERKEEARQGMPPSSGALLKEGWQGEVLYGVSPVLAALTAGRREIHALHVQQDIDGSARKVGSVLIGWLAVAGIGRGGLALTGQPTAPSLDSVVLNRAREAAQAIGCPVFLASKHDLNLLADNRPHQVPG

SEQ ID NO: 9944 - protein, 165 aa, Chlorella protothecoides
  MOD_RES (25)..(28): Any amino acid
MAVRGDGVSIRAGHHGTRQDVTLRXXXXSPCDGRDRWLRGVTGSAPAQGKTSLLRYVLQSSGLKVACIVNDVAAVNIDAKLIRGDATRDPNSTTADLTDTIELANGCACCSIADELMASFANLLELSDKRGTSYDSAWGQKPGCTSGMLYRKHPWTYAPPSQKHS

SEQ ID NO: 9945 - protein, 260 aa, Chlorella protothecoides
  MOD_RES (150)..(153): Any amino acid
MGPTPHPPNPQPLNPLQPPPPTAADSLPPEPADAGAGHARTAPGKRHRPANPHHGGLRRIPRRRLAPALGAGAGAGGGGAGHGQLHRRRQRLVLWRGACAGPDPGGEPGGKGERNGTVPCKLTWPPMSPMHPQPDLVHHPHTHPPTHPNXXXXVPCKLTWPPISPMHPQPDLVHHPTPILPPTQSTQGFPAHLTRFSTAWGSKALRFWIDAAPGQVLSLTTHVAHLDATPATQEFLAQLPDWVSPVIMTTVQQKWNLEFR

SEQ ID NO: 9946 - protein, 211 aa, Chlorella protothecoides
  MOD_RES (7)..(10): Any amino acid
MGRFSSXXXXGASLMRLGGLFLLLIHNQCSANGKIFIGMQPSLADTLPCPPITAASASSSSQAPPALRQNTPSPDHSFHPLPCAGLIPADTDYRLFSYRRAGSLPGIDVAQVFDGLAYHTNQDVADRVRPGTLQVRWEGALCGRCDRMGWGLDGRRKNQDTQSSPSTPRCSIHTHAVHGGKHAGRDVGVCEGAGVRAAPAGVSTWRRLRCL

SEQ ID NO: 9947 - protein, 152 aa, Chlorella protothecoides
  MOD_RES (61)..(64): Any amino acid
MCTRQWGEGGGGLLGPHARVQAVHCRSPGRGRRPPPLRALGPWSGDAGGPGCAAGATGLPXXXXLLFVLLDPGAATLEAQVARRAQRGSHFMPPSLLATQLATLQYAESEWYLHIGGDPYPQLEAIAEAIVARLEADGLILESGVHETLGSE

SEQ ID NO: 9948 - protein, 275 aa, Chlorella protothecoides
MLKNETGGTSRAPQDQEGMHGAGRRSTTWWPRQVTGPPPFQVLQHAPGKGPGIGRAPGSRIVAQGPKSTTSSDGIAPAEHAPGEAPGIGRPPGSRIAAQRPKSTTFSDGIAPAEVAPSAAGQALEPRPPVLVGQGHPGRHRGCMRGWRSRRGRVIIGSTDSAPALDSSRVTRRAWALKSASSHRLAHQCWLGGESRPPPGRYSTAARTACFPRALFGALFGALFGGIVWGIVWGIVGGNVWGNVWGIVWGNVWGIVVWGIVWGIVGACKSIAHLA

SEQ ID NO: 9949 - protein, 107 aa, Chlorella protothecoides
MELFPVHSCRNLPATLAAARGAGWRVLGADGGAEAQACTGVAPGAPTLLVMGSEGAGLRTNVRRACEALVRIPGGAGAAQVESLNVSVATGILLHHLLQPGAAEAGQ

SEQ ID NO: 9950 - protein, 272 aa, Chlorella protothecoides
MSGMRSKVRAPIAWYGRYWQVYCTFFPAALAGLLLPYVLCTRRSFQPDAMVQSLGSATFHAAVASILAAHGIYAGYLNALWATGTILAVVLVWARPGPVTSLLAAALMALPLLGAELDFGGWGKQGHGIGLAGAAPGLLGLVIGDVAIGTLAGVAVYLCAGTLTPHLAARLGRAGRPALLGLLALSAAAGGWSSAAGGAAPYTPWAPKRLFVQHHHAPASAPGQGLEARWTVSAIDGFPVASTLPPHLLQHARPTTEPYWEVRGGGGVARGY

SEQ ID NO: 9951 - protein, 181 aa, Chlorella protothecoides
MPALGCPCRAVLVVFHPAPLPPPSPQARGSDLRVHFKNSREAAASIRGKDLAKAKAYLQAVLEHKRAIPFLRFNGGVGRTSQAKNEGNSIGQARWPKKSVDFLLNLLKNAESNAEVGGGGAGSKAAPGGGRLGDQGSAGWLSACGSVCMPPKGMDRWPLGCRTPSPPLPTTPSPSPLFPTA

SEQ ID NO: 9952 - protein, 218 aa, Chlorella protothecoides
MCVNCLQGQEDITRDIKKQIHISWCKGCQRYLQPPNHWMHAEPESRELLTFCIKRVTGLNKVKLVDAGFIWTEPHSMRLKTKLTIQKEVHGAILQQVLVVGSGGLTRGRVGAWPRLRQHVTHKRTFFYLEQLILKHGADENCVNIKNIHNGVDFYFGSRAHACKFIDFLQSVVPLRYRHDKQLVSHTIHTSEYNYKYTFSAEIAPICKVARGVWWESS

SEQ ID NO: 9953 - protein, 208 aa, Chlorella protothecoides
MRRPPRVLVLRLYLSSPPPPTPHTPTQDDLVCLPAKTALGLGNLGPVVLVTRVTSAITLTDPRTMRSASLEAGQYWRAPFRPLMHARQAVEFVVLDCEPVQSSHGGGYNHGGRWQLAEATVAKAADLGANDKVSITRTHLGHLLKAGDTAAGYDLSSANVADDALDRALAAGLAPPEIVLVRKSYEEKRRRRAAAGARRAWKLKRLDG

SEQ ID NO: 9954 - protein, 115 aa, Chlorella protothecoides
GRKRWILSVPSKGEIWVDDGAARAIKKHASLFAAGITKVVGEFQHQDAVKLCDAQGRELAQGLTNYSNVEVEAAKGLSSAKFLEKLGYQGQEEVVHRASICLLVKREQGEACSWV

SEQ ID NO: 9955 - protein, 517 aa, Chlorella protothecoides
MGAYSSIGIFLSPRTACGPCLGGFQPPCVAVRGRRRPCSAPGVAGAPAGRLAHSIAISWPTRRSGLEQAGLHVPRRLVTQQVEDGCGDICQPRLGLVLPEGHPLRQPRAADRQGDGGQGVAGQGHGLPRLVAQRGQRLLVPLDHVVGVAVVGGEQPAPAQLVGQRQELADGGVHAGAGLHGGGQVPRVPHHVRVGKVDAHGVVAPGAQRLLPRLADLARLHQRQLVEGHAVAGHLHVRLQRLVKVPRPVAVPEEGHVTVLLRLAAGKGAQAVARQHLAADPGDGGGRDQEAGGQLQVAVVLHEPYEARARPAHAVERGELLVLEGLADLAHAVGAEVEHRHRVAVAHGAHRLAVGAHDDKGVQPLVGDGVGGALGPQGGDGGDRVGEGVRRLAQHVRGPAAAHDLPVRLVAVHGHAHAAAAGGDQRVHAAAAHLRQHRLQLLGEADAGAVGHVAAVGKHVHADALGAAVRRAAHKREELVGAGVHAAVGEEADEMQGVLRKGLGDMGPALTCKGGKW

SEQ ID NO: 9956 - protein, 223 aa, Chlorella protothecoides
MAALRLSQVPLARTRATPMCSPGRRLAPRHDSLPCSCMSPSTAFQAATLAVIPLYGAMVTAPRSPRVSQVLASPVIPVAGAAMYIALALGWGAWSELCQLQLWHQGSGPLAWLPSNEGLAMAFTHANLAALTWIHIITLDWLQASKGTPRCCSQITHNPLCPSATVISSNCRWVYLDGLRSHIPTLHSAILCFMVGPLGVLSHLLTKYIVGMHRSSNAQPSAA

SEQ ID NO: 9957 - protein, 113 aa, Chlorella protothecoides
MRMRARDHATRLQPGQIPPIMQAPGRLTATIAHQPAAGRSVKVVTPSCPLAFGDELVVVGSHQGWKPEAGTVLTWTEGDTWVGELSKQLTDPALEFKVRLALASWHLWGGRSP

SEQ ID NO: 9958 - protein, 545 aa, Chlorella protothecoides
MPPPVLQNPFPVVCPGRGVNVEDEYNAVHVAETPTYDAARKVPGRFRSILAHGTAVGLPSDADMGNSEVGHNALGAGQVIDQGASLVDKALASGSIYEGEGWAHISEAFAENTLHLIGLLSDGGVHSRTDQLFALVRGAADRGAKRIRVHVLTDGRDVPDGSSVGFAKELEAVLAEVRGRGVDALIASGGGRMCVTMDRYEADWEIVRRGWAAHVLGEAPHTFPDAVTAITTLRAEGSADPVSDQWLDPFVIVGADGEAVGPVRDGDAVAVFNFRADRVCQISKAFEYEEFAAFDRVRWPRTRFVGLMQYDGDLKLPARFLVPPPAISGVSGEVLARNGLRTFACSETQKYGHVTFFWNGNRSGYFDEALETYVEVPSDRVPFNQLPLMKAREICEAGKEALRSGRYDTVRINFANPDMVGHTGDLAATVEACACVDAAVGELLALTDELGGRWLLTSDHGNADDMVQRHKKTLAPLRDEAGQTVALTSHTLAPVPLAVGGAGLPEGVAFREDQPKAGLANVAATIFNLLGYEAPGHMEPSLLKA

SEQ ID NO: 9959 - protein, 172 aa, Chlorella protothecoides
  MOD_RES (135)..(137): Any amino acid
MHRIGIMARGRLRCIGTSLRLKMRFGSGYRISIRVQGGTSSSGSSSQTEEGALDGDFLIPATPTTEAAADSAPRCKEQQLRSGSGEEQRSTLGRLQAARIKAVFADRLGVTAGGPCMGRRGESELGCISGSLQGXXXLGVTAGGPCMRRRGESKLGCISGSLQEWGWPGGTH

SEQ ID NO: 9960 - protein, 531 aa, Chlorella protothecoides
  MOD_RES (279)..(282): Any amino acid
  MOD_RES (422)..(425): Any amino acid
  MOD_RES (477)..(480): Any amino acid
MPRMASAGACGRVAGSSPRGETQEARTLQTLGTLHNPCSMPNYIECTSGTSEKMELMARAWDGEGATDRVRTKLPRCAAKFNRRRCAISAIQALADSGGPGGRRTRCYLPGDTTLAEMSLVKARRATATQPRRTHNKFHGILLWAIPALGAMGRPDKTDHSHSCTQLQWSRGQTVFASIPSRSRHAGVEGSLPPTERTVRLWQYPENWAKVSGIECRTGVRGHLEPRCPGRTRGCQYRTRRPSSRGGACWGLSLQPWFARTFSSGDQSWFRQFHSASSXXXXSHQVTRAGSVRSTAPRHLGLRLIIIISQRPPIDDLPNTNTTVGRALAWRTNVLLLAQAVLFILLIWGVDRALTASRQRQPAYSSQTTAEAVDIGPIPDCATNIYLRQDRACYTIAYAPKIGTCDARGDIFPPKAAILLNXXXXRYMRRPWGYPPQNGCNSSQSPHLAGRCTGGRGSGSGGGQQQPPHPTNPPQGXXXXVALVEEVLAAVADNNSPPIARTHLKGFASETEIDDYLLANPETVREQRSTF

SEQ ID NO: 9961 - protein, 440 aa, Chlorella protothecoides
  MOD_RES (14)..(22): Any amino acid
  MOD_RES (51)..(53): Any amino acid
  MOD_RES (129)..(132): Any amino acid
MGPATLPWLQCAAXXXXXXXXXSAPPPVLTHFGLSYITQAKGSCETQGMGXXXSTLGASCTPGVTGMDADKHRRPQRGDLMVTALRNAFATMRAAHSAVSHAGGCDWSLARPCCAMQTCSKRDWCGSRXXXXWLDRVVPCRPVVNGTGAAAGRAGGRLSWSRTPPPPPQLSRPRRSRSVGVVAHRVVDGGREVLARLRRQPRHGDAAIQGHVDVVLGGEAVRHLAPRQAGVGEHADLVLDVVPGSGRAPLPQRGMQVLAHGDDAVGHALQLRLPECVELGVGQDGRHDLGAVARRVGVPAVETEGRILIQRACSCGLGGQGRFIPHSPLGSSHGADDPLELALHSGRGVGVGGDHRQRSGALAVQAHVLGKGLRQQQLQPRLGKHADGGGVPVQVAARKALSGERGERNYTGNEETSQVEKDGAVQPVRFSRAHTGPARR

SEQ ID NO: 9962 - protein, 376 aa, Chlorella protothecoides
  MOD_RES (161)..(163): Any amino acid
  MOD_RES (291)..(294): Any amino acid
MVHDYVPEMIKIINTMPPGAVCATVGLCDSSFAGVATDVKRSAGAHQTAAYRRLLETYAPGHAAQSSTVGSWGMPSNGDACQMCQFVVQYAKVGGAGSLVLGGRRRMGCFLPWGRRGPSRRMAGARPSRASGVLDVWAGRLRSKLFASPGAQSSVMSTLLXXXHDRLVQVACWVCRAGRLRSKLFASPGAHSFIMSTLPAPTALPASIAGGAGQQRDRRRDRGQPGHRLRVTVPGQRRGVIAGGVREESDCLGQRHVLAAGAVKPGVSDGSVQAPPPVSNRCNLVHPFFDXXXXSVQAPPPVSSRRDRVHPFFDLLPAVVDCAKLHTMPAITLTISGKEFVLTPEQYILKVRGSDLRMIWIIWIVRSSMMPCVGVR

SEQ ID NO: 9963 - protein, 587 aa, Chlorella protothecoides
  MOD_RES (109)..(112): Any amino acid
  MOD_RES (341)..(344): Any amino acid
MLPVEAGPRRPLIPSVTIAASKACLLPTPLQYYGEIGLGTPPQPFQVVFDTGSSNLWIPSSKCSYFSIACYLHSQYNAEASSTYLVLEWWGVVLMAALTTEDVDKGPLXXXXGVVLMAALTMEDVYNRPLYCCLHAIPWQQCRGYTSASGPTDPMITALSLTLPQHCLSQEDGRDFAIQYGSGALTGFLSNDVLTLGDLKIEDQIFAEAVNEPALAFIAAQFDGILVNVPDLWAMYRSAPNVNVTACSSCDQEAGLGFPEIAVNKVPPPFQQALKQKLLDEPVFSFWLNRKVLRWSAEVLECVGPGHGSVGLGSERSPFCSMTGHHRMAALRVVAHTLVDXXXXFSFWLNRKVRRWPAEVLECVGAGCGSVGLGPERSPVCSLTGHRRMAALRVVALTLVDPTRSRSRTARPAASWCWAVSIRTTTRGSTSGEGRGWATCVQGRGYAAHSPGSTPTPPGFPTCRAPITRRGFWQFKLDSLEVEGVALPAVDSLEALSQGPSPHLPWQGKGSCEDGCQAIADTGTSLMVGPPLAIDSINKARRLAGPCLDCLLYVPGFGMWLGGHGVKFRLPYSSISGRGRSASPRLP

SEQ ID NO: 9964 - protein, 85 aa, Chlorella protothecoides
MARTRPIMGVCPQFDVLWDELTGLEHLHVFAAIKGIPAATRAAEAAKLLEEVKLTEAGSVRAGAYSGGMRRRLSVAMALLGDPKV

SEQ ID NO: 9965 - protein, 225 aa, Chlorella protothecoides
MCEMFKEAWARVQDVAQLAQIEIAIKLQVSADRAGLGGAPVAATGGSVRVHSGVLPGAGRRPRLRPRPAARDGLLQEVRRCGGGGVDPVWAGAGRAANFYVSGKPIPCPSTHAFCIPHPIPSRDYVRLMVTSVRAGLDFHQSIAAMALGNVHPTCQSLVVQECMLLTEDYLVDRQMQRSISVSVPGMGRAHKLRRDDVRLTHAHIYRVLCANLPPMILQTNQVGA

SEQ ID NO: 9966 - protein, 289 aa, Chlorella protothecoides
MPPHRPQSPQSPAGPVGCHSVSGWREKCGFHHPGEQQCAVVQGRLATPQHVRPGEVSKGWGWDGGEDQVHYRERVQLPRASTHPPLLPVLRPQLPLQAAVERELVRRAVSNPDLEWSPALTQFPHPAAKVSFGCGVVLLRRAAGQGLRHRFIAWRHVSRPPRALTPAIAASPLQSPSMIGTIAPTFLFASIMFQVGTVTTSGGQGNVMHAAWPAHGPFHGCNLHAERTTANQSPPCSSSPPTSAAQFVLLLHDVVHEEESGVRRAMATMGLRDTPFWASWFLYEVRTQL

SEQ ID NO: 9967 - protein, 256 aa, Chlorella protothecoides
MAVTLPGLLCRSSGRSPPHHPLPIRNQVMTKAAELLGVLSATSLDNITARFLKEVGSRLQADSASFIRQELLNLCNGLRFIRLRAGTSEEVCMKSWLGWVEIGACSAGGSMSMAGHAGVLAAAGRHPSQPLTHTPLCSQLRASIAFLEAAHPLKHVASDKKSRVQQSICDMLSCILQPIVDGADAGCVLGGGALGQGWGRGGAGRAPGAATAQALAQDLLPGAHPAPVSHSLALYLPLAPPSTPPAGPLAPAAIRA

SEQ ID NO: 9968 - protein, 410 aa, Chlorella protothecoides
MVQVQRPRTAGALQKDAGAQAGAPVATLGPHPPPSPVTISLNDCLACSGCITSAETVLLQAQSTAQLLGKLEEARAGGHLRVAISLSPQSVVSLAVAAGQAPALTQSRLAAALRALGAHAVFSTAPARDLALADAAAEAVGRLRAAARSPRAGEESAAPRLPVLASTCPGWVCYAEKTHGAWVLPFLSRTKSAQAVTASLIKGSWAAGEGVAPEDVFHCSIMPCFDKKLEASREDFTLGIEGEGVVGGLGAVLDRQTAVLFGSKGHTKPGTVCHNNQLLSPPSFLPFSIAGSSRRVAETDCVLATAEVAALLQERGLRLDSPLPGEEVGLDTVPRPGSPGRGLVGRAGWMGAVHAGSGSYMEAVLRGVASELHGVELEEGTLVTQAGRNPGELGGRAGWGVCSGSCEHGV

SEQ ID NO: 9969 - protein, 308 aa, Chlorella protothecoides
MVIFSLFPWSLLSKGVGDLAAAASGEAYALAGVARGRGSTPGGIPWSMRGAYCVRGSLSPEQSSSPLYYQDDCVMPLGTILWVLALQCVGYCLLALYFDNVLPDCNGVRRAPWYFLQPSYWVAPYLLGGALRETGRGSGAGGGGRLPAQGFCGEHLGDPCMHVSCGTRANLQSTPILLQKPSLERAQRAYEASTQESTGLVVDADVAEEMERMKTRCLTYTGKLSGTHHPGAAGVDTAAATPQPAYAMEMYGLRKEYGRGLFRRKPFVAVRSSWLGVLEGAVGSSGRMQGLGEGRQLYKGGERLMGMD

SEQ ID NO: 9970 - protein, 135 aa, Chlorella protothecoides
MLRGKLVQFVAETARHINTLPELSPELQQLRHCLCTVARQCAMQLADALPQDFTADTRRTLFDMFSNYCEEGTPGGWREAGGWGVGREIRCWRGEEFASRRSFRRRGLLAYTHTHAPAPAFKGSPCQISPNKLPT

SEQ ID NO: 9971 - protein, 204 aa, Chlorella protothecoides
MSTSGIAEAESTEIAPPPTEPIADPFVFNGETMPGMRDQVVTETVETRVWTEEVGAAEGSPPRSPDRDPTYRCAVVVGGNDPATPPYSAASPGSPPPESQQLSDAGAIIQGTLHSELERVQLAREVDVRAAFAGLPRVHSHWTHRYMKILVVGEAGIGKTTFIKNLFAAYASDPKFPVADTPARGARKASLQSVKGGARGMDGM

SEQ ID NO: 9972 - protein, 134 aa, Chlorella protothecoides
MLHVTHKTFPLPPEKRAPCCSYHTHPPEEFGQALVNQMDRSFLTRAGALGRGASRREQTAQLVSARQAGPSYLVSYTVSPVDLAPRAVTSVVTPGSHKRRSRLYTLNLSAPAEERERWEPVFSGVLQSFSVPRA

SEQ ID NO: 9973 - protein, 270 aa, Chlorella protothecoides
MHPGPPAPPSPPSQELVRMLCVNITKRLPEHGSALITDLLQYDGVNMNWEACMSGVSAILTLLAEVPARLAGANDPVHLPATAGVRLDGAGMWEWVSGNDKAIVHGTRGEGKTMQPGHCIAWDPKPSAPDELERLGGTAWLPENYDLDRLLPLIEQGYNCLDALSMGPALSALSVSLSKVIQQAHNLHGHSRFSTTNRSFGDVPGRERVGALPVFVAALQCLPFVVPSHWADGRLWEDLPAYAIHGDPAMRKVAWGEELCVNTEAEAPQG

SEQ ID NO: 9974 - protein, 193 aa, Chlorella protothecoides
MQHYARDEAGGWTGCHCEGGIWSTFFSLLLWEALFAPVPDVFRTPFQSSPLDLRTESFYIGRQDLIERILGEIAAGGVEERLRAVWDAHCGELCAGIRWDRWPLEELLTIAACVGGRGLAVVCRLLAEDHSGWAGGMPDLLLWNPARLKAKLVEVKGPRDRLSEQQRAWAHALTQGGLEVEVLKVVEPKASKK

SEQ ID NO: 9975 - protein, 354 aa, Chlorella protothecoides
MPRSLRRRTTSHNPYRHVLRPNKKLEAVRAAADGLGPTNRRMRRRAGHLTARAVQSCEWRPEDLGGDVLRAAAPDPQVEGPGADCQPATDARPAPKRLETHVWHAKRMPMQRAWGWVLPLRRAGRGRGQRSLVARLRGGAVLAHDASYWAALALGLDKGSRFPCMGRLLGPGCIAACQALLHAPAGGEVGLMLYAPDGFPAAAIAPAILTCVPGTAAAEAPSPSSPGHGAVAVLWVHAAAVRGAAAALAQAGAGGAGVRRSAAGAVPERAPARRPLPARPTCRGRRAGRAGRLGPPPPARRGRAGSVGRTRPSRGSGWPGALLGRPCTPMPGLGAGRAHEGAARHGEGRGQWIP

SEQ ID NO: 9976 - protein, 156 aa, Chlorella protothecoides
AAAAGALLRQTGPLVRVAAAARAVVTRLQRLFFLSEDQGLSHFLAAHAGALQYPRYLVHRQQAVWSSRRQLLEYEAALQAAARLMDALEVRGGWWPRALQHSAGDEAAAEAELEGIWRSLDANRHKQLPSPLKQSFSKQSSLLFLSRFQAGKNERV

SEQ ID NO: 9977 - protein, 65 aa, Chlorella protothecoides
MTIKVPIGADFIQSPSGTLYHIRWSQDGEGQLHILEYWADPVSKLLAAVSGPLPLSFPATAAAPA

SEQ ID NO: 9978 - protein, 188 aa, Chlorella protothecoides
MEETVAGTAKHRMLLYSGHDSTLMPLLVALGKEVETWPAYMSNLVFENWRRGDGQRYVKVVFPFLGGEGGWVWGKGLREMVMPVMAGLGCKGGGLQDAHMPEWLGRATCRTGSVLYNGEALGLQELCGTPECPLQDFRRAVMAPLQLDSATYAEECVVHPKHTGPAGTRVETRQRGVSIGSSMQEEDE

SEQ ID NO: 9979 - protein, 278 aa, Chlorella protothecoides
MPLHRLPPTPQPHSPSGARTPLSQKYWPELVREWDACGQAYTPVPLDIRTEDGQPRPANPDDVKQVETRFPGGCSKGELTRLGQRQALAFGRWLRRRYVDTLGFLPGDREQDTLLPRTTNYARTVATLAGDTLLPRTTNYARTVATLAGVLTGLYPGDEGPVPALTTPEMDEVLYANVRSCARLKELVGGLHAEARASAKGDEGVQALGRELAAAMGLPPGHRVSWLNLHDALTSMQAHDKPIPEGEMIKRGREGQGYLMGIGYGTGLSLAAGRGSGE

SEQ ID NO: 9980 - protein, 163 aa, Chlorella protothecoides
METDKQMLANVDGMVDLLQRQLKVGGEVREVLKEMRDDQRRPDFPHGPHTAPRDSILSSNLLQDKKNAGVAALCICRCVCAYVLRFAGRWDGATVSKWVARATSLVLQNFSKGGLPGPEMQVMRAGLPTLARPEAANLMPEVGWPEWQDHAPLVVQRPDREGP

SEQ ID NO: 9981 - protein, 363 aa, Chlorella protothecoides
MGSLLAPITARQILRPLRRPAQEYLGQAGVPAFCRGSAKLAFGEDSPVLKEGRNATVQGLSGTGSLRVGAEFLAGFYPGVKQVLIPNPSWANHKAIFEAAGLQTAQYRYYKPATRGLDYEGLLEDLGAAPRGAVVLLHACAHNPTGVDPTREQWAGILDAVRDRGLLPFFDSAYQGFASGDLDGDAASIRMFAEAGLELLLAQSFAKNMGLYGERAGALTVVSADADTSARVESQLKRVIRAMYSNPPRHGAEIVAAILSDPELYALWKAELKGMADRIISMREHLHAALRERGTPGTWDHIQDQIGMFSYTGLTRRQVADCLTAKHHVYMTLDGRISMAGLSPESCKYLAAAIDDAVRNYAD

SEQ ID NO: 9982 - protein, 387 aa, Chlorella protothecoides
MQWQGGALLRSSLPPPRTPLPSPPTPHSHQVLGALAAQVAAEEESAAPLASAGECVSSTHLCDSSICSPVGDTLSAVLGDTLLGLVLTIAATLPSLHVHIAAGTHTADLSCFVEIIPPTLPWMMESTTRMGNNSLSPFPIQSLALACEAVGWPEVACAYMAVAQALQDPTSRDVSWAPALVRIVALRAFPAHGRWVLQRFVETVERGSEEYQAAGLLILRALFEVEELDLGSSFGEADQARFAGVEELDLGSSFGEADQARFAGVLSPFICTSLGCWALHVMKAAARVDWMEGRRGGRDTDRDDSGVCLVARLPRPSSKVTSTILVTARAAPAQQQDQDGPGVVLGWPHSIDELGTSNKLCSQSLERFVTACAGMDRNAMQVLPFIK

SEQ ID NO: 9983 - protein, 200 aa, Chlorella protothecoides
MATAGVSLLEKKREYVLAIERLQQLLGGTPRKGRGGTTKRSGVHPHSPHQGAHLTPLHPLVSGGVYCGTRRGDWWIRLSINLEHLGRVGEALEMAEAGLADDWLSHGDRLALQRRVLRLGGCSVCDGRGVFRMPQEWEWESGKLGMRVQRRQAAPALEEACLGGERGAGAQGGQDRAATHGQHRRVQEQIHGPERRAVYG

SEQ ID NO: 9984 - protein, 214 aa, Chlorella protothecoides
  MOD_RES (133)..(136): Any amino acid
MTETQTLAAQHPYTQTPSASQMGQWASCFCIGAVLGLFCVNPDAGDYGAWEAQAHALIQRFGAAFAAQGCTLTLERTRWVVRILEARNSYSISVSYDGFAATTLIAKRFPCSLGEERYSQPYVLERALHRSQXXXXTLIAKRFPCSLGEVLVEYHHLRPFVTMGGEAAQVAGLEIVLVGPNFTDLPRKPPRDNGQHRNPARPSNLIVQAIGIAL

SEQ ID NO: 9985 - protein, 202 aa, Chlorella protothecoides
  MOD_RES (39)..(42): Any amino acid
  MOD_RES (198)..(201): Any amino acid
MQSVIQAAVEQQVLRAAEEMETALDAQLHAMDNLDPDDXXXXMQSVIQAAIEQQVLRAAEEMETALDAQLHAMDNLDPDDIEALRQRRVQEMKSTRQLGPIRARGVHLVLKVAYDAGYPATSLCCAPHRLQQRKAEWAARGHGEVQEVEEKEFFKVRKVQSMIRDYCCILTELHCQHGGFLLLMSDLKAAASVLAQGXXXXD

SEQ ID NO: 9986 - protein, 99 aa, Chlorella protothecoides
MWELGPKHSALLVFAEHRYYGESKPFKKRTRHSMHWLTTEQAMADYAELIWELRTELGDVDAPVVGFGGSYGGMLAAWFRMKYPHLLDGAIAGSAPIWT

SEQ ID NO: 9987 - protein, 281 aa, Chlorella protothecoides
MASYGTSGTHDVKETVRRAEVVKTTKLEPTVPAPPRPSEREVDLNGVLVPGGSDQARVLPRRSLRPKFLFECTTGGDGSVPNNREEWKDLLARAAPWLIAAAVVALGAGALNKAEEEEGSVGLWGRKKGRQAGDAARDAKNSAKRGWFGLKREAGGAGEDAKGKWQDTKATAKDKWQDTKAAAKDKAGQAKDGASNAGSYVADKAADLAEASKQAALRAEHTVAKAGSKLGAAASGAEETTGRALKDAGSKLERDGSEGRRQYKGDAIKHDLQSKPWWQFW

SEQ ID NO: 9988 - protein, 105 aa, Chlorella protothecoides
MLNGDGELPAYPVRVACQHLADPQLPKDPQALLRGLGLASGVFYNHSGNLPCFDWEQVGCVGWDWLGSGPFAMMPAASICAPSQHCDGLALPLGSAVHHSPWTPQ

SEQ ID NO: 9989 - protein, 296 aa, Chlorella protothecoides
MQGGDIYVSRAPGRLDVMGGIADYSGSLVLQLPLRQACHVALQRQASAPGEGEPMLRIVSLGARDGQRACRFEMPMRLLVSGQANVGVGAERLHSGSITARLGQPRHRAPPQSPPGRLHCCPPGPNPPSQGTTEQPLDLQAARALLTRDPATSWAAYVVGVVLVLAHEAPESSPLAGGAGLAVLIESDVPEGRGVSSSAAVEVAAMSALAAAFGATRLASDGAALALACQRAENRVVGAPCGVMDQMASALGREGALMALLCQPCQFQGTVEVPEHVSLIGISSGGDGGDGGVLGV

SEQ ID NO: 9990 - protein, 170 aa, Chlorella protothecoides
MVTQQRWFEAHFRLAAEVQLPMFLHLRAAAPAFLDTLARQPGGGLGKWGEGGFGGGRDGSAVSSGTNGHAIEGLDKGMGVCEAAAGRGGGGSQGALLQRSSSPVAAGALRGVVHSFDGTLEEAHKVLSYPGLFIGLNGCSLKTGKCLRLGVGAWLQGRGSGAYMVLGSGL

SEQ ID NO: 9991 - protein, 91 aa, Chlorella protothecoides
MRQGWPVTPHAPVQHPAAPRYPSCSPAHVHVQTRLQVRDKKKWDPDAAIKSRNEPANLRQVLEAVAGARGMEAGALAAQVHANALALFFSG

SEQ ID NO: 9992 - protein, 260 aa, Chlorella protothecoides
MGLKLVQQACEGRGLPQPRCLAQVSPEAWDAGLGALCPAELSGAEFLRAHGEHLDDVTEVDPLETYAVRMPAEHAVREHGRVCEFARLLAAEPTEDRLERLGELMLASHASYGACGLGSPGTDRLVELVREERRRVARRGQRQVLHGAKITGGGSGGTVCVLASGGEEGVMAARRVADLYRMERLGRGMESDFGAGIGNGVGGAPLTGKEQDGAAAPPTQCSILPEEARPGAAFLGSSNGALEFGVVRLRLPRAPSARRG

SEQ ID NO: 9993 - protein, 309 aa, Chlorella protothecoides
MGLHSVPGGGRDALPPAEVMRSVDPDELDRIFVHSSRLNRWRGWLGPVDVPASCTTGTRSPGHPHCRSRVHAQPPVSCPHHPPSTAPAPTPSRTRPRSDAIVEFVTTLCTIAREELRPVDAPRVFSLTKIVEIAAHNMDRIRLVWARIWAVLSDFFVEVGCAPNLQVAMYGVDSLRQLATKFLERDELANYTFQSDFLRPFCVVMRRSKAPEIRELVIRCAAGPGRGCRGGEVRAHAMETQGAPGARGGPAGVWVGGATTRALQVVECRGSQAVAPVGGYSRRQGPEVLSCGAQLPSRGRSLPRDRRLP

SEQ ID NO: 9994 - protein, 81 aa, Chlorella protothecoides
MVLARVANVKSGWKSVFMVFTTAAADESPQIVRLAFDTVEKIVREHFHYITGQWMGRKGLGGWWSVRRGVPLPCDAACVTR

SEQ ID NO: 9995 - protein, 337 aa, Chlorella protothecoides
MLHPPRQTSSPSILRFTETEAATFTDCVNCLIAYTNNPHSLDVALNSIAFLRFCALQLAAGGIGDVEKLPEGAVARTSSAAFRIRPRGDAAAGDVTSAAAAAATSLSAATSASKASTTAPGDVAHSNHTTSATVGSLRFTDKEQHMYYWFPLLAGLSELTFDPRPQVRTSALDVLFDTLRFHGGSFTPAFWLRVFDSVLLPIFDVVRAEITDTTTFTDERRRAEADRWLYATCTRTLQYIVDLVAQYHAGVEPLLARLLHLLLGFATRPHAELAAVGVAALSRLTLALAPRLDEPGWRALLDAYAEAARETLPDVAGLMQRRSARFKKDDAEGRVGA

SEQ ID NO: 9996 - protein, 279 aa, Chlorella protothecoides
  MOD_RES (41)..(44): Any amino acid
MASVFDLGDCALGITRQEMGALRRIEAEEHAKVLHACISSXXXXSRAGLCSWVPLPAQLESPTAALHRWLVMGSLPQPVLTARPTLGICIRRYNLERVCRYGLSLRRIRSSDLTHFPFLHAHVEGARVGAMIPDTFTRHRRPGRWCPSQLPQRPTTCASVGVHGLSGAAEDLAAAATSRAVAQDNGLLEPLVQGLEYLLQTFQSGLEAAHVPHSFGWSIVALTAVVKLCTFPLTKKQVIICWVVCWGGWVEPGDQVYRSDLRSPAHGNGRRRAVRLLGK

SEQ ID NO: 9997 - protein, 333 aa, Chlorella protothecoides
  MOD_RES (91)..(94): Any amino acid
MRGSSIPAGVQAGCLPPATRPIPKSSRRSHTPRPFRNRYTCRAALGAFGVAELESPLAALSALGLAVAGWDGGGKGAMDVVQCPDTVPPCXXXXKALLSCYNSKCNAQWAFLLFRQCPDTVPPCLTPLRSVSALKLVAHLKSEAEIARLIAKVHKVGNDESGRPGHLVQIGGNVRSLYYYPSKAYAAMTVVGKGLDPGIWTTTAAKNKLPLKVESQASEVPDLSFLPASSIDSVVLLPGCAPTPELVAQILRALKPGGRLGLALRAKGKGPIPSLLQALPLGPGPLEADELERYFPDTQWEFMEAGTANAGLDPLVVALASKSMQVGSAPEAL

SEQ ID NO: 9998 - protein, 158 aa, Chlorella protothecoides
  MOD_RES (127)..(130): Any amino acid
MFLYPPLPLPSTPCTQSFMHGRGCGMQEQVLELLRILLDPDTMDASVERDAFIDSFYEAHAGTLVGALVAATRGGGVAAESAGAGAAGAGGEVAGGAAGAPDTAAGAADTGDAPTTSAHTLGLIVEXXXXGVPPARPTPPQGRPTPATRRRPAHTRWD

SEQ ID NO: 9999 - protein, 1007 aa, Chlorella protothecoides
  MOD_RES (72)..(75): Any amino acid
MVRSEAVTWGWSRLARRTRCVHWHGSGTSIEWVMRRCSIIESGTPSCMGCAGGRSQGASHAGEAIDTKSREXXXXGGTGLAWRRSSKGCKALPRSLISPHLNGLAGAPAAAQEGTLAGRGCHPLPTHLPGNEGAGVGWDGGQGVTAKQGCPPQAPPRPSLAPQDEFYNRYLVKNGLLEPIIAVFLENGNRYNLLNSVVLELFEFMWRVSGPCCVGCMVACCVGVSMPGARQGLTCLIGERLTEGEGCCASGPAASIHLVDTNPCGVWQALRGRHCRGEGCCASGPAACIHVVDTNPRGVWRALRGRHCRAPRSDPPCVSPRPLHPRNFLPSSHSQQENMKGLLGYVVESPRWPELQALDFAPTFRRLSMKHDQNQVVCRLGQEVLCTWAACPIPGCVWALSLGHCSKKLTFVTSHQQERSTGSAAAPAGSGPGSEAGGGVFLGHARAAAAAQQRRIRLTSVPQVILGPNSRMLMWSIGLGRSSLACSSRQSSPHTLPSTTGGEKEEDEDEENYFKDDEDDDRGGSAAAAEVSEVRALRDAPASVSPSPGSPRVVGASPPSNGLPPFPGRLVDYDDDDDDALPLGGERHACDCLCDAGALMQHSIRKYLYHGPPCPVPHSCAPRWARWKARLIAPASEEVPAGQPLPVTPKPSFLTTHNVSPALFLAPPVSCSSPLNSSTLCERRAGRQVRTAARSPAAGRRAGQCRGAPWHSPSGHRWSAPPSYGSDAPDASSPSTGARWHDRRCRARPRQPPAPSQWPLVSRGRPSELHGKLRGPWQSHRRSTHRDPTSCAAVQDALEGWNEGGRTDCDPPANDARGVELHGARAPARSASRERSSLHPSCLSATALVMQQDILAAGVPRPDHVLLQKLIEALVIQALAIQKCAVGGPQVHEIGAHRSHHHAISALLLRSPGDRGHGGFVRNYVEDRDMPPVMKRSPSTGIHPPVSRSCIWLGNDSRAALTSALDPHGAPCSKNLSLHLYCSTQCCLEQEGWSVGMSTTVLSRPKR

SEQ ID NO: 10000 - protein, 462 aa, Chlorella protothecoides
MQSAMCRAIARLTPVWTAMWSGSGKCVELCVAHNSIYLILAPPMPGMSGAELMNVVNEAAFLAARRDADAVDLPELVAAVDRTRTASELPSPIAPAQEWSQWRCCHASVGAGISIVEGHPAVDRRRTRRRPSPAGRPVRAADHQVDRLLRPSSGHRAVRDSGEACGVAILTCTRLNVSKLDDNIVAILHEVLGADEGAGPERPGDAVAPPPPEIAADRGTGDVTGTHRTRGGPVALQYGASGRRGAGRLTEQGAAGRGGGVRTPHSLETGGGGTTQTLQGPVTRAAPLLPEGPAIDAGRKDTGPESVPARRRGVPEAVGGGKAVRATGMACPGAGQGRFRYATERKFRGCFGSHECRGAARQGSEAGFRADPAELLHCAMLAVIGHCSALHPVGRIPDSLPPMTNSTAVWYYSIRSHLRPRCPHNSGGYTPSRAGSHMGSPSFFTGVVASHAAGGCPAGAAS

SEQ ID NO: 10001 - protein, 248 aa, Chlorella protothecoides
MLGATVLSGAVRTLQGRLLERWQAPRSGEACLAPLYSVTQCAPCKEGSGVEVVFALMPCTSPTATCPPLPPDDLTLGVERRMRHGRAFAWLAPFPWRERCRPTRRNHQGGRGGEHRATLADVGAHPCHIVADVHAANCPTKGSLPHERSLRRPAFAEGACLVLQPWRHSMEREGWWLVLGTPTREEIHAMNPNYTEFKFPQVGWRGDRMVLTRSRMQCAVSHGTSCHAGPLCTCWATVPLLCARAGGS

SEQ ID NO: 10002 - protein, 157 aa, Chlorella protothecoides
MPLILVKLYTYQMLRALGYIHSMGVCHRYWVGGGWHREFREQCCFIEGLVQSPAGCTGDSSVTDCHRRHTQPSPFNVSLTSLTRDIKPQNLLVNVSTHALKLCDFGSAKTLVRGEPNISYICSRYYRAPELIFGATDYTCAIDVRIGDAHRGGEGDC

SEQ ID NO: 10003 - protein, 168 aa, Chlorella protothecoides
MRFGQEPLHRATPLRERHWQVDHSQYVLLHSTPPVHPVLQHRMSDPYALNDDGTAKDPAAFRAALKADPAKLEAIEKEPEVAEVVLGNDDHAFQELIKSVYHVSAGTEKKRQERLNRTMAERTIDAQRASATVPRDTVQLYAQLRESGLQYGPAFRLLRNVHVPDIAA

SEQ ID NO: 10004 - protein, 140 aa, Chlorella protothecoides
MSYIIPRVWRQLFPTAVSDITCSWPSCRNAARAVAGEAGVPFFVVSASEFVELFVGRGAARIRELFSEARKKAPCVVFIDELDAVGELWGWCWRMATACGRPGSPGMPNERAGHGSCVIPPFVHPPHGTLLPQVGGAAWA

SEQ ID NO: 10005 - protein, 166 aa, Chlorella protothecoides
MQRLKPAMDAIKAKYKEDKKAQQRETQALYKKAEINPLAGCFPSLATIPVFIGLYRSLTGVASLGLLDNQGFYWVPSLAGPTSVAAQRAGLKACAERVGSPCPCTGPGAWDTGGVWAAGYRSPACCPPPPPSLTLASTIRLFPLACRHGDQLALPVCGWAPAHRLG

SEQ ID NO: 10006 - protein, 133 aa, Chlorella protothecoides
MVGYFALCVPSGLSLYYLSNTVLTSGQQIFLRKLGGARLTELDLGPLELGTARRSGTAAVLDLAGMAQDTHHSADGSGVLQAVGAAADAFNVMEDASPQLIAALSEEEEEREARAEAAPALNRRCKRRRLPVA

SEQ ID NO: 10007 - protein, 74 aa, Chlorella protothecoides
MTTITRRTEKEGADGMMVAAVRPYLMDLGSTNGTFLNGERLDDKRFYELLEQDMIRTGNSSREYVLLHDKSGGR

SEQ ID NO: 10008 - protein, 315 aa, Chlorella protothecoides
MQRVRVYHLNENGHWDDKGTGVIKVETAEVRHALGIRCRAPSAGDQGDGSSVCTLKLVCTSASPRPHHRPMLPPQHPTSDVHLIIEDDTDASRLLNHTVTQGTSYQRQKGAHFGMYGRAGRSEGCRHARRPPVHLCMWLGCCDRGQCDCGWHTSVQTLFVRAAFASYKQLLQRRPAPRSADDSIISWTEASSGIEIALSFQEAFTCTQVWAEIQSVQDAGLSPRAQAAKLQGSRWVLVRPWPHARPQRHGLEPCGLFRMSAASAGDLGPSAGWCCCAQCSTSPAQLPPHSSVAPCAALAFPSRSAVADGWGDGGL

SEQ ID NO: 10009 - protein, 253 aa, Chlorella protothecoides
MQDGDYERAIELLGNALHQRTSTHGGVVNQRSQWLMLPDPRIPDLSLEAAAVYFQLGRALLFQAQDTSDFLSGERAEAAAPGTLPADDMGKASVTKEETVSGSNQDAGTFSRVKQHGLGLAPNNRLHPWSPAVALAEWLPPIFAPAVQVTTARMVIKARRKRRTVGRLQICSWPGSIWRPPKSSGPRMAQGTRSDWQVEGGWTGGRGHGAIIWAPAQLPSLTSPPHPTELHHAWSLLSIDRGALPARGRGLGE

SEQ ID NO: 10010 - protein, 406 aa, Chlorella protothecoides
  MOD_RES (72)..(74): Any amino acid
  MOD_RES (192)..(195): Any amino acid
  MOD_RES (363)..(365): Any amino acid
GRAGRSWLGHLGPAEHLVTRQGWRWQVYGALGIAAGPSRYGAGEEGPQFVPFLRFGHPDPVPSPPPSFTTTXXXRGRRDPSSYLLSALAPLILYPYRPPPSPPTPPKTAPEIQRTSLAGVVLYLKSLPLNIDVLGFEYLDPPAVRPWRRACLVLGGLGELVDVQSIGVTMVRSTEGTGIIPVLGGVCVRRGXXXXAHSISPQRPALEAALRSLYVLDAIDGDGVITGDGGVTRYNPAKPPIACGEALAKIRCGHSDRTQSPLDTCTSESPPNPLSHPDIGRRMAALPLTPSLSRALLAAEDGGCLGDMLSVAGMLSTESSVFLGGRGPQQLLASDAPGPAPSGRPPSRPGAGAPGSAPAPLAXXXRAPDGGPAPHTAPLPRATGGGGRRVPRQHAEPGRHAEHRVQ

SEQ ID NO: 10011 - protein, 221 aa, Chlorella protothecoides
  MOD_RES (125)..(178): Any amino acid
MGPARPATARVRTRCTIAWTPTPLLTRPPRPAPTPTPSPSLVSPLSSAGTRCAPSPPTPTGRARCTSRAQVLVRPRGEARRSGREHRGPARPPRTAMPPLLPPPPHAPGSAGRGRWPARPRARSXXXXXXXXXXXXXXXXXXXXXXXXXXXXXXXXXXXXXXXXXXXXXXXXXXXXXXEDAALESLYGQDLDSGLHGSGFPLPAWRRALLEAALRARGASA

SEQ ID NO: 10012 - protein, 164 aa, Chlorella protothecoides
MGTLWVALGGALLYLGSEVLHDASSRLAYLVLAVACLTMAAFTTYGLAGHLRHAPALAAGSDDDSDSGRRARAPPSAWRFFQPFRGGAWFVATQALGWGLFSAGLTLMLYLIAQGAAGVMEGARRYTWTAGAIMVTAQLVRDVGKGGRVGMGDEVPWRPGGAPE

SEQ ID NO: 10013 - protein, 505 aa, Chlorella protothecoides
  MOD_RES (75)..(78): Any amino acid
MQVIVPGRFIKSGTPRGRPTPPGRRMTAVPTPAVPRLKDTMTEAYFNERLEGQGWPRFDAEKANAVAREAWQALXXXXSGCWVAEGVVSTKLAGGHEWRLLRTINLPPGPQLLPPQKANDVAREAWQALQHIYGLGVLETPLLRSPNLEAACTDCRVHLKLESSQATGSFKLRGATHALASLGGAGRVVTASTGNHALATVQAARALASRPEAPALEPVIFLPNTVTPGKARRLEALGATLRYAGDDCCDTEAAARAAAAAERCPYVSPYNDLRVAGGQGTVAFELLMALPRLHAVYVPVGGGGLVSGIASVLKAVDPCIKVIGCQPSASAVMAASVEAGQLLQDVISMETLSGATAGACSGVARGGTWERNGGWGTTMVAGLLGLPPGPVYSQLATAAVSSSPKCGVEPGSLTFPVCRDLVDEWVQVSEEEIAAAMVDLASWHALRVEGAAGVAVAALLRHVPGLRGKSVAVVLSGGNVSDDLMEEAHGIARRSRGAAPAQPRI

SEQ ID NO: 10014 - protein, 486 aa, Chlorella protothecoides
  MOD_RES (269)..(311): Any amino acid
MCHPDVDFSRTVSNDVIEILQVLGIEAARNALLKELRGVIEFDGSYVNYRHLSSLVDSMTRRGYFMAITRHGINRDETGPLHQASFEETVEILCRAAAYAEADDMAGVSENIMLGQLCPVGTGAFGLMLDEAKLADAIELDYAFAEEAAWGGGLTPGRTPLMTPGRASPSALMSPSQSPFHDSVLFSPAGDVMFSPGGASPGYRGMGLLSAGGIQGIEMTGRAGDPGQHQSVMGRCPEPPPPHPPVHLAAPPAPATRPPAPATRPRARXXXXXXXXXXXXXXXXXXXXXXXXXXXXXXXXXXXXXXXXXXXSLLTHKSSLLVSHVVLGMPGSPQQSEKGGLIMDAHDAPRVLNQQLMSSTLCRPTSPQYSPTSPQYSPTSPQYSPTSPQYSPTSPQYSPTSPQYSPTSPQYSPTSPQYSPTSPQYSPTSPQYSPTSPQYSPTSPQYSPGGNGDASKLRGGWPVLQRCPSSYHSPRAGEGVKKEELQ

SEQ ID NO: 10015 - protein, 290 aa, Chlorella protothecoides
  MOD_RES (47)..(50): Any amino acid
MREWDSMGLRLPWIPAAPPACSSNSHALAPANVQILDLTRLPLHHLXXXXMVRCVCVRVYECVGEGGIRMPAWGSMGLRLPWIPAAPPACSSNSHALALAHVQTLGSHPPPFASPPSLARYDGTVRNAVGEVIQFLYGEDGMEGTAIESQRMDFLRYTPKRFAAAFAYDLDRAAWAPDWLDPGELEALRADLDARQALDAELAQLAEDQRTLQREVMRGGEAACNLPVNLKRLIENAQRKFACRPYRPGSTGGWSLVCVEDGGVEARQGLVGGIHQRPVQHEPQGGGPHM

SEQ ID NO: 10016 - protein, 270 aa, Chlorella protothecoides
  MOD_RES (102)..(105): Any amino acid
  MOD_RES (147)..(150): Any amino acid
  MOD_RES (224)..(239): Any amino acid
MTIINDIMERAKEDVKRLIGKVQSNDLEQQPGRSIMESFENQVNQVLNKARDDAGNQAQGSLHDTNNVVRMVTAGSKGSFINISQVEWCGCLCAWQGGDGLXXXXHLPGRVVWVCLCVARGRWFMILDTLASAMLTVVFWIASWILXXXXTLASAMLTVVFWIASWILTFTHQNVEGKRIPFGFSQRTLPHFTKDDFGPESRGFVENSYLRGLTPQEFFFHAMXXXXXXXXXXXXXXXXEDRQHGLHPAPPGEGHGGPDGQVRVCACVCV

SEQ ID NO: 10017 - protein, 160 aa, Chlorella protothecoides
  MOD_RES (68)..(71): Any amino acid
MCRSPTMQDADVWGDDSPTDAGQLEREWQSRREGHYNAGFLEGLEVGKQESVQAGFDSGFMAGAEAGXXXXDRWGFMAGAEAGRAWGERAGALLSLSVLGASSGPEQAALESLVSRTTHAALAPLVVPTLVDSQEGSQSSELVALQTRVTAVLEARSPGA

SEQ ID NO: 10018 - protein, 99 aa, Chlorella protothecoides
  MOD_RES (44)..(47): Any amino acid
MALPPGALVADVGCGNGKYFGLRSDIFVLGTDRSTGGRICVDCXXXXGVRGCRQGDSRGACRHCLERGPLGKEGGGLLRCTQKKPSRASFIMRPYPPSS

SEQ ID NO: 10019 - protein, 242 aa, Chlorella protothecoides
MAANPPLVESPQGLVPAPYASEWIGLARSGVEIRIDGHPQGPDRWDRRGTIFITNLRMVFVAEVPDAATGLVAYDLPLSYITQHSFHQPILGCNNLKGGLGCGREVERWGLDVLLWQHGKRAETALPARPFPQCDCHPSLPSPYSVRNGFPAENLSRHRRSMLDGGAGSRARDLHQVDYLLQEGGRGHLPPPLPLLRAGLRPAAPRIRATRARAGRRCQRAARGDLRANPADLPPHSTGGPQ

SEQ ID NO: 10020 - protein, 166 aa, Chlorella protothecoides
MQFATVFMAITGDAFFAAGRRVTDLLARNLLDAFASTIWFTPMVIQLAAFSMAVGWGFASGGVYYLAHRGAAAGVEASPGLNAAVLGGMVGLASLFLLNFLGGVLLAVLDAAFVCWALDRDAQSVSHPEIAQAFDAVPRKGAVVEQPGGGLAYGGLAHEAPAQQRV

SEQ ID NO: 10021 - protein, 594 aa, Chlorella protothecoides
MLARGCHWGGGGARQLRTQAPSSQFFRAAGHRRPPRSHSTCIKAASPSADIHGPPTFARRGAAHGQGGSWRGAGASSMLAMPPPPPPRALVCLAPSPLPPLPKLTCRMMRQAGRYQKAYRDLALQYPSFRQRSENTDLIVDISLQPWHSFRPDGVIIFRCASLQGCAACAAQRSAFGNAGEPCGAVPHAAPAPPAAFPPTPPYMGPATAPLTPRFPTRVPPFLLHRSDILTPLPALGIPFEIDDIKGPLIANPVRSQEQVDALRSLDTDAVHFVGESLRALRAEVAPEAAVLGFVGCPWTLATYIVEGASSSTYTTIKSMCYTGGCGAVGAAPAGLAAEPPGRPDRRVRHLPGLLRRRLHHALRLLGRPAPPQGTLGVGVGRSAGLRGLHARCRQPRPVQGPPTPPSSGPNALPTTLCTLNPGVGCVERPLHPAPGVQVQGRAPPGPRDPVCQRLRRPAGAPALHRRGRGGPGLDGGHGRRAAAAGRARARAGQCGPCRAVWARPCGGGGGGRLPGQGRGLGACAQPGPRRAGGHARGEREAHVRPVQAAPGRAGGEGAGPASRRRGLAARLIVYRAGRSGSVTSHAREHQGGM

SEQ ID NO: 10022 - protein, 505 aa, Chlorella protothecoides
MSNYESHSTAPVRKVKRLQFGILDPDFIVRLGWCWRCGCARDFWIVTALASARMAGWYFDAIHGSDGSPLGRAARLRRCVRRYSVAKIETSQNYDKGRPRLGGLSDPRLGTMDRAFKCTTDGAGVLDCPGYFGHIELAKPMYHVHFVRTVIRVLRCVSYHNSKILLMPDDPKYKMLLRIRNPERRLHAFTSLCQSKRVCEHTGGPQPIYRLESGTLRVLAEFPAPKASDLDGAPLLESMERKQELTAERALEILRRVSDEDCAALGFDTRYTRPDWMILQALPVPPPPVRPSVQMDSSARSEDDLTHQLGEILKANLRLARQEEAGAPQHIVSEFALLLQVHVTGYLDNTVPGLPQAKQRSGRPIKSISQRLKGKEGRLRGNLMGKRVDFSARTVITGDPNLALDELGVPWGIALTLTFPESVTPHNIERLRALVENGPYPPPGQTGARFIIRDDGSRLDLRFLKTERDRHLQPGYKVERHMINGDVVIFNRQPSLHKMSMMVGG

SEQ ID NO: 10023 - protein, 167 aa, Chlorella protothecoides
MSQFSLLPSARGAPTPRSAGLTRAAHGPSVRTGLAPRPFARPGLGKGSRLNSRSQAPLASTGGGGYAGNGGGAGYGGSGGSSWGDEGSNQPEPEKRVLWKGWSDRVAADPQFTYKVAVEQVRSDACWVRVGDVPGWPGWVFPPCGNQHICILSFLSQPHRSWAWDRP

SEQ ID NO: 10024 - protein, 95 aa, Chlorella protothecoides
MARKLEKWAPLPGSESEANDYLVPWHVPMHRAEAAAAAARPSAVLDGKKSTVCFQRYYHLFRPGELEGLVRQVPGAQLLDAFYDKDNWCVVFGRL

SEQ ID NO: 10025 - protein, 192 aa, Chlorella protothecoides
MADEGVVIKFKWRSTIYDIVTHPQESVDGLRRKVEAATSVQPKRQKLLGLKGKDGKAPTDATLVKDLALKANVPIMMLGAPEENIAALDAQAEVAPAVQDDFDLDPPASSLDPRDIRDEPGVRERLARRVARTEVKVLQPPRPGKKLLVLDIDYTLFDLGSSAERADQLARPFLHHFLTLGAQSLAGRGVGG

SEQ ID NO: 10026 - protein, 448 aa, Chlorella protothecoides
MQPSPPPLQPTPSAVQRVEELEISLQAAHEVNAHLNGEVEKLTARVTALEGERGAFQQRIHLLSRKLAAARRDAGLGVGSGPAGEGPLEAPPDAGPLAGPGPGAADAAPRFDGARSANDDPALRAWLPGTAWREAEARAREQGWLVDPREVALGPLLGQGTFGTTHRATWRGAAVAVKRVRVADAEGGAMFLREVEALRRLRHPHVMGLWGACLADPGAAWLLCELLPGGTLAAWLHGAPGALRAPRRPRHARLQALLDVARGMLALEAADPPVLHRDLKPSNVFLDAHGAAKVADMGLARVLEPGAAACLTGETGTYSYMSPECVRHEVYGPRSDVWSWGVMAVELLSQRRPYADLHLTPVQVAMEVGAGTLCPEIPSDCPEELAGLLHAAFHPDPIERPSFGAIVAGMARVVEAEARGGEGGGGGGDWLAQGKWGLPTRLTGLLRG

SEQ ID NO: 10027 - protein, 394 aa, Chlorella protothecoides
MQASQVPDAPLPLQQGEEVALQGGASSSDSVVIHPFLHSPLPMLPEPLDFGIELDAFIAPSRKKAGRRGLRLLTQARQDLGAELASSANLGSSMRVDVVQARYLGLLLALIGQQDAEKGGGLDPGSPFRSAARYVWRGGPRPHWASSDAILEVVAALMARSTALMRAAAAACVDAASGVRTPAAMQVGWDGAGPGHLFWARTSMDMGTAYKYLLAAAGQLETAKDRLLPHLPPEDPSVAAEAAAVSALSQHCLAEAQYLTTLRAIAKGTSPTLIASLAAEAASLYAASSEALAQAGAVAPKLGRYAEYRAGTLRALSLTFMALVQWRSPGGAGGARATAAEALRVWAAAKAAATAYDAAEPRTLNLDHRRSDEVGAGCVVLDLSGCACTWQKLW

SEQ ID NO: 10028 - protein, 108 aa, Chlorella protothecoides
MTASLSSADHLAKYYGLHGKTCLVTGGTLGIGRAVVEEFAILGARVFTCARKADALESLLSDCKAKGWSVEGITADVATPEGRESVMKAASAALGGRIGGSKAFGCLV

SEQ ID NO: 10029 - protein, 79 aa, Chlorella protothecoides
MQNGLVIRPFRKSHRSRDTDRELLFLGAYLQKIAALESLSGLDHGAWEAYAAQEIRAALRDFRDARAAALSSAPPGPEA

SEQ ID NO: 10030 - protein, 135 aa, Chlorella protothecoides
MKWIEVKMRELGVSTHEQYKLTFMLDHMAMVTVHHEKHGSCQCRKLAPTPGREACSEDRPPPLPAHPASGVFDCKPLEFVWQKFPGVYTPENTIMMDDLRRNYILNPQVQWGGASGGGGFLLGLLWGMHSRRHVG

SEQ ID NO: 10031 - protein, 177 aa, Chlorella protothecoides
MRDPPDGERHEIFCRPQHKEPTRHLRLSGCGPGLGCDPERVYAQLLAPLHCVRVAPSETGQAHIYATFPDPETANAALVTLHGQEYNGRTLGVKFAETKRMKKGSAPSHLDALMSASQAGIPGLDLILEFVSTQEEVELLALVDAQPWEYLAKRRVQHHGMRFEYAVSGGGACCSAM

SEQ ID NO: 10032 - protein, 216 aa, Chlorella protothecoides
MHTYHSALLLTHPGSDDHLACVFELRPGPGVGSLGSSTPNIENWRLKAALRGHGNNVVDVAWSPDDALLATASLDGTAAVWAIASGQRVARLDAHTNFVKGIAWDPVGSYLATQSDDKSVIVWRVEDWSQVARIVSPFSMMISSTFALRCSWSPDGQWLLAGNSFQGATHAAVLVPRERWTRPKDYLLISGHSGATMGDAGGGDRLRTRWRRGCAE

SEQ ID NO: 10033 - protein, 113 aa, Chlorella protothecoides
MASRPNWGLDELDFVFATLVVGSIVNFALMYLLAPTGAGGTAAGASLVTKLFSDHYLKAWGAPAYPAVNRLDLCCRHPSLAPQIRVDFNLEGLRRPPTRASLQVATCLSRALP

SEQ ID NO: 10034 - protein, 223 aa, Chlorella protothecoides
MSLSKTSKLLQYINFRESLGSSPAPVVVGGGCLQSNLLAGSRYPLSFHPTTKIAGMRVTLSDKRQVVGRFMAFDRHMNLVLGDAEEYRKLPPKKGIPEEEVCVRDGMRKRRELCFRTSCAARRAWELRCWVVFQEGDCMLCRSSLTAAVYMLLPLILPLPLHLPNGAAGAAAGAGLGHPARRRGHGPDDRGAAPGRRVTRGQGGPRRPRRPGPGPRGGAGHAR

SEQ ID NO: 10035 - protein, 284 aa, Chlorella protothecoides
MQGLDWSALRCFSSTGEASAPEDSLWLSARGGYKPVVEYCGGTELGGAFMSCTLVQPQAPSTFSGPVLGSQLVLLARGGGLSPHGDPTRLAGEAALGTPSLGQSQTLLNRDHAAAYHAGMPPGPGGRYGLRRHGDEVERLGGGLYRALGRADDTMNLGGIKTSSAELERAVTAGVEGVMEAAAVACPAPGGGPDLLYLFLVLGGDARGVTSGASVGSGAMGATDNDPASSKHLAAAAQRAISQRLNPLFRVHRVLVRQALPRNAANKVMRRVLRDELMATQSKL

SEQ ID NO: 10036 - protein, 126 aa, Chlorella protothecoides
MDEQFELLQAWHAWVSREVGHFKSKFRGAAATVLGAANCRGFTLGERAEGVGRGVENGEYEGPLKLHLPVNMELDPDGAFSFDAPLPSPTGKIGEVRPRDPVVYECLAWMRRGVWRCAPPGACMQA

SEQ ID NO: 10037 - protein, 78 aa, Chlorella protothecoides
MQHPPPSRTAVQFMDIFKALTVPSHLRPPAAAVNWVPLSGDPALDMAMREQVACGVALIAKVLDRLGEAAQREGRPGK

SEQ ID NO: 10038 - protein, 172 aa, Chlorella protothecoides
  MOD_RES (121)..(124): Any amino acid
MPSPQASTPARSGGDGTVFEVLQGMLNRPDWEAARQLPLVQIPAGSGNGLAASTGACAPGTCEAPSAGCGVGRSRRQDAAGGAAAARLGALPSPAANCAGPSSCGGTHAHRSGSTGPAARXXXXKAQGLHPAKGRMHIGAAALAQLREPASHHLYPLRPHPPHPTHAQACGT

SEQ ID NO: 10039 - protein, 353 aa, Chlorella protothecoides
  MOD_RES (123)..(126): Any amino acid
  MOD_RES (217)..(219): Any amino acid
  MOD_RES (347)..(350): Any amino acid
MDVSSVLQPPARRVFSFLSLTYGMIPNLDIGTDHLRWMGSPRFVLGAIHQIMKQGAYPARVSFVDVRHGVVQGAGHVEEGTNGAGPPMRHIGAFQRLPDGAGRACLEYRSPGWEWAQEASGAXXXXPAGRCVARLFGVQEPRMGMGAGGLGGMLSRLHCQACGVVDAALSGSGLRPDTECLLQAPHSPRRQPSARRLQWHCLPGPDGPLAAPAGGGXXXPQACASDLTLSASCKPHTPHAINLLHAGSSGIASLDLPAPWQPLLAGEVQFFAACNIPWLDTNFHVAPGTLLHDGGSRAGARRRCWVRTLTGPECVWLACHWTRAFPDLSSQVSPHRQGTSRCCTRWXXXXSAP

SEQ ID NO: 10040 - protein, 170 aa, Chlorella protothecoides
MWAMAVELARRGGGYGLVGVTMYYAWDALGDAAIYLTTKRHVMDAAQSHNRLLSKLGTPVNAGPWYDSSVVIGRGGHTASVTLPLKGPERGSDVTVKLVRAGGFASSTLFSLLQGDQWEGMLMDAAVGMGPGGRPVLMSLLEAEEPQLKASDAHGNAALARRAATVERKQ

SEQ ID NO: 10041 - protein, 473 aa, Chlorella protothecoides
  MOD_RES (10)..(13): Any amino acid
  MOD_RES (172)..(175): Any amino acid
  MOD_RES (311)..(314): Any amino acid
MPRARVGTKXXXXLGAREAWGGGDALLGAADAGAATGDWERIVAERRDGIAYEAWRRPLRRGLYLYRTRAVLEGVRPADVRAFHLDDAARARWDEAATLVARVAPEEAAPEAPESCLQKYRSRFPRPMVGIAEGGCCGRKGSWRIAVIMLVPGSHQPVDPPRCLNPMCLPPXXXXDCRGRVLWQGRIMEDGSDHARAWVAPASGSPPLPRSNVPASTNPLQASREYHYARRVWDRPADGGCYALCRDVELPGGEKSGLDAGAQTRSECVCGAPGCRQGRGRLRRALQQVLCGVCPFKQPSDPFGHSLTTPXXXXYALCRDVELPGGEESGVDAGAQPRSECVCGAPECRQGKGGSRRALQRVLCGVCPFQQPSAPFGHPLTTPPAAEGAVKGAVRVREYVSCIAIKAHEVGTELLTCYFEDSQVRPSIVKMVVPKSLWSLVQKYESALRWVQRGAVRWIRARTGGRREIEWRT

SEQ ID NO: 10042 - protein, 675 aa, Chlorella protothecoides
  MOD_RES (291)..(294): Any amino acid
  MOD_RES (320)..(323): Any amino acid
MQRISLQPCFTACGETPLAHILRLGDVTLLLDAGWTTEYLEEDLAELRSALPSIDAVCNGFLRSPLPYPCPPHSLPAVLVSHADVAHLGALPALLGQGDRTLPVYITGAAHKMGQMELYEECLVRSGCSEFTAFSLDHIDAAFDGMTTLNYLQHCSFVGKPAQTLHIMPYSSRDPSHHGLTIKCICIAVRDTPVRIVAHPAGHRLGGAIWHIQWSNEDINLSPRRAEQSIACQCLPPSGPTAQCSAGIQTLKRPLRHNTSSSCLRKERHLAGAQLPGIVSRPALLIVDGAXXXXEPLPSPCRAKHRLPVLTALWPHCSMXXXXEAGHDNQSQKGQEPGAEVDACQDDAVDRDGQPVLDLAGDQGGSRHGGALRGVQGQILGLVLDQGGVGVGEIAHLAHPLEVDRDAGHQEAAEAEQDQQDKALKLPSLAGLAGCSRVDPRFSAAHPFPATFWKLSWPHCAQKAMSSSPWTPPAESLNCSCSWNTTGEGDAGVAGGWCRGFWDAESWVPLLWNSKLKAGFATHPNPRQPPPGALSCPSQPILNTDPPPHPSAPDPLTPALQGPAPPALFPCLAELHGRQHPGICQDADGVDERVAVLARRPAAGQSLPPAPCAALRRRRRTGAHGPRAQSGAGQPGGPGCGGRARAAGRLGRRRAQHGRPALGRGGPALAGARAG

SEQ ID NO: 10043 - protein, 63 aa, Chlorella protothecoides
MYIREELERSGEFKAGEYEGSLVHVFHRMDDLMRSAEGFSQLESIRKSLDKGEGRRSGACSLI

SEQ ID NO: 10044 - protein, 108 aa, Chlorella protothecoides
MADFYAMMSSDPARAFYGPGHVWAAHELGAIATLLISEGLFRTSDVAARRKYVALVDEVAAGGGQVMLFSDMHGSGQQLQALTGLAAILRFPLPELEDTLMDEGVAVI

SEQ ID NO: 10045 - protein, 219 aa, Chlorella protothecoides
MHRGAADLSARTHNGEPLPRPAPGGRGILHGRPAPGAPHADPRMPMPTCACLRECAGLATVVQPGPCTQADLLSSWPASCDAPAVPTSPRSFVTVDNEREESSTVLEVEIKDYPGLLRIIAWVLNGLDLVAENAVVSTDAEGIAHNTFWLTSLSGERAQGGCGDSHMGRRGSEPGSCARGRIGAAAGGQLSGGVARKIAGDHGHNPISPAFCPLMQAIN

SEQ ID NO: 10046 - protein, 279 aa, Chlorella protothecoides
MSFRPIQAGEDLWHVFNLVRTGDKVAATTYRKVQRDTGMGTDSERIKLRLMIQVEDIDYDAAGEEIRLKGRNLTENEHVKLGAYHTLELRRQAAFTLEKEVWDGVDLDRIAAASDPAASADLAVLLVGEGLANLSLVGANATVLRARVETSMPRKKGAAAAGRDKAVHTFQSRVYQVPRVARVLLACQGLGWACWGCMCVAGYCVLAGWLRRTACMLATLVISRRPSLSITCNKPSFSHQLHQAVLQHVDWDVVKCLVVAGPGFVKDQFLEFLFAGGVL

SEQ ID NO: 10047 - protein, 114 aa, Chlorella protothecoides
MTQAEERTKVVVRHLPPSLSEDAFKSAVQEWLDRSNWSAYYQGKVRCGGTAAAMTLLSRWDAPANCAPCPSTCSAKEHVHSRAYLNFKDPADALRFSAAFNGNLFVSDRGAHTR

SEQ ID NO: 10048 - protein, 314 aa, Chlorella protothecoides
MGGIRAWAIAWGRHAPTVCPTRESATSWSRAHQSSLHELVSALFTPFIKTHPRSASATEDEEGDDTYSMLRKLVSLQRMQNSAAAAAAAAAGTANGRAAPLESGSGTNVADPGAPAPRPLPGVEATVQAGCTAVVALLKGRRLFVANAGDSRAVLARRGVAVPLSHDHKPSAAGERARIMAAGGFVSEVGGITRVNGNLNLSRAIGDLRYKANPALEAKDQIITAQPDLCVEALVPGDRFMVLACDGIWDVMSNQQVVDFVGARLDEGLTPTQAASELLNACVASDPRETRGIGCDNMTASVVVFKGLDEEGAE

SEQ ID NO: 10049 - protein, 175 aa, Chlorella protothecoides
MRTLPSERSVATTASKKSLEKGGQQRSVGLRVLTFVLLILLSFSGFLVSSIPVYFKWVGKMSYLTYAYTALVQNETQYLTLYTPEGAPVAASTLVPSQIQNGLSIAVNCVILACIYLGSRLLALLGLGGAGDNARQLRPRQVPFLPETGGGCIVSEWALESLNTSRTLSSGARGR

SEQ ID NO: 10050 - protein, 250 aa, Chlorella protothecoides
MLGYCSEACAGSRVSQLVPRGTTDALNPYFPPKTTWAEIVRGGAFTGAHMHGQPVVGWLVLCVCVVRRLPLRCYDGHNEGDSSPRIYHGVKVSSSGWGASGSGAGGVRLSLAQTPYQLRRNTTPAPLRIRYSWEQLTLSTMMSAVSGAFANLHISSRPRAQLSFRASVCPGSMLVLPRPGVARSALAFLVEAKQNSLRRERTSEKARLRNKGRTSEIKTRIKKVGPKEGAKVGGVEQHRERGDTLVQVQI

SEQ ID NO: 10051 - protein, 228 aa, Chlorella protothecoides
MVAMGDADGMVSGATCTTANTIRPALQVLKTPDRRLISSVFFMCLPDRVLVYGDCAVNVEPTAAELAQIATTSADTAAAFGVEPRVAMLSYSTLGSGAGPQVDLVTEATALARAARPELAIEGPIQYDAAVDPGVAATKVKGRSEVAGRATVCVFPDLNTGNNTYKAVQQSTGAIAIGPLMQGLARPVNDLSRGCTVADIVNTVACEWEFGGEGGLNGGWLGAGAAPR

SEQ ID NO: 10052 - protein, 441 aa, Chlorella protothecoides
MGVAPYVWWQHFGAIVFETCGTWAQSQLVPYKIWTRAIASPRSPMSRPAQATPPAVPTPVQLTAAGAHDQALQRMPLYGMWSHSLPWHPPMYAASSSSGPPRAPFSPRCIPRWQMMAFRLSTGLPSVLAARGTRTAAPGNPPGSQATPQHTSPFLHSQTLATPPSTPPLHLLLGIVKASPPDRLLIVQLLGQGIHVGSGGHGLVEGGVKHGDVGGRGEGGHCSLDTLEAGGVVKRGQADSLLDHGLHPIVDEDRGADVQAMHHTVAHAVHAAGKAGGKGVCQEARYQPQGVLVVVEALLQGDTPALRRLGLPGQMTWGEIGDHALHDEERVLRIDVDFRSYTHPTFILELAVSPMRSHSPEARDSNCPLPSAWNTLNLRDELPAFITIVRFFAGAIVRAHGLWGSQGGGAGERRAVHAVSMQDNGAPRCESSKARKEGNSR

SEQ ID NO: 10053 - protein, 317 aa, Chlorella protothecoides
MDHHCIWLNTCIGTRNLRWFLAFLASTAAICIYGARGGWRVASACEVSGPGPLLSGQAVPGDVLRVTHTWSACRVCDRLCPSQPARSSTLAPQGAVLGARIMHGHMGVEGAWKLARVRRGSGRLEYVSDSALTTLRYVLERYPVQVGLRGWVDRAMLLYNGARVGRSHARPELRRSTSLRGLSCQWRAVSYTRTPWRTLGEVALSPVHDSTTPGPLVPAFRHTPPLQFCLTFFLGVMGWVLTGFLGYHIFLILSGTTTNEASKWRALRKDLARQAAFDPAGLHLDLAPDNAYDWGPGRNLLDALVPRVPCTKDSKLC

SEQ ID NO: 10054 - protein, 100 aa, Chlorella protothecoides
MPTPLLQIAYVGDGNNMVHSWMRLASRIPMEFVCACPEGFTPDPATTELCQATGVSSISISHEPFEAVKGADIVYTDVWASMGQKEEAEERKRQFKGFQV

SEQ ID NO: 10055 - protein, 332 aa, Chlorella protothecoides
MSMLVTYTPVGARSQRLGLGTPIRPTASPSRRTAHIRARAAAKSWSSKDVSPPSSGTHFLHLDDFSKEELVHMLQTAKDAKAILKSGDQSFKPFKGKTMAMIFTKPSMRTRVSFETGFTKLGGNAVYLGPDTIQLGKRRRVYDYQLGRCPRANTATPAKRDATSLPFQEFSIASGRQDAILPECTIGPFPGTRTAHPLHTLLVSHDCRYNEMIMARLFGHQDLIDLAQYSDSPIINGLTDYNHPCQPIIEGVQTPWEVLMTAPPNQLFLDTLQIMADMLTAWEHLGRLENLKVTCWRFGYEEVMQMNTMCQQPGRPGDGGKGYAQGCGDTMP

SEQ ID NO: 10056 - protein, 707 aa, Chlorella protothecoides
MPRRLAPHTVPDDAASAGPPGTAPAGWCGGSRLGTPGQLPSWGGRRGQKPHRHCPGGCAVRGSQALGASSPVGADEFKHLHATNPSEPRTRSIGAPPQDLSLSVCEESPRHELVIAARLSLCTDPAPHRLVVVLQVEAGQQEFLAQVHLKLMGGRVWIASCMLTRRREENVPNHLCHADSSPGGQLDGCKPFLSLPPAHLPDGVPQEGESSWPAHGTQLIWRRPGGGCCGMLVDWHGLRQPHSQLAREGWPKDAQLRKSTRTLELPSNGDYMRHSSAVPLCDDPTLVSFAGHVSIVPARRETQKGAGSHAPARCVLRSHSSWGSFLLLQGVVDPICAFCCPFCPRNPGRTARRELIARHSSFRWVLETRRRWTDGSRPSLWATTEFSHDRPQSGRGGQGSQDLACTKHMRRNCWVQGSEQCSVVHEVGALNVAACQLLHKLAPFPPPPPPQHIHTHQDRSYSASNAKMEIWGPLRCPPHRCGRSDGVLRGPSMWLSRCGVGHTPASSSLHAMLHVSTNGLAMRLAGLIALTLVTVFVGGRYSMRSAREEVPNDRPAVTPKKSSAPEGRFPFVSWLADSSVALLVPGHSLRCSQVPTPPGVQCVIPRLCRPPTHPSTAGSITGDFSARHDYRGHPRAVSARRGVVAADHGRCSDMGVDTLRRGGNAVDAAVTTTLCQGVMNPAASGLGGGAFILVRRGEGGAVDGGGG

SEQ ID NO: 10057 - protein, 269 aa, Chlorella protothecoides
MAVSLTTTINTGFGSKILSPSTGGWCEGMPAGLMWVAGCQIRHVRMHPAEQPDGRLLYTRAVQRVWLPPISEQLHQVGRGRGKGAAPPALPGPRRGAGRIRVCDCAAVATPCPAVRGVARGALLSSQFKPLNLVHAPPTLQAREEALQFHEPPHRGAGWQAARVRGGPREVLCAPCAAVHNEGPRRGGARVNTWRHTASTRHTESIESRPPVRARRLVAYGEPAFDAVANPRLHHQLVPSILYAENWSVGGISFNYSTPLLAVRRAGCM

SEQ ID NO: 10058 - protein, 239 aa, Chlorella protothecoides
MWSVGSFLSLAVRPLPLWGRGLIPTSSNPAQPQHGGAAGLPGTHGQGLGERICASRSGRGLAALRVPPARPPEGRPTICTAADWPPLHPSPTPGALLESIAEIIYIPIYDTAATVSGGVLAVLELMVSSDAHDPQVVANTIACVARILDSLALHLSSSGSGAPCSLPGSGPPSPTPTDRVGSTRRGLPPVMRVSAPAAPQPEVAAAAAAADGQARPPRSSSAGRMQRTRSLLVIRPLLC

SEQ ID NO: 10059 - protein, 94 aa, Chlorella protothecoides
MALPTHVAHACLATMNRPDAPTRCPRAAFGSLTDDADTVFCTNVSALQGSSPVLLGLLDYFQRQTPHVGFFQPIGANPLNGASRYTGEPKHVAL

SEQ ID NO: 10060 - protein, 175 aa, Chlorella protothecoides
MELQAGRIVPFKNCGGVFAGTSRPLLPTGGWGREGGGQEAKGWLAMPVCCHRWRASTPLNPGSTSEAPTVPPLPSISTGRLTAAAMCATIAALQPEGAIVVDEALTSGTAYWEASSGCPQFSHLTLTGGAIGAGIPMAVGAAMACPARRVINIQVGSTADAGRREAALGREGLWA

SEQ ID NO: 10061 - protein, 302 aa, Chlorella protothecoides
MQRHAHYLCGTTPLLLSLWHSRPPPRPTDRPDAAITGGLAVAVPMELQGLHSVHSRHGALPWSDVVAPVVPVAAKGFPAHPYLVAALGNVNQSAVLGAFPAFRDAFFVREGGGWRAPRVNETCCARPALARLLERVAKEGPGAMYEGETAAGLVLEIAGEGGVVSEADLAGAQATLSVPSRERVLGLEFWTPGPPTSALTITSALRILAGSHGCGGARTSPCPACPTSTAPWHRTLAGYDLPLAGSGALGMHRTVESMKHAFAARMSLGDPGPGSKFLDVDPVLQDLRSPSYADALRRVPGA

SEQ ID NO: 10062 - protein, 107 aa, Chlorella protothecoides
MPGVPGGAAPQGARVFQGDSIPPLVMRTHGVVQKFPTHAKPTHPRTPPSCHHHQLALGKKARAAGLVTYTVQDAGRTQVAPGSRTVLAIGPAPRTAFDAITGHLKLL

SEQ ID NO: 10063 - protein, 553 aa, Chlorella protothecoides
MASPKHACTLGPAAPVTPSSVPSKWLSACLALEAPQPCKAFRQAPGSLLFPTHLHHTPHLSLLPSPPRSASGLRFTGDLKAHTHSITGMVSAAHSPAALYTASGDGVVRAWDLRAGAVAQEFRAGCRGEALSVAVGPTLVAAGVADNLALWDARSGRQMAHWGDTHAQDVTAVQLHPDAPAALVSGSEDGLLAVFDLSAGLGEGQGVWGGARWLALVYGIHRLPCLWGAWRWDVPGPRSTGGRLRGVCADDALAELPSSPCPEAAGAANVQALACVSLQGPDSSTASHPPPPLHHADEDESFQAALNIDNAVAATGWYGQGGTKLWCTTGTETLHLWEWQAACNEEGGGEKPGGWAPDSAVVWCLDGRCSQHIRAKVFVPFLSVPARQLPPETLCGTKGIVPPCPASGGQGSLADVADARAQLSALTPDFEGGVSYLVGCSYDAASGTLGLLGGSLEGGLGIYPVVDSDAVAPLRAPLSVLAGGHADIVRCALPLGGGRVVTGGEDARVCLWDLTQNGADSSQGAGSVGPAAPPAPGRGSKHAPQHTRRTSPY

SEQ ID NO: 10064 - protein, 597 aa, Chlorella protothecoides
MTSTILLAVHCKKGESLDLRKAVNTYVAGTYGVQVGDPGGGVAACRRALSHSPAGRCVPAAPGLLPFPAPYPPPQAAEEAGDDMQEIQSLRDDIVNLSGSLQHLRRTLSKYYRMLALMESRFPLSRSREGVNLTFSWADAFKPSKRAEQASLDFERAAILFNLGAVASQQGLACERRSEAGLRESARVFQEAAGYFAALREGPCLRIERPAPMDLTPEAADMLCHMMLAQAQECVFEKAAADRKSPALLARPSVLAATSEPPSPHGNNHPHRLSKQVSSYYDDCSRLLTSAPLTSHFDKSWVAHAGVKSMLYDVEAIVQSSAALAAADPLAGVAQEIARLKVLCEWNCARQGVPCTIDGPHDTVFPCPRLRQAAQIVLARARKDAKATSKELQENVAAKESQVAQRLAKAERENATVYLQRVPAEADLPPIAPASLVKPVAPADLEAVDDEVRNLFSSVIPDARWGWVPGEEGGPGARGPQGVGYALASEAPGPCSFKQSQLCLLGGTLVWHGPDLACPMPAGHRLHRSPGGRTWSLRLHRPLRLPVTLLSTAQRKGAVSLHRNGGHRDPESHGGPGCSIRRGAAAAEGVGPPRGEW

SEQ ID NO: 10065 - protein, 136 aa, Chlorella protothecoides
MPGAVTMHAILPSAATRPVALTRGAPFRARPPHDASQKALARRLHTMRNERAGKVVCAAAADDSPDGNPAPKALAPSPPTTSLGEMASYYLSVQPHLFQETVDRQFSLLQEAKEKDQASESGEGTSSTSTDLVLSR

SEQ ID NO: 10066 - protein, 463 aa, Chlorella protothecoides
MAGTETGATAVIRGARDAGIEVCFANPGGSGAHIGYRRTSEMHFVSALDQVPGIRAVLGLHETVCTGAADGYGRMAGKPAMALLHLGPGLANGLANLHNARRARTPTLALVGDMATWHQPADAVLAMDIDSLARTVSEEVHRAGAGGEDFRHLAERAAEARGVTTLVVPHDVSWTRVPAPEDGVKGGGREGSGPGAAPAPPPGTEEFVRDLAAAMRAASQGRLGIYCGGKALIDDGTWVRLGRAVCMVMHFRGRVRQVLPASACQPGVDWLDRVGRDDRPSPRDLGAATRSVPLAHPEGALRLLGQIAAASGADLLCENSFARVDRGHGLPKFRRVPYFPQVRVGGSRTRWCGEVRCSWLLMRTKGTLLWRGDSQDGHARSLLHPSSHNALDRIPLQEASAALGKYETLVLVDARRPVANFGYEGGPSQLVTQSVSGLGPQEPGCIWAGEGDEIILGPTSCAQ

SEQ ID NO: 10067 - protein, 387 aa, Chlorella protothecoides
MSPPPPLRKLVRLPSPPPPHRQALQALEAGSVAALPDAVRSELEDVERSGGLKHLQEVAQQVKGMTCVPWEEAEASLASTDGDGDCGGGISGLAVPSSDAAFKISPWMVDCIRNPNLLLPSPNPWARLVVCRCHSPSLPDRLQEVRRVAVEELQAVARDLANEEADDEQLRCAAQGRVEGGARCGPHASGARRAAHCSGAGTPADRMAGAVAQAHLPHTPKPILLPGLTTARAGTVHPAPSSHGACATGWRGTSPTWRWLGRATPGAGGPRDAAAQGSPRVGRDACVAGPCTWLQPGRASPRCLHHPGPPAGAHLDSSPLVAPVTRLERRLAGESAAFAALGIEAAAAEMPRLQVGRVHSEGHSGWYGPPAVLNHLAVGTCVHLVAP

SEQ ID NO: 10068 - protein, 151 aa, Chlorella protothecoides
MFHLFTERRLVTQEGGALVERQTKALFGDPKALQRQMQEAVGKDIASLDDLMERVQKGALGCWAPPQCAKERAALLRRPVHWSVQPTPCINPQAVADGKVETLTLTVGTQRRAVLEAVAYGVFLRDVESWVDGEYALLSPHRGGGSAGLSL

SEQ ID NO: 10069 - protein, 87 aa, Chlorella protothecoides
MCREDDECLGVHTPVSWLQVNDELKMGKGKIGAQCAHAAVGAVELATLRAPHVLDAWESRGQAKICLRADSTAALVRPQGVRGVSGA

SEQ ID NO: 10070 - protein, 223 aa, Chlorella protothecoides
MAEVQRAERGRAVEDLMYVCILGKFRDLGVDMLPRIEEVQESSDTLRALTEGVHSREALDMVKEHVLGVLGPASMAYAATKIKMSALQAAQVYAASVLFGYFLRRVDTRFQLAKSLDMLPESQEEAVARLERLFSAADDGLPEGATPHPEVPGSDAAAAKPAEESEAASSDRPPADQPPPTSALVKKTKGALRRYVESFDQQTMLDMAKWVGTGEAEGLFVAG

SEQ ID NO: 10071 - protein, 175 aa, Chlorella protothecoides
MPTCCSPLLHPPSHPLSGDIDPAIVTYLLGQGHSGAEVDALLNKRSGFLGLTGHSDLRAVIDGAAAGSAPDRIALDVWRHRIRKYIGAYALQMGGPLDALIFSAGIGENSSILRAFLLEGLEWYGIALDEESNKAAVDGVAGNITAPGAKVQVLVIPTDEELSIAEQAIEVVDRT

SEQ ID NO: 10072 - protein, 118 aa, Chlorella protothecoides
MKHAMGLKDPSESMYGVTEEEAKRLLTLGRFDELMDRVGGGLKEAALRGKLAMKKAKDVILLEGATVRGLLGNHNELNAKIAAELDTSILMVGWARIPGRDAGKEWSAQSVCGPDSRS

SEQ ID NO: 10073 - protein, 315 aa, Chlorella protothecoides
MLRVSTGPIDRNADPESKQTADDEDYAGQLARLMSCQLEGEPVVTVRQLSNARVNVSAVESSEPQKEFMPHTARLRSMDFSAHAQDGLDCQPVGPGQCPQVRAGGGGQAGGVGDWPAPGGGHAAGAAEEAQPGSAHNGGGRQLPVSLRGSLGLRWVQGSYAEAQQRGGGGVPWFCAWPCHASSPACELGYCNPAAGHRRPAGCTPNRTPHCRKARGVQEGQPHQVPYFPCLTFATGSQEQHMRVRRAAIMHMRRCPDEFRAFLGSDFDAYLASMSESGVWGDELTLEEEACLITPAKHIFSGVPSHESAAVSRWV

SEQ ID NO: 10074 - protein, 550 aa, Chlorella protothecoides
  MOD_RES (338)..(341): Any amino acid
  MOD_RES (404)..(407): Any amino acid
  MOD_RES (470)..(473): Any amino acid
MTVLPCPGGCETLCAKHSEPPPRVMQRAISDALCITISVVIGATQMVRYIPTDYRQGKTVRRMWVGRTDAWTGNRAGLVWVGVAAPSSCAEARMQGHVLTATPLFDSRVHTPHSWVEERTPRSTHQLSNRVLSRNTSRRQDGGHELRQSHCLPGGCLRSTSHSNRVAERRSAAECCFLPLPPQGRAFTCVDLALARPGTAPWRTVPCTGPDLTPSHRPFQVRSSAVEQKRQFLQRKGLTDAEIEEAFRRVPEAPAAAYVPAPSPHSVVAVPAGTVAPAGYVPVQQQQQQLVSAQPQPVRWGQGMPTSYIVVAQNIHHPQLRQAMLGAAFVAAGVYALXXXXGKGHGRKHHAQRSALGPYCFIGPLLFGEDAHLIHCRCPRHPPTPTPTGHAGRSLCRRGRLRPXXXXFAVPTIRIPACSAHGPPCPARSLQAQTSELRNTVELLQKLTVSLESSVAESKRAAQDSLSLAXXXXLLFQQSASQPAQLMGHPCPALSLQAQTSELRNTVELLQKLTVSLEASVAESKRAAQDSLSLADLRAELRTLAGTIRE

SEQ ID NO: 10075 - protein, 126 aa, Chlorella protothecoides
MPLTFSLVASGRICPTSTSYGPSSTSLQAHGAFFGPSRVAPKQRKARRSILASRQPRRVRLNAVAAASDQALELTEANVEKVLDEIRPYLMADGGNVEFVEIDGPVVYLRSGSTCASHWRARGPVS

SEQ ID NO: 10076 - protein, 298 aa, Chlorella protothecoides
  MOD_RES (127)..(129): Any amino acid
  MOD_RES (279)..(282): Any amino acid
MAVKTEGVSEAHAKLWLRRLSLRGGGGPPPRPVWHWHYAAWPDHGVPASPEALLRLVGELAPVQTPILAHCSGGGGVPRGVGSVEEGSGERGVACAAGDPCRSGWLAVVSPPQGSSPSSPRPTPQTXXXLWRRGRVSAALPMRLVTHAGAGGWPWFPLPRAPHRPLPAHPPKILSRHRAVWRVCGAAGGRAPGGGRAERRAPRQRGGPGRPARPGGRVSCPACGVRADSGPVRLCAHGPQALGGRAPGGGGGPGRVSLDPISEPSAQGACPAPWLLHPXXXXKRWAGERLGDAEDQGA

SEQ ID NO: 10077 - protein, 227 aa, Chlorella protothecoides
MSSCEVVQLPARGTLDVFAHQIPEVLRALLHTIIFHRALGLVRPQEVDSQLFDLTWVSCTTGAPAGPPPIQAVGPPNRITPPSAGPVWGSERRAQDRGQDSPIHGLGREEPQQARPGGNGMGRVGDHPMAALRITMQPASSRVLTLCTPSPCFSLFVHLSFPGLLVLLREASEGGLVWVPGTAPVLGAVVRGSGRRPVRETCDGGPQHALPVALLLGLGALGPWPAE

SEQ ID NO: 10078 - protein, 321 aa, Chlorella protothecoides
  MOD_RES (202)..(205): Any amino acid
MPHSINLCADSWAGMSTELVGRVQRDRFDGVAQAQGDWESRKESGKPTLGCVGEDYQSRAFPRHLPPPLQLSCYIVSCPAAPDPISVLGPGHQALQQQLRLFRVRLGARGRCARCARQSRSFLKGGHVQQVLAGHRGPAAEADPASRAGHPGPPPHRASGGAIAHSALLPRGGAGCSPSPPSGPSASRPAIRSSHRGCSRCXXXXEPAAVPLPTAPSSRAKEQAAVQAPPRAPVLAAQPSVPAIEAAADAPARPVQAQRNRCFGCNKKVGLLGFECRCGFVFCSSHRHAADHACTFDYVGMDRARLAAQNPLVAASKLDKL

SEQ ID NO: 10079 - protein, 126 aa, Chlorella protothecoides
MPQALVARLAAKLSPKLLEAEFLALGQEDAAAVAAAAAAGGFSAATGCMERNRYSDVLPFDDHRIRLRREPSPGDAGTVSDPLYINASPLEGAPGDVPWHLTLAQVRGLPDEAVQHRGLIRGMGSD

SEQ ID NO: 10080 - protein, 168 aa, Chlorella protothecoides
MLSDDGCLMPAGRLHDVSDPHDRAVSPETAPELFVSMAKGGDVARAEKALLEHGRTTTLLPLALNQVVKSNPPTGTSHPGMDSVAVSVLVIKSLAALRTPLVDPGSCQQLLGLAFSRDGPQVKLSCLTQIMGSRSGVHHGEGACLMTWNGLAGCSVARSEVVMETLWA

SEQ ID NO: 10081 - protein, 129 aa, Chlorella protothecoides
MRIQLRCACQVSMVVLPAPAQDPFLTCTSPPPRQTCPLADGGTWGQATQSTAARHLSSKVTKQDLIVRFKAYKVANVHKAALSEALAGSPYAWSWVSRDNPASAFPTDFGLLRVLSTEIASVTVRLSAV

SEQ ID NO: 10082 - protein, 1120 aa, Chlorella protothecoides
  MOD_RES (260)..(263): Any amino acid
  MOD_RES (287)..(290): Any amino acid
  MOD_RES (1029)..(1041): Any amino acid
MASKHVLILGGTGRVGSSTAASLLRTHPDIRISLGSRGMESHGAAVLRRPELRDCPWIGCDARDAHSLDKALSSSGVDLVVHAAGPFQGDAACSPLEAAIRHGVPYMDVCDDAMYAQRAKRLEPAARAAGVPALSTAGIFPGLSNVMAADMVTRHAGGRAPARVLYSYYTAGTGGAGPTILETTFLLAGQDVVVYRCVLLRVGSVGMGTSEAATGRGPAIAALSRDGKQLTVPAISNRRPVDFGTTIGTKDGKQLTVPAXXXXRLCMHITAHYPSNCRSVYLYNLPXXXXPRPGRSPDNGLPAHENRRAQPYATRPCMHITTHYPSNCRSVYLYNLPETHTGRAVFQAPSISARFGIDPGVFNVAMILVARLLPKRREGGGVMGRVAQHWHLLPYDDQRSRQATMVLSAVTKFSSIPGWLEDRALVQTLAKLTAPLVALVDRFAGDRVGMLIEVELEGVVDESVDLSYSFLVLSDHANTELLQFSNFSVLEYSTMCDKAHSIPSVHHWFKFDLGFGFHVQLPNHSQMERCWPACTCTTTWQRAWALQWQPLQPQCSRVSGFFLAPFLFSKPDRYAWLRWTDTKLAVHASSVGSILHGTRHARCLTAPPSSRPRRRGHAPSSWAGPPGRSAAPPAALAWASTSEPGVLLCCRRVQSVGRVAWTPFCEHARPARPLRSEYVTRVPAQASARLQLSAGGSWYRAIRHESVLGMPALPAVDHRQELAEGQEGADADQPDDGGLQDAKVGVVRLLAQDVQHLLHHPEPVVEQGHALHHLHVVKDGAVEGADVVVRLVQRGRRVQELGQQVDGALLQEELAHQLHHRAATHIDLTLVWGWAGGGKWWRSGMWQCERELAHHHSPFMIPTQTLTGHHGGEVGHRPPEAAQVLLKHAELGGLRQGKADGQLHVQLVRVAVVQGDGVVLNHGLGDGRVGDQNTVPLDAVGRQGAVHTRHHQLVQYVPARESKEGRGRVLGPKTGFTGYCKGVPRRGFRGYCKGYWCTPPTSILNLGHSVRTAPPSTRPNRIRCPPAAXXXXXXXXXXXXXRPQNTTTPESKKKMSAFPLPLPPRWYCMQSTCAAIGEEHQALSGKRPPCLASLKLCRCHARAPSQPPPTPRQASRPTSE

SEQ ID NO: 10083 - protein, 167 aa, Chlorella protothecoides
MSAPGEEVLLAVETVEEEKVEAETRTVDHQRSRSVPSVRELRVGWDTHRVWSTGLGFSSGAPFKGSALGDLLLPFFPPTAQRLPSSTSTVRPLGRIVSLGPGWESPLDVEKPVEAPPEVPVQYQGLGQAVRVRSYCVANGFDRYALQDAILRRNATLRAYSDVGLYA

SEQ ID NO: 10084 - protein, 348 aa, Chlorella protothecoides
  MOD_RES (48)..(51): Any amino acid
  MOD_RES (267)..(270): Any amino acid
MMKRTRFACLNIKSSFPVPANPKLQKPGPDRRATKISRLGANAHVAKXXXXCEPGIAETWPRSRGDKDFSAWRQRSCGQVQARLRTCLGYLPCITLLPPYREEDRRYNARLAAVDWRCEEFRKYTMVKLVRFLMKLSNEKVQIELKNGTVVAGTITGEFPAVSGGIDCWARYASCRGSTSHPPMPPPPRAQACPCVGTQSATTSSPTPSISTPCWWTWTRPRHDPNVQNGRQEEEGAAGGAAVAAEGVVLDIWDNGIQQVATEAWHXXXXARRTAGRRKGARQGARPWPWQGSCLIPGIMAHSKSPLKHGTSCFSGWPALMDYCLLSPGNPCAPSHCASRTLRMHGNC

SEQ ID NO: 10085 - protein, 292 aa, Chlorella protothecoides
  MOD_RES (47)..(50): Any amino acid
  MOD_RES (142)..(145): Any amino acid
MGLMARNIGLSQSMGICAPNTRGRTMDSSFPITLYTLLMQFYEVPWXXXXALIGAWGFGIWARWREALAHRRAWAFVHRVQGQHRALGGAIRTHERWGFLAIGDGTGLAAAPPAFQSAGRHGELPWLLPLPGLPFFLTTHRXXXXYWSCSRTSCVSVGWASWGLAMAAAPPKPPLLPDHPPIYSPMDDACSGVWGYWSTDGLGLFEYMQLAEALDTEPVWVINNGVAHADSERSGAGEDCAVDCVEGASSRIDHAICRAPQAAKQTAPTGSATAYFQSLMPVLLCSVPTDDE

SEQ ID NO: 10086 - protein, 290 aa, Chlorella protothecoides
  MOD_RES (168)..(171): Any amino acid
MRAPSPNPTHNHSRLTGVPASDIWPYVQDALDSLEFILGSPDSRWGSVRSSMGREQPWNITYVAIGNEDCGKWMYLNNYLAFFGALRGAHPHLRLISNCDMGRDAPTDIWDWHIYTNPRDLFNKRNIFDGRRPEVGSIRGIWEGGGWKGRRPGLHAYECRTERIWDGXXXXGVLKGGRPGLHLYKCRTERIWDGSKEVLENHAPLVAACFQTMRLCKQLSITLRIMTTAHPRNLPPPHTHTLGIRTATLCLRPSTPSPRAGAGATLSVSAGALPGGESAGATGCADLQTD

SEQ ID NO: 10087 - protein, 505 aa, Chlorella protothecoides
  MOD_RES (491)..(494): Any amino acid
MTLVDWAPILASALAPKAKRGLTLSKAIKRCVKEAGKTHAVSKSELTAEFKAYISSRKRYDVCNGVLRNACCTVGKIFRNGAAHGGALEVKDGRIFPAKPRLASPPMETSSQAGSPSEPPKKRRKGTPVRVVDKEAVPSPASVPIAAGTQPLREETPSQGATELGSHWNCFQHEKCPGSRQILKERRVLGRRCILCAPLPHPRSSRCQRHAPRRGAWGRSIEMARLCPAARREGGPLHPGREGYHSPSPCQVGRCHSPSSTPTTSPGEHGHSQTDFDWVFNPQASRSGLWKAVGAYLPHRTIKAVWAASTRMLHSGNYQVKGGMAVCVISLGGRWTKEEDAKLLAFVEEHGKSWVKAEAALGRMAVSCRDRWREIRWAWCVVGDGTAFDDVLELCEIDLGTCLCLCLPLDLWQGMRRWGACSPSPIQHAPLPMCAGLGATRRAAHGRQTRLLGYERPSPTTRRRGRCASALKELAPSDTWDATHGLELVTXXXXLRGGAAGARRH

SEQ ID NO: 10088 - protein, 369 aa, Chlorella protothecoides
  MOD_RES (296)..(299): Any amino acid
MKVGVLPDRVLPTLLEDRLVQKGTILQFTTEFYVDFLSSDSVETLMETLRKARLEGRLLEFFPQQKQSWADFEDHFNAAGLKTLVEYSRRKLYDAHCAELRAFVRDTVAEGGEGAALGALVPAMQARQEEWSLADGDVARAAFLGLADSVLASAIGRNQQQVQFNVLRTVRHYAPALARFARAPRLEAALLQTVQVTCYEESRLLKIFKDIVKILYDCEVIGETAIRHWYTKGSNAKGRNVFLQDMQPFMQWCACCARGGGGSGRRLHHVCGCGAEGRPTKNRKVLAGSGEEIASXXXXQDMQPFMQWCACCARGGGGGGRRLHHLCGCGAEGRLTKNRKVLAGSGEEIASLSVQDWQQRGCDGQERGL

SEQ ID NO: 10089 - protein, 512 aa, Chlorella protothecoides
  MOD_RES (317)..(319): Any amino acid
MPGVDVDALEAAAAAAGKQDKGPDVARSDRAILIKNLPWSTSEDELQSLFAESGLHLDRVTKHWSRSMFEAHFNFACRHCHAFLHALTPPSPVPGPLPVLLLPGEVARFVLPDTKALAVIEFEDASDAKRAFRRLAYKPYHHVPLYLEWAPRSIFSGTPKPKAAKVCDGGGRCGLGPGCVTICGEAMEREGRMTATGVPKQSPAAWSVFEAKAVPAATLTTSPTIKPEAGLQATAAAAVLPEDTEADSVSIYVKNLAWATTDKGLHAHFAAAAEAKGAALRSARVARKAGPDGKPLSAGYGFVECATEAAARELIGXXXEGGAGRQAPLCGLRIEKTGIVWMCCGEVLKGSVLDGHKLMLQLSQKRDAQEGKGGVPANLGTKIVVRNVAFEATRKDVLGLFSSFGDVKSCRLPRKFDGTHRGFAFLEFSSKQETRNAVEAVQGTHLYGRRLVIEVAAEDGGLDELRAKTAAKFSSILGPETGATKRVPAPMDADAGAQLAQPPTKRAKKGKA

SEQ ID NO: 10090 - protein, 701 aa, Chlorella protothecoides
  MOD_RES (65)..(68): Any amino acid
  MOD_RES (282)..(284): Any amino acid
METQDDPQKAVERPPCSRLCIKNLPKYVDEARLKEHFSAKGEVGGWDELGAVRAPSHRFKQGFQXXXXHLKLPGPVCRCSVWVCAAIYNGPLPTGKPPSLTQHLAHSQGWKVSMLWVHWLPLVGRCRGSLQYAQQYGRAATEHRPWSKHTPGSSAHDKSQAAKPDVEPAPLKAREAIKAAKTKAAAGKKAPEEADPKLAEFLELMAPRSKKATWSNDDAVAAAAGSASAAAVQQAVQGSDDEEYEDLEGETWAGASVLDLLHPGSRLQGRAPEQEAGVTHLXXXLDNSRLQVCARLAAPRISIAGLGTGAGSRSDSSDEEGDETAPPAAEKDRLVVDATVSHLDYLKARRKAAFSDDEDEGEESTGAADSDEEELEAATGPSGGSEAGAGTSGSDAASDEEGDDAASEGAPEPDPGMQHASRTAEVSDTGRLFVRNLPYAATDDELRELFTAYGEVEEVHIVKDRSTSVSLLCACPSSVPVDNILTADSLPKPLSTRPGLHGRARALRTCCSARPQQRLQRRRAPMAPSSRAGSSTSCPAGQPPRQRRRVPAMPSPSSPRAWLAAAQRDFSQCSARCRPPLPPHPTHERLLPASPLPLSYTGGTGAKPEGRRGDQPRRLELAVRQARHGGRGGGRPLWHHQVGPAGPGVLGCGGAHGPGGGPGVCRHQGRAVRRRCCGGWVTMGGWGVWECLGTDDVFGVR

SEQ ID NO: 10091 - protein, 197 aa, Chlorella protothecoides
MGKAKKTRKFAEVKRMMSLKDVKPPPMKKTKPEDEVRHMYDVQLLSFRIRSGCSRATQLGSGEISVILIIQPSPPPTNTHAEIKRHQLCSSGEMECFEIGRCLTWLCSIAVMTSSVGLAVMTSSVRLAGEQSSGSFSDTPSTCQIDLVKGMMDCLYAECTPCICDCVMAELEKLGQKYRVALKIAKVCWWSWCETLA

SEQ ID NO: 10092 - protein, 540 aa, Chlorella protothecoides
  MOD_RES (77)..(80): Any amino acid
  MOD_RES (175)..(178): Any amino acid
  MOD_RES (217)..(220): Any amino acid
  MOD_RES (432)..(435): Any amino acid
MPKAESASPKTEPVRSAGLTRGVEGSAPTHTRSLLKASILNVPIGPHMVTARSSVWGLGSNYSPAAPFVDARKDDAXXXXGGWQSGNVSMQSWHVDWHPLWMRARTTLTSRMPCRSRPRARSFAERALVLLGKPISEASPGPAYTSESTTSQIKRALSFTAPAAIALTPEHGGSXXXXRGVAKWECKDALMACKMEQPVPSFSSLEDCFSPAFEIWXXXXVQQNPKSSRSQTFRPLKTASALHLKSGASAPYAARHVAMPCASAKSVSVPATLMLPIRGRTRQCIPHSAPRGHRLYTFTIIQRLPGPAEARRPFLSTLSPDAPNPNDDLHACTIQHREQPPRTQCGGARLLPRRREGCAAGSSSPRIGPGLAHHGEFGAWLLGQGGVGESAVPLKMPPSPAACASPVTLLAHHPTPSTPAMPRDVTRACGIXXXXSMDVTRACGIIGVSTQESDANLEIYEGLLMLQHRGQDSAGIVTTDRTRFHEHKGNGLVKDVFDSQDVLGKLTGGCDGMGWSWGGWGGAGGTGRCPSHTSSAAMDA

SEQ ID NO: 10093 - protein, 189 aa, Chlorella protothecoides
MCGTTGAWDGTGAPRSSSDLSPPFGSPFLPPLLPTTINDTLHAPDAVRVPEGQQADAVDEGDAGVGALDQLHGGRHGLGHQVQLLAVGVAGVLQQAALVGAVDLVRQHVEQDLRVGAGAHAAVEEGGAAVQQRAQRVRVGQVAVVDQVDAQRGVDEEGLRLLHRGRAGRGVPHMPQPGAACTCVHECLS

SEQ ID NO: 10094 - protein, 774 aa, Chlorella protothecoides
MCVPPLASCAQQCSLPLRLDSVTSTFMMFSIRQLCDADAALESGGELIDFGNLSYLPSEVWIRGRRRGRGTAGQGIICLRGSPTLLRMRCPPPLMPGLISPDACLAVALALPLEFPAEDLRVHVFDPVRSPRPRTLPAPPPPVPVLSLHLVPPPPRLPPLQRPFPGGRLEDGAALGSPKRGRGDESSESEPSPKRWPSSASGYFTDDSPSPRSTVSRAQAQGDPAPGTGARSRLATQPAAAPGQVEQAGAPPGGRTSAYRGVSRHRLTQRWEASLWLNGRQLYLGGFNGQEEAAAAYDLAALACKGLGAMTNHPPEEYTEQLAEIAGLTRVSHGRRWMPVWMCGPGPRTSKLKPRWGSTDELSANALTTISLTLAGRGGGLRAEAQQRLQPRQVQVQGRLGAQRALGGSHRILWGSKEREHGVGGEPVGSCNPPRVPGRCPRSQCSERSAHPARLGDASRPSDAVFHAAHSYHRPGGGAWCRCGEHFWVRSWDKDERSRPQPGARHTVRDRGMFRKAHVSGTLCSGISQAQPEQILGLHLKPTPSTLVRVGVPRQTSRSRTMSGRLHSTKPTSRACFVASVERVIFYSFISITPLHRPPSSVPTSQRSFKSGRDTSPEDRRRNSATNFVRKWLGWVHESKGVRVYLAREEACCHAPKCVRYRRAVTASGATRPAHGGSILCWSWDVGAKHFEHTVWGCSRASPDAMWEVYMRVVHSMVKPGSGGVYCNGHAQVGHPIPITPASTERCSVRNCVEAAGPAPGPPEAGLKGAIAAE

SEQ ID NO: 10095 - protein, 469 aa, Chlorella protothecoides
  MOD_RES (109)..(112): Any amino acid
  MOD_RES (292)..(294): Any amino acid
  MOD_RES (423)..(426): Any amino acid
MAVVPDAPRFPPIPAFQGSLERLGSQRVTLYLQHWPGFFFNAFANDAYIQGLADVVDQGLAQAVGVSNFNADRVRRAAQQLQVGVWNGEKVVQWRKEAGVREQHHCQPXXXXGVWNGEKVVQWCKEAGVRERHLCQPCPCAGVGVLRYRALGGGSALWTVVAVPMCLACTRVTRLTRAGDVPGLQPGAVQPAVPCPRNKWSAGGLPRGGKHPGGLQPPLPGLLGKAVGSRGLYGGRAIFPRQGVEVYGASADEQKPVCRFQGGRAPSPCNSPPHLASFSFGLLEKIPSPNLXXXHLISPPSLSATLRRCSAPIHPSIPQNKPSGVRGRNFSAAQYEELVRLLDLMRAVGAEEGDHTPAQIAINWLLCKGVLPIPGAKNAAQVRQGCVVPCGRWCWECARGRDVAWKLHRFQCIVVPYCAWFSXXXXCWECARGRDVAWKSHRFQCIVVPCGAWFSLILRCLLRCSPGLR

SEQ ID NO: 10096 - protein, 551 aa, Chlorella protothecoides
  MOD_RES (135)..(138): Any amino acid
  MOD_RES (476)..(479): Any amino acid
MPHPPPPDQVPDGLGPEESRCGEYGFLLQAHPPRPRAPAASGSGLPDRPGPLGCCAAELPGAEPSAADLCARGRRPHQGPRQGQRGGGASWRWLGGGPRARLEGRCGFWDGAGRAPHPEQAMKGWLAGVGSLAEXXXXSPRTSNEGLASRSGSLAETAAQPGLLIALRAAPSHFDPTSCTEHVSKHCKPHMPPHYSRGGCDRGVVGASRATVGERATDSGARRSLPQSSTSNSMQGIASPELHLALHAGGHALTKWRTEHEQVLSMDWVACPGTTDSSRASGPSGLSSQDSGHRQSTAGTLSWAAQVSSRPAHDRHAFLLATHMPGKHKLPAESQIPYGHRPQMPGCRRLALEHGPGGTVPEGHPANPADLQTMYSLACPLMELQHHYPNAQAFKAAMEAGATFLDTAEVGWDDAPPGSLFCQACILQFLGEGPHSPRLGPPSTTATPIVPGRCTGLETPSASSVNFLRAPGSNPXXXXTGPSIHYSNTNHSWQVYGFGNSERFIREFSASTGLEPDVATKFGPLPWRQSAGSLVKACKVGWAREPTVLPA

SEQ ID NO: 10097 - protein, 367 aa, Chlorella protothecoides
MPPLWDAPPRFNSWGALPLSPCDPPSPTQTVFGLVYVNPVCLTEFHTAVNRDPAAIIPAWDGSTGTRTLSFMKSVDAPAFIKRVLGSGTLRVVESQSVALGPVQGSVSLASVPCPEMKGADKFKTAVAVDLVPTPCGCQVWAVQCMWRFSQRGFMGSFQVPWVRFLQSHRGLTPPPPHAVSMHQRLPCAGSSCQPSQPALSLQVHARVSCSAAGPYGLSGAIEGFMAETAKASLVEFFEFCARFLAASGAERLLAGASEARALLEGLAAPSPAQLPRADSEAWADAEALPLPAADSDSAEVLYLRYLCSTGDQAVALLQRMDGRLARLQRDPRPAIPARDLVLGFAAGVVTASALGALALSWRRQSR

SEQ ID NO: 10098 - protein, 107 aa, Chlorella protothecoides
MERKDAVELREEKPCTVPNGSAWVPPAEPSNVVEPSPELLCRIIPVPDCWCGCLARQLASKTPENPGRAFFTCARRRKECGFYCWADEVPLPPVQKPEAAFSLAGAA

SEQ ID NO: 10099 - protein, 1780 aa, Chlorella protothecoides
  MOD_RES (917)..(919): Any amino acid
  MOD_RES (1108)..(1111): Any amino acid
  MOD_RES (1455)..(1458): Any amino acid
MTSMSRLSLASGSRAGRRTYPAFTGDIPRSVSASKRGLRVFAGVAMNGAAPAMAPGESFHVCGRGCSACSWRSQHVRVATVKRETKETRVEVTINLDGTGQADNDSGIPFLDHMLDQISSHGLFDLTVKAKVRLLLCLVAGPSHNHRALGSHSLQRPKTLFPSATFLITEQQGDTWIDDHHTNEDIALAFGTALSQALGDRKGIHRFGNFSGERCLHQDGPTQAPLDEALVDVVLDLSGRPYLGYDLAFRTENIGRFEVQLVEHFFQSLANTSGMTLHIRQPWFLERCGSEEWCVSRVSGVVLVFPEYLVVHAPGALVPGGVLLPCCHHFSCCFPPHRLLHARFHRRSQLAGQNSHHIVEAAFKAFARALRRACEPDVYTAPGRLLSGTILVLQTVYVPIPSINTIGSLYSGFPAPPFQKVKRVKPQSPCQACEWMSSPNTIRGILVSTLQSAAGAFLAHLRPGKPQYGCTDVWCASTRVPWPLAALCLPETSPCIPRCGAAAPGPTWPSRLGRSCFLPGFHSSRPDAPPRPAGRSRAHFSMFFGGGGFPGGFPYGEMPGMGGGRGGAGKPPDNQRYYDILGVDRNASETEVKKAHRKLALKEHPDKGGDPEKFKEINEAYETLRDPEKRKIYDQFGEEGLKEGMGGGGGGPADIFDLFGMGGGGRRGGPPRERRSEDVTHKMKVSLDEMYKGNVRKLQMSRSIKCPTCQGSGSKSGKKYTCEVCHGSGVEVKLRPLGPGMMQQIQQRCSKCSGTGSFTPPSDRCGACSGKGLVSDRKVFEVHVEPGHRHGSKVLFRGEAGADAPDVLPGDLIFVLEQKEHPTFKRIGSDLFYEKKVSLVEALTGALLHITHLDNRVLEVNSAGSIIKPDSWMAIKGRWPPANEALCIRRALVLPRGWVRDVCTATSACLGLEAVPXXXWPGDWMGLQGCWSPADEALCIRGTLMLPRGWGRDLCTATSACLGLEAVLLAAAMVWPVCRLGIPQLQTPPLQNEGMPIHGRPYEKGNLYIHFAVEFPDQLAPDAASALRSLLGEPAHTNGVVPMEELEEVQLTPVKDIEAEIKVRREHERRTAATEAGHACTEAGLSACTVPDPGCAGPGWCKAVVAVXXXXRTGECRRGWAKMVWWGVAGARQSRDGGGACVHRGWTEHMHGAGPGVASTTVTAMRRAGSGDSAWPAPSSSPRRLRRSPCPKWAGESNPDNCSGDNHRPSWWCRLCSRAKSCAALQPGMTPRDGFLGRTSLPLPLGAASNPDHIEHPLYECLVPLALPLATLLPAFSHSSVSFSGLIVLVGQEPSGPLGSQHPARRRQPTWLTLQRWPISTDVSALQDSMSVTYCTLASLAAGLILHLVHRKLKHVRARAKLLAAGQSLTSGLGQLSVLSYNMLTDAPGRAKTLRAVSPEALDWSHRWRLLSTQISGSDADIICLQEVSMHRCGFLGGIWCYCLVGATRCILADXXXXVHAQVRFSWGIWCHCLVGAPRCILAAVHGILARMPVTGCWPFGQHVLPHRQPAFMRLPCPLQLARAGGPALEPGVSSVCPGVDPGGAARAAGLPAAQGRCAVPGALRLVAEEQRLPPRRECSPGGLAPAPRQPPASAEGHPWAALREAGKPQGRCRRPARPGGGPGQHATGFPLRIPLFWQGGRALDGGRPAKGEEWLGDPGAYGRSRAQRHTTCCQRLSQGAAAHAASPSACRLKQVGLNRESLEHAFPLQEAYQAGQRLPQGKAQVPYRDTDFIWYSRGGRVVAVLDPMPAGLRHGAPHASLPNSTVPSDHTPRGAILQM

SEQ ID NO: 10100 - protein, 603 aa, Chlorella protothecoides
  MOD_RES (28)..(31): Any amino acid
  MOD_RES (120)..(123): Any amino acid
  MOD_RES (410)..(412): Any amino acid
MAYGNASAREHNRKPYARASHTFAPRLXXXXDPKGQSDSCKDVNAMPSGWRMVMRPPVNIIGSHTRELPTRSRPDSTWNSGGDIRSPLEALLEYAEGFLNVVYKHSRARHLCPVGRRSAXXXXPKLNSIQLRIRGELPQRRIYTPAVPDFCALLAGVPPGPHFLLTWRSAPSNLPQPAHHPIHPIHCLYADFLGVSSEEEDVEDQGTCSDASDPETDPEPSGSEDASASGGHDDDDFGDDDSQLDEGALKPWKAFPWPSLRALWPCMSLCTTSPCAHHILSHLAPRLVLLSESASDSAVEDEEEAGGGGLLAGKQASIAKAFAKILNKQLPRPAVGKGQAGEEAPGSSAPAPILISSVTVAKQKAEDEAEGARTKAAWKMMQEMRKRGHVLLALLHCIPNHGSDAVNNRXXXAVIDAVNNRQPPPQPRLSTLFGRLASQSPTPTPAPSPPPTDPWPARRGSRGRRPGEGAAAVCHTRRGAPVQRHRGRAAKATRGGGLRRGGVTGGAPGARESPVQAAQPGARPRDAPGAQRAGRDGSRPRSSRRRRSGACQRQRGGGRRGPGLGGPAALLHRAAGWTQDEGLGPGPGGRGGGGGGRTGLQRL

SEQ ID NO: 10101 - protein, 119 aa, Chlorella protothecoides
MSERQALLALVPGVKDVHLDKAMRRGLALPSPEPVEPLDGGLVRKRPGRLQTRPTIGLWEDDSADMAYGRELLAAAGPTLPVRLGADKIWEQGHSGKGIKMGVFDTGIRGNHSHLRNIK

SEQ ID NO: 10102 - protein, 183 aa, Chlorella protothecoides
MCPQASLSKYDEALEAAEKVVALKPDWPKGYSRLGAAHFGLRAFQAASDAYSKAWRMFATHRQITAVGLLGCDVNLITVTFHAAFKFPAMNCHARLCNYTGLELDPTNEQLKQGLEDSKAALARPAPSSGIFTSPEVLGRLATNPTTRAFLGQPDFMQMLQEINRNPQAMSVSSCEGRLGDGG

SEQ ID NO: 10103 - protein, 358 aa, Chlorella protothecoides
MPSARYVPASQLDAVLAGLTEEASAGLGALLFSDGMALDTKGYLDGLWADTQRRARELGATWLGLWLVPGVRVCCSSPQSALSRLHPLQYIHPHTKPLVLLCQAGTEAVLHENTTVHDLAELNAGKGPYAGIVLAMGAGVAYLAGVKDHLPPFMDMVAGISLTLELGAEGSAGAVPPERVHGAEPPTATTAVEPDAHSPDARCAGDLPAHASGWPEGAPSLAAMPYIAAQGSRRCVIGATWDRPAAPDQNPGTAPRTAGELLSQARALWPGLAAWHVVHSAHGTRVVSQRTDHGTPPYGGRLALGPAPALPPVWLMSGLGARGLLYHAWLAQLTAEGVLRGGEEHLPPELLRWRRRRG

SEQ ID NO: 10104 - protein, 72 aa, Chlorella protothecoides
MTRGEGTDAERKQQQERAMADPEIQAILTDPVMRQVLRDMEENPAAAQKHLANVQVAAKFEKLVEAGIVQIR

SEQ ID NO: 10105 - protein, 93 aa, Chlorella protothecoides
MTLSATANGSVGIVNHGYWGMHVEKGQSYTVSLYARAGETGPVPLTVSILGASLKHTLASVDLNPPSEDWGRLTGTLEPNATDSSAVLVVRWR

SEQ ID NO: 10106 - protein, 344 aa, Chlorella protothecoides
MLPAHGSGIFSRPPRSQAEELAAAKNIKLPADFAAAAVEGGLRLSTLQHYISLLSGGWLTRWLASTIPAFRDRLIADRMFLFKVLAEVTIDTGYGSGRKGGADRFPRDSPRAASGPELGREQCDPRSASPAACNTFDLPRTDMPSTGCATVAEVRKRGDEFWGEFEFYLSDLMVGLVLDVVLVGLLAPVALKGRKPRAQTGCEGACMMSMHAVAFGRVAACSDAGTCRPWGREGEVGPSGRAPSLGRAAGGRAQSLGRAAGGGPALPHRNTSSHACHPPRRWTGIKKRLAALPSAVFEASTPTRPYTVLSRLGCLGVKALEYSLAGFACGLVGQGVANSLMIVK

SEQ ID NO: 10107 - protein, 135 aa, Chlorella protothecoides
MAQILCGHWTPGMTTIRGGRHLTSAHSPRYAVIGGGLAGVAVAWHLLQASSPTKPLSLDLIVQGEGLADGASGAAAGLLHPTSPRGKLMWRGDEAFLATRRLVDVAEAAGRKQIAWRQGVLRLAQTQRQGLDSSP

SEQ ID NO: 10108 - protein, 354 aa, Chlorella protothecoides
MGRVYDIKYLQGGGAALTKCKLATTSRAVKNVLGCHHYPPVTSQNYLTDNRLQQALQVGLGLNFGSAEEGSATSTSAHAGFGPEPMEVRLLGAGPGSRSRGSHALPVSIELARGVCRPFPPRYQIQEDAAPASASGAAPPPEASSRPGSAPAPAPQPEEPEGEDEVAAARRAALAEKEAGNAAYKARDFDTAIAKYSRAIELDDSDVSFLSNRAAAYFEQGSYDECIADCDTAIARGREVRADYKLMARAMARKGNALAKKGELEEAVAVYQKSLTEHRFVGYIVCLASLGAPHSRMETLPPPPPPPIPRTADTLKRLNETEKLLKQRVETAYIDLELSAKAKDEGNEAFKAQK

SEQ ID NO: 10109 - protein, 433 aa, Chlorella protothecoides
MHFFRVFTNDQVSYTSWFLDAFNYAIASSMDIVNLSIGGPDHLDAPFVEKVAEVTSAGIIMISAIGNDGPFYGTLNNPADQADVIGVGGIDFSDRCVLGPLVLGDPPLGSGRRRVRPLGSLPGRQGASAGVCSMPAAPRCPAACEVLTHGQHGTQITSLPTLDIPHPKCSSLSIMGSRLHPPPQHPHPPSPTPPRIAPFSSRGLTSWDFPRGVGHFKPDVVAYGKDVRGSHMREGCRSLSGTSVASPVVAGAVGLLASTMRSKAGGRLNPAAMKQALLRGAARLPGVPAAEQGAGRIDLAAAAAALAELESAPRASVHPEALDLADCPYMWPYCGQPLYAEAMPTLVNLTILNGAGLVGRLEGSPVYVPTDEPGRALDVQFEASEVLWPWSGYLALYIRCGGGVRWGCMWGGTLWWRCERQGHAGTCQNGKLL

SEQ ID NO: 10110 - protein, 66 aa, Chlorella protothecoides
MAAKTSHWMHHPSLLRVRPDDALLEATAHGEVRLTVVSAPGPGEKEDRRSDIVVPLTVPIIPTPPR

SEQ ID NO: 10111 - protein, 235 aa, Chlorella protothecoides
MPCVDRPLPPDRIERDRVLVTYSAVTKAVIEDDTISLHYRHADELYVKLAISFALAESTKLSVFEEDLRSLGRSVSYLPAMMAGRGLTCKLPLTLPHPRPPPLPSPCPSPDKGEIDVGGRAVMQLMGQLFLQQRSVNLLTQLLDAPSALDEADDHICTLYRSIFDYMEVVQRVTLLNDRFGVMKEMLDILRQQAHDSYFGVLEATVIWLVGVCSFLAFCQLLAVVYGWEGGHAKH

SEQ ID NO: 10112 - protein, 182 aa, Chlorella protothecoides
MPLIISPDLLRRLVRYCKRLVSVPGAACTRKGLARTLGPPLLQPELSMQATDPRQLTQAAIWHCRPRKPLPLTDSALPHLGVRHFETVFGESLGPAAGDAGAAAARREKLEARVRELVVARAAAATGAGQGAKPARAGAAAPPAPAVSRLVNPITTMRTKAASDWLLAAHYTPQPSASAASR

SEQ ID NO: 10113 - protein, 223 aa, Chlorella protothecoides
MVHGSRLFLLCTVGLVSLVTIGAAWGVEGRGRNSNPTSGSSWNASVTVNLGATHPVSKTLYGIFFEEVCLLPAWGRDQSTSSLYLAGFQPIGGLTASSFPSPDRACRRGFPAHRGVDRFVIPLLRSVMPARDRSFDAIARVSGFASSNAPALPVDLGKLAAQHRDAWTPTSWDLSVAEATTTKADFLDKLRGPGPRWVPGLEEMPGLVPQELGGWPSVGLLQA

SEQ ID NO: 10114 - protein, 131 aa, Chlorella protothecoides
MAKAVWGPAINMCMPPDHCAGLIVFADWYDLETMKGVRFYDDNTRSWWEAATVRKCQLAGGANVPALNDLLQPFGIGLGGPVLEGTMELPGGESVALQSGTAVMAAPQGAWLYTATTPGVLWGCVWGCYTE

SEQ ID NO: 10115 - protein, 70 aa, Chlorella protothecoides
MGGGRGKVVLLEHHENTNHVDRLPSPSATPHIPALLAPQIAYGTTVAIRFANNVIGGEQFVDLARWAGVQ

SEQ ID NO: 10116 - protein, 149 aa, Chlorella protothecoides
MASSSAHHLEQHARQPLRSPPIPLPSQPRTEGGDGVTAFLPAGLSLDDLLQAAEDMQRHLPSPGGEGPPGGGFAGDDAPDAYTPLDLASLLAAHAHRLRQESEKRQALRAAEEVLASRLGLPGPGLPVCCGLGRGRGGGGEIAGVWGDR

SEQ ID NO: 10117 - protein, 235 aa, Chlorella protothecoides
MNRAPGSVPLNLNICPSAYPTTSNTRPVIPATSPAPTLGQFLATVEAFSGACPGTRVLLLPSPRDLHLPPVFPAPAPRLAAPATPALTPLPNPTTIMLEDAGLALGCTSVDWLMAVGREELVRLDPGAPAPDRLAQLATHVLEQRSYFPLFPPPPGLPLDARRARAALALPDQTPAVLVLPSDLAPFARLAPGGATLCINPGRAAKGAGAGTFAHLCAAPGERACDALRCDILRI

SEQ ID NO: 10118 - protein, 608 aa, Chlorella protothecoides
  MOD_RES (65)..(68): Any amino acid
MPTPAPPPESTGPPRPRPARGGARRVRHRARQHRGLPRRAGRPRPDPGDDAGGVLLPRHPPHRGXXXXPDLTLETMPGVRCSRVTRPISAVGLYVPGGTAVLPSSALMLAVPASLAGCRTIVLATPPRPDGSIAPEVLYCARAAGVTHVLAAGGAQAVAALAWGTASVPKVHKVCGPGNQGRPDPRRAGPAVPGRARAGLAGGAGRAAGRGRGRAGGGGRRTVRPPAAGRGDARRAAPLARGLRGGAGRGAGLRGGLRAGAPDHKHRRCGGVGAPRGQRRLRIPGALDAGVGGGLRERDQPHAANLWLCAHVLGGQPGHLHAQDDGAGADAAGAGPAGAHRGHHGGGGGAGGPQARRHLPDGWGVRMEAWGRGGWSCLDVGPQPKGRRCRARRHLPDEWGVRMEAWGEGGGDAWMSGPRPRGAGYQCMLARRPMHHSGVVQVCSGREKNRKEARDKVSSAGDLGRPLQRVVVQQLLYEVHMRHDHAPAAVAGEAQGVHGIPGAMGGETSEHLAACSKHARTAETTSPGRSTPLALHRDSPLGIFCLEEVEVCVPLVPNHFAACEAAHWDNHGDRVRPLRSDAESRVLVENLGEGLEPSPSPSFHALAM

SEQ ID NO: 10119 - protein, 193 aa, Chlorella protothecoides
MPGSRYRPESAGRPSTSPESILVAPHSSHPLTPTNLLLVEEGRLNPQSLLLEGSQALSGGARVRLDVSRLAAFRLFPGQVVSLRGTNPSGHCIIAAELCGPREPDAKTGPSHPAAPTSVVLAAGPYCCPENLEYAPLHALLEHCRRLRPAHLLLAGPWVDEAHPLLAGGLVDETFQSIFQTRVRGNSCSMSMG

SEQ ID NO: 10120 - protein, 463 aa, Chlorella protothecoides
MHWYPAPAPLGLGPDIQAAPPPPSPRLHPHSPSIRQVTARLWASSPSTAAMVATVQPLPRQLLHRHLAREGVQADPRVHARIAIGWQRVVGPARVVPHRLRRPAPQEYGAGAGHVGHPLPRIGGVYDQVLRRVGLHEVQRLGPPRHADHARVAQRGARRRGPRQAVALCGDLRHQRAHVHARQRDQHRLRVRPVLGLGQQVQRDVGRVGPCVGHHQDFAGPRGHVDGHHGLSRGQRHLGRGDVLVAGTAHLVHLWHGGRAPGQRCDRLRAAGGEDVGHPRCARAVEDLGRDGAVGARRRGQHDGAAPRQRGGDGQHEGGGGEHGGAAGDVQAHRRDGAGDAGATHSRHRLQGQGQVGGGLRGVEGRDVGARGVERGAHLLGQVGDGEVLSIREVVLVLASQEACMRTLKGSLCTCLGCNERGRGEGRQHRRGQLRNTAEDDGVTGAAAAICRESPQQSAGHGL

SEQ ID NO: 10121 - protein, 574 aa, Chlorella protothecoides
  MOD_RES (98)..(101): Any amino acid
MSPLNPAQRFQEQQQKLQLKEGDDPEEPQEGSASAAPESAPPPSSLAMVVPSSGMEGVVPQPHAPSQGMRGTARVHFTLRFRTDWGQRLRIVGSQEGXXXXPSSGMEGVVLQPRAPSQGVGGTARVHFTLCFRTDWGQRLRIVGSQEGLVCWVLGHHRGWGRPGSIVAQHDCIKPTAPTTLAGNWRLADGHNMKWTTGDNWVAEVDLPTGTVYEYKFVVVDHASGHALAWQSGNNSVLALRPEDRSVDVFDNWTWSGGLPYSCAAASLHTQPQAARLGQICHPGRWRPPWWGSGRSCAARAWSSLPPRRWECLFGPAGMMLSYRLPGGLQPRRGGPQQVLSVLFLRVQDARKAREESKRMYARLAESEAARIAAATDLRAAETTNKVRWDRARGGSPFSVWATSQSCVLQGCTGCVLRGPLSGSTTVPLLKRSPVHSWCQVLMAQLNEVNTSFKSALETAADLLQAISTRPRPRRASAKAGTAVDADKAAAAAVGRGAGTPLGSAAGVAGGQVSEPTAEPAAEPAAGAASGPGTSTASKRKATVVTTTTPVPSPTNLSPAVPAPKPWGKGSAKA

SEQ ID NO: 10122 - protein, 886 aa, Chlorella protothecoides
MVGALGSSLMTMTRQFLMRKGFSALHHGRRFCLGRDPEVAVLHKPICSSRTELIIPGNMVQVKAHWSCTSMHGKSSSGEGSAHFPSFFSLAAARSSLSFRKSVTTARMDSRTAAANAASAKNSRGVGGLWYVTKRCLALTLHTSSYSWFTQDLVGNEPPLDLAICRARKWATLKTSLWCTPANQLTRVVLLVRRLHKEGQGLGLADDVARDDADRPKLPHGALRKEREDGWVPCSVGQDDAIQQTPSNIGQRDLPESVICMSKHSLPDQTCNPWQHYDCAHLHKNSSQLYTFPPGPHGTTRQGRWQPPPPGCPFPPAPASAHGPQTAWSQTSWPKPFLQGKGGEGWGRSGCLTGIYAWEAGWCEEPSKDDVEPEPRDEGRKESRAAVQQHKHHARDHGRDGKGQVHEGDEELLAPKPVAGQEERRQHAKHGVDRDRDGAEEQGHLHRLPELWLRQDGQEGADALAEGLHEDVGKGQDDNQGHVPDPDKGQEEGAGGVDLERARWRLSWVRLVPLRRAVGPAESSHSWQDGSSPGCTGFQSATTPPQRQPSSMRTLRPVDLFARRRGSAGTSPRQSSRYQTWWEEGPGAVLEEPVRPRESSEAPRSIQDYRISKLSSVVASRRRASIPDIVQEYAPAASLDPLRRDHRQDSRRTQPYEQAMKVYIRRPAGTFSIARPQPEGEALVWDRLGAVQHSTPCMSWRAGACQIFWPGRGRAGSAQHDLPDACACPTNGETRDRAPGVGTLGMRGIFVPACWLCMLALDARALPCRAPRLSSAAPLLALPQIPDDIMQDPGLREAIALLPANYNFEIHKTVWRLRRAGARTVALQFPEGLLMYACVIADILQAHAGVARAYVMGDVTFGACCVDDYSAVALGRRGSMLHTRGK

SEQ ID NO: 10123 - protein, 163 aa, Chlorella protothecoides
  MOD_RES (43)..(45): Any amino acid
MGVPCCYSCSRPLPLPTHRRNPSLTHGSIQGPTSWCTTVTAVXXXAPEGNRVAGADASSPDNSDTKLKQGMRCSWDGCTLLLSLLEAPTLAHPSPQPIPHPWINSGADFLVHYGHSCLVPVDITSIPCMYVFVDIQMDLQHLVDSVRCGLAVGRSKEEGEMLG

SEQ ID NO: 10124 - protein, 273 aa, Chlorella protothecoides
  MOD_RES (165)..(168): Any amino acid
MIANPGVPAYRYDPYARSLTREGYDHKGMQAARREAIRKGARGEVWGLVLGTLGRQCLEQQEDVPAPHWALPLSDRQAAAPWAVPGLAPARKPLPLPAACPTPQPSSSPTHIHTCTGQPCPTGQPAAPGQGRGQAVHRGAPVRGVPRQAGGAVPRRGHLGPGGLXXXXARLAALSPGVDTWVQVACPRLSIDWGEGFAQPTLNPYEAFVALGEVPGWWEGDGDGEGGAAPYPMDYYSSTGGAWAGTYHRPKPKGSGAAALARLRASRAGKASE

SEQ ID NO: 10125 - protein, 430 aa, Chlorella protothecoides
MAEDMSTWRPEGRLAGHEVATFAGGCFWSVQLAFDRLHGVLSSSVGYAQGQKQHPTYKEIGALHARGRRWPGNVLRPAPSRLRSVCAGPDTVGVHGNDRAFRGSSARITSSPSVHEAQQSHLCIVSPLPAEIDPLQREGQGADVGSQYRTGIYTHSQAAKQKVASVEGCAVEVEPFTVFWPAEEYHQSTWRVVQTYHAVLVAAACSSSARPTLFHGRGESALAVTRRTWADERIVEMSRKSSNCRCRQSLLLCWSDCAYVQGAGPHPSPQLGQAAEPRLQEEICAQYRHRAQGSRSSEYHQCSGHRQHQPQQGGLVMCGTGVGAVYTAHLRSPTSRPIGLGCRNPCFLEFNQLAILSPQYFYLGSSVVKPNEAYQPDTRLRVGLGAKASTSSDDVTIRCGAPETGPPTPYHVWEGCCTAVEGPGHSTCPA

SEQ ID NO: 10126 - protein, 70 aa, Chlorella protothecoides
MGEFGAVSVISGNIIGQTQTLTLFVESSYKEYNSEAAFAAAVLLSILAVVTLFLKDRLERAAAKEKNEGK

SEQ ID NO: 10127 - protein, 113 aa, Chlorella protothecoides
MPPRMLHVDAQRRARPHTPDSAATQSPCTHAFPPFHPPGNEKVLATVTAIIDGMGSVGAAIGPMVTGYISELPGGFDNVFLMLYGAAACAGGCAKGRVEGPPQWWALCVRLHP

SEQ ID NO: 10128 - protein, 67 aa, Chlorella protothecoides
MPFVVRELMPVLEEMDIQEEEAATSLGELFRGGLEGRRIWVADILEGHAAQYSMGSAVWHHPDQRCE

SEQ ID NO: 10129 - protein, 155 aa, Chlorella protothecoides
MALIVILPFANVFVQAFSKGIGPFLAVLAEPEFRQAVKMTLLLSAVAVPINTVFGVLAALFLSRNRFRGKELLISFMDLPFAISPVVTGMMFVLLYGRSGLFAPLISRFGFNIVFAFPGMEGPGSEGGMETRVDEMAVRECSMVILYDQGMWQCK

SEQ ID NO: 10130 - protein, 781 aa, Chlorella protothecoides
  MOD_RES (283)..(286): Any amino acid
  MOD_RES (417)..(420): Any amino acid
  MOD_RES (608)..(611): Any amino acid
MSPTTATQSRISLAGGRMGDQDPQRHREDGARGRSHAHWAWPVLPPPCDPWGASGPHRAPGTYPAAHPCPWSAPEWHPPRGRIGPEGSCKAVVMGEVYSQDVVPHEPALQSLPHQRASLPARHAPQVLGGSDDALVEATPVVSAPTLAPAPFTSAYFSPVGTLSPCDFSTPPESPCASISVGDAIAAAVACSPGVDSASPGVDSASPAPASAPPMGPRPVTVLGPSSAIAFSASPGQEEAAPALASSLGSGTKASADTPNGNAGTPATAGTAAAGMPGLSPAXXXXAQCPAILFIAAGAAAGAAEREPPTAASPEAATAVNSALAREVEELGDQTIEEEGAEDTPPLLAATVAGTDAVLPQGRPRVASKVSVPSSGFDSRFEILGRTWEWPVVVVGPAGPCSPQHASSFRAEPDFSXXXXLGRTWEWPVVVVGAAGPCFPQHAPSFRAEPELSATENTRACPLAHPKSHNAFPRKAKEDAPKDCEDEVEKEEEEEEEEYDAYGEEEAWVSVEFAGCPHTMLRCPSLAWRALREEEEQAGAEDLTSALAGLELGPEAKLRGVPTPVGTHIRAATSGLMIDGVMACHAGEPLQDWRPGGVKFKFQGGGVXXXXQESLCRTGGYAPPKVVMSNNTRFVLVTRFLGAEAVQGAALALEGVDHVEGGHGLAAGVLGVGHGIAHDVLQEHLEHAAGLLVDQAADALDTATAGQATDGGLGDALDVIAQHLPVALGTALSQALSALAAPRHGCRRPGAHQSKRGFRKRGKERRSTAGGTNTFRHGHGA

SEQ ID NO: 10131 - protein, 103 aa, Chlorella protothecoides
MSGRGKGGKGLGKGGAKRHRKVLRDNIQGITKPAIRRLARRGGVKRISGLIYEETRGVLKVFLENVVRDAVTYTEHARRKTVTAFDVVYALKRQGRTLYGFGA

SEQ ID NO: 10132 - protein, 271 aa, Chlorella protothecoides
MAGFSTGAGAPVHVSAGRLEAARRLLDETVGAAPAAADRQGGPIGEGLAEHSPTPGFTTGLGAPVAVSSSRLEAARKLLAEEPPAAEDPRPAPATVAACFSTGLGRPVSVSPSQLAAARKLLTEDPPQAGKTADPAPPAAGPSSPMVGFSTGLGTPVAVSRKRLEAARKLLTDEDGANEGHPASAFPGSSGANEGHPASAFPGSSPAGQPDTPSLRVRPPAPGEGPGPGETTPCANTSHQLLSPGSTGLRCGPGPGRARSGGVQPSRFVLA

SEQ ID NO: 10133 - protein, 78 aa, Chlorella protothecoides
MQSPPLHVPAPQVELTDGWYRIWGRLDAPLAALCSSGRIAPGSKLRICGTTLQGAGPGDPLTAAATSSLQLCINGTHR

SEQ ID NO: 10134 - protein, 119 aa, Chlorella protothecoides
GRPSGGGAAAARAEAFGRVALGNLNLYTAPRERKTPRDVERAEVHFSYAAREYARALERDPANLWAAQGLGCVLAEAGHLREARVAFTAVNEAAAASGGFVAAPDAGVNLAHVALAEEA

SEQ ID NO: 10135 - protein, 1107 aa, Chlorella protothecoides
VSAARCATTKALRGFRRASSAGAASRVWHPNIPPSEGGVQGVGNELRLLLGVHRAEAGGRGGHGLASRVLDAHGGRAAHALDAGLQAGLDVEVGAHVLWFLLGPQHLRVGVAPQLPLHQVEGEGRELFDAHDGHLVGLALLPRPLRGQLVVELAGAEDDTLDPRHWLRIGGAVGGVLVHDDALEAHALDVLIVGLVVELGERGARQRVAQQVLGREDDQRLAELAVDLAAQDVEVVGGGGAVDHLPVDALGLGAQVPTREPLLLVDDGGLVRVLVHHLQEALHARGGVLRPLPIVAVGQEHGEPRLAQPLGLAGGHELVENNLGAVGKVAELGLPQDQRIGRLQAVPQLEAQDAELGEGGVGHRELPCALVLVHMGQRCVLVPGGLVVHHRVPVAESPALHVLPAQAHVVALRQQRAKGQRLREPPVHALLPRHHGAPVLVHLGDLAVGLEAGRQRGDHVAHGLATAEIHAVDAQESRVPPPRSKKPTPPHLEEVNGDAGVADARILDGGVEALPVAGQPVGELGLVLLGPLKRGGQLGLHRALNVVHRLLAHRPLGQQALDVELLRVGVALDGGVHEGLGEHGLVDLVVSVAPVADEVDDDVGAPGLAPLRGQLADADHRLRVVRIHVEDGGGEGLGHVGAVGRGARLARVGGEGHLVVDHHVDGAAHGVVGQGRHVQGLIHDALPRKRAVAVHEDGQVGAARVVGRVVLLGAHLAQAHRIHRLQVGGVGQQAQVHALAVDGGAVIGGAQVVLDVARPGVGAAALAGAPPCELAEHLLHGLAHDVGQDVQAPAVWHADDHAARLQLGRGVDDGLEPRDQRLAPLQPEALGRGVFVGQEGLEELAPRQAVQDEHLLLARVRLALRGLDARADPVAPLAIVDVHVLVADGAAVRLTQAPQDLAQRADGPVLRHEPLHVPGPAGPAAPTGGPSPGRHAPAAAGALTPGWTGPTPPPRPGGMRSPRAQRRRTPRPPPRRTHPCLSLLCGGGSWGWGYRSVEVCQGVVVRSMVLGPSRERGSPHPAPQAEHSTTGGPGAVHARGVLPVALLQLLQVGGGGAIQETVLQLRERHRFGVGLSRLGAGLEVTLDGSERAGDAARHPTGRVRQHG

SEQ ID NO: 10136 - protein, 218 aa, Chlorella protothecoides
MTASPPPAAAAPAKADGAGPPAVTAAAPPGTAPADTAPDPEAAARIAREDAVLASGADPARPFSHWDAVLAEAHWLAVDFAQERLWKASTALAVAAEVAGKRGEFGLRPPPPEHRAFHDEIVAARAAAVAAAAAVAGKRLTAAARAEAGAGLALDPTADPIWADLALEAIPPTPPGFDYALVYSVEPELAPALEATLESRELERAIEADMAWAGPGGG

SEQ ID NO: 10137 - protein, 104 aa, Chlorella protothecoides
MLAHSSRRVAGRVARTLAAVQRDFKSSAEAGQAHPKPVPLSKLKDSFLDGTSSTYLEELEQRYREDPASVDRTWASFFKSMGGLLGACMAFPRGVSNQHAHRAA

SEQ ID NO: 10138 - protein, 184 aa, Chlorella protothecoides
MPPRNDGTLRPSLLPRLAPSVSSLVQPQSRSHARSWSQPPSPSTISHQVCRGYRYELDAALRSHFAAVAEASKRAMRLDADLADGCLLGDAGDGADLADDGDPYAQKGKRGKGGRRAGYLLDDFAELGDAEFAERAPPKRAASRQYIEDTYLRKRRRERYRDVDADYDVGAEPATGRYGTRRAT

SEQ ID NO: 10139 - protein, 532 aa, Chlorella protothecoides
MGVSAEAVAEAYDAFERGENASPLAAAAVSAQSIQESMRLLLLVRAYQVMGHLSAQLDPLGLDQRAAPAELDHTFYGFSDADLDREFFLGTWNMEGFMAEDRPIRTLREILGRLRETYCGPIGYEYMHINDRERCNWIRARIETAERESYSREKKMLILDRLSWSELFESFLANKYTAAKRFGLEGCEALIPGLKAIIDSAAELEARSVVIGMPHRGRLNILANVMRKPMEQVFSEFAGRRPGEGGGAYTGSGDVKYHLGTSYDRPTIHGKRVHLSLLANPSHLEAVNTVCLGKVRAKQYYSADDSRRANLPILMHGDGAFAGQGIVYETLDMSALPDYTVGGTIHVVVNNQVAFTTDPRKSRSSPYCTDVAKALSAPVFHVNADDAEAVVRVCELAAEWRQTWGSDVVIDLIGYRRYGHNEIDEPMFTQPLMYSAIKRHANPQQLYVQRLLAEGSVSKETVDDIQSTVQAKLAAAFEGAKEHQPKLSDWLSSHWKGFNSPIQYSRIRNTGVPIDLLKVRGGWFFRARGRDP

SEQ ID NO: 10140 - protein, 571 aa, Chlorella protothecoides
  MOD_RES (43)..(46): Any amino acid
MPEEEQVAAMTPIGEEGVTATDGGGPGTPTARPQAGSPAQEAXXXXHSHGRGWTRGPHCRASGREPCPGGLCGRRGGGGDWCWVPGGRGGDRGVRLPAQRQEEEEGGAAHGIRGPRLCGHAAQPRGPNHRGGPLPRHPQGGRHLPRQLRRGGVLQDPLDAGGEDRQGRERGGPGGQPAHGAGGPRYPRQDQRRAARPGGSCEFRSGEWGEEVGESGMETGWPPRAEPHPGSRQLDSHLRRAQTAALSVPSPWTRLVRVFGFGRATHGFDARKHCDKRRYEYILPAWAFDPALVPPSSLLGEEDGEAVPLLETEEDGEAATALGDDEDAPAAGGDAAGDPGDAPPGTGEGVTPSVEADGALAASTGVPQPEDTGFIFDAACAARMTSILSAFEGTHNFHNFTVRVAASAPNARRYILSFRWAGLWRFGARPGGLADGAGRMVSRIDWRLNGVDALGGLKRVASMQRVWVGRAVAVEGLSWGADRWGRPTCEQERLETGWGGCLGRSQEGGEYAMGVGTTPSCKWWYEFCLNIDRSTSPAPPSTCPITDPVDDPASLIPPGAWGPLTSAGSRG

SEQ ID NO: 10141 - protein, 440 aa, Chlorella protothecoides
  MOD_RES (395)..(398): Any amino acid
MTTPMSWPRPLRWVYGGVLVAEPVWGCARHTCIAKPRSALSTPSRHSQENLFEWHFAIRGAWDSDFAGGIYHGRILLPADYPFKPPSFVMATPSGRWEVGTKICLSISSHHPESWQPSWSVRAALVALRAFMQTPAGGAVGAVDASPEARRALAQDSRAWVPRSSSATTQEQLNGLHASMLAAEAGSRALHLAQVGSEQRAGPAAPSQDGAGPAAAGDVAATASAQADAAAAQAAASESTRPGVVSPAAAAPEASEPEDDARGVGADRAEPEVRATVDHEALPPSGAAAAAARSPSPDPRPEVVAPPPFPAFLRMADAPSLHHRTPPLGEDRGLTYLALLLVLCILAIMVRKVCAWGGGRGEKVSEEVPRALMVHKRQEQPLVYIVYQTHDSAPXXXXVPRALMVHKSQQQPLVYIVYQTHDSAPPAPAPGLPGDACGHG

SEQ ID NO: 10142 - protein, 110 aa, Chlorella protothecoides
MCPGNRCTTLGPLVPRCGDRQLSPPAPHHSGPGTLSCSHQSPRNTTLSLHQPRVQLLEEFDEELEGTSTRLAAAQKKIQAVLDRTGSKGQLAIIGFLLVVLVLLVVLAIA

SEQ ID NO: 10143 - protein, 216 aa, Chlorella protothecoides
MRFLDWVGPLRAQGFSFYLDRLATQVHAMHAVHGRVALVGHSAGGWIARIALGSVPYQKHEYGLSPKVHTLLTLGTPHASIEQYPFYKPVETLDPGPTAPLDPRDLTSSLRWTNYYYPTGDCFGGTRIVCVGGRVSLGPGDGRLRRYLVFESYMAGCGDGAVEGDGVTPLCIAMLPGSEHVVLEGVWHMPQRKGGGRWYGDPEVLRQLEVWLQPPE

SEQ ID NO: 10144 - protein, 561 aa, Chlorella protothecoides
MGQLLCAGMGGPGCMVKMHGQNMCDACRPTCAWLERRLSMRNPVTWEEASNGRILVKQHCPGAFLPLPEVPHHRQPPRSACGSRHRTPSGEPANCAVPCENNYPSSSYLSLDRLHRDRGGGGVLAFDLCVGAVSMGLAPPPHAAHLHHPTSLVATSTAWFTRASFSPAGLELNPPIGVEGKRVELERRDRGNGTAASPSVPRAATPRQIPGIRSEGPWGNKGHPELVNILNWLPAVQPRLDWPLQPRASRHDICQGRRAWGCAISTTGPESGSLVGPSRLRGATGARPAHPPPPVCRRDTGAVDGRGRFPPGEMAGGTGPGVTPVCMRVLSRRCARPGALAPSSLVANTLRGLRDVQEVHGNRWSEVARHIGTKTGQQCAQRWRHRVNPNISKCLPSSSSSPGRSGQKRKTTSSPALCGSMGAAGPRSRASASLRLPGWEPGLGKGGGTARAAPLSASLDESHPTPDMHPAGVKPACMSPHTPPPPRPLSCATFPYTSLFPLFRAQFTGQNGSAVHGEVAAPSGPLGPPCQLAPHRGREAEGARGRAWWVAQGAGPADRCA

SEQ ID NO: 10145 - protein, 120 aa, Chlorella protothecoides
MGSIPTMPPKLLIHTPMCLALSRYASIRSLLLGFAATFFAAFDIPVFWPILVLYWFVLFFVTMKKQILHMVKYRYLPFSWGKKVRFALASWASGVLGGDTVLYSTCTTPFPALICLRADN

SEQ ID NO: 10146 - protein, 486 aa, Chlorella protothecoides
MGWMIPPHPGIASSKPCVPCRRPISTQREDPVHALRLRGHACAVPGDSRTCCAADLAQGLVQLPGGAPGEDVDRFDARMLLDPAELAAAGPAPGGAGRGPADTELEEQLAFESYRDVIRWACQGLAPHEGLARAAQEDVAIRTAQRRTALGLAAGMRGGGGPAGRDPGYAAGGLGHDAPTDGDRVSASEGSGDEGGGEDPGADVRMDALARAYGVADFSAMLRWAVRREAAAAAAGLSARLAPRGPVGGWAARKRALRLSVPAGQDRCSEGPGTHAGSLDWIPVQQAVEVGLRPCLSGVGARPGPSLRGQARDRDLGARAGAQGPTALPGSRTAPQAHQQSPGPAPPPARETPKERLQRLMAAQLGKKIHQDAAAQALRRSLGLPGGPSPISSHTPPARLPPTPVQEVREAAALSAAHASQAPRRAGAGGNADPSGHRYCFGNVLGSPGWSCEAECYSMLQQRGVQGTAHGKERGNLAMHECTPHS

SEQ ID NO: 10147 - protein, 289 aa, Chlorella protothecoides
MHNGSDAIRSCGACGAVPGYAQLVNSQSQQDARIIIRPRHMQHAMSVTPTTLARATSSSKSCLAGRAPTTSSGPVRVLSTCGVHSPTHRLKHATNAARKARMGPGPPKARQTVVCGAGGLTPTRHAVLHDFCMVLPAGGLLLAAGVAGLLAGSGRGAAVVAWGGVAELLLAAMSLKAWKKGRRSVGAAITSLQTGALRKSNRRVVNMACAMLHALHQRVTLSPRHSIVAGIAAFLSLRLYRVFLASAKPAARIVHGVLLAIAGSLLVFLVYNLLAGGNPPKRAQPGEEP

SEQ ID NO: 10148 - protein, 419 aa, Chlorella protothecoides
MLSTHQHHFPATHLDTARKAKAIELMVVDALLESDAALKLSDRIWDPAEFSLMDDSILDWVENYRLFGNLFTVEDENICAIERAQVLCEGVVMGVAHTHPAGTLLGNPAAPPPHNMWTQVLIDRLRRRDLYKFCDEALIPAVSPGCLFSSHSRNMPQSMGLHGPAWTAMLSSHCGRWVPPTAADVVNSYRGSGVRMRPEDIVVQAPRVCTIQICGRPTAGSCGASSTDPRTRDTLSIPRPPQENRINFSMRNLNPLDSVHFFDSLESTQKRVLRTNQISSMVAPVFQVRRQAWGHTIRDGIEGEASGRQNRHAGGRPPIGRTDFVEQWLGIQREDAQPALSAPECPGTPPEYTPAPVAGKHTPCLLQEQCAGGGAGGAGGLWRLAGEAIWGQGADTHALQGTPTRPMRHGTLRGPAPSR

SEQ ID NO: 10149 - protein, 179 aa, Chlorella protothecoides
MNHPLAGLPCPVITASHDMVPLPTPQAALSAYLRKTLGSKAPAGPLEISQFSHGQSNPTYFLKVKPCLGFALLEHFLRRQMAGEGPLAWQGRLLSFTSFETPTLAIRWLPALQSCIPRNAQAGGQRFVLRKQPPGKVLQSAHAVDREHLIMSRLANTPVPVPRMVRRGSRGQRSMSLMN

SEQ ID NO: 10150 - protein, 127 aa, Chlorella protothecoides
MTSDPPPPARRQPGESALPEMVALSEWLSENIPAADADPSRTRITHGDFRRVDEWTGSDEAGKRGDDILSPLIALPCPGWTIWCWTRRVLAVLDWELSTLGDPFSDLAYNCLAYHLPQVGGCVEREL

SEQ ID NO: 10151 - protein, 88 aa, Chlorella protothecoides
MPPKPSTQGTPGLAPLPKPLPLGIPSEAQYLETYCAARRIPVPPKAEWHFYLALSTFRAAAILAGVGARAAAGNASSLRAAAVGDSAV

SEQ ID NO: 10152 - protein, 985 aa, Chlorella protothecoides
  MOD_RES (876)..(879): Any amino acid
  MOD_RES (939)..(942): Any amino acid
SSNRPLSHPAHASPAAEVACKARKHAAQAALPPLTHGPPVSFQTAAVQPKEQLECLQREPLVPRGRPAVGARVRERLAQAASLAQVLAVVCPEPRPREVGGRRCGGGGPVPAALPPQLGAGVEDVPRLLLWWVEQRRLRKHMHGFLRGRWPGAWLATPGTYCGLGQRGTNPCGLHTPSPAPANLMLPCTSKPDAGARPRLIFHGLLSHSPFLDEHYIPTLLAVHGLDNETDCSGSTTGEKLLGSHSPWSLALFHGLLCGVIHMPGALQAPQRLIHTSSPFCLRLHQTPTGTGGRTSTPPTHTSTLDVSMTGANVSFCAVPPDRGWDICLVIITGSCNSSQYSAPVALPGAGSKNPHCPTLAAHIPPGDIRLGLLAAVRRSSLAQCAHGERENRSVRGGFLQLGQDPAPSPEDIAAAARRAAGYAPLGRDCPLLARKFGEGVVAQALALFLRCHPSIGVLNGGDCRDGRGLSHRLASAALPWAAAAAVCSAAALLSGAMALLLQALFLQHLAEHAPHDAPQNLSSEAQLVTCSVGGPSLREEVLRDETLLFDRESAHVAMCEGYRFVQCRSETDAVYKQVLALEKKCFSKADSWRAFTRPTTRRGHGAGATTEEHLHHMHDNARGSACECGCCCRSSFAGQAAAVRCMHRTTRQRVPHQPCTAASLTRNRRAGHAKRLIQHVTRELQRARRISTFSLHVAAVNEPALALYKASGFKEDAFLQARPSLCGVSVVIPELRTTMHPVGMHTGFRVDQLANELVAAEVNRLETLFASWQNLADMAAPAEEPSPARLLQPPQYIQAFRVDQLADELLTAEVNRLEPLFASWQNLADMEAPAEEPSPVNGTRKPQPHRCNARLEDLIQTGAYSTTCAVPGHLXXXXNAVHLNVQTGPLFAVNASMSEMAKVVPRYGAPKLASLPHSVAHKTPSIALCAGESQPVLXXXXPWHSDSQHCHLCRREPTGPYLVVEDPSAYLDPDRVFNKRRGPQ

SEQ ID NO: 10153 - protein, 288 aa, Chlorella protothecoides
  MOD_RES (270)..(273): Any amino acid
MLRCMPSLSLALLRPASGIAGRWAVRGVWTETPGPKESEVRDSFYDSTIENVRWEEASRDHGCCASWPRSSLAGDLGSSMACMHAAWASAEGGVLLAGSQASPTRLAPPSHLPLHSAPSPCTQYARQPIVQLTLRGMLDMGRDTLKGPACRIASARFVQEELPKRLARRLLDLQLLPHLVVTNPHIHRVYTAYFHTLQTLLAVPPVTSLAQNEEFTALLKRLEVTNIGIDGAASPSPAPACHPGPGCATPHQSEPLAPPRAAPMLDYLAXXXXEEGVGVGGGDDQCRD

SEQ ID NO: 10154 - protein, 369 aa, Chlorella protothecoides
MSVAEGVDFAGQRCRQVGAVFVCLRRHNRTSGIPHWQGDERIGSMAHTVCFCAATGPLILPSQVCNETYGLAPDVVITGDKRLTIPYVPSHFDYMVYEVLKNSSRAVVERHLQQSAHSALERRLPAIHARICSGEGQVTLRCVCLAVNLCSAPALMLASMRMRAAGGQDLGVWIYHHGVRGRVGCLECCWRFIRLAARMRACIPSSSLTIHRKELIDGVERTEGLGFDPSFGAGWSVAQIPVTSGNRFRMGGLGFGLPLSRLYARYFGTSAEDGAGGGVGWVVYSMTPWHPVWGPHALERSPAIPSLPALLQDFLAITRRWRPRSPLHSRVWNRHVSDLEEAGRRGLAGGVCRGLYVAHAKSIPLNMRG

SEQ ID NO: 10155 - protein, 218 aa, Chlorella protothecoides
MQGVSDLSVRQTEAQRDLRAFLKLLAAMARSGSAEAGPAAETELVQPRGWGPSCRSFPRTCRRTPSCATPSSTPLHSCSRSVKCGENPCAGSAALGAALCCTTLSPPLERTLTFDRAHPPTSPISHPPQTFPGAMASLPPHVWGALMGTLFQGLGMAGGGLALTQVVLDGLAALATFHVKDALAGGKGVRDSNVPGPGGGGSEGWAGLCEQANAAVSP

SEQ ID NO: 10156 - protein, 831 aa, Chlorella protothecoides
MPGPHRNHARTFVLGGLGCSKGQAPAQAGLEDRSRGLSAALDALQSRCERGPGVHQRPPSLGQPIVAMRVRGQRGQHGTRQLRRGGDAGLGPLAGLDPVPQPGGRDRGGGGRSRYDPAPVQELLLRALLGAVQRRAGRPQPRLECEAQGPGGVGGRGAVGPQGLARLCQVHRQLPQGARSFPVACWRAAAQDVVECMVASSPGGVAMEHCPTLDNDKVQATCDGATQWYLSSCYALPPPLMRCILSEHAKLPEPTRIFPPHTQQKSILPERGREVQTPVQGARAGKHGMHLLRQPVGAPPAPIPARSVPKLGAHVHHQGLPPRGKAPAQHGAQCGERGGRDALVLVGSGGGRGRGTDAQRAQRDLGEGAALKVLASLVVPAPVCDGKREGWGLERSGTGSSLGCAGLGQSDHRGAQSPNAASTRQAGHLKVPRFSRCRAHQGFSMGLADCGLHSAVSAVSSSRHVRCSCRSRVERARCTMPRTRPSSPRSDWLASPCPRLTSCAAVRTHWDRTRDRDSRDLCRACSSTNLVTPWRSGAPSSGQSRRLASRRVRTAWNWAAGTLEWLRMCWQAARGEGLQRKSRSVRSASRRVRGFSRALEAASITVWMEAKSMAPACAPPSPRPGGPRHAHHELCLQAQRRIDCLHIQCDGVLQHTYGLQIPACGSQHAHIYNLHGRGLRAVGPKITEQLTSGPSGEHLCGVIAPGWRTDASSPPPRRVRDEEMTRHIPDHAPESLCRGGTGHECWGGIAGAEQRFRRVQWGPPPSPSGPLIASGEVAEYKNDLHSLDRKSQKNAVKRVIAAMTVGKDVSSLFPGTHSRGESCLSGLPVSS

SEQ ID NO: 10157 - protein, 237 aa, Chlorella protothecoides
MFVFDPQSRRVTALLGSLALVTDLCLSTASLSQPCAESFCAIFILPFRPLHCTDVVNCMQTEDMELKKLVYLYLINYAKTQPDLAIMAVNTFVKVGVPCDMCRWCVDSSLCETAGAHPSLILIPTLNQPPPSPPLLLSPGHARPQPADPRTGGAHHGLHPGGQDHRVPVRPAAALPEGRGPLRAQDRRGLRGQAVRHLRRDGGGPRLPGRAQGVPGCLWGGGRLGTECRLPAGCQGG

SEQ ID NO: 10158 - protein, 525 aa, Chlorella protothecoides
MGLAGTMPCPLLLSAALKPHPPSPSIPTAPWQDMVGDANPMVVANAVAALAEIQASSSGPVFVIDGAVLTKLLRALNECSEWGQVFILDALAAYTPADSRDAEGIVERVAARLQHANGAVVLSAIKLILHAAKVSWLAGGWHLESCPQLPPHPSSLHAHHGHAQYIDDAGARAAIHKKLAPPLVTLLGAEPEIQYVALRNIDLIVQSVPGILSHEVKVFFCKYNDPIYVKTEKLEIMIKLADEKNIDQGGFNLLVQPSPWDPSGLVQPHDMLPPPALHHPQPHPSDKPLKSQTCKDAAGAARVCQRGGRGLCAQGGARGGALRHLAGARRGALRERAAGPDPGPRVLRGPGGGGGPARRLPALPGALRARDRAAVRVPGGTGRARGQGCHGVDHRGVRGPHRQRRRAAGAVPGGVPGGVARGAAGAGHRHGEAVPEEAQREAAGPDPAGAVLRDAGDGQPRPARPRLHLLAPAVGRPRRRARRGAGAAPRDRGRRRRRGPGPARRAAGRAGLAGQRPAPPRRGLH

SEQ ID NO: 10159 - protein, 671 aa, Chlorella protothecoides
MHVSTQLGDRPGGDGSRRGPNRLSQEVHAVLSSPGALDWCLHLSAALSGPPQHGNQRGQTCISFIFPHRSLHNILRSGPPACDREAARALRQLAVHLAQTSEPLGPHRPAPTYTAWSLRLAFQAWLWPPGAALDRAEQGTEEEFLDGCRVVAAAAAAAPVSAPRLWDWVEPGEGTQTRIAAAAELTRAVLSTLASDPHRDDWLTEAGRTLVDAWAALATGLEGVQGGAEAAAAVFEAGLRRGLALAAAEATQDEGACVIAFSPPFPPVFHTPVRPDDAGEHAEAATLEHDLACLAAIGRGAGAPVLAAVSSALVDARSRLEAAVAAASDPSVPLEQLCWLLQVAAALLADAPGADAGDSPALPLAWDAMRDAAAAASMQLLAVAQLCVTHGGHDALSPRLGSAVPDGPRQSDAFPPLPAWGVDRTAHFHQGLTSRPHPTHHRLLEVTCVSLGRWAATWFPTEASLPPASGAQDADVAQLLVQLARTAFLAYPGETALHKACPPCFSRSRTLFAILFRPRALFSHPRPSHQAQTLPPAPALSQKASRRLLRALPTSAPAAATLLRCDSWLDLCRAVASQELLVSADVARPLLCALCLAAKGDDAEGAAAYVRHLVQPSVDRLQVVWGWAGGPSGGGSVGVEHPLAPGRRDVEGAGRRAIHKRQLPATSMPFP

SEQ ID NO: 10160 - protein, 150 aa, Chlorella protothecoides
RGYAKAHSRLATALGEVGRHADAAEALRRALACRGATPAEKKGYQTRLAAAQRAAAPRSNGMMRRGGEGEAPPPPDHYRLLGLAANCSGEEVRRAFKRLALQLHPDKTAGAVRCRASLGSCGVVIEEDQETELRQSLQEAATWLFKCLSA

SEQ ID NO: 10161 - protein, 436 aa, Chlorella protothecoides
MGDFVKLSPDKKHLELNGQPFRIVGANSYHVQTHGADNDGGSGRQNIAKLLKVAKQEGVNVLRIWAHSEHCEEFKWWDHQKNDWIPFSNTWKIIQKQPTPDGTWYKPNIDPDGIDGLDWVVAEAGKLGIKLIMSLTNYWNDYGGMPQYARWATGKKDGLERDMQEEFLRNGNAQSMLKAYIQFLLNRENPYTNKLYKDDPTILAWSLANEPRGGGDTSGNRLDDWIKDTTDYIRSVDKNHLITVDTEGFFIRDDKVEIGPDEKIDIKVDYMNPGERSEGCDFLRNASHPNVDFACIHMYQEKWAPDYAKSFHCQSHSFPIQGDGNDAQQWKWIYKWLDVHLAICKKKLQKPLVLSEFSEIAYNDDFAKRREFLKKVYRWLEKGMYSNDFVAGSCYWMICEDNYKNSDGDSESELIDHAKKFPVVKAAAPTPNVAAQ

SEQ ID NO: 10162 - protein, 619 aa, Chlorella protothecoides
  MOD_RES (92)..(95): Any amino acid
MQRQHAHPAPCGAGGCHLRAVRRWWPGHRGPRHPPLPMPSVGGASRRRTLAAGARWRRKQRSEPPPANPRCALDMGRCESWCRWAADKSPGXXXXPANPRCALDRGRCESWYRWTADKSPGQQEGDAGLPEGGQFPGWRAPLALACPTGSAMYDGDCNRPHKSLRLILITSKQVPGMSAALPGGAVGQTDEALGLGFGQVPRSVGGRGGIGGGHQGTCQRVGVGTAIGTPYTYMSDCWNVHVVDARPWRCTLFLRNRPSHLTCRPLLLPLHICTQRDAHQRHLRGRSRPFSELLGDRGELGTAGKGGNLYILEYQIDCADAPPPSPGHPPPSARSSNVQGAARWKLRSRFAFKWGELSFYCIPSEGSMPCCAMHESRKRRCRARGAPGSATRGQGRETAQAVRSRPPETTQGRCLASPVVSPSLRVTRHVPSEGGLGLARAPPCPPCPAPCPLQDAQSELSAIRQQKQAVDAELSGLEARATQLQASCETLLHDKSGLQEENRELLERADRLLERQSLLEAAAESLKLENGTLLQQFDRLKLTYEEETAGFQAELAALKTRVVSMFAQFTAGDISAEQLIEYLSASGVGLRVHGDDTAASDSSLTARLDSARSREERVE

SEQ ID NO: 10163 - protein, 197 aa, Chlorella protothecoides
MTKANVGSLLVFDPSKIEEPKGTDKILHASREAVVGIFTERGEARQRGGGPACRGVAAVCTRGGSLLVQVPGDQEASMCTPATGPIWGRVAASDSVLGATWRAFRASVTLRGASAATITRVALCHRVTPSSPTSPPLARLHDQDCSPGTKLPRHQDLGGDDAQPHHRHAQAQVWAGSGEQRLCVGQGRLHGAWGLAV

SEQ ID NO: 10164 - protein, 394 aa, Chlorella protothecoides
MPLSPQRSPGSAEDGADPSALDQVLGDGVTTAAAGFDHVLVATGEETHVFGPSYTPQGVRGLHLASIHTPHPVAALAAGEHHSLILTRAGSLYTFGLNREGQLGTGRTDARGPEAPALVLGPGSSRPEPITAVAAGARHSLAVTRQGQVLGWGWSLHGQAGTGEATPAVNSPHLVVALGPLVVDSVAGGQAHSLALTQDGDVYAWGLNGDGQLGDGTTQTSLQASRQGSLGGADAADLPMVTPSARHAARPERCFSVLPVHRIPVPRRPSHRTPVADPPLAWQSPAAQTAGGGDGARGQHQRRRTALPPADPDGLRPCRRTRRVWGHGDGALRGQPGAHCRRQPGRQAGDGPGGGLVAQPLRAGVSGMRGGGVLGKVPPWKSALTAHPGLHDFR

SEQ ID NO: 10165 - protein, 267 aa, Chlorella protothecoides
MLPTTHPITHPLPINPPPTPAPPWEPPSATTNTGCTVSWPALWCAIQRRRCSRSCWRATRSSSASGEAWCTTARRACAASRRTGGPPCSWGSRWPGYWGPPPGAEVGQRNGRGGGWGIEGDAGANMDRVHSVLESAGEMHHMCAPTTTTPDAGGPGMMEAATEGALAAGGTVGGIKISREAGTSVRTAASYLPADAQVYCRFLAPRKVALVDCAVRPGEADRTAYVFLPGGLGTMDELFELLTLAQLGKLGSKHPVPIILCKWVWDV

SEQ ID NO: 10166 - protein, 816 aa, Chlorella protothecoides
  MOD_RES (61)..(63): Any amino acid
  MOD_RES (333)..(336): Any amino acid
MEGARRFCLVGGRAEEGLARRDVQRDITVCPSEPARPASTAPHRRKTKASSLRTIYMHEVXXXPARPASTAPHGRKAKTLSLRTIYMHEGTQITSYILILVVAIPAGALGRRWPEDVELEPGRHAETDGACVSVCGGWPRVGSPSRMVVPSSDHDRPRPCVIGFLADAGDMGLHLTFKVTSNILYRSRSAPRCPRALQKHLMQSTTRCLGRPRTTYTAYATALWWDVAAELPGQQQPVFYEPIPSPIHQASTEIRGLGIRAIMREAPSLWRDVVRDDLIHQRPFWVLSCYGHAREGANDLTGDVSPEEVGSAVAGWGEGSAGLHGVVDAAMGXXXXLIPVMTRIHCTPPQVRWMDMRRGAPQRQLASDFQSARRARINCMDRLMKAPQAPSRGGGAVAAPPYPAAQAGISEQPRPQQPAVAQQMGGGGGFGAAFRNVQAGATAAPAPPSQTGFGAAAGLGPLPLAAAPFGPRPVSGFGSGVPSAAQPGFEAAAAQQGFGTAVAQPGFGAAAAQPGFRTAAAQPGFGAAAVQPGFGAAAVQPGFGAAAAQPGFGAAAAQQGFGTAAAQPGFGAAAVQPGFGAAAVQPGFGAAAAQPGFGAAAAQPGFGAAAAQPGFRTAAAQPGFGAAAVQPGFGAAAVQPGFGAAAAQQGFGTAVAQPGFGAAAAQPGFGAAAPQQGFASIPIIQPGFGAAAARPGFGNAPTPSGTFGGAPPAPAGFGASPGAGPFGASGVPTPAAAPPSFGGFGATPSPPAYEGQSMAALGLNATPQGAGLGQAQQPPLNQASLDGTDADVAAWRAPAFEPGKIPETSPPQEFCT

SEQ ID NO: 10167 - protein, 938 aa, Chlorella protothecoides
  MOD_RES (52)..(55): Any amino acid
  MOD_RES (432)..(435): Any amino acid
  MOD_RES (593)..(596): Any amino acid
  MOD_RES (718)..(721): Any amino acid
  MOD_RES (833)..(836): Any amino acid
  MOD_RES (863)..(866): Any amino acid
MGCVQTGRCLPAMFILIWYEPQSSPSFTSSSQPIPPSSPSPAHPSVCQISEXXXXVWGALGACVRDRAMCPLWKFKATGLSADVKIPPSLVYLELVRTTIIAPSSPSPAHPSVCQISECDVRMLRQLGAGACGVVHKAWLPREARFVAVKKISVLDRGSRHQLMNDIKALCNAPPCDGLVQFHGAYHAADRGQIAVVLEYVDGGSLADVIAKVDYCWDGMDEVWCQSLRPDPSLVMPSGDERIIRMICSPLSSSIHRKASRTPFPQTNKVGAVPERILAPITARVLRALGALHGRRLLHRDIKPANVLLTRAGDPRVADFGISATIPDATLAACHTFTGTVTYMSPERVDGLPYGLPSDVWALGLTLLEAVTGKYPYDASAGVGNGPPGGARHTRGWPTTSDPKPTVVVGQSMALRTGAGTPLHHSMTPRPXXXXDPQWSSASPGACAQVMEEECPLPAPGAVSPACRSFLAACLARDPTKRASIEELLRHPWVAGSGAQGGVLQRTAMAATLRQFMRCTHDVEEARGDAVLAACARFFRALATSGRAGEAGLAPLLGPTCVSGGDGGGGKRARGLYEHDPQTPPSTCTGGEXXXXPPSKQSFIRASTMTTNKHLPPHAQAVRVGATEHSGRYTAAKTVEQAMRRGAPADVELWVERVDWKSITATVNGGFRLLHTPGSEMPRVMWRTFPSQAQNGKVSSFDQIKVQDTILILALLFXXXXEVPRVVWRTFPSRNHSGKVSSFDQIKVQNTILILALLFPSPNAGLCSVGRCCGGDCPPQHSPAGREPRATTGGQGQAAHAVGRGGGTWARQRHGLIAGPRRTAGCVELIQSXXXXGRGGGTWASRAAQKPHPLCALPREGDXXXXSGAAQRPLPLCALPREGDHVPANSSKFQWRARRRPTLPHWADRPPAVNSDVPCLFYIERGVLVIWNRFVLWR

SEQ ID NO: 10168 - protein, 503 aa, Chlorella protothecoides
  MOD_RES (162)..(193): Any amino acid
  MOD_RES (305)..(308): Any amino acid
  MOD_RES (473)..(476): Any amino acid
MQTRVDAQELPMVEINFLCVHKKLRHKRLAPVLIKVGRSRVPMGCQLWEEYDEGQAMGMGPQASSDGTALQLSARGRRPAASLQPMRTYQCRRPPTPPPLPRPSAGDHAACEPGGHLAGGVYGRRAAAAPRGRGAVLAPHAEPAQAGGGGLLAPRPAHDSGXXXXXXXXXXXXXXXXXXXXXXXXXXXXXXXXVRPMARADVPAVAALLARHLARYRLAPVLSEAEVAHWLLPLPDVVHSYVVEDEGGAITDMLSFYTLPSSVINNTEYNTLKVERGKGRLRSGEVGAFGRRCISLCAHGSSPGXXXXTRSRHAPPLRLACGQNRESTRIHRHNQPQSRGPRRSTAAPLNFPPPPSQRQAAYMFYTVAATIPLSKLLNDALILAHTTGHDVFNALDIFENGEVLRGGWRSFWGMAATGPVRDSCCQNMGVGVGEGSRVLLVGSRTGPHPGSSLHMPKDPHFHIWNHFPITDLXXXXRGWEEGRAAGCFWWARDPVRTLDPACT

SEQ ID NO: 10169 - protein, 279 aa, Chlorella protothecoides
MEPLPNHRPQVWDRGWQAAVLPLQLEGGQDAGTQRSGPRDAVNRHGTNPSNPGGVQEIPWQIHFRVVFRDSSRRAVPLHPSSTAFRNPKPAECRSLRRESEVMSGAEATPGPPVLGRPLGGPFARPVTLLAGAGPRPRRCLAMAAQAFRPATQGQLRDWLEGHGVPTAPYGQGPTKSLEHLLTEVLDGESTLGLDAGGQPQRRVSVVSVEIRDARGRTLIEARQVLPSGAQRARALPLSEKLLPGEAWEAAAVRGVHEELASVLPPSPQVSLNTCACTC

SEQ ID NO: 10170 - protein, 575 aa, Chlorella protothecoides
  MOD_RES (324)..(327): Any amino acid
  MOD_RES (408)..(411): Any amino acid
MIHWIDNGAESAPALSPVADDPRGDQVGTGRSRKNRPQCTIFNKLDTHSDALEGITKYFIDQRNRKWVAWEKFEVGAASGMRGSRAKGRGHLQMQLSSGAGRDEGSHLMFHKRNACQAHNYRGMRKHRVHFAHLLTDFTLRWGPPAGPEWKEGGPPVSAPSPRGVRAETDRDLSTPYKRDLGMPISKQSPTAHISSKEPQLLHTGTFPHTTRLIHYRETLTSQCALTRGPPRWSLPLPWLPACCSVWRPMATLLCLSRGMPCTTPTTASSASTPEVRVREPRINGDVYTSGSHPVKPLTPWTGPSACSAGGSLQWPAGRHGMCXXXXLHIGFPPFQTLNTLDRTERLQRRWVLGVAGWSPWNVRGPLHRGAEARVRRRLRHRHHHRDLHGGAGRQHDDRDHCSSQGAXXXXSAITGTYTEGQIVVLTVVITAAHKGRFMFRVCVIQDPTSERAELTDECLNQHILMQADVAGAQNAGSPYWYDRGVGSWDMAYQLPQGLTCDGVNTRCVMQWWYLTGEGSTGRWKVMELLIALGSGEMQGVAVCPSVAKVLPCTGDSIPITLPTLATPLRRRQLL

SEQ ID NO: 10171 - protein, 177 aa, Chlorella protothecoides
MTAISLKTAAVTAMLVLTQVDAHGYIAVPASRNFLHNTDYCPHCLNAGGTRATSEGGALRWPLSRHGICGDPFAGERKHEYGGVSATGTITGNYTEGDNINITIVINTSHKGRFSFRICVIWNPSLELTELTEDCLNEHILVRAEFGGGEWEGWTGITAVRAEPGCKKRPVFFHSSS

SEQ ID NO: 10172 - protein, 449 aa, Chlorella protothecoides
MTTPIPSFGDGAMFLQQQMLQQQLPPRTPTGSAPLFPDPPLAAPAANLFSSIPMPDFGKPATSSRPPADSDHSSDDAEGRSRGPDAHKTTAIQEKNRRAQKRFRERQKAKMKDMTEELDDMTSELGRLRVENGALKNRNSILEKVLALRDEHIRVLQDEQHVFDLGNHHLQTSNPKLLGPGPAAPAMLGYGAGGGGSGLQGGGLPGSGQGAGSQLPARGSGPLALSAALASEVASVKTMPADAVISRWKETVRELGNILVTLEGCPDPSAPAHAEASATLTRVLDAAGALCMHTAVLHPTNMQRLIATALDDGRSGISSEDRARWAGVTASLALAPDQRAQVVSLRAIFLRRMRRVVEERRAILDRLQSVSVPDRMLALQSVIAETLKVNECTVELKANLQEEHLAGMEFIGTVFKTIFTPLQKARAIVQSYPFYPDVYQVCWRGVCVC

SEQ ID NO: 10173 - protein, 104 aa, Chlorella protothecoides
MLSAYETGRLHPILCFVRSLLEVGLVSRVFRPPNPWFMGLLALMAEVYKLPGLRNSIVFEVELLFKAAGLVVADVAPSALLGARRAPPPDSADFGGGAQGPGVA

SEQ ID NO: 10174 - protein, 583 aa, Chlorella protothecoides
  MOD_RES (94)..(96): Any amino acid
  MOD_RES (475)..(477): Any amino acid
MRAGSGGATQHHLLRHSLPTDSKGATALSHFGAATVAEAGKTIKRMSQRDLQNTFRAVYGTRTFSNNNNWLRRKLCEGKEWYKARSLAALIELXXXRLLWWGLSLMLHAPAMRPEPSGSILARVPPPSGRPMQQPHTPRRSAASLWLRRRTPCPLRTQHRPCSPWERVPAGTATGLRVQCPAPPASTRSYYDRGSSRSAATGPPAVGLEELQLSMSSQADQTSGAGEEASVHRTQAAEVYVLPAPEAHILALQHAVPRTVHSSTTAQPTHAGADSRPAAEAAPQARQASPPRPTQGMPAWVSPELLMQLRMLLDSGGYLASGQPPATSRPASRHQPSLRGPEQRNDWEAVARAGIPLRAIPLPLSGVSTWDTQGKPMVGPGNGAGADAAPVVVLGGRSGAVSPGVGRRPAGKAAAIPLVSHTAWAPPCRYARSFRGGAVGRRRFKDAHRLKPPPECPDGPPQPAPPCTPSSRLPXXXFGAGRSAGAASEIPIVSSPHRSAPTPPPRPALPVLRPLACPLPCDKTRMFLPSLLPSDALTLRACLQAAMPDPHALMFEISSAPRPLRGSTEESPALPRRSVPYVP

SEQ ID NO: 10175 - protein, 302 aa, Chlorella protothecoides
  MOD_RES (283)..(286): Any amino acid
MVLGGGPRPGPHVHEIWPPGLVWWSTRWTGHELWGAMMDPHSPPYYSTSGGEHTLHLVVEAGGFSFPQGSPGTPCKFGTPSYSLPSGGASSPSRNSSAPNFGVFIGGPRQLPHMSGPAQPLPVDDAGLPEEVREIVAKARSSWLKNSEVFQILQHATSGLLPLSTSPPELPPGGTLFLIDRSSCRTFRKDQHQWRKKPGAARGCGARCTRKPQAGRAVFTPRRNIWGCSVACRSGARLIGSGIGAGSHTSLLVRGWLPSAQELHGAPAPPPHLPPHQRLPPTXXXXLARGPTPACSSGAGFL

SEQ ID NO: 10176 - protein, 459 aa, Chlorella protothecoides
  MOD_RES (101)..(104): Any amino acid
  MOD_RES (297)..(300): Any amino acid
MRAAAPEWSLLPRGLWSGGAHCCSMCTSAEEVGPRTDHAGPCLVLLKGVTLPRADFEAWLRDSVMEWAVMRVYWIKQRCADRQGSCLSCLAYKQHWADNHXXXXSVFIVTGSWSVSSWLKAPLMEPSASTAFPISLSRGWEGAQGTEFDTASAPCSVSCHAQSIGQQAAAILTPSELGHLVAPLLSTHHDPTSYTVPQDALPLDWVLQPAAFTHVLDVVETAAGVAYSMSPCPRLFRTTAWTRPRLEGSLCKATSKLAEALAWVKHAPRGGVAIDLGVSGEYRLIRGPPSLLCRAGXXXXCRHCLHPTLLCDRSTPGASPGGWSTLLASSMHRVISIDPADMAPEALALPNLTHIKSRVETALPQIEAALAAAGAGGGADLLVSDMNKHPSAMIGMVEPLLAYLKPGGHLLLTLKFFSRSRDKAWDPTNCPQLAGFRGVQVVWLLANTAHERTCVAIKC

SEQ ID NO: 10177 - protein, 575 aa, Chlorella protothecoides
  MOD_RES (289)..(292): Any amino acid
  MOD_RES (507)..(510): Any amino acid
MAALAGHVHARNLSFGMYADSGTSTCGGYPGSRGFEARDAAAFAGWGADYLKYDNCYPKEGDSVRARYGAMRDALNATGRPILFSLCEWGVEEPWLWGRAVGNSWRTTGDSSASWLSLVNNLDNSVGLARYAGPGAWNDPDMLQVSENGEGEWGGLPRVILLLACGPKGVKVVIVGGPRVDVPLRGSEVQLQVVDHSKTQPPVGHKMRRPFPLSKLGSRAALKALTLLARQLYAAAAGRNSPCINKRCRAPGKQCQPMLLTHPLNRGPHLEAGKGGGPGRAARNWRGMXXXXKQARGEDLAGSQELERKGGDGSLPIQSLDLDLSDAGDACTDRGGEPIYPPTPPLQGSKEIYAGPLAGGDRAVVFFNRAEHDEGAAGARFTRKPPCMLWAGVLIVLPCYPAAASARSLLNRCARGQLTGAQLFTCRCTARLRCRPLFPPNSCSAHRAGRVPGRHRGARARPLCTARHRHLPRQVFRAGAAARRACAEADTGGGAVFEVGGRPAAPXXXXQTAELLTPEAAPFLEWEGGRWPRDDGWRPWTGQAIYAEHEEDLENIPWRKTEGDDDALEDPAVAI

SEQ ID NO: 10178 - protein, 375 aa, Chlorella protothecoides
  MOD_RES (132)..(135): Any amino acid
  MOD_RES (184)..(187): Any amino acid
MVSHSLPSRHDSETAHGRSAVPPQRHTVVLFPDGAPTGPVLGVQVPLAGQAAVLLAGAGQAAQLAVLVDGVGDPVDAGILQHGGAVFRVTWGACGGDENGKLDCGSMRSVLRTEHEPATCIGLGRATRTSSXXXXLDCGSMGSVLRTEHEPVTCMGLGRATRTSSHSNSIHVQWKPDGSCPAAXXXXSASLPGLLDKASAHVADGLVEGVHQDDLKVLVDCVLVHPVGVQHAQSTALAADTLLGQVGQVAGGLQLGDTLVHGLAVHDSLQRRHGGGEVHFTRVHSSIAIHPKHAQDDYTIPTHMAPSMCSGPHPQVGFETQPTLRTPEGGHQGRACSRRAPWGRASCGHHGARARGRRRIPAWPCSPCGVPCRAG

SEQ ID NO: 10179 - protein, 164 aa, Chlorella protothecoides
  MOD_RES (150)..(153): Any amino acid
MRVFNLSRISGCIKATTTPFFVSMRRTRAAAVALLSADPIANQTKPAPPLQGRQSGRGPQGIEARSLKSTAHVVVAQVEPPQQKTGSPASKKKRSKAALDPSGFVQKDILSIRNKASRIASQLDGLYPNPKVPLDSASPFQLLVAVILSXXXXRPVPESQGAPG

SEQ ID NO: 10180 - protein, 200 aa, Chlorella protothecoides
  MOD_RES (18)..(21): Any amino acid
MYRIHPPCTHQTTDVKVXXXXYSHPQADGCWVKSPNALQMHIYRIHPPCTHQTTDVKVNTVTPALFKLAATSSAMADADLAEVTAIIQPLGLSATKAKHLKGMSKVGGCLDGVIGEGEAIPYESNMPSEGEAIHYESNKPRCTLIGILVSQHPLVHPCRSRPVHWTRLSCESALNSTFLFFLPPTDAGRAAWRPGPIQLR

SEQ ID NO: 10181 - protein, 221 aa, Chlorella protothecoides
MWLWVDRRSAGAGSHPGRRSEGPSPPPHFPSQYIEELWKKKQSDVLRFLLRVRCWEYRQLPSIVRLTGPTRPDKARRMGYKAKQGYVVYRVRVRRGGRKKPVPKVRVWNMLGPGALLLGSGGLAGSRTRPGDGALSTCSEPCAWGSYSHLEHGIVYGKPVNQGITQLKPTRNLANLAEERVGRKCGGLRVLNSYWVNQDAVYKYFEVILVDPFHKAIRNVS

SEQ ID NO: 10182 - protein, 200 aa, Chlorella protothecoides
MAWLYALYSFDYKWAAHGVPLITRVSFFETHWAYFAGAQVSGWHVSLTSDALHSNQVGPWQSCTPLPPPLGAGFGLLPILPVLLTSFFIGSAVVGVAFPLFIILAADANPKARQAEGMPPENTIPLPAPFDHAAVQQAHGPAQLSPLRVFAPASWMTNAALRSVGGGMRAATRMLRRRWTPRRAEHGESRRPAPTREPAG

SEQ ID NO: 10183 - protein, 159 aa, Chlorella protothecoides
MGKGAKNSLALAEAGSVLDDPVFTPFLADDFDAATFASQAIVSGGGSAPAHMRELREGIDRLEAGIREHLNTHQDSLLASAGSLGSVEADLDRTSLSIAALRSLASRVRADVAGPAARVRALTHQARGLQSTIDLLQHVTYRLKLVSQLRASVSNGQGA

SEQ ID NO: 10184 - protein, 301 aa, Chlorella protothecoides
MFGTVEEHHGPIPARERPGVDLLGPLKGGGWRVDGLTTTVLPPCLLPDEVPCHAKVILIDGHHLSGQEDGGRRVAQLLQPGADHQGRLEQGPERQVGALLPKGQPWVAHLLRGIPRQAHAVVQVVDQAEPGGGGVAGGAPGVANGAAPEPGLLHPPLAQAEEYGATRGVERVAHGAVPRAHRVPLLGVAVVVLEVVRAPPRKRGGVPGLEAAGAGVAAAGGGAGVGVHAEAQVAGVDVSRQGCHAPRKARIVGHQVPIGGALMLRPAIWMGWVRGGREGWQAFCVSLGGLPRHGSRASSIC

SEQ ID NO: 10185 - protein, 79 aa, Chlorella protothecoides
MPAFPVDTHIHRLAERWGLSSGKSVEQTEADLKAVFREELWNKLHLQLIWFGRQHCSARAHNPQACPVCVWAAPNRAKE

SEQ ID NO: 10186 - protein, 207 aa, Chlorella protothecoides
MTVPEPRQGSPRAGSPGPGYDRRDGPGSHSHHGGDFGGRYGGGGFGGGGHTHTWKPGDWTCMACHSHCFASRDTCFRCGADRLGQRGPPPGPRFDPRYPQDPGMYPPFDPGMAGMPGAAFPPPGAESVYVHVPPPSIPGGYGDAAAWGRGPVKDGGYPMRYEAFEYQPHDTCYRVPGAPEAAPAAGGMSGGAPGFGGGAPGASGWVG

SEQ ID NO: 10187 - protein, 63 aa, Chlorella protothecoides
MLQDARINWIANPVHKHRELRGLTSAGKKYRGLTGKGHLHTKNRPSRRAVWKKNNRVSLRRYR

SEQ ID NO: 10188 - protein, 266 aa, Chlorella protothecoides
MTLHPWITAGWDCDMHQRCPHFLAFLDATTPSTHFAAFAARQAAERARREAAWASECEAVEKARQHARHELQLAEQAVAGAFTHQEYTAGLAALRAARAATEAAGAARPPPAPDHADLDGEQAPMVHTAPEQLLALLRDGQRRGLQAAAGAAAAATALHAARRDAEEEGRADLRTIAALAERLAWAERCLAEAELREAELTRAAELREAELARAVLALDAPRAGAEGTEAAAVPWALQDALRLCGLGEAPGGACALDLLQQIEVLG

SEQ ID NO: 10189 - protein, 613 aa, Chlorella protothecoides
  MOD_RES (464)..(467): Any amino acid
  MOD_RES (604)..(607): Any amino acid
MRRLSAHGRDAGLRASLLIDTCSNTAAGDRCTGPTGHTLPLPGAAPEEECAAQAHDPAAQQGVAGGEFEQCTASTASPPSAALRVTFCSHTMTLVWCMQSATHLILASQWQPPFHGPTDIPSPPLLPTGPRLGHQALAAHAVQGVPHAGLPRLGDQSLWQGQPAGPAAPAVPPAQRQAVCKVAPVPGETKVWQYITLTKKIFLIDCPGVVYNGTTDTESDAILKGVVRVESLEEAADHVGEVLARVKPQYLRRAYKLEAWEDAEDFLSQLARAAGKLNKGGEPDLNTVAKMVLLDWQRGRIPFFSLPPDHVDERDGVEGDAAAALAAAEEEEEEEDALVVGGVTEEDAAAVPDGDPIKAAAAARALTAAAAEEIQAQRAGAIPVRHAFFSPEDAGEGGQDLSGDDSEGDASDGSEEEEEDNGEEAAAGAEGEAPAASDDDAEAGYGEGGLSWEAVLQSIQRAAXXXXWEAVLQSIQVCWFASQCWVVRNACSTRDMLRHAVGFREGCLCLRRPAMESALRGFGVPVQCMTRTLPCCAIYSATKYSNLVTAQEPGAAEDEDEQEEEPTITVPAPQKRRAGAAGPAKRRGGADAGGRKRKAAIGTXXXXAWGSRG

SEQ ID NO: 10190 - protein, 320 aa, Chlorella protothecoides
  MOD_RES (146)..(149): Any amino acid
  MOD_RES (177)..(180): Any amino acid
  MOD_RES (267)..(270): Any amino acid
MQELQSKELPSTRIQPDRRWFGNTRVIGQKQLEVFREEMAAKVADPFTVLVKEKKLPLSLLSDPSTNFAASNRSGYSPENPLRCSTTSTHCKDDTSVRTAGRAARNGLVATQPFADTFGKKQRRKKPKLSAESYQGLLDRAETVEXXXXDTQPSPPSFTSKADAVGPSDPFADIRPXXXXECTLVAGRLASVSWERAGQAKHRYATKPPCADCPGVRLLQGPVQAHLGRAVQGPRLLRRRHPGLGRAVGLCQGFPWLRAASLPPPFXXXXTPQTSSSRSGLCCGAVLGFPLASSCIPPPSLLSAVAGDDHPCLSVPSDFQ

SEQ ID NO: 10191 - protein, 623 aa, Chlorella protothecoides
  MOD_RES (446)..(449): Any amino acid
  MOD_RES (533)..(548): Any amino acid
MTSHGPGTLPEIPSNSAALGEEDEPPTFSPRSLAVQRGILAEAVGALGSQDFAAALSAQGDSVSDDSDWEYELENFDQVRGPGLLALNIAHAGGRVAPSACAPPPCCLHVARHRTACPWLGVAPSACAPPPCWLYETRHGAACPGLGSGKASLRASPCAPFTSADQHQAPDQGGAEGHGAQDDRKAEEPRPDADARQAHLRGVLDGLMPCPCQSTALGQGVDIEIGWGTWSGICYPNPMPNPPPHHAVPSPSTSCTLPGGPPHTALALPHQHRMDQGESMDGSQGHDGLGMECGLWVTFALNLGPLVWSIVAFRNSLVPHSLDKMTSHFLSWRFSSPVDSLPTPPSAGTGSRPASAMRHAGTPPPRWWITWPLPRRPAGPGSPPACVSYSSSPWSPTSSGRSSTTSRCLGGWQEAGFQPLGGQVASLIPIPAPANEYVLPPRPRIXXXXHPSVSKRVRPSTPSSHLLGAGVCHQLQQDRAAGLRNPVQVRAGMFCTRWDLMAVGACSGAGRGFLPTMQARLLGQGGSHPAMQXXXXXXXXXXXXXXXXESRNASRPQVCDLQPPQPFWRGGAALSSRAAARRVHGYARGPLRRDPGADLRLVAVPAGLRGLPGDPVHRLGLER

SEQ ID NO: 10192 - protein, 1032 aa, Chlorella protothecoides
  MOD_RES (375)..(378): Any amino acid
  MOD_RES (830)..(832): Any amino acid
  MOD_RES (861)..(864): Any amino acid
  MOD_RES (936)..(939): Any amino acid
MPKDAKADILTKGTKIKPKKDPRTPKKPSGACEHGIQDCVAGLTDPGLSSPSRTRSTANPGNADIHYCKDKRELLKQEHPSLSLGDMGREMGKRWQEETMEVKKVGVRRAFRHGWGIEFASQGRLSVLGWRGKLPIKVTHAACTKSDCGLYNDAHGLHMTQFLGAMSEQITASLSTCTPWLQPYFDMAARDKARKHSLHGPSAELVFQIHVFALKAQVLMLWPGIMDSPSSRSPPMILLPNVSPGCCTRNVQAEMTSRQASLGRARILGSSQLYFQLAFSTTIFNSPRPTPKHSSSSPADGPLELIDLLIREAALHGAVCNAVAVARLALGCQEVEGMGFVDVHAQGVTAAQSRLAAPAQEWIDTSSDHAWLACXXXXVRRSREWGVWMSMLKSPPQPSRVSQYPSTSGLTPQATTRGWHAPRDSCAPETQPPANSTTHRLWVCEAVDELHLLHEVPRHGTHHLAQVVLGEAVAQPECHVLEAGRVLAVGLEPGRSASPPSRTAGCLGCQTGPWPDAPDQGCKGKQEELARYCGWSRGPSMPRCLGCRAYPQQPMGGPSLPGQADDALWVLTLQPHATSCHRFSTDAVLFLLHSRNDQGAHPNAQALRPAKPPSSTMDCWVTPHPSTSSHSPLNRISSSKEGSVKGNHRWAWGNVSESRSRDWRAGLPEFRTGQACLSGGPIALCSQPSSMTNNLSHPCSHQRALAAPPSGGTPGSASSRCCLACSSARVGVSGTAATERDGVGAPPGVSPRWPRIDKTTLHSLLDHAKFECQAEVLHPGAFSSPAGEALSRIPAPLPLSRLPTSSKFWRLEGGGGRGRLVCMIGERVPXXXGHQDIIKVLADGRGGAGAIGMHDRRACAXXXXSRIPAPSPPRPAFLCTHSQALCHPPVHIAGDEEGGLPALQQLQLVCRGVAAQHGGITHVVGVVGVAGDVVGXXXXEPGPVARWEEEPASSHGLVQEGAPPCPAREAGATHRLDRDHGVQVIKGLQGGVRLLEVLVDGSLDDAERVGWPSGEKQSEGVGRGEGEQNRSA

SEQ ID NO: 10193 - protein, 179 aa, Chlorella protothecoides
MSASVLVPHGQARVPVGVGHSPAPRSPLLLQRARAMGPCFVPNVTHKSSCSPRMSSCIITRAVAEEQEVASAAPTPPAPQQKIRIKLKSYWVDLLQVAVDAILDVAKTTGATVSGPVPLPTRIRKWTVLSSPHVNKDAREQFEQRTHSRLLDVKNLSAETVDKLMQLEIPAGVNIDVKL

SEQ ID NO: 10194 - protein, 98 aa, Chlorella protothecoides
MEGLRVLGPEDWGSMDPTQYAETQLKQTLEGLAQHLFGESKGSVEMRWVDAYFPFTEPSFELEILFKGEWLEVLGCGVTQQSIVDDGGFAGRKAWAFG

SEQ ID NO: 10195 - protein, 98 aa, Chlorella protothecoides
MAAREAAHERVSTFLVSSDRAQASGNEIREALESSNDEAKVEAMEKAIAALLAGEQLPALFITIVRYVLPSENHQVQKLLLLYLVSGAIGLEAVLVLS

SEQ ID NO: 10196 - protein, 331 aa, Chlorella protothecoides
MILICQNLRNSLQHPNEFIRGVTLRFLTRIREEELLEPLVHSGDLRDRMGCIVVVIQQACCMSSMRRVQSSPIPPLQCRPPSSAPPPFLSKRLPNVKTKIAVLANLEHRHSYVRKNAVLALDAIWKLPRGELLAPDAPEVVERLLAGEADLSTRRNAFHLLVNHARDRAVAYLLSNADRVAEWGDVLQIAALDLTRRVCGDDPAQRPRFLKVVLALLQARSTAVVYEAAVTLVGLSSAPAAVRGAAATFTSLLASQSDNNVRLIVLDRLEELAARHPEVMREALMGVLRALAAPDLDVRRKALDLALDLVTPRSVEEVVGVLRKEVVRAAA

SEQ ID NO: 10197 - protein, 148 aa, Chlorella protothecoides
MVLFDIPDIRLFWTEDSRFLSQFKAGSMKTKWVVQRGKRTNRLDSLSPSPPPSLAPRTPRFKPYSKYPPCFKDVAFWLSDSFTENNLCEVVRAVAGDLVEEVKLIDSFTHPKTEHSCPWEHASHAWSLEVSIHSWMGTARPDWAAVAI

SEQ ID NO: 10198 - protein, 1211 aa, Chlorella protothecoides
  MOD_RES (57)..(71): Any amino acid
  MOD_RES (127)..(130): Any amino acid
  MOD_RES (474)..(486): Any amino acid
  MOD_RES (686)..(689): Any amino acid
  MOD_RES (872)..(875): Any amino acid
  MOD_RES (899)..(902): Any amino acid
  MOD_RES (930)..(933): Any amino acid
PPPPPPPPPSSSPAPSPGISPSPGTKSPPPPSYVASPPPPSKASPPPPTSSPSPRKXXXXXXXXXXXXXXXATFPPPPPISKDLYKSVSWFGMREVHTSTGTCSRAVSVHILNKFHCTPCCRHCMDXXXXTQSEQVPPHPLLQALYGSYLFYEAQVSGEKPSWNRITYRGDSHTDDVVPGGCLLHIRVIGGAAVSFYIDLTGCSLDGTALPSKSEPLPSTKSTPPPPPPARYDAGDFLKLNFPMGQTVSFLAWSLLDFPTAYADAGTATPALNNIKLAATYLMKCHIGEYQYVGQIGNPGTDHSYWGRPEQQTGTRPAYTYTKETTASDLLGSVSAALTSSSLVLAGSDAALSKEMLMHAKALYAWGKAYPGGWEGVDVLGGKEDERGHCTQSRLPSPRPRITPPRPLAVQACTTRHTPPPPMCTGPRGTWTSSCTPPPGCSGPPGTPRTLPTPTPSGSLPERATSTPAGTPPXXXXXXXXXXXXXNLLLKLASEGKTVPGKAAYEKWIVSSFLSAWQTADGEPGGWLSSWCGMHRFLVQGSGRLQSQPVSALFPTDGANGAGQEPPMQLEHHQDAQGPDLPILEQVGEPALLQQRGLHDHHARLLLLREQGDQHRVGQEPAGLRAEHHRPQLRVWRGHRLPAAAPPPLRVLPQHARGLRLGPVLLCGLQSPDADGGPGGWAPQRXXXXQGGKPTDADGGPGGWTPQRGWHLRGPAQRLCLQRGGGRLQRGLHRRAGRLHRPGLRRLLRLKKPRRVPDDRVALIRAAADPPWKPWPDTCTLVYCILPLTHSPHHCLLRHPGITPPRPDCAAQPGPPPGRPLVQGGGGGSRLRLRRFDAVGGTPGIQSVQRACCAQGSDRTFLRDAFVHGTGXXXXHSAQGSGSSQQAFSPPPGCRLPGXXXXARSHCLLGEGLLLCRPCLGSASPCAGHXXXXHVLTACWVRAWSSAGHVSVRPALAPAMGGWVRPPLGPGFRLLATGLSPASWVSAAGSQVAKEQRPLQHPAPQLQVVVGRDLVPVLAPARARVGECAGIKDHEVGVEARPERALARAQACKARRRGGPGAEEGGEPHAVLRRAVPAGGQAVLQTGDAAPGAAEVTAVQVLERWGRWGVVAGQQVDGAVGQAAPQRLSVGRAPDGRHAGEARVAVGHVVGGKEEVVGAGLHADRKALGLGRRQRGEQAGGDQEGGIREWAGRRPLVWRSRVLGRGQQACT

SEQ ID NO: 10199 - protein, 331 aa, Chlorella protothecoides
  MOD_RES (93)..(96): Any amino acid
  MOD_RES (136)..(139): Any amino acid
MGETSIPIPAPAHPSHGCVTPGASLPWTQPTVHVRGSRIVTVATAGPDVDRVAFARHYAAANPRAALLDYGGAVIGPGLIDVHVHLNEPGREXXXXYGELFGFPMTIGVRSRTSVRGAHSGGSAAHCPGVSASWGXXXXGAVIGPGLIDVHVHLNEPGREEWEGIPTGTAAAAAGGLTTLLDMPLNSEPCTNTVADLRAKRAAIRAGARVDVGAWGGVVPGNARDARALRALARAGARGFKSFLSPSGMAAFPNVSLADVAAAIPVLKRLGAPYLLHAELVDGDVPPGAEPRSYAEFLARRPARYERAAVHAVLDILRKGGRGWACGWAWG

SEQ ID NO: 10200 - protein, 92 aa, Chlorella protothecoides
  MOD_RES (60)..(62): Any amino acid
MVLTVDALVIYLGCVLAGCVVVSIADSFSAEEIASRLRISAARAVFTQDAVLRAGRRLPXXXAHQRRARGVHAGRGAARGAAPAAVRARGGG

SEQ ID NO: 10201 - protein, 96 aa, Chlorella protothecoides
MNQIRIRSKAKQLLDAGCQIHEFGGQTLEEGGFGDDVAALQAFLSEREGFSGYFGSVTKEALCDWQRDSGLEVTGSFNTASHLEYLRQKVSRGERW

SEQ ID NO: 10202 - protein, 226 aa, Chlorella protothecoides
MPDTTPARPGFVVHFVHLVSSSLLPALAAAKAEGLPVSVETCPHYLLFSADDVADGDTRFSCMPPIRSAANREALWRGLADGTIDLLASDHSPAPPALKHLDSGNFRGAWGGIAGLQYGLPASWHGAAQHGVGLPAFFRAWAAAPARLAGLSARKGALRPGFDADLVVFDPSALADTGAGGRQHRHKVTPYHDLQLRGRVLATFVRGQQVFDSEKGVAQQACGRYV

SEQ ID NO: 10203 - protein, 284 aa, Chlorella protothecoides
MTAQEAGPTAMRLKEVLEGADALPLPQVRKHHLGLDSLGTPGPGGRWGPPGGTHIRAPERCPHPPLFPQLWRLVSKHVLHPDLPFPLHVKLYKAAYAGWDGEAQGPPPSWVPDPDAMRDTNIARFMQEWKGSELWRRLRTGDPTQDWPLLQQISFEDPESFWPAVLQRLRIRFHSVPSRVLARHADPDQVSWFPGARLNVAECALAGRDPDRPAVVWAEEGTPTELHTLSLGALAQRAQHVADALRAAGFQPGAAELGVGTASAPGRLPSPRRAPPRLHTPCAA

SEQ ID NO: 10204 - protein, 155 aa, Chlorella protothecoides
  MOD_RES (33)..(37): Any amino acid
LGAAAVHGAHGVGGALRRGAAARRRRRRGAVGXXXXXGWEVPFGAAHPPDDAAAAGRVGVDESLAPLPQIMAVFSAVAWNIVGEEQPARVTLRLWSFDPARPTASLEDLRLQVPDAVLCSEMGVSFSPCGRYLAAAVACRAGTRRGAPAPLGTPG

SEQ ID NO: 10205 - protein, 232 aa, Chlorella protothecoides
MARTTSSLLLKLLGNVLSQPGEARFRRLRLNNPVLRGSILETEGGLDVLLAAGFQLQPGDEADGGCGVGVGEAEWAMEPRGAAQFGSRPGAVSQFAVLEPGADLAPLRAACQMLRHLNATEQPAGDSRAEPGVGRAPAASAGPAPKPAPAGGAGPAAGSPSASCTVPAAAPPFAGVQPAPARRRATRVVLPSSVEREVPPWFFERTGAELKAAFLGAARRRQEEQASRGRGE

SEQ ID NO: 10206 - protein, 105 aa, Chlorella protothecoides
MRFPDVHPGPFQPQDVSIRVSQKPGYLCRIEAECSLPLPPDTLFHQIVTHPDNATIFRNMDSCTFRKILQRSDAVRVLEVEHAANWRILLFRGTFKTRWVGGFEV

SEQ ID NO: 10207 - protein, 139 aa, Chlorella protothecoides
GAPPEPGPFPGAPDLGAAAASGERPHLQACTLRVLRSAAIERLAEPGRRSLLRRLTALLTEAPAPPAPSGLHLVPVAVVLLESVALVIELLGEAGAETLAALSPALLACLGWPAQGARVQAARALAALAVAEPGAAAGL

SEQ ID NO: 10208 - protein, 306 aa, Chlorella protothecoides
  MOD_RES (58)..(73): Any amino acid
GAAAARRAGAGQARRQAGAGGGVGGALARPGPGLRAARGVSIHVGDTGVGVGAVDHAXXXXXXXXXXXXXXXXLGGWGEKGGRKGEAGLEAERKEWTGGKIRSQGLCRPTGGTGVFHEFVEAPRATTNPPRQLQPEHHNHTTACIPPPPPCPTKVGELDVAVRGDEQVVGLEVAVNDALRVAVLQRQHRLRGVLPRHTLAQPAERAEEGEEVAPRRVLHDQVEIGVGGEGGVEADDKGVARRRQDVALVAHALHHVLPDQVRLAHDLDWVVVLEGGGRGLVRQPRRAAAVDGEVSGRAALLLLMNM

SEQ ID NO: 10209 - protein, 132 aa, Chlorella protothecoides
MRKADLIRKNMVQSVRNERNILAAARNPFVIRFHTSFTSHANLYLVMEYAAGGDLFSLLRALGGLSEGVARQYAAETVLALEYCHAQGIIHRDLKPDNLLIAADGHIKLADFGGTGWGRRDACCGVIVVFGL

SEQ ID NO: 10210 - protein, 200 aa, Chlorella protothecoides
  MOD_RES (51)..(53): Any amino acid
AEPHGLARVDPRGADLPPPTCTNGGGAGTNGSGVGYLQANALQAYDELLRXXXTRGADLPPPNCNNGGGAGTNGGGVGYLQATALQAYDELLRAALGAQGCGRRNLTPEGPWRWLLAEFASAYGVRPQYAALSYLKWVVGEEVASLTSDCFGVLARELAPLHAARAAAALSSGELGVLAQVCNRVDGLLSQCFENYFMLR

SEQ ID NO: 10211 - protein, 984 aa, Chlorella protothecoides
  MOD_RES (50)..(52): Any amino acid
  MOD_RES (605)..(608): Any amino acid
  MOD_RES (887)..(925): Any amino acid
MGCTKQVAPGRYCVEGRRREGSAKVSLDGDPEGRMPAISPWYLVICVGVXXXQGRRGEGSAKVSLDRDPEGRMPAISFPWYLVICVGVCARTGQGGACKAQQGKRGPQQCGARDTALVHSYAASHAGGSKRAANRALAPRNAPLALRGSDVLSVAPPIGCLSCSRARFKIAVVNCIPGIQGEICSCLPIVQLLTWKYGHLITRQRCTPERSGDMWAESKAVRRAPGFHFKCASIHEASSETGPIKDGIIHCSICHHYVRFNHARPLFLRQFKCLGLGSCEGGHPLLTPVVGPPARSGALTVKAIAGPLQEHRTSSLHHYCSQHLAGLLIPQYGTDLHEAVQPGEPKSSKGKQGASRGKARHSVIADLQQHSDSCTALPSQLFSRKEMRILMVGLDAAGKTTILYKLKLGEIVTTIPTIGFNVETVEYKNISFTVWDVGGQDKVGSSLLFARKPRPHPSSPDPSPLEALLPEHSGPDLRGRFQRSRPHRRGPRRAAPHAKRGRAARCRAAGVCQQAGSAQRHECRRDHRQVGAALPAPAPLVSQGDCHGVLLVLVRRVCVQGFANRWREYYFPDVFCPTSPLHPCKPPFSPPPSPSASIPSLWYRXXXXARICKQVHPVLLRHQRRGFVRGPGLALPEHCQPNVSGRRWLERMRRRWVAWGSALPGAPVGATVWHGESRGATHVACHPPPDALPCTASPDIHLLGCNPGTCRAGRVERGWGRCKLEKFIGCDSSLWHRRCTVSCTSRPAHEPSLRAAGLGQLGQQLRPLLPDQGQLVGEEAAHQRQQGQVLARRRRGQRLVSIEPQDKDGRDEEALLAQHAACHAGAAGRHAVHRAIQGPQVEQPRHRTHGVARGARAAKGGKRERVAGTVVRGARARQGGRLTCKAXXXXXXXXXXXXXXXXXXXXXXXXXXXXXXXXXXXXXXXLPCTKAVPARQMPDSPSVHTRPAAFMVSYASCSSRAASAAASPLRTREASAASEAWQGG

SEQ ID NO: 10212 - protein, 290 aa, Chlorella protothecoides
  MOD_RES (115)..(118): Any amino acid
  MOD_RES (212)..(215): Any amino acid
MMMFASAPSLKPCRPRALFATASHAEGGARDRPKRGLKALQRPKTGYFADVDPKAEVYPVKKTNNASLTDKKDRWTPEFIWNIDWMGQVGRASKGIKDEARWSFLCGLILVFEDXXXXEHRLDGSGSWTPPPPYGHCKQADSNGEPPQQGSSPEAVAEPARPAARGYLSIAGRQSLDSLDRDLSQELIIQKKQRLDGAAEAGLAAQMRPAAXXXXGPGPFPGTDHSEEAAVGRCSRSRAGSADAASCKVPTRSRFQERNSCLAENLPVCRAGECVGHFPALPAALVRGAR

SEQ ID NO: 10213 - protein, 228 aa, Chlorella protothecoides
MAPQARTPLACSPANGLAGKQYNWYTLNQRVFRSLGLSFTKQQLSDAASAIPGSAESILKVLRARLQDEVGPQAERTEGKGVEEEPCVDVIPAVRRGEASPPPAIVEGDLVAHLQQTIEVRGMGLLLITRSPLARVTELKWSSMTAATHDLLYGLQSTTDLHAICRSPTLKPDCVTSQPLPPTATWRQDIQDGAATATERCKDPGTDGEAADAAGHALLLKARPILTT

SEQ ID NO: 10214 - protein, 307 aa, Chlorella protothecoides
MVGWVLANSVGAPALTPSKEGLSSEPGSKHALPSLSMYSELPGSEISIEEFEQAALDRLRVLKGLDDLKAKGFRPDQVQDKVLSLVDQYLKVSAKKGERDSPPCTAPRLCWGKDPDQSTELAPKLHNQVHLNYVSPPPPSSNWSGRYTRKYHPEGHRVPLRAAPGVLPDRGAASLVPGPGVRSLPCTLSGPAPRRATRLHRGQPPALPPPHPRRVQGGGGRPAGHHAGGDRQPAANQCAVPGRRRATRGLLPCALRGRAGPGGGQEGVPARRPRLRQPRPGGQPGSAALQVEISGSSMWKREWGGEG

SEQ ID NO: 10215 - protein, 281 aa, Chlorella protothecoides
  MOD_RES (12)..(15): Any amino acid
  MOD_RES (147)..(150): Any amino acid
MSGVCHTVLHPXXXXPTDAEGGIIAACISGVCHTVLHPIHPPPPLLAMQLGAHHMLEDYARRGDEPKDEIQLYTWTDATLRCVCGGMQLHVASGVNSDRSVLHKTQPLACPSPVPTYPFPFHISNPSLCPGGGGALEQTRGGRCENXXXXYGGMQLHVAGGVNSDRCFHPTLLTCLLHSTKTSIRELCDLVKEVHQTARRPSVRLSFSLVYPDRRGRNVLRHSQPMACPSPVPTYPTPFHISNPPSAQVGVVHSSRLGEDDVKTLRSINFQIGDFLDVAIY

SEQ ID NO: 10216 - protein, 87 aa, Chlorella protothecoides
MEAVKVSTSVMDIGGGIAAPGAPGIGAAQVCTLCVKHGMAAAGGFGGELVVKRLESLETFTYRCGSWGRGGVLMYVSSRVAGSGLST

SEQ ID NO: 10217 - protein, 267 aa, Chlorella protothecoides
MTPPIPSFESIQGGAEQGAGDHGAALEPGGGPQRGAPPCAHRGVAESALPGARLLGPREARGDGPGGGLGHPAPRPGIALHESHHLKHDGRMQLGLFLKGIGLPLEEAVRFWRAEMAATAPGEKFDKEFLYNVRHNYGKEGNRRDYTPYTCSKIIASVPGVVRVVACRGNGFPSFQRHGGEKPGGRHWGRQGAEGLGAESLSKDLCRGHWPGVPALPCHWQAAVGWCHASCSAGVPPHMIPSRVKCTGAPSERLGPTPCDRPSADSR

SEQ ID NO: 10218 - protein, 113 aa, Chlorella protothecoides
MYFSPGHIHFPTPSIPQVTPAKVDEACAKAKAGHFQLACAAVWEGKHGCSCETGINHPNQYFEESQKVLHGEQQPGGPGLSQSQGVSTANPAPAGASPLPASVQPHTKHARVA

SEQ ID NO: 10219 - protein, 171 aa, Chlorella protothecoides
MSYPPCQASLAADASRVRNGEAAAEAARLEQEAYDTMKAAGLPPSLPSTSASHDSPRHPFPLPALCSSSAASYAVGAVAGLLYLRALYRTVDGMSPSGSGMAGSMLSQQRLLIPAILILGFNRYETLAAPATGQHLSLLALVGGFFTYKLALVGQQGAELLAKLAKPGGAE

SEQ ID NO: 10220 - protein, 95 aa, Chlorella protothecoides
MPWAVNTTVAQPGGRLLCSVGDDPGALIFDPGVGPSRPAVKLADGHVDFSFAAAWHPGGNCVATGNQVWRGDGHPTDRATRGEGKGTSQHLPKWQ

SEQ ID NO: 10221 - protein, 126 aa, Chlorella protothecoides
MLGPAWSPTSGPGTPCRLVGFGPSSLGMERVMNATYPFPDFSIGTMNPRTYEVCDPLDGVDCPFVAVAQCVPKGMMPCFQDSAGNIGSYNLGHGNKGNHNRGDNNMGRCQSCGRGPVLCALRGLID

SEQ ID NO: 10222 - protein, 142 aa, Chlorella protothecoides
MAARKASRTPARQGSACVHGWHCTHDTGWGARGACCVCRARGAAAGRAPSLCIPCTPPSTHPSRGLALDPVAAFHLKNGATCWRLNWRADVSGPGLERSHGIMVNYMYDLGSLEANNRVYVVQGKVAASEEVLRLLDKDEAS

SEQ ID NO: 10223 - protein, 276 aa, Chlorella protothecoides
MQVMRRSASSPPVSPYQQAVGSDIQVAPASSRRLLRDSSFSRARKFPVSNLTTLILVAGHSVYTGLDYHDAQGSSSWYLLDYQKEEDRPSSSSPPPAQVKGQTESFMAHIRLGVEQAAADPKSVLLFSGGKARASAGPRAEAEGYWLVAEANDWFGFPEVRRRAFTEVSGMGWEVRSVCSFHGGSSWRLLCHCHWRDYYKGTPVSSTPSLHAAGPQQEKARDSFENLLFGLCRYYELTGGICMRQECVLQHSMTFAHITALVALQARAHASVLSSL

SEQ ID NO: 10224 - protein, 652 aa, Chlorella protothecoides
MATGRTYDVVVLGATGFTGQKIAEEMIESKFLGWVASNGFGQGTRPGPGLYVMGHHEGAGLGTSNYRRHASLIPPPTPGRSWAVAGRSRSKLESVVERLDLTSASVRPDIVLADVGDAPSLLALACSTRVLISAVGPFRRYGTPVVKACIEGKCDYLDVCGEPGDDDGGVLILWRWGVGVEASGLCMTPRHWSDARHEQSKHQPSDHLHPPPRRTTSAIAEFMERIELEYGEAAETAGVLITSALGFDCVPADVGTQLAASLFKPPARCTWVESFVSIHAGEAGLGGNFATYESAVFGYAHAQSLSRLRKQGIPPAHHTLMLRTTPKRDTHPSPAQAVAAKGKVDLKIPGPRPRQSAKPVWDARLRRWTLPFPGALWGNADVACMRQCIPALQFPNADPGSFTSWTPSCRCVRRQEDLGRAGQAGRGCSPHLCLFHPRRPLDCGPVSWARGRGMPLPCNLGSASARCHSKERPLLLDCRPWLPTRSPPDARPRILAGTSSSARSSPSWPTGPGAGPCSSVSPASSPTACSRGKAPPTARSTTPASSTYTSRMGTPTPRPPPRARRRTSTAACVSWGQSRGTLPAPSLSPRPPTCCWRSGTPSGRGAACSRRGCSCAARVTSTASGRAASGWRRYPPPLRRGVVPPTVAAHDR

SEQ ID NO: 10225 - protein, 133 aa, Chlorella protothecoides
MLPFCPVSKHLPPACHPACIGHHPTHVTVVGYEFKKARFQDMHRAAVRYPATSFSYVGTPALTPSAVDGEAAAAAAFRTDPYGCSGALAAKRAERDPFAEGGYGPDRCPAMAGLLNWCGPDPFPGRLPWAPRR

SEQ ID NO: 10226 - protein, 291 aa, Chlorella protothecoides
MYGWELCIQTGGDNAEQEECQLLQGLSAPAGVLPAGLRLPCPAHAGAGVRCLRIHAASIPRSPPHPIPTPSLCTGIGGALPPKRDLHRFVKWPKYVRIQRQRRVLTQRLKVPPTLNRFTKTLDKSTASSLFKLLLKYRPEDRAAKRERLLKEAEARTGGVEVEKKRPVVVKFGINHVTQLVEAGKASLVVIAHDVDPIEIVVWLPALCKKMGIPYVIVKGKARLGTVVHKKNATALCLTSVKNEDQRELAKIAESAASLYEGRISWGGGILGTKSQARLRKREKVLAKEAR

SEQ ID NO: 10227 - protein, 393 aa, Chlorella protothecoides
  MOD_RES (251)..(254): Any amino acid
MNRCLGVYIVVPESGRRQIWPEIAGTSHAGAPRFHVGNPGSSVMVCPTPTLPCPVKPWFPARPSTTRHPSRPAAMATRCMVPAAPSGMLRSGRQPGMHRLALTPRHRPVTCRPMLVIRAAGPGQTVVIGLAADSGCGKSTFMRRVTGVFGGVPKPPSGGNPDSNTLISDMTTVICLDDYHSLDRTGRKVEKVTALHPRAQNFDLMYEQTLPMRRAPEVVEKHLAWLDCRSCLVSGLTQVMPRFTNCCGTPXXXXVRGLTQVIPRFTNCCGTPSWPPRLPLQVKALKNGQSVQKPIYNHVTGALDPPEEITPPKILIVEGLHPFFDDRVNDLIDFRIYLDISDATKFAWKIQRDMEERGHSLESIKASIESRKPDFDAYIDPQKAKADVIIQVG

SEQ ID NO: 10228 - protein, 245 aa, Chlorella protothecoides
  MOD_RES (103)..(106): Any amino acid
MDGQFEKLEELIYVESHLSNTSTKFYGEITQQVGVFVLGKRGGALCWAPIVDWEILQAGEEMIHCQGDAGMGNGGEEHHRIFGIWHEVRPPACPGRTSCCQEXXXXVCSERGGGLMLGFHRGLGNLQAGEDMIHCQGEAGMGNGGEDCYRIFGIWHDVRPPAFPGRTSCCQECHSMAFFSFGASCTASPLRHPTDAEEQQLPGVQERHGALPGHHRAEGQGSVRAAHAARGGQGLRAAASCPCME

SEQ ID NO: 10229 - protein, 290 aa, Chlorella protothecoides
  MOD_RES (114)..(116): Any amino acid
MRHPETILPLPLTSCRYDGHRDAILRSGDRHQAGASSMGGPEQAPDDINLYAYFSSTAYSGFGDGLRVSTRGDREGVCSCGWRLSGMCTARGCLWSAGTWLIKGGHNRNGASTXXXQGGSVQLWLEAVGDVPGTRMSMVGRHRADLGRPQQEWSFYGVYSGLFERLAKQEAESRGGKSRTSFVYPSFAAPLQHPLLAPHCRHLRLCMAGGGDLLCRVVQLLVCTQLFLGRPVQPGHGPKPPGERGVGCMAGRALTSMRCSSACHIGAHLWEWRSANPPACSSCTPAQEAD

SEQ ID NO: 10230 - protein, 104 aa, Chlorella protothecoides
MSCMLSLETSRFLTKRDCCYRLGRWAVGAAMVRCLYEVLEVERDADDSAIRLAYRKAALKWHPESLIPAAPMTSTMPSTHIDPRQEPAPGRARRGQIQRDSERI

SEQ ID NO: 10231 - protein, 484 aa, Chlorella protothecoides
  MOD_RES (94)..(97): Any amino acid
MYPSSYPSVQLPGWTGLANARVTIFGDVYPLPSDMQEAAREANRSAAGVVESGSPPAFPTSDMQCAVWSVAHSSHPPEQVLTPSHSAPSPKLLXXXXMQCAVWSVAHPSHPSDQVLTPSHSAPPPKLLCFPPPLSQIFHQKHASHAGDPAKKSSRWLSGNAQYFRMHHLRDIYFVGGFGTVQWVDAGEYAAATPDAIVLHGPTAVLRVLNERFAGALRGLFGARGGGVDDAVVISIDKLGADVRVVTRGAVEMVAWGERADDNVDGRPGAGEVGCRVSWACCTYPCMHPLAPWTDLRRPWEPLPPTAPPGGGDAGGCHRHHAAADRACGGVGGRDGGWWHRRAEPRLLLAHFDPPLHHIRLLTPHGLFPYLLSMYFLAETRQAGHTREPRARTGTGTGMQTGTAEHPAPARKMVQRFRAVPMRQRRRAASTDGCTEAAPAPMQWSSTGRQGCQSTVWPYTGEQAEDHESGTGKIGGTSIARGVC

SEQ ID NO: 10232 - protein, 543 aa, Chlorella protothecoides
  MOD_RES (8)..(11): Any amino acid
  MOD_RES (18)..(20): Any amino acid
  MOD_RES (156)..(158): Any amino acid
MGMNRNPXXXXEPGSGLXXXDPNTIIEGVDEAGRGPLAGPVVAAACIIPPDVTIPGLDDSKVMSEEGRETAYDLLTQHPAVEWAVPGPGRWLPQRPRLIPRRRAVVPVEVIDGINILQAALKAMVEAVDALPAGYPDYVLVDGNRLPKVAGEQEVXXXGRSEGHGGGCGRPTNGVPRLRPGRWQPIAQGGRGAGGWVDGWCWVLSMYRTPLHSQGGNPPHVQGLQQTCGQPPTLCRTWTGKGAPPSSRVTARAFPSPQPPSSPRFSAGCDARQADGELAPAAPRVRFRPAQRVWRAGPHRSHSAAWAMPRAQAHLCPREDLVAGGQGCRGVESVNSDGPLWKDPGSTVFSPRLLPIPKRPPNSSRARAWFPMPPQARLDLVLLPNHRGPWQHGVRPWTASNPKAYPPPIPPARARGFRCPSSQARFRLASQPSRSAVITDYSTILTLHSIQAPQYYPSWFFPEWPSEGECALRPRPLPPSTHQATHHKVLARPVIHRASLSRDVGRSPLLGLGAVPACHAMSPVPQQGSGLSSANAPPPGDPV

SEQ ID NO: 10233 - protein, 196 aa, Chlorella protothecoides
MEAGSGLRRLFLDQTSSRPSGGLLPTSGPKRCGNPETQTLATENIDLTAEELSDAENDRSGLRVEAGAGPHIDLPEAHGEEWSHDIDDRLQEWLSSIGLAHYHPIFSNAGLSLDAVRHLTEEDFRVLGIPTLGARRRLALAVHDLKRPGAVGKGEQKWEPHQPDQAQSRTPLAPLNRRPISGITHFFRPAQRWETG

SEQ ID NO: 10234 - protein, 139 aa, Chlorella protothecoides
MIEADNEKARRAARREFNENVREMVAFVKKRDKRVLAHAVEEAARKAEAAALEAERKEREKQERLLKARQYKEAAWLAAEEAGSSGSEADLQEEELHTFYCMACDKHFKSERALQNHSRWAEGGGYAGRRGVHATCITA

SEQ ID NO: 10235 - protein, 84 aa, Chlorella protothecoides
MVSAHALLLQIATDSPEAPDEALRRAGVLASDSAVVYLTPAQVQALEEEMAASGDLFDPASLESTFYYVTDCLARAQWSNNRWQ

SEQ ID NO: 10236 - protein, 72 aa, Chlorella protothecoides
MIPPLRRASLLHPPGPAVFRKGGVVPLRPWQLVPGTQFVVDRFDSLPPSLPQHRHWFLTHFHADHYKGLTGK

SEQ ID NO: 10237 - protein, 83 aa, Chlorella protothecoides
MVHQGRPLASLLPDSVMPSLVTPTCPPLPVPQAAYPAPWVRQSKFWPTTCRVDNVYGDRNLVVRMPDVPETPAGTRGAEVVAP

SEQ ID NO: 10238 - protein, 256 aa, Chlorella protothecoides
  MOD_RES (50)..(52): Any amino acid
  MOD_RES (78)..(81): Any amino acid
  MOD_RES (104)..(107): Any amino acid
MSSSWTSGGGGWGGPGLQSCSSQSSVQAWSDTRGEHSQCLVSGSQPTLPXXXALCKPGLIQGKNTRNVWSQEVNQPSXXXXGQCQCAEAACVGCPQPVPSPAGXXXXIEAEDIAKRLIDYGFHGPTMSWPVSGAAWVSWQGGAWRLISGCIRAGTLQDVFPVRGCSMCSLSPACPESSRNSSTPGPNMLTHPFSTTATRHADDRAHRVREQGRAGSFRGGHDRHPGGDRGDRVREGRPGEQRAEARPAPRPRRHGR

SEQ ID NO: 10239 - protein, 651 aa, Chlorella protothecoides
MAHIGADEPRRGQSHLRVHVGAVHVHLPARGVDDVAHLVDAVLVDAVGGGVGDHQRGQLLLVLLGLGAQLLDVHVPLLVHAHRHDAQAAHGGRGGVGPVRRHRDQADAAVRVAARRVVGADGGQPRVLAAGPGVGLQRHRVEPGDLRQLLGQRLEHGGVARGLGGGGEGVQRRQLVPGDGQHLAGGIQLHGAGAQGYHGVGQGQVSVLQPLQVAQHLVLRMVAVEDGVLHVGAGPRRAADAGGGVGGQRGRVEVGRGAAVEQRQQRVHLRQAAGLVQRDGHRRAVQLPQVDARLMPRPHQRVGVGDGDAHGVEEGVGAHLQAQAARARRQHAGQPGHALRDPGDALGTVVHAVHGGDVGQQGLRGADVAGGLVAADVLLPRLHGHAQGRGAGGVAADADDAAGEHALVLLAAGQEGGVRTAKAHGHAEALGAAQRHVGAPLPGRGQRRQGQQVGGDHHLGPRSLGRGGQLGVVAHRAVGGGVLQQHAAGGVVKGKPCLVAHLHLQAQALGAGLHHRNGLRVAALGDEEARLLAARQRAAHCHGLGRGSALVEQAGVGQGEGGEVGDHGLEDQQRLQPPLRDLCLVGRVLGVPPGVLQDVAQDDGGGDGAVVPHADVGGGHLVLLRQSPGRLGKGGCVESGELGGERVGATY

SEQ ID NO: 10240 - protein, 558 aa, Chlorella protothecoides
  MOD_RES (362)..(364): Any amino acid
MPINIQRQGLPAPHTPAVHYVGRLVEGDAVFMDTRSEGQGEPVKLVAGRGEHGAEEVGIGSHEIHRAGVTMVALLTTWHPSLSPVNTARETGLNLAVATMVPGELARIEVAPRYGFGVAGSFSFPTVPPHAGLVYELELLDYEEVDEVRGGFCLVPHGMRLQRPMPIPAVSPSLVQDARVGSMLFEDRLEAAERRRAEGNALFKAGDGEMALRRYHLALSYLDADLLMQLEGRHLDAAQAIRAPTLSNVAAVLLSQRDWAAAAAAAGEALALGVEAARPKLLYRRGLARRALGQTDAAVEDLHEAARLAPGDGLVRRELAEAKREQREGMKLRVVPAKYMGISVEESSSMTKYMYPSARLTXXXPAKYMGTSVWSPAVWWGAGEAPGACRTGPTQPMQTRTSCGGPHTSPAASCMGLGAGMLVGALGTVCALGSPVYPEKARRVTPASGAGSRRIRPWIAWPGRISPRRALSQPGRGRHARVCPPDKFHARRWPPQISRNKSTRSSAMGRSRSLSRLVALLRGPALAGSATGGALPLQGVQRCAGSTSMFTGGMHPCL

SEQ ID NO: 10241 - protein, 514 aa, Chlorella protothecoides
  MOD_RES (385)..(388): Any amino acid
  MOD_RES (415)..(418): Any amino acid
  MOD_RES (464)..(466): Any amino acid
MNFTTPPSSVMTCFSKGPEGGSVFIVAVEGCPAKGVRSTWLCMSQRRDRSGEAHWPWLVQEEAGNCCVLGPRTRTPHEDLDLGCGHDRTPSPGVCRFPAPAGQGTCSGGQKQFMLPGSGRHWVFEQPAGGGAGHGRQEHHEQGWGREGAGLHVQRWRRLQGIQWHRRGVRAWIQQCTLRQKVSTDPDWHMKAGMCRNRVVGVGSTDYAWSFTLRLTHKNGTKNSASFLGMPKGNEWVLYGGDEVDLTDGMRDYVAYNLARASGEYATRTVWIEVFLVVEGRPIAPSDYHGIYIGEEHIGRVHFNIVVHTFHAAPPPPCHRQGKDRVNVTKWTTADPSGGYIFAFDNNNYGPTDLLTETLPGYDFPFVIKCVLTRGTWGGSLTAQXXXXIFAFDNNNYGPTDLLTETLPGYDFPFXXXXLPPALALSAGFPGLGGGDPQLDSAVHISKRKRGASLLYSPPHTHTXXXGCRLIWLYPLGFQGFWEVTPSLTALYTYQSESMEQPLLYSPPHTHTHL

SEQ ID NO: 10242 - protein, 159 aa, Chlorella protothecoides
  MOD_RES (82)..(98): Any amino acid
  MOD_RES (148)..(151): Any amino acid
MKISLPKTSQSPAPPCTATRPTKSPHPLPPSRGSTYMHKDVDQPLAMGPAWDYNEAFGECCGFPFEGYEENGKSEPGAMGWXXXXXXXXXXXXXXXXXCANQSTASPILAGPAGVFSRPESSAFSQSCWHQQWKAPSASMSLLYLQVXXXXRGGCGPGG

SEQ ID NO: 10243 - protein, 119 aa, Chlorella protothecoides
MPKENDWVLYGGDEVDLTLGMRNYLAYNMARATGEYASRTVWFELFLVEDGAPLTLENYNGIYIGEEKIKRDNDRVDIGKWTAENPTGGYLFAFENDNIKPDDTPVGPIPGMEDPFVLR

SEQ ID NO: 10244 - protein, 167 aa, Chlorella protothecoides
MAEGEKLSKKQLAQETTLRKLRQQNRELSGQVEDLGARLGAAQQAASEAGARVESALAELAAQREQHAAQLAADRATHAQALQEAHAAQDPAIAEARGAAAEQRAADAARTGAVQQLRGSETRAAALEKSLAELRAEAEAQVCACVVWLCVASSGKRGDVWTEGGEV

SEQ ID NO: 10245 - protein, 79 aa, Chlorella protothecoides
MIPSPPEIPRIVHNDLKTSNILLDDYGSAKITDVGLARMLPATFTDPLYNRQREGLALWALVGCPLLCLLHGFASRLGI

SEQ ID NO: 10246 - protein, 636 aa, Chlorella protothecoides
MGYYGTITPPVILRNILENPGWYTQYTPYQAEIAQGRLEALLVFQTMVSDLTALPLANASLLDEGTAAAEAMAMCSALARGKKPRFLVSERCHPQTIAVVQTRAKGLGLEVEVGDETGFAFDDTTCGVLLQYPATDGSVRDYAELAAAAKAAGTKVVVATDLLALAALAPPGEWGADVALGSAQRFGVPMGFGGPHAAFLACREEYKRVLPGRIIGVSRDSTGTPALRMAMQTREQHIRRDKATSNICTAQALLANISAMYGVYHGPEGIARIAQRVAGLAGVLAAGARRLGLEVGADPFFDTVRIAVPDADALVRAGHEACINLRKLDGATVTVALDETCGLAQVDALLALLNGGSAPDFDAASLAADASTGIGGAARSSPYMQHPIFNSYHTEHEMLRYLKRLENRDLSLAHSMIPLGSCTMKLNATSEMLPITWDELAALHPFAPASQTAGYAAMFEALAQQLAEITGFDAVSLQPNSGASGEYAGLATICAYHAARGDAHRRVCLIPVSAHGTNPASAAMCGLRIVPVGVDKQGNVDIEELRAKAKEHEKELAALMITYPSTHGIYENGIDEVCDIIHAAGGQVYMDGANMNAQVGLTAPGLIGADVCHLNLHKTFCIPHGGGGPGGSGSVV

SEQ ID NO: 10247 - protein, 100 aa, Chlorella protothecoides
MLVERINTRRKPRGIDTNDPCTTFRHPPTGVVLWELVTSEIPKRGKMRPIRVPEECPEAVVNLMEACWSAEPKSRPRAEEAVRILSSLYETPEGAGARSS

SEQ ID NO: 10248 - protein, 105 aa, Chlorella protothecoides
MAHMASVIERLTQRNEELALKAAAVSQQDVEELERDFSARLAAAERKAYALTKERDMLRRSCEQTTALQDKLKEKDEMIQEVSCCWRAVQQPVFFWAAKEPCASA

SEQ ID NO: 10249 - protein, 107 aa, Chlorella protothecoides
MAAELGEFVSLVGGPEHAQVLLLPLETLATVDETVVRDRAAESLIAVASAMPVPALVEFFVPALQVRHVWAGQEWGFPRGGLLPAGSPTLLRRHVGCTLTAYRWGAN

SEQ ID NO: 10250 - protein, 146 aa, Chlorella protothecoides
  MOD_RES (90)..(93): Any amino acid
MLPTVVERAKGHCLPWPTHQGCMGADQPPPPIHPFPRFPPFGPIRTGSGAQRAIQRRAAARAAGGAGGSPRCRPGDQARPGGAGGRQGRXXXXAQLLERLAGLVDPPVVDQVIKPVLAELAADRDADVRFFATHALAACDDLAAMA

SEQ ID NO: 10251 - protein, 680 aa, Chlorella protothecoides
  MOD_RES (64)..(98): Any amino acid
  MOD_RES (125)..(127): Any amino acid
  MOD_RES (352)..(355): Any amino acid
  MOD_RES (373)..(384): Any amino acid
MMLSHNVQSWHCRDGDIAEDVQLGIECDKEAHPTPEEAGSRRDAGPATQSNGPGGKWRSTCGSXXXXXXXXXXXXXXXXXXXXXXXXXXXXXXXXXXXNSMTSSSRMSDAGAQGPDTASPCEEPXXXARYTIQWVRGKWRSTCGSPMGRTRRSWIGTACRHTLEDLNSMASSSRMSDAGAQEPDTASPCEEPGSAGSVADHIQFRIVYGRNSKSVSRSPQHTVRELKREIEEHTGVVVPNQKLLCKTQLRDHQTLSEAGVKQGSKIMVLAIRPQSSPATPQTAEGSTEHAWDPTPAAEVLESGRPEGGWVGIADRQVPLDDNQAFIPALLTQARVKVRGHGVLRGGPASRAXXXXFAAGPGVRSTGGWLGRHXXXXXXXXXXXXCIRFCRGRPPSPPVRSTPLMLMAQDIPPRLPGAADVQARAAAGVARVGPQHPKGPLQQCAWHHFPAHPCLAWLLHPVPLFGLREQPAVALLGTLAGCVRHQAEGAGGAIPIMTGRVLVANMQRSKNSALLAKVSKEGGSASTSPATPAWVCASSAKQTARMPGAFVVSMQLRHHFCAAADAVSSASRFPRPPMPVTRTRIIPRGSMPSAHGASIGQLPEGCSHGSARRQVCLARQAPKELERPVGPDDELDNPLQSLLRLVSGGLWERRVWAWVMLTVVVPSARRWYREGPFLTKE

SEQ ID NO: 10252 - protein, 233 aa, Chlorella protothecoides
MPGCDEVTLTPCEGRAGCFVSRENGMAWSWMWTSAAGHSGSHSHLAVLFHQALQLVLGRADQLVHLLPGLEDLEGRHGGDAQGLGNLFHLVHVQLHEHDVVIVGGQLLEVGGDEAAGPAPCGEEVDDDLEEGGQGGCVGRQRGNLRRAGSSRAQTRPPPPLDEGLNDSQDPATSPKEYYRRFSPFRMLTALPEFLASLSTWSPEVYENIAGDPEDSKHPPAMLRFDEKIPVIA

SEQ ID NO: 10253 - protein, 258 aa, Chlorella protothecoides
MPGDSSVKLRHVLAPSMSGGRLSDGSLLASWSAVRIDRSRILAAGQSRGVRPQSYILARTHSPARELAHTDPPILFVEYVSAMAPQGHVASPALPQGSNSARQCISGVCMLAVVLLLAVAPVQAFRTLNTVVPVNNKAQWDFVLADSMAKNQTVRAGLEPAVETPLAHAPHRQVIAEFGAVWCGPCTALRSWVQQMSDKYNDLNFVAVDVDNAKEVAKQYDIIAMPTFIVLQDTSEKERALGAIKSRLEAMFHKYSKY

SEQ ID NO: 10254 - protein, 63 aa, Chlorella protothecoides
MSDKYNDLHFVAVDVDDVKEVAKQYNIITMPTFIVLQDTREKERASGAIKSRLEALFHKYSKY

SEQ ID NO: 10255 - protein, 117 aa, Chlorella protothecoides
MAGGKVVVVNSKAEWDQVLNEAKNSGKAVIVDFFATWCGPCRLISPYFQELSSNYDDVVFVKLDVDQVEEVAQALGITAMPTFQVFQSGEKVDELIGASKDKLKSLVEKYSKVGVAA

SEQ ID NO: 10256 - protein, 179 aa, Chlorella protothecoides
MSNPPAPQPIPPLPQAATIEHLLPVFLSLLKDEWAEARLNIIGKLDQVNQVIGVDLLAQSLLPAIKELAEVRGCVAASGGGTAGGAWACPRVRRRSDQHGEGSEAPRGNMAHSSMRRGRARPRQGPCLLRRLHGMSTLGLQMLRGQRCISHGAQRCLCLRGAATGQPAWARCHHAHPAP

SEQ ID NO: 10257 - protein, 157 aa, Chlorella protothecoides
MAAQAQGLTACRGCMATLHRPARSSIQNPSRRPPPPFLQRLAGKEWTARVSATRLFTPTYARCPPEHRPDLLRAFLALTKDETPMVRRAAAQALGDFAQVVEPEPLSAELLPAFLQLTRDGESSGMLAGEKSCLGGRPYAPGSGRGTRECAAACQAG

SEQ ID NO: 10258 - protein, 164 aa, Chlorella protothecoides
MRRGGVPGLSCQSPGSPPPPASTPACPCIVSIAAPHALSLPTSQDKSWRVRYNVAQQLPALAEVLGGEATRAELLPAFVRLLRDGEAEARAAAAARVATVARLLPAQEVLDQLLPPVKELAGDGNQYVRAALASVVLELAPVVGKASGDIPLGGGECSDVSVPM

SEQ ID NO: 10259 - protein, 401 aa, Chlorella protothecoides
MPRACPRQDSLPSSRYHAVTESAPTHLHPSNLCPPPPPPHPHPPGSVALAENYPRTDAWVVRRLKAAGAIVFGKANMGEFALFPSFTLGSLAGFTRNPYHLHHSPAGSSGGSAAAVSANLALAALGTDTGNSVRGPASHAGVVGLRPSIGLVGRSGVVPLRLDRDAVGPLTRTVADAAALLGAMAGLDPGDEASVHELGGPAPAHAPPADYTRFLRGASLAGSRIGVLRSILDLPGTDVQIRAMFNGALYTMQAAGETIVVLVGRGGAGGTRLSSVPRRVPWRSSFLSWSSLAPKTLPGSHLLPAPCDRRHAGRQLHHREQQPGGALERKPGWPGSRSGALERGRRVVGPVGLQLPLQVRAGHGCEGREVRLTGEGSLPRSCPRSSLPGVAQHSPSDVRQP

SEQ ID NO: 10260 - protein, 161 aa, Chlorella protothecoides
MPGVHCSLALALLLHAAAAQTQMPPSGILYPPDSTGPAVVTVSQLERGMCPPALGSTAHPPVLELSIAGARTAMLAGRFTCTQLVQTYLDRIRVYDAPLGLNSVRAVDVEQALAAAATADAQLAAAIAQGNDSSLAPLFCTPMLLKDNFDVVGLATTAGGG

SEQ ID NO: 10261 - protein, 156 aa, Chlorella protothecoides
MDYGSTCHISGRPYTVFRWRPGNDARYKKTIICQEVAKAKNVCQCCLLDLDYNLPVQVRDEALGMQADQLPASDAGKEYALQRMSDAGELDHSKFDTPTAPELLVKLQRTTPYYKDPDCRHCKGAGKGAEKCCAPCVLGPVQASAGLADQAARGSF

SEQ ID NO: 10262 - protein, 216 aa, Chlorella protothecoides
MCKRGAECPYRHEMPIEGPLSKQNIKDRYYGVNDPVAEKMLGRAAEMQKLTPPEDTSIATLFVGGLGPEHSEADLRDIFYTHGELKSVKKLESKGVAFVTFTTRQGAEAAAEALSNRLIIKGQRCKLLWGRPQPGRAAGGPPPAPGGGGGAGAGFPTGTGPAAAYPSMDPTQAGTRGEGGPAGKRPAQGAQGGDDAQKRPRVPVPPPGAPPPIVTA

SEQ ID NO: 10263 - protein, 68 aa, Chlorella protothecoides
MEKSSHPPRLAPAAALGLPAGITFLARPFDEGTLLAMAHAYEQASQLRAPPMLFPDCTGGSVLSQTAG

SEQ ID NO: 10264 - protein, 189 aa, Chlorella protothecoides
  MOD_RES (75)..(99): Any amino acid
PVPDAAPKPAVTPVRAALASLKENVPRKSPVPRVPAAAWGPDAAGSHQRFREALRTLKTAAEGAASQACEAGQSXXXXXXXXXXXXXXXXXXXXXXXXXRQPAVHVFCVERSGRGGAFYRSFAAASYPAVWQQYHQTPALQRHWYEVRAPRTGEGGLLHRIWASSVRMVGERTYHCWCLASINQPLPAA

SEQ ID NO: 10265 - protein, 220 aa, Chlorella protothecoides
MGLYDSRLNARFALSSIQMQTLRLVGAAGTQGALQSELAATVGSENRNFFYVIRNLEQRGLVTKRPAVVATPRTNNYFSNHIQTNVVHLQRFAPDLGRDTRLLSHHGRPPDPLHPQDAQYQQSQVEPPAGQAGAGREANPTTPASTLGAVDDGAYFSAISTKLAELPDSTAVESELKVALGFVGTRGHRLWRRLKGALVKKGCLEEFIGQSGSKPVKCIR

SEQ ID NO: 10266 - protein, 137 aa, Chlorella protothecoides
MTAAPWLTHDGRLNATLWRALAARAVEAVAARPGEAWGRRNLPPSSPGIPYRELVSKFLIVGEPSAEALIDALCFHGVLALEGAKGVTSPTSVLGSCFSAHVKEHGADVPGEAERYVVLPEGWLGRLNAARPSLMTA

SEQ ID NO: 10267 - protein, 305 aa, Chlorella protothecoides
MTSSSACASLAACCGWMYCTVWRSSRPLKMNSNRVRRFSGLGAVTKMLLYPSASAPAMARPRDADWERWMGGQVGVGWTEGMLRALQGPCHAVRLSLIGTLVSSNNARPCCRFSRRPAKATQLHTGWNSLPPTRPIAGTHAESRPSAARLGNTPSRALGRPSAPPWNAASSRWRRPGRSRRPAPGPACGTGPPAPRPAGCRPGSPPDPGAPRFPPPRRPPTRTRGGCFAPEGAMCEGTRVSGGMILPAGSSAVEDDQARLHLPRNAVPGPGPHLDVELIVHEDAIGAGCQAQHQALIKAACRREG

SEQ ID NO: 10268 - protein, 178 aa, Chlorella protothecoides
MRSVTSQASGPTGGIGFRCQDSTPFRPCLPITTPHTPPHPPTLHFLVALGPQPGVDVHGQGVQLAQRLQRGQQEHDAAPALHRLHRPREQVGDQGLKVLKDQHAVCVSQHLVRLRVVAIPDVGGGLSGEGGSVGSGHEGGKRGFTVPGRPGRSLGGSGCMGHLQPSLAHLTSHYKPSY

SEQ ID NO: 10269 - protein, 177 aa, Chlorella protothecoides
MEVLMARIDTDRDGGLQLSEFVASLVDWGVVQRHHAWQDWVRAVFDRLDKDGNGFITLDEIAEELGDYKGKEGGWVIVWVEFGHRLFFVPGKGGLKGDCCGGVNTMLEPLVCGEEMQCQGWLCVIANQEQASVSTPVHGPPSGASHSTTLPDSHPIPVLYRPLCRQPDCRQAHAPGS

SEQ ID NO: 10270 - protein, 667 aa, Chlorella protothecoides
MLGQCGSYRTSTSPGKHGQQLHEDSRLPMTCMGVAGPIQAGPCSPACRSSVQPRSCRHGGRPASGPQYNTAFVTQRVPRKCMAVHAKPSAATPSVDSPLVKTQLRTGPNHPPSEYKDTWMDRVILGIINHRMDEELGALNPPGDRERNNTFQGFLDRAESITRGRSVEEQRRFVAKVLGGLVQPGMGVLLRRHLPLNKVLQWWGTACMPGCCGAEQNRMFGSACANQVSVCMSSLQQIPDAPPPPRAQLVAESMALVASTCFGGLVGHTQRQQVRCLLGCGFVGRACMAVAKINMRCLKAVVGTWRQYHAIICFSQVKVSSKGKTHEWKSAVQIEKCRFLEGSGCVGMCVSLCKVSSLGTRCLRGERRQLLQGCSQKTDAGCPLQTILGSIAPGHLLQLIGMLLLVPLTSQMPTQTFFLETVGLPLTLEPNFEGKRNLSCTMTFGKVPLPEHLDPVHQQPCLHMNKLSPSGVSRVVAYCQLRCDCCLEAVELPSMGYLLKAEHPCRLLECLCDSFPTHVTASAECSDIPLILLKDFMNKSPAAGLWAMATCHCFPTRPGRLIIHSHRCCRYHGASPGSTGLRPRRHGHIASASSRTAGMCVGAHLLDHPVTDAEQGRTEKRCSTTLSHAFRPPDSSRRLSPPGAPQTQTKRPEEAGVGFAKYYRARS

SEQ ID NO: 10271 - protein, 137 aa, Chlorella protothecoides
MQSTIPLQSGTLHPRHPLPYPRACQVTFMHGDAMQPGSCMNWAEASGPALLESLRSLRLTSPLNPQGCAAQLPPLDWSRLQRRRIPGVASRLVVRCARTDYTAKAGDVEVLKKPLKSELKPSELVTVFGFPRDFDTQ

SEQ ID NO: 10272 - protein, 217 aa, Chlorella protothecoides
MGDMLGAGSFGVVRQATENQTGNQYAVKSIMKIPKNGRPTPRYLIKLQTEVDAMRQLGASLDAVHLKGLPACLRPTRGLQDKICTAAPRLRSSHKPHRTNDTFSKQDVFEDELSIHLVMELCEGGSVLDGLQQGDYSERQVRVGQGLECVWEHSCMMPLLPRCTGKAPCLVLLSGKTPYLQNPQVQHIMRSVMRFLAQSHSKGIIYRDVKPDNVGAF

SEQ ID NO: 10273 - protein, 206 aa, Chlorella protothecoides
MRLARRHLLPSAARRFAWSAGCLAQSGPPSSPCSHRKKRMRQIQKMSQRGLLDPEKEDPFSLFVASTNIRYCYYSETHKVLGNTYGMLVLQDFEALIPNLLARTVETVEGGGCIVLLLSTLESLSQLYSLTMDVHSRLRTESHQEVKGGWVRGRVGGGNGEAWSERGGVLASEPNAPSGTRSLAGNAAHGRCHMGITLRPLLYNIV

SEQ ID NO: 10274 - protein, 292 aa, Chlorella protothecoides
AAASAPRRAASLSERRGRLGSGAWRGQDAPHVVADAEEGGRAVGTPDYLAPELLLGTGHGAEVDWWSLGVILYEMVVGRPPFAANTPEAIFQNVLDGAVAWPERGPGEGEEEDDGEEEEEEEGEEEEEADDDEEADDDEEAGDDEEADEYEEAGDEEEADRDGPTAQGPAGTPHTHASRKPRKERPHPSQACRDLILGLLTLDPRRRLGRRGAGEVKLHPWFAGVDWPSLARRKAAFVPATDCDTDTSYFSSRPVSQLSLSLDVPPSEAGDAPGSPGWGPARSRPGSRAAST

SEQ ID NO: 10275 - protein, 375 aa, Chlorella protothecoides
  MOD_RES (175)..(178): Any amino acid
MAAENHSLSRDTCGQAHSDALNIQFPCCLACITLAHANMLVAASAHEGHGGRSTTSQPGVRGASCRRHSVASTTSLRWIPRETVRIGAPRRRGFPRRCAVLGSGDAQPSRGVIILPGLGNNSTDYGALVHLLRQRNLHVEVAPMSRLDCQWSFQRPLFAWVFLIPGPPPGACALXXXXVHGANGAFNGHYLPGSSSFQVLPLGPVHSAKTKPSPCLSRNPTHHPTHPHHGHPRARNAAGLRQAAYWKGTLNPRPTVDWYLDRVSHAAEAALRALGGEAPLTLLAHSAGGWLGRVYLGARPPAARRVDAYVSLGSPQAPPPDGTFDQTRGILRAVEEAYPGAHEPGVAYTTVAGRYACGAPLAGPGGARARLLGLA

SEQ ID NO: 10276 - protein, 302 aa, Chlorella protothecoides
  MOD_RES (180)..(183): Any amino acid
MWEGGPTLAPDAVSFNTALKACTNAGELDRALEVFKEMGSRGVRPNITTFNCLIAAAAEAGAAGTLQEVGRWLEVADRDVKGACMNTFVAALVKVERRGVGLEGEGRGRWRGGEVDGRGQWKLAPSAPPLTPSPLTLNAPPLAAGPLRGAAVAAGHTLAGQRGDSQARHPPWPYHGPARXXXXTWPTTAVEAFTLCSPSDSLAPHPQCTPPCSWATVRSRSRRWAHPGWAAWGLPSTAPTPALPRPVPGCPVMREGSHLGRARCRTTCPRPNGPHPTRPLPSPPTTPPTTPRAPPGSHHSSQ

SEQ ID NO: 10277 - protein, 125 aa, Chlorella protothecoides
MSGRGKGKTSGSKAVSKSSKAGLQFPVGRIARYLKNGRYAERIGAGAPVYLAAVLEYLAAEVLELAGNAARDNKKTRIVPRHIQLAVRNDEELSKLLAGVTIAEGGVLPNIQSVLLPKKTGKKDE

SEQ ID NO: 10278 - protein, 242 aa, Chlorella protothecoides
MTSRWWPCRPIGHGRGRITPPRSTWARRCDGVGAEAGAGTPGSLSCPALRSPPFRCSSADGQAGPQPFTSAPAPQGYLARLEQLLVEALDAGRPVLVGTATVEQSEALYGRLSRLLESEFGGLGSKGPTLNLLNARPESVRREAQIIAQAGLPGTVSWRGEGRRVGDFWWKGRRRRELPACVSLPCAPMNPSVSLHAAPPQNADHHRHQHGGEGNRHPAGGQRQGADAADAGALLPPAPRPR

SEQ ID NO: 10279 - protein, 303 aa, Chlorella protothecoides
  MOD_RES (71)..(73): Any amino acid
MRAISQTLCRLQRGSRGAPAQGCIHRARAGTASLSMTQDPIKLVLVGDVHGDWDEDRCAQGAHAWRDRLSXXXPSLSMTQNPIKLVLVGDVHGDWDEDSATAARHLEPDAVLFLGDFGNEDVALVRSLAALDLPKAFILGNHDAMCGGGGERRGEGELSFGVMCQLASRGGSPRDTANAAWYELQRYELAAACRSARPKASPQALERRFSLSGRGKEYYVKRILQKSTLGPFCSDPGSGASPNVALQLEALGSMHLGYASATMADGRLSVVGECSGRGGSVWGQHLSRALGGIRIWLWRRCSC

SEQ ID NO: 10280 - protein, 521 aa, Chlorella protothecoides
  MOD_RES (201)..(203): Any amino acid
  MOD_RES (243)..(245): Any amino acid
MTSSHHPPTDLPSVLVTDLTYKAGFGPVLLENINLDLPPGSRCLLCGANGAGECAKGLKSLRECAFMARTRGTGGDLGLLWTSAGGQAHGPAICGPDSGPPRLPRPLSGDHGGPRLPGHPVAQRGGDARRRPAPEGKLKRPHTDLRAPPGADRHGPAAALQGAELGVNEGWVGWRASMLGDTWWSVPSVRFQTDQHYSLLXXXLQAGRWAAGLRSLPCSLGWGLCGTGRLADCGCELRQVRLXXXGDTWWSVPSVFFQADQRHSFSPAVPCLISLLFLSPPHTPTCQPSKVLLLDEITVDMDVLGRLDLLHFFKQVGGQRGWGHCHVPCDGVCVDWEGSQTVDGSCGRSNLFKLRPTAIDGLFAPVKDPRSHPQPRASPKGRGLPRSRTLTPVPSLQVLQPFCKFSDPVSHKAGPRPPPQECEERGASIVYATHIFDGLEGWPTHLAYMEGGKVVKGGLWAGIHELEGGQRLLATVEQWLLKEKKERRAAMAAGGCKQDALTTAAKQPAPMMPSRHMAYFR

SEQ ID NO: 10281 - protein, 358 aa, Chlorella protothecoides
  MOD_RES (164)..(167): Any amino acid
MRLKRLHAVLGGSEGHAHLSVHRAVRVVAHIHGSHTSASHWPRHDKYVCLRLWKSCSIVPVRGASPSHSPERVRPAEIQLLAPLLSHRFETVAFHPGREDAQPHQHDVLAWQARVGGEVLGRVIVLAGREHLAGHRSCPWLRTGTGDSVISSITVPRLTPSQSXXXXARWQGASGWASLMPLVTHRYWRFRDTIGHRAPSDSFTEWHARLPDGAREHGLPARKSPLPDRWGAAAGVGVAPLAACDRAQTWRIWWSTYPSPGLHTKVGRCQDLPAADTPPSPPPLQVFFGTNFVTVTKTDTYPWAVLKPDIFAAITDFYSSGKPVLLEGGAVENLDNVINDDDDEVLVGMHAQRVGGDP

SEQ ID NO: 10282 - protein, 94 aa, Chlorella protothecoides
MIKELLETRIRPAVQEDGGDVSYKGFDPDSGIVTLKMLGACSGCPSSAITLKNGIENMMSHYVPEVKGVVEAPADESEQAGLAAFNELEKHLSN

SEQ ID NO: 10283 - protein, 137 aa, Chlorella protothecoides
MEEGLDPGGPPCQCSCPCRAHDYPSRAVASPHAVGAREPQGEPPGPVPRGAPRPLEPALRELTDEELAGTTSRLRVRLAGGETLKALLPEAYAAVREAARRVLGMRHYDVQMVFMANMAGHLLAAGPLQLGLDSLAT

SEQ ID NO: 10284 - protein, 252 aa, Chlorella protothecoides
MADFELADYEPHKKIAMDMACACLPPTQGPKPHAVQTWVPAQGALAHCCLGVVMLRPVSASSSPGLRLAQSISCPVLSGDVTSQMPLTETGTPAPGPASCPALHLTTLCDHARQLGLVVLPRGLHRLQLAHSQHALRQHPPKYDVLVVQPLCKESAWFERAGCRTPSLPCPARPPTCLGDGDEELAAIGPWPRVGHGEQARTHVSPREVLVLEAAAVDAEGTGAVALEEVAALEHEALDDLGACRRGWRGLA

SEQ ID NO: 10285 - protein, 231 aa, Chlorella protothecoides
MGWGPRSAWRPSRVPCAPHLACRAAGGVRGPFQGRFGVYQLDDRDIQEVMGYRTGLSLLAAADAPWAGVLQAGSDVAAVSAIGGLAMSLSLIHIYVAPIKRALQALAAVGAVGAAWVGLTQGGPLLQTLELHPIYLLAVGPAAAALTGVCFKEALCYGKAEAAVLMLGIPVLCLGHLTGLLAGGLELAAADIVAIFLVLFAARKWTQPVSDDVGDKSVFEYLAKQGNGAEL

SEQ ID NO: 10286 - protein, 63 aa, Chlorella protothecoides
MTLTPPLVQLGGIVLFEGCVAEMGTGEGKTLVATLPAYLASLEGLGAHIVTVNDYLAKRDAEW

SEQ ID NO: 10287 - protein, 324 aa, Chlorella protothecoides
  MOD_RES (58)..(61): Any amino acid
MQYLSMNPVTPLSISQGCQNSCTCLGVERTLCSSVYRHQTGQSGSAMEPPNSQALIIXXXXLGVERTLCSSVYRHQTGQSGSAMEPPNPQALIQHRLDVGEHATLGDGHAGEQLGQLLVIADRQLDVAGHDAGLLVVASGVAGQLEHLGRQVLQDSCQVHGGTGTDALCVRVVRRIGEKAVVKGDRPISGRAENADIRPYREPSRITATCITTVLQVASNAPDGELQTSLGGLAHGLAAGGLSLAASRHDAECVILESASPFKQVRSRSGVAIPRQLIETYVSQIEVILSRPATRIQGKEDSYDTGLVCFHFGQLSAAKRRPVY

SEQ ID NO: 10288 - protein, 265 aa, Chlorella protothecoides
  MOD_RES (223)..(226): Any amino acid
MSLSALQIRYAPRVSGLGACEKPSGPSARMLQHFWELHARRPMHRDVRSYASNTVQLRLPDDSTVMLDVPEGSSILEVALDEGLDIPHDCKMGVCMNCAAKLVRECLMWVQEDLTMEARRLWTIHRCAPGRMVSRQCSPHILSQEEGDVDQEAGMLSEDVRSKGYALLCVSQPHGNVKVRIIPEVQWLASLWGLFIGHVLTLAFQRKPPICLKCFHPQEELLXXXXGESLGLFIGHMLTLAFERKPPICLKCFHPQEELLDEVMN

SEQ ID NO: 10289 - protein, 255 aa, Chlorella protothecoides
MGPRRTTLTYSSEDAAPLGDAQVFVYYCKYSGKHVLTTDCDLSKAPRRQTDHALVIDTTRHTVRLYNTTDAGEKLLRRRSGAVERQLRMRVGKLPFAYWTEPEGKLLYIMDSAVTTYSTADDPSGSGVIVPVPPCIRALDAAGGATAVTLEVDDRARATGILKVSADAVRLQLKTSIIAEGAAEELLEYLRSILGGCMVGRVEGGDTSQPHRGRAHGGPGARRPAPARCLSTGAWVRRPRPAHPPRRQPACERAV

SEQ ID NO: 10290 - protein, 1287 aa, Chlorella protothecoides
  MOD_RES (52)..(55): Any amino acid
  MOD_RES (857)..(860): Any amino acid
MPSCTSCPGSGGWCVGEDLRGGEMRSKGGWPQLVCPPDVPAGLALPPASPEXXXXHLLPGFRWVGVWEKTCVGVEVRSKGAWPQLVCPPPTRRQALHCLPPAPNPCIARTRRQEDMSQVLGWHFERVGAREEVTPAGLFTVAARLIQVRGGAMSSWAGVGAAPAIPHCGEWVPQRWAEVGPQAGPKHPLPQQFHERTPALPGAVGGACASGCNHESPQPCRRGPHGRARGRRGRAAGPSCWAVGCHVLRPGVVKRVDHMALGHVIPRGTVLTPSIGLPGQAGKAPVGQFGLGTLRLSASGFADEYGEALGANNQKLHLLAGLIAAGAEAPARELLSWLRCLGVAQPAAFPAVGRALSARAGSLITRALGGLSEEGGAAPDALPMQLLDTLRTLGVYLYRDVLVLTRLIRLLGRCLASGGELGAELQQQAGRRVGIGRHPGAGHLPLDVAGHAPRPPPSPCKTWHSPPFPCTHKQALAQFLHPAGQRHPVGRGDAGLQPGAHQRGPGGRALGCAPALLLPAALHPLRLAPGSAGSTAASLRQGGSVETKHPWLPRARPAAHPSRFPQELMAGTPLLMAAAKLAETEARRVLRRVTAPSSHKEAKAAMKPLGRRLAKLTHAVPLPIAEQLIRQHPSPPPLCPGDGHAGHGADRGREPEAVHAHDLRRADLCHPAQAVCGQAQAQEHGGGVVILAMPTPCLPLHKPAFPPRTRQEDGVNMEEWFQWLAAFTGIICRRYPSMELSALLQYLTNQLKSTESLDLLVLKEILTAMTGDRVAGIWTPSSCPLSLCTPCIMGIELVNDVSEHQLDALAGSKALHVEVFFQGQFRPSPKALAGGTRRLLAALKDSEVGQYWLSVGXXXXAILAEVWVWIGGLAGKHFPFRQVARASKLAPPDGQGMTAAWGADGSAGLPPVTLWTPSNGRNLLFWHKDTTDGAQENSLLRPSPACKILGQPPSLSPTGSLRRLLAPQAGGGAVRQLPGDAAAVHRLPADGPDPDPVRRLAAIHPGGPENRPRWRARRVPCPPFLLASEGLSPGRGPASEEVHPGALSKGRIQCSLAPHLSQPHPLQVPPHFHLLGPQSMVDDYLIEPEVVFQLVRPMVKAAAVPPRAALAPSAAASTAAGEEGELEEGEAGPTEAGPMEADSAAEEGALPVANGALPVANGALPVANGAAAGVGGTLAGILPEVERLMASQATFRALSPLLYAVFWTRTLDELELPRDRGPGSGSYRSGGSARVSVRPTFCLAMLARVQRPVLGSRGSGCTGECPSGQWYFFDAGSSSCICERGDG

SEQ ID NO: 10291 - protein, 272 aa, Chlorella protothecoides
  MOD_RES (94)..(97): Any amino acid
MTGEGEFLEEVGLVVSRDAWRRKEIRTNTKHVYQQRKWVSRGCCQGMTSWDWWGQGGASNPGWGVPLDFTGLRARPGTHMACMRGTPLFPSVYXXXXQGGASNPGWGVPLNFTGLRARAWTHAPFMHGTPLSPSLYIISLPQPSPVMTGMPLPIPVRRHQSKVCPLPRYNLLREESEGWAKLVTLLNQSGAGKVTEANAGAVVSVRVRGRMLPALPAPHARVCSTTGPTPGQTHGLRIQSQLLRSSATQKGIPRPQLPLPYQHAIPLCSLRS

SEQ ID NO: 10292 - protein, 425 aa, Chlorella protothecoides
MVSATSLATTCIEADILKTHTVPKWMMEPHGRASMAPQAAHRAIVEALHQSSRDERLPHPGSLHTGRRAVSKSFAEAIGVTRAGGSCLKIDEFPNDLKITAHSQRSAIDRMLQPREEDGLAPRRPLPERRMVWRHAVPCTWQDEPTAARCTSELGKQGRATTCDAGASSCPELPAHHSGICISQKAGVAAADRPQIPGTEAHLVNAGWHCPPASHVPSPPSKQVVESGFEENLPKTSAGEYAQRTALHKALDVARSMHGKFDLIIAADTVVQVGDRILEKPNDDEHAAEMLESLSGRRHQVCTGVVLLTQHGEPTSFVEMTDVFFASLTTAGIEAYIATGEAHRCMYGDVDAITQPCIQRARTSGAQGRVVEKPGLTGSREQPHVSWNGSRDATITLSDFLSLRFPRLSPVLWVRRSWDNQRIDR

SEQ ID NO: 10293 - protein, 83 aa, Chlorella protothecoides
MGESLVTAALVKGLNDGSVVASDVAETIPGVTQELACGFLMDLLEQVVLGQLEPGKLDTALAAAGLTKHKAASLPLMIADAVW

SEQ ID NO: 10294 - protein, 227 aa, Chlorella protothecoides
GAAADATRAVLSGAADAGLAIVRPPGHHAESGTAQGFCFLNSAAVAAAAARAAGAARVLILDWDVHHGNGTQEIFTADPSVLYASLHRHEGGRFYPGTGAATDVGVGPGAGASLNVAWPRGGLTDADYAMAFATVILPVAREFDPDLVIISAGFDAAQGDPIGGCHLTPGLFASLTAALQATVAPCVAVLEGGYNLRATAACTEACARVLLGERAPRPRRGAGASPA

SEQ ID NO: 10295 - protein, 137 aa, Chlorella protothecoides
  MOD_RES (79)..(82): Any amino acid
MSSSEPNNSGALDPSSLAPRILQVVQGDGTFDEPAVQAYMHSSGVESTGIDYTVVAIMGPQSSGKSTLLNALVRCRVGXXXXTPELWQEHTAQCTGALQGGGGGGGVDLVAVQEALQPYRSHCMQWGCHGTHERGLP

SEQ ID NO: 10296 - protein, 327 aa, Chlorella protothecoides
MPLHAARQALVTAKLMTTRARFDEQDVWSSFETLDAAKKVGWGLAVRTMYPLMLVVQTGGWLWGPDRQPRASPASLPLITAGGALPPTSRSSPSNTWCCHAPLQVVKLKAFSKFENTADALQAAASLVDSKAWAIARGPSLPRHTETQAHPSPHPPLPSSPGLKKFLKKHAGSDTLAVLDAKLGNVIKEKLEIPCVYSTGVSELTRGVRNQLGGLLAGLGHEADLRPMSLGLSHSLSRYKLKFSPDKVDTMIIQAIGLLDDLDKELNTYAMRVREWYGWHFPEMTKIVGDNIAYAKTVKLMGTREKAADLDFSDFLEEEVESALKEA

SEQ ID NO: 10297 - protein, 207 aa, Chlorella protothecoides
LHRPPPSSPPPQSLLAEIRQRDPNYNANKAQYLDFILASGVTPLIAATQRGNLQCAEVVRSWGRASVAIVLMCLDIKSLCSPIIYERGSCVAIKGQAPPPLTSFITQLIAAGADVHIVCPSLDGNSALHEAVSRKQDSLVEVLLQAGANPCVENAKGGCHGFGWWSRGIGKGGRGAGGVMVVANRSRRPHAVAPFVQLPAQRTCAGT

SEQ ID NO: 10298 - protein, 158 aa, Chlorella protothecoides
MLQVVPALSGGKQLKMRYKPAGETPGEREGLAAPGDSARGPLSASRHLWLGNINQRPSDQALVDLFSPYGRVDSVRVFPLKAYAFVNFGDMAGAASAMAALDGVVVPALTGLKPLVMRYQQEPLVGAGARASPLPGPAISAPGADAGLKGLLAAGAAA

SEQ ID NO: 10299 - protein, 213 aa, Chlorella protothecoides
  MOD_RES (209)..(212): Any amino acid
MNCCAQGRGSIVCCAHSVSVELNWLCGEWTRQGDPFTSNDPPHHPIVQACKVGKLFAKHFKQAEQEAVLSSTVMHVAVGTPNRLIKLIEAGALKLGRLRYVVVDVAMDAKKRVQLPDPRSAPSSLRRTVLDMAETKSDFWTLFASHLKPKFESGAQFVLTSCKVDKDGPQWSHANGLTSGMVSTMSGDDAPPPHAYVTSQHGVGRGDNXXXXS

SEQ ID NO: 10300 - protein, 134 aa, Chlorella protothecoides
MAWRPARCAHAGVPWDGCGPSFLAKLWSIARRPSPPLPTNPTPTLLLPPVLPGPGFQFREGALHVLDPGQLAASHGLYAGKSVERLPALKGRPFPPEAQAVTRMAWHPNAGEKWGRLATGCWAGMVRVQTIYRR

SEQ ID NO: 10301 - protein, 71 aa, Chlorella protothecoides
MWQAALDAFTQMRSEGCWPDAVSYSLLIAALRRGGAWAPALGAYEGMLGAGLRPDAGVLASLLGALCAGGL

SEQ ID NO: 10302 - protein, 237 aa, Chlorella protothecoides
MAKASLKPKAASKGKAKAPLPAKAPAAKQPAGVPGASIIMWWMAPWVSAMPKHVEDVSAPVAHGAPPCLAPCPPLCFPGVEKKKSKRRYHGPPAPRQEKKPRGPAPVNPPGSRQARKAEEEAAQATTATIAGAPATQQADWLWDRYRAESGASELERQGLTAGCFAPAHPSEWLEESLASLPEQAAFLGRGGQHVPVGSPAVLVVTGAAIRAVSLIRQMPAVNKVGTFDCLGCVAAG

SEQ ID NO: 10303 - protein, 316 aa, Chlorella protothecoides
MEGVEAGLACLDSRAVAALLKELAKAGAGHRATELFDALRALPPGAPLARLADLYTYTTAVSQCGAGQQLRRALELVAEMRARRVACNIHTYSALMGVCVKCGECDLALDVYRQALDEGLAPNAVTFNILVDVHGRAGRWREAAAVLDAFAGAGLAPESRTYNAVIAVCARAGAPDAAGEVYARMLAAGAAPSSTTYTSLISAYGKAGRVEEALAAARGMAAHGLEPNVITFSSLVCAAEKARRGDLALAVVADMRARGCRPNVVTYNALLGACCQGGSASTPACGWGGLGAVQAGEATATPPRPPPWGGRTFHPP

SEQ ID NO: 10304 - protein, 97 aa, Chlorella protothecoides
DNLIHKDEFLWALFKARRDSLFADRVRCTVTCLTFAGAVHCAFAICVTMSQDHYGLAVFELFDIKQNQVLDFEEFVCSLSVFHPDTPLEEKASCKPG

SEQ ID NO: 10305 - protein, 134 aa, Chlorella protothecoides
  MOD_RES (29)..(32): Any amino acid
MLDRGFGPEVRRVLAAVRGKPRPARCVLXXXXVSGLRCGACWPRARACTAAWRARATSSRRWSRGRTRWRRWRRWWRARRRAGAGSWSSPTRWPPAAPRSTLWRPPGWTPPATMATCPPRRAARACAASAARAP

SEQ ID NO: 10306 - protein, 146 aa, Chlorella protothecoides
MGMFLAPVVGTLINGAANRVSIGTQVIIRAELNAAIYAKALRLSNRARQQSDTGRIVNLMSADVNQLQTFFYPYVQQLVMGPVTIIAALVLLWFQIGWATFIGLAILLVYTPLTGIFVAKLSSCRREMLKFTDKARCIDFWGEGPS

SEQ ID NO: 10307 - protein, 423 aa, Chlorella protothecoides
  MOD_RES (66)..(69): Any amino acid
  MOD_RES (390)..(393): Any amino acid
MSVLAACRGVRLLPGGLRQISTATRRGTAAPEPVPAASPSLDDTASFRAADIRYELSAPNAKLNLXXXXSPSLVSETRRSVSPWHRENPAQKVPSSPTDHPWPSALRIYHRSWARPRPQDLKFGAVFTDHMFLTEHVAGRGWSTPTIGPFQTIAVHPAAPVLHYGLCCFEGMKAYAGADGRARLFRPDMNMRRLARSAARLQLAPFDTQGWRPLPRCCSLHIDGPRAPTMPGALSLGAFFFTLMARGLLSCWIVVLKGTGECSPLERARKMRALPPYLPRGLMSTSAHRSCWSVSRSWCAQIPPGFQHRTDTPCTSGHMPSPPVSRMRRKWGAQEWAGGRELPKQSSEGQSLVSYPEHALEPGHTIPGHVASPMLRAPARIPRPRRSRRXXXXPVSRMRRKWVAQEWAGGRDFYSSLQKARVL

SEQ ID NO: 10308 - protein, 591 aa, Chlorella protothecoides
  MOD_RES (208)..(211): Any amino acid
  MOD_RES (469)..(490): Any amino acid
MAMSAYIMKRQANALSWARLVQPAAVEAASCAWHPACPGPDSTSEQRQPPGGPGPWTVDSGSFLRRAYSKGRPHAQHGRAQERRQKGGTPHGAVSVHIRDFDRPTPVAPSKPVQAAEPAKPSLVQALKAAGWSRQEVLNVPNALSMARMVSGPAIGWWIVQGQVWCGAHSLLSPWCRDNCQPSPAPLQAHVFSILVVAGAEGPWLDPXXXXVTQSLVLGQLPAMACSFAGPCVRYPGGSGGRRALAGSLAPGRVSWQVFPPSPDPPSDIPLPSPFPIVGPCGACPGGVRGLRLAGRPGSPQAGPTVGSGVLPGSHRGQGPHRLRHHRPHESVPVTRTSPSPLNVLGLGLPPQNQTGVAPCRAGLCDRGPRRGAGGGGRPHAGAAAGLALARGGRVLQAGRGHGRGPRLPAPHLQDQHRAAAGAGWGVRPARATRLAVGGGAPVPGHAHGWDYDLVCGGLCPRLLGGGGXXXXXXXXXXXXXXXXXXXXXXSSSEGLWPQDHCKPRTGVLLSPRRRVHQPSLPSPTRLRDRSLPGPYPTLTPDPRPLHLPHPGSWGVVPAHLRPTTGPGAPAGAAGPSPPKTTFTWGTTTSG

SEQ ID NO: 10309 - protein, 1227 aa, Chlorella protothecoides
  MOD_RES (424)..(426): Any amino acid
  MOD_RES (933)..(936): Any amino acid
  MOD_RES (1038)..(1040): Any amino acid
  MOD_RES (1125)..(1128): Any amino acid
MRPFGTLQPQARFETVDSPLKRPAGRPPRLQVPGGCRESCPSASPSPNAEHVSPAGGGSRAGGQLSARSSCSSPSPSSQQGLAWLQAAAGLDSGRLASASLRRCDEAFVGDGGARATQPVGAEGAIRSGGKSETGGRVPGSAGGQGPMALAAGLPYPPASPPRLSPSAGGETLLAAILSPEKPGHSRLLGEMMHTASAAGMPKGGMLLGAPPPQPEQAPCLPGSSGEDGEVKPIEPVPGDPARGGPASNQSPPENPAPSKYVQAARPKEVLVFERERHAPRDDPLPSPTPRAWNWAAAGALAAVALAAGACPSGSGAARPWQLRGRCDEETAARAGTGAAPRVFCRGAPSAALLRAKVLARTSPGAPCRGRRQGCRRSSSPAVAESCRRALQPPIPSPMHGLFLWQLSSIFPSLPPPTLQPVPXXXFPVATVVNFPLPPPPPTLQPVQVSFRLSRGGGNPQARSWSSGAGVSVRGGKPGRVAQLPGPSIVRRENQVGRVSHTCDAGADPPRPAREGRERSESRSRAPPRARQAARLPSLTAMSRSSTASSRRLMCCSGHSLPGAGSVVASVTMASRFLARLVTASSFSCRSFIFSSMAPWLTFRSSSTRAYFSGTFMLYLRCGGGQPCGCLAPVAAPGTGQGTGQGATWAPFSSSEAGGSLHASARGHSHPPHPPRAAPGVLLDLLDGDALLGVDGEDAVEQVLALRRQLLDGLRHVRHLAPPLAHLLQPDLQVGLGGVGVGVLGVIKGEGAEEHDQEENARGPHVHAAAIVPQLPILGVDQLGAHVHGRADLGEHVGLLAPGLGEPKVADLDDGRVGGVQERVVQLEVAVGHVVGVAVAHRRQELLEEVPRLVLGQEQAQGLGLLPLVGHVGGQGPALRALHHQAEVGGGQDGLVRLDHIGMPESQLRLDLGPGGGGCMSGGRMGLRMGPPXXXXWEGVRMASYAFITLACPNPSSAWIWGQGGRGCMSGGGGGHGDGAPCRHATPVCRRSAQAKQAGPAWRSSSTRPRRRALATQGGNNAIITGCTACRTQRKESXXXAGVQEERPSQTGRAGLDILQHSTTQACVGNAGRQQRDLHRVHRLPSAAQGVAGTASPSGPGSPSPPFHRTSHSTPWHPSRSQQVXXXXRLGQGAPHPLPPDQPLHARAPGQIPTSTCHTWNSRTMLVSKTFGRGLRMNLMATSLPVLESLNSHVSPVPPLPAPGGTQSSSSGGGWGRRSATTCPART

SEQ ID NO: 10310 - protein, 103 aa, Chlorella protothecoides
MLPIRGLAARHLHAVQAGLPPPALPDKLGFGERPHRHVLDDMTRFQDMCRELGVGPGDLVSLADLQKGRACHRIASCLWDLASILRRGGHAEVCESLGERGAA

SEQ ID NO: 10311 - protein, 255 aa, Chlorella protothecoides
MWPRPCSGRLLAFLAPVALVATADERMRLTFFPKPPFTRHPLTSTRTTLGIIMSPVGPYFPSGLTPIPIFVDEVHRRAWPGGVGDSKVGGNYAPTILPQVEAAERHGTPQVVYTFAQPGQAPEEAVFEECGSMNVMFLLDKGSGHRELVTPPLHGTILPGVTRDSILALARAMPGVEVSERTISIGEVERAAAAGRLLEAFGCGTACIVQPISSFVRAGGQLMRAAGDGAFVARMHAALCDIQYGRVSHPWSIPI

SEQ ID NO: 10312 - protein, 85 aa, Chlorella protothecoides
MKVPEKYARVLEDLNVSQGAIEEKMKLRQENEEAVTNRAKNLLAMVTEATTLPAPGKECPLQHINLRDEAVLDRDIAVKEGNLAA

SEQ ID NO: 10313 - protein, 230 aa, Chlorella protothecoides
MECAEGGSLTSYVADKWQKAQALGLFLSEDEARYFFKQFLSAVSYCHAHNVAHRDLKLDNTLLDSSDPPIIKICDFGFAKSWSEEANMFTQIGTPVYMSPELINSKNGKLGYDGRSVDVWASGILLLVMLLGSFPFDHTEHPDPNTSEAHLEVWLQQVSKRWSEVPHMAEAIKKLSPECKDLLNRIFTIDAKKRITIEQIKQHPWCGARGVGGVGVTSGGGVQATPCFTA

SEQ ID NO: 10314 - protein, 174 aa, Chlorella protothecoides
MARPQEELPTLLHDMDIHIFDIFDMAKCDGRCPMTVFIECVPRGQDSCSADSNLNIGANNTGMNNRGNNNQGWCNLGPWFDDAVLYFLLLCHVLCLCPAPKRVSAAIVPQHFRESSLLAHTPHRSGLLHTSSLYPIPFQATTTLETITGAATTPAPRCSATIYSRPVTDALWTS

SEQ ID NO: 10315 - protein, 228 aa, Chlorella protothecoides
MSSKLAMLAFVLALGSVSLAAVSRRACLSRIVPVRPCPPLCSYRDQQEPCAKESSPSATTSSLQSDGALRLVRSPTTISQRWRPAVFHLRQKRFHLLLELPSTDRLGRPPCFPNPPPNRYKGFDWGVGMFLANPIEQLPILLPGLDIHVYDLFDSVPCNGTCGMTQFVECVPHDQTNCRIDETFNIGNNNVGLNNWGNSNQGSYNIVVLEFRCTALPETPACLPVPSV

SEQ ID NO: 10316 - protein, 179 aa, Chlorella protothecoides
MFFPYFKPPPTCRLQQCGVRCVQLLGSQSMEQRNTQIEAFSNDPDVRVFLMSLKAGGVALNLTAASHCFLMVRWGDGAFDFLLEGMHACAPGRPAPTTVSSGHGLGGDWYIFGSSLCKSLGVSPSSHVLTHASTKTMVPTSPNRTPGGTQPANGKHLTGSTGWGERLLQEDGVYEQGWS

SEQ ID NO: 10317 - protein, 98 aa, Chlorella protothecoides
MHHRFKAFSSGPAPRSRLETWASWGGWRTHATTQSRESSRAKQHLHKPFPAPQLVIVTFAQEWLRKKGSPHSRIERAEFTNERTLEGLEFDAFSTERL

SEQ ID NO: 10318 - protein, 341 aa, Chlorella protothecoides
MFRKQSCQTPNRDAVPSNMNDKSGNLVIGGKALRNSCVLFESLTRGDPDWSFASPASPQPGRNQTIPAWACLLLPHGGDPVRGSAQEEEARGRPEWQVRDTKRTHSEGEWQDLSFTSGNKGRAQQRCILLDEERAGLLLYQRPGESKEPDRALGRWEQHLELCYAPPQRPRMPQPAILHTPVLAGVRNHLAKKIMQGMRAGDKAFFYQSNCKEPGVIGIMEVVREAYPDHSAWEVGGKYYDPRSTPEEPRWFMVDCKLVSPDGVDAWIPVRSCTIGTQVEPRDWPPGAQAVQRWRPLWDGPLQAIEAVGAAREEGGVGFCAESRVKGPRGRNMTHLATWII

SEQ ID NO: 10319 - protein, 83 aa, Chlorella protothecoides
MTSRYFEDLNVNAEVDVVIVGAGSAGLSCAYELSKHPDVKVAIIEQGVAPGGGAWLGGQLFSAMCVSLGTGTGGLKQGLGAGC

SEQ ID NO: 10320 - protein, 67 aa, Chlorella protothecoides
MGDAPLRVMISGAPAAGKGTQCASIVEDVGAGVVNGSGGHFGKGEGRAGSIDLGGNGILGRGHWHGT

SEQ ID NO: 10321 - protein, 308 aa, Chlorella protothecoides
MKKTGGTLAIGCLAFCRGGVPLHATLPWLPVPDTMLCPCSCHFGHLDFHDLVGLLNPRTARVCQPAHPPPPSQEMGPIGGGILADEMGMGKTIQAISLILAHRRDGELSTGAECRRVGAEGPEAAASQAGPARPRLRLRGVAPEAMAPMPGSSPPRPATAVGDGLLDPSPGPSPAGAECGACAHGSPPDTPSAAAAAIAPRSDSHIGVRHGDGAASSGLVPSGATLVICPLVAVIQWRAEIERHVAPGALRVATYHGSKRTADPHVLAGADVVLTTYSTLENEFRWVPECFQERGAEGAVLRGFWALL

SEQ ID NO: 10322 - protein, 232 aa, Chlorella protothecoides
MVVGALSSGEAARRGWLLDGYPRSPEQAQAIDRAGIRPDVFLLLNGWDIGTSSAGSPPHPTRLNTEPADAGCPWGHVVSSCSGPLCPVPDDALVARVVGRRLDPVTGDIYHLTFRPPPTEVAPRLVQRSDDTEEAVRTRLATYHANLDAVLGFYPDQIVQQTGGHSGAGAPDQHWRDATRSALSLTSIALHPLPALPRPQIDGARSMPEVYADIRAALDAAVASKALRVAAA

SEQ ID NO: 10323 - protein, 129 aa, Chlorella protothecoides
MTSTLLSKVLAAPNIKLFNATAGETGWGIGEHSTACSTSNPGFPRKILPSRNASNHTAEDLIVKDIPAKGGRHVAGAVTNWTLVSLNHDTQMCMDPNTILSKVMVSSTGHDGPMGASGEVRCFCSYLDG

SEQ ID NO: 10324 - protein, 109 aa, Chlorella protothecoides
MRAVRFIIAGSVEERILKLQDKKQLIFEGTVGQDNAALARLTEDDLNPGIAFRLSDTHSLLLGPDPDGPAGTSVRRLQSLLLWGLGLHLASLLALPAVGGKGGDGVMVK

SEQ ID NO: 10325 - protein, 262 aa, Chlorella protothecoides
MIEAWGTVHGSALLNANVCHPCAFHPARARATRCLFAVHEYRRSLRPACRPRETDAACMEPKLAKPPRWLDRAISAQTTQTMLDQLREWHAVYSTCIVPRNAHDAVELADWVRLVRKANRGGWVPAELRAALDELGFEWDVPLLDAQWHSCFHAARASKEAAESGTAPGGDEGLFWEGAATWLARQQTLYRQQKLTLRRLHLLKSVLGERLGGTDVGFVGRALPPRMDDATLCSIKHCKSCRREVCEAGRTSAAQSPCDAES

SEQ ID NO: 10326 - protein, 401 aa, Chlorella protothecoides
MPKGKTGRKDGKTQAGATGKHDAAQKTKAGKRKKLGEEPQADADPDSDHPTNVAREELRALLAAGASGGPHGAVRAGPGFGGRIEPESAAAAAADEMIARQAAAVLDEEDTDEPSSVIHQVCWAVERGPGRGRQSTCTWFSPAQQPSSRQGGAPGACANPEGPGWAAHAAGLGRDPGCHLPPCPSPRRACPATVHWRRIVLDEAHSIKDRRCSTARAVFALTSRYRWALSGTPLQVRQGSRGRLASAKRPKYWRGVSVWIPRGLFECCYRAVLSPHASPQPSTVHVQNRVGELYSLVRFLRISPYSYYYCRCVRLPESVAGDRLGAQEVESGADESCQPAIMAHDACLARPLFASHPRCFVHPPRRVSYLSGTKFDPGWGCGSQRMHLMQPLRVAALHLYR

SEQ ID NO: 10327 - protein, 209 aa, Chlorella protothecoides
MDAAEADFYEALYTQSQAQFDSYVDMGTLLNVRRQGRRLGECTCRVGGEVGPGLTGCGGPACIVDPSWLVGSCDVWRARHGPALPVWGHARGEDVHRKVMLGRHKHPAAASTCRACLFAAVSPAANPPLMPTIPGPPIHPSRLRQAVNHPYLVVHNSTDAAGVVAGGFGAGADGVAAAVVEEATHDHALVQGLCSICHDPLEVVGMRRR

SEQ ID NO: 10328 - protein, 36 aa, Chlorella protothecoides
MSAGRDNAAKQWVLDGADGAPRLLRFRAGHAAPPAL

SEQ ID NO: 10329 - protein, 326 aa, Chlorella protothecoides
  MOD_RES (39)..(42): Any amino acid
  MOD_RES (94)..(97): Any amino acid
  MOD_RES (195)..(198): Any amino acid
  MOD_RES (310)..(313): Any amino acid
MHGTLPPATLFKREQAEWGGGFHARKLSERAATKRASPXXXXTAMSWDSVEGPPQTRGSSGSSHILSKAAQVPALRPVDLLERIGAVVNVFQMXXXXIDRKKNIFKLAQGEECWAGSGCAVEGSKLSIWVHGESTESQLIAVVIPAKDWLKENGGKEALNKPEVGCGVCADGWCWGAEGKRIAWTPHLRRGGWAXXXXGKEALNKPEAKKAMVEELSKTAKANKLKGFEFVRAVHLDDEPWTPENNLLTPSLKVKRPQLKSKYEAELKQLYKDLKLECMFIGSETAGMSTSCQGRAADFPRNPKRVRVSXXXXRPAVSYMPQPSMM

SEQ ID NO: 10330 - protein, 322 aa, Chlorella protothecoides
MLPLSTPLWAAQALAHEAQATFFNISAASLTSKWHGEAEKLVRALFRVAAAAAPSIIFIDEIDSVLSARRGDEHDASRRLKTEFLSAFDGVASGGAHLLVLGATNRPWDLDEAVVRRLPKRIYVPLPGAEGRRALLEGMLRGQRADPGIPAVVAGLTEGWGLSQAVLQRECLLFERVKWGPSSMKCSRLLRSMARHEHAAKCTRASRCRHHMCKWGPCPVHTVPQITGSGPCGRSSALPSHPLAPPFTMHRYSGSDLAALCKEAAMAPIRELGRRVATVPANRIRGLTVADFRAGLQVIRPSLTPESMAQFEEWTARYGTAT

SEQ ID NO: 10331 - protein, 474 aa, Chlorella protothecoides
  MOD_RES (6)..(9): Any amino acid
  MOD_RES (253)..(256): Any amino acid
MPSTQXXXXGGGHGMSSVGLHADAVSPRLLVQVPSKPSSQTHVLREKGIMSSLSSAFLVNMAAALQDSQCLYMLLDFQQGGEFFTYLQVQIRGTIQGASSNASGEAKAPGTAQIHSQSPVPGSMQHAWLQDWSTCIPRAWPGGEGARLDWFLRLDSTLLVFPSKDQLGTAPHLSLSEPSSISSNPYTIHWNRDLKPENLLLDGRGYLRLADFGFAKRIAPGSRSYTLCGTPEYLAPEILMQSGHGLPVDWSNXXXXVCLWTGELGGRSNDVPPPTARWALGVLLYEMVAWTPPFHQEERAVMFRAICSANYTMPAYFSKDLKDLIRRLLNKQPSRRLGTVQPCAFPLPSHILNPTSSGLPLILFRFPHACPGRSERYPEASLVCRVRLVGPCQPEDACPFRPKGNKALIGRPLLTCTDGELMSDYRTLHSPSPHRPTAQVQGPEDMAHFEAGQEVAHKLLGSGRHASVGTFADF

SEQ ID NO: 10332 - protein, 304 aa, Chlorella protothecoides
  MOD_RES (118)..(121): Any amino acid
  MOD_RES (181)..(184): Any amino acid
MQLWHPSPSDPNTSLLPPPRRDVCPAVRSTTVAGVGAWALLAPATYMTDTYLKYVAWALSDRDAAVRATALDALLALYAAPENVAPLHAFAARFKPRFRELVDDVDDEVAARGVRWGXXXXGSTRARVGGAAGTHPVGGKRHRVPRAQQQARAGRASTLPIPSPCRPSPPARLQPSPPGSXXXXSRAQQQARGRPCLATPHTIPGPAKPARAPPALTPGEPTTRPPPPPQIRLLTRLAVLGVVPTADLQGLHRLLGDASPGIRHAAAALVASGLESAAAAGAAGGGHDARAALLRGLLAVCVDL

SEQ ID NO: 10333 - protein, 295 aa, Chlorella protothecoides
RDASPVLQWTARGGLRGVDHHWARSQFATAGVGVCVWDHARSDPFATAGVGVCVWDHARSDPVHAFEWGADTVASVRFNPAEPDLLASVGGDRSVALYDLRSATPLRKLVMQTKSNALAWNPMEAFHFTLASDDCNLYTYDMRRLDVARCVHQDFVSAVMDVDYSPTGREFVAGGYDRSLRIFAKHGGHSREVYTTKRQQRVFAVRFSGDGTYVFSGSDDMNVRVWKAQASQQLGVTLPRERQKAAYGAALIERHKHLPEVRRVVGNRRTPTAIYKVRGKYCIVGRRGGKGLGRG

SEQ ID NO: 10334 - protein, 341 aa, Chlorella protothecoides
MRDKMEPLLPAELPRPRAVDCPHMGNCTKSRASNCFDAAPAASSQVMPYTRGLIPFSTLYSYHVGTMCMADTSLRRRASAAHADTYPRLKTLHRGGNSVVYRAQSPAGGTLVAKRYHIHAMCSRELGAMRREVRLASISSDWHAGAGGHHKGPNTWIDPFRPGPPQMRLLRLSQDVPGVVRLLDQHETALTACMIMVSRGRGPRPSTRAMPGDGNGVQVPSALGGARRGPVHAYLYSFVIDRLHARESQEDCDGGDLYNMMRFGDALSADWVASTVVKPLLRILASLHATSIIHRDIKPENLLLDARGSLKLADFGLSIDQRKEIPFLRAGTLDYMAPEVG

SEQ ID NO: 10335 - protein, 296 aa, Chlorella protothecoides
MQPLDVYSLPKTPLPLPESIVLYQYEVCPFCCKVKAFLDYHKVRDMGSKGEQRPHDPAPPSPQIPYTCVEVNPLTKAELKWSEYKKVPVVVMDGEQFNDSSAIISRLSASVGRGAATPDPAAPGGWRSWLGQGSAPTSSPPARSGTQGSSDEETWRRWVDSRFVRVITVNIYRNARESWQTFDYIAEHGNFGWVQREAARVAGAGMMWALSGRLKKKYGIDGDSRKELYAVSEPGLTSGRTFHGGDAPDLADLAVFGVIRAVAGTDTFNDLMHGTKIGTWYEAMFKAVGGSARRPA

SEQ ID NO: 10336 - protein, 326 aa, Chlorella protothecoides
ATLAAGRSLPSSLLCALGAIRESFLLTDPRLPGGPIVYASPGFLALTGHGAGDVLGRNPRLLQGREACAEARRVLREALARDPPTAATVTLLNRRADGSRWWNCLHIAPLRDAQGAVRYIVGVQVDVTARVRGQEHRAGASGGGAEVGEAAGVTDVDKAAGVTEVDKTTGAASPGGSPGAGLPARKTCAAGGHSCHLVRGLDPALPPLDPDAWHALKARGVAGQVRLAARALGPSGLEITVTRISIAPLALPVHPPPRTSVVHQVAPPLLAVFHVFPASPFTPDRTFMTRRFSRTSLPLGTALPLLFNSMAGDRWSGGGLGDTIKA

SEQ ID NO: 10337 - protein, 109 aa, Chlorella protothecoides
MITVRHPWLGHVCQGSHQAGQHGHRVQVRGWWWKGGSGGAWDEAEHLGDLVRQPLADLREAQYRANGKDCYLFNLDDAIVIDATMCGNWARFTVSGAAKGFGGGGGDHG

SEQ ID NO: 10338 - protein, 429 aa, Chlorella protothecoides
MWLGPPITYPCPHPPVNLLQPYSQRVLYNGQEMAPSRFEVMCGKPDAKKWKMSFWRTDADGEPIEVRGRLIKPCSDGKPAKVRMLALQAQCPLLSSFINPLTQSMHDWLSRYGLDRKALDALARNSAAHEAYESHVAGTVALVLEDILLSLGASPYDPSDDDEGSGGKDEASGEEAGEEAAVHDETQRQQPRAPGRELISGVDEPPRAPGQELISGVDERVPPLAATQQSAAAGEGEEPGVNDEADEDEETDEEVAEAPLEPERGAPSEDRPGAHHMAESGDDEGPQSPAREASPAASAQEGEDSEGTQPCSPVSGPGTSAGATSAGARAWDALGERGAGEESAGMDVTVQGIEADAFPGEPPAEAKLDPGAGARTLVPPAPVILAGMWVRVYWPDDREWYLGQVVGEDPANPASHRVLYKLDGEVGPG

SEQ ID NO: 10339 - protein, 381 aa, Chlorella protothecoides
  MOD_RES (80)..(83): Any amino acid
  MOD_RES (110)..(113): Any amino acid
  MOD_RES (307)..(309): Any amino acid
MRRQRALRWRLAVRGRSAMPCRRAAASWHATELANPKQFTSARITFIVGDVCGSPPSLCTYRGDGIESTTPIMLPSSWDXXXXRWRLAVRGRSVMPCRRAAASWHATELXXXXRGNGIESTTPIMLPSSWDMSRHVTTMYPRGADRGFQGLARSHAGPGDHRRSTHRSHDGGLREMTLYSDAEAQREGLLSPSRFRSRVGASLHLLQRLGLTRRLEGHTGCVNTVTFTPDGEGLLSGSDDQLIKLWDWRRGVEVLSYDSGHTDNVFQARAIPGTDNRTVVSSGADGQVRLGLAGEGGSVRTRCVARXXXPHRGLLRRRRPGAAGAGRRGRLGAHALRGAPQWPRAQAGAGAGGGGLGAVLRRGRPSAVHGRAAGRAGDRSG

SEQ ID NO: 10340 - protein, 172 aa, Chlorella protothecoides
MYWHTLRSLPGRRWPEGRKRCIITTTPKSSPQEAESRQLEAEKTRLELKVAEARGQLEAAGDVSERARHLEARLVDLEARDARLAECEAAAATANDVVEAGRQRLASAQRELEARESEAAARRSELDTLSAAIEEVRREQEAWTDDAERRAAALSSAEQVPGVSLWWGFVWG

SEQ ID NO: 10341 - protein, 141 aa, Chlorella protothecoides
MSNQPDRYEKFVVPDGVKKVAFERDTKIANAGTFTVQREDHTIGNMIRTHLHEDPHVIFSGYKIPHPLEYRMLIKVCLSENVLLGDQSMLSHGTGVRLRSHPPPPCSRRCRRMVGKHRWPPLKRQSTSSWRRSDPSENNLW

SEQ ID NO: 10342 - protein, 289 aa, Chlorella protothecoides
MWFGLDLHRTAACSRDMRLAVRGFAGALAPGQTRRRPHPAGSGALSIPPSGRIEFARLLPPNIQSLLIQPMGREGVMLLASNRQRGFSSLDKVRAWGWFGMLTFGLWGTLVKDLADGRRRERRMADSCRCVGLLSMPPPCALPSQAWAVRVAEKLGATFDRSQEGLSGASKPSYGLRAEHQWNATGPGQTQAVVQSHANVFGTQRIACRIQLQFLASGLVLERMPPAGGIGGVGGGPLRILDLELWHWAVGSTGLVSMHLAQVDLQDTVQPQLHEPGLRRAEQGGCWLF

SEQ ID NO: 10343 - protein, 272 aa, Chlorella protothecoides
MEEFPSSSGSEEGFVPDYDFESSFERLKDSACFPARLTILGLKRTNKHLVMRELLRVKNAQTLDEIKDAVVAAYQDLMALEIFDAVDIVIDGLDGKGRSGGCTPAQNRQRPRLLCLIDPPSFSCSPGSVEASATLTNPLGHAERLNLSGEWGSRSTTTYSLALTRARPRGLPYLATARLYQQFSSFERWSSFTELLRGAETSLSTEDGRHLVGAGIGWYRLADPARRASRSVQQQFGEGVRSAIKYTFRHTTFSGEASFPLEGGLRRSECEG

SEQ ID NO: 10344 - protein, 167 aa, Chlorella protothecoides
MAHPGHSVSPAGAASDKLVEHTGSNITLTRHDVATLGPGAWLNDEVINLTMTLLQERDTSARKAQVGLLWADAGCGALRALHATALKLWGKYRLRGIEGTACNCFEAVGQVLCLAGLEHSPLLQVNTLAASPHPQKSWPKTHFFSTFFCNKLYKDRGYTYAQVGAPQ

SEQ ID NO: 10345 - protein, 595 aa, Chlorella protothecoides
  MOD_RES (47)..(50): Any amino acid
  MOD_RES (85)..(88): Any amino acid
  MOD_RES (416)..(419): Any amino acid
  MOD_RES (551)..(553): Any amino acid
MPTSPRPSAGRYGQAGQLFTKQTQAIFYNWKQLPVQRMLDFDYLCGXXXXDWSASRRGWSLRAKKSPDFKLLRTPYPTSLPQGDXXXXPTVHVHACIWNDGALPDGGLRECALSTAGFSRQVPTSRQSTKPNSTGLCDIHRSAGGSRGSALPLRRLDSAPNRIVQACATSTVQQVAAVFSITFTFNKLDAVLCLISAVPRRLAYGEEPCWEPKAGHSLASRRDRRRPLNAKVSSPGVLLHAAIYPCPPSECCSWLLVLTVEEGNSDSELCGLDPFDLKLRLHRPYRGTSGRPTETCDRTSLRLLSGQASPELAPAGSTAWLAPVRVRKRIYVRTAATRPGAGPRPRDPLLRQGRYTGEVTCGDLPSTLQERSRGVSTVQTTSSSLTIPLKYTTLVSIHAAEAASVNEYTTTPREQXXXXTLQERSRGVSTVQTTSNSLTTSLKYTTPVSVHAAEAASVNEDKRSPRGQESPVSVLQSVLASRKLPPPNAKKIPPPSGPKRSPPSAKKAGVTPAKKTPPPLTKTSAAPPPKKRPPQPAKKRLPPPVKRRPPXXXRPSLRRVRHLSQKRDRLHQRRKGSPPQSRDVLNLQRRRAPPR

SEQ ID NO: 10346 - protein, 584 aa, Chlorella protothecoides
MKGQLLDNLMSTPGADYPRTACLCASLVILKGSPALHVTLLFLGHMPVEATQAFSACPRQGAIGRAHLEDDTASRPPSDCAPSCALCRAHSPVGGDTHGHRHMDNLTRLFRIRKTCMELLRDRGYLITQVGSVCTSKEWRSAGTHFSYAAIAIWRTSACPPLQEDQDMTKDQFREKYGDEPRKDDLTILAPKQDDPTNQLFVFFPEEAKVGVKTIKVLAERMRAEGVQRALMVVATNMTPFAKQCLQEMQPKYVIELASCHRKKGAAFLYLNILAPTQPCSHLQQFKEEELLVNITKHVLVPEHRILSAEEKKTLLARYKVKDTQLPRIQFNDPVARYYGVQRGGVDTSFASFACAPRASVGDEFWEGGFGCSAQPSLPSRRIERVTTHGPDPAMPTRSASEPRALHLACHSTPGSPEYRGALPDVRPVEAVQSGDTGCRVWEWARYCRAGGKDGHPLHSARSQITSPEHVLCSRPRNFPLSISPLPLSTPYQTPRSAASWPPGARAMMGSWGTATRASATRPRSSSPSWARTWTWCPAAATTAWPPPARAARPTAGAGATLGAWAMPRPTTCGRPNPSGACPG

SEQ ID NO: 10347 - protein, 186 aa, Chlorella protothecoides
MHTLALTVDGAVYAFGRNQAGQLGIPSQYDALEPTRVAALEGKHVRQVSCGGEHSLAVVEGGQLYVWGWGKYGNLGEGWWGKEGDPGGEARTILRQQSIRGLLRKWSPNASETSWTTGCRCTWRFRVPPPSPPPAAAGGTLRPWTPRGGCTPGAGTSTASWAWATTSERGVGRVEDGSGAWEAKVD

SEQ ID NO: 10348 - protein, 621 aa, Chlorella protothecoides
MLHADASPHHVPHTGALPTPPLQLQDLMHVLTSTPLATLCEAAALKRDEAHGCVVTFSPKVFLPLTRLCRDSCAYCTFAAPPRPGARCYMTPEEVVGLARAGAAVGCTEALFTLGDRPEARYPEAVCELAELGHASTLSYVTAAAGEVLRATPLLPHVNAGVVAGPALSALRAVSASQGLMLEGTAPALAAPGGPHHDCPDKDPTARLRCIEEAGERGVPFTTGLLLGIGEGRADTVDALRALRALHRRHGHVQELILQPFVPKPGTGMARTPPPDRAYTLWAVAAARLMFEPGMSVQSPPNLAAGGEGEWEALLRAGVNDWGGVSPLTRDWVNPEKAWPHLASLARATAAEGKLLLPRLPVYPSHSTLDQRGRWLDGRRGAGSPLAAVLRASDASGLSRGSSWWPGRDAKDREESMEGVEAGRTDVDDAAPSVQHSNRATHAHVPSPTTRSAAWRVSLCRDGALEAMPRPERASNALTELAVALASGQYAPAEAEVRLLLGARGTDFEAVCAAADNVRRRLHGDEVTYVVNRNINYTNLCAYACGFCAFSKGPSDARGSPYLLTKAEVGRRVAEAWARGASEVCMQVGAAGSGLAPKGGSFKGGRGNPWFLCGLSERRAT

SEQ ID NO: 10349 - protein, 715 aa, Chlorella protothecoides
MGPSEAAGLLRAGCNDMGGVLMNESISRAAGASHGQELGPQAMDDLIRTAGRVACHVWEDCRVGQHCILGVADLTRVRQSDACHSNLLQGRVPRQRTTLYGVPPRSQVEKAYAATPLMASTGRRSKLTAIDSQSSISALSLVSRRLLPKLPELSTHGVTSPKSERCGTVRMNPGYCGGSLAHRCPRCTLLSTRTSILLALRWEDDKFLLWSLGGFFPGPVTTVRHHALLAGSLTRSTAATRRGALPSSGACAQIRSLLWTPASARRRRTTGRCLGMTYGRLFMMQLRRGMQSSSCAIVMHTSLAYLDPTVTHSGRARAPGGQDRDWGCDARLRREEPARRDVTMHRSSVLDAYVAGSGAEKGETDDVGAAAARPVAGATPPQCPSAAGNEGLEDAQADKDELWNASAGPTQVQSIPSHAPVEPAAEALPGPNRTGDPTPPPARRPRVLLAVTGSVAAIKTAQLATCLLAFAEVKVAVTRGARAFLEGLELPGSCLPLLDDEGEWRAWHGVGDPVLHIELRRWADVLIIAPLSANTLAKLAAGLCDNLVTCVARAWDFRKPVLASPCHPQENANALTPPPYEAGAGHEHLDVGQPLHRSAHARLCRPGHAQHRPHRQAAGVRGRRHGGHGRAGRHRRPGAGAAGRVSLATALNALRGAMCSASLPAIVALGCWSAWHMQGVMPGRMNGLHSRNGGRGVERRGRQQECEQGVQQGTG

SEQ ID NO: 10350 - protein, 275 aa, Chlorella protothecoides
MGGWAWRPCRACQGMEIWCSGLGAAVMQHVGPGACMSPASSAHCPSHLAPTQDFTARIKKYEAIYETITDRRLHYIKLIDMVTGEEGIGGGGGVRCGRLGAQVSILMDKPPGAIGATANPSSQTLDPTPVARSSAMHSGPPRSSLPQAPPQSHHAGKGYMDVNRISGYIPGKMVFFLMQVGGGHCSSGGLQGPGPAPPHLAHAAWGVGVQHHGQDRRKQRPEPEVRGKKGTGCFPAGQKPAVWLGRHSLSAFNVLGQGLPHEEEPPMSRCHMCMF

SEQ ID NO: 10351 - protein, 688 aa, Chlorella protothecoides
MYVQAYGDWHSWQAFHTELEELLLISCRANTAPPAHLQAQARLPVQPRPPARHRPPRPAPPLSRHPVLRRAHHPAQRHPVSTWYHQTGTAVPSTSSGAIAGSWCVPPCPVQAAAGCTIDAHTISPIGPPSPHPARSQTWMIEGNYCARSCKYCSTTSPSPSPSPSPPASPSTAARLSPCTDNPTPDGYSCAQQSGWGKCRAGSRHPRSATWMLDGNYCAKTCGRCTTPCTDNPTPDGYTCAQQSGWGKCRHPSSLLPAVLPGCWMGTTAHRPVADARSRAQTCPLPLSTPALSKRAGANAGGSGARAWWQRCRGALGRDCRRSKALVRVSPYCARFLSHTSHTPPLTPSESFMTSGNYCQITCGRCPTASPSAAANSILAGSVSEQSPSPSAFAAPSPVAFGPPPSLEEDSVDFFEDEPPQLISQRLSAPLAPVSQLPPAEEEDTDAFLPPVAPITLTEQSPAAVPDEVLGGFEEDDESDLFMEDKPLGPMAEAVTGLEVVAMPPVLTGTWPSPAPAGGAAGAPASEDQPEVEEGFSIDSVVVPSPPLTQTQVIINSQVPEAASPPANASQASGTGCASDTPPPGLSCQDVKFQGLCMTPAILDAGLCSITCGFCAPSPSPLPPMAPTAGNDSVVTDSARSPTLVSSALNRAVISPGCVDVAPPGYASCDVSAEWWMIFCEGWRGGPG

SEQ ID NO: 10352 - protein, 223 aa, Chlorella protothecoides
MDRVVPLAGSAPPPVAVWTSTLARTIITASGLPFPKVQWKALDEIQAGICEGMTYREIAARLPGEYELRRRDKLRYRYPSGESYMDVIQRLDPVISEVERERECVCIVAHQAVLRALYGYFMNRPLAEVPSLNIPLHTIMELTPQPDGTMAETRFEVDVDLAAAREGLAGDGGGEKGGDHQKAARGMPRSASLAELRAKSFVRQLDAFGRLSSDSDDPGRLMP

SEQ ID NO: 10353 - protein, 400 aa, Chlorella protothecoides
MALQPRPQQHAALLGVGHAGGRADHPVHRRHDLLRLHDGGRLQLVGVGGGHVLGGEAHHLVVQVVEQRLVDDRGEGGADAAGLHALLHDDGAARLLDRPADGLHVEGLEGDEVHHLRVVPLLLQLLHRLHHHVAHARVAEDGHVSALANYLGALQALGVFGALHLALDVVQQHVLEEDDGVVGADGGLEQGLGVLGGGHRHELHPRDALEVALQALGVLRAQLPPHAPGPADDHGHLELAAAGVVQHAAVVGDLVECQEQEAHVHALHDGAQPRHRRAHTHAHEPVLADGGVQQAHVAVLLVQAVGDLVGAAIVAHVLAHQADRGVALHLLVQRLAQGLPHHQLLLGGRRPGGGAVQGPGACAGDRLRVGVGPDRGQGVVGSWWRTGARSTEIHAPRHHL

SEQ ID NO: 10354 - protein, 491 aa, Chlorella protothecoides
  MOD_RES (64)..(67): Any amino acid
  MOD_RES (323)..(326): Any amino acid
MGIVLTQLCLSSRAAASYPHSHPITTSVATTTHAARERAGRRAVRRSQRALWRARDVPLPLPAXXXXVGVAEWKRGPLNASLGMLGHASMAQRSILSHLVSRLRRWASFSPSSASPPGLRPLARTPTPSRNPLPPPLTQPGSALGGALSAGPSERFGVRSTSRFPFLQPDRVRDAEGRRPGDPGYDPTTLFLPPTWLHDAKISEGQRQWWAFKAANFDAVLLFKMGKFYELFEMDAHVGVELLGLTYMRGEQPHAGFPEAAYAGMAATLARAGVKVVVIEQTETPEALAARNEKRRQSGQKKMEEQRRTRDRKRWSFAGAADXXXXFWCMCGRGGDGGGTPGGAACRWRSGEGRGIGSDGLSRGRPNAAWGLLWGTTPMRMLPDPLQPSMTSTAATSNPPPHPHTCTPTTAPLAPGERRAPREGGGADARHADGRGDGVLHPGPHLAPGPGGAGKHGDRGRRSRRPPRARAGLAARRVAGPRGGVRPPGLP

SEQ ID NO: 10355 - protein, 324 aa, Chlorella protothecoides
MSSSKKPVAMGSGQRSIASFFGAGKRSSPRLKPSPSRQKGRASPARALDLEAGSEPPTAAATAVTTGCLQPTPKASPPAGDASSQGAAPAPGARAAKRNAPPVCEGQRLRVFWPAEKAWFEGRVGEVQERKGKRRAYVAYDDGDEEWVDLERDRFEVLEPGRKRARAKAAQVLDSDSEAEPSASQGSEFLASEEEGEESDDDSVSMAASEAEEEGSEAESDVKPARKPAGGKTASAAAKASPGAGAAAGRKRVSSATTQATPCPASQSKGGLPPATPASGLRPAARNLAEALETPSFATPATSGPAATVRGAGQWGLLSGKGDF

SEQ ID NO: 10356 - protein, 161 aa, Chlorella protothecoides
MHGGARSVLASGPPHGAGECRTPDRLLKGPWRGRPSVHGRSSTQASPHPGDAAGNDAGSGILSVDELDRIARHSRHRLTQCTSSPAAFSHAFTRRGLSIRLTSLGPAYRIACRDEGGAILGVTQGFKVPLFPILHADTMQVQRPRRMGAGSFWAVVELLRW

SEQ ID NO: 10357 - protein, 94 aa, Chlorella protothecoides
MFPLAASFGGYYALYVAVLTASVRLAVFLSCLVSADRLINISKFVYFKIRARLTGHLPEHDWAFPDLPHDPAAYPKVGGRGTLGGRSVLAFRPM

SEQ ID NO: 10358 - protein, 150 aa, Chlorella protothecoides
MQVENQPAGRHPGGEPGGGPAPRFKRQGLHGLGLLLFVATLAHAAACGCQRIEMLAINDAGARPGPEHHAYMEDLSGPARLPPAEDTHARLVRYYRRLGFVARRDVRGERLSDVPHLLVWGGRGLRMDGDVAALTRRWAPVVRAGAQSEV

SEQ ID NO: 10359 - protein, 74 aa, Chlorella protothecoides
MFNERAVCQAIIDCCCELHWPTQRLKIQVLDDSTDTVTRQLVDDKVLEWSERGLDIECLRRTNRQGYKAGAMKE

SEQ ID NO: 10360 - protein, 278 aa, Chlorella protothecoides
MTEYHTIYKGPEGETTQWDDIQRKLGNRPEKVWAAPTTVDPVWKPQAYTPEAEPTRGTERLDGEDAEGLEEAEDEFSDDRFLEQYRQRRIQELQASVSQPRFGSLEEIRRDDFVAQVTNAGEGVWGIWLGVCSQLLGISLPLPHPPTRLGVISSPTPSTHHSTRACGIMNQCLMELAPRYPATKFLRIVASNCIPGYPDANTPTLLLYRGGKCEQTLVGLERFGGQATSPDLIAISLNRFGAVCGDPDDAAVAAEQLAGVVAAAAARRGEGDGEGDSD

SEQ ID NO: 10361 - protein, 473 aa, Chlorella protothecoides
MSVRYPFPNYTISTINPTDREICTPTAPDGGCYFVALAICYPKGVATCEADPDFGNTGNNNDGMFNYGNNNGGSFNHGNGNIGSHNRGSNNIGSNIVCNNWASDAPCPIANLKTTETITLAGYPPPPPPPSPPPPSPPPSQCVVCSGPGTIVLGDPLPFTVEIVPPPQLHCNRYLGSLYLASSTDPDAYCRRKGYTAAGYWESVIVTPDAPFSQFQIATLQPETLEICTPTEAYHCPALTVVECLAKGVARCVQDANGNLGNGNVGFHNIGHSNQGSYNRGSLNLGDYNRGNGNWGTNIVCNDLVAQDGAQCSIAALKTVATLVLYPYPPPSPPNVPSPSPPPPNVCDSRNPILALPTIEYLGTLYLVSATGLDTYCRWVPLNWVWGPDSSQSVVPPVARAEDYILRKGMRLLYPLPALYSLLPHLSLPPFHVAGGRGTQEQGIGRCSTLPRVLRSVSSRLPRSTLRRWRFAP

SEQ ID NO: 10362 - protein, 866 aa, Chlorella protothecoides
  MOD_RES (124)..(127): Any amino acid
  MOD_RES (213)..(216): Any amino acid
  MOD_RES (273)..(276): Any amino acid
  MOD_RES (462)..(481): Any amino acid
  MOD_RES (634)..(637): Any amino acid
MPASWARVDAAPSPPRPDPMMMASQGFSWGWGQPAAVTATAAPPANFIMVSWRCFWNAGSVSDPYGMQLRVFDRSSMHRSPAKHSQHDFENLSHRAIDLAPAVTGARMVQGSRIACVDFKLKVXXXXTGPSISHPLIWPGSVGPVRRGLDLRHSKACTRFATASNRNVDPRLVQRGLCATGSLLGWPLPAVAPRPAVLQQDWQAYRRPKTWPXXXXVAPCAVSHALHPVECLGNHSPAVQKAEDLASSACSITGPKLPVLQGCCGTGWGTPPXXXXQAPSSPCCRVAAAQDGGFLLGDVREELAVQAGQAHRDPAGPHAAVHLHPHPALGVDVQHLSCSPCGTLAAVAGTSRETPELSELWAVSLHAPAVPRAGSATPPPASAVAVDRGLFAARPGLRVLQLAWHPLGDGHLAVLTSDAAWRLYCLDEPSVPEQTLELSLGSRCASSAEWTGDQARACVLAXXXXXXXXXXXXXXXXXXXXLWRLPPQRWQTATPLSQHGINQCTHFACLQPIPGSPPHSFAPSFPCQACSGAGRFGGAPDSLCVWPCRGLGQVCALLPLQPQQHLPRAAWVVTRGCGAAPVLGFESQAVSRFHPSVLMSVLLGLGLTSVPAASGTCGHGCVAPACITARSPSXXXXCGHGCVAPASITARSPFPRAGNPPGCRVPSASLAALGEDLGEADEATHSWLQRAFAAGTRSGVAMAQRHALGAHVPVLVGPLRVATPGEGPLPAGFAGLWGDSGAVAEDLLLARFAPGCSAICVAAASGGVAAGVLASPARPAWQEGRPQCLAGPGGRLDAVRSQLGPGTADPGEGPGLLVLDLGEPAGRSVRLLGDAAARERVHVLLRGGGCFALDLAWLPRLAADAG

SEQ ID NO: 10363 - protein, 458 aa, Chlorella protothecoides
MTHQFRRPGGHWFTCGTHYVGQMGEGDAMREFMDFVTGGVVWDPLPDTFDMFCFKSDGAQFSQPTGAKRWMERLIESFPAEQKARRPVGMQSGMESLLATGRAGSWQGGTPGSPNPLPATTQAIRRYFRDIKRVYSWYRFYFLSRSMGRPFSSILATCTAPRRRAFAQQTCQQYMDGAFRDRRLIGVLCALWGDYGIRPDLVTFMQHALVAGNNFEGAQVASEGATRLVLLALHRLRLGTYYPRLGSRALAKGALALIRAKGGEILLSTRVTQIVLDEAGRAVGVRAVRGGKEGVYRGRHIISGVRCRVLDMWEGLGGGCSRRCTEGSRRSTQSLETALLMPLVHHLIHTCSSNHPHELTASAAPTLPHSCTLPSGRGIQYLQDPAATPTARLLGRHQAPACRACRDLDLAGSGRLTAGAVRHARRKPLDLCRLPPFAGPALRSQGVCTEMSEGALAG

SEQ ID NO: 10364 - protein, 743 aa, Chlorella protothecoides
  MOD_RES (120)..(123): Any amino acid
  MOD_RES (328)..(331): Any amino acid
  MOD_RES (415)..(418): Any amino acid
  MOD_RES (686)..(689): Any amino acid
  MOD_RES (727)..(730): Any amino acid
MAGIEEPLAGESAEVWRVPVKSTVLGTINWLCTLFSHEPLAQVREVTYAFLSCSALKEKYAGHAHSLEVCLFTDPAYFMGWEERNDADGRQDYVQTWELRNVGAGMHILHLVLTNHILPXXXXSQVQVMVWELANEVKKNIVADALDFVDQFVPGLKDHVIFSEYHVPQHIRPVQHQRSAILPFHPGAYLPGWDARHLELFLRLARRYHVRRPSDRAEIGGRSGSSASDVCGEPVACRCVVVDASVCQVQGMRSRVCLESSATYRWVGVHCVVPLWVSAHHLHVSPCIDPKSLPGSIALCLGHENLSHAVHRSRPPPCPSHRQAATPXXXXHVNPSLSSPSISIASPGCDANVFGLAGAMAGGVMAAGLILHPRLGCLAALPAMRRCMRQPGEGLLTGEEAAKVHARIQRVWHDXXXXRAWGAWLPCSPCVAACVSQGGACQFGQQMRSPLDWPVHHPAHGDRQVRVEEGCSVVRGVNLNVSPAPLLLNISDCRPGPMHGSNSDGPASHSQKDRVEVRRSYSISSLPLALPKLSVTIKRVAGGVASPWLLDTLQLGSTVHGLAPQGDFLLRGAAACKPLGRSSEPAVMPPSGTSRDRCMGWRGPRSSQGREHGRHRVCTCRHTDSSDLTRPKTPYTAGSTLHQTPCTYSWEQAAGSPPCCPCWKRRCSSARPLHCWVATVTQRKRXXXXSPHRQLRSDPPPNTLHVRIDAASTPVHVFMGAGSGLAXXXXLDAALRHCRPPAG

SEQ ID NO: 10365 - protein, 308 aa, Chlorella protothecoides
MHQRAQISARGRGRSWLSRLAWSLETPAPPTRPPSPRRTHRGSGERQVTLEDLKRVAHLSQERAAAALNVGNTRFKSACRELGMRGWPYRKIKSVRSLLYAIQKEPDSVHPDIWPAILWRLDRLVDHHFHNPTEPLTEEFKVLRQAAYKRRHGQKRRSGDGAAACSSSEHCLDEDLGAAMPAGHLPVGQAPCTGYQAFEDSAQSPCTPPNARERALRRLGPAGEVMQEGVAESGPGLRPEPPSADACPHAGQGVAGTPVCQLLPAALPSPSAPDLWCSLTWTSGLEFAPEPNEAREDLEDVYAQTASS

SEQ ID NO: 10366 - protein, 71 aa, Chlorella protothecoides
MKFAGGAAVAVTAAGCPQPQEKPWDAIIIGSGLGGLGAASTLAQLAGMRCLILEQHWIPGGGFLARDGGPC

SEQ ID NO: 10367 - protein, 340 aa, Chlorella protothecoides
MSWENRTTTNSLGGCADEVRSPRLLPGDSTGHWTLRIHNKRRRDLNWYRERVGTPMGNTFRRLFDGLFGNREMRVVMLGETEMGAGMASSACSSAMLTANAPFCRPGRGGEDHHPLQASYRGGAQHRAYHRVPGGATSVFHWMSSYLPLVPHNTGFNVEKVQYKNVIFTVWDVGGQEKLRPLWRHYFNNTDALIYVVDCCDRERIGRASAEFKDECLAKHVILSQGNLNKLPLLPPQQIIDDPLMRHSAILVFANKQDLVRACRLVLDPEGVGRSRAPGALTPAETCEAMGLPALKGRKWHVQGAISTRGEGLYEGLDWLSGVLKTLQAGSERDGKGDGA

SEQ ID NO: 10368 - protein, 169 aa, Chlorella protothecoides
MLALRSAPVGVVSSRPAFAGRIRAPKARVPSLLTPHATALPVEIKTVAPLGERVVVKVVEAEQKTQGGILLPSSAQKRPTQGEVVNAGTAKALKKGDKVVYSKYAGTEIELQSEDFVILKVSLGLQGLAMQWLGIRHLFVVTHAWNMLYSGEVPQHGALPHLPGCLACV

SEQ ID NO: 10369 - protein, 562 aa, Chlorella protothecoides
  MOD_RES (293)..(295): Any amino acid
  MOD_RES (466)..(469): Any amino acid
MRLPRSLANMHATLCELSIHNPQPAPLPASSRSKADAAAIDAELMGPVPHGHPPSRPRPGGPGQQRRRRAGGGAPPAPLRVRGGRGLPAPHTAAPLPGPGDPAAARGRAPGARGGPGPGRPRLARRRGAGRALRLQLPRPAAPALRCAGCRAGGGRGSRRTGDGCRGRRAAPLPRPRLHRRALRLGCGGRGRGRARPAPGHARLAHGAQALCGALRRRAPLPGRTVLDPRPGRPLRSGRPAPLPRDAAVPAPGRRGGGGDEGWPFRLRTRWWHGGQCPRSGARPADHGPAARXXXGGGTAGSAPATAPAPPTTASPHADLPGMRQSYTAGTLEESDAPADPLALFQRWFGDARAHPGVAEPNAMVLSTLGAGSAPSARVVLLKGLDSRGFAFFTNYASRKGTELDANPAAALTFFWEPLQRQVRVEGLARRLPAAESEAYFNSRPRGSQLGAWASRQSAPVAGNGXXXXRPTSTAGLAAASWAPGPAVRVRRWQETVAPRWTSAWRSWRGSTPTSESRCPTPSTGAGLCWSRTRSSFGRAGPAACTTAWCTNGGAGRRADGP

SEQ ID NO: 10370 - protein, 791 aa, Chlorella protothecoides
MFLPHKGQMPAKLSALVTKQPAAPTLCRGRRATLGPRLQQQEKTPGGHRRGDAVDAPRLPAPASRGTAQLGPPQRLPITGSAGGVPVSASGHLQRQADLHFTMPHESEADLRFTKTHAKPFVPAPPRFLFGRPDLALLRSLCTARLEWTPVQADELLLPVLKAWDEREVGGWTRMVLRGGRWLQLCWAWAGGWLMMSMPAHPSPPPLSCPCSMSSRSTLAAPANPGAVPCFPEAVCEDPVQATAACGARDCWEDDGRVGAGRESLRRGRDSEEAEGSQVPGKDSQTGPVCRASCPGRASRGKQGQRGCQGASGAGEDPSTNSTQLQGQPHAMRSRVQITSRGGRIAGAGAAPDTLCKKAIDRDFTDVTENEWASPPLANPGGCSFQRSPAGEPGRHEHRHQGFFASQQSRAPRHPQQSAGAASSQLIQLLSSPASQHGSLDAVLLDLQPLLGPGNGNPSSTLLDAHSGLGAACAACLVQRIRDSPAPDQALGSLLRALPRPAAASLLRGLGLGSRAVNTSWGEAEWRAAAALAARGAAALDREEAGCVAQAAAGALDAALSPILLPASRPRGVASPIPPTPQATAAMAAVGAAAAAASGSLEAEERVLALHGAAILGCLAAAAPLVFGGRASTALLLTAAGVAASLRVTLARRGSGEGDPATEHPASDGAGHPSIVTEGPRPLIGVHDALAFLAPLLTEAQRVAAAELRAVVGPRLGKRAALEALLDVDLGVPLTRGGGLDGAGGGLQASRPAHGLLLALAEVGAASLAAGWGAGCAAALATLLRPGASGG

SEQ ID NO: 10371 - protein, 309 aa, Chlorella protothecoides
MGVKKLWDLLEPCGCRISIEALTGKRLAVGAGGGRQHLATCVAWLPACTSHAPTPLRPPFPHWTDASGWLFQFIKAMRDERGDLIRNAHLVGFFRRICRLLFHRIKPVFVFDGAPPAIKRMTVIARRRCWGCAGGLQPRWVCLPGQDQARRVQEKHWPSHIALMLIMHGTSPSKCTPPPPSTARQREQQDARLRRTAEKLLLNQLKQHALAQVASQGGSDVLAQMAGTQKSRGTRPDPFQEVVVQDTDAAAGGRAAGAQPHAVPAQCVPEGPALGASAPQPGEVEQELEAHLDLDLDQLGGVEVRGLAG

SEQ ID NO: 10372 - protein, 770 aa, Chlorella protothecoides
MLKLREAQVVANREKFAAAQGAPLAFSQVQMAQYLKATAFRCVEDWQGAEGLGACPAVHEEGACWAGSTTPSLQGSVIPARMWLVRQVNEIKEAVNAAAGLLGASRRIAGEPGREYVLLRDEEALDGPGVPGAQGASSPPEPSAAPASSAAPPSSGGPLPAQDPLVLTFGASDLDPATDASEEEVGWEDVEEEPSLPGMLASPGGSTEPVPDVGLREQRDLHWRERAARRQRFWSLAQGFRQGRALSDWGKAGDGAQGSSLGIGRRRGCAWTAVPPVSTMAKPAATVFILHHGIADSPALSPGRAEDGTRDEEEQALQAAIEASLQESREAWEVAGGSGPSGSGPARGGRESGWVGTLPPETALPPLAPDCQASFAGASETNQASHAPASGSEEDWEDVATEPAPPGLAPSRVAAGVNTASETELNRLLSGARASAPDKPGQGLAVGLSVETVAPPHVGVSASAEKHSPAEELVSAIASTVSALAAGAQVEAILTEAGPTGGVEIQALDSPSGPQVSPEKKALETNTAGIVEGGKALNAVAADPLQPDAGELPADAPQASAMNHVLAAAPLLQEAVLAAAQAPLVEDSAPSPAAAAEAADVTEFLGDMEPDAEEEEPLTFVDDFGPGIGPGEAEAGLEALRHEALGLRQAQRAQRGQADAPTDEMYTEIQDMLQLAEACRLSSLAPPLNDESWSSSATPMAALTQMFGVPYIVAPGEAEAQCAWLDAAGLVDGVITDDNDAFLFGAQTVYRCGAQGWACQGVRPGECHDC

SEQ ID NO: 10373 - protein, 645 aa, Chlorella protothecoides
  MOD_RES (471)..(473): Any amino acid
  MOD_RES (551)..(554): Any amino acid
  MOD_RES (605)..(608): Any amino acid
  MOD_RES (635)..(638): Any amino acid
MTGHDGSGPPRRCPPGFPKVWASFVEAVVDTAHANGPAAPRRDPEETMPLLDVPAPPALLNNPFALSRFLPQAPSLATVLPGVERLLAIGDLHGDLDKARRAFRLAGLVDDRDRWAGGAATAVQVGDILDRGDAEIQLFFWLERLQRQAAAAGGALHVLNGNHETMSAARDFRFATAGGLDEFSRFARAHALELALKARCGCFGADGNTAAAAAAWRGEMREFRRAEGADARYAALRPGTGPLARRFLAPHPLVLQVGATVFAHGGVLPVHAAQGLPALNAAARAWLQGAAGERPPRILTGRSAVVWARDYSAEDAEACDCAGLAESLARIPGAARMVVGHTIQQEVGAAAAKPFILDHSTLFPPKIQHPGHQQRVRGPSLQGGRWAVSWVRGRATRRAGNQERLRDAEADGGARAEPPAARAGCPGSRRAAGAATSPRAGLREGGWIGVPVILSIPSPSRWFNRQKLSTXXXTSLHHSTASKACTQRRLSGMRASRAPMVGGAGCCAHSIWVEVGRDCPWQHARQVRIGADGRGGFVGAFLGTDRKDTLXXXXQTGGAGKGWSDSGVPCRAAEGGKGTSSAITQQHSQWQHCRTGLQCLREASXXXXMGHLTPATVASAPPNDAAGRGQHGLGXXXXPCKLAGS

SEQ ID NO: 10374 - protein, 245 aa, Chlorella protothecoides
  MOD_RES (39)..(41): Any amino acid
MPRLACSGSAWPQRSMPRHRSPTHALPPTSPHPFYDPGXXXCPGTAHQLTHAPHLPPPYLQSRYALEDAASDYQYGLECLFRFYSYGLEKAFNLQLYREFEEHVLQVQRIGGKGGTERWTPGHGMLAALDGASGARVDTQPRALSGGVLEKIIRAPDYANGFLYGLEKLWAFHNYHGFPKDKELEIQPKVQSRKQGVGAVSAPRLGEGEGGAACRTACSPFTGEIMFCLACEVSRAAAWDVKSPC

SEQ ID NO: 10375 - protein, 225 aa, Chlorella protothecoides
MAEGLSVNHAAEPDLSPGPAGTPKYLRTKDHVLSIEDALGNVGRHLSRLQRERLEYEPLVPEVLQGKPARCRVPTCMPEFSGPHEIVEQETRQAAANHEAIAKLFPQLCRSPLHLLRLVPGEHAPHAEGHRPLRIGVVLSGGQAPGGHNVITGIFDYLAKQHPCSVLIGFKDGPRGIINNDHKLLTARELVRGGVEVLSGGLVDGACSACSVTCVAHLDAHLNRN

SEQ ID NO: 10376 - protein, 499 aa, Chlorella protothecoides
MMQAEPSFWAQIWRTVRVLGLAFLLMAGAGALMDERGLSRGVLNSPDLKPQVETGTKFSDVKGVDEAKGELEEMVEYLRDPARFTALGGKLPKGVLLVGPPGTGKTMLARAIAGEAGVPFFYTSGSEFEEMFVGVGARRVRDLFAAARKAAPCIVFIDEIDAIGGKRNPKDQQYMKMTLNQLLVELDGFKPSEGVIVVGATNFPQSLDKALIRPGRFDRHVTVPNPDVRGRRQILEAHARRVPLAADCDLDVVARDTPGFSGADLANLVNVAALRAARDAKAAVGQADLEFARDRILMGAERRSALVSDKIRRLTAYHEGGHALVALYTPGAAAVHKATVVPRGGALGMVSQLPDADAELSVTRRQLLARLDVAMGGRCAEELIFGEGDVTTGASSDLVAATGLARAMVTDYGFSARLGAMSIPFAEASAEAQAAIEAEVRALVTAAHARARDLLAAHEKELHALAAALLKEETLSGQQIKDLLAAAGGGPELARAAEQ

SEQ ID NO: 10377 - protein, 259 aa, Chlorella protothecoides
MSLNYTCTVLQIADVVVARAEAGKNYGVVLVPEGLVEYVHDVSALIVELNELLAKDSADPHDLPAVAASLTPPSRAVFESLPAGFKTMLLEERDPHGNVQVSHIETEKLLIRLVEGELAARRASGRYAGKFAAIPHFFGYEGRCSLPTNFDASYCYALGHAAASLVGGRRTGVMATVSDLQLPAARWRVGGTPLVAMMCLERRKGAVKPVIRKALVDLNGPAFRAFAAVRRKWGLTDCFRSPGPIQVGTVISSWPKRER

SEQ ID NO: 10378 - protein, 68 aa, Chlorella protothecoides
MHTDGPITARFHIGDAPMDVQAAADAGAVPLGVTTGIYTKEQLLVAAPSATILEGLGDLSKVMDILRQ

SEQ ID NO: 10379 - protein, 418 aa, Chlorella protothecoides
  MOD_RES (182)..(185): Any amino acid
MNGKRFAWQGVALLPFIDEARLLASTRPLEGALTPEEAFRNSRRLEQVYVAGAHPLAPELVELAEGGGGGAAGGDQARAAARALDPELSQGMGGEVLAPGGEACPAVLPAPFGLGPDVSPNAVVCAAYRLPPHAKHVCALLPGAVEEPAGAGPSALPGHHPQGEDSCLHPRSNPAGAHRHGXXXXKARTHACTPVPTRQEAIVTAEDLQADKPLWHQDTRGPGRGGGRGGPPHGMHVGDAARRHIAAGLPRQQQYGQQQPQYGQQQHYGQQYGQQQQYGQQYGQQYGQQQYGQGGGYAQAAPHPAYAGQQYGGGYNPPPGPRGGGYGGYSYGGAAPRQPPQYGAYDATPHQPPQYGGRGDGAPSRPMQRFGGGHQAWGGGSQYPGGPQYSSDARGRPPPQAPAPYDRNNPYSALQRRR

SEQ ID NO: 10380 - protein, 121 aa, Chlorella protothecoides
MPRLVSFDVDGTLIKSIGARANQLHREAFTAAFKQVFGIDTTIDVIPHHGSTDTLILVAVLVVHGIPKAEHDGRAAPSQAMASLPALQQAMNSYFAANIDRAGDGLEVLPGVVDLLKALKV

SEQ ID NO: 10381 - protein, 181 aa, Chlorella protothecoides
MEAPGMQHAFPVSHLPSLMNSGVLAPVARGRSRVHMRAQGKLWGDVPRAGLCFKAWPHSNAQPRLHAMRSSPVRLPPPPLPFPIGRSMMVCRAQAQPAQKRVALGGLVGAAVSLPSLLATHPALALVDERLNGDGTGQILGINDASLFWVLAIVFGLVWAAYYNSQRDLGGDKGDDSGLTL

SEQ ID NO: 10382 - protein, 202 aa, Chlorella protothecoides
MKTPPHIHPLQERFPPELLNRLDDIVVFERLAPQHLHAIAELEIAALARRLEPLGILGLTVRAGHACSRRPGGVTQMHPTPEASLRCHAPPNPSTPHPQASAELRAFLAREACADGRGARGLRTLVSGLLADAVADALLTGQVSRGQGVHLTLVADGQVGVQSLPAAVAPLENNVVPAAPTAGSVPSVERRADRGQDAWTPA

SEQ ID NO: 10383 - protein, 309 aa, Chlorella protothecoides
MTGLPGAAVMRVAGGDTLHGVSAVGGGIGLAVTLGSMPHGQIDAAGVTCVLLTPAARSPRPIHPTLPTIQDRIVGQDAACQAAARALTRSGAGLRDPGRPQAGLLFVGPPGCGKGLLAEALGERRFGGSVLRLDMSECGQRHSVSRLLGAPPGYQGYDDGGTLTEPVRRVKVAGGTVVCVGRPERAQGCESRRAAAETSSFTPMMHEQRRCSCGNLPHSINGPPFQPPQAPAPLPGHPGQHREGAPARAQPPAPDPGGRKAVVILISTSHEASGRGGLGFEPAPASQAEAEAAAAQRARREILDSLKAS

SEQ ID NO: 10384 - protein, 286 aa, Chlorella protothecoides
MPPSCAGPDSPRMGICVSLPPHHFLAPCPSLQKCEERFAKSRMVHSIMRHVAETCGVELDDLYSQVGWPLYRLYGHAYDAFRGMIPDPEPVLERLRTEVHSGETPAVLTPAVLDGILKNIKRRMTPQPIKIRADVEMTCFAYDGVEHIKGAMRAALAQSSEECEVSIKLVAPPLYVLTTQTLDKARGIEVLTAAVEACKASVEAQRGSLRVKEAARAVSEKEEKLLQEELEAAEAANRCPGLEPPIDIPLANSPRFDREIAGDDESEEDFEEGMSVDVDAAPALAM

SEQ ID NO: 10385 - protein, 117 aa, Chlorella protothecoides
MPRSRFYESRYPEMDDVVMVQVKSIAEMGAYVSLLEYGGIEGMILLSELSRRRIRSVQKLIKVGRQEPVMVLRVDKEKGYIDLSKRRVNPEDVAVRVLGTWRGFVWLLLFEGGEGWA

SEQ ID NO: 10386 - protein, 176 aa, Chlorella protothecoides
  MOD_RES (170)..(172): Any amino acid
MAMQCTLYLTTPRGALLGRASRGCAPSLTPQLRTVPPTRTCIPPRHRPHASNGGALDPEDLAGASTGTAQPSLSRVPAGQGPARSLSDVVDAGINLPWPKLASWAAAAFTFYQLREFFGVRGAESLWRRGGRTDGNLSVPGGSKTYMGGDGMLGACHSPQLRTPSTHPSXXXGAWC

SEQ ID NO: 10387 - protein, 236 aa, Chlorella protothecoides
MTRQGKRAREHSRTPRSPDKVSRQASEAPLPTPAQDQGPTAPSTEHRLTRHRARVSGETPLPAQPEPERLAHHQPREGAQADHQPGMDRKSSAGMHVPLHPPVGLRGRPCSDLAAWSLASPPPQKNNSPFTPQHEEEEEEERLQRGHSALQGLLRRLGAGFEDVFHTGASSAAGGGAYHPGNARVRAALGQLRSHDAGEQLAGLAELCEYLAVSTEESLLTFPVDTAVPLLVSVEG

SEQ ID NO: 10388 - protein, 129 aa, Chlorella protothecoides
MERFLLIASSEDVTHAINYTELDAVSHVQVAQALPGPAARGVSQIQVAQALRGSAARGVPALAATSRLHTHRHPRQVIGTARTQYLGVALQKVLRQYTNAAATFTTEILSFTSRFAIQVLFGRGGGRGI

SEQ ID NO: 10389 - protein, 318 aa, Chlorella protothecoides
MDESALDAHNVHRFRTMSHAALQKRIWKIRRPEKLRSFINRSPKIDGESPKATGTDTAFALCLPRRCWKASRRPSSRKRLGWPWANWKGVESYSEKRYHGPDPARLAQTGTPAAALECACHITWHSPNSASSCWGPAPPSCRGGDLTGTAHRHHPAQLLTPHPESGQAQVPSLQHCGGLAQRAQRAPHGRQVDGQRTARHAHRQAASAHLALAGGGQAIQVGRGALVQAGQGQGFLPLVAPGTGRLARVVDAVVRVAGFLAPQRVGGALGVGPRGLQRQPVPGVGAAGVQPRQQRQRVLVGQGGRLGAQTLLHFPEEV

SEQ ID NO: 10390 - protein, 431 aa, Chlorella protothecoides
MLGRWAVHGTRLSRACTGRAFHCTPPTRDRIAVGISGGVDSAVAALLLQRAGHDVQGLFMRNWDEGEETGNRNCSVEADAAAAARVCRHLGIPLAEVDFVSEYWTRVFEGFLAQAGRGLTPNPDLACNRHIKFDLLAERAAALDCGALATGHYARLEPGDPPRLLRARDAARDQTYFLASVRPQALAYACFPLGGLTKPEVRALAAGAGLAEAAGRRSSAGICFVGRRRFGAFLEQYLAPLPGRYRDVDSGADLGPAANLLALTLGQRASVGGGPQRAYVAGKDVCARVAHVASGPDHPALRCRAALLRAPHWLDGGAAAAALADGGELRCLYKARYGQEPLPCTLRALGRGGFRTSALCTLLEEDERIGPGFLVAHFDEPARAITPQQAFVMYDGERCLGSALIAKPGPSLAEEAGGGCLDGACPAAADA

SEQ ID NO: 10391 - protein, 86 aa, Chlorella protothecoides
MAAVAGILFTEAVGLPPWWKAGAEQYPIDNKTLILVEIATFAVLEGLRARGWEKTGEVRVLKQATVFELCYLCKGRKGESVVAGHV

SEQ ID NO: 10392 - protein, 125 aa, Chlorella protothecoides
MSYAPPRPNGRTRAQAEVTDNLSPAERHIMEMAKREHRDTTAAAKRAAQVSGGGVGLNLHVAELQGHAAVLGQQEDPPSLHIADETVDAGRNTLVEIHRQGEQLDHIERGLDHVSVGVMCSEEVV

SEQ ID NO: 10393 - protein, 263 aa, Chlorella protothecoides
MHKAPSAAGATTSTPPPPPFIHNPTFLLQRQQKVELLQKLLDALHATKLLQGRAELIDARVPIIKCCMAAAGGLHVDISLGTANGAAAARYIRAQVLAMPPLRPLCLVIKALLRQKGFNQVFTGGISSYSLCNMVRLWSEGYKLGEVPGDPGEVSSELEGVFAFLTDLHCEGLHGESAGPGPPGASTADLGRLLWGFCNLFGYAFRYSHQAVSPARGGICKKIGPWRQDHRGWLLAVEDPQQMGKDIGSGSYEIRAIREMFAE

SEQ ID NO: 10394 - protein, 455 aa, Chlorella protothecoides
  MOD_RES (291)..(294): Any amino acid
MGRAPGKPRTSLQGKIQAGLKSEASKPAQPTKDALGTFLSWALQNANRASIEWPCIERMLGRSHSLFVPLHDTCTGVSGVGSKESKVALFEGQDVDSRGLVAVKGLAWSAPCLQLPIPPCPQHHTRAQDVKAGEILLRVPARLAITDADKDGPPPPYPGAPWSLTLASRLLSLREGAAGSAWEPYLEVLPRNAPSPWLDVTWEALQIVQYPPARAELDRLGWIVHEGIAAARAQGASWSTADFHWALGVRPVWDGLACCVESPMGAGVSCCAWIGVAHHAQNARPRNSPPXXXXGARPTSTGRWGTPDPGTLPRSIIHHHPSPLACEAQLVHSRTFGSAGKRGGVGVRMLVPLVDMINHAGDETPESWSPGAEPVSRDNARCRGARGGQVGFQSCGAHRTNGTSTPCLLPLHHPQMGHGAAAGWKVDRRSVCHPGHRRGLRAPALIRCVEALWRL

SEQ ID NO: 10395 - protein, 131 aa, Chlorella protothecoides
MSEVDPGAAAHCTLELGWTVGYQAGSRSSHRRWAQCADTAQAPLALIYWRGALPSSLSIMLVLVIGDLHIPHRVPDLHEKFKALLVPGKIHHILCPGNLCTEVGPGQRLFLLNASWDVHLADSNGPFLSSP

SEQ ID NO: 10396 - protein, 134 aa, Chlorella protothecoides
MAAAGTLPCGRPQCCLPSPPQQVQTYGQFRIGMCHGHQIVPVGDRAAAAILQRKLNTDILVLGHTHAFQAYKHEGRFVINPGSGTGAFSTITPDPIPSFVLMDIDGPRVTVYVYELHGEEVKVDKIEFSKPASL

SEQ ID NO: 10397 - protein, 294 aa, Chlorella protothecoides
FYASDNELHRLFKSVNGIIFPGGLTDIWLDNPYVIAARKLWTWAREANDAGDIFPIWGTCLGFQLLHVLEANVSFTELLIRTDSVGHASTLDLTEAAPSSALFGGISPHLARKVADPALNITMENHYFGLPPEHYQRWGVLGEAFTVVSTTRDRVGVEYISTAEHRRYPFFATQWHPEKPPYEFGMKAIPHSLDAVLVSQHLANVFVDTARRSGHEPESHEEELVMLIYNTKPYFTLKDSVMDRSYDGPDMTYFFDSKDDAPDNGLRGAEPRGSTSFAGRVYRGQEAPHLTAWA

SEQ ID NO: 10398 - protein, 531 aa, Chlorella protothecoides
MDDEQEATWRACGSHLKLHWLSSPRSVLLSSKPTPSLAPRTVDAVLWLVRRGLTVWVEPGVYRRVRAAVGAALADPGAGPPGSGDEGLSSVGSGDVAGSPGPGCGLDAGRPPRGPGSAGAGGASTPNLCRLADDQVDLDAALRTWKARRGCWGRGRSGQAGEVGEEAGSGGEEAEEYDDSEPLWGDDHEMEQSDGHTAAQRRSSTASRSAPPTANPYADVEGPEPLPARVASAIDLVVTLGGDGTLLWACSLFGDAPVPPIVAFAMGSLGFMTPFPAARLCTVLSRVASTAHGFPIMLRHRLQAQGRCAADAPSSHIHIKLCDPSPPPKDQQHTASQGTVLREAAGEAACPSPPLMVLNELVIDRGTAPSLTNLHVYADGAFVTVVQGDGLIVATPTGSTAYNLAAGGSMVHPGVPCLLFTPICPHTLSSRPLVFPEHVALTIVVPREARAGVYASFDGKHRARAGVYASFDGKHRVLLAPGDGVAVRASHFPVPTVCNLDASNDWFRSVRDGLNWNARVVQGAGEKAAKA

SEQ ID NO: 10399 - protein, 120 aa, Chlorella protothecoides
MSLSSSEADDFPDEETSPTTFGQRLVGFASGFGEALARTAASATVLLSDAQLRRQGASVLSAGASKGLRGVQSGVVAGVQRLQAGPKQLRAALARVQQRIEEERLAVLLRVRWGFLLGGG

SEQ ID NO: 10400 - protein, 103 aa, Chlorella protothecoides
MDTSGPGIFRTSHRAHIATRRAGAGASARLAMTSAARLQALWNHPAGPKTIHFWAPTFKWAITFANIADFSRPAELVSYPQQCAVTATGLIWSRFATQIKPVR

SEQ ID NO: 10401 - protein, 478 aa, Chlorella protothecoides
  MOD_RES (269)..(272): Any amino acid
MIGEAGVGAQCYCSRCSSRPVFNSRSQAGADDLSAELHPLTVGTGMGAGQSKENHAIGSNGASELSTSEGDSSCPVPESLRVKAVYNVYNQRIDELAPAKTEILDPSNNMPAEPNQQPSPGQKKLLSTQRVVSNIPKGNTESTWVYPSPQMFFNGTCGLRRPGHLFRPDTRPHRCCSTAEGQAYTLLARLPVVSLSPCPSSTHALVGSPASQGKGRRHRRGRHGLCHPRPQQHERDHMEPCDGLGIAAPGSLLCALPAQSIASILILRXXXXGNRCTGITAVRPPCSGSGDGQMTSGENGNRGGMGSDAWKPPRLFHLPRVCECTCCQRVWRHFPDSSSPPTPRSPLARIRSWFGGPLPFDRHDWYIDRCGQEVRYVIDFYFKDELAGRHRGCGSGENGLAPHAIGTWAHNLIPEAFELRVRPALDSLEAGLDRVKMQIYTTFAQYGLPCPVTGHPSGAAAGKMGQGPGPGDHAAGSQ

SEQ ID NO: 10402 - protein, 312 aa, Chlorella protothecoides
  MOD_RES (54)..(57): Any amino acid
MPLPCTNRCQKQVAQVARGRSWSTKWGGRRNKRCAAVSPGCCYSPPEGLLAAEXXXXVDQMGRQEEYTMCCCVPRMSSQPTRGVCSQPNTCLAWSNPSVRPDVVRQLPDLEDVVLRHRGHHPLVRGIEGKVRDLGSVAAMDEEQLRRAVLGVLRRLRVGHMVDRSFVAAPSQHPWPGRLQAAHWHSNPCGTQGAQHAMPLQIQPQHPETHPLPPPTHCIPPRAPTCSSPMRARSQTMSRRSAPELASTVSWWGLQPTWNTSSLWDSSRCSLRDVLRRSHSATVRSADPVARMNSLCGLKAKQLTSAPCASSD

SEQ ID NO: 10403 - protein, 467 aa, Chlorella protothecoides
MAGGRSPGALVWGRATGRGWSWPAARATGSPEQTPRTTSTSSQRESLILGRARPTEQTDRHGWGCPTCELVCYVMTRFHTSAPQVLRIRLADALSSPPHVSPPLPPPKDPLRLGSVPENLTRFQEGELINGRWAMLGVAGEMGASGKEGTKSSLVQCCRSSFSSHQPCRRPRTTGILGAELLGQGDWYSAPLPVINGEPATYFGVPIPLNLGELSAIVSEAGKFESCPASNARLVLDKIRPWCEAMPSTHEVQGSVHIPRHLVHRAGVHRHRLRGDPQERRRGRASHLAWWSVRPPGAVQGQPGGAQDQGAHWTTVRSVSWASRLCLLVRKAQPPLGPLCCRRRSRTGGWPCWPSWGSSPSTQPMGSAHSKPWAHTSATPGLKCGVDPGWLFMWDSSSSSAPSLKSLDEGLKLSCLGMWTLDSSTYPPFPARSQQLCDKQRGGALRLWHLSACWLTACSLRPLPSPC

SEQ ID NO: 10404 - protein, 322 aa, Chlorella protothecoides
MGVALQQSSSKPRAHTCAAIAQNPGPPAPQAAVLSAVCALLPFIPTYAVALPGSGLLAAQGHIPGAIVLLLVHWGAYYLGDTLILEDIPGGHPYLLSLGILGGIWTFDNPFQVGSVVLSSGLIAGLAHPVPHCDNTQLLIQAEAGDVAVPRLAAPRTMGSRSGSHPNHVPPGTNPPISTPKYSGLPLWPHPALPAVGLLQAARGVHGHGQRRRRAGRAGVDHPPRRRARPLCIAIRDEGRGAGPGTALPASPSPAAHPAHAASRRAQGAGAVTSRRLRGQGACQSPCPSRHSLCREWGLRIGHLPLEGGFGARELQLWVSPP

SEQ ID NO: 10405 - protein, 211 aa, Chlorella protothecoides
MQMKEENTEQGVSKQQLILGTHTSEGEQNYLMRAEVSLPLEETETDNRGYDDERGEVGGFGGTTGRINIVQQINHDGEVNRARHCPQARLMRPLTLFSSAPPSQNHFLIATKTVSADVYVFDYSKHPSKPAPDGLCKPDIRLAGHKNEGYGLSWSQLQEGYLLSGSDDAQICVWDVKGTTQSNRVSGGGRPGPRKTVLVVQVSCGVCHDAD

SEQ ID NO: 10406 - protein, 189 aa, Chlorella protothecoides
MTVQPLATARPCFARALGAGPLVGPRPSGTAQGWRIAAEKTESAPKKKVVDRPIWFPGNDPEIPDYLDGTLAGDYGFDPLGLGSEPEQLRWNVQSEVFHARTAMTAVAGILAVSILHGANPAVPQWYDAGKVYLEQNPNVSLGALIWTTIALSGFVEFKRLADWRKPGSQADQWFLGIQKEFKVSQGVG

SEQ ID NO: 10407 - protein, 86 aa, Chlorella protothecoides
MDFTTMRRNLAAGHYTSWDALEVDLQLMFRNAQTYNPPGSEVHGYAAGLAAVTSRMLDMARAGRTDFRAAAASEARRANAAARAAE

SEQ ID NO: 10408 - protein, 113 aa, Chlorella protothecoides
EAGDGADTAGSGPARGAGGEVGDGVPRREALEKILSRVQKKDTHGIFRDPVTDDVVRTWMMCCMTVGRGGGVRGPGRCVTGVVFGMVLAEVPPGARHPTPMIPWVHARHLVSV

SEQ ID NO: 10409 - protein, 582 aa, Chlorella protothecoides
  MOD_RES (335)..(337): Any amino acid
  MOD_RES (371)..(374): Any amino acid
  MOD_RES (397)..(400): Any amino acid
  MOD_RES (470)..(473): Any amino acid
MAAGSMSGESEGGFGKGHCLLGAAAKHRDPVPAIAAPNHVQCIGTLCPRLLCQITSYLAPAREACEASLKRLGVNYIDLYYLHRKDPATPIEETMAELKVCLAMVGPGPTGGGGKDPPHRRERAYCQRSSQGACHSSPHGPPTGMEPFHPGRRDCGNAWHATADWLQRAGLAAYHAQVLISSLHGSHRMKSSLSAASWASASLHLLAHSTIWNSSAVDSLAQRLQGLAYHPHSTATDSPLGRGVLSGQIKSIDDLGEDDWRRTQPRFQAGAFEKSPIAYPTPPFALSRTWNWSSRFMSVQPPRASRRVAGLQHLAPPNHVSPLYPVRPACARLAXXXLPRASRRVAGLQQLAPPTMYLRSAPSGQLALAWXXXXVGERYDPVLMQVRGDGSKPVGWXXXXLAQGEDVVPIPGTKRLQYLEENLAANEVRLSPQELKELTELADAAQVVGERYDPILMQVRGDGSKPVGWXXXXRSDQMEVTGLMWEHGRPSGTGDTADCEEHLQHALKQSSNNVLPAELIQWLKDLLEVISVQNPKGTRKNLESAASFSLEALTKALPCDVLQYQGWIPNSCDHEASASKYV

SEQ ID NO: 10410 - protein, 173 aa, Chlorella protothecoides
MKACEIWFAMDPAFGLEIAGMSWGYHNSGPPAGTEEDYINVRPGRPGSRQVIHKAIESGCMLDTSDIYGPFTNEELVGKAIATIPREKVTLATKFALYYKEDGSMAVDGSRKHVREACEASLKRLGVDYIDLYYMHRKDPGVPIEDTMAELKVRAGRGSGQHCTILIIDQRSP

SEQ ID NO: 10411 - protein, 295 aa, Chlorella protothecoides
  MOD_RES (166)..(169): Any amino acid
MKLVEAVKKLADSKDATAGEGGRVGALVASALPNGIACAPPRRCHGPIFCVAHRPCASRCQLALAWVLAQGDDVVPIPGTKRVKYLEENLGALDVTLTAEDLAELARIADPSNVTGARYSEAAMKASLALVLVCLSRGHPGGQLVQGLSRYLTSAISRFGSSYFQXXXXLSRGHRGGQLVQGLSSYLTSAISRFGSSYFQTTFHLTDGLLQKEQNEYLVALHAVSITVELKGRWTPLCSTQESHYTSTDPNTINAEIILPPQNLVQSVLATGKYLQSRHDMLSIGVECRALGSLK

SEQ ID NO: 10412 - protein, 176 aa, Chlorella protothecoides
MRAHTRYKYKLASTGMDALARAPTYEYTTLNEIVGHLEERQVSQSSGAFRPRQYYPNIYLVALECSTVHQCRGGTGTLDWETKEACRDHINNTHQTCIPTDRYCSLKVIDPSCAENPELQHGVEFRCFIPPGNPGPCLDKPGDILRLHRVKVPHVLGVGVRAGGRRTAASHTTPAS

SEQ ID NO: 10413 - protein, 284 aa, Chlorella protothecoides
MSGLDHLLALLVAEATIAMHALCWFRMGSAPKKFARARAGGISRPLAQGIFAGGRASPCASTCSQLDTYATRSITYLWQVSRCGAAGLQAPRLSRSPGLSPTPGHGVIFRRHRPVVRDPRAHGRRAVPAATCNPFHPGPSPLPARSFAANERTFLAWLSMATTLGTVATAIAGFSVEDGDASGRKSSISPRTVELISMLLLPISVGMIAYALFIFYSRSENIRKKRIGFFDEKVGPLSVAIVVMISLTLILASAIKDVCAPLLYSVVRTVALSSMLPWASIDEK

SEQ ID NO: 10414 - protein, 379 aa, Chlorella protothecoides
MHGARMLRAERTLFLCEPLVLFAPPIKRMPGLLLVATPHTGRALRAAPTQHLVLNREPSSQAHNIALRFSAPGSLLLKSPPRRTLSGFVRAMAKDQDLNPANTSAYVQVCSMNHGGHAPLSDPPHGASLMSFSRFRVNCVPCRSACARTETEPPASPFPKLQVLGVGADAPSSSPSVLLFFDRQRYLFNMGEGFQRYCVEHRIKLARMSALLLTRVSAATAGGLPGSLLTMADSSAGGLLAGQASMALHGPPGLSALVNAYRTFVNLKDVGLGMQELQHAQPAVANELVTITPYLLTAGEAEGAAAAGGEVSALGAGREGPTSTSDAEVTAGSTREAAGKDGEERAAKRLKPGEPGPGAVACYAAELPDIPGKFQPQKV

SEQ ID NO: 10415 - protein, 410 aa, Chlorella protothecoides
MSSLHQAAAWNAVTASPTSAFLLADHAGSGKTLAYLLPLVQRLKEEEQRLGLAAVTRTNSPRVLILVPTTGRPAVVARSPHNKILHPTLVTLPPSPSPSHPPHPELCRQVVGVCRRLSGAGFPLRITGLTTSAGKDSQLAQLAAGVDVAVGTPARVAGMLEDGSLGLAALSCLVLDEVDVLLGNTTFPEQVEASLAAPGASDAGLVVVTASLPGDLHDALLRRWPGLRAVTGPGLHRPAAGVEERLLDCSGGEEVSEESGFARKADALARLLAGSRAARTIVFCNKVEGCRAVENFLKRRERAGGARVLPYHTAIAPPLRKANLRAFLAAPGGGEGEAPLVLLATDRASRGIDSGLAEHVVLFDFPRDPSEYIRRVGRTGRGPGGTGLVSVLVLGRQVGSGLCWGAAGSG

SEQ ID NO: 10416 - protein, 156 aa, Chlorella protothecoides
MFYLSRSVDAFFLNQAVPDQVIAQKVSQVVATGVRCCAYLATFLVGANAVGLAGGVESAATWSLGRVCGAWWGVPSVHRALGDGDVEAGPSSVSSLAAYAGLTVQLLLFGPQEDEGAAKGGAPGGPSLPKVSVVDDIGAIRRAFAEAEEQGRGERP

SEQ ID NO: 10417 - protein, 149 aa, Chlorella protothecoides
MQACAVSRRMQSTAAVTRLNHLAIAVPDVRAAAAQYQAVLGARVSEPQALPEHGVTVVFVQLENTKLELLEPLGEASPVAKFLEKNPAGGMHHMCLEVCNVKASMAAVSERVRLLSSEPKIGAHGNPVVFMHPKDMAGVLTELEEVPRS

SEQ ID NO: 10418 - protein, 278 aa, Chlorella protothecoides
MGAVPRCHAPCPRSPIKQVEACFPCVGTALPVIFPRAPAGPGATALPYPSVGSWVNLRNVGARVVDGQLQGFVTGRSKWAPRRDAQAVILPALHTRVAANAVAGATGWSLAGRDGVGLGGVDGDGRAWPKLGCGCAAVAGTGEAAPACASWKLRGSLDGPRPRDAQTPHQAKPCADWSLGAPVVATPVDAERPLDTLRTLRVGPAPARYRVRAQVVEFCPREPTAMWQRGTEEEGLGEWGTRGSSVVGQGARQRRGRACMQLAPGGAGELQHAPLSAA

SEQ ID NO: 10419 - protein, 136 aa, Chlorella protothecoides
MPTAGPEPGALPTLSLDRSGHNAYNRGGGRGLRKGQEPRWKRREGPQGPGPPGNSEGRRPFRGPPGRREPVDEGREPPRPADFFAASSFEDLGASEDLIRALSKTGVTRPSHIQAWGLWGDALGVGCRDSAAADGF

SEQ ID NO: 10420 - protein, 439 aa, Chlorella protothecoides
GAPTSPQEGTPTSPQEGTPTSPKEGDPAASEEGDPTSPQEGIPASQGIRRPCHRTPNRLLLGSRDIESRPFTRAGTPRPSSGLRCAQLDGLGSWDSLVAFARPGSHCRGLGPHLCTLTLALVVFIGQSIFIYDTPLNCCNHYNVAAGRNTSATRLPRWGAHKEEKHTLQPGTHCPPYLEMGPSSCVCRLGTFGPRPVALLWALLVVRHVSLAAADAATITLNFIECIDSSSEGTPTNVITCTASVTASEMPLNAYWIDYTWGDLQGEVKIGAKQLTSFITWSGPGTSIEGSAYAWYQTLNGTYIRSTRIPIAPFKSPPPPHPAPPPPPPPPFPPSPPPPEIAVFDYAFCRRIYSERIYCTIYMTFQQLPTSVVLTFKMADGTTVQEQPLTNSKTMTYTAMFVGFSPFGTVEAILQLGTVITVGPYPISDDSLPPPPPSP

SEQ ID NO: 10421 - protein, 1837 aa, Chlorella protothecoides
  MOD_RES (423)..(426): Any amino acid
  MOD_RES (617)..(620): Any amino acid
  MOD_RES (1295)..(1297): Any amino acid
  MOD_RES (1396)..(1399): Any amino acid
  MOD_RES (1574)..(1577): Any amino acid
  MOD_RES (1698)..(1701): Any amino acid
MSYPSASQHHALFLKSGPSSSVDTACSSSLVAAHLAAATLTRGEATGAAVTGSNLLLDPATMVGIARLGALSTSGRCLSFEAAGDGYGRGEGFLAAALAAGGGSNAERPPHALAALAASAVNLAGRGSALTAPNGPAQTAVVRAALAAAGIRPGALAALSVHGTGTALGDPLEVGAAGAALGPGAPLALLSTKACLGHTEGAAGLTGALGALGALHARAAPPTLHLCVLNPHVGAALGAGGGSFSVLLPRQRAPLLLPRGAAGTSSFGMSGVNAHAILDAGRVAISDEVKSGARDERLMERRRLWPRPAPSPALERALAEPGTVRFDVLLSQPGLADLLDHQVRGWGVGFLGAGPGTAPGRHESGADGLGRGYACAWKSHCTRKGRAWRTAGGCDPAIPSPPRRHRTAAPAGTGGKREHGVWXXXXKGRAWRTAGGRDPAIPTPPRRHRTAAPAGAGRKREHGVWRAHHRRRERRHRGARHGGVLACTTLSSCAKPCAGSSPLRHLQWPIGSLQWHAGLPGGWRHSACRPPCSQGGRRAAPGRHDCCQDDGAGLLWCRGREPGNPAPLAASQGGLGGGRGLPGRRASGTGICQLRDARLQRGAAHKSTEQAPEHYCXXXXDHEGSGRSSGAQEVAHMVYITQWQAQDAGVAAATSRCAALMYAAAIRHHQQRERIDGARQHANLHPNKSAAQETLWLAGDSAFNTAQPAAALALLQTLSLGVGPLTSLSLWGCSLQPQLSATGAMARVAARERPGGIQVHAAGGDLHAVGSRSFVRPSGGPSIIPPHNDDDADDDDDGYGSWRGAGGVRMQPRLLPWVGPGEALRGNDVGASHGVALVTGGLGELGGLVMRHLAMTGRHTAIHVLGRRRRANALAPLESTSLTSATLEPTLSLFHAGGVLADAPLAAHRPAQLRELAAPKAGAGIALLRSTSVLPVLVTALFASTSATLSPPGQAGYAAANAELGALAARASDRGLPVLSVQWGAWVVGMAARSPALLARLDRIGVGLVRPAAGLRALQRLLIARPGGAPPDVLASPFHWGRMAAAGEGQVRPAVFELAAEAQGERQGAVRHEGVHTNDPANDCQLQGVDAGGTAGRDPVGPGDPPADGGAWLCCRQEGVPGVLDAREGCYAGRGAHNSTAGLQAHPTCPKPSITCAQVAEDTTFAEAGLDSLAAVEARDMLARRLGTALPATILFDTPHPAALAAALEEQLAERAEVVPMGAADGLAALAGSPVRSTSVAIYTTASRFPTPVGNSPGAWAWIRVHAFLSGEKALAATVQLQQGQIELRMVTPLXXXLAATVQLQQGDTESRMVTPPSPTPSLLPDHDRCCGPGSLVAISRRRGGRHGPPAPHPAGAGGSEPAGAGRWHAGGQGHDRPAQPGPRRPVILPHPSTLXXXXCDALRGCTMWRQGLRSLDSDAQSSSLTLSLFIQNLPNLDHPGVYVGSMYHEYAGVAARVGAAPSPLAVTGGGPSFLAGRASFAHGLGGPCLSLDTACSSSLMALALAADALRLGQASVALAAGVNALLDGATTAAICLLGALSPVGRCRAFDAAADGYGRGEGFVTLGLGPLATXXXXAAADGYGRGDGFVTLGLGPLVTRDEHGTLLPPPLARMAGWAANQAGSRAALAAPSGPAQTRVVRDALRAGGLDPGAVAALSLHGTGTLLGDPLEVGAAGAALGAPGSSPPALLADKAMHAXXXXRRGSSAGRAEVQPAGAAGGQGHARAHGGRGGPDGHAVRAVHAAGPQPGPRPAPAHPEPARGGRARRLGTRPGREGGRRAPPPVRRAAWERQGPGRRELLRHERSEHARGPGTSRQACAGICRGISLGGGRRCCMED

SEQ ID NO: 10422 - protein, 249 aa, Chlorella protothecoides
MEQPIRQAGFLTEVESFDLSLFGMSSLEACLVDPQHRLLMEVSMVITKESRALARAGLGPMLWLPSLCHRGPSSAPNTLNTHCEPQASPRLPSPPCNPCLPGVLATAGEGLGLQPLGLCHLGARRHPADGVRGPVSAPPDLHRPLHRDGGQPGGGRRAPRLPLRSEGPGRRRGLRLQLGAGGAAPGPAGNEVGCSAGQCAGSWGQPVPEPGDVCGGSGGRHAQPPGQVQDPGRLSGRLRQVGKDHGVQA

SEQ ID NO: 10423 - protein, 730 aa, Chlorella protothecoides
  MOD_RES (58)..(61): Any amino acid
  MOD_RES (82)..(84): Any amino acid
  MOD_RES (144)..(147): Any amino acid
  MOD_RES (210)..(213): Any amino acid
  MOD_RES (375)..(378): Any amino acid
  MOD_RES (521)..(524): Any amino acid
  MOD_RES (657)..(660): Any amino acid
  MOD_RES (684)..(687): Any amino acid
MESGRPVLEHLTESMSESPSDKCIRMHTIVRESIRQVHTNAYHCPVSSARQAGEHKTXXXXAFVATASALLEAVLPGTGGGXXXIHSLHHPLEGRALEARGAAALAAARARAPPRPSLQQRMFDAFVATASALLKAVLPGTGGXXXXTSCQPDGSALSHPARLDAATHVLSSLPRPVHGKPGGLLMPVGIRAALSTASAGTGLPRSGDAXXXXGSTAGGAAAVGRLEDAGQRQENGRRLHTSCQPDGSALAHPARLDAASHVLCSLPRPVHAKPGELLMPVGIRAAISTASAGTGAPRSGDANAGWATGRGQAQLLDTVLADITLGQSDVTLSSFELRVRDGVRMGVMRNTGCVGVHDQALAAVHAQFRHHLRSXXXXGWCENGCDEGRRLCGRAWPGCGSCPCPMPTPPPQPATASIRPAPAGIPDATASPTSLRARRSEPEPAIPAMLPEDPAAPSLEDAVSSTVQMVVEKLLGAAIPADQPFAEAGLDSLGSSRYKFLLGYASWLSTPAAAPQQQPRXXXXWYWCAWLHSQLKQWLEGAPASTSCLAMLHGCQHQPPPHNNNQGAVDLRNDLAGAFGLDLPATASFDYPTRDSMRDFIVSEMIEVGRTVPDWGPGPLTVQSIMTEVCGGERRRFVAGASCTVVAVRVTFAVMGXXXXHSQDRQPALPPHILPPSVPGAPPXXXXERRRFVAGASCTGVALRVTFAVMGIQVWHRAPSNDCLFHSVSS

SEQ ID NO: 10424 - protein, 663 aa, Chlorella protothecoides
  MOD_RES (58)..(61): Any amino acid
  MOD_RES (123)..(126): Any amino acid
  MOD_RES (302)..(305): Any amino acid
  MOD_RES (448)..(450): Any amino acid
MDPQQRLLLEVRAMGMQDGSPLCLLPQVKQCRGMCLRDNAWVMTLVPKYSSPPALKNXXXXCRGMCLRDNVWVMTLVPEYSSPPALRNPSAPNLHPSGDTGGLQWRFLLYVVPAPHLNLCACXXXXTHQVTQEAFSGAFSPTSYQPPASTSVHVGIQQMEYGGLSAAWHPLGATSATSTPFSVAAGRISFSWGLTGAAVSLDTACSSALVALSLGAGRVDPGAPALVGAVNLLLARNTSAAAAAAGMLTQDGRCKTLDAAADGYVRADTVAALVLCSPVGARDDGGKRAGPAAVILLRGCAXXXXPVGARDDGGRRTGPATVILLRGCAVNQDGRSSSLTAPNGPAQTRVIRTGLELAGLAPPQLAGLELHGTGTPLGDPIEVNAAVAALPGAIRLSAAKARVGHAEPAAGAVGLLQAAAQLSAHSVHPLVGLARVNAHVAACLASRXXXRTQRAPPGGPCASQRSRGRVPRRPAARAACAGAGAGGRWQGGAPGWRGLRRQRLCLPGHKCACGAGPQTRGRGRPHPKLRHALDAGAALVRAGSPAPLKFSPAPPRQHAALPAGGWRSAGSVPAGPPGGRALRPPRSRHAGGHGGRCGAGIQRGYRRECLCGAPEHQRSFDAASGQGHGGGRGCRCCQGRHAAGQQDCGGRRRDPASRHEPGW

SEQ ID NO: 10425 - protein, 1294 aa, Chlorella protothecoides
  MOD_RES (79)..(82): Any amino acid
  MOD_RES (866)..(869): Any amino acid
  MOD_RES (1083)..(1086): Any amino acid
MPAGRHGGEPGRAVLGPHRALRPCPGGRGSRRAGRRPLDPGQPGGGGAARHGHRAGRPHRAGGVGRPDPGPRRPGPHRXXXXGDPIELGALAGLIPARAGPVLTAAKSRVGHGETAAGSTGVVHALSQMERGAYAAITHLRGLNPHVQGAVGRRAFLLPRQEAPLNRTEGARVAGVSAFAFQASCQGGTNAHVLLDAPSGTALDTEAILPPIPWQRQSVWVSPAAHPWLTVASIGSSSRAASFHAYLSPSWSFADSSFEGGSILLPGIVIGLASAALMVLRPYATPTNAGRTGLGSISLPTTFDSLATRIEVGVDFLTATVNVAAAGRNDVALLAGAMQQIGPWRGKSCKRVDPDYDLSCRKGSPILPELLLHGVVKEALPVNLTCHLAQSGKQDSSACTSWRTLDTLVALGQPGHCPHGLTALDALLPEELAGDTSSWASMQAGLDAATLPGCRLKGGCSKPLVRGGQDSLSELLYTTEWSPVDWPQDSDHSARWLALSIAQDTSGDNATPSMTLPASLQQLRGCMLGVTRCQETAAPGWLPPRNTELVVSTEAGLHALLSSSKVQAVLVLAPPAPEPCLHAASMAWAYTAAALCALGSAAKRHSLSLVSQGLLGPAGSEAAAHQALALGVARTQFMEDRGSYGVTLDLGDGVTAAQFRAVMAAGRGTEYVLAVASGRLFSEHLRRHVTPAGPHPALELQLQGKTAFICGGTQGLGLRLARQLSRAGVKSLVLTSRRGKLAAQEDERFFARHGESRFMSGMSVSRVGLKRGGVRFHKCPMRQLELPSAHCTEVFVLSQDASSPAQNADLAHWLASQDLPPVALYAHAAGVLAYDLIPDLTRDAFLAVAQPKVTGKEYPRNLWILXXXXTRDAFLAVARPKVLGAVTGVDAEVTLLFGSTAGVWSQSGAAHYAAANSFLRARASHRVVTLSFGPFSGAGMAASMRHGRLHEVKMEGCAEVLPTQMDVGSCRVRSHISLRPSSISALLSSQRFHGGGGAGDAGAGADPARPQDGAEAGPPGRRRGPPEPPHLLRRQLDQGPLELPGRASGRRAERDRGATAAYLFRPAAGSRSRSRAPTASHRXXXXRDRGATAAYLSRPAAGSRSRLGAPTASHRSDGAARSRAGRCHRGGGRRRPDLLRHVCCRSGWSGTLRRQALIPLPVQHPAPGAFDSLSAVELASKLGQSLGLTLPVTLVFDFPSIPSIAQAVSERLGGGAELPAPAGQAIAAPTQPSDPASTLDQAVWVAAMAALTPGPLHQAFSSDCIGLVPWSRWDAEARPSKVCCLGLGFLIFAA

SEQ ID NO: 10426 - protein, 438 aa, Chlorella protothecoides
  MOD_RES (48)..(50): Any amino acid
  MOD_RES (121)..(124): Any amino acid
  MOD_RES (432)..(435): Any amino acid
MSGVNACALLEAAGALEEGASKDLAWMRRRHWPLPRSHAILCRFASPXXXTLAPTEVPRHPVSLCVPSDGLHQVGACGCKSCAARPHSWEHKVGGETTQWNQVVHAHLLDAWPIDSSLPLXXXXDGLHQVGACGCESCAARLHSREHTGGGETTQWHRVVHTHLLDAWPIDSPLPLAIPYARLEGRLQSPCLAFLLDHVVQGMAILPGAAMLECGLATLSTLGSRGTPLPHGFLAAVSIPAPLPLDGRTSVLSCEADPATGALRVASAAQQGTATARRLHLLATGCRASPATGPPACTETASNPPTAAAALLAGLTSIALLSILDHPPDIHSLAAASETAVIDPAWQVHPALADAALHLGPATGDVGVQESVARTRVVAGMEAAGRPPAVQAGPAMTTGAWVTGRRAPMTPDGTVITDHSIQPLALSVEGLXXXXALP

SEQ ID NO: 10427 - protein, 338 aa, Chlorella protothecoides
MGSSRCCQPKTQLCTAAHSSSRTAADSCACPHSTLASLSTPLSILPFPFLLSHPPKGPCLGMDTACSSSLVAAHLARASLLQGEAGAALAAGTNLCLVASTPIHLAQLSALSAVGRSCAFDLAADGYGRGEGAVVVTLGLCDSHGTARPLAALRGSGYNQDGRSSSLTAPNGPAQTALVRAALAACGAAGADVALASVHGTGTPLGDPIEVAALGQALGSALGSGGGDPPPARGVHLVSAKARLGHTEGAAGLHGALAALACLTLGAVPANPHARSLNPYVASALEAWTQRRRPGIIPRVREGEAEGILGWACAGNSSYPGGWRIQWLLWAANVGGVL

SEQ ID NO: 10428 - protein, 960 aa, Chlorella protothecoides
  MOD_RES (6)..(9): Any amino acid
  MOD_RES (212)..(214): Any amino acid
  MOD_RES (279)..(282): Any amino acid
  MOD_RES (374)..(377): Any amino acid
MAGPGXXXXFLARPLTTLHLGTLNPYVATIFDGEHRRSEDGRAWTVRRQGGAPVSRRGFVVGDGGLEACSMAQPRGGLLAGNPVLAPARTMQQPGLLLHSCMQVRPPLSTPQTLSPLPQPPHKHAATSGTPPRTGAHVRHAATHGGVSAFAFQGTNAHAVLAADPGAELVPAGGVLAHVARPGVHWCLPVWHPLLQRATAPPAGPACVAARXXXAAARHRAARRPRLRRGAAGPARPRFPARPRCAGAQRAAHRPAPGGGGGGGRAAGRAHIYPGGVRXXXXGGGGRAAGRACICPGGFRRPRRGGLPHAPHAGRTVPRAGGPAGEARNWPGRQVQLWCWRLKPQIIRARHTGAWPPVSASGLGRTPTPTSRPXXXXKASNHPGPAHWSLAPGLDERAQAHSHANPPPACAALDCAGRPRGPHADAWADPAAADASLQLAAALTAPRGPLRLPVGMEAYLGRPHASPAHARPAWVAAVRAGCATLLSHRVLCDAGAPLVSLHDNQFASLEEWAARAAAAAAASEAPAAASSRAEAEARAKGQPSHLESKAVARTEPEVRLKLVHIVTELLGGDVEEEQPLMAAGLDSIGGTSVDTIHWSPFPKLPVSAGAVELRNAVASAFGMELPATVAFDHPTIGAMAQLIAGSGVDGGNGEGEGQVVHAPIVPMQGAEGLVGIWSAATRAVGGVAATGGARWDMGAVHERLNGMQRHSRSTRGAWFSTHQVKGGCRALIPLSLPTNPALSLTQPHFSSISRLYKESLGGGGPRQRGPSGALGRRHPAASRRDQARAFEGVIVGWPVVVRCLRWLMRSPPHPHSHGPHHTPSCAVHRAAFCGVDLGGGQLRRRAVPAIHHRRGGPGPAVPAAAGGGGRGPGRDATGLSPRLGGRLCGVGLDRVQRAAGRPAGARHHRGPDGQRAELPGRPRVLHPGLPRWDDGDVRPGRVDESHCQPGHGADPCCERQ

SEQ ID NO: 10429 - protein, 368 aa, Chlorella protothecoides
MPTLPPSHHPQASAMDAQQRLVLEGCWEACAAVLPSDQPPPPAAVAVGISYAEYGARARPHGLSAHSAQSGTLSVAAGRVSYTLALAGPALCVDTACSSALVALHLCAGSLCAAVPGLAAGVFLGLAPDAVAALARAGMLAPAGRCRTLDAGADGYARGEACVVHALLPAGGKWGAERGGRALLCVAGSAVNQDGRSSSLTAPHGPSQAAVLSSALAGLPRGSALSALELHGTGTALGDPIEVGAALGVALGERGSALTALELHGTGTALGDPIEIGAALGVALGERCAGNRAPTVPLELMASKTRALHAEPAAGAVGLADLAGRLLGEDRWGQGGLLDGLGANGEAGRCPAQALSSGEWDAPRPIIH

SEQ ID NO: 10430 - protein, 145 aa, Chlorella protothecoides
MTLPTKSSACCNHRVVHHGATLASPTMMHLHGFESHLDLPKHPHPRLIRACLMVLEAVHWMLLGQPCSWLQALCVGPGDLPAQTPAVSYQYPTCHPPRSVPASRWDLDTEWPDSGLAVKRFGAFVDDVELFDPALFGIGTQEVGG

SEQ ID NO: 10431 - protein, 338 aa, Chlorella protothecoides
  MOD_RES (37)..(40): Any amino acid
MPPHSLPCCIMKGQWVVTTDEEDQQESVPRLTVRGRXXXXRGTRVFRAFPFCSRMPPPLVAMLHHEGTVVVTTDEEDQQESMPRSGQVCRPVPDHAKHAHVEDARRRTFAPPTGPRESHCRRPCHSADCCYSVDRIVAAMSQSVFQPVGQKRLTNIAVVRMKKHGKRFEIACYKNKECCKIPIAPLYFLRHRPRFAPLHLSPLCSEKDLDEVLQTTTVYSNVSKAVLASREDLKLVFGTDDEDAVCRFILAHGDLQVSDRERKLELDTKFRDVAAVISEKCINPTTQRPYTIPMIERALKDTHFSVDSNRPAKTQALEVGALSWGKGDGGLPSTAGLP

SEQ ID NO: 10432 - protein, 279 aa, Chlorella protothecoides
MAAQEGGVARRAAGTQRQVRLAPGVEATDCTMKAPIPLPCHPTLQYNRRLAPRSTHGAALRSSSSLVSMVAGDGAASADAAALSSLQHLRHLGLVVNSGGVLTDGVLARQDVAAVRVSAAPKLLSAQSMHGRLTALQPLDRLLLYSSSAALFGAPGQATYAAANAGLEAWAAVAAGAGGQASALQWGAWEIGMAADEVVRQRAQRTGLLLLTPAQGLGVLESSLRLLGSVSMPVLAAVPVIWGTLLKVGVHRSDNAEVDAQLSSRSLAWVALQDVKCER

SEQ ID NO: 10433 - protein, 159 aa, Chlorella protothecoides
MTHTARQARGSGPTHRAASTLPMILDAVQELVGGTLPDPHQPLMEAGLDSLGVVELRNSLATATGLELPATLVFDHGTPAALAKHIDALMLPLGAGDEEGDGDVEPMEDVQPTPDGLMPLSRWDVDQYVSNPPRGLEARFGAILPEADLFDPGLYGVNW

SEQ ID NO: 10434 - protein, 176 aa, Chlorella protothecoides
MDSGPLTLGATKSCHGHTEGAAGLTGALQALCALSDKEDGPALYTSCKGSASFHSTCLHTMRQAAAPVLHLRDMNPFVGTTFGDWPRRHGLLASIPRQLAPAPLHQPLAGTSAFGMSGVNAHAIFEWTEAAQEGLTPSAGGEKFWERVGGGGPLQIGQVLPENMSARPHNGCRPGS

SEQ ID NO: 10435 - protein, 238 aa, Chlorella protothecoides
MRWACGSSPSGSWVPVTWLPGDEGLGYVALAAALPQCKSLVSNFNRPPSNPHKDDWVCPDCEQGRPVPAQGPTTARSRVLTRAGLALARIEALWAMGGGAHAATLRWYCLPEETHAGRQAVDGTGALNQVPRPLHTHTHTQLKTLICQPLRPRHAYQTHHAAREVFLTSTRDLNEVTTLLRHAHVLPSPEFRHAPPELGDDVFLCDYEYNEAWQGGRPWRWGRERVRRAQAWARVVQL

SEQ ID NO: 10436 - protein, 127 aa, Chlorella protothecoides
MSFCSESLRRAPTASADADPAAASPAAERRRAAASAAPQAAPAQETVLYPRGPIAGLPDEYASRRERCAELDDLQAGWTIQLSSKGESGVVDAAFFSPRGARVGAYVAARRQALQASKQAAVDLQPA

SEQ ID NO: 10437 - protein, 534 aa, Chlorella protothecoides
MVHRKHAPSPAQIKAMGMLTSEAGLTVLRRLLAGSWDRAGAVWGAVPRSYWHHVLQYMAEVPSLLADVMEETTGSAVMAPCQDHVQEGASTAQQHHLKGGDVEPGLRALVESVLGVESLEPGVPLGLQGLDSLAALELRQKIQDPAGALLATVVAEVREGMVKTARAQNPTGHTFQILATTPISASSTPEAGAVTRGDTHGPAPPRHPMQKPLLRMFCLPYAAGVSANVFARYGDGSVTPSSHGSHQPHPHSQRCRYPERLPAWIEVWPVEIPGRGRLAPQPAHGQVQDLAAYLAHTLPLDELPYVLFGTCLGSIVAYELAALLEREEGRRLPLALIVAAVAPPHLYARAVMRLYLQRAMSEMREWVGLRSRGPHRMGKKAFAKDAQCDLSKDTLLKAFEAGNFAGVEEMRRNDRLFWRVAPLGVADISMAVRYHHDPSVPPLACPIVSLDGRLDGTIERGAMRGWGRHTLAAHTHIPIRAGDHYFVAKEYQEVGGVDRSSRGGGVGKPVGGCRGCSGRGSMHVVVLFASVSLS

SEQ ID NO: 10438 - protein, 195 aa, Chlorella protothecoides
MPIHNVELRPGKGGQLARAGGTAASITKKGFGGQMREGGKRGTDWHAAPLLQCYFCSRPPRGLFNTYPPSPPPPFPIHTKTNNSGTDGYATIKLPSGEQRLVSLACTATIGALGNAQHKNVKHGKAGATRWRGRKPRVRGMAMNSVDHPHGGGRGKVKGRISQTPWGVPTKGHRTRDKGARTNWAIVTSRHKAKH

SEQ ID NO: 10439 - protein, 158 aa, Chlorella protothecoides
MEAAASITGATLDADSPLMAAGLDSLGAVQLRSMLSTRFSLDLPVTLAMDYPTPAALAEFVAAEVAPEGSIGVTAHPAPASNAPGQQLQDSCTSVLGVAGCYPGGEGQGLDGYRSAAQAGQDLPTPVPLARWDLEAYYSPDISGEDREVPCLRCLCST

SEQ ID NO: 10440 - protein, 246 aa, Chlorella protothecoides
MCGVIHPRQAVVSKGPVVAGKREQRGLGPKVRLGNDKLEFVPARTLAKGGKPTAAAKTLAKVQLFPAAPHAKKKAGPAQRKASLAAKTVAPEEKQQGTERRAANRRTAVESVEIDNVTFRTGDSVYVVLDDSAIQGLRSGDVLGGWHPMAAVRCCDLDSMRTACSPARQESSPQFLVNPACLCHISPKVAFLHSHSDDEEEEACATCGEVDRAGVDMLECGRCLRGFHLCCLDPPLDAVPEVRTVA

SEQ ID NO: 10441 - protein, 211 aa, Chlorella protothecoides
MAAFILERLAGAHGRTATTPRPSQNLVLERGHAGLSGDGVAIAGLACRLPLAAGGLSDLALALACGTEATSLVPLARWDVEAHYSPDPGAAGRSYARFAAFLGDVAGFDAALFGLGRAEAAGMDPQHRLLLEETAAAVGTVTMPSSTGPVGVYVGCMYQEYPYVLAAAEAGLSSSAVLGNSMSFMVGRISFTFGFTGILGCVEEQRWWCRA

SEQ ID NO: 10442 - protein, 100 aa, Chlorella protothecoides
MGLCAAWQALAQSALPPLPTLRALNPHVAAALTEWPRRAGRRGGAGRAPAPLPGGAGAGAFAGASSFGMSGTNAHALVSRAGEEGDYLTAARPKAWRRSR

SEQ ID NO: 10443 - protein, 247 aa, Chlorella protothecoides
MAAVLAAEHEVDNTGERQEVQAQTWEDVGRPISFDTTAAKKAVHLVGLSSRLPSTPGGHLAEAWAVLEEGRDLQGVIPLARWDAWAVLEEGRDLQGVIPLARWDVDQIYAPPGTTAAQRPTSYARFAALCDGVEAFDAGLLRVSPGEALLVDPQTRLLLEGVHSLLAGSSGLDPRATGVFSGCMYHEYLSVLAAGGSQQLPGPAFVGSGAPYMELRVGVTVVLLHHGVASYGTGSARQQAAYFRRWC

SEQ ID NO: 10444 - protein, 131 aa, Chlorella protothecoides
MSRQPWHGYHYRQALLVHSPVHLTTPPQIPTTGVLELQRLLQDQFLVALPATLVYDHPTIADLAALVSQLRRGRTTTRSATTSTTVQLLRSIVAGVLGREVEDDEPLMQAGLDSLGRLPAPKNQGTRGLLY

SEQ ID NO: 10445 - protein, 569 aa, Chlorella protothecoides
MLPDISTDRQPGGFAAHPAQVDAATQLGITMVDLLQTTSTPSRASLSVPAGLERYQRPALVGWKSVPGCMPAGGWGEGGLDGHGNTASFRLGHATAVRGLRFAAMTSGARSRAAVVAPASLALRVAEAQVYRPWADGGESRAQGAQVLMHMHGAAINPRRPHDLLAALQRAPGRTLMASLTTRSWTGGGAPASPLASSTSAAAALFRVAAREVGKPWRHLEASCLAASQPMAFDAAEGKGVILVHGGLLVPDMVDATRRRSTPHRLALPGACAWVTGAGGELGRLVARWATHSGAGSLLLLGRGRPRVGHERAAASALRAGAAGVHGISTWLTADLGFAADVASCDSRFEAAATPSEPCGLLLHAAGCLADAPLSHQTAAHLRTTAAPKTAQLRRLTPCSAPLSLAVAFSSLSAWAGTPGQASYAAANAALDAHAARAAHSGLPCISVQWGPWASGMTRDRPELEARFARAGLGLMLPDQGLALLSAIVAGGLLSQPLFAGLLSSGEPVGGSMPVGGARAEAVVQIPARPARPGGIPTISQLVERVLGRRLTADEPLVSAGLDSMGERG

SEQ ID NO: 10446 - protein, 92 aa, Chlorella protothecoides
MYPGDPGDPGADCAGVVLSNPGGGGGLRPGDRVFGLAPGCLGQRVRVLADLVAPLPPSVFYQTGAALPTVFITAMLALQQAASCGPHSRVGA

SEQ ID NO: 10447 - protein, 537 aa, Chlorella protothecoides
MSAWAAANGSTPAEMAAERVPAERSSPGRAALATTIHRAALPPALVPLAHLGTRPGRVDAATFCLDPFAADACLHLGAHMAAAAGRAPAVPASVAAVSCCQAGGNRGPLDLHAMGSSGGKRGPLDLHVTGSVVSGAALSRHRMLAPTGVAGDFLDLGTSAGPVQAGRGRGARPSARQVPFTKAPERATGEARGGPRAAAQALYVTLWQASQPGAGRPAPGASQPAISVAVGGRHAPADVRPAGLALRGRAGAGTLVATLLGALQGLAHAKPRSVALATRGAHPGSGPGLSSGASPLPSAAVGWGMTRVAAAEAPQTRWSLVDGAAPGLGGDTGGSAVCEGVATLPLLVAHALRGTSSPAIDAERLGTHVLITGGLGGIGSLLAAWLGASTSVQLCLVGRSGRVGASAQSPAPVLDFHAASSDVSEASALQALRHSSASLAVLHAGGVLQDGIILRQRAAAARAVAAPKTGFLSALTRPGVWGTPLQAICLFSSVSAFIGSPGQAVYSGINAALDAWAGQVARSGLQGDGWGGSVVLG

SEQ ID NO: 10448 - protein, 116 aa, Chlorella protothecoides
MTAASLSVLARGGSFVEVGKRDIHAASRVGQERPDVAFSTVAIDFLPPQVLGRCLLGMSALLARGELGALPCTAYTLSQTATALRQLSLSQHVGKVVVQNPGIKVSGVCRGVCCDV

SEQ ID NO: 10449 - protein, 362 aa, Chlorella protothecoides
MLSPATPVAICSLQALSRSGRCLAFDSGAEGYGRGEGVAVVSLRRWSATATDPSAPQPLALLLGSAVNQNGRSAALTAPHGPSQARLVRDAVGEAGAGVEVESVLAHGTGTPLGDPIEVGALLGALPPQSAGRALGLGAPKSALGHTEGAAGLAGLACAAAVATRARMPPGLHLRDLNPAVAAVAAGGAHLPRQGRGIARSTPGLWATGTSAFGMSGVNAHALVAGPGGGAEATRAAGGALPVLLQPTRIWPLPAPSVLLLSASARSASTVTMQCHLHSAGQPAVMFERYTLHPPAVALEILDAAALCRGGGYADAPSGCSRGRAELHHLPRHWPKRGPHLAGPRGCRAGVPCGRGLYQSHK

SEQ ID NO: 10450 - protein, 837 aa, Chlorella protothecoides
  MOD_RES (88)..(91): Any amino acid
  MOD_RES (650)..(653): Any amino acid
MARRRASSLTRRTRAVWWHLARGMPMGRLRVLRLPHHYRLEGLRPSLPPPQPRATAWRGCASPSWHLCWRRGRRRARGRSPSRTTASXXXXHSAPTATSDGVAGLCLSLMAAVLAAREEEGAGAEPFTDDSQLALLDALDLAPGSVGVVEGGDGAEDLGLRGGTAPSDTQDQHPASPVPPPLARAPGVSAQWPPAPAPAGVEPAPSPDPRARLGAFNAVSARLGSLRAAALDAAAASRPSSMFRGLFDRRASVEAEAAGRVQSAEETGPSTAAGPTGHPKSVQPVGPKRVSSPEDAPLHQTPLVWKGRRHGAVASAAPPSSSGSASPLSSLDSDSEEDGGPGMVAETEAPAPAALAPWWDDLVTLAVPPGLASPHASPQASPRPRDAKVLHRLTFGPAHGVTALAVAAGDGARNGTPTAFAATQSGQIRAVELESGKQVVLLGGWVVGCCCQQAGGLLRRWLLRRPSTHMCVARPAERCSPALIWWAGSLVPGLPPLHPPQSPPTLSTLTSCSALSQGALRVAIRAAADVPGPGAPRPARPPTGAGGRLRRRGSCLLRAHWLLCRRLGAGGRCGERAVHAGIGRGGRHRQRRSGGLGDGRRAASLAPCRAEPGRRGRRATPAGTGGTAGRGSLVFGCTARGLSPGAADPXXXXGGAVLPLLDLEGLQGEGAWSLAALLAGSHPGPLILAGTEAGAVLGWDPRRGGAPAWRSVLGQDIVAGLSVDAGSAPRVSAAAADGRLRLLDLRRGGAVMASAALGSPLLCAACPGPGWTAAGDEEGAAWLWRAPGGGRPARAWRGEAGDALNALALGPPGPDGSPRVALFGTEGGSLLCVDLGL

SEQ ID NO: 10451 - protein, 90 aa, Chlorella protothecoides
MWSVLRGGPVKCMVSCTPRPPSADHVQVLDAALRTLGSQDGGDYFAGGEYTLADIAASTRIYRPIVLVEDHFGMDVQRLINEHRLDRWAM

SEQ ID NO: 10452 - protein, 75 aa, Chlorella protothecoides
MPAKYASLHPGPDAPAKVPILDDADGTALFESLVVAYYLNDKYPEPALLPSEAAAKAKVGDVREGAWLLCPWSCV

SEQ ID NO: 10453 - protein, 156 aa, Chlorella protothecoides
  MOD_RES (37)..(40): Any amino acid
RPHPPRARGPGRPQAPRPGAAGVGCACGRVPLPLPAXXXXAGLKHHGLEHLEWGVRVDEFHSLSPLAKYVHPAAALKLQQLWDAGNRLVSVLNDASFQCLAQLDAQAGVATVVETGEALRTLPPDDLVAANAVFASIAARHPRAVGGAGPGGAGSG

SEQ ID NO: 10454 - protein, 62 aa, Chlorella protothecoides
MLHEVLGIVGGCVDLRHVPGVKPEFAQAVLSTAADPFFAKHAGSNFGEVGVAIKQLVDDLAG

SEQ ID NO: 10455 - protein, 498 aa, Chlorella protothecoides
MLSLRALPVHAGCACRLLGCEKCSRSLIWTSEALPLSHDPQITAPAAVVGQTRPGPCPVQERKFGRLKGQPLFGELRPRASVMPGVRLKNPTVGNPPASPPRTRTCRHARVVRACHAAPDSGGRHRDPFPRTSIPGSTHAPPQKAREVGAGVDNSVDQAPAAAQAALTPATASDLEEDADWQDWKAVMARTHSLGLYDWLVPPPYSRPQPPALVPASSPTLSQLPSSTLPTPPQAEAHEEACAALDSSVALDAYAAAAALRDRLAGIRAQDCLGEALAELDRAVAAERYAAAASLRDMAWAGLPGWWSGRGDRGDVAGHLIRVSRRYGHYAAHAFSGRDLAAALGWAPDAVFEYVSLGGGDEDAGAGEADPAAQAVLEMHFRRGAGGALEAQAVAVLGPAEAEEVESADGDELAEVVVAVQGVEVLDSDDETEEVESEEDDEEEEGLEVGGLLRRTDDGSRALHAGGDDGAEDGAGDDDDEEEAAALGFAAPGSRAQL

SEQ ID NO: 10456 - protein, 199 aa, Chlorella protothecoides
MRSGCATNAPGLPIVTRAPLQSRLALPRCAEGAARETLEEAGAAVEIVAPYVHFDIPGIGQAYLLFRARLAPPFTFAAQAPESLETRLFPLEDIPWNEVRGGGVVGGWMHALELWTSLDLVQHVPNHAMHNEQPTPDPMFRPATAGFLCGEPGIALLRGGQEEPELAHAPWRDQEAGGGGAQRPRFLQADRLHGVAIGS

SEQ ID NO: 10457 - protein, 621 aa, Chlorella protothecoides
  MOD_RES (566)..(569): Any amino acid
MKPAVLLFTLALGSVTALDFGLPWASLRPSRSRSHREEAQITSMPGYPHTPFPSRHYGGYINVDASRGRRLFYYYVESEDDSSSTPLVLWLNGGPGCSSFDGVWVGSSGVNGGFVKEHGPFKVSFKGRPDATGELKQNIRLDDNPFRCLAGGGGWGDSGCWVDTKPTACFCTSTLQTSARPLTPPLPLPTSAGAKARTCSTTADLHHFLRLWLQEYPEHRETPFYVAGGWPGQLTCLEEGVERARATGTQPFMTEVCEARSDGSPPLLLPLTLQASRMQACLSRSWSRPFSMEIRNPVGPPSTSRLVFRRLGDAALKLGPGRGLGQGMSSSVSHSTISLSRSRPLRPAARISTSPVLPSPRRPLTCDSFTPHQGYLVGNPVADTELDANSVPAYLASQSLISQAMYEAAVKACDGGRFHGNPSRACSEAQDAMDAAGERAWGCDVLWCLCCAWDAGWAGPEPRVMGWPVVGRTAVARRGGYHCLRKSHSSTPSQLHPFGLQVHFQCTDTHPCTPTLQSATSTTTTPWPLATTAGTPTWSARAPKRWMPSHRWPASGAARTARGVWXXXXDGCGATDGRRRAQRAQRGAFGCSAGAAHARPHPSVPGSKVGMGQVERISSSS

SEQ ID NO: 10458 - protein, 563 aa, Chlorella protothecoides
  MOD_RES (61)..(64): Any amino acid
  MOD_RES (198)..(201): Any amino acid
  MOD_RES (261)..(263): Any amino acid
  MOD_RES (329)..(332): Any amino acid
  MOD_RES (512)..(515): Any amino acid
MLLCPGVWAPGLPLDVHGHPKCPVSLHRPMPDHRPSVSPRAPPTDPQPSSNHPLVAALSTXXXXPQPIPNHPPIIPCLPRFPRRSWTPYRALFTVRSMVLRYVNMVEIMAPIFEMELFDRMVRPTLFDAYFGWGLDWLWPALLSYPPDKVAVIDEVCVYHPKTDRKNSALYKLGERDRKREGDTQLVEWRCNWWGEMXXXXNSALYKLGERDRGREGEMQVVGGRCKWWGGDATGGVAIDRVAVSAAATRWARTSLGRCPXXXCNWWGGDANGGVAIDRVAVLATATRWARTSPGRCLGCRSHAEVLMCLGGRPAGAMGGLPPPKKNPXXXXRGAHVSRRATCRRHGRPASPEEEPMQQLSSAPSPCLGRRSPHDRKGGGQPAHQGVGLVAGGQGSAGEWAWEGQGWVSGLAWCTGASPGPATAPWTPKLRHPAPPQGFSSYSCDVISEVARPSPIAAPNLVRGPRARYPQHATHRERHRPVPPAYQGVGVPPSGTPHKPPHQNFETRSPQXXXXTGRGTGQCRQPVSDCHPPHMLAHALCSPISCPATTPCPPSSRVASSTG

SEQ ID NO: 10459 - protein, 314 aa, Chlorella protothecoides
  MOD_RES (259)..(262): Any amino acid
MLLLHRMIGKQQHSGPSTSLRSQSAWGTVRGGAMLDAFGRALGAREPGVKCAWRRGWSYRAPNHSCPCCTTCPPSLHGSITATRVTVSCIRCRRAERRHLVVVLGGDRFNASSWMTDPEHATWDLYLIYYGSNPAKSCPLCTKVRGSSRIARVWRGALKEEPVPCRYMLASPTGHSTPPHPLGVCRPGRQMAAGLAIHSTLRLAAHPESIQECGGVCVEGCVSMSSRVVREGLCSLTSMSGRLIGQVALAGADPHAFRXXXXAYKSAEGFVCTAISFIDDDLEVAGGEVLNTALAVFEAFDLLIAQPSVCNEPG

SEQ ID NO: 10460 - protein, 358 aa, Chlorella protothecoides
  MOD_RES (349)..(352): Any amino acid
MLHLPPTALGSPGDWELLAQGAANYVLQRQGPDQDVSAWAACFEASKDGPHHNLRRPSVWAQVGWLLRIPKIRQPPDLVSAFLETQIWAPFLQGLNSGNPADLDESYVRLVMGPLVDAKYLPVQVGDEVLMMSTPNPPSPLSQQHWVPVEPAFLVTLAQRPCLERLDVDVRRVMLMRDSRLLPADTSSGRDLRPRPTVSVEIKPKWGALPHAHTVPPQHRVAKLGASRYQLHQHLKAATGAIEVPSEYDPLDLFSGEAGRVWTALQALGRSPQNNFLTAVDGKPGGLHSASLALLGPCRAVHDTPGAALLTVVRDVLVQEGTAERSVGLRGEERRWNDLGHGADGFHRXXXXWGKAVE

SEQ ID NO: 10461 - protein, 587 aa, Chlorella protothecoides
  MOD_RES (25)..(28): Any amino acid
  MOD_RES (156)..(159): Any amino acid
MHWHDCRYHASPWPPSLRCQEAGLXXXXDCRYHASPWPALLRCQEAGLTSFHQEHTHRAVGVGASGAVYAGVNMEFPGVPLSASVHAEQFLVVNALQHGETALRYIAVSAAPCGHCRQFMAELNEVVSVAIGEEGSAADGMCALCPTAAARTASRXXXXELNEVPPARQRGPSEPGSRLPPAPGGAADLIWRHPPFVPGPAPAPSVPALRPAGLRPGAEAPPLRQSEGRRARLQLRSGPRRGPRGRGFVAGSRCPGAHTGCSRGCGPLPRALLPLPLWRGAAPGGRARGPRRQRRLRGKRGVQPLPWAAPVRTGVHAPPGPCGLVAHRGGGPCGGPPGKRESGGRHRRHAEGHCTPCQAAHRAPSLTWRAISQWCAHHLCCPWRGPPRGMSRIISGTLACDDLTCDHWLVMWPMVYRGWGANTNRGRRPTPSPAKHAHLHPRSLQVVVGCGLDATGHTHDLGVQRQVARQLGHRLPVQVYHGQTVEHGAAAMERDPARGLRRLRPHGPPARAFSTQRQEQGTVTGRAGGKVVAQQAQGRLKCWSWRQGPLLAHLGRGRVEQRLVLRMHSMDVRGAEPLYIQDLGQGI

SEQ ID NO: 10462 - protein, 806 aa, Chlorella protothecoides
  MOD_RES (235)..(237): Any amino acid
  MOD_RES (371)..(374): Any amino acid
  MOD_RES (466)..(469): Any amino acid
  MOD_RES (707)..(710): Any amino acid
AGGVRDRDPSPAWRGGLFDRGSWTEAQAGWARTVVTGRARLGGLPVGVVAVEVGTVTLHVPADPGMPDSAERMIPQAGQVWYPDSALKTAQAIEEFGLEGLPLFILANWRGFSGGQRDLFEGVLQAGSQIVEALRTYRHPVTVYLGPGCELRGGAWVVVDSQINPAAIEMYADPTAQVGGLQSRSSLQWCAVGTGRLLHWSPLCVLGRKRGPAGPVLRSCDGCTTHQHPLAHLLXXXMYADPTAQVGRLESRFSLQWCPVGTGRLLQWSPLCVIGRKRGPAGPVLRSCDGCTTIQHPLTHLLAQGAVLEPQGVVEIKFRNAELIAAMHRLDSKLAEIKVRKGGDGRMVGCQAVHRSAARGPLGCLERERRXXXXAGVRLWGLGGPSMASGALAAQMAQMFVQVEAWRCEALHTRCDQRCGVKVCVAIDAPHHLPLACPACTSPRRKPSNHCHRRSTLPIPPDARRXXXXAGVRLWGLGGSSMAPGALAAQMAQMVVQVEAWRCGALHTRSNQLCGVKVCVAIDAPHHLPLAASPPVIVTHVRPSPSRQMHDGPVRMLAKGVIRGIVPWASSRAFFAARLRRRLAQESLVRQVAAADAELSPGEALARLRSWFLSSPLPAADALGEAASRGTVLARAVDDAEALWRDDARFLAWAEAEAGASRIAMELKVETGWRGGGGGDDVRGAPHRWTCEFAARANALDSLHSDXXXXAQGGNGMAGVWGWGDVRGGPDRWTCECAARANALAPLHPDLATPSPPAQALRTGVAMRSVEELCQTPEGTLGLVRGLDDAIKSNPALLLQLRSLLK

SEQ ID NO: 10463 - protein, 89 aa, Chlorella protothecoides
MRALVYSGDHDMVIPHTSTEAWTAGLGLRLERGWAPWRADGGQVGGFAVHYRGLVYATVRGAGHAVPESRPREALALFTRFVRGRGAPA

SEQ ID NO: 10464 - protein, 141 aa, Chlorella protothecoides
MPDDKVIFLSDIMPTGWHGAECGQVGEGDNVAIWGAGPVGLLAAQSCYVRGAAKVAIIDSEQYRLDYAVAKLPGIHTVNFKEVKVLEALHKIFPVGPGPDVAIEAVVSGRSFPVCDDVKHEQHQSWSVQVLWLWVRLAGMA

SEQ ID NO: 10465 - protein, 76 aa, Chlorella protothecoides
MQSQFSCCDSTNPSKEQEFLYGHNTAGLYSHMTGGWDGGQAEYARVPFGEFALWGVSLGEFLLPAGACTSTLGPYA

SEQ ID NO: 10466 - protein, 171 aa, Chlorella protothecoides
MKDAGVHELLESEDQVLSLRQDLDATIGLLDDLEDNLSIFDAKMGLMRQDVAGFRMPAGGGGAPVPRPGGPATRPTPAPAAIEVRNNQLETQSRNDGALLDTLDSLLSQLALGPDTEKILMHRQLSMSGWVMNSLCGRGVVFHIELHSPATPLPSVTAIRRGWSISVLAVP

SEQ ID NO: 10467 - protein, 66 aa, Chlorella protothecoides
MPYEAARGDLGRALAQRFSLAGIPRLVVVGPDGAIVSGDARAAVAADPTGANFPWAGPASAVATGG

SEQ ID NO: 10468 - protein, 392 aa, Chlorella protothecoides
  MOD_RES (109)..(111): Any amino acid
  MOD_RES (141)..(144): Any amino acid
AACRPWPAPAPGSGSARWPARCACCVRTTAGRCAAGGRTAPPSWRWPPARAASTPSPPRGRSSPGRRRWPACTAPLSPLHSGFTLGEGMVCGRGQRACVLCFTMGAMSXXXAPPQKNSPPIDGCGGRWPPQPSAGAACVPXXXXSFLGGRECFVGGVSVHMFCVLPWKLCLGPCKGLHAAQMCAHLEAGRRRPRACRRPPRPPCLSPLRCALHPSSPPPPPNKHLSSNRRLWREVAATTFSRRSLRALALTWNVNECKPDPDSSQVFRHLRRAATPAGGGEGPALVAVALQEIEMGSSSVALAAAKDAISYRMQERGNTNAKFWSGAVLRALGGEAAWQLVGLRQLSGMLVLAYARHDLKVIVWWVEWRELGRRRVGGLYFVEASLVRRWAA

SEQ ID NO: 10469 - protein, 802 aa, Chlorella protothecoides
APTGPAPDALGPSLPGAGRRGPAAPDPGAEGPEGGAGPRSLVPQVAVGADGRIVIAEASLTVQAQERVENRRGVTDEHFRLNSYTYANRLHNERWGAEDTELFYKPRCMRAGAQTLRRLEWVWEVRPPADAICAHGLVLAVPPVSQCYAAPQPHLPLLPHAAQALSQFGTDFTLISHLFPGRQRPHLKNKFKRESKVNPRRVDAALKASASATATSYQVCRGWGPVWVRGLHEEERELGGMLLHCKRTAKGLQGLGGGGSFTSPSADPFPGHDLHAEGQRDDRSQHGGGGGWGGRQAPGGTLAAAQLPGAGGAQPWGAAYEPPRTCGSPEGLTLGMIRFHRPFIWISLAPLTTSLEYGRAIVVDISVIISRGVAPPRLPEGGSGVGTRAVQAGFQGRPPPTRRPSAVRQGLCSCAEPRSRGQTPNAAAAGSGPEDWRCYARPHIPTLNSRHENCKGSEPLLQSAHGSPLGAIPRLPPCPRCPSAAVGPGSTSRRLHRPAAPAPPSPPLPGRPGSGCASHAAPPSRSPTGLCPAGHTQACGRTRRRRPSSHTRGRSSAQRLGLPWLDLPRRLAHRARAARGGGIRGAGEAHGPEQENPTPPQVAPHLWGGKGGAAAEKDAVAPGRDPALLRRVVGKGVGRGLVELVGGAEGDGPLPHATEGLPRRHLAPALVLGWQGRKRERMKRKRGGRARLACLPSTHARTPLLLKSLLAPCAGQQAGTVVAHGPVPDVLVGAVDAVVEVPRPDQGLRLLNSVALHQGVLRRSGLGQVRRTGPGPQRGELGARRPRLRFIWAVEGERGGCE

SEQ ID NO: 10470 - protein, 510 aa, Chlorella protothecoides
MRKEQVPHGYHRINSRETYLHLRAVWWRSFPLTCPFPLGSGWLRHVDCDPSGSVIVRSEPDRRLELLTSMPSLRAWLCLLALILHASLPVVVVAEQGRNKPFAVVRPVADHSKLELDETGLAVLEGIQGPVSPVVVIGPYRSGKSFLLNQLMGVPCGLEPCHPPSHLPDQGFGVGHSRHTQTKGVWMWGEPAERLDAKGDPVQVGRGCMGELQSLLDMGVGRSDPTEKVDKSERLPGALASFYPGSFYPQLLLRWVYNLAPHKHTCFFCIHLPPALLSPSTHKHPPSNPPPSPAPQLLFFDTEGFESTGKADVYDDRIFALSTVISAVLVYNLPEAIRESDLERLSFAVELAKAFYADPAGREPGGLASPPTALEPGAMLWLIQRDFLQGDSLEETLAAALAPVPNPARDPGLTQLNRIRVSLHALARNSSALGLPQPHLDRTALCGLADEELAPGYRAARAALEARVAAAAAPKLVRGRALDGAALARLIRDVGGGEIDDDRASVKGGA

SEQ ID NO: 10471 - protein, 272 aa, Chlorella protothecoides
MIEERGLAAGIAFPTGCSLNHVAAHYTPNAGDKTVLGYDDVMKVDFGTQINGRIIDCAFTVAHNPRYAPLLDAVRAATDAGIRAAGVDVRLCDIGAEVQEVMESYEVELDGRTFPVRAVRNLNGHSISPYRIHGGKSVPIVKGGEATRMEEGEFFAIETFGSTGKGYVREDLEVSHYMKNFDVGHVPLRLPRAKALLATIDRNFGTLAFCRRYLDRLGEEKYLMALKNLCDAGVIDPYPPLVDNKGSYVAQYEHTIYLHPTRKEVLSRGDDY

SEQ ID NO: 10472 - protein, 205 aa, Chlorella protothecoides
MNMESAGTQAMKVACWRKEEQLPALLAALDENERPGRGAPLSTFILKPDAGSQGRGILLAQRRADLEAWCPEGGGVPAGVASRYIERPLLLGDSKFDLRLYVLVLGTAPLDVSIFTEDESGKRGAAPRPLVFVQRRQQGRQLLWKQQGARHEVVSLRHDLGEPGQVARQPLLSRQLGHAGQLFGRQFSIQAVLVGRICRNWPLLA

SEQ ID NO: 10473 - protein, 148 aa, Chlorella protothecoides
MVDAAPTLVEEVSAPEPSVEAEAAAPEQSKSAKRRAKKKAAAENAAANDGAGAEGAEVPQPGTPPEEEEGAGAADSDEEPETPSVGDVVTKKKKKKNKKKKAGASAGAGAGEGAAAPTEQTDPPSIPIRLLFPSGVYPEGEWQSYKEE

SEQ ID NO: 10474 - protein, 93 aa, Chlorella protothecoides
MFLRSQCLSSFHVPTPPHPLPNSQLWRETSEEKRALERLGKDVINEVRQAAEVHRQARKYVQSIAKPGILLSDMCEKLENSGEWGFDGAVEGF

SEQ ID NO: 10475 - protein, 445 aa, Chlorella protothecoides
MDPIEQKKLKRVRESAGLDAFAEAELELAGQKSKKSRPTKEVTWDVATGGQQRPVSCPPTIPQAHENEDAFFETLSAAENLPKYAELLKFKVSAWEKNCSRDSSSTTLLYLCVLLTFPSELQSVPLRHDLTPLPSLTQILGVGARVWGAIIEVSERELVVSMPHGLRGHVPAAAAGEPGMGVDLLAAFNIGQLVRAQITQLTGAEAGEDGAVPPKDGKKRRKKVYLTLAPSAVNAGLGGWRSGFCTRNCREVGGEGGGTIIQLVEHALALTLAGSGQQAGVRVPPAGNLMSRPRRTRAGILPLCQRAEHGGSWCRAFLWHQGVAAQGQALGTTGFLPAAAFPERPLIPGTLLDVVVTSKKAGGRITVDAGSEAVAAAKTEEWIGMHIGEAAAGGAVHSGVGCGDREVCRGPLMQCTPEGPCRHPSQSLPCPLQAPCSPAHWWPPQ

SEQ ID NO: 10476 - protein, 329 aa, Chlorella protothecoides
MARRPRLQPARVCRLFRPGKGPGTQMQASASPSALPLLTHATLTMPLLPQADPLRKFYTSLLAQRPASDMARKWCVMHGLLSEAEAAAYVDEVAAKKLAARPASRQAAGSASPAPKRAASGQAPKRKSTGSGTQRSWVGVGALHAGCAGRVIDLSACRVPHSPTPPDNDPSATTPPPCSQDCTRGKAQEGGGGCGVERRRERAGGPALQAAAGRRAPAPQAPGRLGLGRRHHTGPSAGPARARAEEAQGFHAGRRFPGRRAGGGVPERRRCPPPGQEAVTRCAGGADPATCLWWLVSCALHTQRLRISGVHRKGAKNQGWQDAIKCGQG

SEQ ID NO: 10477 - protein, 464 aa, Chlorella protothecoides
MRIRLKQLPGLLLALGVALAAWPTDAQSTLIRLKTGQIAAHGPSSRCVACTGPPSGHHRSTNAPAILPTRPSYHRDQVHRLLLTNSEPQSLSPHWGPLSQKQQWLVTPQQGESLTSAAGAVEAAGGVILGHVPDNTLLVMGPPGLEQALRARSRIFLPSPITANSLLPYEPQHKLSPEWAPILRTLEAAAQASLAQQQSVLSSLPMATSGTGPALRLLITAIFPPRPAGGAGAAAPDPGRAAVADWAAPLRTAFGGGVDVVRGGSGAAVVLCPPFLLQASGRLERKGWTPSHAAAHTHASPRACMDLGLRVRMQVLVQAAGALCQYPVYTTVDAQLCFPPLLLQDVLTWLAAQPMVHWISPLPRMQLQNNQASAITQAGTGALSTSQNSFDNPEVHPIWAAGITGTGQVIGGGDSGVGEAASWVVGKEGGPVYSRLPQKDVGGCLGVQRESVMADAGQGRDPPN

SEQ ID NO: 10478 - protein, 233 aa, Chlorella protothecoides
MSITRRLGQTLLASFSSGLALTITLSPASAPANAFENLASYSSQGGPRERPCARSCPVTAMAPAELSGSAVVHLRAAGLLFHPENPPSSSTPQHTGPTPDGRVKPDLVAPGSLFSAKSSTSGTETCELQGLVVSESGVLVLPCCGQGYIQAALSGMRRQPLHGSPPATHSFLLIPLGHFDGDPGGGWLGGPGAAVFHGRLVPLRGQERQRGLHPLWRTHQGHTDLGGGFHDWL

SEQ ID NO: 10479 - protein, 457 aa, Chlorella protothecoides
MDIPKEVLQTLANGLPVSCCMHVHGAPASDRLQLLINPSNSPTGQRAVPAMLMPLGWLSTLQSLTWETVPELDGKDVPDNQAHAPLQREAQWMACRLWMAPASLHVPASRTLCGQQGRVGVSAGLRVLACDASPPLRNPMTLPQVWARIRRLPADHPGCGDPGLPHRGSTGIPRRLAAGDALPVLPIGPGARHRAAHGAVSTVGCFRLRHSCRRMYAFDVHCNSLLPWLLIVNGGLACQVPGWGGEAWTSAPTLSAMHAAGGEQALCPGASLEVILHRSALHPPPRAVLQLVLSPLLVSQSYLAAAVSCTLYVAGASSYLYITFLGYSVLPGLNHTVACGAAPRPCNVFGEQSCSLNCQCAGPNSLPSPPPPSSCSCPWVQWLWHSPLPYWGGSTPHERRSGSTMDTGGPDDRIPAALPPMCKPEARALDAPAGRDGMKPSMPRSLAPRDRTTECGA

SEQ ID NO: 10480 - protein, 465 aa, Chlorella protothecoides
MLVGSLDCFPDLELLDPTVDIHAMFLHYNKFYFEDSLGACSVEWSSKRMTSCGGVCEFRGGGCTIKLSEPLLKVSCTGSLCGQFRPVADIKAVLLHEMIHAHNFLVGPKDDGRDGEQASCLWSLQQPGKPWKPQTPLVPHAGHGSVFQAHMRRINACRDPDPLRPLEGYNITVSHPRGRRMRPEAPALDPRARSLLGVQPLWPRSPRPSRCSTGSAQAHRCLCLTALLQIRHSMLDEVAYYQNHHWSCPRCGHLVRRAMNRPPQEADCWRRAGPACADPRCGWHVHLRHCGGTYIKVKEPEGYKPKTRRREEAGKQQAGPSSAALPGPTPAATPPAGHRPITGYFQPAPSHGATAGSSSLRNPDSIVPAASNNTAANVQGQHGPRDAPLRHVRVNCAMTVHATTRHAGGSKLRSRTPDGCEEDIHSRRAKLAAAALARLQAVPPRPPSRPPASPHPGQETIIDLT

SEQ ID NO: 10481 - protein, 339 aa, Chlorella protothecoides
MLCGGTDGRSWNHRQEECMAADSNHELDKCSLRKGWHQQSWSLNSRGTPSRAAILFQRTCIDMSCISCVVKILITNPRTLHRPVEDLVAAEEDVEEFQSLEKLEALGVIKGDIKKAKDAGFHTCESLLMQPKKRLVEIKGLSEAKIDKLVEASRNACPNFGIMSARDFEGQRQRQIVHISTGCQALDELLGGGIESKAVGFGEGFCVCFSCQSLVVDTALSAISAVPTDYRDLWRVANGQDSALPHALRDNSDGRGTGPALKLSPLLHHPPAAAGRVAYFDTEGTFRPERIRPIAERFNLDGDAVLSNVLYARAYTFEQQYGELLGMIEPADGGGVRDS

SEQ ID NO: 10482 - protein, 94 aa, Chlorella protothecoides
MAHASTIRLSVRKGKAEQRRLFDHTSAPTRHRLMKVVDAPNLAEAEASYAISGQGIIDYKCEGCSVLYQSRAQCWYLGDGGIAPVTQGWQWSGP

SEQ ID NO: 10483 - protein, 153 aa, Chlorella protothecoides
MSVLRPLLCSFSICDFEGLMERLDEELSYYDLSLEDLVDDGKEIHFVEFGIGGGTNQAGVGVARTAEQAAYYPFYGIYGAYRWAQAPCRPLVMLRPPARHHSGRSGRHPSLVLLPPLPSRSCQADPFNMCDLVTPSPVRDYRRKYFEGISQVT

SEQ ID NO: 10484 - protein, 232 aa, Chlorella protothecoides
MASSWAEDPTDVAWEEQECHVFDHESPPTLSSLPHTAVQGSVHEVKDYGTLCDLDVHPDIVGVAAPHQVEGEAAQGPVPGTRISALVLDRNPADGIVDLSLLPRLTEAEAAAKSEPSAKKGKRKGVEAASPKQPKLGDQLECVIELGWACKGWAEGRLDQQTCNPPAAPPKTQVKEREGYCVVSLPAGCQPRIGFVPSHDFNSRAEAVSQTPGAVQGHGRGGGGMVLDEFEG

SEQ ID NO: 10485 - protein, 228 aa, Chlorella protothecoides
MAALQFPLSSCSPTPLAVSAPVPPPPQHPYSKNQRVKARILYVDPESKKIVLTMQRGLVAGQLPPDFPAMGQVFAEATVLRIDPGLGLLCSLPSAAGQVTYPPGFAHISNTLEGRVKSLEKDTCLGCLCLMLWNSQGAADLGRCRHSSCTRRQHILLPQLAMPIAATTTLPNVGLHRWPEGQGQGHWVQAPGRSCGAHPASLCGRAVDPQPCRCAEGLLSWGWGAHLG

SEQ ID NO: 10486 - protein, 95 aa, Chlorella protothecoides
MSTPLGLVWLRCPAGWCTLCSGGPAMTLEKCPCACKGQAGNPVSLLTDAAGQLGQLVAVEKLVGVTLPARVREAPLVIKALYDLDLVEEDLILAW

SEQ ID NO: 10487 - protein, 266 aa, Chlorella protothecoides
MLKCSGPTSPPALQDTSPPVLAFNGGTPASGSTSDAPMVNVSFAGQDPLPVNYTCALAVEDAAVMQGPVFAGAIAPAIWPLQSRAACESPAIFHWLLPGTWSLSVVAEDAAGNQASPAVYSWTVAFSAGQQYARLTRWAQTGVEGPGAGMGCISDVPASQQIEFRAAPGAPVLPGANPLRMAFSTTPLRPPRRSCSGPFGLSRLLESASFEFGVFAVQSSGASLTQVAQPSTRCWLAGPGTSGSSPSWAPCTSPHIYANLSEGAYT

SEQ ID NO: 10488 - protein, 120 aa, Chlorella protothecoides
MPHVEAIHVYPAPLAPVPKHSALRHACLQYLLQGGCRYRVSTVYLWNLQSWDPQAIYPLPFADAASQAANPTAYYDPVVVATINAHNAEAAARADGCAARAPEPELEAELAVASIVPPAC

SEQ ID NO: 10489 - protein, 380 aa, Chlorella protothecoides
MCAHALGRLTLTHCTARRHDAAPAELRTQLHAASGGQGGGCHRRHPPLLRAFYGGPAHRDPGVWSRRGGSVFIKHVKRATGALSRVHSIRAWPAKDLIGCLPHPVAGLAQIPSPPSSPPSPQPLKVWTDYPALPSVSKVLVNDLDLTVRASGLGGIPLLGNGGSIANETQPDRENNVEQVSMSFLPVGPVAIQVDAHFVHASAGRQPYALAVNGAFAGTLVVPGDGEQGPACTIVVPSESEMAEARREAGSLRACRADKEEHSWLAKQRGMRIACPPPIVIPNHAPQPPLLAGITKGPSGPTNASPIVFEFAAAGNAAYGGLAWECLLADGNGAVGSTGTQDWKVRAWGAGMGPCKGRWLEYSVRHERLRNGCYSLASSC

SEQ ID NO: 10490 - protein, 207 aa, Chlorella protothecoides
MTDTSEAAMARRAAEQLSGATAAMVTQGNLEAEMAAAKKAEDAAKKAAEEEAAAAAAAQAEADAAAAKKVLFCSLRGCSGIACPPLPAGVPRHSALSVPPLAHSKARISSLTVAEEDARLAEEAAAKLALASPEVAAMSTLRQLLASGTAPAELAATLRSLELPGGPAARASALYQVLFGDVEAGAKLSAEVEGRKAYLAPLSKVGR

SEQ ID NO: 10491 - protein, 178 aa, Chlorella protothecoides
MGSARLGPCPAAHNPTHPTDTLKFFGCELGAQTKFEKASGTSIVNGAHDASRLSELLESFIKKYVQCYSCGNPETVVKIKRENIFLKCKVRGERRQLCEVVVSALTMLSQHCNGQCVAAASGPAALPHLAGLRLRVGGGCSAEVEHLHSEEPARQQAEQGREEVSTSLVCERGAERAK

SEQ ID NO: 10492 - protein, 553 aa, Chlorella protothecoides
  MOD_RES (244)..(247): Any amino acid
MEHPLEAAPAPQEIPLTSCLGTEVETLQHHMAQCVADLEAVKEALLACPDDPELLEVRRGRAGQRCAALQSSWIPLIRPLHSAKGALCASPPDPFDSAPALSTHPGRPFTPDAQAKQLLEESLEGAQEDAGIPDDGTLIQKDGSRSASPSLPQAATPPPAPLPHAPRVAGRGAPNNARINPRSRGNRDAGGPSRRRSPAAVLTCAPWRTVPWLRGGLSGMLRACPTASCLHPGAPLPPPKYPHXXXXGGPSRRRSPAAVLTCAPWHTVPWLGGGLCGTLCACPTAPCLHPGAPSPPPNEPPRQGTGRPSLNFRDPRACVALTRALLARDHGLRWDLPPGHLAPPVTGRANYVHWVQDLLALSAPEGGEVCGLDVGTGANLIYPLLGAALAGWRFVGVDVSRAALRAARRLLDANTGVARRVTLRRVPMQPEQRAFFRGTEAAPEGPREEGGDDGGGERGAASGGAWEEMPAGDAAGGGILSAALRAGEAFAFCMCNPPFFESLDEAGRNPATAFGGTPLEMVYPGAARAVGLVGWGCAYQRCFCLDVLTFKDG

SEQ ID NO: 10493 - protein, 761 aa, Chlorella protothecoides
  MOD_RES (392)..(395): Any amino acid
  MOD_RES (421)..(425): Any amino acid
  MOD_RES (667)..(670): Any amino acid
MRPDFVEIGLDYHEGDDSPLDSIRGGIDRRTYPRRPTTGALRGSADDSPTLVWRLDGLNPRQLYLELISPGVPSRRASLEFAASILPSIGWRRSGDQAHLAIITSDDLLHSIQVGLAESDICTPASHSGSPDISSKLPYSLTSASLESRLRDTGDPVALQYVNAYLAIGTTQGRILLVDVESIGEKVTELRPPNLGLSKVWLSDAGDTLTTQLLSFPDHGISTYFSQVFGGVFSQSFSQPAISSLMSFPRPEGEFLLAINERAHLSIWDTAAAKMLFGVDLLPAEETSLVPKLARAASEPLDALTCILFVYYERRETSTSESGGPGTLHTYEILMEERGNALLKVRFWIQERLSWTCRSEAGPLIVIHYTLHHSRRSMSRGEPNWKEMSTPXXXXNALLKVRFWIQERLSWTCRAEAGRSXXXXXKKLGAWMRYQNSMGAQCIRCIQIDYTDSVARDMSFSTIEEHALAAVPAAEDLWWWQTFKKLVQHDWPDLKIDQAFTFKKLLQHDWPELIIDQAFVRACVDAILNPACFSIGCLVATLAAIGCSASNDSLHTMSAVELREWIVSVLDAYCADQRRPDTDLCESRDVDWSYFVSCYVKEWTKRFPIVGLIVAQEHQHDQILVARRNDMTTLGLEVFPHGSKQGAEVGSRARRPDFSSLIWTMKXXXXDIVLIIQRLSQGAEVCSRARRPEFSSLIWTMNAALGGPSIHRVLDAVIQSKGVDLYLHVLPAVERMLSGSSLPIVSASTPDQTCGRRSKLR

SEQ ID NO: 10494 - protein, 315 aa, Chlorella protothecoides
  MOD_RES (46)..(49): Any amino acid
  MOD_RES (212)..(215): Any amino acid
MAGGPAFQCNYILVLQASIRVRATQDNVAGVKLPKFESFKEGADTXXXXVAIHRWYCQRMAGGPAFQCNHVLMLQASIRVRATQDNVAGVKLPKFESFKEGADTKLALIGLGNGGKQIQDCRLNRPAWASTCPTTTRYPDFGPSLCRKSFLSAVELLVELASLQTAFLTLDEAIKTTNRRVNALEHVVKPKLENTIAYIKGELDELEREEFXXXXLQKLFHMGNQSPSLKGELDELEREEFFRLKKVQGNKKKNADLAAARVSTGLGNERVGADCKGTRMICHALLKKSSMHTPPAICPFECVGAGGGQRDNTRA

SEQ ID NO: 10495 - protein, 272 aa, Chlorella protothecoides
  MOD_RES (116)..(119): Any amino acid
MGTPSPGVAGRGSRVTVQRRWSLPATGCLSTLPEQPDQLCMSFRPVKWGHSRDQMHQLWESEAFRCDAGVESLVRLGLLPSTGVPSFVHARAGYIWFQGVLASWVVLLLPAMCTQXXXXSLSGVYLVSRSARQLGGAPPACNVHPGVQRHGHYLHSVADSSPNATSLTCHLFRCAESLVLGLRWHVDLAETHQELAQEARLLSKYNGLAPKRALLQQRKSSKHFDSADWALSKSLTANTGVSSDLESLPPKRWEPRTPTLQRRSSKLSVASS

SEQ ID NO: 10496 - protein, 239 aa, Chlorella protothecoides
MLLHEAEATATPLPTGLHGRLLELEYITQTEASRRRYRALSHLPLGGQAQTSISLTPPAATFRLCELDLSDCCSADTLDAFSEGLKLRAARRARLAKQAAHQSRRDTMAATEAAARAAYPVPQAAPPIEEWGGEPKLWIDPGAIVTSATVAQGGVSYARLTREGFTASGPELSSARSPGASVPSVPSPQGAWAKRQATPGAQQEGTRVTWSASTPPHSKQASGGKGKKTVVYTTQQRKY

SEQ ID NO: 10497 - protein, 564 aa, Chlorella protothecoides
  MOD_RES (528)..(543): Any amino acid
MVVSYTPPPPFARALAGPSATGRHRGPGLGAVKGGGAAAPASQPILPGAHPERAATGAGTAPKNGAPQEVPASSQPPPMDAAIDSPRAASSTGPPAADAAIVGPGSEEDGAAKEPRAAEGADPITASRAASGAVGSSDDPTPQLGPGSHPPVVQQGPPKSWAELAAAAGRRPGRARPRPSSHATTCAAAQPTPHQAAPAPGAGNEQSSRPAGEATTPRTVPVEAEPGHEAAAPAIERTGPTPSDAGADHPAQATGSKLLAASTRLQQLFASSDWVASAATRYEPRGLLNPGNLCFASATVQALLASPAFCSLLSGLAREGAESLPRSVYPTLAALAELAGELQPLGREGKPGTSARSPPGPTLVGRKLAPPPPPAGGKPPSRGETGAASLLAGGAPFAPGMLADIVAVFAPLNCTGGDQRREQQDAQEFLTFLVDSMHAELSALAETRGWSRCEAEPGGSARGEDDGEEWLTRSGKRNVRRGESGVMGGASPATALFQGRIASFVAASGAPASVTLQPFCALGLHILXXXXXXXXXXXXXXXXAGGETGGWVGGWTDSRHCVPR

SEQ ID NO: 10498 - protein, 154 aa, Chlorella protothecoides
MRKKPGTSFEAYFPKADKGALKLLRRLLAFDPAERPTSEEALADPYFHGLSQPSREPSAQPVSKLAFEFERRKLNVDEVRDLIYRETLEYHPQMLADYMAGGRRQPNFVYPSAGQYVLRADCPGFICNVMMWGCILNMHCRAPPPPRVCMNLHR

SEQ ID NO: 10499 - protein, 111 aa, Chlorella protothecoides
MRCPSSSSSAFQVGKRVSFEPYITIKGQWLTSDSGDHGALYKLIATVSHRGAESSSGHYTADVLHPSGRWLRFDDGDVLGVSSQQVFTDRPYLLLYQRLTEEDKAAVARRR

SEQ ID NO: 10500 - protein, 185 aa, Chlorella protothecoides
MHDFKDIYVVFELMETDLHQPKNILANSDCKLKICDFGLARPAFNDMPQTVFWTDYVATRWYRAPELCGSFFTKYTPAIDIWSIGCIFAEILLGKPLFPGRNVVHQLELITDLLGTPAQEVIAKVGSPFPRCSCWFEWKIGQGTRVSTEVGMPIPLLLVLAPGVILRAPACSCTYPSCPWSIGAQ

SEQ ID NO: 10501 - protein, 349 aa, Chlorella protothecoides
MVGDVDSVSWNNDAYMQTTHHSPLPVSNRRTWLALSRRGGKGEGAVCDIHSCLLWAAYRTHMIDTPIQSAIPSEDGILVLQLVKAQTGVTWPAAIAGHEVSPDVQTTDQKRLMLERFQAERALSWSSSPPEPRRTIPLKSPLIPPSPLIAASRLRLLPGRVQRRSPRPLHLLEGPARPLDHRVHCGPSSRSMLTTQASMAAASSPLALGPPRPRLATRGQLGLDGLRGRCGAGHKKASGTSQRPCCPARSSRDARGSDPRSSQRAGFPAASLCGGGHGRPSTHDAVPRPSGRSPLAPRAAPPGADAAPPGPGPDLEIKIVGLGGRGAAVLDALARGPRLPVSAQLWACE

SEQ ID NO: 10502 - protein, 189 aa, Chlorella protothecoides
  MOD_RES (115)..(117): Any amino acid
MSGGQPFGRWCRATPRSRAAIKSSGANPVGRADEHEFENRAVTCAPSYTAESPPRICIVRGSSFTIGRGAARPQDRVGAGPRIPSPRNGQGLQLSVAASVPKLAIHDRRQASRPXXXLLNAQACHSRLKASIPPTHARSDINIFIDLPPGARAKDLAVSFTTARLTVGLANTPPYLDVSPSLWGNELLV

SEQ ID NO: 10503 - protein, 396 aa, Chlorella protothecoides
  MOD_RES (127)..(130): Any amino acid
MQASSLPHMTPHPKPLPTLTPPYSPIHTPSTHLGVDLDVHLVHLRHDGHGGCAGVHPARGLGAGHALHAMHAGLMLQLAVHPAGMGCGWWPTSGPRCWLRPAVDTRPSPRPVHPVQPPSARAHLSPXXXXCCGHPSQPSAHPPRSPPQRPGSLVPRDAQHRLLVPAALRQALRHQAHAPALQLGVALVHAHQLGGPQRGLVTPRTRPHLQHDVALVQRVAGEEQQAQRLRLRAQPLRQALHLLARHGLHVGVALRLAQHVPRRGQLRLQRAVPLVPAHPLLHLRRGAGQALVLGGVARHRGRGHAGLQLRVAAGQVLQLGQHAIHHPNPIATHRCGPGDDVMPGRDARWIGGACGAGSEWPRPCTGSRGAQGGHGRGAPGQGTRRQCRAHDGRRDA

SEQ ID NO: 10504 - protein, 157 aa, Chlorella protothecoides
MTGDSSVARYLAGLRARTGVDSGIYCHGSGQVYELGHQGRNAMHSSPLPRAGLSSAGERGGARDDLDQLGGDGGLARAVVGQRQLAQHLLRVLGGGLHGRHARRLLAAVVLHQRVVQRGGQVELGQVLQQLRAVGALNLVLVQQAAGLGLLLQGLQG

SEQ ID NO: 10505 - protein, 314 aa, Chlorella protothecoides
  MOD_RES (138)..(141): Any amino acid
MAKPRHTVFVDGEEEAAAFDPAAYFDTHPDLVGRAFNRPRTEQLANPPPVAEGDTLAGVAARSERRRATAYKELLQRQARGEKLSALAARMAYAKEVAGKGRKRKLTPAEAGGQKGVFKWKAERKRQRNLMRVIGCSXXXXEPDTCLPVRYYIRDSQSEEPDASRRLLMLTRQPSFPRYLDPGKQFSETRAQRHRHVTPPPLQFPCQTPAPNTHGSLLATPPRAWGIRKDAAAGGSQPRQQALPEAGPARACGAGTEAQLRCRRVSLECACPAAWVCVPATPRSSHLCPIPVPCREAVEGARDASTLLGMLAWR

SEQ ID NO: 10506 - protein, 140 aa, Chlorella protothecoides
MDTSARPPSLPPSSFVQVLRGKAEARNPDEFYFAMEKARTKDGVHVVSTSEPNRYSQEELRLMKTQDVGYLTLKAQAEAKVIWWGGWVGGGRTMLLWGPVVHTDKPQSVPSSSLPLPLNLTHVHTKPHPSPIPCLRKWRG

SEQ ID NO: 10507 - protein, 184 aa, Chlorella protothecoides
MCRFNRVVLVEGCPPSLSMFWHGMVPYAGYPCNPLYREVATGKLIGTNIPLKSDALEGGGGGDLATTAQHEEFSGGAGQCCWRGGRPWPGAMSASLKNAVKRKTHKERAQPALDGNPAPTAGLHAGSLGSLRRKRTTYFVPRTFTKRRMPSGCAECGVSVSVRLGRLCECSRAVSLQSLPVLQA

SEQ ID NO: 10508 - protein, 350 aa, Chlorella protothecoides
MLLRDPYLACEMNEGHVNTRYLPAWVLPPNIVATTSAREAIEGSQYAIHAVPVQQTRSFLQSIKVGRSWWDGSRGAGGGGPHHGRALSWVCAVGGCPREVGCMGSGDLHRQLWTRPCSTSATLDSTPSPTRTVQTLLPPTLPLVSVSKGLEVSSGHVLSDVIPSALGRKQPTVYLSGPSFAAELMDSKPTGVVAASKVGGRVVVWSRRREACWGGSAPWRPRGTHARAGHGVCASSSERAALLSTRLIPGLDQTSHVRRRQLQASHISAPLTPPPFPFPQDKALAEADKALAEAVQHVFASPTFRVNTSTDVVGVEVCGALKNVLAIAAGIVEGLDLGHNAMAALVAQVP

SEQ ID NO: 10509 - protein, 155 aa, Chlorella protothecoides
MHMLGAHAACVAGPARRRHPTTPPTSPHCLTHRPRRPPYTKGCAEIRWLAEKMGARGATLSGPAGLGDIILTCYGSLSRNRSVGVRLGRGEPLADILGSSHQVAEGVATAGVVVGLARKYRVQLPVLTAVAQILDGHISAREAVFELMNLPQIDE

SEQ ID NO: 10510 - protein, 270 aa, Chlorella protothecoides
MSPALPSGALAWGAAAMPSLRPSRSCAGPRPFTPSTACPANPPRVAPRHYIVARAAAQSGWGGGSPVLSHGPAGGIPSPCVILYSTYLLTPPPQKTKDPYVLAKLEDLARSHAELQAGMATPAVAGDPTEYQRLARAAAEMQERVSGYERYRALEAELASARDVLRESEGDADMEAMAREEVEGLAERLGAQAEALRLLLLPRDPLDERNIMLEVRAGTGGDEAALWAAELVRMYQRYAELQGWRVSLVSESLAEGGGYKEAVLRITGDK

SEQ ID NO: 10511 - protein, 538 aa, Chlorella protothecoides
MGAGEEDGRRRAYLPNDSRTRYEASLEAGLDDGRDAEPYLSEAVRSRRSPPADGRQQPPPHWEPPPQKTPREDWVCGRCQALNFGRRQACFVCSSSREGVQAAGAREVRQRASSTLRVTGLSRHVDGPALQAVFRPVAEGARGWQWASPSSGSAGGSQECRHEVAASALRRHAPASASRAMSRRCASCEVQVGPQLPPTPPLWYSLVTRRPARRWLRCRWADAACLGGLRVRVAVHATVFLSWDGSTSQPHHNPCLLLLHDVAQTHTEALEAQFGPLTIEFAEEGLRGGEAAQVELGPNGVLEGTSWEPASFEEQETGDAEAAAAPVAVDCERPGDGPGSSAVMEARGHGSTTEEASQAPSAAPGFAYDPASGYMYDPGSGYYYDANSGMYCHPSLGVWGTLDGETGAFAPYQEPGLASTGVSSAAEASLAAAHETIEQERRRAAGAATVAASGPGPGAAQTQQPRRSAVIGAAPQLDAQGLFEAARALQQREDEKARAASSAHRPPAAKSAPAPIPATKPAVQGVVHRGKWAQRALQ

SEQ ID NO: 10512 - protein, 809 aa, Chlorella protothecoides
MSTHRPCCSSGMGQCEEARQVHLAKTSAAPAGSRRLSALQASGPLLVTATLGDGTALPWPQLPHPPRPLRSQSQPSSRALLVHRLLRPRPLRGQPRGGEQVVAEAVEVHPHRLIRGPSPHQWDHGALGAAAHAAREVQSGGGVPARGQDEVGQRRQLGAGLVDPGLQQGCVGGIEGRPAQLGLAGAGQWRRHRRPDVQQPALDGGELLIWMSPWLGVRFGVEEAVPSGCRGDLEHTVAHLEGHAGVEAPDMLPCHADGGVQLVDVAQGRKGGIILGTTLAGNDHGRRIPSPISRQQSSIDLLIPDAGGVVGSDGDAGRLAGDRCGEKVQPKPECGWPPWSYHMDGEAVWTRMQGMPDPLHIRFPDMPCRACCPAGWPFRNCKLKDADDLANQRGRNPRGTRDRAALQSIAREDGRQWSSSCPHQPHWKPHAVMATELPVSSQCRIRQQVCVVANHNAWLRHPAAKMETAGCNPSLLLLQVMMSRTWPLPAPSVRSMCTSQATHHGLWATAWWKVRPDSNDCSVGELRAYGFQHDLEYSRVLIKYSVPDLMPTHRWVNLPCNAHGPAVSHSARLGASLHPSSKAVMDQKYYQLDETKTLNWLKTKVENTKNGLRSLRYGGQTPACRRRECEGPTSAGSIVCHRPPMLQPVLTSTDRIESYTLQESRSSHPKPLHSTHRSLGWADAEEGVLLPYAVGLVCEYLPPHRVESLRTYLNVGMEPASPAVAGMPYPVSEVDTQPKRKKVSCLGRYPVGCIQMGTVPARLTPAEAAKLKAAESRQLNKAAKAAKEAAGTRKLSGFFKPRAGTNQSA

SEQ ID NO: 10513 - protein, 337 aa, Chlorella protothecoides
MLALDLQQAWRTQKTTPSSGARFDFSDPRGSARASAAASTLTDPTPQRAWEVSCSKVGPCWPTAASTAGWVAIRGEAWLLHRVKSSRTAPLATRAHLHDICTTPAQTPLMRKPNSEDTVCVTCEARPAQAAPAPGPGLQAEISEDLSSPGSVLQGPTLAQRIQRAAEDEREQEISQSLADRMLHGWTLLGQSCPICSTVLVRSRERQVFCVSCKMPVRLESEAQPTQSGPAARPPAAAEQIGEASTTSDQSGSGALPPLGSPEAAAAARDDQAAPAHASLPDTGSQLEAGVIIADAKAAVLRQMARATHLLSGEDRVEAQLHIIQAAAQALTALRGC

SEQ ID NO: 10514 - protein, 619 aa, Chlorella protothecoides
MGWRTLGGQLMWQGEWTLCITSGCMAKRDRMCPWESSRPSPIRPHDPPAPLGDDPLDLPSLGRSDPDPNPPPPRSRATDPALPPRPGHPLVGGRGGAARHRRPSRGRGPLGQGEGRERGARAGAVRDGGVCGGACQRPAHQPSAPDHGLALRLAVRGAGLPAQRPRRGARDHLTCPVRDRGGGGGRAGFCGRVPAAPAPRLGEPAPAVSGGKSRAAGCARQEKPAGERARPDNVSARHSCKVINGALAPRVDCIHTSIYALDLINIRSRPAVSPLFAPFRSLTLGDGQCCRRKRAAEHGREGDGRSARSPRTDQGARACSQTRAAEQGPVRRVRPPGPQVCRPADAVSLQGLSLCGQAPPSGFWCPQEYLNGFHKRKQQRRKDAVARVEKELKQQRLEERADVRDGITGSMPQAWGSWLSRKYPAPVGGRLRRMRPSPILHWRGVCGFQRREALKERYSTLGPDLDPAAPSLAEDVERRVHVFSHGAVESRVTVSAIDLNSSDEEEAGPGPNDDDDDRDLGEWPGPGVARAKKSAVQSGGGNGGGGEPARVRTHVSKATLRAIARTKLKLEGKRSAGGFKQPGPKTGGKGGRKAEAKEAGGKKGGKGGKPAPLKSRGKR

SEQ ID NO: 10515 - protein, 515 aa, Chlorella protothecoides
MKMPPRPTTINPDEPTCWVSAKKLGFAPASKAAWMLLRRASSSVTLRCASADVGVCPSDWQGFPTIKDRVTRSKIRQETILHTWRSICGPGTPRRTVHPRSGWTRTPACMLPTPSRPRGWCRSPRSMPSGHTSFRWPEKGRRPGLSGCMARDLGSDAAPREVSSRNSEVSLTLRSLSAGKCVACCGEYPRDDTAVDGAGKHVRKVYESPPRPRPRPQCQHGSSDPDSLPRRPVHVHALASRPDLPGIWLPWPGPHWQVIQRPSPPGGAGRLCPRGAAGLGPARHLPGRGAGRSWIDRHRHPAGRAIAGQPQGGRSSGTPPPFPFEQRSDYGPTQPDWYLIALRNCTGCSLRGGGTLDGDARAWDKVRAPGRRALVDWADPSCPVPSECRPRLLGVLDSRQVSVRGLALRDPVYWALHVRHSVHVALDGLDIRSEWGVANADGVDVDGSWDVDVRGCTVLTADDAVCLKACTPGRPTRRVSVTNCTLRSRSAAVKVGSETRADISDVTFGDLTVWA

SEQ ID NO: 10516 - protein, 216 aa, Chlorella protothecoides
MKIYTKTGDKGTSSLYTGERRAKDDATFAALGDVDELNSAIGVAGEHVRGLDPSMALQVRYGVFFPVACDTQQRQHPKPFQHVEGLEGPLPHSRLLDVGSAVATPLASASEAKLRRAAFDPAHTPLLEAWIDEASAELPPLTNFILPSGGHAAAALHLARSVCRRAERAVVPLVGAGATDEAVGVYLNRLSDYLFTAARLAAKRAGAEETVYKKGA

SEQ ID NO: 10517 - protein, 143 aa, Chlorella protothecoides
MHHDCADEAAIRRHASAMGAGASVPLFAGMLTQRPWDQVRRAHGAPERLRVEGSEAERELIRGFAVQYASEIAHLLRCMPRPLLLLLKTNDCLRCVQRVGWCSWKGVRVRGPSDGCLGGRCDWETLCGSNPLPKPCLSQGSSP

SEQ ID NO: 10518 - protein, 92 aa, Chlorella protothecoides
MVTDLEGLARLRVPPAAVAERVSRTFNEMIFRHGDVHCDPHAANMLVRAAPGAPGGWQLVLLDHGLYRQLDDALRLEYAGLWQALIFAGGES

SEQ ID NO: 10519 - protein, 328 aa, Chlorella protothecoides
  MOD_RES (171)..(174): Any amino acid
MQALRWTDGPADCLPAPAARCPPRLPPVSRGPPTNRPLDFPHVFTSRSRGEEGLYDYILVNDDLERAYASLAAVGERALAGAAPATPGEASAAFRTAQGSDVQEGPGRQPHESTSGLRGVELATIEGPGAAGDAAIPMPAGAEDVATATPPAASPASLLVSSAPGSILMVXXXXTATPPAASPASLAVPSAPGSILMVLHAGAPLGAELCCQLAAAGARVVAVAGDAPPLLALQERVQGLGAAAEHAFLPVVADLEREGEVLALPRIVAERWGGDAAVSALVVCPPDEPPTEETRLLVEAPAQAAAAALAMGLAGPAAVVRSLAAAGG

SEQ ID NO: 10520 - protein, 805 aa, Chlorella protothecoides
MLQLLFKKSYKSTCVARILLQGIAEGHRRGYDAKTDWTVTSAVQLGLAMRAARSGGARELERNPGATSAPPLHNIYGIPAMPTMRPGGGDRSAPRSPDVVGHRSRNHPVVQDVEHGGRGGPILQVSRGGSAGATAGWQGAMGTGGHPVPGVWAAALGHAMPFVPLPFRKPPPQPLNPSSHISACHALQARDSPPQEIPGHRLRPEAPPRLAAPRPAAPAAPAPPRGWAQSGGAAGGGAGAHRAVQPPGTPAGLPLPRSLPQARAAVHAQPGGECGPLRAGSGAGVDIAELGVAAGAAVAPPADAAQQRICEDIPALTEGLASLLGELLSAGVDAAFYSWALHSYTGTHRYTALLLAYVLGVGGAMAFAAPNFGGLFKRQAALEGAYRAVHTRLRANIESVAFYAGMHKEGEVVRGAFRDALRAQRRLLGRQWQFGMVQDLLLKYFGATVALALILGPFFGGHLRPEATVRGRAGMLSAMRYHTSVTISLFGALGTLGGASRKLMRLQAYAERLAELEAVMAEIAGGAGTGPEGLPPARGQLLACEDAIAFESVVVVTPANATLVRDLTLRVPAGTNLLVTGPNGAGKSSLFRVLGGLWPLTAGAIRKPGGGAGDAAGGLSHEIFYVPQRPYVTVGTLQEQLLYPLTPGAGGAAPVIPDDELADLLASVDLGHLLARGGESLDWGEELSLGEQQRLGMARLFYHRPRFAILDECTSGVSVDMERRFCSMVRDAGCTCITISHRPALMAFHDLVLALDGEGGWSVHAGHRALGASGAGRGGAGPAGGGGSGASGAPAPTPMLSGSVD

SEQ ID NO: 10521 - protein, 339 aa, Chlorella protothecoides
MGRPRKPGAGRIARYFVSAVACTLILTRENKRKTPNTHAMMVKLGRAAKKAKQFEVRKIVRRLKLAEANKKPALEAQLEAAKAANVQELASVAGSQLGLVRGPAGSLPDSPESCWADGPERAVCTRMLSAPCLKAVIVSLLEGDAEEAREGKPAPLDSPPASPSSSDGEEAADEVDEEAGAALAKLLQRSREAAAPSDSEDEAISLASDVSDLESLLSSSGDEAGPSAESSKAEAAALPVQSQKRAKGARVGPGKKSAPAKPKNRMGQRERRRLATMQYGRPAPPTIAKEAQGKPDRVKKAPAPALDATDLHPSWRAKRSQAAAIPARPVPATKIVFDD

SEQ ID NO: 10522 - protein, 727 aa, Chlorella protothecoides
  MOD_RES (401)..(404): Any amino acid
  MOD_RES (706)..(709): Any amino acid
MVHRTYMFCDYPCIHCHRWDSGMQRMASSELQAGPAGLDPTFPDPIAVAHGSGKAALILGHPWKGTVRRGESWASHYQSTGSTPLPSPSDPACWRSLAAPCRGFGNAHRMSLGIWKLYVRVLGSTLEPPFRYSGTHACGKPRFLTPASYFKFSHLTSCITFCPTSVAVEGRTWSRRSRASPREIPFVSRMVGVILQGRMGGGPGELRRATLRLARPSETHPVIAVRHETTGSLGFTKMLSNSRPWASCMEEVEGGRQAASWYLECLRCPMTTTALSKPLYHIYCHPPQVLFGQRRVHYGPSPWRHTRHPEHISKYAQIPHPSWHEERTHEGFYQGTIRTGPGTVLQSRGQVGCQEQAQFCSCNHAFDAHILNNGTHTHCRISAHSKMGGSRAYPAAQNLAXXXXTVEYQHTQQDGGKQGPTQQLRTWLQQPSRPPQREAGATLWWQQLLRGQRPRSPPENVGLYGACFDKNLDALNDSTIDAHLLGKVIGRAGGQHTLSSGPQTGHDILQLLALAQTQTCSVDGACGSQRVVPRESMGSKRPPFPIDPPRKSSLHPLTNSAVAAQVPTAGEHDVTHPGEAGEGQGVGPRSHRQAGDLVQSAGDQRGTAIVAKADAVGDAAGDRQHVLQCPGQLHAHDIVGAVAAEAIGGQQLLHMLSQLDVLGGDGDGGGDTLGHLRGKGGPAQERQPEEEKSGVRGGMKKPLARXXXXGPLRNASLKRRKRGWEGG

SEQ ID NO: 10523 - protein, 921 aa, Chlorella protothecoides
  MOD_RES (10)..(13): Any amino acid
MATCRRLLPXXXXAYIRTPSTALVTLFGTPKHGYMQEAASGCFGVLDLKQVCRTMDIGEDAVESVLSHLESSLGSLHAGRHDIAYLPQISLPEIFRLLPKTGIKVKVSFFADSAKSLAPQHPSIQVQPRLAKGREIEGCNALVTLCKNPRNGIYSVSVGKLASFLACTPSKALVSLRELAARNLVSLEMSKQEGPAFEILRTPPAPASLTPALADWLERGVRNQASQLDIVYRTFSQAANHRLAEAQEVSLRRDVEAYFENASVEAAGCLQPHEGVPLPLRPITKDVETSIRLVLRTLAGQEATKLQGLTVARMLLGISSPAFPADVYRRKLQGLWGSCTNVCAWELECMATRICTSQTFDNLAMHAGHPHYDEPLSMGPDAVDQETLCKGSFTWAAALTADYDRPGDERQIHRRWTMEEQVTFFRVLRESIGQKPETLCIKLARQIEHKQYNQVRDYYYRLTRRLRAVLDPSLDLNSATQVQLHWAMLRLWDTAQDFDIRDMNMTKLCKTPKKMREFSKIVSQKVASILKSRQVRYSPHEGHLQEQTIDTPVTERAADQVARDPLRGAAANFPSVQRSSAPTGSVLGPSDRVNQLPLPRARKVDAIHTQRPQQGFRQPVDRKAVRTRFRVQFHPMYQSTLMQMEALGTNPYLEICCGPKKTIYSILLHLSSKWNEVRTSENADIYISAARNDNGAGAEEWSLYNVSREAKMCDITHECGEAHIVQFLYRWGSKTAGQGGSVDQRITDSYDSEAVDEVRYYNCDCFYTVRIAADLPDHQHLGQNITIAVEAATTPRETEESIEGVEAGSSSPPTTSLHKNGEDNGGNRLMQEDILHAGNHLSAEQPLGPFPLSGPSQYAHGVTPRPLSSSAVPPLTIDGLTLGFESLLGPINPSWLENLHSNQPLLPLGDRPFADLFKGTS

SEQ ID NO: 10524 - protein, 180 aa, Chlorella protothecoides
MAETRTSYILSLVTPGSALADTSSILIYCAFRHDADVLAAKLQAIGHRAKSYHAGKHYKERAEIEADFRDRKLKIVVATIAFGMGINLSDVGAVIHATMPRSLEEYVQQIGRAGRNGSPASCYTVVDDGEYCTLRSLTSSGRTTSSAVEALLEHVFKRWAEVHEKVTRLAGAGRAYIRTS

SEQ ID NO: 10525 - protein, 351 aa, Chlorella protothecoides
MLLQALPSAVMASALSDTRTTVTVVGGGAWGTALAAHCAGMGHDTYLWAMEKEVVDAVNKQHENTVFLKALCITSAMSMQPTDCVPTTPPHTTTGTQGLPLPESLKATNDIEFAIKHAELVLTVVPTPFLFKSLSNIKDLLTEEHIIISCTKGILNDTLETPDDIIKRALPEKLHSRLAFLSGPSFAAEVTKGIPTAVTIASKNIQLAQHVQELLSTNRFRCYRTDDVVGVELAGALKNVLAIACGISDGVGFGNNGRAALITRGLDEITRLAVASGANPLTLAGLAGVGDIVLTCCGDLSRNRTVGEWVQGGFARRINGERRPGRNLEQGRGYLARRMVLEKPCLAADDK

SEQ ID NO: 10526 - protein, 116 aa, Chlorella protothecoides
MCSCAAGRRLPHASTTLLCISPAPQVVVDECHCVTEWGHSFRPAYYRLGAALKRMLPAKSLLALTATATKLTEAAICQSLGIQTTLRETCLRENLRLHVKVNTSGGRAGLGSLVTG

SEQ ID NO: 10527 - protein, 434 aa, Chlorella protothecoides
  MOD_RES (110)..(113): Any amino acid
  MOD_RES (359)..(362): Any amino acid
MKFQQLLLVAALLVALGPVSAYYLPGTYPQEFAKGSKIEGVMVRRHVRGRDSHFLVLRSRARASTWDIAPFTCSGGELSGVIGNGDSVPILPDAVLQARRWRQKGLQHCXXXXRYYRMPFCKPVGGVKKASSTVNPGTILLGIRINNSPYSFSVMVGGGCLSQWGVSITGAPHLGNFPALSLLIPPTAVTPDIPSLLMLLTCRKRPRPRWSARARTTPAGLTPRSPPRRSRWALHVDASGLRSQGPVWPGHACRTQTKSLLPGGLYQALPLGSCTRPHRLNSKCPGNPLQTLKEKIRDQYRVRLILDNLPITTYDLELDPESGGHGRVGDAWARAACGDVGQGSLGSRVECALRGRLAXXXXAACGDVGQGSLGSRVECELRVRPGYEVGYKLKDKYYVNNHLMFKVLVHESDGRYSRVAGDASLEAAAASDVR

SEQ ID NO: 10528 - protein, 351 aa, Chlorella protothecoides
  MOD_RES (186)..(189): Any amino acid
MADLTPRPEGVQAGIQRPPTHVLRARLAYIDVEILHHLVTVDGSGVALLPDSQRAGFCPGLGAGALCRIVVILRSNMQEVLEGSLIKVRRAWLCHVGHWMCRHLLHGHNMRLCPSTWNQVPYETLKRTTRERKYVLDDIYKILAALPTLAEGTDGAQKLQDMASALQHLKTKAPISSPVLAAFCRXXXXSGVTRDPCRGPNIGMHGRLLFPLQSWLHSVDTPTDATAPVAQLEGIAEAERGDLSRLLARVRYLRRVGQPEAGRLIDWNRPRINRLVIDYLLRRGYRQSALHLIQTSGPGVSRPCGKGDWERAQLGSQASLRMPRTGAHVEDRVQSGMRRPHAHTGVAGVPA

SEQ ID NO: 10529 - protein, 99 aa, Chlorella protothecoides
MHHLILPTPSSDLFPQAYYRRGDAAFALAHFKDAVRDFKAAARLAPRDPDLRRKVHWAGSFVCGRQQCWCESAAPPQCSWWSRLTASLPRSHVCTARRG

SEQ ID NO: 10530 - protein, 524 aa, Chlorella protothecoides
  MOD_RES (354)..(365): Any amino acid
  MOD_RES (423)..(426): Any amino acid
MADQKSDADQQVEIWKVKRVSGDDNLHRRVSGRRLALWRAPAVSTPPTPPSPAPLPPQLIKALDNAKGNGTSMISLILPPKSQGLEGPAYHHSPTPLPPSCHFPTFPRFQVAQSQAMLANEYGTASNIKSRVNRQSVLAAITSAQQRLKLYNRVPPNGLIVYTGTVLTEDGKEKKLNVDFEPFKPINTSLYLCDNKFHTEALNELMEADSKYGFIVMDGNGTLFGTLSGNSREVLHKITVDLPKKHGRGGQSALRFGRLRMEKRHNYVRKVAELAVQFFISADHPNVAGLVLAGSADFKTELSQSDMFDARLQAVILAVVDVSYGEPGRAQGEDFRAEGGDEGWGVTGSLPCSXXXXXXXXXXXXCQMDWLVEQQPTTHAASIECLLGKSCIRLCPPYSPYCTICCFILTVLTMSPVHEQNLXXXXGCIRLCPPYLPDCTTCCFILTGLIMSPVHEQNLHIFRGCLYQFPAYTPWQQIKWRPPHTMHAAPSHDGSPPTGLPPVLRVLYIPSPITYPPVSFILDV

SEQ ID NO: 10531 - protein, 261 aa, Chlorella protothecoides
MAFVQSLKSHTPFFKPPGGENGFSQAIELSADTLSNVKFVQEKRLISSFFDQISQDTGKYVFGVKDTLACLEMGAVETLIIWENLEVSRYVFNTSSGEQEVKILTKEQETDSKLFKDKVTGLDLDVVEKVGGLGDRVLRALWGRGYHAAHAGGSRGTLARREPMQRGAVEHSPGVRSPMTSPSFPHPLQQPLLEWLANGYKKFGCQLEFVTNRSQEGSQFCRGFGGIGGLLRYAVNTAEFEEPDDVDRPGSDEEWTSDEDI

SEQ ID NO: 10532 - protein, 268 aa, Chlorella protothecoides
  MOD_RES (259)..(262): Any amino acid
MQHGPCFAGFKSCQCLFISPRTRSRFPGCAARGPASPAYDQRHCRLRHAPGSLWPWEAGGSTQAPGVHSVAPARHPTPAASVWDSPSCNSAGILFNWFLICRDARSITPGRSDVIRPGMDLRAPGGEPGARQGLGLDHARARHGLGLDHAHKPIPILSSLRLKFSMSRYKSLELFKFGVYVTIPILLVGAIVYRPENLEAIIRNRSYVVYPPEAPRPPSAEQLQEVRRHEAVGLRLGLAPMRTRLTAPVTILAAAEEAXXXXGMKQWD

SEQ ID NO: 10533 - protein, 202 aa, Chlorella protothecoides
MKHDDGVHASVLWPHGTHPRPKHTASIHPRGTAPHAALPCSIPLSPPPSQLLPDGSRCGFFIGDGAGVGKGRTIAGLILENWRRGRRRHLWLTIGPDLRVDARRDLDDVGGRCALGPGSRLAWRVMGRRGIGVGMGRREPPAVLFGTSWAFTYAHSPPTPTGSHRDSSALAEQAALRQAGLQAHRHQGGCCVPDLCLSRLPV

SEQ ID NO: 10534 - protein, 143 aa, Chlorella protothecoides
MTQLQSRYKQLVEWCGKDFDGLILFDESERVGRRLGQGSRCAAGAKDGLGSVKVSRGHGRRGARQRSTSSALACHGAFAQAHAHTPAPASCSPSGHKAKNLVPEAGTRATKVGLQVSNLQAALPLARVVYCSATGASEPRNMG

SEQ ID NO: 10535 - protein, 98 aa, Chlorella protothecoides
MNPFRTPPPPAQTYQPAKLPYGFPHPDPVVETSSLSAVPPPDVKYSLGAHPELVDAGVLSALQLESVVYACQRHEQVILPFLCGGEGIRGKRKPGPGN

SEQ ID NO: 10536 - protein, 419 aa, Chlorella protothecoides
MRLAASLAQVGPPLPRHPPNPLFLSTHPGRWLEPVRGPTTSTPPALRVGGPLLPALRVVLGVGASQRPLLLPGPKPPLPADLCRGGGGRHARLSLRAGGRDCASRRPPAGAGGAGRTARGHGVALLAPFGPGPGAAGGWAGAGGPARADAGRRHAPVAAPLLPSQTAPVPTSGAAPPPLRLAQSAPTALLTRASFKLYETGPEELPRDIRSSLEHMIPAHVLEGFVRMGCVHVTLDCLVDCGATGSPPSGQSLLRGLADLAARPGWAAVPAMHVQVGGLLARAGRGVPDPGVRDLAGEGAPRVEAARRALPLPASRAVELRLTLHACDLRRDRLLLRSQGEATGYGWETCLDARRPIQGCTLPFFSAPSMHRGISGAQAAERDARWRWWGLAPRRRGAPAVAHSGRLHPLRGPSRRHPV

SEQ ID NO: 10537 - protein, 153 aa, Chlorella protothecoides
MAGEKLVAIISEAASAGISLHADRRAGNQRRRVHLTLELPWSADKAIQQFGRSHRANQASGPEYKLVVTPLGGEARFAAAVSRRLETLGALTQGDRKAGPGNLGFNYESRAGQQALRTMYSVILQQSHKPDLLPETCREGGCQGGVRAGDVGW

SEQ ID NO: 10538 - protein, 375 aa, Chlorella protothecoides
MASPDPLFSVRNNFYLGAYQTAISDASSLTGLSEDQKLERDTFVYRSYVELGSYEVRGPAIPFPCASPSPPFSQPHPSRPPPTARPQMVLSEIPADAPPPLAAVRQLASYHKAGPSPSSPVPDALEAGLSDGALSSDPTYLYVTALVRFLRGDAAGALRLAGPARTLELLALSVQVMLSLHRPDAAERQLRAMAAIDDDATLTQLAGAWVALAAGGPRVHEAASIYQELGDRFAWTPRLHAGLASAQACMGRWEDAEAELLQAVEKNPKDPDSLANLAVVSLHLGKPAGRYLGCAGWTAAWEGGKGRLRAVLCRPEGEGPSECGPVRRTTRAPEPEGIAPSTRRVLKDVAPSHALLERRAAAEEAFDRAASGITA

SEQ ID NO: 10539 - protein, 278 aa, Chlorella protothecoides
MDAVNVQGTRSVVEACARHGVSRLVYTSSASVVFDGSPLVKVDESTPYAARHMDYYTGTKAQGGQGFVIGRGRACVSGGGAAMSAWLSHGVPGMAAGGLGPGRSGRCLRFSSLSLQPPSMTRRGGGEVAVLAANGRGGLRTLALRPSGIFGEHDTLLVPSVASNAARGKLKYIIGSGRNCMDWTYAGNVAQAHLDAAAALGDARRVGRVAGRAFFVTNDDPRPFWGFMGDLCEGLGYPRPSVRLPFHLVYFIALLMQYVILPLLAPFKRIDSDFTPFR

SEQ ID NO: 10540 - protein, 222 aa, Chlorella protothecoides
MCCLDDDRNRPSTDGHPSDPLSLQSSASDASVSGKDSGDGKTENTSGEEEEESEESEAEIGLESDSESSKQGVSEEDSKETPEAAAKVLGGVWVFALAGNGGPKEQAALAILRREKFAAAHATALERREAILAAVGNLGLPNNPLDVLIDELGGPEKVAEMTGRKGRLVRSKSSRTVTYEARNASGVEKGAQEYCCLDVVASLCGRECLPGLKCSGRWGRQG

SEQ ID NO: 10541 - protein, 210 aa, Chlorella protothecoides
MATLELVAMDMKAQGMYVSRTLSYAGSEFLTVTVPLEEPVASQYADAARMWLELYREFMYAEEQVRPVHNFGRGGRRRVLPLQKGHAAVQVWHSSSEQSKLGPPSPHACAAGSARAHGTGQGLALIVRAVEIGVPLTPSRAQLEALGPTGLAKVDTKKGSGLQDARTLRLRAFWGSHQRFFRYMCMAAKARHCRVLPAGLACLKHRHPEK

SEQ ID NO: 10542 - protein, 252 aa, Chlorella protothecoides
MVSRAGWVQRGGPTPVLQIGRRGATVLGMLSRVPTHVHVGGTTNARKAMHNQSDIKFQYREREHKYAAHALIITFGDLLSSHETITMAFDWAGWALKVGSMVSAGRQARDLDAIQNLQFFICSNVSIQGAGVTLALLAALVYFQEKLVRGALAMGGAVEPERPPSLPPSLNNALLLHLIPQIYVPRLPGMPAAYQFFPAEFGLEHEDVWLSVPDGVRLHAWFMWLKGLTPEQRRRRPTVVFFQENAGNMSYR

SEQ ID NO: 10543 - protein, 169 aa, Chlorella protothecoides
MGQGVALAHGAAPGDALAAAVPHEAAWDDLRLESLFTRPLAADQAARALNCSVCASREDAVPLLAEAVVRAPRAPRTLLGPRCLGVGIVRAVDGERRRVLLLAPLPPAELAGVDTLQLGRLELPGPLLQTPGARAPYMSVHCLPTLGTGAGAIRSRNNLARARQADRGD

SEQ ID NO: 10544 - protein, 83 aa, Chlorella protothecoides
MSRAAVEEGKCIVIGLQSTGEARTNDVVAEKGDELDDFVSGPKELLSRLVTEYYPMPASPALWDQEDGASQLMIIELGEREGG

SEQ ID NO: 10545 - protein, 222 aa, Chlorella protothecoides
MHRGMEVLLSELERNSRLLGTPERAQVLLAACQSLLLGDPRCSQSLVPRLCGVVLAAPATTRHLLVKWWAECPAALLEARVVRPLQRYLTDELYTTKKLTVSVMNVIKVLARVEEGSAAGRVLPPDAFYNELISEKLDVLDHYVAWRQTHDTPAHAPGADGPFSFCSYPFLLNPRAKSKLLHTEARIQMDQTVAACRAEAAAGGEAAGGEERVVPAKRRAPR

SEQ ID NO: 10546 - protein, 112 aa, Chlorella protothecoides
  MOD_RES (73)..(76): Any amino acid
MPGALLDHAGGGVDPLAVVSRLPRHAHIPRLSQRLVRIIADSRTTASLQAGCAAILRADAGALAARLRGALSXXXXQPAGRLRRHLEGRCGRSGGAAARRAQCRAAAALPAP

SEQ ID NO: 10547 - protein, 182 aa, Chlorella protothecoides
YLAALSTREPALAAEHAALAVELTAEYDPAALEGLLLASSDYPLEEALRVCEARGMVPEQVLVLGRMGATDRALRLIVENLRDVGRVGQRGRKGGGACLPEPAPGGPCLGLRRRAGTWQAVEFVQNQRDDELWDLLITLALADPELTGGGPWGDQEACAAPVALEGLAVLSGRDSVCRDGLA

SEQ ID NO: 10548 - protein, 85 aa, Chlorella protothecoides
GAEAERRAQQERLYALDVARIAAGEDRRTTLMIRNIPNKYTQKMLLAVSGDRAGGRGVATLCRAGSPPVAAGLDLFGHAALRQRR

SEQ ID NO: 10549 - protein, 167 aa, Chlorella protothecoides
MAAGRCAWQPPWTSERRPCRARRRASPKRAKASQISPLTILPPLPHNTHTHTNHLQLIEEQFRGAFDFFYLPIDFKNKCNVGYAFINMVRPSSIPGLVAELHGKRWPKFNSEKVCCITYGRIQVCVGLVGGAGTVWGVYVDRQGGGLWCQPSGAGWGEGGQGGPRPR

SEQ ID NO: 10550 - protein, 1029 aa, Chlorella protothecoides
  MOD_RES (387)..(390): Any amino acid
  MOD_RES (646)..(649): Any amino acid
MDPNKITSKVAEMVNAARDLALESSHQQITPSHLAIAMLDDRQGVPAQALARVGGEEAVASVLRVLKKGLVRQPAVDPPPDEAYLSNDLKKVFATATKLQKAKGDGFLGGGAGVCPTCHPPSPHANPITPRRPHSSLPFTSLAPGIDVVFEALLGNKVVAAALAESGVGKAQVETALADSRCGATVDSETADTQFDALGKYGMDLTARAAELDPVIGRDDEIRRTIRVLCRRTKNNPVLIGEPGVGKTAIVEGLAQRIVRGDIPETLKVLIMGWGGGGVFGGWGLGFPGKGGGRTNGCRHPSPTRSRPQRSIHTTLPPFQSSPGREADLAGHGLAGGGGQIPRRVRGAAQGGAEGGAGRCGARHPVCRRAAHRAGRRQDRGRHGRGXXXXAAGRVILFVDELHTVLGAGKTEGAMDAANLMKPLLARGELRMIGATTLAEYREGVEKDAAFERRFQQVMVGEPSVADTVQMLRGLKERYASHHGVQIADRALVAAATLADRYITNRFLPDKAIDLVDEACSDLQVQLESKPEALDRMERALIGLQVEAKALEKEKDKQSVARSAEVAAEIAALRDELQPLQMRYQKASGGLHGTGLSPMPVAISIPTIPAHPHSTYFHPTRPTPPLTNNPPHHTHQLTRKRRGWRXXXXRSVCGEGCSEFGAFLSDTGKGAAGGDQGAAEEKGGAEHPAGAGRGAHGPGHGGRHPLRRAAGSGRGPARQAGGRGLGRQHVVGCGWARAGGRRGLQVDRHPRHQAAGGCCHWWCLGFGTSLLGMRAQGLAQIGRPTASSIHRSMGLAPPLLPTCCWLARSCPSRSPLTPRLEPRRACSTSPNSQLTHSLTAHPPAVHRPGAAAEPGGGAARTGGRPGRGGQGGGGGGAALARGPGRARPRLQLPLPGAHRRGQDGAGQGAGGRTLRQRARDGAPGHERVRRAAQRVALGRRAARLRGPRRGRAADRGGAAPALLRGPAGRGGEGPPRRHEPAAPGAGRRAADRLQGPHRLLCQHAAGHDLQPGRGGAAGRRRRPRRARRG

SEQ ID NO: 10551 - protein, 230 aa, Chlorella protothecoides
MEAKGKLARLGTKPLVQVLLTPGSLAARARPPCGRDILECGPDERIIVFSTWRDVLRLLEHAFGRNAVPHAHPQTRKALAPAFAAFQVGPGAGAGSATPRVLLLLVKQGGNGLNLTAAQHVILVEPLRSPGLEAQAVGRVDRVGQLRETHVYRWDSGVDFTKGDRRGRRRGGGASLPLASTGGRLDLGCDVQHSRLPVSYFRAADWSAMRVINPELDMCMAVLRARWRRA

SEQ ID NO: 10552 - protein, 469 aa, Chlorella protothecoides
MATGIGDRPVPCKPPLASAHLQGLQLVAQGRDLGGHLRAAGHALLVLLLLQRLGLHLQPDQRALHAVQGLGLGLQLHLQVAAGLVHQVDGLVRQEAVGDVAVRQSGGGHERAVRDLHAVVAGVALLQPAQHLHGVGHGGLAHHDLLEAALEGRVLLHPLPVLGQRGGADHAQLAARQQRLHQVGRVHGALGLARAQHGLVDKQDDAPRSVLHLLQHRLEPLLELAAVFGPRHQRAHVQRDQPHALGLGDVAAHDALGQALHDGGLAHARLPNQHRVVLGAAAQHADGAPDLVVTPDHGVQLRGARGEVHAVLSQRVKLGVRRLRIHGGAAARVGQRRLHLGLAHAGLGQRGGHDLVAQQCLEHDLGGGGKHLLEVVAEVRLVGGRVDSRLPHQALLQHPEDGGHGLLAPDAGQGLGRNALPVIQHRYGQVGGRYLLVGGLEGQVPGRIHHLRHLGRDLVGVHAVRVCAL

SEQ ID NO: 10553 - protein, 136 aa, Chlorella protothecoides
MHSQEMSRPASDDAPFSALAFKIMSDPFVGSLSFIRIYSGTLEVREMAGWAADDQANESAGQALGAPNLAPAAAWGPAPAGLHHLPAGTYVLNAAREKKERIGRLMEMHANSREDVKYAYAGDIVAVAGLKVGGRV

SEQ ID NO: 10554 - protein, 254 aa, Chlorella protothecoides
MPGLFEDSHRRRGHGRAVSWCPPLTASLGVNAALAILLIILALRSRGGLGPDTIDLNKRLLLAEEGLERLRAGKPSQASGGGRSRPPWLTIGIPTVPRRQTGTKYLQRTLETLLDELPGGEEGEAGSVHEVSVHGGGRGGGGAKGTAIRGGSPVLDRRPGSAQRSTARAVSTMCDTLPHLWRNEVSVLVMNNAPGEHAEFEELRRRAATGTDRFSLKARHYVTWLNNPGLVADPTPDAADPDDLHNPDDRPGRC

SEQ ID NO: 10555 - protein, 177 aa, Chlorella protothecoides
MALAQDPCPRLPHQRTPSLALQAGEEADLRPHRSAAPCRPTLPLLLLHGGGGCRRRGSSSVGLCDAEGSPQCIFPDTPRAFYVGPLACDCWVLAWLSRVTPVCAVTHLPSPLNPLPHQDDFEVCPFALRALHTAAVKANAQRESKGWVALRVSYGMNGVLMHNADIPDLMDYLWCGV

SEQ ID NO: 10556 - protein, 158 aa, Chlorella protothecoides
MISNLGCDPLVIQLPIGEEENFAGVIDLISNKALVWNGEELGASWNVEEVPEDMKELAAEYREKLVERVVELDDDAMMAYLDVRELVVVGGRGVEGPWTRSCPEQSTGAVPALSLLAVQGELPDEETIHKLIRKGTIANKVVPLTCGSGAGGVWRSGQ

SEQ ID NO: 10557 - protein, 101 aa, Chlorella protothecoides
MWPPLGDAHSAACPQVSRALLRPASGMVAGRARGMCVSAAAGGGKRAFPLDMYRNIGIMAHIDAGKTTTTERVLFYTGKSYKIGEVHEGTATMDWMEQEQV

SEQ ID NO: 10558 - protein, 775 aa, Chlorella protothecoides
MTSSISPTKAFLGRLGRGWRIGGPGTPPEPGPGSPPAQDSPPPAAGKSASLEALSPAYQTEGSDPLDEELCALPLAFGPADLETLAEARTGVLEAVSEKLSAHVLANYDRFVGGVEGVTRVEVDVQAAYSAARMARERLALALAALGATIRIAEDTRRKGSLAALLQTAGRLQQVAGLLAAVSCGTHRAVIGAPVPMSLHAPLPSAVLDCQEEGEYAAALATCGRAAVALGAVPARVAVARALEASLNAAYEETLARMSGALASVCLDFRPGTYARVLEGYLYLSAGDGGGADAAEAGADGDSSSDLRGALSDGSGGDGSTPGPRPSPLPGLAAEVQSALLAAVGSVSARVVRGVLLTRSGCEARARSAGGLQDLVRLLPSDLFRTALARLLQVLFDVLASHQAMVAWHAAALQAQEALEAGRGEVVETAGPATAACGAAETAGVLKGAMVGTQSPTQGEPARASAAVHHRQTPPRPPRGGRRSPENKARFSVAGPATLALRRGSSAREETEARARDEAERCAVLHAVHAGLVAGRGLVWDEVARHVATLLSSPAAFEGEHFLQERLGGKIGGSGTGCPWMPAHMPMLPPATFFSCSVRCFLHHPACHMQPHPTQLLMSLVHHPAIPPPTPSQTHTHTSAGDGLDAALRGGRRGVQRGGKPRAALHAAASIRQLLRRLPRQQPGGAEQHAGEGELDAVARGAAGPAECAGPPAAGWGGWREGRRRGQRRGRGRWRCRRCRHPRRARPPPPIRHVLPGPGRGGQPVAAAGRRRPLA

SEQ ID NO: 10559 - protein, 154 aa, Chlorella protothecoides
MPFGIYPVHCIVPASLNFHLPRSSAHKLRTGLIPLRADVQNLDAIVQDAQRRRMASARGLTGMWVKDKANSDSMDTVCEMAALSWVLRTAVKIISRMELKDDEEAFEVTMKAGGILDVRERYPWSGEPVDHPRRDKRRGKHTAYVKRTDQGPTV

SEQ ID NO: 10560 - protein, 103 aa, Chlorella protothecoides
MRDAAALLVWHARTAPTHAEEWPLIPPLTPAPHLLQLRDKIVSDTNGAKLTMSVPRKGIWGTAGVGGDNLAGCVAWTDCGGISLGGGGWCGALMNWCTSDGHG

SEQ ID NO: 10561 - protein, 235 aa, Chlorella protothecoides
  MOD_RES (54)..(57): Any amino acid
MDRSMKKRFRASVTARLSFVIFVFLAGVLIGRLGKPLLGESVLATGDFQQTPSXXXXVLKPAAAAHPPHTAQQTPSWETKALNKEAQGVVKGAQEVVKSAFSRASLTGTSRSIKPGPVRTVCENTCPTARDGVCQDGRPSPGSNATSFYETLHPVVCDLGTDCADCGPWVTTATPEALAWAPVALLRTAETKLLVRRVASPAGYIFGITDPELDTDVSRHVNGTGLFEPVLTLLW

SEQ ID NO: 10562 - protein, 113 aa, Chlorella protothecoides
MCRCVLKSPDLSSTPANPHRHQLLANCVQPDGSRRLVVDVGANFGYYTLMAASLGCRWAGAGKGVDALGLPAIIGGDGLGRAGWSPLFSYMKGRSMPGRAAVACRARIDGIVS

SEQ ID NO: 10563 - protein, 93 aa, Chlorella protothecoides
MAASLGCRWAEHSMLCSGLARGHTPTIHAHHPSRVKAWEPVPSFAAFTQYGLLLNNLTHLVEVGLVVGACGVECPTGLCLVLVGCGVHMRRPT

SEQ ID NO: 10564 - protein, 199 aa, Chlorella protothecoides
MHPDYCAEGVDGYVALPRGEWLPSPCYFNLLPSTPLPHQCTQFQGEAQPQPSIPILGSKTGELTPSSTKPLVPRSVCTNTCPTARDGVCQDGRPGPGVDAEAFYATARNVTCDLGTDCADCGAWVTDASSEALAWAPVARLRDAGNTLLVKRVASPAGYLFGITDPALDTDVSRKVDATGVFEPILTMIWWGKGGCKGA

SEQ ID NO: 10565 - protein, 169 aa, Chlorella protothecoides
MRGARDLLLKRSVENIIMEYSPGVGDWQRDWDKSMSNPIMLKAIPGAQHGRPPLAQRSHPQTPCPADAQRWSVGGYFAYDLPWSKVYTYPGFNVSMPVLERVLTYMLDLDIQDMQRAKLGKLGCELKQEVRAWFNGAGLDGRCLVNVALGLARGAWVGGACLSHVVWSQ

SEQ ID NO: 10566 - protein, 214 aa, Chlorella protothecoides
MPLLSQELVTVFGLDGSVTTFPPRPWPLDEARPGGGRALSLEARPPLLSLPLTEEQGLTIGSVFTIRASNGVDSCRRLSLLGFCHSVDHLHEKVELVVRQRGGAVVSSERQLTRCGKGGECGVCCMRGGCKKGLAVSLKHSSQAFSSCELRGIPPQPGSLRSTRSALAERLHMCIAIPLLFGVPPEHERLRAGVLAGGGIIDRVVQQWLVGCVP

SEQ ID NO: 10567 - protein, 217 aa, Chlorella protothecoides
MALQMLQDSNTSAHIDLVLCDVYMPDMDGFELLEIVGLSLGIPVISDTEVVLKGVTHGAVDFLIKPVRLEELRNVWQHVVRRRSQRRAEPAPPPAASEAAPVAASPRVGAPAAVHNAEASAGSQSGGGEESGSGGPQAPVGTWASHELRGDERGDERGDSLDHGSGPASDSRHRQPRKPRVVWTSEMHRQVSVVLFVGVGCGVERGRGQLMPAGCVL

SEQ ID NO: 10568 - protein, 338 aa, Chlorella protothecoides
MGERMRQEFGNSAPHLSEKEADLRVSDLCGERRALAGDILMKYVHLQGKEVSAKMLCDTLCCSLQNKKANIEAYLAKLSLASRKAEYLVKEFEGQGAGCLPILTTAGKRFSSSRPRCSSTCSPRFAVMGDLGMSLIKLANYEEAEGTRAGPYTDFGADARGIATESRRIGTAAVRCRRLARLAVSHLTEALVPLHDELALAPAAVAALKEREAALLTEHLIQEDKEKKQQAAAALEEAGATRFGGNPSKARKFAQLENEIASAEAAIVAAHAEYEKVKSRNEEVRSNPTNPIVPCCARSGHEPNVPYIAAGAGGMAGGQVSRLREDVHQRSPDQHALQ

SEQ ID NO: 10569 - protein, 349 aa, Chlorella protothecoides
  MOD_RES (330)..(333): Any amino acid
MSVQDPLRFGLEDDEVGRLKSLGLTPRGARLTPPRRHHRISSSRMFLLTWTSPITPARILFTMMQSTTQGAEGGSFQEPSTSAAAGVTEGNVREGPSAHFISPSSYSGNSRQGASSSGIQAVRGHSLTDTNREDLGLFGTASEEVLGVKSKPLYTITVSDPVKRSEEGMIPGLSSSHYDYLISSSSTEQRTRVEVRRRFKDVVALATLLSTKYRGYFLFPRPDKNTLEGQLGATDLVKSRVADITRYLNHLASHSIVGRGEELAVFLTAPGNLLNSLEWQGLSPLRNGGLLEGVARLPSQLLGTQPTLPSTTEATLNARDTNDLLRRFRXXXXSCWEHSLPCRPPQRQP

SEQ ID NO: 10570 - protein, 419 aa, Chlorella protothecoides
MMYSCMSLARCPTSLPPRAGLLPTVRARVLLSAPQQCARHICHGKAENNETVKSEDQGGALEEVGAEVDRFTKMTASTFAPRPSGPAPNPAPPGSILYTVFEVQAWAALVVGGLLSYNVLLPSDHADIPRLIGMWSIWIFTVPSLRARQCSSKEKEALNYLFLAIPLVNIAIPFVVRSFPLVFTCDLLLLAGMYAWKGVKPLSQLPSSKTGARQCQSPKSLASTLPLTITIRLSQLTCHAGSGNKKGQLMLTDQPRCQRTLYHTATSCWPMTFWLYSFHGMMPPTTSCLASVLGSTPARNLSVAAAAPRPSAMAQTWRDDCMRSAMIKALKRFIAPSCPPRPLGPAACTHHEGLATPAVASCKHSIHGCRKLAILCLEVGAGIGLDTQGLGQGGLWPQETHCEQDHVSLDDLGRGAKGR

SEQ ID NO: 10571 - protein, 649 aa, Chlorella protothecoides
  MOD_RES (635)..(638): Any amino acid
ARAPAPAGAAAAEAELEYKRLLRDAAEGVPVGGRPALWEAGRPTVVDGLAAVKSGGVKAYERAPLPFRDVQERMADWGEVHAHLPAEQHAQLLNTQSARCMDCGTPYCLNRTTGCPLGNLIPEWNALVWQGRWREALDRLLETNNFPEFTGRVCPAPCEGSCVLGINQNPVTIKTMEVSIIDKGLGPGRTGYDPESKWCWGGGRTHHALLAKAISRQQRSKGPFRAGTSAEHPEQTPDTSQPLLPLPLQAWEEGWMVPRPPAVRTGKRVSIIGGGPAGLAAADQLNKAGHTVTLYERADRIGGLMMYGVPNMKTDKVLVGDVLGLGSIVSQPAVPFMVSQLNASCAHTSLRAPLGQPASMQPLLTGAGGHRPAACRPDGGRGRPVRHLGPHRPRGGRARHPRLLRCPHPGCGGHQAARPPHRGQVRGHCGRWHADAWDTHLLLAFPSFIPASLKGVHFAMEFLAANTKSLLDSGLEDGKAISAKGKTVVVIGGGDTGTDCIGTSVRHGATNVINLELMPQPPVTRAASNPWPYYPRVFKVDYGHAEAAAKYGADPRVYEVLTKRFIDDGQGNLKGLEIVSVEWQPATAGGPPKFVEVPGSNRGVQKVVVPVRACNPTFAHAHHSRPWKIGSSNPXXXXVWGEGGRRCIL

SEQ ID NO: 10572 - protein, 140 aa, Chlorella protothecoides
MVLLAMGFLGPEATLAEALGVETDPRSNFKAEYGQFATSMDGVFAAGDCRRGQSLVAAGPRGRGGQEGAMKRLSALIIADLMQSSLQVWAIAEGRGAAAATDKFLAGVEPSTDARQEVVGGIIPWKEYSQKVMGQQLVAV

SEQ ID NO: 10573 - protein, 218 aa, Chlorella protothecoides
MMDTRFPVRTAGGRGTIQPSSHAWSGRGRRGCEVSGVCSGCSADAQSVARSTHLVDDGDLHGLDGDRVLVDAQDAGPLARRGAHPARELREVVGLQQPVQCLTPPPLPDQRVPLGDEIAQGAAGGAVEAVGRAAVHAPRRLRVEQLRVLLGGQVRVHLPPVSHALLHVAEGQRRALVGLDPAALDRGQAVDDRGAPRLPQRWAAANGHALRRIAQQAL

SEQ ID NO: 10574 - protein, 581 aa, Chlorella protothecoides
ALLAAAAAAGSTRHASYADLVGAALGPGPRAAVAALQIGINGLASVAYTIAAAACARAVRTSLACHGVSAGAGAANCGDQAALWREIAAFGAAQLAASQLPSLDDAAWSSAVGAATSLVYSLAALGLSLLHAGPGALSKRTYRGRIALPPPVMVYPSLLPCSHGAAGDEHGHPRRDGRGEDAGRAERAGRHRFCAGLPHRAGGGPGHHPGGPRRQAGGGGHAARHRRLPPGLLPPLHGRGRGRVSAVVRGVDGVDAARDCLGQREMQVRGSAAPPSGAMAAAVSVPSFPHTHHPSLVPGPLSTPIPLLVIHPSHSYAAFGNEVPDNVLAIPHIGPTWVLVVANCAVILHLLSAYQVYSQPVFAALERALLPARDPLGATKAGQALVVSETHPVVTPDHSEPAWPARLVLRSAYVVLATALAALLPCFSQILGLIGGAVGPMGSVLSWGGPAGEGWRGSMHCRAGPDSTPCSGVYTHSVPWSTHAALRPQPPTPRANPPTIPCARSPACTRCPPVLAGRRLLPHHALPASDGPARLAAVRPPDPHHPALLRFPGRGGSGSTRAGAGGAEELSLDGCPSGTAP

SEQ ID NO: 10575 - protein, 316 aa, Chlorella protothecoides
MSRNVGECRRGCTAAGVQIAKAEWNTAFGHKSFSLLHIKAHEPRLGAYMVDFYNIAVRLSVSASLKQQPPRGFGSTFAGELPGTFQPLVETLLEILRCNAANKLDAASSVRSSLPPGLPPGALLRGQVCFQVPRPPHSEVGRDHGSGVVENSDPQCDEVALRLEYNGHPISCTVDRTCRSLGYSGVGSQLEVELSHLVGSNMSALSLADQEVCQQPPCRVLAAVECLPPGRSACVADGQGNIGSGNTGLGNFGNDNSGSYNIGELEEEVVVGEAPRAPGCGMYGRFEAQARCSGVSWLCILVLLVRPVLTDIALRQ

SEQ ID NO: 10576 - protein, 435 aa, Chlorella protothecoides
MTHTQYSPLASTAVLYRTDWHHVLPDIEHSAAGDEIYSDQARPSARRAISAGPGSSRGATVTQEGKVRANSPRTAITSRPVPGPRWLAGTTGPRLKGLCAACAGSRPCTSEVRRDPTYHKKATIDQRRGFDPPESLVTPARPETHEAISTVQCMARARRLEPGPRLVLALSLLLLPSSVIGTCEGGACAGDHAAATAAGLLGSSAQSGLGACQPKKYPTSGSLMPITLDTQILDLVWVNSTEGGQPHVYAVTQDSGGFLGGPLWRSEEPGRAEAWRDITPMLTGTMGVGLCLSTTSQCLSVPSNLSPPSQIDLVPGKVSPYFGITNVLVSPALGQHILLQGRAHFHFTSRDGGKTFKAIGTPGNTTGFDQAGEVREHTHLASGTDFKLSISRFLALSCRRRSCSTPSSLSGFWPRHAAPAAPGTCGAPPADTIYT

SEQ ID NO: 10577 - protein, 273 aa, Chlorella protothecoides
  MOD_RES (14)..(17): Any amino acid
  MOD_RES (42)..(45): Any amino acid
  MOD_RES (192)..(194): Any amino acid
MPIHHSMYRLCRGXXXXLQLLRLGRTGWGCHLFDVAVMNGDXXXXHQLLRLGRTGWGCHIFDVAVMNGDGKKMTHYPAVVRGWLGRATWATRYSTDTDVVENVTLVHCPPDRHVKVAVPIQVGACVWGRRECDLPHCPAARNASPLSLGWAAWAQAADGEHCRCYPATHVAPCIATATIDLRLPLPLPRSSXXXIRWAGLGGVRQQMGSTAGVILPHMPHPALRRLPLPPGCPCLSPDLRGGGLPGAEGGGAHQPYLEEGPSAGAGRLHPGKL

SEQ ID NO: 10578 - protein, 205 aa, Chlorella protothecoides
MADYPLPPYQHTTPPGNQPEAVNLWVGDERSVTSWHRDPYENMYVVVRGAKRFHLLAPADGWRMAVRRAEVHCWEAAGPGPQTGLELRPTGETTAWSSVTPPGTGRGEAGIKAVVSRAAEAPGPGAPGANSDAPGHFADPFLPPPLEVEVGPGETLYLPAGWWHAVEQSPDTIAVNYWHDRHWGAGVAAATAVESLAVLAGLSEA

SEQ ID NO: 10579 - protein, 253 aa, Chlorella protothecoides
  MOD_RES (18)..(21): Any amino acid
MENTLYGNFRATSISKEXXXXTSGIPHSVMEDTLYGNVRATSISKELLVSVLRQLSLDARGEAMCAEGGGYAACWPASLHSVLIGQVTTVLHVLSTPSSCAELDVGSSVPMLEHPPSALQFCREYVGPNRPVLVRGAVSEWPALTLWNEEYLIRALGPTPLTISTTPNGRADALVPGPDGSALDPDTGNPVFALPMESKVDIATFYQCLRRRDGASPVPYLQYQNSSLSVEAPQLLVDVAPELGWASEAFGEA

SEQ ID NO: 10580 - protein, 239 aa, Chlorella protothecoides
MTEPASPALPWASRSRLSPAPSDAIRLDVGTRIEVLWQIDSEEDSDPKLKWWPATVESVGSEIQHGTAGPVHTLRRGLKALIDMKPAARTDSMMKITSSPPAINIFPSCHLTPAADAMVSLGSCDPESGSMDLIPEHLTWRRAGELWQLADEEGKSTGEFSGSKEGHSSTYGRLAALNEDNDANEGVVRLQEIAAAITERERLCGSSVDAECADALSALPASQQRDFAAGFRQFTDAIM

SEQ ID NO: 10581 - protein, 204 aa, Chlorella protothecoides
MSSTPQPSTFFSPWEPPPPFAHPPPDPALAQRIVKLVEFAVRNGPSFVDLARQKQAGNPEYGFLTGGDGAAFFTWRLFAAVNHLPADQPLAAGQHAALAAPAAPQPGAVGAVSSSPSPALPPEVASGWTQVLAALSGSHTSIRASQEWFMACRQHAQGMAEMMLQVGYGGVGGLMILETPTGSRRAKGMYADARAVAGMLGCTK

SEQ ID NO: 10582 - protein, 150 aa, Chlorella protothecoides
MAPMYSAAGCSLPDGPLGCWCSPQLSWGSTWFCLGHQAKRHWKAFCTSSTRHMLCQDSSPHRNHAGLIPKLVEESLKVDPPYSPLTIRAVSEAGVPPPPQVDVYLSARLDKFYAQIAVSTRVVVNYVVEAQGAPAPGCRMAVLNHRQPPG

SEQ ID NO: 10583 - protein, 446 aa, Chlorella protothecoides
MYANCIPRHPDAPGWDKDLHYVVSLDFFVSPVARMVPCGNLFEVVASKVFLAVPSDCPLGADGKARSVPSRSVAGRTVTLYVSDWDGDDFTEVCLPSNLEDDGEGPGERGDLGLRGCVGDGFGKRYNMVETHDSAAAFVLADHAEPGSRGPTSDSPTSDAYAPAYNASMHTLSLRNVFRRDFLADFMRVEGLPGMFIANRVDPLTVATGAVADYGAYLQTVATRNGGADWSRLPLPTSFRYAQCDACPAGALRDRCSLHLHGPTSWASPAGPRPNLYSSAAAPGLLLATGNTGLHLDTKPSAAAACTWASRDGGLTWQDVADRPYIYEIGAGGDAVVAAGHASDGPTAKVRFTADAGACWHEVDLPEAILVTNIRVDPASAGTVAAPARARLGTRTAPSRAACRRRASSSSSTWPGCWERTSAPAPTPTTRTGPRRRRARACWAVG

SEQ ID NO: 10584 - protein, 129 aa, Chlorella protothecoides
MGGRWYAGLRKMICPALNASMHATTSAQASKATQEAAKQLHLLYLANDVLFKALPSRPTGSTPEADAVAEAFCPRLGTMLRHAFLAGGQTDEVGGPPTLAGWGLRWGVSACKIKSSVRCGWTPAGILGA

SEQ ID NO: 10585 - protein, 296 aa, Chlorella protothecoides
  MOD_RES (84)..(87): Any amino acid
  MOD_RES (163)..(165): Any amino acid
  MOD_RES (243)..(245): Any amino acid
MPEYANKSVEELRREDYEDGCKGGAGAPAAGSGMFGAAPASAPSVFGAASAPAFGSQSPSPFGEWQRGPPGSSREGTKAGRRSXXXXPSPFGEWQRVALGSSREGIKAGRRSGTPCCMLHHHGSPGPDLARVCGTLVLGFDVPCPYSSRWHGSWSAPKLPLPXXXNTFLTPPPPFPKAAAALGWPPHPHSARPPLPPPLAPPACLAGRRSSRPRPSGPRPPLARRRRPPLAQPPRPPHSAGSXXXWHDAGARLWRRRLGPRIRRVWHARGLRARLWRLRRAARSLRAGVRGLWRGQ

SEQ ID NO: 10586 - protein, 301 aa, Chlorella protothecoides
MEAVGGREGALLLVPFARLVDGKIGSQDSSGRSPHAGHLKLRPTSHHPCLPQRPQVAFDPLDGSSVIPAGWAVGSIFGVWPGSQLVGRPGSDQVAAAYALYGPRTLLVVAAAYALYGPRTLLVVARGLGGSSPVCQEFTLGEGGAWALARDGIAIGDGVRTFAPANLSCRLTAPRTPHCARAARRASAENEAYGGLVRRWLEERYTLRYSGALVPDLHHVITRGGGVFCNPTSAGAKPKLRLLYEVAPLAYVTVAAGGAATDEAGPALDKVIAEHGAKGPVCLGGKAEVEACQEAMRSSVV

SEQ ID NO: 10587 - protein, 143 aa, Chlorella protothecoides
MRAVRVLSLLVLAIVARCTSADLEGTCWSLGPAECFLRPGCEYCNFFGRKNVCIWDAVAEYIPTSIANCTVTPGPKKPDHACDAYAEQEPCNGAQGCVWCISAAVKPACYPQDEAKLLPPAVFQCDAPSLLESLVSRHRRDII

SEQ ID NO: 10588 - protein, 199 aa, Chlorella protothecoides
MAESVRGLEGKGRRLSVVAETVLNDINSNFSNSSGELQRLLPIQRKLTEVQQDVKDLLEALTCIVEDDVQLKRLCLSDRAAALASVPGAAGPGAVAGKRTHKPGFKELRGAEGGYSRKGDGAGQRSPAMRMAAAILESYEFKLTAVHVSDIVEWVDLVAGLRRGGGWRSWRALPQLRTATRTAARGCRWTSPFPLSPPN

SEQ ID NO: 10589 - protein, 479 aa, Chlorella protothecoides
  MOD_RES (76)..(79): Any amino acid
  MOD_RES (264)..(267): Any amino acid
MRCCLGPPAGGVAVVVPGGCGRSARVAGKHISHLVAGGAAWLIALLASMLAHAPTLQLGFLPTPDDERAATWRWKXXXXCWPMSPLSSLGLFRLQTMKGQPHGAGKPRPGSGPYPPRVSASWEGETNATHHVALYFVSLLDPSIGETGVRHPWVSKLGGRRTVPGASRSCTPAFRTPPATPLPRAPSRRARSPKFDCAADRGWSSGRPDGQGGATAGAPKTVGCYKCGQTGHWARDCPGSSGAARLQGGAAVADGQLGLTPGGXXXXGENVPGVGHVGRSSQETQHCQRSHFILDHPGVLTPGHRGHVPCHASLLFLHRSTPPMTDAGNPPPAVVKEKRKKRKLTLDLLKETRGIPDVFHTFPDTFRKQCRGKGHEAGDLRRLLEMYIRWQVGVCEVHQGLLDLLACMPGRRPGDHGDSKSHPEEYAEGDHGDSKSQPEEYAEGVCSMLFLPEAVVNGTALTPFHPLSTPGPGVPGRAL

SEQ ID NO: 10590 - protein, 823 aa, Chlorella protothecoides
  MOD_RES (484)..(487): Any amino acid
MTLGKRQRRATEAALGSHASPGYFIAVHAGAGFHSKSSQPKVARALRAACRAARKTLREGGTALQAVTNAISVLEVRVRASACGRGVWAGHCLPGRHLHSVPHFPCHASPSHPSAPTLKQDDPSCNAGRGSNLTFNGSVECDASVMAGTACYGAVAAVPGIRNPVKAASLLAGETLEPLPCGLIRPTAATCTAWAIVCCAMSQPHLAMPHCRMLAGEGARVWAAQRGLEAAESREQAAQLPVPIPILMQARPTTHSCSLRHVPHKHPPCHQMHSTPRAVRQWQTFRAILADATGEYSGVVLPDSQQQRLFDTVGAVVVDGRGHVASGVSSGGIALKQEGRVGEAALYGAGCWAEEEEGGAGEEEGAGEEEQQQRETKEKSGGRRLRGETGASEAAPLGSKTNSMHGVAVSTTGVGERVAACLLSKTAADAVRAAAGDQGVSGALRSALRRSVLKVWRLGPQWQRGVAEGYPLPIVYFQGRQDSXXXXELQKGTPYPSCIPRAGKMHSLRRPASHTFLAPDPSTPQTPPPNDAGVICVLAQRSERAHPDQGCEVRVEFGAAHCSHSLAVAHCGAPRAEPSVHFMPALGSRDGLDPGATGSRPGHVVELAQSCRWNVEERVRLLYAMDDVHGPVPPAGLRGPDIPPLHPGLQAAAAPTPGPPNSRLRPGPLAPRPPARPAWPARPHQRRGWPAPRPRCRRGPRLPAAPAAPALRPAAPAGPRHPRRAPAAPPPRRAGVARRAARRPCRPRLRRRACGRWPGPSGGGGGRSEERGGEEVAWCALRRSPGKIWDAEQDPHPAFMATSFPQPVGQTGKAKASRSQVLP

SEQ ID NO: 10591 - protein, 94 aa, Chlorella protothecoides
MFMFVVNCSMGTGLLMGGMVYVYYKFGPKRRYKARLRDMRSLRDLLVFHMDDMDDVIQEIKQRGQVTKTEFAQIVRESIQERPMPRTCTKYIPY

SEQ ID NO: 10592 - protein, 60 aa, Chlorella protothecoides
MLAVRNQAVLLKTETCRAVLYADRAVLFPAHKTRATLRIAQQVKSAVGQRSVLPFELKAR

SEQ ID NO: 10593 - protein, 100 aa, Chlorella protothecoides
MSEAVRAYRSLLRAVKTHVSSSTGNPAFQQYISTTLKQRARAGGDPELARDYAFLLNSITEHKDLLLSYNIGIDPEQRQKDQYKKAASRVGLSLPEQFSG

SEQ ID NO: 10594 - protein, 299 aa, Chlorella protothecoides
MERRASIVVRYPPKQSAVFMGDFSCSIADAPAAPHAQAAALAQEGPKPVVAWINHFMYGTQEWYQLSFAAYKTELVEAAGGQNLNYTDILEIEGVQPTEFSPSDLAFAWGTNETFANQTLALEAFLSVLAEVDIVIDETFVADPSTYHLGEFLLQFSSEGVFPTAEDVWFSAGKILRTDGLISAAAGLDWYEGAIPRPGKVLLDLVSTTRPEALTVSGIVRGRGATHTPIWLRNIKDDPVVVTAADCTTAANGCSASPSTICPFISFCGNGSPVLLETNLTTGALPTGGKCTYAACPAA

SEQ ID NO: 10595 - protein, 271 aa, Chlorella protothecoides
  MOD_RES (165)..(168): Any amino acid
MLTATILADLASDNWLVVATALQAACRGATPELVTAFLPSVTALLAHPAPGVARKALLALHRFLQLDPGAGADLERTLVERLGHREPALMAAALAGLGQLIRAEPGQYGALAPYLTAILKQAYEGKLGRAFELHRAPAPFLQVRWVVYCFGGEGTAGGRGSEALXXXXCALLAGAILDAEARSLRTCSEARRACARRGDDRALPRPPTDTPPGADGAAAPAARAGRGLALRLRRRARGGGRGAAPRRGAGLAAGPRGGAGVPAHARGAGVP

SEQ ID NO: 10596 - protein, 324 aa, Chlorella protothecoides
  MOD_RES (235)..(238): Any amino acid
MPDLYAILKSTEKLERAYVRDAISARDYEPACQRLIAHYRTLWSTVSESVPSLQSFMATYGMQCPMAARRLAQSGMPATVEHGRATSSGEAGYTAAVADAVGQFITTMDALKLNMAAVDQVFPLLSDLTQSLNKVGKGMGGQYGHLCLWGGEEFAHRKSSVSLLRHGKERSIPLRVADVEACGRISKTVLLLYQSRLLLWSCCGSPSPLVILCHRDETPASPSFFVPPGPHTATXXXXSPSPLVILCRRDETPASPSSCVPPGPHTATRPARPPEAQGLGEQAAWPARQLRAGRGRGAAAPLRAGGGIQRIHGPPAPMREAGSP

SEQ ID NO: 10597 - protein, 604 aa, Chlorella protothecoides
MQQGLRACKTDARAAAALWHEYFRLELLVAARLRARRALLGIDGPAGAGGPAEEQGKTGDATTDGAGRPDEAAAAPATKDSEAEAALAEIMRGGIARVVMRSALAQAPRDAAFRSRFLDILQEMGDVASRGGSRRHGWPPLTLQSLPRIPTAAVDALLVVPQEEIYAGLAADLPESPQAWALRARHAAPSGDARDAIAAGLEVFERGLAAAPSPGLYSEAVEFLVQALEGDAPGADETLATACELCRRAGEAGHGSVQVLLTWSQLRLRVGDLAGAAEVARTAAGMLPQAPELWETSLRLAVAVAAAASASRDAEQASGCPTTSHGDSSGDDEEADAPGPSGRDDALIGATLEAVGACPRSEGLWLLAVQCLVAAGHNPGMLRTQLEVVLAQGPRGPTEVRNEGGERGGMGAVAAALFRAVALVRSPAAARKLYASLRHLPSPGGEFWHAVLDMELEAARAGRGDELPRPRILALFEVGWGGEGARVIMGLSLVAIWPKLGHSLPTPVHKENQSSSGSERACIHGYSPLAAAKLGSMLIAYKPRPWPRRLPWTHMGRRTPTCGCGICATPPSRGPRAAPGPFTGRPSGLCRGPLDSWSAASWSD

SEQ ID NO: 10598 - protein, 285 aa, Chlorella protothecoides
MSVFLRRAGERGIGHPPLGPTAPTGPHPRPTLTTDLREALDPPDHRDRSLSGIIQLHQPISRRGAVVLECLSHVPGDLSLQGWRCQGGRFPNNSAVQMQGGRCRHAFAPFGDPGDHFVGEFVGHGLWTTIVTRTCWIAGQVRLGRVNSQDGHDAISLASVTRPITILQPPGLRGVSAEQDGRFRNKELRLMKQMKFPEEYKTKVDLSRVNWDVMKPWIAKRVTELLGIEDDVLIGYIFGQLEGQKTIDPRKLQINLTGFLEKNTSLFCKVSRVGEGVECAVCTPE

SEQ ID NO: 10599 - protein, 109 aa, Chlorella protothecoides
MVQADFAATLAPLLGLPTPYCNLGRVHRDLFQLGASNGKDLEIAAWANVEQALEIAAWANVEQVVRYLEAYALAAYFPKQVLGRVLQEHADLLGDRETSKKGSEAEAGR

SEQ ID NO: 10600 - protein, 425 aa, Chlorella protothecoides
MLAVQREAARGLSCLARRMFVSSAVSASELEGATKTSQPAPEVQLAVEALRKRLAEGMQVARGFLGVDVRPGYLHHDRAWPCAAIHTTLSLCSLAAGPDLDTFVQGPDLTGYSVHAPAPKERARKPDWLKREVPGGAKYTAIKAKLRELKLATVCEEARCPNIGECWGGADGHTATATIMLMGDTCTRGCRFCAVKTSRAPPPLDPEEPANTARAVAAWGIDYVVLTSVDRDDLPDGGSAHIAATIANLKRETDGRLLVEALVPDFSGDQACVDRVAASGLDVFAHNVETVPRLQRLVRDRRANWEQSLRVLRRAKERGVRVTKTSIMLGCGEAPDEVTAALRLLREAGVDVVTLGQYMRPTKRHMAVAEYVTPQAFQAYQDIAEGMGFLYVAAGPKVRSSYRAGEFYLTKHLQDGEKADAAGQA

SEQ ID NO: 10601 - protein, 423 aa, Chlorella protothecoides
MLGGAGLLALLLSARLGLTQHSGWGFWQKLTVHDKEPAAHLGANVSWGAQLLASGTDHITRLAGKPSSWAGCLLVAGFPVALLGMAVCALSMHVPGVDPAAANILASARLARLAVAASFAAAAARHVVQGAVDAGVAASDAPLSALLAWAPGRLFQTDGGYVQPATRLFARVSLSTSGLALLSLALNRRVLRSHPGLLPAGLAALVALLSPPSTSLAMLCMLGWGWAAAYLPAVRLRSRLAQLQLNQSRHAVHAGLGLGGCVPARRPSALAPGAAAACSGSHARLLCLGAPVRVCGRFVTDDDFHLYRSGVLVALETFGPMLLVTTLAGIPWGSTASQARLAGAAEKTQESSRPVPSPQHAPEGAIAMMGTLRCAAALAAMLSAAVQRRHLYAWSLFAPRFAFEACFLVVTDITVLLMNVLLV

SEQ ID NO: 10602 - protein, 232 aa, Chlorella protothecoides
MVRPLQGHSCMSWYRGEFLCHGGPHPSSLLRPLPPHPTSGLLEVLAAAVDSRRTVLVEAALDAVQRLIAHAYIRGTVTVLHHRAGGGAGPLDHGAGGEGATAGTSTSASNPPAGSEARRPLPPAALAVDLIVRRPLPPAALAVDLIVRCDDLGDEGVELRLLSALLTAVTSAGLAVHGAALLLCVRAGYNVYLLSRSEVNAATAKATLTQALNVCFARMESGDAHEVPPPIM

SEQ ID NO: 10603 - protein, 402 aa, Chlorella protothecoides
MGSPAVFHLLNDRATARRALQSQLLLRQTGKEVWRAPLHTHTPSHPRQVGEAWGKNLTVVIAGLTNTYASYVTTFEEYQAQRYEGGFTLFGPNTLDAYIQVKLESGKRGPRGSEVRLGGCPGKCLRMRSGRELRALRAGSNPDSSAQPPPGPSASPSSPTLGSTCAGVQKPGKGHGRRRSAEYRGPAPAAQPAQRGRRGGLYKASSGSAQNKPPGRAKPPSLPLDNLQSPIPARPHPCPSTGSDYGRAVEDVEPGRSFLPGDEVRVVFQSACPRNNIRRGGTFLTVERQAREGAGWEVVATDDDWETRFAWGSCHTLDSAVGNGAEFLSRQITLKLILIIHSSVPTTHHPNIPWPSMKNTSHTYSLLPLPSPTPAGIGRYHPSPLRPSPGSSPMVPRQDGTA

SEQ ID NO: 10604 - protein, 287 aa, Chlorella protothecoides
MHAQSAPPRSCRPAERGQRSSPHSPPLRPLLSAGSRATRCTPPATAAWPSASAGAPPGQTTSPPAPSSPGSRPTRLTSSCSERASRVCEIVVVWAGFPRGVLSVPRCAARKWRTPVRSRHAFLDMRGLVVAASPHTRAGVACKPAMGMAFAAGTTDGPGAFDFKQSDTNGTAFWRLVRNFIQKPSAEQMACHAPKPILLDVGDMHFPYDWAPAIVEIGILRAGQFAILAVPGEFTTMSGRRLRAAVRDTVRLGECFSVFVGRSPSGMGPPGGVNRKQGRRGPGLLLS

SEQ ID NO: 10605 - protein, 246 aa, Chlorella protothecoides
MEGAYLPAEHGDPLAGGAILLMSRSVDGFWEGWQLHAVLSTSFPPSYPPKKLHPPSPTHFFAPGAFTNQLQKGFEEPRLLIVTDPRTDHQAIKEAAYMNIPVIAFTDTDSDLAGIDIAIPANNKGKHSIGVLFYLLTRLVLQARGTVSAASPWDVMVDMFFYREPEEAKEEAAPEAEAAAEYVADAAFPGAEEGAGFDASYNTGFPAAAPEFATGFDAAPSFEPAAAPAAGGDAAFAQAQDFGGGF

SEQ ID NO: 10606 - protein, 119 aa, Chlorella protothecoides
MDPANSLHPPPRQIIRPPDDALLSFLLGTAIGVMMLLSVVEMWVHNAMEHGWASTTSAVLLGALFFKVAQPLLASMSGTDQGGAVADLEGGKDSGMALVLVGDPSGTVLYNIMCASTGD

SEQ ID NO: 10607 - protein, 110 aa, Chlorella protothecoides
MADQRGNDVALLLAAQSHLGTKNCTAHMERYVHKRRSDGIFVFNLGRTYEKLQLAARVIVAIENPQDVVAISARPYGQRGVLKFATYTGARATVGRHTPGACGAVLGRGA

SEQ ID NO: 10608 - protein, 191 aa, Chlorella protothecoides
MGDSCCNPQGIGAVQDRIQRALPGVFVHSVATGATESADVLSTYFGDANAQVRAACDALRALPQLAGGYVAVGFSQGGLLLRGLLERCTGKGAPAMHTLITMGSPHQGVMDVPGCWDVGGGAGVAWSWCKTPAFPLAAAHPDPLLPCHRTGHASAVGAWGVLLLAAAQPPPGPVLQGEGDQREWVPDSEQT

SEQ ID NO: 10609 - protein, 281 aa, Chlorella protothecoides
MHDSQRHHWYSCMQAPEHVLTPADALSPVLGSGCRLPPGACRPRLQRGMRGGTGAESEEATAGDIGEEELTPSSGDVEMEGGSGTEEEEAGASGSDEASDDDDEGEEEEEEEEGPSGSEASGSDSPPPRRPGRKPRLDMGGLTTREMPDRKTRANRYAAGEVLAEDEDGDQDFWCAGGLVCWRAERSDLLRLETVTWLLPKAHPPPYHRGQEFFAEEAADEAYETESEPEDRLDQDFDEPVSEWWRWKLHGRGEWVMRTVYDTVLGEQEGGARARTEGGVC

SEQ ID NO: 10610 - protein, 66 aa, Chlorella protothecoides
MEETAAYRDDRLGLRTLNESGRLTLANCPGFHMQFTLDWFEQHVLPHVAVPVADARVAATQPSRTA

SEQ ID NO: 10611 - protein, 302 aa, Chlorella protothecoides
MGPGGLEYSIPDPSPEVVALVRALGAPAPGQDAPLPRASRAGSPKTGSPGTPTPCPTPPSTFDARTDAGSAELYFHYYGQLQHQQNMLADALRTGTYHAAISENSADFAGKAVLDVGAGSGVLSLFAARAGARVVYAVEASPAAQYARRLVQAQPGLAGIVHVIQGRVEDVELPEKNVEEVGQWVESSGSSGARSGGGTCAARQGCTACLRPAHSEKMLRHPRPSTHKPLPTLPSSLGRQVDVLISEPMGTLLVNERMIESYLAARDKHMKPGGKMFPVSRWQLPAVREEGLMGRWGVDQGC

SEQ ID NO: 10612 - protein, 139 aa, Chlorella protothecoides
MARSAFWKATDFFGLDLSCLEAEATAGYFGQVVVDAIPSGALVSNTAQRTIDFATAAPEDLRELAIPLSLQVAAPGPVHGLACWFDVLFEGSQAPRWLSTAPGLPTTHWCALGFLLREVHALARGTWRRVVRVWQGLGP

SEQ ID NO: 10613 - protein, 280 aa, Chlorella protothecoides
MDVGSKGGYYAGKSPKLLLHEWCLKEKLPKPRYKAVPAAAPGRWRCRVVLPHPRQAEADAIMFLAEEAAAETEEEALQRGAVVGLHRLAGDRSLHSLLPEQYRGLWKELGHKEILPRPGPSPSCTTLQAEESKARAVAAAARKERAAAREKAAVARAARHAPSAVIMTDQHRRAVADLLADLSVRDGEGGRLGIDAGPVPEGSSVASEARRLGFSEAAVAAAMQVLGPAVSLMQALDWLCLNIPEEELPTRFAPGGELLESVGMCGKGLEMGFLVAGRCV

SEQ ID NO: 10614 - protein, 203 aa, Chlorella protothecoides
MCRLSASISSPAISQALPRPTISGGTGPQPPLLPAAGDLGLQAHARPAPDIERAYALGPVQLVPRDGQQVNLHGVHVQRQLAHRLRGVGVKEDLALPAQRADLRQRLHRADLVVHRHHRHERGVGAQRVGQRLHRHEARGAHGEVGHLKPAVLQVPARVQHALVLGLGGHDVALPVPVETRHALDRQVVGLRRARGALPFDHS

SEQ ID NO: 10615 - protein, 98 aa, Chlorella protothecoides
MSAPSSIAHWNVSLDWSEEEQRALETGLARFPPTQGSPLAQYVRIALALPRKSVREVALRARWTKQAALLKKRRTEELESGESAAKRPLLHNPLLVGT

SEQ ID NO: 10616 - protein, 364 aa, Chlorella protothecoides
  MOD_RES (205)..(208): Any amino acid
MRLPTSKQEEFRFTDVSRITGAQLAAPPGGDAAAALGAAADLTLTRPAAVTAVVLDGVLLRLVPGPEALPPGVFVGASHDAPADVLAFSLGMQSGQRGGAFAALNAASAAGVLVVHVPAGVTLAAPVHVVHLSSPGGGVGDRDPGAVPMSSPRTLVVLEEGAAAGLVEEFVPLASPSGGAAGTALPAGAAAPYYVNAVLEVELDXXXXPSGGAAGTASPAGAPAPYYVNAVLEVELDDRAALSHAYVATDVAGASHTKATFVHQGAESSYSLTEARLGGALTRHDLSIVQLGAATQTRLASFLLASQAQLHDLHSKLTLDHPAGQADQLHKCEWDGCLTSGRATPGLSPSRAGRRVGGRPSSPN

SEQ ID NO: 10617 - protein, 144 aa, Chlorella protothecoides
MDQQISTGGGVWRLRWHPTDPQLLLAACMQHGFQVLRLRPGSGEWAVEERYAHQQTLAYGADWQRRGGDQAGPFAVATASFYDNALHDTADTPGRICNGRGSKTCGRPVGQGMEKAGTRRARGWAELMGGQAAGLAGRAIMLAV

SEQ ID NO: 10618 - protein, 174 aa, Chlorella protothecoides
MAVWHRAGGRRGCPPCGLGAESVDACSHQTEPVSAANVQLLICLPSKACAMCIVADGRSRGVFDGNVRVNRGAQQTDAAQISRNLLLAPRATVNVKPNLQIVADDVKCTHGAAISDLEEDQLFYLSSRGIDATAARRILVDSFGREVVQRLGDAALQGRIDAAVKKALQGVQAV

SEQ ID NO: 10619 - protein, 230 aa, Chlorella protothecoides
MRRINICIPDCSSTGLARVQGPAHRSRHDSPCRPTSDPRNHTLASPLAISQQVPQPSMPNWPGSMGGLGPIMMPSHPGPVPASAAPAPPPAQERATPAPGPGRGEASLGSLLEANLALLQQFKGNMTHFRVHDNTRLLVQFRDNILAVIKQMESMDGVMAQMPQLPVRYAADVCGGPAVVVLDRTRAVAWLGLPVRTPYSMWCLIEVALSQRSAAEGRCVRGASQSLAGT

SEQ ID NO: 10620 - protein, 134 aa, Chlorella protothecoides
MAIPHTSSRGPRQTSCPRRAAFLICASKRRDVDMMRFTLGIPGFDDAQIPRIIGLAGGSLLIANHVLGSQPTPLAQTLAEVLGLALASLAFAIPNLDAWVNGGKQAASATITGARNVFSLAEDLSEDAKVVRAR

SEQ ID NO: 10621 - protein, 280 aa, Chlorella protothecoides
MPACTLATATLTENTDVVAWCPSSRHTDLLAVGTYQLDESSGLRAGHAYMYRVRTEGPEVLQLEAEARCAGVFDLAWHPSSSSTPLLAMALSDGTLRLTGQDLVTIASSTPQPDSDALACCVDWRRDGQPPDTARLLASYSDGDAARLQATPAGLTTLERWSAHSLEAWAVAADPWQPALCFTGGDDCALRAWDERAPASPAWADRREHGAGVCCILPSTHTEHLVATGSYDEAARAWDLRWPGRPLLLSKARGHVKRTLAGVAWAYRGEDVTLKAYATP

SEQ ID NO: 10622 - protein, 62 aa, Chlorella protothecoides
MYLDMQATTPVDPRVTDAMIPYFTELYGNPHSRTHFLGWEAEDAVEKARAQVRRCVVGGMGN

SEQ ID NO: 10623 - protein, 216 aa, Chlorella protothecoides
MYVMPVPSGWGVSPMMAWGGGLQSSAGPDSRAQKKVLDLDFPTFPRVPARPCNEGRLVVSVSAIACTAEHREYSCQHTKYDQGMTRPKAPKTKTTPGQSPPTSPMPGSRKRGADAGSPAKDKAAAEVVDLEKRRLAVAEELRHVEQQLMPLPPSDQAQIYDLETKYLETSSPFGNAVRGYEGFLGGSSVANRKMVLKPEERLFSWSSVSGQTLVKQ

SEQ ID NO: 10624 - protein, 460 aa, Chlorella protothecoides
  MOD_RES (217)..(220): Any amino acid
  MOD_RES (410)..(413): Any amino acid
MAELSRDHQGETGSRDSTKGYWLGEPPVHQRKWMDSRRREWVDKVKGGHRCRGPPRCLQGRRGERRSPESSSAHVWNQTQGCTRCSVGMAVVFEDVTDQPEATPTSTESEPPKTDSITYSDAPIVIPDPSGDVPEECEANAASSSEQVGGECLDRAQGSLCLSGGARTTQQLILTHGVDPQDPIEQAEALKVEGNTYFKTGDDEKAYVRATQPADQXXXXEGLRACGAGSLVLLWGVVVVGCGISGATQPADHSALSATLQELYTAALEVAPAEATQRAVYHCNRAACSLRMARHAEVVTDCSHALELDPTYGKALMRRAAAYEALDDLEHALLDFDKVGCMPAVTSVGQDGQVELDAGNSAAGAAAARLRPVVEERREKLKDEMLGEPTSSLGVLGPDDSERRQPGLTXXXXFVAWGAWTRCKLKELGNTVLGKFGMSLDNFKAEKDPATGSYSIKFGQ

SEQ ID NO: 10625 - protein, 533 aa, Chlorella protothecoides
MPSLHLPSALALAFLVTALLAPRGALAASFRVETNALRIKEPASYAGSYDSAIGDFGVPLYGGTLQGRIGHLAANPKGCSNFTGSLPEGVEILLAIRGDCFFVEKAYHAQLAGAKAVIVADNIQEHLLTMAIPEDRPDIAALVPKIAIPVALVQKGARHLWSSLAVPLRALINHAQGGPNAVAYQGPDTSLPPVCPERHHSLPTPQILPSPRQDAGDRIQSALAADQGAVIVEFDWKESIVHPDNRVEWELWFSTNTACGQACSATSSFLAQFKDSAVSLEQEGFTAFTPHVMLGSCSVWTSEELCHRNCIRGGKYCSTTASSTGAAGELTGRADLRHLCVHKVLNETKKAWQWWEYAARFAAHCRPEAGQFTTACSEQQLRDLGVDTNAVGGCVGSLDSGEAHPLLDAQVRAQNERGPMGRVIMLPTLVVNTNQYRGRLNNAGVLRALCAGFAEGTEPPACLNPGVNVDECTQGVDTCWKENGFSACVDTFRGYVCHCPEGAAPLFLFFLGGGDGGGTRVGWKESGAGVCEL

SEQ ID NO: 10626 - protein, 190 aa, Chlorella protothecoides
  MOD_RES (93)..(114): Any amino acid
MLAPDDGSAEAAALQHPDAGGALRRFAVVGNFRAERDEFGLRLRIAEPGGGARTVEFAFDLSRDTAASVASEMVDDLALSPADAADIAAAIRXXXXXXXXXXXXXXXXXXXXXXAALSSDLEAAVSMNLEAAGEALQAGILHSAASAAGNEAFGVGDDHGEGAGGGDASAGDGDASAGDGDASAGGGDAS

SEQ ID NO: 10627 - protein, 131 aa, Chlorella protothecoides
MAAAGVAPNAVTHDTVLSAHAARGDLDAALAYAAAVHGDAECEYSLFFQTTLLRVMAGGGRVREAQRIFRDLRAGGAADDVAYMTFIDGMLDAWEGGGRADEGLLDQALVSARNPLEWGRGHGCRELRGAI

SEQ ID NO: 10628 - protein, 801 aa, Chlorella protothecoides
  MOD_RES (473)..(476): Any amino acid
  MOD_RES (556)..(564): Any amino acid
  MOD_RES (666)..(669): Any amino acid
MHSARGTAAWDSPLPFADIQSTDNPGTPQAVHHHRLPAGRHFVHRCGGLLWRAGSGEAGRFGLAWRGATSSSSLTLGPCSGTCLTHDALWFEDARVLASCPCQDPRTRSRHVTALRLRWPVPPALATSPPSHHPPHSPHPPPTQEYPVAGGSFTYIMLTFGEFPAWIAVSNQMGIEVFGSAALARSFSAFLASMCGQPPTFFTLSGSHGDEEDWSIDLMAGGGTLLITLVLTLSGRLSGIFITGVTLVKLGLILFILVVAFTKADPSNLHPFFRDGDVGGMLSAASIFVYTMTGFDSISNAAEEQAAPMGLWRLAWPREHELGSVGRAWARVTAPRGSGMHACVSQGTPTQGVGRGALARPGTCRRPSAPTSTPPHAQAKNIDSLPWAMTGVTIIATVLYTLLALALSMLLPATAISASDGMGHDFLTIGAGEWGGGSEEVQGYAWTDLVTRCMSPVQSPRTLAMPMCTCGTXXXXASDGMGHDFLTIGAGEWGGGSGEVQEYAWTDLVTRCMSPVQSPRTMAMPMCTCGTVHRPLGVSHSRRICPGSLASRLFLXXXXXXXXXMVNTPSSIRPALHEVRRGRGRGSRLLHGPPGGSVHRLAHRHGGGARLDAAALAGQDLHAHQHAGARPDRRGRGRGGVRLPAAGIAALAWRILPDAGKSTIPXXXXLLRGWGWGLASRGCGCLPLELPLWRGESCLTLASPPSQGSTTPSHLGNCSPHRRLLLRPFPGGPGQLRPAAEHLVCGERAAVQAVLPGRQAAVHTVGTGWSDLRRQGRCFRACTGIMQCVCDWGLNVSVRWG

SEQ ID NO: 10629 - protein, 231 aa, Chlorella protothecoides
MQYIVATAAVLGCITGLMVGLYAISRLVMVVARDWMLPPFLARVSTRTQTPLVAQIVLGLIIGEDDGIWGGGIGSAQERREWVGGPCLGGGVATCWTGILGWATGRVGAAGHVMGAGRRVVCRLLPFPCPCTIALLVPADFLGDLVSFGQLFSMWSVVNAQVFRRYYPEIKLRFTRFGAVETANAKVESMALGGRLNLSVAARRRLVALHMALMTLFATGERDGGREGGVS

SEQ ID NO: 10630 - protein, 111 aa, Chlorella protothecoides
MAAEAAGLATASYGDLMLATIGGVYAQQAEIALGGIIDGSVAALRAKGQNIKSQGGEGSTPHEGQGARASRRAEACAAARVWPRLARTLLEHSPNTHNPPSTPSSRRPTWR

SEQ ID NO: 10631 - protein, 138 aa, Chlorella protothecoides
MRRGLPHSPLQGGVEARNRHDGFAPTFFRVGRPGSCDFQAPYSALMGAARKPQPHSRAPLPLPNPPSQVGALMGKGGANISQVRSVSGARVHLSPATEGEPGATRALEVSGSVEAVLAARNMVNAFLAVGGCSEAQPV

SEQ ID NO: 10632 - protein, 766 aa, Chlorella protothecoides
  MOD_RES (462)..(465): Any amino acid
MLLVRGSGDEAGRFTEKTIKVIILTWNYMASWEGVSTLAQWTTPPSHHLALTAICTPFALPHEANPMRVEVHITAPPPSPFNIRLIQATLTPFVAKGNLVNPRQQNLLVLKRNSSGVHQLQLNFILGCCGLQINGDLIPAGQVGGDDLHLQRHGVCGLMFKEKGSKRGFHDFLQHRGCQSAAVSEASPFPICQRPGLRQQQQRQRTFTGTPPRRRLERCSVDPWLRDELSIVWSPLIRRPPATRTCTYLDPELQVRDARCRVHLENPGLQTAPTKLGESLDLTGQFPGFFICAPKHFAPGTRGSDTRSGSGVALGMSDDDEGFLDFSPLVHAQTGGQADDQHPGPAPQRQGHGRSTVTVHALVADMLHSKQHHMRLMAPSIPSPVALPPPREEQLPRDRPCPPLPEGQLHSEPDPGRPCLSPSPGPRQQAPGLVPGGLPPDPGARQPLRAHPGPRVLCSQPXXXXILDQEVRRVLGGGLFGRHREVFWMLHGASVPECDHLPGQRCVPSLRRQGRLWRWSICPSCHDAIPTCIPHPSSLRSHLVQEASTLLSAGAIAGSNAACPLPLFVPVQDALRDGALGVDPGGAAHYESDSLHTSALPSALFYPGEQLRLFAARLDARDAPAAQSCRDAAEAGRDDEDGDGDGVGAPHGCDLLPRVSLQARASFPLASPPSHDPAPAAGPQLGAVLAAFFRPPRLPVRLDLDLVWRYADAGRAVAAATGRFDPASAAEWHLAALDPGTERDDGHRWGLGLLLSLRGFGGMRFQ

SEQ ID NO: 10633 - protein, 379 aa, Chlorella protothecoides
  MOD_RES (86)..(89): Any amino acid
MPNLGFCEAQAIAVYSVPKPVASYLLAPSLSAFGQRNQATYLIKPTQDVIQESHKGFQQKQTLLPAMIIEVRRVDKTVGPLWTGGXXXXYDIFKYIIWEQIIEVRRVDRTVGPLWTGGRSATSSGDAQHNFSRLGHSNPCLENLIPPPDHLRQDVNGLGESGSVVQVSAGYARNYLLPQKLAQQLAFDTSLSRRERTQQAAAALQGADLATSTSQSQAEEPEAKSTPKDEAGAVMEKLKTPLVGILTILGDARGQHSAMHILTPGVQTEGRGAQAGGPSRAGGRGGGGGSAAAHHPCPRAVGHREREAERGGGVPAAPEDCDAGRTARPAGGPHCSDVKHPGPCLSERSSTKAGSLGARQGFPVPGCLREASRGVWHMK

SEQ ID NO: 10634 - protein, 478 aa, Chlorella protothecoides
  MOD_RES (248)..(251): Any amino acid
MAAPLPRSISSRAVTSHAQKHFIKLLLRGEALPEAVAASGAGYTLSGRPLDPNCASARAYGLRPDAFHSERVVQAARSKCASMGQYMHAWLGLFVCVPGWSLCGPCGGPRARRNHPHLPILTGVAADGKLTVGIHVTSLEMEAEPAGVVKRLPKGMPADGCPWESSAALSAAKRGRKKRGSSDSEDEGRPLAPAFPAAAEVMGWPRGPPSHAILSCLFTPLPGLPPASTRAPPPRNPPNTPRHGHGGXXXXMFKPLMCPLCRNPCPAWPASTFPCHSLMPVYAPSRPPSCFHQGSSPAEPTEYSKARPRRQGGQRAVMGDTSESLDLTCPKEFVGPPGSAAPLAQPFAVVTSSQVGCKYGVVVLSPSPSCSTAGALDPALASPHSVCPLPVIHLCIAHAAFRPLSPAPSHSHGDRPTQARLVMDFHAHLSGYEVIGLLGGRYEAGRRVLHVDEAYPCRRAQGSDSGEALDAGPGPWSW

SEQ ID NO: 10635 - protein, 502 aa, Chlorella protothecoides
  MOD_RES (225)..(227): Any amino acid
MELEVTFHPGLETLGERLLARKKAASGDAESVWDAYMRRRAEKRAQARRLGKSGVGSSDEDSDGDPDPASSGDEGEMLAAGVADDPFFQRDEGEDPFADPFFSSAPGVPGAGMAANAATARKKEKRSKRAEEGATAAERAELEMLLMDEADMLRKAQAGGASPRGEGGKGGTAAMVMAGWEDLTLVCRYLVYLLHEIQFGHRQPHAPFPRHVQQAGPQALQEGAXXXALGGRGGKGATAGMEMAGWEDLALVCWYLVYLLHDIQFGHRQPHAPFPRHVQRAGPQALQEGAPAPEEGSAACGARPGLRRRGACAGRCVPSVHTGAVRARYTAARDTGQTGGRRGGSPLLEHCHLVPVCPGPHGPPIQGRERDPGQAGGQAAEGGGGGAGGVGAGAAGAGRAQHGRHRAVPEAEGQGGPAGGEEAQARTAVGDGAVRPTCHAVFTFKREVQHLPPPSTTVGRVGAWPRVKTTPALPVSCDVRIVRISASFPKRRVLPETTMPDC

SEQ ID NO: 10636 - protein, 520 aa, Chlorella protothecoides
MVTGGPQPGCSAGRVRWQSGALSPTQGTQGGPRVGGSGGPQAPGATGWLGDRRHLGRRAGWSRGRRAHPGAESTRSRHERARGATLPLRGPRSVADLGVELPPGLDPGHDAVGQLFEVGVQRSAEWDVHAVEVNGPAHAHRAVPYVPPRLHSAPPGQAPRARHTPSARPNPLGLHTHAQTHSLPTPPHPLGDVQHGGLHGGHAGVQLDGLEEGDDLLLPEDALVLLAQVDKGVAGLGVPDVGQPRLHAQAQVVGDDLDAPPRPHVVVAAPGLALPHQAKVHGGADGVAVKGQVHAAHGEQRALRGERGGGDLVWGLRRDEGRKHRRASRKQGKASMAPEHAPYRQGMKAACSDPPPPPTLHHQTQAHLGNGHDSVHVSRVALLRLHHLGGRVVVWDVEPEAVRHRGGLALAHGEWVAAHKVAARHVRVVQGVEEVGGGGGQQVLDVLLQGVDVLAAGGLGHEAVVVDSVDVALLAHHVPEAAARMGNRVEGSELEEGKLGRGSWTRTRHCIRSLGRIPAL

SEQ ID NO: 10637 - protein, 69 aa, Chlorella protothecoides
AARRRAFLLAFAGSPVDAVHHLVAAQARDLRIAAGGDALDVLPPADVFAERWVEDAALRVMAARGAAAG

SEQ ID NO: 10638 - protein, 138 aa, Chlorella protothecoides
MAPPEKAGGSTGKADNQEMDDRFAAVSTDPRFRRFPKKESKVKIDDRFAGMFKDAAFQGQGARDKRGRKVKSGGKGEKLRSYYRLAGDEEEPAGKGKPVASDPDSSSEDEAAEAEARWAKMRCGLAIGMERASLSLDS

SEQ ID NO: 10639 - protein, 202 aa, Chlorella protothecoides
MDDAVVTPLIRLTPRRIPRQIPLVPDATPRLAVLDLDWEHVRAVDILAVLRSFCPPKGGVQRVTVYPSDYGLERMAEEATAGPQGIWDAGADGKQEDQGGSEEDGEGPSAGNDGQHRRAHAQVSQEPGVQKKTPFLLLCHARAGGGRSMATVNDSFPWSPIIPCSRNRAAAAPGVRAVQAAVLLCGRRVRRRGNRFAAIRGV

SEQ ID NO: 10640 - protein, 165 aa, Chlorella protothecoides
MQIFLRGLSGRTRVLEVDSASSIADLQLRIQDVEHVSPADQVLVAGGRLMSGDHTIESSSLSHGSTLHLSSRLRGGVPVKVKIITPHLACGNEVTIDLEPTATKDEIKLKLVDATGVPFEHQKVLLSGINQIALGDKRCESGLNEADVERGWWWSCNVNFDSPAQ

SEQ ID NO: 10641 - protein, 109 aa, Chlorella protothecoides
MKLGQVAREYGLVASTLRKATPGKVFLTRAEFTSEKELFGKLGIVSLPHLALIPPSLPVGAAQAVGLTKDHAMPLNDYPWSAETIAGWVMETAGLPAVEINRPSLLKSR

SEQ ID NO: 10642 - protein, 90 aa, Chlorella protothecoides
MSSHDPEGSTLALHSVCVAAKHRRQGLATRSVLQQEAVVHAITTLQVALYEGAGFGLIGPSSVVHGQDVWLEMRLDFSDSADGLDWCVGA

SEQ ID NO: 10643 - protein, 402 aa, Chlorella protothecoides
MATAPPRPGVNSAKPEPRSCLGVLFYNQLRHDLGRPPACAGIKRRKEAGAVLNGSPDALPSGDFKFMCVGYSAYDEAALRDAGRNSKPGEPITMPACEGIEVVAAAHGQHNPRLMPEGPQADLPPLAATREAEGRPAKPRPGISYGEEETPGGGLRLWLGWKHGTYKSWFLGPPCLVAFTPLKTHSIAHLPLARGAQALRTGFTSWSRGLAGVERLAALRWGTLAATSVRAMLAPMPGQWPCTLRDPLQLSYIVVRHRPEHAGWLGCSERPPRALFAALAVPDPSLYQRVRSMLPLHLMEQSMPWSGVHAPERAPPNPGGASSRPPHMQSRTLHARKGRHSLASHGVPHRHRPRRPARGHQHRRVGAEAGGEHGPDLEVLGGQQGRLAAAPGVPQLDLVQVL

SEQ ID NO: 10644 - protein, 619 aa, Chlorella protothecoides
MPPLPPRPFSLHLQVSVGIPAATTLPGHSTAPAFRLVPSWALGSGVVLLVLAFDQLRRQWWRLAQPQGGVAVSAQAPPAQEVPISIAQGPPLATVQDAPAFAAQESPQTIAREALLPDALGQATDRVQPAPPTPFSPVELAALHDSAQDRAWALESELGSLYVRLCRGLPRHATSELEALGARISRLEAEADRDVRRPGCAVLESWTRLICNPCHLHVARHRQACIVSSQHLSHVHQSQQGEAPDHLQRCAQLSRAQLDVLEAAGADVSAYAPLLASYFDQRALVSKVEGMVRSLAGPRAAGQAGTARTPEVDGTSTFETQESDFQSGSSLGGAVQEPRQAEEDDGATVQPSRGDAQLVGGNVREGILAPGITGPAPLGPQPEAVLVDVAENGGTEGPGRSGVQGSEQQPATSQSAPPAVIPEPAPWPQSAVPEGAPASVRDPPEAGPSAGPDPAGPAAPPAPSAPRLTVVGGAAMFPHPAKQKMGGEDAFFLGRSAFGVADGVSGWADYGIDPSLYPRALMASCAQLADSGDGAPLSTAALLESGHEAAQEPGSATVVLAQLDPARSTLDMVCLGDCRAWVVRDGQVVLETEVSGDDPEGTGVDDRVGACSRHLQGRM

SEQ ID NO: 10645 - protein, 253 aa, Chlorella protothecoides
PPAVAAAAAGRPAGPTRHFETELEINDFPQRARWKVCVCGVLSVDAGNSIAWCKPQSHPHTISPTHTGHAPRHHQRHGGAGRGGGHQGHLLPARRQGGRGRPQDLPPHRGWVGQSLPFLGGREGKRGRFARGRQHGATRPASSKPTLPLTGAKAIPWPPTALHPRSPPPPFTSAVQDRRSRSCGAPRARSSASSRRRRSGRCGARPRRRGGTPSCSRGSLPRLNPPPQVRGRPGLVALRLEFLVCKGLQAVGL

SEQ ID NO: 10646 - protein, 90 aa, Chlorella protothecoides
MASSAGVEDMRTPDEKGAETCWPSGPPYSTEREVVGDTSQIGSDAMQGPHARRKGRKKVPPVDLARVEDPEERKRQRRLMKNRETAAASR

SEQ ID NO: 10647 - protein, 418 aa, Chlorella protothecoides
  MOD_RES (39)..(41): Any amino acid
  MOD_RES (97)..(100): Any amino acid
  MOD_RES (258)..(261): Any amino acid
MEGSEQILHTAPSGCASGRDMAGIRQLCWSSSALSHSLXXXHSTIRLCQWEEHGWHRTAVLELLGSFAQPKFHALTPPCPSPPPVHTGRRSTDGGAXXXXLQKQLNSGAISQQDAEALMVGHAEKTLAALWKVNVLDIEKTLEAVCVAVLNDAGAAGLAGRGAGCRKYTCVPKSELAERALALKRIGKVYQSVAAAAALATGPRRVLSQTFPGVKTEGGQGPAPAAAAAAAAQPPAGGWSNPAQAGMHSAGFAAGAAXXXXHSHRREGGPTPHRPACTLPGLPRGRPRPLPGRAPPPTAPPSSREGCSNLCHGRLTIPGFDPCYCALLQIQLSPEHILCSEGITVQSDSARQQPNLNCQGRSICFHMPPLRKPGAGVSVILRSEISGTTATGYSAASVTPRKAVTVAMLFQSRAILLA

SEQ ID NO: 10648 - protein, 544 aa, Chlorella protothecoides
  MOD_RES (25)..(28): Any amino acid
  MOD_RES (533)..(535): Any amino acid
MPLQSTRLPGRGETSMPEAGARQEXXXXTAPGMASPPLAVELRPPQYAGADVPKRRGRKPRASTPARPFISLSGVPAPVECFRGQQREAADCEDPGSRPSPGHAASPETRISRQFDALLAPGVLWAQRHGTPRSTPSPAPLRKRLQGAGGGPADAPPHHCDFMSPEKYLCKDGIPESSTLWSEVSIKVKTRYNGVLSCTARQVGEASSVPRLESAAAQLLLSETPKQFLSPLSTSTRLQDKLCIHSLHRCHRMVKETVYYDVLQISVDATPEQIKKAYYLRARKVHPDKRPNDPNANREFEAMLCMHPGHLGQSALGMVTCGYDLPGHAVYAFWSSRTLSTEVRLLLSKRASFPVLEPFPLVPFQELGTAYQVLSDPQKREIYDRLGAGGLSDTPLMDPSVLFGVLFGSDAFEEYVGQLQLATAASIAADASGQPLTQQQLSAKMAEAQRQRVKELTEHLAARLRTYQGATKPATLERAGREAADLVKFNFGPEMLTTIGLCVGWGTAPRPPCAGLPVTRCVAEASRRRKGGXXXQDHRAQGCR

SEQ ID NO: 10649 - protein, 251 aa, Chlorella protothecoides
MRPRLGTPHPHPPKLSLSVAHPSHLQGCLGTRGINLEEEAAKAPCQEYIDYMHSCNDQPYPIHVTVLWAIEKAYHEAWHAHQPPQPNQAPYDYATERWASEPFSKYVKELQAVADDALASATRDERWGLEGGEAGCEVTRRFQRWGKDGGGQGSLLEALMTNVHTIPLPRQPIPFPTHHTAGRRRGRPSSTCAAWSATSGPWPMRHKQRKPCPRARDAAPPGRGRSAQPVVKAPAPRGEMERARWACYACI

SEQ ID NO: 10650 - protein, 363 aa, Chlorella protothecoides
  MOD_RES (55)..(57): Any amino acid
  MOD_RES (232)..(235): Any amino acid
MPHGGGSVGYLGTCTPEGRCHFRPAYAVSSLPAPATLHPDLPFLSLIHLSPHTAXXXHTLSAVSQPLARCTLACPFFLSSTSPLTLPSRVRQPLPLPTPPCTHSPMFVLPIFKGPNAFETIMVQCQLPCVLLTSLEEYKRQGPVAVPFMTMTHYTELQSTKSVVLVRGDIVDPNALTRFEVRRGTWSVQGIRAGTMARQDPAGPCPASWAWLQHHSLGPMSGAGRLAAGSTXXXXDPNALTRFEVRCGMWSVQGVRAGAMARQDPAGPCPALWAWLQHHSLGPMSDAGRLAAGLTVPACRHLSMEVDPSLDDPVFSSQPALIPAPPNPLCHAGHQPHEDGARILHGESQARLCARLQPQPALL

SEQ ID NO: 10651 - protein, 102 aa, Chlorella protothecoides
MSPRSQGPKSAWNLLQASRRCYSLGGVSAPSSRNLWDIVKRAEFENHDAKHVHDIWMEVGRRCIANTGVWLVERRYPEPSLPTEHILYHSSTPTHSSTGWQT

SEQ ID NO: 10652 - protein, 61 aa, Chlorella protothecoides
MPEVFGCYLLRSCHAKGKGRTYIGFTVNPSRRLRQHNGDIVSGAAKTKRYASVDCVRTFVS

SEQ ID NO: 10653 - protein, 117 aa, Chlorella protothecoides
MEYGRVPVTNWMAKGVLCLLGRACRVQACPRSSRGTWQRRSQSHDRTLSWKMPLQHPVTPTHPPCQPPPRRYGYGLPISRLYARYFGGDLQMISMENYGTDAYLHLNRLGNVQEPLP

SEQ ID NO: 10654 - protein, 202 aa, Chlorella protothecoides
MSQCDGRRGHAHEQPLLDRGHVPQHAALHVRQDFFFARECTRFIALNVANAPFKLFPTLLGGLTAIDDELQWFQVTIDGKGNAYILSQLMKILLPLLSASSYCPQGELEKRNVIVEEHNPLPTCAQYIEYLNKSTGIPYAVQLTILWVVEKAYHDSWRLNSPMEEPYGTYAQRWASDAFAEYILALEGHLDTLMETEGSAVR

SEQ ID NO: 10655 - protein, 309 aa, Chlorella protothecoides
MVLFVHGFPTAVTALQFEWAWQHPEVSLDVRAAAQRLGKKRLQGVQGKVRLLHEMLNLEPWRYFPLSLHILSSAHAPLRAQCPPLPAHIAVTFAPLEVGSGSLVGEAVLGDIQGGVVPESGAGNVSTPAAELAGYDIADESTSQAEEEAAQAALGSTNSTTPGSKASSPAPSLAPSPHASPSRAGGKGACGLCAGDASRTWWACSSCDSRFHLGCLARHLLEKCATSRLKTPLDTRAGRRHPPFAGQLPDVRGTGDVAGGVAGRPERGVGAASRGPHQVVPGSQEAGCRQGGGIKGAEGLTPGLAGVAP

SEQ ID NO: 10656 - protein, 108 aa, Chlorella protothecoides
MWRQPPPLTPQILATTDAALRLVPREAAPCGASLLINYDLPAPHPQRGYATRVGHLLGGAAHHPRIVVSFAAAGAAAEFRTYAGERDRPIEVMPIRVAEIFEQGPARG

SEQ ID NO: 10657 - protein, 115 aa, Chlorella protothecoides
MNAVSSRSHAVFMLTVVKRKPVGDGSDLHRVRIGKLFMVDLAGSERLKKSGSTGGSGCVRGNCCWGSWGLLEQALAPTDRHRFAHGFGTSKTRRSGELWSGPCSVGTTHADSPAR

SEQ ID NO: 10658 - protein, 309 aa, Chlorella protothecoides
  MOD_RES (290)..(308): Any amino acid
MDALEALSGSSSDSEAEAEPEPQPAAKKSAATKISLEDLQQHGYSGGPSVLYVPPPADADPNWTWWVLGLWLGERSLAMPSSGADRKGVEPVQESREERERNREAVTSGLDEEARLARAAVSHAQQLKAGRRAEAQAQKEAANLSWKQKVRAWEQGCCGLASLLSGGERHSCSSQTQPSRGGGYLGARGSLLLTGSVMCVDDSPARTCKALNGKDPPKDNPSWGGFYVKGISATPTLLTAPVSGLRRLHSYVRKNQAGAVGCHGRRTVFCVEGAGGVGAANKGARQRPWXXXXXXXXXXXXXXXXXXXA

SEQ ID NO: 10659 - protein, 63 aa, Chlorella protothecoides
MVRHNNVVPNQHFRKKWQTNVRTWFNQPARKLRRRQGERPRDGDRRPSNALQLAFCAGDGRGS

SEQ ID NO: 10660 - protein, 406 aa, Chlorella protothecoides
MMQCIRHIPIHPPASAPHSPCDNRPEAQVAPQVGDHAQEEHQAGAQLVPVLQRVIQQAGEDGGQAPDVGGGPHQLQLALVKVVGRLQIRRPYGEAVDYAAAQPNGQAGGEGGPLVDWAHAGFQAVPAPVCGRNPGQTSSRTRHARVTMQGIAPPRVGDSADLHVHEREQMRCREKKSPTTVLHLCEDGIPHRKPFEVRTKRVVPSFPASRAFVRNHECHRGPRCEPMHPASWCVRDMLWLSEYHYMLDELKKPPTPPAEAAWRHGAVRSLSRPVGGASTVAWGALPLRHKATRVFAAKNDELLAKPVPRRPREEQAQQKADAPSAAVQGPTPPSPASSPAETEKATSRTPGVSLEHQRSQAKLMLKYFREKQAAKIQSSGRTPPQSIETLLLAPTVFLAGTKRMRS

SEQ ID NO: 10661 - protein, 335 aa, Chlorella protothecoides
MADTAVSSSPRELAQAPSEDPLDRPDFDVTAYVNRLFPTEESLSGLDPLVASLQHRISRVDAGILASVRQQSRVGGRARADLAAARADVAALCARVAAIRSQAAASEALVQHICRDIRRLDAAKRHLTATISSLRRLGMLMAALDALQAAVERGDYAEAGNLLEAVQALAAHFAAYAHVPRVAELRGRLGALETSARGRALRDARGRALREFEALGEALPPPATLERLRACCGLVAALGYQVRDELIDAVCRRETGVYTQIFGITGETARLERTVNRYKWLLKRLDARREVWAVFPPAWHVTQLLCVMFCNITKTALAEILDLKVRKCRRWGGGG

SEQ ID NO: 10662 - protein, 235 aa, Chlorella protothecoides
MRPVNKWSTFAASLPIGLSSGIVYCFSIWSADLKAAYHLDQGQLQLVGAAANIGGLAAIFAGLLYDALQDWHQLGPRLVLLLGMVTNLGGYLGLWAVVTGRISPPYWQVCALAAIACSGNTWTDTVVLVTNVRNLPQHRGTVVGIIKSCEGLSASVFTAIYLGVFAPHAKPFLLFMAVAPAVIDLVGTLFVGHVPFIQHSELKRRGRRTFTTGVCGGGSRSWYLCGGWEQWVCTC

SEQ ID NO: 10663 - protein, 348 aa, Chlorella protothecoides
  MOD_RES (268)..(271): Any amino acid
  MOD_RES (341)..(344): Any amino acid
AAAPAAAPAAAPTTTATPPAPAAAGVIGQDAFSSALAAAMRHSAGGAAAERGPTDAEAAAGPAPIDAAFLEVLPEGLRAEILGAGSDADMLSAGEEPEEGEEEDEDEEGAAGPAGGAGGEAPLERESSTSGIDPEFLAALPPELQAEVLEQARRERRLAREAEARETARAAGGGPAPGAADMDFASLVTSFPPEVRAEVFLRESCWEGHGTQVGEQRSTGRGCPGEETPQIMVLEEHVADDCVTLISGTADAHTCNETIPDISSQDRXXXXRGCPGEETPQIMVLEEHLADDCVTLITGTADAHTCDETVPDISSQDRNCALCLEHSKWAHTSLHPSTFKXXXXCSVS

SEQ ID NO: 10664 - protein, 420 aa, Chlorella protothecoides
  MOD_RES (57)..(79): Any amino acid
  MOD_RES (142)..(145): Any amino acid
  MOD_RES (254)..(256): Any amino acid
  MOD_RES (349)..(352): Any amino acid
AAVVAALPLALGEGGAGGLPVPPGLSDAQRATLLAEKRFLEALLAGPAAQSCGGGGXXXXXXXXXXXXXXXXXXXXXXXPATVPARGRGVALLPSRHGPAWRAGRRHGAGEDRAGHGGAGPGGGRGARGGAWRGQGAPPLPXXXXLWRRPRRAWRRVARAGRPAPPSSSAPPPLSRTGPSRSGRRWEGGGGRRSSARRWVAAATAKECGAATARQRNLATPKIRPPPPPPRASSPSRCCSTPAAQRSARRCAPXXXTPGGEPLAVLQYAGGAAERAALRPAFLDPDVARPPDVVVASYETLRADAAHLAARDWLYVVADEGHALGNAAGRVARAACALRAQHRLVLTGXXXXHALGNAAGRVARAACALCAQHRLVLTGTPVQNGVRELWALFDFLMPGFLGTSRAFNAKYGRALQVRCF

SEQ ID NO: 10665 - protein, 371 aa, Chlorella protothecoides
  MOD_RES (43)..(45): Any amino acid
MRPAASLPVHLSDPVTNPWHLEPPNPRPPPSSLPPPFLAQRPXXXMRPAASLPVHISDPGTNPWPLEPPNPGPHHHPSPPFPCAEAGAHINAVEMDVSGRTVFTAASDGCVYAWDLSAAAVVRTYRACREDRSEGVLCLALVPSLSGAGRLVTGAADNSARVFDAGSGQTLAAHSRHTSWVVAVAVLPDQDLAISASNDTTARTWPSPPPTTRLPGECVMSYDDLSVGSVRRARADATGISFFFFWVPQSLLSIHNSQPQDLEAEQRGYGTRAGGAHGAHQRAPPGGGRRPRAHRVRGWHRCGVGRSLRRAPGGVRRAFGLGGRRGARRTSGPGCHRLGRRHGGGALGGRQRAAHAARPLRRGACRGADAV

SEQ ID NO: 10666 - protein, 390 aa, Chlorella protothecoides
  MOD_RES (86)..(89): Any amino acid
LAGRRGEHPGSWRRRAWHGSQCDVKTIAPRPTSRPSSTSFHPVPSSSQTIPPTTGRHGLCGARLPPRPAGFLRARGCHTGLPPSPXXXXALLASYAREGVTLASLPRHDPYLWLNVGHHLMGAGYDAELRGILLDPAWLEGKLEAAGHTALVADFRRYQQAHADPGVKLVLEALQMSLGLVQAHPEAAGLLRCQLAGRLMVAAGPGGVLEDWRAAQEAALAQAPASSVEGGGVRCLRTLTPSLDQAGGLQRLTLRGHTKAVTQLKLTPTRDDIVSGGGPDRGKGVECGGLSVSWKPGSADGLVHVWDQEIGDCVLSMQGHIGPITSMCLSADGSLLVSGSADGTARAYEMERGQCLRVLAIGGLWEVLWGTGHEGWGGGGEVHLGLETQV

SEQ ID NO: 10667 - protein, 379 aa, Chlorella protothecoides
  MOD_RES (294)..(336): Any amino acid
MPTLCSTPRARPTSCPTSLQPTPPSTTAAPPATTTRPAMPGSAPELCCDKARAGRGLSWNGTPLEKGRDGSGLAWGCLVLRVSPRATNFPACAMAAHGVPMQLAPPSICRSDTTCATMPWPRPLLLLSTRHLCRCTLHSSCGAGNTTFAAGTCLLLSVPGFSAYEPDDIHMETTDSDSGLIAGAPFIITSREVPGYTLAIGFDFGSSHDFDCANTIVPGACALRGGLEDVVAACGYTSACTGFAYYPRGMDYTSWAMGILKAVPQRADLQQEALVLNPYSAAYMAGADLPILPXXXXXXXXXXXXXXXXXXXXXXXXXXXXXXXXXXXXXXXXXXXAAAAGVQLLLRPRGAHHSDLHLWRPGRPGHLGHAADHGAAAAP

SEQ ID NO: 10668 - protein, 262 aa, Chlorella protothecoides
MQPTRRCLRFQGPSLHRYQGVVRGEPGCHVRRATLVMAFRAGWPPGSVMPPKTPSNTHRRPSCLDSVQKDGQERPGAKGLSLSQEQWGIFVAALPALQAAIALDGHEVPRRECSGNAMGCSKGPILRRDLNPINERARGKAFNSSNCSALVSARARGQHLPQGNGPVHALLHGSRAEGARARAGRQEQAPGQATGRNLHQPEHGGLACKGSEEEMGDRVHPLPPMLTCAAPAAGVAESCPSRDQTACARLPPPPPLYAIATP

SEQ ID NO: 10669 - protein, 278 aa, Chlorella protothecoides
MKFQASDIATWRRKLAMGRDLVCLARVIEWRARMRKEAIRTALFEYLEGADLEAATQRTVQQELEDRLGEPLNEYKEYIRAQTDAFLAGCTARGNDEVDDEDFQQPRKRVKGGFVKQFGGGAVWECLLDPQGAGAEQHGKNDAANGHPLSGDVYAAVRDWHGRVGVDIRQYYTDKEGQLKPGFKGLALSPQGWGLLSQALPVGLWLACCAGRLHRGVVLDPTVLLVLMHQACTATHPPQNLCKRLDARTSGDAVELDKNQRASVSEFKGVPGWDWAGR

SEQ ID NO: 10670 - protein, 172 aa, Chlorella protothecoides
MPELPEVESARRLLHRLGVGRTIVRAVVADDDSESWIYRGIRGCQGHLSQEAAGCTTGFTDPVHRSARQTHVGGARPEQALPHAALRHDGHACSQGLLEEVADIFTGRHTNPAEPQPPTGYLCRSASRVKVRQTTGGRMWTPPPGPPGSGRSTFSWTTAPRSRSVTRDALPG

SEQ ID NO: 10671 - protein, 86 aa, Chlorella protothecoides
MSQAPSKSHPPQQKDGQLLPGKRGIALAADQVLALLTAAPQLTAGLERRDDSCRAQLSARWVGIGVGRETGSWCGMGIQIQLETVL

SEQ ID NO: 10672 - protein, 244 aa, Chlorella protothecoides
MYFPPSPPHLPHRESLACVERAAPRLEALLESANMDADLAAFCDTAAHSVAAGEALAARQAGLLAGVRRELAASPEVLRAGAMEAWDAARGVWVPDRFVLTRAGFLHRLARSPGGDPEVSMVQGPPTPVLAESVALARCTFEQGDGFKGWQLHTRVEAGGGGHMLSGHVRGSSLPPLLRVQHMSTWAVKGEAPVFRLVEIAAGSLARSLFLAPRTRARTFRTASVEECMDWAIALREVLAACTR

SEQ ID NO: 10673 - protein, 336 aa, Chlorella protothecoides
  MOD_RES (25)..(28): Any amino acid
  MOD_RES (261)..(264): Any amino acid
  MOD_RES (322)..(325): Any amino acid
MGGAQTHLCCPLRRPPNPSPNVPPXXXXYRNAGTWMRAEAGREANGGNHASKAPSHAQPPHPHQPLPQWGAPRRTLAAPCAVHRTLPQCTPHDKTTQIHLWIFLIAIFHVVCAVIMLLLAEWRLRQWRGWQTGDLLRSAALRRQQSLASFRREVAGLGVPHAVADTRVADQPPAEGEAGLGGVPTARPSSSSASQAGSENVLELQLGNGTPREEGLQTAADVEGQPGGPPLLSFRHADTAPGTAPGTAPPGTAPSASPSSXXXXLQLGNGTPRDKGLRTAADVEGQPVGPPLSSFRHADTAPGTAPGTAPPGTAPSASPSSXXXXQWRRRSVAGGF

SEQ ID NO: 10674 - protein, 236 aa, Chlorella protothecoides
MVGQVQDRHGKLDILVNNAGIQFVSSVQDFPEDKWDAIVQVVMNAPFHASKAALPAMLEQGWGRIVNTGMFQSCAGVGQLGCCIRAPTCIRRLHQPADSDTSLVTKYPHHPPTTHPGSMHATVASPFKSAYNAAKHGVAGFTKTLALEVATSGVTVNAVCPGYVMTELIEKQLANQAATRGIPVEKVISDVLLVDQPIKRFVRAEEIGAMVRHLCTDDAGAITGACLAVDGGWTAR

SEQ ID NO: 10675 - protein, 87 aa, Chlorella protothecoides
MARQLGAGSDGFVRLPLSSASLALPDLAVTGSSEALLKGQKPPLILAARAVDAAGKIAEHILPVFSEGFVVRCVEGPIRVGGPEASR

SEQ ID NO: 10676 - protein, 95 aa, Chlorella protothecoides
MLAVGNATQTKLKDLARAAADAGIGSFAFPFHSVNKVRELQALMVWAEESLERCDATKKILKLTKGWEEAREHVFKVKAPSLRPGGHWDVFGLGL

SEQ ID NO: 10677 - protein, 398 aa, Chlorella protothecoides
MVQYAPTTKEVTASGLADMFLNRISCPHGLPTIVVSDRDTRFTAHFWKELFGALRTELCFSAVYCPETDGQTERANRTLEEILRAMVDPYETDWDKHLAIAEFAANSAVSAATGASPFQTVYGFDPPSPTQLISHQPADPGITVESERAAQLQQTLERMRATMAKYNARMATQANRTRQAHAFKAGDRVLLSSAHLKLVAPNGRKLAAPFVGPFTITAMRGTGAATLALPQSMGMDPSVDESYPKPYHRDSNHRPIPVFINDSGAPAYLVEAILRHKRVGRGYQYLVKWQGYPDDQATREPRANLAHLDAYKAYRAVQTVGRPTVQTGEGVVGVPLVLWGLPLVLWGVPLVLRGVPLCCGGFPLCCGGFPLCCGGSPCAVGGSPCVVGGFTCAVGGSP

SEQ ID NO: 10678 - protein, 515 aa, Chlorella protothecoides
  MOD_RES (131)..(140): Any amino acid
  MOD_RES (471)..(474): Any amino acid
MLANVMRTQRWCAHPNARHGCHIIDVCMEVGSLYMRNAHPDSSRSGAPAPGVCHWKISRQPATEAGTVQLADQSKGRSECIVNIDYRVADPPVCIYNMRCSYPKEVVASMPHYRVADPPVFIYNMRCSYPXXXXXXXXXXLRNIEFLGVPGSSAVACMLARPSLRLHHAVHAGSLRGSLGLTSLAAPGPCFHHHGISLEASASQPIPMARSKLRLHAMSSSLAQNSVPASQPRQLPPHTSIPPPSLPPGIAAWESAVVLIDKPQGWTSFDVCAKLRFALSRTLDKKARTIKVGHAGTLDPMATGLLVVCVGRATKLVESLMAASKRYSGTMRLGEGTPSLDAETPVHETKPWQHVTEASLEAAAEAFLGEQEQIPPMYSAISVDGQRLYDSARKGLEVERKSRRITEVCRRPAGRGLCRELQQGNLRQEPGRRSGGTHGHGGTPHRPKETEQWGARCGSCLAAARPHLPAXXXXVAHLTALRRLSSGEHDVAAAWQLPDLISQLGDLKKEDAAQA

SEQ ID NO: 10679 - protein, 299 aa, Chlorella protothecoides
MLTSLRAPCPRGACFQPSKRPLTHLKCRQSCVAPLCAAPGRPGPANTARTLVDLTSHGTLATLLPDGTPLGTATSYVLDGTGQPILRLRAHAVHTDNLRANPATSLFVHPANPPARALARLTLLGHAEAVPENLLPAVAEVHATLAAGGQGVDAPSPSDVYMRLHVTSCFLVDQLGGGSAAQRLTREEYLGGVPDALRGPAAGLVTYMNASRTEDLLNLGADAMGCSPDDLATVELVWLDSLGFYIRTVPLLPPNEPQTLRLTFLRPVSDEREARSALTMMAQESWERRRPYNPVMVTT

SEQ ID NO: 10680 - protein, 171 aa, Chlorella protothecoides
MAPASVPLVPALCRRFGVAAKVPHRPRPSTAHLPAFRPDPLALAAALAAAHASNVVVLDVAGRCAVADAMVVATGRSPAQLRGQAEAVVDWLERGARGAGCAPPGCRVEGGHGAEWLLVDGGRVIVHLMLEGARRAYDLEALWGEEGRSVHSVEAAPGVQTLDGLMPGAGA

SEQ ID NO: 10681 - protein, 464 aa, Chlorella protothecoides
  MOD_RES (164)..(167): Any amino acid
  MOD_RES (399)..(402): Any amino acid
SAAGSAGDGVARQDGAPTTPATDASSPAATTSAASSGWGWYEGAGVAALRAWLAAGGMRREAGLLATLADAPWPTDQLRPGEGGVLCARVSPCDAAVGSVMPLSGAHGRRRGSLHLQPTPSHAPDPSSTPCSRSRVHSPSPRQQTPCRSPRVGGGAELAARGRXXXXSPATLRTLPSHHAPAHMCTPPLLANNPHAGRPASAVELSSLRADGYRGLVAPLLRGDWQCARGGVYASAEARLAGALDALLGAVPLWFRGEVLQRQHLAIGEALAGGVGPREAGIAVAETERLLALEGVLGGEWRDVWQVVWRRGLSLISDVREAAMYAAALQRHAFSPDVVPRPVFERLMAEANCHLVLPFPGDSVVILRSGALMHIDRRVQQILAAVLRPMAGWMQPSQXXXXCAPAPSCTSTGAAEHGGYLENHGRVDAAIPGCCRRRGRMGEYIEPMSGRGSSLPRNPIPFLL

SEQ ID NO: 10682 - protein, 464 aa, Chlorella protothecoides
MVPYRQDLADPVAFASNVACAQAAAAAGLWDGAFAAFASVTAVGGFPAQLQVASVGLPDPPSGDVAVTLGTPPLATPVRLGIEVERAVTRLSVALSLPGQAAVARVLVAAAVDGATNASGGEEPSRATFVVVAAAAPARLAEAQALLQPSGPGSAASSAPSPQVADLTLTVRARHTHPDGSATPGRHAVDRARRQHAAGPRRLLCRGQRHPGGDRCHGGPTVRLRDPSGTATTAHVDATWEATGGGGARIAAPLCAETAPEVVLAVFPEVRIVLTSDVAAVCPGNLVHLSAKIDQLAGGSLGDLRFSLRPGAGVKSLWPLRSVAAGVQVDAVPDGFALPSASDSAGALGWVLMAGGGLGYGSLAGTLEAARGSARVAPSVLQIPGACEPDFVEATLAGRAFVDENGDGFAGPDEAGLAGAMVALSAGVDARTDAMGHYHITCLAPGRHAIKLDPPPTHPACSLG

SEQ ID NO: 10683 - protein, 543 aa, Chlorella protothecoides
MTSLRAAAAPPSSPAIRSRSGLSSTAQVRCRAGDTFASEAVAPIVGRRPRDFHWRHGLGNLKNLMFFPTWHYTHDTVNQFCALQTVARGPQAHTWATAPADLSHVAWPQDASLETFLAQQQVDGFALVHQGALVHESYLSGTRPSTRHSLASITRSLTGMTAGILVDRGMLDLTSPLETWMPQVCGSGYEGVTVRQLLDMRSGVNSSAIGALQSMHLIAALPWQTRHDGLHAWSHSLKRAEGCEGPGPWPFEYRTGDSEILGQLCEHVTATSMATLWSTLLWQPLGAAHDASVMVDGHNHALFGGGLAMTLRDTALLARMILRGGTAHDGGPAILPRAYIDDMFHGDADTRAAFPGTMLDLPLPGGMYRNQSWSLQSAPPITLLLGAGGQLVYLDPSADFAAIVTSHWGKPIAVSATPPPSCPGPPGGPLKTGSVAGYYFHGRFPLSIPTSPCLVNNEAHQPVSAVPQRRPGTVVRTLFQVVRHLFPLRRHIACPATTEAGGWCATGAGAGAGSVLSGIAALAEHLRSRVSTTLWRGLGAPGD

SEQ ID NO: 10684 - protein, 388 aa, Chlorella protothecoides
MVKLGPAFCDITWGAGGSTADVTLEVAGAMQQEVSTWRLASVSRGWVGPCADRHEHHDAPDLHQHVDREAARESGEGVIGTHGSSCPLCSSEEGCRAAGMPCSHLLVSLLMYLSPMQIHQCLIPGSHPPSHATPGLLLQAKSMGIRNILALRGDPPKGETSFTAVDGGFACALDLVKYIRCGAGECSVLCRHAFCPDTQSASCSLVSLGLAPAVHAPACTRAPNALRLHPPGPPCPRQTHLSLLHRQEYGDYFGICVSGYPETHPDLIVDDPVAMEANYRSDLAYLKAKVEAGADFIITQLFYDVDCFLAFVRDCRVEGIAVPILPGLMPLMTYGGFKRMTAFCKTRVPAHIAATVEALKDNDEAIKVGGRVERAAVRNVESCLREGL

SEQ ID NO: 10685 - protein, 429 aa, Chlorella protothecoides
  MOD_RES (312)..(315): Any amino acid
MTTEEPFFGIIVMISGSPCRMHLPDSEGIFSPSQDPAALRILAAVPRDGMQYLGGVIPPSTLGISRARQGIQSTRHGYPNDKTRLSSRDSCSGWDYHCLLKNPVNKWMQEMDGSPLRESAVAQATAPTTAANESQRLAVDAEAPTQRYISQSQQEPSGVKREAVEARSPDEQASSPTPGETNAPPCVSDAQPPQPSNTPVKPPQPSSTPVKVPEPHVECSSEPLESPADASGAPDEPGSMPKASQDGGGTQVDVPPSQLPTDEEITYRLQELLTEVDLQSTTGGPVLANETLERGGAPSSLAWPGRSPHSFXXXXRGGAPSSLAWSGRSPLSFSIPFAEKMLRRRLEQEFSTDLSSKKALLRAEVGGGRNPGTAGAHALREAGWVLRVGIQRKPADHIIPPPDSSQVEAYLSSQPAPPGSEADEEPTAR

SEQ ID NO: 10686 - protein, 114 aa, Chlorella protothecoides
MTTTTTQERVRRRQRRGASGRGRTATPGEKRVNGFTKPLRLSPAMAAWVGAGTASRPAIAKHMWAYVKEHGLQDPANKQFVVSDATLRALTGQDRFKAFGFSALVKQHILGYDD

SEQ ID NO: 10687 - protein, 579 aa, Chlorella protothecoides
  MOD_RES (118)..(120): Any amino acid
  MOD_RES (301)..(304): Any amino acid
  MOD_RES (519)..(522): Any amino acid
MSLRLLLPPVGTRLDSHPGQAVLPHLTRTQSRWEPGRLHRDVNFMHAAHGSRGAWGWRRRSSVLTPHAAPMEDDPQLERKVWYERCRSAILWRGPYPLLKSVAWDGVSPEPADGRKLXXXGAPFSGGGHTCCFNQLNGTVSPLSQQMDTSMKSRRLDAQDSLASGPALCSLMHPSNIDNPDPSHPTTQERIWTLPTALTLARVAAIPAFVALWYSPAPWAPAAATWLLLAASVTDFLDGYLARKLVRGAGVGVGRACLCVAAWAPASGSCTRRRLLRGRHRLHGKVTLLPDRQPSTLPPKXXXXVRGCLGAGIGQLHTPAPAVGMAPAAWQGDTPPKPPTLHSSPQNTQTERGLRVRGLPGSRGGQAHGLHGPGPAQHRAHCRRAPGRRRAAVPAGRRRHRGARNRHVSAAGVGGGRGARGAWRRGRQHRREAEDQRAARSAGRAVRGADARRARHPGRRGCGAAGACSVPHPLVPGPVLCGALALHGRPAQLPVSVRMGCGNPAHGSAQRRGGGWRMXXXXKSCPWVCPALRRRAADERLVGPGWRRSDEWQRRGWRGPAGIVAMSGREEAGGARLAS

SEQ ID NO: 10688 - protein, 177 aa, Chlorella protothecoides
MSMDAEANLCTQPRLYHTPLSSACSLRSSISHESHPTSTRPTSPYHPAPRSGVRICRTIGTGHLRNLDPFLMLDELKMPAHEASAGFPDHPHRGFETCSIMLSGKMEHRDSYGNHGVIGPGGVQWMTAGRGIVHSEMPKVTEGMLHGQQGGRVGVQSVASCIPKRPATSYSSYNSAA

SEQ ID NO: 10689 - protein, 951 aa, Chlorella protothecoides
  MOD_RES (820)..(823): Any amino acid
  MOD_RES (894)..(897): Any amino acid
MALPVLRTTEPRDLSHPAMLYGSLQAQKSGGHPAGVTHSQAGTAASDAHHRQGQGCGGQALLPSSNVHQYKAEWVCDNMDWCQETPCPGAGRVYRPLQEARAPPTLVNGLERLSIPPSEQSGAAGLLGIQRYPAPAGAGEPQGPRDPDHIGIALNSCRRSTATTLWESERSEPVAGHCQTAGSPWTPWARYILSAAGGTCSSSEPTGMTLSEWREATECLACVVHTTTSPHLPPLQQEHPRRLPHQCHQLQVPGLCQHGPRAPVHRLLLYPPPGGERVLAGNHADQLQRHDDPAVPQQGGGPHQVLLPWRLQRGGHQGQLCAHLRAAGRDPGLWLPPNLRARSPEVPHLPKGAVVWVDQRVGGGARRSGEMGGEVQLCPSLRRWGGREGSRITVWGFVLESTKKKREAAAQNATLQVTGAVGWRQDSIKYKKNEVFLDAIETVNMLMSAQGRWAGGNLFDKMSSSMNFNRTRSLFPRSVLRCDVQGRVVMKCFLSGMPDVKLGLNDKLEDHSQSKFGAGIEAAVQHSSLLLQSLHAPFKNLDVTFHPCVNLGRFQAEQVVSFVPPDGEFELMKYRCTGEEPWPWPGRQVHAQAMVCGMSHAPAHQTGAQTLCTHTPPHLASSPPPLDRGHQPALQSCGPGHRKGPDAAGGQREAEEQLPLQPFCHQRHRPHPHAGADSACYLPAQHRQGKVRPQTRLAGLEDQAFCGGCRAVAERKRRADRHDAREEGVEPAAHEHVIPGGWVGDRVLYREWDGAALVGNPDALCQRRAGAVPQGVGEVELQGGQVGAQAVQVRRLPHQVLSLEATVTGMEQAEDKVRIXXXXLAVIERRAIWERGFGRVVKLGRTRSEFAPAQVVVVDTNGRQARLVAPTDFLENNKGIESLHTVADLYMFSXXXXLENNKGIESSHAVADLYMFSSWPCPLNWEAASSGLQLPTTLASYSGTDASARSQ

SEQ ID NO: 10690 - protein, 900 aa, Chlorella protothecoides
  MOD_RES (28)..(31): Any amino acid
  MOD_RES (61)..(63): Any amino acid
  MOD_RES (585)..(588): Any amino acid
  MOD_RES (615)..(633): Any amino acid
MAHAYCEGWLNSPATTHTTLALQCQRPXXXXWGVGGCWRQDVLQAAHCQLTQHHPSSYNTXXXHGNLDGTCILRGLAEQPRDDPYHPCPAVSKAQTVLPYAGAKPAIADSVFIAPSASVIGNVTLGSGSSVWYGTVLRGELVLGGDGRTWGVGGMLAAGCPASGSLPTHSTSPLLIQHPHTHTRTIPGDVNSISVGEKTNIQDNVLVHVAKHNAAHQELPTRIGSSVTVGHGAVIHAATLGDRVVIGMGAVVMDGAVVEPESIVAAGALVTPGTVVPSGQVWAGSPARFLRDLAPGEAEFIAAAAEDYARLAAVHAAENAKGFNAVELDKARREDRAARDPEHDAAQGIARDPETRAVPWPGVRSGGQESAESGQADVPQHAPAHWLCTALLESCRQQRREEPGIVWRQSQEQIRCRKNRSGGACQAVQLPTSWSTAAEQETHRCLQRLRDFLEGSALPLPSSPRFRPARLAASDSDSDPLLLLSEPDDDDEEEEDDEESLEEEPPDDEESSEDDEPPDDADDESSEDEEASFLAASAAARCAAMSAGRFFSVSRMRSVSPAGSVLGAGGCCSSTPIQDKSTHPXXXXEESSEDDEPPDDEDDESSEDEEASFLXXXXXXXXXXXXXXXXXXXIRQPCGIGVGCGGLGFWGAEALLPSKTKAHTLAPRFPSHNPRTSQPDGGEEVDGEAHVARAVGGEDAGVPRGTAWVLQPLVEAQQAQLLHQLLEQDLDKDAGGGGGVLLRQPHHLQHGPGDGVAGQQVGEELGHVAQLVGLQAVDERVLAHEALGEAVAVLALELGEALPQQRVVPVLPDAPRHCQCMAALAAGRLHGRSPVMHAAGFEQHHRQSTSGYASSLYEGLLLGAALDDHGAQLHLQAGRYALQVGRRVVGKHEAQEAPFT

SEQ ID NO: 10691 - protein, 368 aa, Chlorella protothecoides
  MOD_RES (25)..(45): Any amino acid
GAGKAQSNGAGAAAGTVPPAVERAXXXXXXXXXXXXXXXXXXXXXGAGGGRVPSPLQAGGHAGGGAGHHQRAVPAHDLGRAAQVPQRADQQGERRQHQAHPARVLLRGTVVGGGCLWTVRGRGCSSSGWVAGCLGNGTVPWPPDHSGACQQDHTLRVPPFPENSQMASPSFTPVYAALVAVFNTKFPELGELLLHRVVTQFRRAYKRNDKPVCLAAIKFLAHLANQQVAHEVLALEVLMLLLETPSDDGVEVAAGFVTEVGALLQDLAPQGLNSVFDRFRWEGLGGVGTAWSCLPCLGAKGLSIEQTICSIKRLELHCPSSRFRAVFDPGLQPLTHRAILHEGSIDKRTQFIIENLFAVRKAGFEQQG

SEQ ID NO: 10692 - protein, 154 aa, Chlorella protothecoides
MIAHHKHPQNTITSWQREYGEGAARQLAARKAAEAAAAAADPSDPNLVPLGERPPREASPAPAPVPAVEWWDARLLTDKTSYGAAAEGEPSIREERITHLIEHPVLIDPPGEAPLPPPQPLMLTKKGYEEGWESVAVWGSGPNASPNCISNGWA

SEQ ID NO: 10693 - protein, 284 aa, Chlorella protothecoides
MSTGLDVERLHIVWRLSATLLAKARHFQDPEATDPVLLGPPNKPSPAQEKKKMRTQNRQAREKEKQELIRQGLLEPPPPKVKISNLSRVLGEEAAADPTAIETEVRRQMGERAAAHEDRNLARKLTPAEAREKKLRKLLGDPEADPTTSVSLYKVGSLARPQLKFKVSLNAQENHMTGVGLAVEGEFTLVVVEGPPKAQRRYEKLMLRRIQWNAEEEDEQEGMEEAEAPKAPNYCRLVWQGTVLKPSFRKFRVETLRNAAAAKAFLGQYNLSHYWDLAEASVPE

SEQ ID NO: 10694 - protein, 330 aa, Chlorella protothecoides
MMLDVFQEDPDFAQHEAEYQAIRREILGEESGDEEEEESGSSSGEEEEEDGEEGGHAAGPSGVGGPISDQTQTDLINLRRTIYLTIMSALDFEEAGHKLLKMVGHTCRPGDGAVHHDHRVLLPGEDLHKETCHAGALQQGLPCTGSAEVHQAAQAHNDRHLGMNSRLTMVLTSHTLPTSPPSKMHHRYYALLGERFSKLKREYCDCFSECFVRQYSLIHRLETNKLRNVAKLFAHLLASDAIPWSVLEVVRLTEEDTTSSSRIFVKILFQELVEQLGLLGLNKRLQDPSCAAWYTGIFPTDSPRNMRFSINFFTSIGLGGPWVVGWKAGR

SEQ ID NO: 10695 - protein, 452 aa, Chlorella protothecoides
  MOD_RES (100)..(123): Any amino acid
  MOD_RES (299)..(301): Any amino acid
MAGVPAWKEVGWRGHDQRQEGHVPGRTGPHRGWWRAYTPPPSAAVAPNSMPRLVQDMPPRRRAARSGTGAAYRCTPKSTGQRALYRKSSGIRISYSSRDXXXXXXXXXXXXXXXXXXXXXXXXFTTIRNPGRVRWENSEADDNVASGRALGVPCRQLVSKRSAGPTTAPPRVGPHSFLRSHKRVHAARAVMTPQIRSRGGRSRLSGSCCLCSATLPPICTAFMAEIIFVQLLSGWGDDHGHRSLFVMPRAQLLRFGDGHIRSIHRCTRLPRANTGSQPGPANHLFISSRGVFLQTCGSXXXSCCACCHDSADPIARRSVEAKRLRNPDGMATLAPGTLLGNGRYRVLKEVNRGGTAVVYECETLPSGEHVALKVRLPYGKGPQLHPRRAPGSCHDREGWACHHADQGRQARGVCRWSCDEGLMKGVFVKPPPSDFITPQAWNLQHAMQVHAK

SEQ ID NO: 10696 - protein, 637 aa, Chlorella protothecoides
  MOD_RES (231)..(233): Any amino acid
  MOD_RES (253)..(256): Any amino acid
  MOD_RES (374)..(377): Any amino acid
  MOD_RES (477)..(480): Any amino acid
MEKACQLNGSGKQDPHCAWPNPSLVSLGVSAHVRFTHGTHMRFLWTQPSGHGSLPLPLDVQLVTPANLLLHRAHGATAGNRRRRHRPQGRNREARGGLLVLPLQRQCRHRPGGQRWLCGCLFLCPAATYEKTSNIHPFQGEESYVAVDKGAITDEHVLVVSVEHFPSSQSLSIDCYAEIRRWASWVLGRLVLGHSVTLLHRSEEDPLHHNKPHSALPGTGARSTGVQRQVXXXRGRGQGSPGARGWGARLCGXXXXEDPLHHNKPHPALPGRAGATTATSTPWPSAPRPRPGLARCVGVGGAVVRDTGRCAGGWVVIGRPGTPLSDGVCARGASPPLSLSRSIRGAACTSRVMPPQVELPCGTCSNSSRPRHPXXXXLSLSRSIRGAACTSRVMPPRLELPCGTCSDSSRPRHPAPPPIPSHQHRQVFEDRAKAAGFSLTHVPAAAGEAARAALRDVVGDGEYFQAFLPDGSSLVHXXXXKGCGVQPHPHPRCRGRGCPSRAAGRGGGWRVLSGFPPRWLLPRAPHSLWRAPPPELWAGGPGRAGGGARSGRVEGVRRPCGGGAAAVGGLQGPLQAARHHGRAGVRPAASGPGRLYCCASTLADSMQGRLFCLTRVHVHRQHHGDTGSTCLLCLYSR

SEQ ID NO: 10697 - protein, 193 aa, Chlorella protothecoides
  MOD_RES (174)..(177): Any amino acid
MVEAVPQLISWLESRGGRLRDIEAGEVAQGGRGIVATRDIAPGACVLEVPFPCLMTCSSALACPTVSAVVNAGPLPLTPFQVGAWVEMGRSCVLNCIPRWDGGLSEVNSGMFACRGRGWMPWMRSSPSRPRRWDHPGACTAGCTALGLPYPAASHNPHTQVLTIHVLLETSKKXXXXPPFKWVHGLKWGVPVL

SEQ ID NO: 10698 - protein, 211 aa, Chlorella protothecoides
MLTHAIRRASHMLVTARAPASASLRNLAITATPGDDQQMRADVNRLLYRSRQRGWLELDLLMVSGHGAIEATGMQFYGTRCLASSTTLTNTHKHPPTLQHQGMWAEQNVPTMTAKQLEDYNVVLDEENPDLFKWLTNQLPTPEHLRNNSAYQASVHGLLALAGTVEKMDWGILSFTSSFCRPVSSASTLIRFPPCSYYTLACNSPWTSTAS

SEQ ID NO: 10699 - protein, 264 aa, Chlorella protothecoides
  MOD_RES (90)..(93): Any amino acid
  MOD_RES (154)..(157): Any amino acid
MGDGGATVIPPSRRPDGTLRKEVRVRAGYVPQDEQPAYVPRQARQNVPKCPGLDETSQGAWANDVSTNWDCTILASSRALMLIGSHSCCXXXXTRLVRASMLIGSHSCCLAVAGAPKPKSKAATKNAKRKEKKVDGGKPAGVTEAPGKAAAKSXXXXAEGEEGRRRPARRSDAGSRQGGCQVGAGEDPCSKPLRRGAAAGSLHAGAGCQARWPGPNLSPSCPEEESEASGGAGEGAGSWFRPFPGTAPEARASRSMVWTEDACL

SEQ ID NO: 10700 - protein, 334 aa, Chlorella protothecoides
  MOD_RES (22)..(24): Any amino acid
MRSTPCPVKILARMHKKTGMLXXXPDHGTAIRLNSMRSTPCPVNILTRMHKKTGMPKKPQGICKQVSRWLSRWGMVSWASSSPRTGLVQGGVSVATGAAYTLCSTPPLTRPRFTHTLQYYFYHALSWPQLLYVAEDYDGTIVGYVLAKIEEEASETHGHITSLAVARSHRKLGLATKLMTAALHLNLDVTPPSAIHATPCETGQLIPIACADAGMEDTFAAHYASLHVRASNRGALHLYMDTLGYEYVAWCLPRGQIVAGGAWEIDCCVTPGSCLWRKGAQGLRWHAVRRCTGQMQAAPCSSPHPSSRDLSPASVTGRRSTMQTARTRLTCGSR

SEQ ID NO: 10701 - protein, 239 aa, Chlorella protothecoides
  MOD_RES (133)..(136): Any amino acid
VAAEGADAARGDALHWVGVEVLLPGGEARGAVHEVDAAGLLARVAPGRQGDGGAWGYEGAEASVEVPVRDLQAVTPARTDTVKVGGAGCGEGRVVEPSGVVETRELQGLGCCSGSAPRGRAPSAPRVRLPGAXXXXVVEPSGVVEIREMQGLGCCSGSAPRGRALSAPRVRLPGAPPPTTPRRCTLTPALHTTQLLRGDLAGRVGELVGTDGGDGIVKLGPEIKIWELAHVGRVVLPAA

SEQ ID NO: 10702 - protein, 157 aa, Chlorella protothecoides
MSRASSDWPRCLVVVAVALGGLSSGSGRRGVERGGLEERSSQAPTAHACLAPAQVGNGAKQKWLHALALTPAAEMTPEALQVQPPGSTGNPFQAAAAKRLKRAAGDAGPGTDLGSQDWRWQEQKKARQIMAAPSLGEWGWRHANEQHCSLSQLRALA

SEQ ID NO: 10703 - protein, 114 aa, Chlorella protothecoides
MLGSRLWLTSEAQAGSRTESTPSVETRWAHPASIRQGVPHINPVPQINRRAPRKSRRTHFPRRPPAGWNLVVKPLGQSDEEPYVAEATGGRREPNADEALLLKRQTPRPRRRIL

SEQ ID NO: 10704 - protein, 202 aa, Chlorella protothecoides
MPAVRALFAGACNGSIDALFKRASAVNASNGPFDLLICVGQFFGAAGPHSPSSRALPPPSPTPLPGPDDGEYQGPLLEYLTGGKAAPLPTYFMGGWGGGAVSVLEAISAVPESNIHYLGRAGVKEVKGLTLAYLDGTHNAAAFREVPDNSGSARYYTEADIKLLQHSLSLQGDIDVLLTNEWPEGLAEGLPEGVAPPDSHGR

SEQ ID NO: 10705 - protein, 75 aa, Chlorella protothecoides
MFALLEDENVPIAENLSDLDLAGLEALRASLNERYSGPNEMVVNTAPPGQLPWEILGVDESRGGEPGAGQAVSGM

SEQ ID NO: 10706 - protein, 173 aa, Chlorella protothecoides
MLRRCRTLQPVFWAACPAPVAACYSALPQPTEGECRPATTHDGDQSAQEHGPPGAGHALATLPPSKLGPRPSAKEAREELRRFAGSPRPSPEWRELVRLSHAALQPPGQANPAMLTDSFGRVHSYLRISLTERCNLRCLYCMPDEGVELAPASHLLSSEEILRLVCGGDHSAG

SEQ ID NO: 10707 - protein, 288 aa, Chlorella protothecoides
MPFDGNVWSDKKMVTYREMRGAVEAEFGPLEPILSPAGEVARNFRCQDFTGSVSFITSMTKAFCSDCNRLRLMADGNLKVCLFGANEVSLRDAMREGASEEDLAAVISAAVYRKKAAHAGMFELAATANRAMTHSSTGGQGHSPQASLLHAHDVVRLEEGLEGLRPPPLLLHRDGARLPLGPIGHPRQLGQDLPPIVQGVALAKGYGVHEVGAIGEESLKVLAIPHHVPQRGSGSLARGSGDESLEVLAIPHHVSQRGSCSLAGGSGDVGEAEPRSLCPVLEDLAVLV

SEQ ID NO: 10708 - protein, 138 aa, Chlorella protothecoides
MHMHTCTRVAPPFRNQARLFVSAGVDKIRLTGGEPTLRKDLVRLVASLSALPGLASIGITTNGLTLGRQLAALRSAGLTHLNISLDTLRPDRFVTLTRRQGHARVLASIQEAIAQGYDPGLEVVSHVLQPIAAEPELA

SEQ ID NO: 10709 - protein, 830 aa, Chlorella protothecoides
  MOD_RES (328)..(331): Any amino acid
  MOD_RES (546)..(549): Any amino acid
  MOD_RES (674)..(677): Any amino acid
  MOD_RES (826)..(828): Any amino acid
CRALRPGPLSTLARWRLVGGVLLGRDPRGSALGLGAVAGVVALRTLLQDRIANLNGEAVHHVLRQDVRSFLWLLGVSAAQGCASAVLAPSLRHIADLLALSWRARLTRAASDRYLAPGATGYTAVQLAGLGDVDQRLTRDVERLSRDLAALIPTLVKPVLDITWFSARLWAMTGRRGAAILYLYAALGYGTLRLLTPDFGALLRREYELEGGFRGAHSRLRTHAESVAFFGGGAREGGAVVARFDAMTAHLRGLIAQRWAYGTADEFFSKQLPHNVTWVLTLLYSLDQQGGFICVGGVGVEGGGHSKGVRCGEVCTVACITVGRRAPXXXXGPTSVHRGMHHCGAAGSGSSKEGRATLGLHHRLARAVSTTPTSHPPNSVAPAGDLSDDMVQGHLVHQIRYLASVVTSSFSAFGDLLAMPRKFAEISGGIARVSEMFQVLDAASRFDSRAALAELEGALPDSIEFRNADILTPGGRMLARDLSFRVTPGHPLLVTGPNGVGKTSLFRILSGLWPLAAGAMHRPGAAGAGLDSSAFERAMPTGCQWXXXXMGGGACTKGRCLSFRFTQISLFPEPHHPPTNPLLLQDIYYVPQRPYTTIGTLRDQIIYPLTARQAYQRYSITDSSEDAAQQLDAELDDLMGVVHLKYLVSREGGWDASREWGETLSLGEQQRVGXXXXTPATHVDRDPTPLQPHSIVLSPNRRAAAGGHGPPVLPQAALRHPGRVHQRHECGRGGVAVPARHQPGHHPHHHLPAHGAGEVPRARAAAPGRPGRLGAAQAQGLMRAGRSVVLIKAYLNIRSRSQRSVAACSAGLEDQLLEELASGVPXXXGS

SEQ ID NO: 10710 - protein, 722 aa, Chlorella protothecoides
  MOD_RES (685)..(688): Any amino acid
MVGDGVNDAPALATADVGMAMAGGTDAAAGAAGVVLVGEGLDQVCSALDAGRAALRTIRQNLGWAVGYNAVGVPLAAGAALPSLGLAISPSLAAGFMAFSSIAVVGNSLRLRERIAGRPATAPALIPLAPTTFPSACRMASLVLLTVHPAMDPCDPAPTKANPSNICCTLPALNNLLAASSSFSPCSHAVKTLKKKSALPTPVACMPACLALAGTGLSDGFLGPPDLLSLPSPDEGRGAVGVQTWEIPKQDTTDVHTPNTWPHFLPFGDVGFALPALHIVLLAVPGHRQDVPKVDAGQSHGPGQDDAPGRGQLQQPGQLEAGEVVQEKNANQHGQGGGHVEGQHAAVGHLRVAVHGLAAQAAAWALGGHQAGVAAQAAAQRVELIVRQEGLARAVRLLGLDEADLVGAAWRNEREAIRMRCGRERSADEGQEPSRALEHPAGVRHREELLLQQIKLLVAELGLALKSRSIMHGSKPQVKLMSHRQGLQEHLLLLSKTELCQSAGPSLVYTAERIYPRRWGCEAAQGPMASLRSTNVPSSTELSLVAFLWTLRRGAPAARGAAALNARGHARSLVHPNAAGRLAKMSVARLLSTFISKSTSTGQETGCDLRCGAWSVLARPAAENRPGWGVEKRNGLENLALGDHRSSLNSAKPAHKTVNTASIVPSTPELPFYQHRTFDEELALXXXXSTRRPSFHQRPSSLFIITGRSTKSWHCSDHGEVL

SEQ ID NO: 10711 - protein, 248 aa, Chlorella protothecoides
MSNTGRVFECARGFLPFVSTPLTPATHPYRLSLIPPCSSDEIRFIEAQKAYRSGKPLLSDDEFDALRGRLRRNASLVTAQGPRCSLRSQAMYSDAEVAYGRMLALNVPATLAVLVSVFLLDDLTGFKLTGLLELPAPWGIILTWAVALPSIYLVVDKITSIAFKDALVLVAPCPNCGTTTTTYFGDILTVPGNRKQNDVQCRECKSNITFNAEKRQAVVTNLPSSGDGKDSKSGGPKKPSDRPVPAKA

SEQ ID NO: 10712 - protein, 416 aa, Chlorella protothecoides
  MOD_RES (30)..(33): Any amino acid
MPLATLPVLGTTAAAQRAVPSRAPCLRRLXXXXRRPAGRSVSRSMPPTVRHYGWGRQGPRLGTLPRATLLLRPPPAPGRGSHLRSPTLRACHRQHRCAAGPLPYQPGRQQGRAPALPRRESWARGSPGCSACGVWGREGPVRGHVLAWVCGICDVYQSVRGVAASPSADDLWPIPRMLFVRISRPRAEIQHARTHKPQEVVGIRNSHHRRTVAEHVSALTWQAEAERAQRVTLAVEGNIGAGKSTFLNIMADQALELQDIIEVVPEPVEEWQSVAGAEGGEGPVNLLDRFYKDPQRYAYTFQHYVLLTRMQKERDSRSGLKPLRVLERSIFSDRMVFVRAMHESGFLQDMEVSIYDSWCAGSSDMVWPGAWGGDLGGGMWAPMHARVWVSAVWWGRFCRARSREQRDLHRKAAWPP

SEQ ID NO: 10713 - protein, 82 aa, Chlorella protothecoides
MEIGNDKLLTPNGFIYLKASPDTCIQRLRHRARAEEVGVSEEYLGSLHDKHEDWLHFGARTLSEVVEAQRHMLETVTREPGS

SEQ ID NO: 10714 - protein, 250 aa, Chlorella protothecoides
  MOD_RES (89)..(92): Any amino acid
MAQGWAAPCPAPESITPRPHHTASPSYPSQLFSFLKLGSKTATKPKYETVIPETSYAIPAVLLGEDMGWGRRVFLSWETCTLNVNMPLXXXXRKWGGGDGCFPIGIVHTQCQHAASHDIPPAFSSSYPGGAGLTQVTTSNTALAAGLGLLGAFLAVQASRVKFVFDEDALEVLTGKDEEESENAFVGGRNRWSYDSIINWEFWFPSFPILVYFKEDQTRPEGQIHFFPVLFNGKQLFEVMSERFNKPESD

SEQ ID NO: 10715 - protein, 321 aa, Chlorella protothecoides
MTSPHTLAHIAGSRRSLSSLRERWWRLRLTGLPPVLPARRCGMVLRVGDQGKQQPWPGMHAACQSQIHLHLSGTLGAAVGYTGGQSSHAVEPFSPHVTGQAHDEDDGDGDHLRSRREDDRGDTEGEGHCWRRDCHRQVQRQDHGVPPVYGACELPCMPMAVYLLPHPPPPPHFQVTKLGRSFARSRDFDAMGGPASSPGYPCAHLFTHCHCPAPTSCLTSSAAPPSGPATKFVVCPSGELQRRREVTHVVTLHEIDVINSRQQGFLALFAGDTGEIRSEVRDQIDSKVATWREEGKADIIPGVLFIDEVGLARGLGCLCGC

SEQ ID NO: 10716 - protein, 144 aa, Chlorella protothecoides
MADLRVNAEEKDLTRIERIGAHSHIRGLGLDDSLEARAVSQGLVGQASARKAAGVITQMIKDGRIAGRAVLLAGQPGTGKTAIAMGMAKSLGDETPFAMIAASEIFSMEMSKTEALTQAFRKAIGVRWVLARAGGCGVFSCTED

SEQ ID NO: 10717 - protein, 143 aa, Chlorella protothecoides
MAPKKADKSPTKAKAAKGGVEKPAKKVKKEPKGEVSVGRPTAPGNTGYCMLGLPSVHLVALRVLDPSSHRTSLNFSTTQRPLSAFFFYSNDIREQAHNACTIVLPAVKSDNPGIAFGEIGKKVGALWAALSEKDKVSVWELWV

SEQ ID NO: 10718 - protein, 748 aa, Chlorella protothecoides
  MOD_RES (118)..(121): Any amino acid
  MOD_RES (508)..(511): Any amino acid
  MOD_RES (612)..(615): Any amino acid
  MOD_RES (683)..(685): Any amino acid
  MOD_RES (717)..(720): Any amino acid
MGTRGPGLQPGAGRPPSPAVPAPLPLQMKVDTTRDELLHIHFNITFPALPCSSLTMDTGDVSGTYHSELGVAVARDHCPRTIWACAWPLRPFLLPAPAPGTGSCTSGGWMLRAGAAIXXXXPPRINAHESAFAMSFNLGSANLENIDFEKQACRHLGLGPSPGLPLAPVLERFSAPPKPDVLPSQANPLFTLSRRKAMLAHEGCLIHGWVAVQKVAGNLHFSVRPEALFMSMNEAEIIGALLTRHMHLNVEGNVSRPATTCTAWRRVSSPALHHPSFPTPFPPSTYTRNAAHTRRLGPERQPRHPHTEVWGEGLPRAGLPAGGRAPHRPQGHRHRQVLCQGSAHALPPRRLARRRAHAPVLCHRVLCAGGHQGQQPAAGHLLPLRHLPHRHGRRVPTAGSPAPPRTRRGGGGRHLCPHGLLVSLVWVRGGWEGVKGPRSKYGVCCTCHPCATRRRRGLVSGQRPHVRPAWQGSGPYTTVNTPRPPSFDAGIASCTCWCCDLGRRKVGXXXXVLHGRAAGHTEPSTLPAPPPLTQGPRRAHAGAAIRAAARWAGALSRHAAEGVKGNLWHWHPGVTGHRHPTPWCRLPSPFHTGPCRPRPSSRMVPVEGKEAXXXXLLVSLVWVRVGWEGGKGPRSKYGVCCTCHPCANRRRRGLVVTHCQKVVVGVMHPSMSPCMGLGHCRRXXXHRSGRYTLSERLWLGHASQHEFLRGAGALSSXXXXGPCRPRPSSHTVPVEGKEAWLLQTESRD

SEQ ID NO: 10719 - protein, 120 aa, Chlorella protothecoides
MLDIECFSYLNRALESELAPILVVASNRGITRIRGTAYSAPHGIPLDLLDRLLIISTSPPGEEDLARIIQIRAEEEDVELAGDAHALLTKIGLETSLRRVGGLANYAWLPPHIKGCTVGH

SEQ ID NO: 10720 - protein, 76 aa, Chlorella protothecoides
MLAAGKLDAIQPLLDAGARVTQNCEGSPPLTMAVCMGSHPSYERFALAASSLLLDAGAVPFERRAGVCFLGVGWVL

SEQ ID NO: 10721 - protein, 112 aa, Chlorella protothecoides
MDTIDPEVRADVEYAARLLQTAAQSDGPADDQDTASQGDGQHPLAASPASPDRELQTPNAAPQRRSALGPVSLELFCVLMEEVLAQTKGEPRRAARGCVRMGGWDVRPGPAA

SEQ ID NO: 10722 - protein, 199 aa, Chlorella protothecoides
MAELRRAKAASEVKECTFAPTLNRRSQNLTSHRSSALKYYDRLYLEAERRRHKLEAAALELPAQVTFAPKILRSSVVLRRLNSGRADAELAATCLGRPPRVEARLLERGERYAARAEASRAAARSALDPATGRRLFVPETCRPPRGGLGGVRGSSIGEHLYGVAAQHAKRAAAQAEAERRRAERDAASTFVNASSQVRV

SEQ ID NO: 10723 - protein, 240 aa, Chlorella protothecoides
MESEETKSLEDPRPVLLVTTVDIGDGVTGRVEVRLGDDPEDAARAFCATNGLPESVVLPLAAHLQSNLDLGPPSEQDAATGSVAPAQAISWADGDVPAQTPRDPLSQQDLHWARPPGQGSPPPHPDAGASRGTGGVTPAWGPGSSAPPQGTTSCVHERLYHEHFRQQLKLEEARRLRDLELQLRMAQVHLDPVSQSLSAARTPDGYTNYGERLYVEGRLEALKREQAVRCSGATVGRGPF

SEQ ID NO: 10724 - protein, 114 aa, Chlorella protothecoides
MSFLPSNSAAFGSQNPRGDVEQLFAAEPPVATASTSAPGSGYQAPSSPGASASPVGYGPTSNTLDEPIGDTIKRDLKRIYKNLVMVVFPFKDRSQQTAALRNWDLWGPMVRATE

SEQ ID NO: 10725 - protein, 108 aa, Chlorella protothecoides
MGEGGQHHPCGPQVRQSHPLLSPSSGCRLVRNPLPSIPLHPPLSSLARAYRDDWGRTALHWAAFLGLTDVAQLLLLRGQQWAEREAAQDSDAPAIPSLQEFQARCGCV

SEQ ID NO: 10726 - protein, 218 aa, Chlorella protothecoides
  MOD_RES (96)..(99): Any amino acid
  MOD_RES (187)..(190): Any amino acid
MDPTQGFVTEFAGFVDDLTTPEKRNIVALTEIAREAMHNQPQAVPGLAQVIINRVLHVSGVQGETQATVQCLRWPTNPSSCLPCTSWIPSPSLWVXXXXCAPIIMTQPPTSQADQPLKLPALYLLDSISKLVGEPYKTYFSAALPEVCDIWVELFGAARGEQKQSRGGSLEEQMFGSHHAVCQDLFXXXXSRGGSLEEQMNGSYHAVCQDMSSSSRIP

SEQ ID NO: 10727 - protein, 898 aa, Chlorella protothecoides
  MOD_RES (264)..(317): Any amino acid
  MOD_RES (337)..(339): Any amino acid
  MOD_RES (531)..(533): Any amino acid
  MOD_RES (732)..(735): Any amino acid
MCLAPDGPLLGPNCLGLDPHLAWLSSHNLTALCLARPASKHSPQPAPYTPPLSGLFFIGYLAQLPANVACLTFGVRRWLSCILLVWGVVAGLGAAIRTRAHFLVLRFLLGLAEAGTFPAIYFQLARFYDADGLGLAYTWWVDMRGGSAVPAPHQARPTSHLSAAGLKPYRASAPTSRQGGDGYRGGGPDRRPAGGRPAGPGRPRRAARLAVALPVRSGPRLPPLSRGGPGPALPRRRWLAVGRGAVRAPNAGALGTGRAGRTGXXXXXXXXXXXXXXXXXXXXXXXXXXXXXXXXXXXXXXXXXXXXXXXXXXXXXXFRALRWAASATKTAVGRARXXXAALRTRVQWAQAGQGALELVPREAAVAGAGPHDGEAPASEDRADDLPLLASDGGPRRGSAPSGGHGGRAARRTARREAVVAGGHPAPGGRRHERGQLLAAPDHPRLAQGRHSEWGRGRRGGRRSDLPAAAARRQGIAPGGAALRGGWRGHGAECAACKAAPRAAAAHRRPPRRGGGRPGVVNNWQWAIAEPXXXWDAGFWGGGGERKVGVFMLAWGVVGGGTAAWLDCVATLVWCQGSIATARPSSGKSLIDRKTQQCSPPSACFLPFSPPKNPPFPPRQATPADSPPAGHGWHRGRPHGRGRRHLGGPWPLLLLAVCLPGRADRVPGLCAGQVAGRSGRLLRAAGRGRTGGCRGRRFRRRCLLPGRRRAAWSGHDSGKPPHTHACPSTAFRXXXXTPVNGFSWSHATLRSLLGSPLTPMLAPPQHSKGLRARQSHCCDCHPGCVGVKVILWSTYPQYPSDNHTRPCCLTYPLAHRTSPCNWTGVHLSEAWWGLQVMVHRLAARLTQHSCPYGLTGVKLRPRALAPGDMPSGPPQPAADRAPTGNRARCPPGRCLPRQV

SEQ ID NO: 10728 - protein, 236 aa, Chlorella protothecoides
MTSEPSLPGSYPIKVRRAASRCPAGGEDRRISEGPGPWSRSPAPPSTYRHGRRTPSPGHARGGRMRSMIASWTVCASTAGSGRRYRVRLRAGGEGHVGTKSAIQIRSHAQKFFAKVAKRGGDSLSSSCSQGVGRVRLGAGPPCAWGIVVHMPAESVLVMGSVRSWIELEAESPPCQSVQIGCPRTSRSLPPRPGVGAVTPRCRMSRTTLAMGRAPCCRCPRTARSESPPRALRHPR

SEQ ID NO: 10729 - protein, 646 aa, Chlorella protothecoides
  MOD_RES (542)..(545): Any amino acid
MCCRSSRHRARPRWGCPSRLGHWTVSRCVEGQWQGHPDACCACSAWGAVQAPMHAHRIEIIGEGECTSMEEWGASRGGQPRLVQPRPACPRPARPLSHCVVHAMLPNQSSNLVSGLPLPPAACFDSGSGGYTGGGAGIVPSRRTCRLQECSHRAAGEKGLLVRLMTWASLTATDPLEKVLFSAWSRRPVYATAPEIVLCPAAPSKTITLKPTYGAPDVADMSVPSGRCELSPLGQSNTAVTPADCSRCGSRHVATAYRSQRFQRRQILPGSAWSRCTSSVTPGAGRARDGDADGWGISLYEIYNVVSVNTSFALFKVHLQRPALLAELSHTPMSNPAGSPPAPGLDEENSVINELNNLALKDVSVRSWGAVKAPILLIAQWGPQRDPLSNTNVQDPVSKPEIDQPGSSQGACDWEDDWEAAVPPPAAQPSPPTTSGAPDPALLAQDERGRGAGPPPLDPRSTAAGPSAAAGTPPFSSAHCLELTGLSPAIRQRDVEEWAERLKPAVPPYVRWVDETAAVLVFFDPPAARAAQRAAAASSGPXXXXPPAARAAQRAAAAASGPALGTLRGWEEASAGARALPPAELAPPRPRPAASAAVARRLIGAALSMNLRDKGKEEALRDAGRAKREARVAEQARRAALDAAWE

SEQ ID NO: 10730 - protein, 420 aa, Chlorella protothecoides
MGRLKWHQTGQWNTLQGSKTIHPCRDFDRDDELLELADVRSCETLRAPTQNPDPAVRPKAICVGVLCGTRLSASIMDVSCLEDGDWDILGAAPSGNQAWWTSELEGDSRFPLLDLSTDAGGSASTSLCTPTLELDFSDGAPVIAMTAGLGPVDKAPPPVPATGTSGASSNSDHQTSRPKYTAEERLERQRARNRLAQIRYRARKKAAAGAVVGHVSAVAASLQAARAEAAVLASQHSLLSGLMSVRDELIDALERAYMSQGGGGAPAPGAPRARPPPGAGCPRPAASHFTPGQLAGWHGGCTLASMDRLMALPPEQARAFSQVPTEVVARRWGDALSSMKQLIVDLEERGGKCKPLEDQLRRKMLEGVSLSVGVGLRAGGCWVWEGEIVGRGLPWRSACLAQVAQGACLVEPCRETGNRK

SEQ ID NO: 10731 - protein, 193 aa, Chlorella protothecoides
MAPHGRPVTGPPRHGLPTSQPRLSAWSVDIGKKALQGLRRSPERTYAGPDSPSQDAGRGVAPWWAGPLRGVAALFITSTLSLGGVRVCHAANWSSLLEDRLVESAQGLEAAVGGVTSRFRASLVTKNAREAQAAQTFLDEVWEVVGTNFEDVRSRGFRREDWQAQRAAHAGIADLEEAHRLTGQCLVQCAASL

SEQ ID NO: 10732 - protein, 512 aa, Chlorella protothecoides
MTSYPPRPQVFAVAWRGGETARPALQKLLGTWRGVFADHVLAMAQAEMQYQDHVQYHRPQGAQTAPHYPAWAAPQQPQGAQTAPQYPAWAAPQHYEGAHGAAQYAAPLPAAAAPQYPPVTQPRYSHQPAPAAQHQHYAAPAPLVPRYKTPPPGMCHPTPRPGSGPTVPIPDLLSSLLAAGVLGGAKAAGVAEAREPSLEFSSEIIKVACASSGCLTEWRRGDLCAACVRPVEPCRRAVPLAREEFQGDHQETDRAWLPGGAHLGRELGGCVGWVQQKHQGRGSVQRVGAQWQGTGWSKSWQEVCEVPHFITRQPTGSSRSTSQPACLCPGPHLLANNQTCDTTLAPPNTRLPSSHPRPTPQGDASHAVHRLLARTAETKSAFLDVQFLRRARRGGGALRASRLWYVDLDVWLASAAGAGQGAAAGEGQPPQRGDRQPDARVASAAAQQRHSVPVDEDQPACALSGEAFEQVWDEEHQEWRYEGAVRLTGDQALRCVMYDDSGSVGQAQGEPG

SEQ ID NO: 10733 - protein, 101 aa, Chlorella protothecoides
MLKYDVSGVGLNLVTGEEYLERTNAARLEDGRRPSAGVWVLGVIQGSLAEQAGVRLVSKGGACTVHGPTGSVWNEGGACTVHGPAGSVWQWVCGRRTLWGR

SEQ ID NO: 10734 - protein, 926 aa, Chlorella protothecoides
  MOD_RES (484)..(487): Any amino acid
  MOD_RES (687)..(690): Any amino acid
MRNGAIQILRSRRRSSGQATSCWMLALGVGGVLALLAALSWQRSRAAADAAASDTEECKVDGRTSRIASDNTVDPGALTPPHARLARAISQHLSPSKSRHRPLLGQELWDGGSEGASDPDMSAHLDSVLLDESASELHLTSVDPLQRVGRGASGPGRCPRCRDPARARRHLPAHTRTTCRSVYKASWHGAPVAVKYIPCRADDARGLRAAVREVAGTQSRLRPRAAHGASAVCHPSLSLPIKHSLPFAPSQVQCYDWAVLPVPTPSRPTPDRCDPASSSPPDTPPGDCPDPSCTPRSPKVSPAEADAGGQPAALTLRRGPGRPRPATPSSPSPCLPATPGPDGLSPGSAPSSPAIPALHGAALRVATPTWRAMLQPHDRGSPLATQPSCSSFSGVHAWAGPGGLASAELRCPSGRAWAGPGAPASAGLRCPSGRVLHREQRHDAAESAWGRTLPSIPTLPLPARPHPPSPNHHGPLTADATGPXXXXPSPTLPKPSWSPRRRRHGPHRPAAGPSALGLDGGGAEAGHPVAPAPGTQGRGPHRPGRAAAAGLPLLGPGAGLRRPRGGGLVEGRGGASSGCSGGGVAAARGVPHCRAGRPRLLAIGGAGRPRRLRLLAIGGAGGRRRSAGPWPPAPACLPGRVIQQRRGVWLPPETQITRCCCSRVLAAGTLAHVGTIEPLPSPGAPPXXXXLEGIGGRHAGACWHDRATALPRHPTSPLPLPSPPRRTPAVAARSVAQHPRQPIFELEGWELGPHDAVLAVVMEFCDVGSLGRALSKGAYLPSAKWSADVTHVSGAHSCCFIRGRGDGGGDFASRAGRWGRRFRLEVCGPGGQTRPRHRLAVCASPQGRQAAAMPERSHPHTHTHTHTHTLAESTAADGAGGRQGHGLHSQPRHRPRVRAWVGRGDEEEGGRGLIFLGQSQGLRAWE

SEQ ID NO: 10735 - protein, 462 aa, Chlorella protothecoides
VAGPRGGLRPRPPGARCGRVRGHVDAPLPRPAPRQGRRRGAGLPPPRAGPAGGAGKGRGSSGAGAGSCHAAAGAAGGGGAARLARAQPSIARPPDRGAQAAGAAPGAHHRLAHRKAGAPARRRVVCMFTGSGVGAGKRFACRCCVQQPCSRLLCQAHGIMCRQGSSKLGPHHHLPGLAPASSSGSNPVSTKIPRSFPPAGKKAGDSTSFPAVAPKTRIPRPGSTQQLPQQPLPRVQSEVFPSDRRASCEEVAPCGDSWPLSPFSFSLWGDLCATPFPCTPSAVCIAMPGWSVPWDQRLPVLHAGAPATILQEGQGSTPRLKTETRASVPSVQLLSNKVILRQGQELVATSMALPPLPLALLTLVGACLSLATNDAALVTCGSLIKLQHVATSCRLHSHDIPYGYGRGSGQQSVTCYPDSDSGESYWRVACEVRCLIWSRELTEPAAWGPPVCPQTPELPTCI

SEQ ID NO: 10736 - protein, 106 aa, Chlorella protothecoides
MASGGRHSGLARHRHVYMRWKERFFVEGCECRLTIAGFYYLCLDRCGHVWEGQGGCGGAVMSYNRITGAIEGLYFDPSSTPDQQLTLEPQQAAGDEGLAFGHVDIA

SEQ ID NO: 10737 - protein, 119 aa, Chlorella protothecoides
MCRHSNVRLPEPGALGLCASSPRPGPAHTQLFSVPTPSVRLVSLAAQRFIASLLDEAINVHKRRKLAPASQLKADGHNVRDKRAVLTTEELVEALKECGVNAKVAPYYADQPKPVSGSA

SEQ ID NO: 10738 - protein, 99 aa, Chlorella protothecoides
MLDVLLTVVVASVVGHILTMVFWKASCPVRDQHVFITGGSKGIGLAVAEEVLRRGARVTIAARNRDDLSKARASLAAACPASRGKIHTVAADTTSVDQV

SEQ ID NO: 10739 - protein, 82 aa, Chlorella protothecoides
MGRLCGTLEAYNIPDSERPVTTFFEGEIVDNVNHTFFTSEYGACIESDLRHWSRFKTFQALRRVRRRAGREREGASGSMDSI

SEQ ID NO: 10740 - protein, 502 aa, Chlorella protothecoides
MSPGRHVGFPGRGPHPHPLRGDARPLGVETAQHPRPPSRGDATGSEPAPGAGRLDGESAPLPRPLAPRRGGRGAEPRAAAARGRCPGRRHAPAPGQAEDERNSAPSHAPPPAYSPVVPADAPPPPDCIVCYEPCVEVAVGACGHATVAVGACGHATVCADCTLRVRLCFRQLACPLCKTELASVALTQWRAGLAGLAGDAAQASRGLVPLSRQAPDILVDRGAMGRRREGTRGGGGRGQGGEEGGNKGGRREGSWDPNPATVPPCPSKPCLSTLHPHSPAPLGLDPHPPHTPNHALLRLAFGGAAAPAPSPFHLSLLHRTSIGCPACGAACPTHSALLQHARRVHAPARLCAMCLQGGRAWPRQLALHGDEAALAAHMAAHHPACDFCRRSYIDDDALWAHMRDTHVSCHVCPAPGPRPAYFRNFAALSQHVHAAHHVCPEPDCARQLTAFATPAELARHAHERHSSHMPRWDPGRARPLTLDVAGIVVGGGQATRPAAATR

SEQ ID NO: 10741 - protein, 113 aa, Chlorella protothecoides
MVQLHAAAQSAEGALGPVDVVICNAGLSLPGSLSIHGWSRGQAYASLCTIRARATAQLAAGLFPDSSLENFQRQVDVNYLGTVKTIKAFLPGMLERRQGHICIISSALAICGG

SEQ ID NO: 10742 - protein, 64 aa, Chlorella protothecoides
MPYRLSEETGLIDYDALERTAELYRCGAGCGGWCRRMAAPVPDAHAQSCQAPGRWACEPGVCMV

SEQ ID NO: 10743 - protein, 123 aa, Chlorella protothecoides
MVSAGFCHLLGDALEQMPAMDFPLAPFLCGVGFLLTLLCDAAVVHASSGPVPGCHGAGLVGGAAARSDGDLGLDPEAQVDPARRRRQQRQGPASEGTADGVQPPTPRAHPALSQRGPHAKPGG

SEQ ID NO: 10744 - protein, 136 aa, Chlorella protothecoides
MTNKYSEGYPGARYYGGNEFIDQAESLCQVRGDDRKRALAAFRLDPAEWGVNVQSLSGSPANFQAGSCSVAGRAGTVLGLARQAWVQCGPSRRMHRPLHSPRLFLWLTPCILNLHAGVHGAAEATRPHPVSGPPPW

SEQ ID NO: 10745 - protein, 114 aa, Chlorella protothecoides
MTTVLAPLQNGGLEQPGLDPRVLQCGFARLLGKDVDYIVRKYEIVLGRRSKASTLDVILGDFMSVSRQHARILYSFPSGVPHIAQWPGVYVQRAGACLTKQRLEMGHGWCCTLV

SEQ ID NO: 10746 - protein, 621 aa, Chlorella protothecoides
  MOD_RES (265)..(268): Any amino acid
MPVPHTLVPSPSSTALRAPLTARWELQVLGKNGVAVDGVTYLPGGDPVPLASRALLQIGQDVSFHFLLPSSTRRRHVSVIRVSGPDPIEVWCPLARGSVESHVPLVVLTPDGGGHQGTRHRLDDRGIMRCPGCRLLRSKSLKPACPTPERRSLTPSAPHATAPAAPAEEGPGSAPVPPAPAAAAAAAQPAPAPDQPSTQAHTQDLGPAGAPPAASPASTPVEEERPHVPSASPAAWFSGEQGPAQGTASPRAQAPHPQPSPAARXXXXPAAWLSGEQGPAQATASPHAQAPHPQPSPAAREAAEWGRGGVQAQQAQQAAPQQPGPQALLAALSGHPGVQQALASNPGILQALLGNPALLQALLGNPGILQALLGNPGLLQALLGNPGLLQALLGNPGLLQALLGNPGLLQALLSNPGLLQALLSNPGLLQQGGGATPGVLQGLLAMAGQQAQQLSAQQAQQLSAQQAQQRAMQQAQQRAMQQRAAVQSLQGQALEQEQAELTPAQHQQLLQAWQAQQYGNPHQYGRPGSCWVKGEGVMAGSIEGGAIWDEPEWGGMCLGRWTARLPSLHGCIHVHVHGRRAFLDRVPLDGKLGHTGLVGEDAPHQPGQGLRAAWSFKYCIV

SEQ ID NO: 10747 - protein, 92 aa, Chlorella protothecoides
MACTRSQSTHPAHVQEFIRVGYYVNTEYEEETLREEPPETPQLDRWEALLLLSSCWVVAAGRWDCMHAMQVATLFLSGSVTCPPLVVTPCNT

SEQ ID NO: 10748 - protein, 176 aa, Chlorella protothecoides
MQAAVGVDTDTRLPHPAPHLEQAPAAMAEKPEKQNLTWAQLTKSLCAGGIAGAVSRTSVAPLERLKILMQVQGTEKVYTGIFQVGRDSVCVCLWWDVGYRCRVLSALICQNWALVASWAPRRGYKITACALQGLHACAACIVMPRTGALAWFGSGVWMLDAPHVWQPPPPLASHLG

SEQ ID NO: 10749 - protein, 192 aa, Chlorella protothecoides
  MOD_RES (32)..(59): Any amino acid
MGIASLWKLLTEEGVVRKLSGSDPSQHHTLLXXXXXXXXXXXXXXXXXXXXXXXXXXXXWIMQADQQLALLPHFGRTERCMKVALERNWVKAINSVFWHPCPSQSIQWLRHGCLPVIVVEGRAPAEKLAAVQARYAARNGVDGGGRGSSSFIALGKSVGVMLQQLVGAELERSGAACREPGGTECKTRGRRG

SEQ ID NO: 10750 - protein, 221 aa, Chlorella protothecoides
MCRPGRLPLPFCRAPPLRTASPLVYRTTCFLSYAAWQQDRLARRAEEIAEQWKAAAPAQLAKEGVAADAATGAYAMPCPCCRAVVAPAQLPPGFAARARGAPAPAAAAAEPPAALASLLDGPTLQALRRLQRTQRATLEAQRRAGGLVGTRVAVTLAELEASRQAARDTASAAVAEPREGSGPPARLQGATDRDVRPAACRRARRPCAEGGPLAGKPRTSS

SEQ ID NO: 10751 - protein, 254 aa, Chlorella protothecoides
MWVSDGIRGLFKGNGLNCIRIIPNQAIKFMTYEQLSRKISHALIDRGGDGQLTPGLRLAAGAGAGIVGMSATYPLDMIRGRITVQHSSHAQYRGMWHAASSIVAQEGLVALWRGWLPSVIGVVPYVGLNFAVYETLKDLIVKAYGCRDERDLAIATRLACGATAGTLGQTVAYPFDVVRRRLQMSGWAGAQSLHAAEGAAVRYSGMTDCFVRTIREEGVTVRPGIVREGWGGGGEGGCGRGESHSRAVGLPCVG

SEQ ID NO: 10752 - protein, 137 aa, Chlorella protothecoides
MRRPSLHPSHCSAPPPPPLPQTFLLASKWWPQLAYHGRGLGQAWWMLHVRPNKVKQLCDYLGMRLRALPPTPGMAVDEDGLRLVEFWVPRKTVRAWNPRTGKRGTRTLAWAEGLQILVRLDLDEEAVTAITRTTKIT

SEQ ID NO: 10753 - protein, 445 aa, Chlorella protothecoides
  MOD_RES (350)..(353): Any amino acid
MVFFWGGVWGADNLAREYPDEGMPACGPPPVRCGSSCACLSRDGCGGELQRAQRGPVCLCGAADHRDGHRRAAAQRRGQLDGRHAEHRAAQRLRRPDPRRRRGALGRAGAGALPRRDGGRGAGGRGAAALRLCGRVGRHRAGRGRGSARQGALGRVQGVGWVGPCLGGRCGFGVGWMGREGVRGDVWEQWHGRKLDGELARPAARWCGIVSISPCPRNHISPPQHTQKKALGLVRGVCEGAGTVLQVVPGPTAQTATAGEECAEGGVSEQGLEASMPPAGGAVAAEDSAGGDAPTEQPTGGESAPQEPLSETRNAAEPADGSSAPAEGPEGAGGEPAGFVAREQRRSVAXXXXPADGSSAPADGPEEESARVAGSPSDEGDPPAAEPEAAVPAGPDLTDAVLVQFLEHLAAERGMQALEAAGGGGLRVARITARDWVAAAVDAST

SEQ ID NO: 10754 - protein, 146 aa, Chlorella protothecoides
  MOD_RES (97)..(99): Any amino acid
  MOD_RES (126)..(129): Any amino acid
MIAVKRESPPTPTASGCVDVPQDGFPPGLRGLQNLGNTCFMNSVLQALLHSPFLVPFHLMGRHNGDTCFISDDDSPCLVCALVSQGCWLKTAHTVTXXXCIYGDCQTGTFTAGHFTVSFTPARHPXXXXAYMETARRGPSLLAIPL

SEQ ID NO: 10755 - protein, 130 aa, Chlorella protothecoides
MIVTTPDEWVALYNAIKEESSCSEEKHVFIYASAADADSVAALRILEVSRGEMGMVFCVQGWEVMCCMIHTPGPPFDPATPPQRLFKNDMIPHGWLPVSRYKEIEEDFDACYQPDEEVGDLSYGCDGDAW

SEQ ID NO: 10756 - protein, 206 aa, Chlorella protothecoides
MAELKLSGNHLKGSRPVLSFDATFDQEPHLQVLKEMLTQTFAVPRRHHKVKPFFDHVMSFTVADGRIWIRNYQVLPNPEKKKAAPGDVTLVEVGPRACLNPIKMFAGSFGGPVIYENPSFVSPNAVSQAVGPYLAHHPPLGLLLAFLAHPQQHLLHSHPLPLLPLYQTDPSGTKEAAVWEVWCQGGCKGAPQAARRCQPTSAERAG

SEQ ID NO: 10757 - protein, 246 aa, Chlorella protothecoides
  MOD_RES (83)..(86): Any amino acid
  MOD_RES (239)..(242): Any amino acid
MGRKKKRDDIFGGIKMQSIQPGKAQYDFTDIAGIDSGVDPSDWGAEGDLCMHRQTSSKEGKIVQRELLDFNLITPLPPSYSLXXXXCIQEAVLAFHDTECQPSIASPLGTRIKEEIREVVEFLKNPARFLKMGARSPAGVLLVGPPGTGKTLLAKSVAGEAQVPFFSVSGTGEKGEMRPWRADVSPAACTSFLIPIHNDRVHGDVCWNRCVEGEGHVPTGSSSGEMVVIEMVKEGGGGXXXXTHSQ

SEQ ID NO: 10758 - protein, 527 aa, Chlorella protothecoides
  MOD_RES (100)..(112): Any amino acid
MRILSRPAQVSVCPNGTATGSTYFLPLEEQLETRIIERGYLESKMVGSWVRVRWVVPDGVGCVCAGLSLTCLRAVSHPEVNACISWTPSPRHSLGQAGGXXXXXXXXXXXXXLLGIESAPARTPSSRRPPPIHLRWWHWRVRCAEMLVLGEANYTSSAGEDLTLVCDLRVSRIRGLYQFLSVLLWTLPFWLADGVIMANYIAREMVYHSGFGARMGPVALQDDDENFLMREKGRHAGSRRRAAEGRGSESSKLIPCPPFHPVQVGAGVQHLHGAVPGGLPGREGHPGRSRGQGLLRHRQELRGLRGPGPESDRARDADRDGDQRHPGQIPAGVYRVQRLGRRWMRTRSLSDPCSSPSSCRHARTPVSAPAQPETPCPWTPAALERYPRSTLSGFYWEEDGSVGYPGKPKVGLSWCWLGPGLRLVKVSCKGRVYLPPDPTYTLPYLLILALPTPKTHEGRLVKVGVTRNGVEIGADTGNGAAPANGAEGTNGSGKGKGKERYVPEWWAPGNPYAVRSNMGRLLLREGM

SEQ ID NO: 10759 - protein, 441 aa, Chlorella protothecoides
MRPCAQVFEHLPGPEAASGEQACAHLAPFHARAWGHAPAQAIAAHLARHSSPADGISSGGRPKSAPPPGPGPPTSSTPHRWWRHARHAERSVLLLGRGEPGHAVHASQLHAQSLLVDVGRQHVLAREIGGLGRLDGRVHLLLCLLLQRLQLGHLRQPGVQQQLAHVLDGVAVLADVAHLVARAVGAAGVRHGVPVVAVRVHLQHDGPLCQRVLLGKGHGGAHRQHVHAVHLQARHVVAAGEVGGGLGAAPLRRAHAVVVVLADEDRGQVPQAGHVEGLKDLALVGCAVAVDGHAHRPVVQVLVAQRQARAQGDLRAHDPLPAVEVVLALVHVHGPALALVGWRGMDRGWVRLGSERATAMCIERCRARSHVHEAVTEPPHPPATPAAQPPRQPCTQPPTDLPSTLLRLSPWRRRCAGPSARQSPRQPCPRGRRGWRGRGSW

SEQ ID NO: 10760 - protein, 443 aa, Chlorella protothecoides
  MOD_RES (374)..(376): Any amino acid
MYGTDVYKYSKTSECGSGFGLACSGVCACITRDGSRQKLHMICPARPLHDIGVRVPCLDSTPQPETGAPPSKPTSATRCPWPLQPCRPPGPCRHPTPGPAPGSRPPPGSTTPPLSVKPCMPLAPGPAFACSPARPWLRKVGASSRIPCPFPTPRCAWPCPVLGGPGGPGPPTTYAHTVLPLRPGAGVVNDETWEELVLKSPVPVLVDFWAPWCGPCRMIAPLVDELAEEYGDRLRTLKLNTDESPTVATDYGIRSIPTVMIFKDGEDPGWGCGSLGIGSGRVGLWGSELTLLHPLPSRHRHQAGCRDWSRAQGDAQASHRQVPRISLRGLSCTRCKAYSKDKGGVLGNDDSADGKGWGHLCLSWQGPLIFWPSXXXRYWGTMTVQMARVGTSNVYFGRGHSSSGHRLIASPKIIPPGRCCALGDDGPWRWAPPRAPGRQTRPP

SEQ ID NO: 10761 - protein, 559 aa, Chlorella protothecoides
  MOD_RES (194)..(197): Any amino acid
  MOD_RES (228)..(231): Any amino acid
  MOD_RES (262)..(265): Any amino acid
  MOD_RES (305)..(315): Any amino acid
  MOD_RES (533)..(536): Any amino acid
MRVAIDKVRHRVLPASCPKSIAGSMLVWTFTLATGPLAISVLGLRDIVRLVAPSHSQCHQGNTSQDPAGAPGGREGALPLLAGLEGPDTYEQAGSRTRTSTDHLFDRPAGAQSRSRLTRARYSTLTKPSSTLTTQLCLRFQQGGARYTVPCTSPSSARGPSTSKKHGARWVLGRDLVPSLILICISGSQPQPPXXXXPSNRFVEQLAAWMLSILMLPSQSLHAGFSFXXXXPKQSLRRATRSLDAQHLDAPLSIAPYRVFVXXXXSMVPHLRGRIRPVCCCSLPLPQASRGEDSQRCLPSVADVXXXXXXXXXXXVDLNGDGKPEVLVAAPNGQVQLLAPARPGDGFARVRHGTPRVRSSAAPPNHVSPAPLPGPLRGGGRARQQHAAAGACDGVPDPRAQGVGEGPTQAGGGPADQQPHAALPGPQPAPAVEPAAGAQLPGARHARRGGPARLPPLRVQGGPGPGRAGGGRHPCRCCGAQAPSGGIWVQGGLQLTGSEVIPPTRFFDDCCPLQTIHLDGALEEVLLGEGLEXXXXTGSEVIPPTQFFDDCCPSRTRSI

SEQ ID NO: 10762 - protein, 253 aa, Chlorella protothecoides
MYSDFCVATQPVIGSFRGGCPHPCRISAPPTSAPCRGTFRIQKAGSVPYPSRNPADIWRRTFEPQLPLPLLLCPLQTSRGVGSRATRRDVPPTRASTSHESSSAELPPKWVGAAAAQAISKSQVAAVVAAGLICGNFAVRGRELAGRPLLSQYCMRHTPLPHTMLQVKGYALFLRGELGPIVRPWLPQECHTPWLAAFAAVLVLGGLLLLALRPRSIYLLDFVCYRPPDELKVTYDRFMQGSVDSGVSRCEAR

SEQ ID NO: 10763 - protein, 483 aa, Chlorella protothecoides
  MOD_RES (134)..(137): Any amino acid
  MOD_RES (246)..(249): Any amino acid
MLATPRPDSQPRQKQGGDKKKGRPHKGPSQKPVDDAEDAAAGPGYRDRALERRQGLGPELTGVPQDLVSLINNDGVGCVCFEGLVCSRGVPLQVAPVSGGFTPGLVSAVAALGCHHPSVPASRPSSLTPSPSPXXXXSPVIPSLQSLLSDPFSLPWARRPPCTKVRAEEQREAEEEEDSDREDSGDEAPGPQQAAAGRRAAPFVPRHIAPPASAPKARTAMAAALHEYLFAPKPKALGITARKAHXXXXLRTVRTPDHFMSFCDALPGQLPAKHITMRCPAFCSSAAAAEMFQPRRTSFLYEAEGGGLENLPTTLHRAKEDCPKVRRGVRMGTMPAWDAGVKDRQRLDAAGLGGAEGALEAGAPLHRSTPGPMKTLPTHASAAVKKKVKKKQHLQGTVLPGGVALAGSLRPDRDAAALKDGAGPDAEGAGQPGVSALRKAHSLFATRNGDVPGGMRARVILLKLSALPLHGSQHWPVGSLITA

SEQ ID NO: 10764 - protein, 485 aa, Chlorella protothecoides
  MOD_RES (92)..(94): Any amino acid
  MOD_RES (129)..(132): Any amino acid
  MOD_RES (402)..(405): Any amino acid
MPLPACTAGSPSHRPAPVDDDENIFDDDGEEYKPERRAPGAAPVPPLPGPAGRGAYFGGAEEGQLVSPTQGGFLPESSLIALGRGRGNSPLXXXISPTQGGLLPESSLVVLGRGRGNSPLNSFGVVLLXXXXITDCVNYCPHIVNPDAGVGLAGPSGATECAPPPPPLQPLGHEEEEEEGAYPDTSAQYPDTSAQYPDTSAQYPDTSAQYPDTSAQYPDTSAQYPVAQTSAPAETGVAFYLEDDKASDQMAAEDKPPAKKPQKLVLQDADDGYAECYPNYFDAAGTVVDSEGEDEKAGVRPRAEPSPPVYPSITIPSVQEVILSRLDFDSQAEWEAYSASLKPQVAGKGANPRKAQVRWESLHARAWTRAHGELARVRWLRCRDHPPLGRGTLPTGSADLPXXXXVPVFEIRKRRAFASCSPQHHDPICAGGCAGCAVGTHPPLGRGALPTGSADLPSRSHSGSATRRPSKTRTRWKPSWVRFAI

SEQ ID NO: 10765 - protein, 480 aa, Chlorella protothecoides
  MOD_RES (116)..(119): Any amino acid
MLARSGAPSQAGTESTGVQAESCRLSPVGGNSLPQSPALDTNHERYRHACDLAGCKFPSILEIVLETGSSLRAALGTGKGGLGVDSYFIQPGNSVENIVIWVHRASDSHRAAPSLXXXXTGLPEPAFCPGWSGCGVGPLRERPWQVDCHDTCCLHIPPHQSLPSATPPQHAAVRVLESGHGAGRRRGGSRRAPGPGRAGGGRGCSQAHAACAAAVGRPLPRPVPRQPLAARRRHARPRALRPGLLRAIHAVHSPDERRLCGPGEAGMAGLPVERTPGAAAGRGRAREPRASSLLRRTSGVAESCTDSPILPLSPPFPPSDQRDGVVMDCCKLGSGEARFAQHASQLTGGVYLKPSEPQALLQNLLVRVVEEGYQARPHASADGLCGGAGRPSPAHSAHQRWRGRGRHLHVPPQAPDDGTRVQRLPERLLRAPARLSDLRLRVCDRLMEGREHQAMGGVKSKRRQPVRAEESPGDRNTSLG

SEQ ID NO: 10766 - protein, 631 aa, Chlorella protothecoides
MPFLRAPPPTVVYLDADTIALRNLDALFLCDGLCGVMRHSERLNSGVMVLQPQAQLFSDMMSRIEQTPSYTGGDQGFLNAYFSGFAASPLFDPGRGRLLSESWARPPPGNATGGAAARVRMGRLPTEYNADLGLYVLNSNRWMVPEVDSQGIVGAGWVSPQQHRARDLNGGCVSKRRWVSESLPPCARLRLRLPYIPGAVDVQHPHPKPPRTLRAPLTPLLSFLPTPHQDELFVLHFTLSSFKPWNWWSSWIISGNMERWQALRRRLPGPDTGPSRLLVSTLAAGPWLLFALFMRRTPSLSPCLRNLSFRRGAPGMSGALALERVACMPWVILLAALTSLCLAVGFAVCLVPTQVGGGLWAWEWCCGRSLPDVCRGGVFRYAPPRRPLLGAVEEVVIHWLHQSKGGFHDPTSSPRSCIPLLPRTHSLPVGLRAAPGGQQHFGRAALPGRQRREPVAADGAGIWRHAGPAGHPALVERRAGVGDWPGHRCGSCMIAPCWGPSSHGNSQCPRAAACPSQSLSPPAPEPACAIALPPQPQVLHGPLVLHGRCHRAHDARGGPPAELAGLVVVPRRAQHGLARLAQAEAPRVRGAPNGATDGCGRGREASTLAHAGRLFAILAGTMFLQNVSLPP

SEQ ID NO: 10767 - protein, 367 aa, Chlorella protothecoides
  MOD_RES (39)..(42): Any amino acid
MIDDARGKAWVRPSRFPGTRRPRCPEISTRVMAVYGCAXXXXSMGPTIEVPRYETAPLPWNFHPSGGCVRMCHHPDTGSAPIPVSSRCAVLPSPCNSPITEAQLGFSSARISRHDQNYVIGVARGLHAHGNVIFAQTGSQAPTMLKDPLQTRSNFDFLVKTPALDVAWGITGSRSGRRVGDYWCPEVTHPTVTICSLPGGHPLRPVHAVQVLGDGKPEAGTKHKQAYVSLMYGDDFLLGMRVLGQSLRESQTTRDLVAVVVGSHVSDLSKNVLRKDGWIVHEVRGVGERINICRGLVACRVHARVDAVQNPGLWTGTASGSFPPRFWAVYTKLLVFNLTQYERGTGLRDEHALSWAMEGLHAFKEHG

SEQ ID NO: 10768 - protein, 273 aa, Chlorella protothecoides
MLASTVRHPACTSVLSISTGQWACQFRTLVDRTKAQRYHAEECLAWKAEPQQYCSVRWVLYHCCGIGDMPDRDCCATCRGMVRDQEHSCNGTSFEATLSPIEQGWIQAYPPQEPRRRRVSSSSKSAAPAGFRESESTTNEHETAFETYNGPYEWVALPFKLTNDPDTIQNLMNTLFSALQSKFVAVDLDDVLFLDCVLDFGGAGEDAARVEDILMELETSAGELSYGGLGMEMGGVKGLKDMAEVKMMVVKSLAVCQDAVEVHYSKPVQQCTE

SEQ ID NO: 10769 - protein, 229 aa, Chlorella protothecoides
MQPGLIPVPAALFHGSLLLSTLGNLGLTQEALAQPTLYVSPLFVAGWAGIVNTALNALPVGCLDGGRTTLVSSWGLLTGMLLPELGSKLCSSCRRAGEGQACCLAELKAAAGPNVAHATSLARHCSRSPITITQAAFGKGALAFSSLVVYALLGFGALGGPLALPFGLYVLVCQRKSEGWIQDEVSGVSGTRQALALGITLLALTVLLPESAGVLLGGVGAGGPAPDLF

SEQ ID NO: 10770 - protein, 189 aa, Chlorella protothecoides
MHLAQDAHEFLVCFLDALVSMKDAGGRGLDVGLQTQLLPGLATLNGWPAGAAASRQPQLLEKGVPGRQEYGSQGTWLNHNTPSAGHPVAQAFSGALQSEVTCWACAHASTTRDGFMHLSLDIPPASHLIAPAIALDPADPPPAPRAANGRRVAPPVRGRGRGAKVGRRLGVLGCCCWSRIIGIVGGNAE

SEQ ID NO: 10771 - protein, 152 aa, Chlorella protothecoides
MPPLGPQHECHLLTGPVALAAQGLLALLAGSTGWSFQCLRDAGPLAGVSATEAAPPTPTGVAAAILIAHTPNGHASSECSWYFFAFLADTTLGMALSLGLHMLIMRVASGEAGQGAVDTKTTLLGALKVLVPCGDYGECREVVGCSGYVCRH

SEQ ID NO: 10772 - protein, 360 aa, Chlorella protothecoides
MADMGSRSYDPAAIGAGRRLPTASGIPGTTLGLIRLPVFSSGGCLVDTPGVHLHHRLPHALRPEHHAALAPRGRLRGRGVAVPPGGAVLWWGGCVRLHVAPHRGQHVSLTFFGPKSLHVAEAGGGEEAAGGLARGAPGAGGVDACGDRPPPPPAGGAWFQGGSAALLERGLSRPRRLTKPLAPGQPRAIADLAVSGLPGWVSVHGSGAGELALEVCVPAGVEVFWRPPLPKVAGAPARPHGTPPLAIRCDLSGAAAFVPGRRRHHEHLDLAPLAAPPTTGRRRRLGDGAAGLRAPAQHCVLHQHLGNVDSQGAHDHDRRQLQGGAAREGGVQPGSQPLQQWGARKDLPRGVEERQCETLG

SEQ ID NO: 10773 - protein, 242 aa, Chlorella protothecoides
MHMYKREHNFYGGQGIVGAQVPLGAGLALGHQYLDDGSVGVAIYGDGAANQGQIFEAFNMASLWNLPAIFICENNHYGMGTAEWRSAKSPAYFSRGDYMPGLKVDGMDVLAVRAAVAFAKQHALAEGPIVLEMDTYRYHGHSMSDPGSTYRTRDEVSNIRQHRDPIEHVRKLLLDAGLAEVAELKALEKEAKKEVDAAIEAAKAADFPGQDVLAAHIYKEGLGMQLRGVDRMSWLTAPKQED

SEQ ID NO: 10774 - protein, 94 aa, Chlorella protothecoides
MDGRVLASMVLPSVPAQPLLVADWNFDGLNDIMLLGHHGVFGWAQVRRPGALSFATLVAALIVIMVGVFVSQAREEGPSAKAHRPRGRSTDQAE

SEQ ID NO: 10775 - protein, 141 aa, Chlorella protothecoides
MLIPNTIFRLGAAAVLLTSSASERRRCKYRLERLVRVHLGADDAAYRCIFQAPDAAGSMGVALSKDIVKVAARAMTANLTRLGEGVGSGTRLGRGPTGGRYTTCLGGGGAQGNGRAQTGIRGQGPGMAGLGDWGWKCEGGM

SEQ ID NO: 10776 - protein, 238 aa, Chlorella protothecoides
MALSALLQKPVSVQDIVGEAPQQAAWSIDLAHLLAGRGLKVVLCTRMPGVDTSHARLSFYAAQMEEDAPRVDRLFQAGSQVQSVCGCNGALFGDHPVSGCSGESRVLCLVSAVVPKLGLVQVDRPRLARFPVPTSTQEAAAVGIRVLCASLTDQELLERLSGSLAILLVDKTCSMLGVPGGEYHGHFILVCGFDPRTERFAVMDPSEEGAAPLWLPAARLNAARLVPGTDEDILFLSK

SEQ ID NO: 10777 - protein, 237 aa, Chlorella protothecoides
MLTPGVGLQARSGCPAGRTVRQVLLPRHGRAGGPGAPFQQQTALWALFRLRPAILLQWIGQVTCYPLVVPCRTARLAHPPCQAAAREYGEESCRAFRTSVLEALPHSWQGSWDTALHLAHFQRQKRGKGEQRADPARLAREDGGAGSSPAQRTGLKLGGSPPNALAGVSWAGGAGEGRTGASVPAVVFRVFGVAGLAIQAPVEHRAVRSPNPPLQLLRGRKAGEEVSPNVLVAHLSE

SEQ ID NO: 10778 - protein, 119 aa, Chlorella protothecoides
MHKPETPCQLRAGNAWMAGRAAVRHAGWRHAGSDSSESSFGKCTMNRYERDCVAGSIGMDCLTGLTGAAISRQAFCLVSSHQLNLLPLLVQGVSYGKPAACMIFDLAALLGQETSHMLW

SEQ ID NO: 10779 - protein, 148 aa, Chlorella protothecoides
MAAFFQDQHFHHTNRRKPVVLIGPADASLRCLAVGYEATGRMQVGAEHGDPGWGAAEKGLEAQGQAQSHSTPMSPVVHDILRQNTTSDTKPWPSSSQGNKLGHAFAAATEAVKAEAWHDLFDTTVIQISKHDVDRFKSELLRLATDLL

SEQ ID NO: 10780 - protein, 125 aa, Chlorella protothecoides
MFAFNWVARQVCQPGTVAPYVPDFTRAFDHFCLHAGLGERKGRCGVIHRGVGLPRRPAILARCCKAHAAAHCRSLTHPCRREGRRGGAERAAGAQPDADGTQRQHPVLVSENSQAGAGGLAGLSA

SEQ ID NO: 10781 - protein, 76 aa, Chlorella protothecoides
MAQHHGMPTHMFLTLVTSPHHIPFPQLGDSGVEYDLTEIPQSVRSSIAVYEAARALVGYITPDFDEVQRVCVEGDL

SEQ ID NO: 10782 - protein, 78 aa, Chlorella protothecoides
MEAALTYKDSIITSYRDHATHVGRGGTVAEVIAELMGRRTGASMVRGGGGWRGDPWAAGCRAGGEVGLQGLQEGAAAL

SEQ ID NO: 10783 - protein, 158 aa, Chlorella protothecoides
MRSSPDDSCMHRALNASREPVTVGLIRGHIAAATTVGGLLLSEASPALAQDAGPAASVAAGAAPALPAIDPAQLSSGVDTAVGTLVDLLRAAGSGIKSGLGGAQDGLEAAESAYSRIAPYVDRAVDAVRPGVEAGVAKAGAAAGPALERALPAAQDAL

SEQ ID NO: 10784 - protein, 160 aa, Chlorella protothecoides
MGPTGGLGSVPSSRLPPFPPGAHRNHAGYGKSGREDSPDAAENRFNALSLEERRKFEAETLVNVGGRKRQSSLNRYRTSWGAESSGPNELIVVTILAAVAAPLKLPRVTSREELLEALSKLGGVRSEDVLAVEVLWTPEEEGDTFTQEDLFTDYPQLNNL

SEQ ID NO: 10785 - protein, 257 aa, Chlorella protothecoides
MAMAALTASAALLFCSCDPAFAAGSGGRMGGSAFSSSRCGDTVVEQRYHVRTDPAALCHVQFPQEERQGVNSRSMDKGRCNPSSGFQDSGSSFPLGRGADSSFLQQQRSQGARSLSSPAARSSGGHHLSVTGRSALAPAYMTPLGGGGGGFGLTSLLFWGVFAFIMVKAAQGVLGGGGGSRALREGDDPVSVAKLQVALLGSARGLQRDLERIASRADTSGPAGLHFILQGVVPRESPGVHAGGAPGPSSKWEEAQL

SEQ ID NO: 10786 - protein, 297 aa, Chlorella protothecoides
  MOD_RES (130)..(133): Any amino acid
  MOD_RES (268)..(270): Any amino acid
  MOD_RES (289)..(292): Any amino acid
MHICKLVLILHQAAAPQSPDSLLYTTRSQAWPACGDAGPPGPSRVRADHAQAHAQPLPHQLLGGGGRHCARGLGRAAREAVCQLLAGSPGVRQPGTGLPQRCMPTMPPVHLVPSPPTHTHTGTHCRCRHXXXXQGSEEYAGMLGSNALREAGLKAAGALPETQVLEVQHQVQHRGLRESSSADLATLAGLITIVKWLAPEFDYGWLIEEARKNVPKGACGWQASVHGACTLAESGAQRMGGGIFNRAFYGCWPHSPPHPSQPPTPPLXXXIRNQLCPSDACTVKDRLHXXXXGVKAQ

SEQ ID NO: 10787 - protein, 213 aa, Chlorella protothecoides
MSHLDHQGLATVSRVCKSWHEAATADALWQALCDRQSWAVDASHGEAEAGASPARHTFRSKYSSSCYDCLQPCDHCTLGFATLVLSPAPPSITSPAQTVLGLCRSLRGPQPLPAPRHQDTCAVPVPHEASGPGSAATRRGLQSHQPSLPAHAPLPKGRCRGGCMGEEEDEHKISAEVWLSVPAWTAPSCCVAGTGDDNLEETTTTPPPETHQP

SEQ ID NO: 10788 - protein, 1086 aa, Chlorella protothecoides
  MOD_RES (677)..(704): Any amino acid
  MOD_RES (803)..(805): Any amino acid
  MOD_RES (917)..(920): Any amino acid
  MOD_RES (1015)..(1018): Any amino acid
MTLLRCRAHEHHSQPQVCWKVFKAILHPFIMGRGYGRGRGKVRLGCWVSLTRLKRVLRRDFKDGKTDEWQEKRQRRDDGWQEQPTHNDAFNEYYKGQNICPPEVTLVPVEGTGLSQAGLYAWRGTLRAARGHQACMPGHSSCPTWSPSNARGAVTTRPHIHFVALSQPTLPTGITSAPSCARLSCHPPLAGVGRVPGRPAPPAAHHLPHQRLWQVCAQPARPAAGRLPGPLLRRGGCRPRERGPAAAGGAGLVPGRPGLELLLLPRRASQAARPGGPARVHEARDGGGRHLAPGGGVHGPAPLPGRGAGAPRAGHVRGAGVKDLPAAGGAALRRRGGGARGRRGGQRRRRQALQPAHPPDHRAVQWARDLVGAPGGEAAGDVKGPGAPEEAVDARNPLPPPPQAPRVLFDRILADVPCSGDGTIRKAPDIWKRWTPGNGNGLHLLQLRIALRGAELLAVGGRLVYSTCTFNPVEDEAVVAELLRRTRGALRLLDVSGEVPALRRLPGLAAWRVHDGQRWHDAWAGDGERGRKLLPSMFPGVGEGGLHLERCMRFLPHHQDTGGFFVAVLEKVAPLEGRLEYPSAPPRDRAGAALAREAGKGEGAGAGEAGGAVVADAVEEAGIEQGEQPAAGVEAAEAVGAAPPAALHEADGAGEEAGAAAAAGTPGGGSATREPGXXXXXXXXXXXXXXXXXXXXXXXXXXXXGAGGHPRSAERGGGGAGCGGRRRGGPGALAGLGRGARRGRAQPPRRALARHRPHRALHRPGAAGAHARLLWHAPRVPRALLPGGAFGGPPTQAPELRVXXXLPRALLPGGALGGPTTQAPELRVGRGQGAAAHGRERGDEDHRRRGQGRKGGCQAWLVGGVGTAGRSACPASLRGGCRAPAPGARHAQAVRVPEGPWGGRAVPRSLPRGHHTXXXXALRPFTVGAGRRHQAHTMLRLCESLRGPGVGGLYYAACPAATTHKGARSSLRWQAPRGSGTLRHCAGTMSVARQIPLSTPTPPPRVPRARRRTAXXXXRAGVGPCDTAPTQCLWPARSPPRRPPPHLVCLVRVAGRPGELHLPRGAGGPAQPDAVPDAADHRAAPE

SEQ ID NO: 10789 - protein, 467 aa, Chlorella protothecoides
  MOD_RES (165)..(168): Any amino acid
MSVQPLDPSSACQTHHMREIMLLMIGWLWPHGDSMALLKQAPHTCLDTTPVRQATSSSLTLGHDVWLGNPCLSSGQIISGPPSNAYPSKRASISPKTEAPGEVFNEKRGERREWFREGELKRSEVVSFSLACDIPGSLSCLPIFFLHIKGYCSSVATLVRRREDXXXXGSLSCLPILFLQIKGYCSSMATLVRRREDAVQNAGCCASKASVTCRRSQTDCTNRTAQGLAEQVPGSTPLSCISRCGEGRLIGENLMEVEPSSTHRRVVNKEFQPKMVSARAFVLVVAISLWAGVHADEVDSLLSTKKEWVDEALSSWEKVLAPVPKVETPPAKVPKYVWPVPVPKEEPEVPSKKDLESELFAKFDLKPATPSPKPKPEVKLPAVTLPPKPEVEVKSVVLPPVPEIKLPAVTLPPIPEIKLPAVTLPPVPEITLPAVTLPPVPEFTLPAITLPPLPEFTLPTFTPSPKA

SEQ ID NO: 10790 - protein, 167 aa, Chlorella protothecoides
MATQSLPLPSLPAVKDAMYAYGKHLGLAFQIVDDILDYTQNAETLGKPQGQDLASGNLTAPAYYALQAAADLAPGATLPGSEHQQGAEPPHHLTIRGGGVHSASAGAGHRRGRHCKVGGCGKAAIAGAGKGTGSSRARSPELLAALGLQAVPGGAGGVCAAAPILRG

SEQ ID NO: 10791 - protein, 146 aa, Chlorella protothecoides
MASNLLQPQAHAVFVPFVSARGACHGLRPARRTLPPQAGTQPRPRSACVDAAAQAAPGHATHTSSTAASSFPAMAPMPATVSHEVLRAPVASDMETCRQNLLDVVGQRHPMLLAAANQIFSAGGKRLRPLIVLLVARATLPITGMP

SEQ ID NO: 10792 - protein, 126 aa, Chlorella protothecoides
MQISLPISLSLPSHRAGVDLTVSSLIKDKELLSAIVDFHVAPNYALRPAQLTNNLQIPTLATDQLITVFVPLGSPVAFGGAQGYAIASTLETLTLCDVVAYVLDSVLISSAADAILVSQGKVAASG

SEQ ID NO: 10793 - protein, 157 aa, Chlorella protothecoides
MAALVHTRAANMKGLTVGLFDVPFEEQHWHRAVIGPRRWRLLWCDGGGVEGPLSHFPAPQDAAEKELADARAAAQKEIAAAKAELNKERDARLGAEKKKIDAALEKDLAALAAEKEKTFSNLDSQVRWRGALQEGEGHALEGGRGPPRARAWQLSRP

SEQ ID NO: 10794 - protein, 140 aa, Chlorella protothecoides
MMLTLQHVRPFQAVGTPRAGRTAGRVATVVRAAKSGNSNQQRPVSSAPRSLGKLATTLLPALSPLLISLPAHAEPGKIFDFNATMPVMAAQFLLLMVALDKFWFGPVGRHLDARDKELRDKLASVKDNSAEVSKLQVVLG

SEQ ID NO: 10795 - protein, 102 aa, Chlorella protothecoides
  MOD_RES (89)..(92): Any amino acid
MEYFQVLPTKEFGAAKIMSSQPQFLRDTATGLSTTRFRRVGVLVAAWQCFTGMPGREGGCGLEKSKLFRLSQPTPPCCSRHGPSPRYFXXXXACLGGKAAAV

SEQ ID NO: 10796 - protein, 210 aa, Chlorella protothecoides
  MOD_RES (198)..(201): Any amino acid
MRGPRPHRPGVPVLARRGTLLAGGLVCTAVVLLVLRLSVRPAHGRVVQPPHPSESVAGSARDPPPCCPLQPLGLDLSSSGEGLERAYRSQRLGNVPMQRFCRLGVQAPQNTTEHTLAVLIPYRDRQEHLQKLMPALRTHLDEQKLTYGIFIVEQVQRGDDTRVCRVTCWCWAPRPTMSNPALMSVLRILANLDASSCXXXXPLGRTKTDV

SEQ ID NO: 10797 - protein, 387 aa, Chlorella protothecoides
MWPSVEQCYIDSQELRVATGAVHNITPPPPSASSKEYGVDAEGVLEGDPLTDGENVEWDAEASRPQLVTRMAWGSCREAALLWMTLADSLPLPGAADPGLQAAGVALLLDVGARLVQQLTLLKHNGAIEKCSQALSAVCTRFGGRLWAFGVLHAGLEVTGPHTHTMQAPGPPLRGWGRECGLVLLTSSSPSRHPQCPPPHGLSRVLASGVKELDVAPLAWLDAFLAFLSRPGQGRSDIVRRSAGLPAGILAVLAAGSSGTWREVLISHTLPRLIALAHPETESTADWAPRVHALNTLRMLFSASELADGTARLLPQGVGACLAGLSASRWEIRNAATLAYSALLTRVLGFRNDAVQERLYLRAGPGNRKGRWYGGSPAGRMGVMSTH

SEQ ID NO: 10798 - protein, 248 aa, Chlorella protothecoides
MNFGWAIADWAADLAAAGVPMPPRVPNAADLRLYAITDPGLDERAARSLVDAVRLAIDGGATLVQVRDKDSPARAFAAAAAEALEHARARGVPLVINDRLDVALAIGADGVHLGQDDLPAAAARRLLGPDRILGVSVKTPEQAARAAADGADYVGCGGFAPTNTKAGNLTVGPEGVAAVVRARVLPVVAIGGIGEGNASAALATGADGVAVISAIFGAPDVVRATKRLRAVVDAALTARGLSEGGEEA

SEQ ID NO: 10799 - protein, 223 aa, Chlorella protothecoides
MLARQVEVVMADVGAAAVKTGMLPDAASVVALAAALRACPAPAPALVLDPVLLSTTGDSLAQPGVEAMLREHLFPLATLITPNLPEAAALLGDGRAIVDLEGMRAAARELHALGPSWVLVKGGHLPAEARREAAGRGAAAASSGPEQPSRQQTVTDVLFDGRTMLELSEPLVVSDNVHGTGCCLATAIACELARGHSVLAAVRRAKRYLARAACPLATARSAP

SEQ ID NO: 10800 - protein, 183 aa, Chlorella protothecoides
MRQVAKEAHATFAVLLDILELQSAREGTVVGAGHKGRYAPLAAIAPRLGYHRILALRPPLVLESLAQLGNNRLCTSVCGLLRALWTAASHDPEASWVPGTVQDTSTALIDGPDALRANLAAHVLPLLFGIHPGACAALLAALDSQGAGAPATPDLQSARMAVLAAGHASGLVTWEKAASGGPP

SEQ ID NO: 10801 - protein, 130 aa, Chlorella protothecoides
MLLLQGSAYDYFIFQDVDTIPRPGSGIRYAFPSGPVPLHLTPFGIHPKANFEDFFGGILSISQQQISRVDGFGTDFWGWGREDDNLKLRLQNHGLWPPQYPDVPRGTQHGPYFIHQRHKQAAEVSGDCHR

SEQ ID NO: 10802 - protein, 422 aa, Chlorella protothecoides
MNRKAAKRAEKEKRRAEREREREAKSKAKAAKKAAKQTIKDAKKAAEEAEAARLVRGWCGLGVGSWGTGSVHGEQRMQAARVVPAACVPLPPPSHQGGQVPNYTPIAQAEEKRWKSEGYYTRDVEATDRYNPQPPLPLEDRPEASNSPSREARRGGAEVGNRGALDAGGKDAGVRARDDSPSRAPKRGRSRGLADAPARERRAGASPAARRHPSASPPRGRARTEAADVEDARGPRRLPARQDSPPRRRDSVADSPPRRRGAREASPQPGSRSRAPAASKARRSASPTPPARGRRSLSPRSPGRRRGSPSPPRRRQEAGRALASKGREHSPSPGPEPLQLLVLRQEQQQLERLQQPVQWVEQQLVQQQLGEVELQQPASPAAAGVAKPQPTEAALTLLAMHACCCFPSSQRPSIWGAACPGQ

SEQ ID NO: 10803 - protein, 111 aa, Chlorella protothecoides
MAVLAAGHASRLVTWEGAAAGVTPEQLHAHVFAALQTRNGEQRLAAASLVCTHPKALAPFTPRELGLVQLWAELEMVCDSTPHREKVLRLLSKAGARVRGLAAAARQRGGA

SEQ ID NO: 10804 - protein, 77 aa, Chlorella protothecoides
MDGWQDQAKKPLLNFLAVTSKGGRFIKSVDTAGKCKTADYLVEQLEAVIKEIGVENVQVVITDNAANCKRAGEIIHE

SEQ ID NO: 10805 - protein, 213 aa, Chlorella protothecoides
NLPLPKLRNFGGKLGDSLAALGCATAGDVLALAPEVLERRFGPERAAFISAAVGQWGVWNGACGRLAFGQGRLWETPSRLLGCTLHARSPWNPSCPCLAQVQGISMEPVKAREVTKSMLAAKTFYNTRGGFGCLGGILPAEQLPGPAPVTGVLEGGLMPPACLWRRVQQGLVRHLHSDGWSWWTSSPGTLALPNLPTSAAANLLPHPLPQIWM

SEQ ID NO: 10806 - protein, 117 aa, Chlorella protothecoides
ATSSSAGAAAGPQLTGSTLEGWKAFKRVFQEGVELFNAKPAKGVAFMQEQGLVGPDPDDVAQFLAKTLSLSKAQVGDYLGERDPFNLKVMHAYVDALDFAGLEFDMAIRWEWSAGMS

SEQ ID NO: 10807 - protein, 128 aa, Chlorella protothecoides
MSPIPSPLKPRPPTKTTRRKFLDGFRLPGEAQKIDRLMEKFAERYVLCNPDSFRSADVAYVLAYSVIMLNTDAHNPGVKVKMTRADFLRNNRGINDGGDLPEAFMSGLYDAIVTREIRLKDEVGAGTG

SEQ ID NO: 10808 - protein, 60 aa, Chlorella protothecoides
MLGIAFAPEQSAEQLGVRGVLVLDARKGSPADEAGIKGTSRDEYGRWVGVGVGVGEARAG

SEQ ID NO: 10809 - protein, 125 aa, Chlorella protothecoides
MRARARDDEDGDEDADEAGTGQRRRALAGPLPASYPSPPRAPDGPFRLSGVYLGCMENKAGFHPIRDPASKWYVSEEQLPNSAVPFGVKYLAGWGYVLSRDLFTRIVHKTNLWAADPESAPAWYT

SEQ ID NO: 10810 - protein, 203 aa, Chlorella protothecoides
MAEAALSKSLDEIIAEQRQKETTKREKQTSKRGSKAQQAPATRKGSRGGQNSSRPPARGAPGRVITVTINRSSGVVKRVGWGGGHQGLACHVAWGWQPGGYMKCPYQTRGFIFDAQAGDGHRGRPVSLEDPEPRNTEARIQALEGAGKWGHDMFARAEGKGAAGPRSASALGTKLGGLPGHAMHIPLLEPALYGRTLLPTRQA

SEQ ID NO: 10811 - protein, 152 aa, Chlorella protothecoides
MPSSPPLHVAQRTLLCSTSGTRARPSTLVRSNKKTDIAKQGLNGIENEVVKNNLMGRSRFQNKKDWVDASGRKGKGYGVYRFENKYGANVDGYSPIYTPDLWSESGDSYKLGRNGLIAWAGFFVIFLGVAGLGPSQGAGQHGMPGMAFVEGS

SEQ ID NO: 10812 - protein, 533 aa, Chlorella protothecoides
  MOD_RES (427)..(438): Any amino acid
  MOD_RES (469)..(478): Any amino acid
MHGWKGWDVKLFPFPWCPPRRIVPAPIISIPKPVIDREIHEPRHSCFPFSSHLTFPPLCGNTQRESMALTALVHTGSIQPDSPDGAALAEMAAHGDAGYFLDRVVSPIFAFLAVHVDRMGTDGVEIAHRIAYDDVNESLCRRDIVAQSVGQCGVAEACTFLLWSGCPAQAHLHLVMPSPLTSSLHPPTPTLLPLTPSGPAAPGRQGWAGREHRHVPRPLRCPAGHRQGPDQRGGAAHRQAGGGAAGHGGHGGRGLERGGRARLSREVGVGASHAAIPRQLDAQGLILPACAEHSTASGPSSSWSSTSWPSSPGAATTRARHARHAAAHALPQLRDLLPGHEPRPAELPGAGRRLLDAARLSAIGKCPSALADDMAPAPPPPRSSFPAPSWGPPRGGRGHLWACRPGRAPVAGHPVRHGPAHGRPGDXXXXXXXXXXXXWWVFGKYHIWWWAAAGYGGLVVAHALLSTRXXXXXXXXXXAVSLTHSAAALARRARARSWCFGWGWACVAWGFELLGASSARPPPVDHVAPYDMR

SEQ ID NO: 10813 - protein, 181 aa, Chlorella protothecoides
MLWAHCERGVTCGQIRACGHISPEQRHGSLVGVRLRDAVPTLHLDMHDFCLTLPYALLVAVRELIRWLASPSTAHIGGSHDRREHTPYAGQGLGSAAALGFLGYTSLKAYKQGRRAHVTAVLSLGQSGACVLAAALLSRTLTASGLGSLAGALSILSDGGMAAFYVWNLTLFHPKLPLPKE

SEQ ID NO: 10814 - protein, 285 aa, Chlorella protothecoides
  MOD_RES (119)..(133): Any amino acid
MGRPTFSSSLLPGGPPEEGSHSVHRTSEVGVLTPPLRHYPAGAAVSTVKKHDAGSNKARAGNPNAVKLDAETEDFHHEQVSSELKKQIQQARLAKKLSQAQESTEWHSMWCAPNLTDTXXXXXXXXXXXXXXXPPPPPPHTLQLAQMINEKPQVINEYEAGKAIPNPQVGGHRWLCMGLCTWLESGPSCCRTAPVLVVSLHAGSVSCLDTAIPTASTSNHPSLPSSTDFRKAVACPRGDPAEKSWQEVDDQIDAMQCFAIHDVGACSGGPWHRKIQASRMLQFNL

SEQ ID NO: 10815 - protein, 183 aa, Chlorella protothecoides
MSNTSLEMATTTTQFQITYSGKSLQVTLPHQASVLDLGRHAPAGQCRAPMSLGVLTEISHPSEIVHRCDIGGHISSAGEQRCSSWRRHVSQGNTTLNPPDEPRIAGFDHELRREAARRAGVAHPRAPPAGPYTFKNFRAWQTPGLTPSPAEALAFLHRCRWEGHSAVCTRIGGGAKLATRAST

SEQ ID NO: 10816 - protein, 231 aa, Chlorella protothecoides
MGKVEWGGGEGGGGTGAGLPGAPWPQRSDDKGSAPNRICRAPATPASCAVYEGLLSANKVPDLYSSALSPEQEKRRVVLKKANLDNSGIRTNFLKAGGRRGDPPQGFPLCPLARQCWSARRDWAGGELHEPPHLAPPNGACRRGVCECRDPPCARSPPSASPPLPHACSRGQVARRVARYLGQFEVAGASGAFTRGTQWLVWRFESDATLADAMAGLLDGGMEVWRERAGG

SEQ ID NO: 10817 - protein, 209 aa, Chlorella protothecoides
MAGTFTVHLGWEEVPTETAGCSGVAINIFDPCKERPMRPNSARCAAPEQLVLPKAVPRVPAPFIAVLLAPFLWRLGRPDLFDSYAAGIILLQVGKGLEKNRGHTTGREADHGEWHSVFMLAWDACGTAVKPSTPPWPPSLPTTHVQMSIPQLRSAGSLKAFNKELAAADYDLDLWRRRSMRVQACDFEVLDANNQAGERTTGMHASVCS

SEQ ID NO: 10818 - protein, 265 aa, Chlorella protothecoides
MPPEGKVGVSPACILGVNINAGQEISLRLRTDDLRGFRRYDRICETLMHELAHMVHSEHDNAFKTLNSERHASTSGEWTSEAASLDFAKSSLPSGAHPVKGERLGGTSERSRLHQFTGSGDAARNAIAAVTSSAGAREDGSGARTPDPNGVGAAARQFRKNDAVLYTQRDGSQVPAKVRQARAGSEHALMLTGERTALNYQLESVRQKGIAWNRPDLRSTPPLTLLQPTRKPQPVRSENDHHEYTFDMFMYQDGFSRLFMIDMGL

SEQ ID NO: 10819 - protein, 122 aa, Chlorella protothecoides
MDRFARAVHRLHAAIFQGYRDWCSHVGLPLRIPELKLAKIHRPHTIQARWKILHRVTEWEYGLEELAMYFLVYSEAANLRHTPECLWFVYWICRNSFHRWNGASCPNPMHPSSPIFACEWRL

SEQ ID NO: 10820 - protein, 91 aa, Chlorella protothecoides
MPDQKRHLALTKAVMRKLLKGAWRPDAGTATALAWSFMALCGCPEHVLHPVSDFHLSPTAPALQRLHSLGIVHRDVKPDNVLVTSKGDVRR

SEQ ID NO: 10821 - protein, 840 aa, Chlorella protothecoides
  MOD_RES (65)..(78): Any amino acid
  MOD_RES (435)..(437): Any amino acid
  MOD_RES (554)..(557): Any amino acid
MPQSPALVAAWSEAGSVGVWDLGAPLAEARAEPSPDASRSERLARIAPRSVHGTGAEGYALDWSXXXXXXXXXXXXXXGLVAPGGGAPGRGRPPRCHPRLGARAGGEVGGGRGVPRAPGTGGGPAVVAHRGHRVCQRGGGPDAAYLGHAGEGTFGRGGPLRVGNGGMGGALGQGGCGLVPGGNPSTPPSHPLLHPQTLHTDEADADGGGARGGGQRRRVECQHGLHAGLGRRRRPAARLGPARLCLGAVRRVPEVPQVRGKGAGTCSRGVESGVCRRCRAALSACRPSLFQASPGPPLPPRNLTLRPPVQRAHHIPGVVAARVLHAALHRRGRPDRGVGSGPGAGPGGGGGAGTGDERRGARRAATAAALRACRAARREGGALARPDPGPHGHHGRRWLQPVQARQCVRHWQAAPNAAGTFAAAPPQCCVEPSAXXXHWRAPPNAAGTFAAAPPQCRVEPNQNPGNSVSSSRCQAAGTAAHSGGGQSVKKALDPLDSGMQGGARLVDADVVWDVAGVRGRRVCLGGVGQPLALYSPQTRKGHNQCIPVGGPSVXXXXLGSEVGGSAWLGWGSLLRYTPRKQDRATISVFLLEVQACGHASQPGRAIPIDCCPPEEGLAVEKAMRRSSRLLALLASACSERALPPARAPKKRSSDFTSASSARGMMCLGGADREHGVAMGWPHNIPWRLELQGSPHCRVLNGINKPPPFTSQLSTWAYAPVGRPVGGKDAQGAAGIPGRPILLLQCLQPQVAHILKGFGDNVSHCWRGEGRGVAAPAHPASRHVSDAVAFAKSKLAPNPLRNPHARHPIVPPAGDSAGRQAGGSQPPPPPSRRPCRPGTRI

SEQ ID NO: 10822 - protein, 674 aa, Chlorella protothecoides
  MOD_RES (140)..(143): Any amino acid
  MOD_RES (330)..(333): Any amino acid
  MOD_RES (355)..(358): Any amino acid
MAADPKRYLTTRGRRGGGSITGLGSLHHNAGQLGHTRQPLQCLCWLERGAHHNLTGSGWPTHPGSSPPVRKAAGGGTTCSRATRRLCRRGKVRASGPLQLITEPQSLADMHGHMQGGGSGTELPCRNAGGTRHLVTDWDXXXXLRHRAPVQESWMHQASRDRLEPGGGLCASPHTPWSSSDPHSPRAPGGKVRHPSRSDQDAWTLFPQLSSGEGLHGDGGEELDSPKRRSRTGESDAPGHQALAAGQHAQGVAGHIQQTDAVQQATGHISLAANQFLCFEPVVHFPLIDGYPCSKGCGWLRDSFGSTCAMQITMSSKTSDTGSQPLDPPXXXXCCMHEGARGRQSSPKSIGGDHXXXXMQITMSSKTSDTGSQPLDTPMAQPSHPGQAPLCIPAAQRKCEQSALHSPGGSQLASAESRSWRMCAACMKYLGHEGAHGQLTTRQVSGDAIHEQILPPLPAHHIYVRELVGGNLLQHPSEETIHPLHHLRGIDMKIQRAAMDVHLGHTRSRSPLSNMSLALVPQHGYVLGTLVGGVLVQNVWMAIQVGMARRKYKVCYPTMYAKEDTPDAKTFNCVQVCAGLGNSRLRVGLCSREGSWFLPLHSRPPGALTSPMLHSLISQRAHQNTLEMISTFNTLLIVAGARVSGGSNLIPRSRGNVLCRSAVHAVAPWPVVHL

SEQ ID NO: 10823 - protein, 111 aa, Chlorella protothecoides
MALESPRFTLPGLRWAGVHASWLQTDGQHMQDCGRLQRPVAHKLVTPSHLPQALTQRDLRVAQGLRERLRGPAPHWAAELDAMLAAGRKADIEALPGALAPTLLEALRCAM

SEQ ID NO: 10824 - protein, 240 aa, Chlorella protothecoides
MDWESMAAELKKERSAGVLSAAPDAGRLLPDFPELAAAAAGPEPMELEEALPVTLAAGGGATARALIVVDTNVLISHPATLERLLHALAAAADPPSAARESRSLEVQALVPWIVLNELDRLKSSPDGGKAAAAAHALQRLRLLLMTRDAGIRGQTAAEHAAVSDEEGWEEDVVPEIGRVLVDGAREGAGGQGVAGAAEVAAQHARKRYTSRQLALAVTAKHCMPSHMPTGDPSAFSIPTS

SEQ ID NO: 10825 - protein, 166 aa, Chlorella protothecoides
MRTKKSSKKGKKKSASAKVDGGGGPSCMPWCAACPASVHRPAPRPTQASAGPAVPTKPEVWMPGVPGAEPDEEGLDYDPTAYTCLTTLSLGWPCLSFDMLPDALGDQRTAFPHTLSFVAGSQAPSARLNSLSVCCVTNLTALRHGKVRCAGPRGRPAGRLAHPWAA

SEQ ID NO: 10826 - protein, 429 aa, Chlorella protothecoides
QRSAAREVGAPAGDPGAGRDPADDLGERGRFEHCAAKPLAADAVLVDEASMLSLPLAAALMQALPPTCQLVLVGDVDQLPSIGPGTVLNCILTSGLVPVTDLRQVFRQAATSAIVGAALAVQAGVAPRLPALARPGDVIAAAGGSAALLLPVPRAGDLVAAARDVVAALTRRGADRSEPAWASGDVQVISPMRAGPVGTGALNPVLQGLLNPGGPDAVGGRSGAAQSHGLRPGDRVMQLVNDYDREVFNGDQGKVRGIWLLCWGREGDARGFVTKRACPRTLAADPCAGARHHGPLRRLTHAMPSTKVVSWDPAGKVVKVQFPHLVEAAAAERAEAPASFAARAGANPAPDGVCSYQGSEAGALGLAYAITVHKAQGGEAPCVVLVLAPGHGRMLDRRLVYTGAIGGWGGLGSGCGSMVEGCWASVERA

SEQ ID NO: 10827 - protein, 369 aa, Chlorella protothecoides
  MOD_RES (215)..(218): Any amino acid
MPGLPHGLGGCVLQEGFPGVWDHGRAQVEGQAWRRLPAQFPRQSGPLHLCRRQRQFHTVRPYRQQRHDCPAVGSRWPHGTHQAIDLSIMPFISAPISLTTCLSYDTTRDFDNFSPLEYYEQYVGPRPTGYFTAGDPGSEATGGAAAALAAAAYLLKSDMPEWYSVSGRVGKREEGPRRHPFTCVVAHHVRLDRMPWSIPMLCARSHTLSSPPPPXXXXRQSTIAKATALYEFASTNPKSFKTSSDPVIKNMKERGALDRIGFTCVISDEQCICVTVFDPVNLLKPSHPPSFLCTQLMQALYATDGDYHDELTWAAAWLYKATGKKKFLSEAEKWWAQSTFHNTLEVCWEDLGGVGCGTAGFFEGDQVEG

SEQ ID NO: 10828 - protein, 409 aa, Chlorella protothecoides
  MOD_RES (19)..(22): Any amino acid
  MOD_RES (82)..(85): Any amino acid
  MOD_RES (123)..(125): Any amino acid
  MOD_RES (184)..(187): Any amino acid
  MOD_RES (231)..(234): Any amino acid
  MOD_RES (252)..(255): Any amino acid
  MOD_RES (275)..(277): Any amino acid
  MOD_RES (297)..(300): Any amino acid
MAEPAARRETAPTSSGSPXXXXSHEPLPTSHSSPPRPGMYGESEVRQVEFASGRVLRSRALPSQDFAEGITKLGNRCGAACXXXXVGGWWVGAGVLMCVGRWLRRPGRQVGAGAKAPAQSRGXXXGQVGEGAKAPAQSRGSLGSPSYEPPPTSHSAPPRPGMYGESEVRQVEFPSGRVLRSRAXXXXDRSAPGLWGFAVRAVAGCAHSRPPGTCPTPFPPPQPVPADVALXXXXAARHLVFARPVPADVALXXXXIGAHLDRGALLFAQWQGALXXXPAPALRAGRRPRRALPQRAXXXXPRAWVYAAEDLGAARLASTPLLDGWGITNDGTHLILGDSSPTLTWVDPGTMARLHQRSVHDAGRAVPFLNELEWVDGAILANIWGRECLVRVSPTDGRVLAWVDLRVGG

SEQ ID NO: 10829 - protein, 81 aa, Chlorella protothecoides
MAPEASRDAAWMPFGGGPRLCLGNLLSMAELKIFLALLTRRYDVEFLDHAEAWHYIPLARPLRGMPIRLRPRHLTGKAPSA

SEQ ID NO: 10830 - protein, 191 aa, Chlorella protothecoides
MEPAPGHKSQSLRAEAVQSNNEVYDKVIEVFADKKPSAWRKLIAYSKQWRGMADGILKRWEPGIVSGATWPADIQEGRQEFGGGVDGGAATPSWGAWLGARGRRDPGWPCGGRSTLDMRADAASARDAVEEAATLRKLSRRLRAVHEELEQYVSLAEAFRKQPPGEWESMVTTHRPTLTMEFFSHLELMYM

SEQ ID NO: 10831 - protein, 192 aa, Chlorella protothecoides
MMLPAFTPRAVQGYYPFISSATSAALEAWCGSADPVLAYKAVNSLALKIAIGVIAGTGGPWMQAEAFPAFQRLVTTWLEGLFAWRIDLSWTRFGKARKARAALDQMVLESIEASRSGTEFCAIRVMLDARDERGVPYSTLELLDNVMTLLFAGHDTSATAMLCLLEEMRKHPEGVQALRAEQAGWSRGEAPV

SEQ ID NO: 10832 - protein, 90 aa, Chlorella protothecoides
MPLAEGWVKESMRRTPVVPIVPRTAIQGFEVGGFWVRPGQPVVAGLRSTMQLDPRWAAVESCSKGETVWEAVTGMGWAELRVGLECAVRG

SEQ ID NO: 10833 - protein, 353 aa, Chlorella protothecoides
  MOD_RES (179)..(182): Any amino acid
  MOD_RES (235)..(238): Any amino acid
MLPTADSGKARALVDCFADLMDLRRDRSRLHAYFRAAKESVLSRVCGGERHSAGHTREGGLLLKAEEAECKEVEEEGCEEAEEAECKETEEEEGGAAACQAADIRVQVAHQSFHGAGAHAQGCAPGCATVRAEELAPASLHLIKVEHIALSTSTITKGEEAEPSTPHVVKREQPKSPTXXXXITKGEEAKPSTPHTIKREQPKSPTFHLVKGETPAPSSPMAVDPGGSQSATDWXXXXETPAPSSPMAAEPGGSQSATDWEDGSPGGHTPCSKMSTKPPACVDLANIDVGEQARILADILAQRAGTGKRKAAAAASLVQGSLKRLWGGGKGVNLEVSPAATPCMRVGADLQAT

SEQ ID NO: 10834 - protein, 477 aa, Chlorella protothecoides
  MOD_RES (220)..(223): Any amino acid
MLLVYTNPWTAVAAFTLAAMARSNGEPPGVGARGGGGAWGPDLCLCHSDCSSAPVPGSHPDSLATCHGSACASPVLHPLEHAAGILGCWFLMHALLSSTFRTGRVSWTGVLRCWIGCLTICAPYALMQGMTRRSWGWGWLAVARPAGMEPLLDAALQPPPWCQSTLPSLYGYVQRQYWDVGFLRFYSKLDRVRHRREAGGGLSLRGSETPPQCLNPSVLXXXXHRREAGGGLCLRGSETPLSASTLSCLLLPLYLSRAPVLNLPSHSLSAFSLLHLSSRMQPPPAFLPSKPYQHPPVPTPLMNTPQWPKVLQSIPVAALSFAGCWTWACADWACALSLGMACRAPARPLSPLARTGSGAGPLRRPARWAPGPPPSRRGGVGAAFHTLGAGVAQPCAWPPEAPALAPYIYHWALMTAVAATAMHVNVATRFLSSCPPLYWYAAAWIKQGRRPALVLWGWALAFTVLGTLLLPNFYPWT

SEQ ID NO: 10835 - protein, 183 aa, Chlorella protothecoides
MQHPLSCKHIGVLPHHTGSAHTTIFDDVSAWDSVFFVRVAKCGYETDMINAFFPLLPLVMRLGSAFLCEWWEGDGVCRGVVSVWGFVVGSCESKAQGFHEGAMSPGYSPSCYLQLISTINVVPLHGLMPLESLLTLAGLLINIAAFSAAALALWRCVHAQRAGRGKETKSSESIAMCGGCAHR

SEQ ID NO: 10836 - protein, 262 aa, Chlorella protothecoides
MLSWRTLHPGWDIRFYDDQVGNRARRSTPSHPSPQNPPQDCLDFVRREFPEYLAAYRSLERDVQRSDFFRYMVVLRLGGVYADIDTEARQPLDGLLASSDTLVVGWESDFPDAQATVDAWYVRPRQVLQWVFAAAPGHPALRAACDRIAAGVATRHSLSPAIDTLERTGPGLFTDVVLEAAAGSPWAGAARDPWTVRILPRVAFGAPKAPAHGLTPLDPGVVVLHHFMGSWRSRRRWPWQVSAGEVARALARRFLARPGDAE

SEQ ID NO: 10837 - protein, 956 aa, Chlorella protothecoides
  MOD_RES (284)..(287): Any amino acid
  MOD_RES (668)..(671): Any amino acid
  MOD_RES (805)..(808): Any amino acid
  MOD_RES (847)..(850): Any amino acid
MLAGGGVRNKRGPGLGGASVQQTPTKGSGRLVRGRGSRGRLVRGRGSRCVNGPPTTLPCHRHPFLSSVPRWSPLQITPPAPTTTPRAAEVRKLEAADRGAEQLYPTSLTFDPPYVALAPRGGLGESQSGADVAAALAAHGSWQPSVQPLRGPTLAEVLVGSLGGVGQRRGTLVDVGAGYGVVALAAAARGHAVHAFEAGPRSAAALRASLAYNGFGDRVALHETEVLGAVVQSARLCLDVPAAGGEAGGATGAPPLGEAAVELARGYGPPEAYRAREEPGECRXXXXCYRFVAAGRGSGAAGARVGETCAELEGTAGGHCGGPAGQPLVQLGSLIRTCNPLPPCHFPHPPKKHAANGWEAHILEGFAPLLAAAPAPVIALEWNPAALRRAGTPDPVAAILRPLHDAGYTEASHSGYVCDERWYAATYGVRRRGGVTPEELAALRQPTWCRLHVEDWGALLERASPRSPETLLFVNREAGAARRRMGGGAGDAAARAGHAEATGGDEGANDAEPGALARAALGAAAANAGGAEAVAAAGHGSRAAVESVGGDTAANADAAAATGTAHDAQATMETADGAKAAASPSPAGQVRSATGATNSLGGAAELENMDAAVHATAAAVADLADAQVALHSGGDATRPPYVPSAHTKCPNHGPLVSLQTCRARLLPXXXXAPSAHTKCPNHGPLVSLQTCRARLLPPSNPSAESANWQGPDRCITAGHHPHVCRRATHRLLEDQSVPCSSLGHPCIPHSQPACFHLAAVHIIPFSNRLYTHRGAGLTSMRSQGKVKDGRRAGRIATLQRMGGSXXXXNVRQAQGGEIRDAAKNGRCTRAGEASLEVPRWVGRGDSXXXXRVHELARLLWKSHAGWAAATVFNTSRISVVHNEGPRGVVVGPLCAELGAHEPGEGFAQCAGPGGKAEVHLHTQQLPVGLRLPHAHQHRIVTLRACKGMLSMCEIQT

SEQ ID NO: 10838 - protein, 201 aa, Chlorella protothecoides
  MOD_RES (129)..(132): Any amino acid
  MOD_RES (155)..(158): Any amino acid
MSIPSSSLLKRNTPTLYPHQRRTILVLCLTALLAFTTPMTKAQEQRWRNCSDAPTPLTVVEALVEPSPVQAGKEAAFMIKYESGMEVSAGILDVTVKYLGIHVANASPGVHASPKCSTHVHTCTCHSEXXXXSGAQFYYVWRSRSAVYRANARPXXXXDCPLPAGSGSFVLKEKMPAIAPPCARQAETALQTMTNFLVSRD

SEQ ID NO: 10839 - protein, 231 aa, Chlorella protothecoides
MATFPGLKLRHAYPCALFLSPAAPSPLRVLQAWEDGDHVLVGTKCNQLLRLDTLTGRSRAIPLPPAPPRARETFDHEWGHCGIHSIALSPARRLVATGGDNPADAVVLDRATWRPVATLVGHLDWVFGLAWLSDAHLVTASRDASVGLWTLPEEAVLGDGAGQDEADAAADREEEARAGGDYGRHGDFRKSFGGKVRGVEYDAATRTLATLSLEGAVRLHDPGDNLRLIRR

SEQ ID NO: 10840 - protein, 385 aa, Chlorella protothecoides
MARTIGRPRLSSPAPGRKAHRLNRTPCPSLRQVPFTLHVVHIDERAAHSENVEESGPGPSAHAAAVGGYCTDAGVAFHAVPLHAVLLDGGSHSGTEPNTAAGAGRLRALLDSVADATARDDTLRALRTRLLLRTARALGARSLALGCSSTRLAAHALAEACKGRGHGVAAGARLVDARHGPALPFFFRPFRDTSTRELAACAHLLALPVPARAPQRYLAGRRGARSINLLAEDFALALLAANPSAASNVMSVLDRLQAFDWSEAGRAGGVDAQTGRAQDRGATLCPLCLNPCGPRDGPGRDGVVPEASRLPVPAAEALAQTCAACRVGVLGLGLGRNHDPDEGTAAALLGAFAALAAEQGEESLAGRPAPVPRERMRAAIADCLL

SEQ ID NO: 10841 - protein, 463 aa, Chlorella protothecoides
  MOD_RES (52)..(54): Any amino acid
  MOD_RES (163)..(166): Any amino acid
  MOD_RES (410)..(413): Any amino acid
  MOD_RES (443)..(446): Any amino acid
MSPAGISGLRMPPYVFRMLQWPNAPRPYDPRSGVIGVGSLNCLHMFGVSYAXXXRARACDWESNSLSCLHMFGVSYTSIGRAPIVHPAGSPVWGPDLRRVLMHCHHVFNVMLSSFTLNHVTLGIGLDVFSNRHSLMRSEAPYHESSHETIPPNVWQAGKLRTXXXXYHESSHETISPNVWQAGKLRTGLQSVRTTCMLGPEWILRYAARPAVAAAREVFTRRVSLYSPFVFGLGTMPAVQPTASSARAGNPCIIRSYPAACVQAASRGLGRRHPPQPDARPQRLGGSFPSRPRHTARGPTPTPSASLSPDAPLAPSSDPGFGARLASLAIALTNAFPVFVVGAAVLGLMRPASFDWFRAEYVTAGLAATMLGMGLTLTFEVRHEEWTLLYEKGWNGNDPGHHVAALAVVXXXXGSRGSTEFWGPPTSPPSPVLSQPGAGAAPXXXXPLMGHAGVLCIPCLWPS

SEQ ID NO: 10842 - protein, 184 aa, Chlorella protothecoides
MQGVDIVYGAVRVPEPQDAPFPAPPTPQYPGVYPFTRGPYASMYTGRPWTIRQYAGFSTAEESNAFYRGVSVAFDLATHRGYDSDHPRVAGDVGMAGVAIDSVEDMKVLFDGIPLDRMSVSMTMNGAILPVMAMFIVAAEEQGVAPAALMGTIQNDILKVRGLGLEHSVCSCCGRRGEELERGG

SEQ ID NO: 10843 - protein, 237 aa, Chlorella protothecoides
MHLPKPLYSSPLSPFPPFQLGSHPLFSRLSSHLDQQVLTRGRDVAGSLRERWETSDSPLVHRLQDAADSWSQESEGAAALREIRARDPDFDMVRFLARVRADVPVIIGAYLRGEADVIREHCSPEMVERLTGIMAATAQSGQVPDPTLLDTSDVELVDLKLSEEAPCVVVQFTCQQINCARDSHGNVVDGAPDDVHRVYYFWALQQEAEGYMGTDGTYQPPRWQLREMMIRGMHHLL

SEQ ID NO: 10844 - protein, 147 aa, Chlorella protothecoides
MAAVLGGTQSLHTNSFDEAIALPTDFSAGLARSTQLILAEETGICDVADPLGGSYYVERLTAEMEARAGALIDEVEGMGGMTEAIVAGLPKLKIEECAARQQAHIDAGRQVIVGVNKYAKEGDQGEALDVRKIDNTAVLRAQKARLE

SEQ ID NO: 10845 - protein, 114 aa, Chlorella protothecoides
MELRGLTPAWTVDRVVQLLGSRQPLSMACDTHPLTLALNWPGPADAARARESKASRDVGAALVRGACSAEEGERWACRGAGQPSMGCNVLRGMEADGRGTFTGLLSSKSAEHML

SEQ ID NO: 10846 - protein, 126 aa, Chlorella protothecoides
MHLQEAGATPTLELAYTLADGLEYLRCARDAGLSVDDVAPRLSFFFAIGMNFFSEVAKLRAARRLWARLVKEKFSPKDEKCLALRTHCQTSGYSLTAQEPHNNIIRTTVEVGGWVGGGMWLSDGER

SEQ ID NO: 10847 - protein, 376 aa, Chlorella protothecoides
  MOD_RES (152)..(155): Any amino acid
  MOD_RES (345)..(347): Any amino acid
MSVLASIAGWLVAFIFLSYLIPHTFVAWFYKTQNLKKKYNAQWALVTGASSGIGKAIASRLASQGLNVVMVAYPDPLLEASHEELSARFPNVTLKKVPVDLGRPGYMPAIEKAIEGIDVQVVFLNAGYVLTGFFADVTYKEIERGPLTPALXXXXNAGYVLTGFFADVKPYKEIERGASHPSLRSMERQPGVQRRECGPDNPCAPPKAGEGGGAWGAPRESHTKLREFWTCCCPWHKFSAAQSISIHPEKDVRTKHYKNSPRTLDSAATHSSPFRYPHTQLDKHLKGCFVYTSSAAAAIPNPFSVLYASTKAFISTFGASLAAEVKPSGIDVLAWSPRMLSHSTXXXRQDTPLGVLTLLTAVIPFEDAVAEDAEAQ

SEQ ID NO: 10848 - protein, 398 aa, Chlorella protothecoides
MKALAAEVTSAFARRLAPLGISSSSLSTRTVFPSLIFPLPSPTHPSIGLRVKELTGDMQLSRKEMAETQMIVTTPEKWDVITRKGGEVSVAATVRLLIIDEVHLLNDERGPVIETLVARTTRQVEATQSMIRVVGLSATLPNYQDVAAFLGVNLQTGVVVVVVVVVMVWGAQAGGRARGLVVESPEGGTRHGGGVARGLVVGSPEWGTRHGGGACGQAAGPASRLSHTPPFLISAAQHTHPSLPPDPPQTPTPSPGLFYFDASYRPVPLEMQFIGISEKNFGARTTIMDDVTYQKVADSLKRGFQAMVFVHSRKDTGKTARSLALRAQQGGDLDLFDCSGEETHALYAREVQKSRNRELAEVFEAGGLGRVDGRVTGRVRCFICDERRIGLRRLGQIT

SEQ ID NO: 10849 - protein, 114 aa, Chlorella protothecoides
MLRSDRTLVERMFGAGIIKVLCCTATLAWGVNLPAHTVIIKGTQLYNPAKGGFTDLGEQGSSEISGGAGGWEEGKRQEAHGKERAGSHLQLSVRARHAVRGRALTQPPAPPLPG

SEQ ID NO: 10850 - protein, 125 aa, Chlorella protothecoides
MLDVQQIFGRAGRPQFQDSGEVSRAGVLEWDGQHLGESGDMLSQVSILPDEKASDALLKPSRAPTLPQGIIITTHDKLGHYLGMLTQQTPIESQFVIGLVDHLNAELVLGTVREGGRMPVARVQE

SEQ ID NO: 10851 - protein, 187 aa, Chlorella protothecoides
  MOD_RES (83)..(86): Any amino acid
MPSAQLDMALLLCVYSWPTGWRRLAAAALRFPSPFPVPSLHLYSIQPPVPSTKFSPGQVTNVREAIRWLSYTYLYTRMRKNPXXXXGGDLRLPHCVSHPLSLFLHCTSTPSNPLPPPRDSPLPGHQRTRGHPLAVLHIPVHPHAQEPPALRRVVGGADGRPDPGGRAAAPGGGGRAGAAALPHGALR

SEQ ID NO: 10852 - protein, 479 aa, Chlorella protothecoides
  MOD_RES (31)..(33): Any amino acid
  MOD_RES (224)..(227): Any amino acid
MPCLLPLSAHVQERHASTHLDRGNTGLPGRXXXATVHATPCLLPLTARVQERHASTHRDRGNTGLPGRNRLAVLDLPRAAPAAKPLLLRPAGHRPGPGGPLPFLPGRTRGAGTQGGGAGGGAGPRGHPAPAAGGALRPARPPAAWHPTAAPGPAQRAQRGGRARHREWRSGVRRPARALQRGQAQPAACQGGALATEGCTHGPIGTSLNGCGPNAASCMCSNPXXXXVMGGDVHERHRQPGGHLPEWMRPRCSILHVLESHPLPRHPAHADDPHTKAGLLLQAGLEGVAMPISDYNADKRVVLDTAARLLQAMGELLSLQGGQVLDATLSCALLGQCLAEGRWHDQGKGPSALPADVLRGRTSEAATRRQENGHAPRGGRGSGKAPAAPLAVVVEAEWATRGADEGSPTACRTISISISTRHPEGEVALSTGQVGSSTGPKVRPWCRTQAILSSTKTTTAPADSHSPDFRPSSSRHTGW

SEQ ID NO: 10853 - protein, 172 aa, Chlorella protothecoides
MPVQCSKAPTPFDSRYTSAAAQAFVDGLTPLPAATPFLAASAAEEAAAEEAVFVPKHAERLQTQLGARWLAGWCQRVASSGGEVPADSASLVPDNDAVPTAAARLLLEQTSEDVLAAELYDLLGEGVFARIGGWAVGGEVWGSRDTCTWITKWRRDWPCVFSTHPGNTRSGF

SEQ ID NO: 10854 - protein, 150 aa, Chlorella protothecoides
MGGTLQCWAWQCSHADGEKKALRPLKHCNTQGVAVARGQQRGCHVSNEVIFLTAAPRILPFLLSPQVGLVIVDEVHLLGAEEGHTLEVVVSSLRRTAPTSLRFLGLATALANAGDLAAWLGVAPEVEGCGMGKVLGRCVGLTMQSARPGL

SEQ ID NO: 10855 - protein, 316 aa, Chlorella protothecoides
MHACPRGVRIGSAVQRLTHAGRVPRCGGGGPSGTSQHSRASRARAGGLHTAFRPPPHPSFCLPPSADPVGAYVHLPFCKRKCLYCDFPVIALGRAVDNAAPVPAIEAYVESLEREIAATPAQNPHPLQSVYFGGGTPSLTPPPLVERLLHALERAYGIAPGAEVSFEADPGTFDAGRLRSLQALGVNRLSVGVQAFQDDLLHRCGRSHSVAEVHAAIEAIHAAGVPAWSLDLMSGLPGLDPGAWAASLEAAVAAAPTHVSVYDLQVEAGTPFAAMYRPGQEPLPSDDAAAAMFGQASECLRGAGEGLSAWAWCERG

SEQ ID NO: 10856 - protein, 325 aa, Chlorella protothecoides
MFKKNITVSQTSLLGGKDNKSLKAAAKKSCPSLSEDQLSDLFSSKTRITLSKLNNRSLVYGSEGGDPLFFDPTGHGDRLFPTVYTLARFPDMLEKLYTYSPVSDKVLGGADLFLQGLILPTDQPIPAFLAGSVRALCVPGNPIPFAVGTMAVSRTEAQQAGMKGRGLTILHSFGDLLWQLGSGAAPNAGFTPSRIHPLPDQAGPEDEASPRAKSSVDSPSDDAEPDSPDQTEEAVPSIESLSVAEESSAPPPNGALGLDEMLEQAVLGGLQTLKAIELPIQFSDFYSKHMLAHRPPGGLWGGVKGRDYGREPGMVANSGPGEVRG

SEQ ID NO: 10857 - protein, 178 aa, Chlorella protothecoides
MTAQEIGDLLHHPAAGPQLADAAASFPALLLEAHPHPITRTVLQLVLRITPAFEWKERVHGGSLKWHIWVEDANSENIYHSGGRWRGTACHPPLLGPHLHHLPHEPEQWMLQRHTARAGPQKLEFVVPIFEPLPEQYFVRVVSDEWLGAQFLLPVPLRHLTLPQRQGGHTGEAVACIL

SEQ ID NO: 10858 - protein, 124 aa, Chlorella protothecoides
MQGYPSRFYSPRMASMNRPAYVAIQTHAQSRPAQGVGPGLKGRVTRRGKGYGDVASRERRPTEHSPGNPGHCVCVFEAPDSRHGDGHHQPRGGRRQAPRFPAHDGGGGGRHAVLSAGGWRVVEG

SEQ ID NO: 10859 - protein, 71 aa, Chlorella protothecoides
MESFGFVPDDLAKDFQKAFSSSCSVGELPGKQEHDMEITMQGDLGAKVAVWFTAHHGIPAKYIDVKGSKKA

SEQ ID NO: 10860 - protein, 86 aa, Chlorella protothecoides
MPPLQAHKLDAMEFFKKMAVDPEDLPDTIFASIGRLVWRDVGPTAIGFRLLMKVLDYNLFSTLIAVFGHLMPDFKRHMKPRVKKTE

SEQ ID NO: 10861 - protein, 163 aa, Chlorella protothecoides
MGAASYLQGRRFSRPKSLPAYLRWLEAYREGPRESPGAELPPESRRDVLLDAVMLRSRLRGEGGAVSSPMFPNLLAQPPQPQATAAAHPPPDGVWLTVLKDIAGDRRHEPALLSALEPHVAAGLAWLERDGEGAATHFGLTDPEGFLLSNDVVSDIFLALDES

SEQ ID NO: 10862 - protein, 590 aa, Chlorella protothecoides
  MOD_RES (44)..(47): Any amino acid
  MOD_RES (324)..(326): Any amino acid
  MOD_RES (425)..(428): Any amino acid
MLQTGSSRVYGRDGCILSRLGIAWQVGQLAAERWRVSQGIPAPXXXXLTIMPRPAVLPRDCLASRAASSRTRALRSGKEPCILRARFGSMYQSPDCPTRRAHWGLWHDGSIFMDNGSFLRYIEGSAGRAKAGAGPTSPHSDPATWTRIAPISFNYVVGALPLPPSVVPGLPPPNTRPPRPLVQLGVSSDLRLGDPPGKHASPICFPLTMDELDHKVHGSRVFPLIHSMPSLDLSQAGSSDPGSGASVHSPSVAGGAGGSGHGGRFKSILSCIGGPCAARRMGKGVVEDSLSCRVRGRLWVAPVFDWLGMGPLPSSWHLILPAVXXXGCRGQPVLQGGRPAVGGPCDRLARHGSPAFLLALDLACGQALNVFPVWGPWAPDPIRLVVLYIRRRESPGPCRAGWMTGGTPPFAGPPSPTRPTPLFHXXXXVLYIRRRESPWPCRAGRMTGGTPPSARPLPPTRPTPLFHTRTQAGLQMGQDAGGEEEVAPARRPADVAIRPAFYWVAGAAGQEANPSQRAAAAAASRWLKADCQDEAVVLDGFAGVPGQVFAGVFDGHGPYGRAAATHAARALPRALAASRAVRTPGPGGAG

SEQ ID NO: 10863 - protein, 766 aa, Chlorella protothecoides
MSNSSVDECWRAALSRDANQQLALWTRLIPGLLQKEGTSGSIRYCTSIAETPQGWRRGLGAKCTVWGALCRSLHSVGSAVPESWTRSTKAPHPRTGSEEALVDLVFGIADRLAVSPRLQASSTPVITTALGNPKFRRAFAAALLRSDTSKLAPRVGDVGSRWHGTTGGIAVVDVSAALAGGAVDRYRGHGVWPAGYTQGRCIYMHTAIPTSPSLAAPRPAQASLIFLQWSGLLIASLDLESGAKAIAKVVEFQGEVRSGPGVQSAMAGHTPSSPRPHPPTPSVVAPGQAGTWKQGRSCLRDRGQGAAPRPGPPPRLFGGAAVRRLRPPRRGHHAGRGRKGGTGDRGRCHAGALLQRAGPGSARGPDPGGDGGLAPRQPGLGPQRAGGEVGVPPTHPSPFHQPLPSSPNSLPGTLAPAFERALRRAPDATLGTLAALAPGFAPGSARASEAFGALLPQLVSAARAGKESTRAAALRALAALGPRLPADDAARGAAARAALALFSGAAEGKIKGVPERACLAQAAALLAPSFADLAVLATNETDGDEDLEAAGVMAEAVAAYAGEASEDGRLGLLEAVRAWAPAAGAAAFGPALLARFEAGLSERDAPRRAHLVALVTALRCTRCVPPAAGLAPALLRVVADGAAKAVLRQDGVLAALALARLASVDAGARAALQKSGLLEAGSPLLQPATAAKLPPAAAAAAAELAGLLLERQELLLGRAASQDVVPLLCDTLVLLLLHHDAATRKAASDAAGLAKDLSPALSGEGC

SEQ ID NO: 10864 - protein, 391 aa, Chlorella protothecoides
  MOD_RES (267)..(270): Any amino acid
MNPTVDELEKKEEELFRTGPLSVLTTSVKTNSQVLINCRNNRKLLGRVKAFDRHCNMILENVKEFWTEVSISAGPGRQMSDITRRCAGNSRSPSSPSGSSVRGGLWVSHFPADTLRPGTKEGQGLCWQQADQQRPLHLQDVPARRLCHHGPSQPQVDLTLPLHDAGSMGRAMQARLHKSKAAAGAGGPARTPPSQAWDSRVHPMQIECQGFWCPSAPCETHPRTPGVTPRAGGPRGRQQTRRRRPPRGSSGPAPLARGPPGPPLPGXXXXARGVRVAPPLWRRGPLGRHFLGRRTGRRVPPPLLLTATRHPAFALRPRPAPLPRPAGGRLRLALLAVVELQGVLGAQPHLHQRHAGPPRLTVRKGHLERGQATPLLAPLRGGRRACGLEGG

SEQ ID NO: 10865 - protein, 179 aa, Chlorella protothecoides
MPAEAFPYRQGVGFRLLLSCVSCEWVILAGAVATVVTLTNWILLLSRACACRYQVQRVDDGREYALKATDMSKLSGVERISLVEEIRYLASLSHPNIVRYYEAFVEEQWLCIITELVLGGDVATLIENTRNAHSFVPEDSIWSIFLQTALALEELHNCKILHRDVKPAVSLGEENANQT

SEQ ID NO: 10866 - protein, 273 aa, Chlorella protothecoides
  MOD_RES (29)..(32): Any amino acid
MLVRIRVTDHGSPTRSGHPPTTHRRRRRXXXXRGKEAQDAGAYQSPRPRRSDPLRSPTHHAQEKTQVEVTLPPRLAEARDRAMDLAEAAGVAQAEAGLQLEPMEWAASVLRFGLAESRCTCAAAVIVTPCSSTKRPPTRDCACCCGTWQTQNSRNGTVAGGAAHACQGASTAPAAAAHGRRRTQGTATPLGALPTHVKGPGVPGCSQDHGERGPFQADGGRVGVHQARRHLCCIPVLVPSGSLGSCWQTLTPTHQAVSVEQPLEEAALLGLLV

SEQ ID NO: 10867 - protein, 259 aa, Chlorella protothecoides
  MOD_RES (89)..(91): Any amino acid
MLMLYSPGPRDEYAGAGEVQRDTAEPAPAAQPAPPPGLKLMGKKKVGVVVGLGGCVLLWALPSPTPSKPVPPSLSLLPHVPSSFPIPLXXXTPSKPVPPSLTLLPRVPSSFPVPPHLLTQNDDDDLLLMGKGGKKGGKKKPVAALATPALVLPHRGSVAGAQYLIAEVPLRCITGICRQRLADVDGPGVLHGTPAALSTAVSALLRAQAEAGPSGEPETLDPATDLKLQSYGEHGEGGGSEEWRGRGGLGVRVFGSFTP

SEQ ID NO: 10868 - protein, 488 aa, Chlorella protothecoides
MQSLPAAVAHMVRLSVRYPTPPPLLQSATPDYQPLLSQPCFGAALAALQRATGGEPASEDAEARPGDTPLPGPSARFCFPILRAVLSAGEATPLHGIALDVLGLHVGASTGLSPSDTLALLYRTLEVLPVMRERVQPLLCTLCASLSPDDGDAMSAALAGLRSARAATRGAALRALRDVPAIADGGARDEPTLCALWVARSDGEERNAAAALALWDLLGASLPAGFVRAIVRDYLPSREGEVRAAAAAALAAGLLECPAAAPEAMQACLGLYGRDGAAPEAARLGLLECPAAAPEAMQACLGLYGRDGAAPEAARLGGYLVLWVVLWVGGWPACRPGGRSRAGTWSWRSAFGSGPLLLHPLSKLLASPHRLPVIPITPISPHPSGAVSGLEAIAPQLTVAELPQALDFLLSRGLLEPVPAVQGAVVLAGVALVNAHGKHAAATMLPLFEETLARKVRRLLGWGWAWGGRCVGLCTQGHAASHRPCVSM

SEQ ID NO: 10869 - protein, 293 aa, Chlorella protothecoides
MASAPHAAQQRRDSQAALMAMGAYERHRRLLASLAHYGAGARGQDPPAPAPLPSRTDADVLRDSFRFIRSDAEDAAGDPWEVRLARRYYAQLYREYAIADLSRHRESRLGLRWRTQREVVAGKGQFSCGAVSRARACTCVPWVALEPCRLARLLRAGVSTTLKPTCSSAAAQGCEERRGLASFEVPFAYCEAGRSRVALVKVRLCPKHALQLNHRKQREAEAAAGRARKRRRAGSEGEGRVARGREEERGRDASPGPSSQEGAPAPEVRGHSNPAGDDADEFAAFLEDLLPSA

SEQ ID NO: 10870 - protein, 157 aa, Chlorella protothecoides
MVAFLVATAFLEDHEKPRVPSSEPASSSHRFRRGAAFGLAGVVKGLGIGCLKNFGVLDTLKAAVQDKGGADGKEGALLAYECLSEKLGRLFEPYVVSTLPSLLSCFGDSSAAVREAASAAARTIMGQLSAQGVRLVMPALLQGVEDKAWRTKEGSIQ

SEQ ID NO: 10871 - protein, 227 aa, Chlorella protothecoides
MNDWPETYSAPLPLLFGQSVREADAATRVFQAEMRALLRGLRAADLPPYSLGSLLLSTLDPSTKGPLSEARLLSELSNMFVAGADTTGNTLAWALVRERGRGRERGVWSSTLGTCHAPPPLAVTPGVCLTMQLHPVMPALCSQYLVSLHPGVEARVEEELKGLGLCGPGAKELEVGDLGRLRWLSAVVKVGWGALGGAGNGRVKKGMHVAREMLTRRRLLKDAWHPN

SEQ ID NO: 10872 - protein, 134 aa, Chlorella protothecoides
MCGNRRDARRHDTEDALCASPLPALRPPVLQPLLKPTTHLQIRDIVGTLLQVLNTPSEAVQRRVSDCLPPLMQVLQQDRTYVEGVTKQLLGSCLKARSYGERSQGLGCLGTGVSMECCGGHGGIPGGHRFLGGS

SEQ ID NO: 10873 - protein, 46 aa, Chlorella protothecoides
MVSWNWRNLRMLANTFLPHSTALTMEEKLSSRMTMSAASLATSVPG

SEQ ID NO: 10874 - protein, 789 aa, Chlorella protothecoides
  MOD_RES (100)..(103): Any amino acid
  MOD_RES (335)..(338): Any amino acid
  MOD_RES (413)..(416): Any amino acid
  MOD_RES (674)..(677): Any amino acid
  MOD_RES (763)..(765): Any amino acid
APLRPADAHPAAGANGAARPATSSRATSGGEDDDDDEVEEDEEDEDVLAEGDGDDLDEGEEGDSGAGEEDDNGEGVELPPPLDPLPGQESADSEATQPSXXXXEEGDSGAGEDDDNGEGVELPPPLDPLPGQESADSEATQPSGDGQAGGVEVVPWRWVPGKVGGRCARGGAHRMCPGGVSGRLGPGRHGTEGASGARSSRASTQACDAAGRGVRQAGPWVAWYRGCERGAKLAGVDPGVCACTFYDPASPPGPRSQRGPLKTCTEAEFYADLSAFLKERKVRRRCAAGLCAVGTGLRGLAPGCNALHHAPASCGGASRAGLADTATMVWACALXXXXAHGSGRRGHHGVGMCTEGSALLSRPAPLPSHPPQGRTSGFFPVLNALQLDLFNLYNLLPRPLPFPQGGVPAWRLXXXXEPAPSPHPLPQGGVPAWRLCPGQRHQLEGPGVPRHAELHAGPPPDGGGERAQAPLPGLPPGLRTGEHLGGMDRRGAQGEKDLGLTTGACSRGFVQVWAGAGAGAAWSASPVTGACPRGFVQVWAGAGAGQPGLLHLSLVLLRPVKRRTTPSQAQPPSLDAPGPPHSQANPDDVTSGNCLVCGQGAGDDWISCDNCDRWLHFSCDKRPHPGAGCEPATWRAERHVTFGGVCPPPWPPVRWRVSVPAGHVTRGTAGPGQXXXXARDVWWCAPTSMAARPPASVGAGGACHSRHGGPRARPPPDAVPPSIDLRHAPAHAQSMHTSVRARTAWSHLSTPHPVLSPPTPTGXXXRSIDLRHATAHAQSMHTSVRARAA

SEQ ID NO: 10875 - protein, 504 aa, Chlorella protothecoides
  MOD_RES (254)..(257): Any amino acid
MKSTGVNTASIEWCTWGGCMHAHRRPCLSCTLPPPASLPSHSIITIHNNPENLAVAAGPSRLAIQLADVTTADPAPWFDPVADFIAGARARGGAVLVHCGAGVSRSATLVIAHLMRSRGWSAERALAHVTAARSVAAPNDGFWRAVCALESRLGLAQRSDPDKFAGSRGADAGDEPAAAPARGAGSGVGVGSRATFVPAGSPPRGGGDLRRGEGAGSAETGAEKGGKGLGVPGAGDPRVPGAGVPGVPGAGDPXXXXAGSAETGAETGGMGLGVQGAGDPGVPGAEDPGARSQGGLGAGAGRAAGVGGGGSRVGGRSRQMPGTRRMSLGRRREESPDARHPAHEPVVDPALGPSLSILLTVLRDDETLGTLTVDLPAPGQACTFGRMPSCDVPLEHPSISRAHAQITLEGGSRAMLTDLGSGRHAGGGRHFCEDLLGLPSMQARSSIQTGRGITLHPTHYMGSSLQPCITQAPSSPHHPMQRTAQTSLGCGYAPRSLAGCRRAM

SEQ ID NO: 10876 - protein, 211 aa, Chlorella protothecoides
  MOD_RES (43)..(46): Any amino acid
MWRCVEDTRCDSVKGGIATRSYLRRHTEICAVRPICCRPRVAXXXXNSFVSTTPYQYLRRPTHMLQASRRDVNIRLWVGPRNLVKAPTTHICALAPHLTYNHSPSTSQHPLCQLIDRSLAIHPHGHPPALGAMEVRSCAHDAIFRTFTRCGEDPLTLLVDLRPAKEFLKRHIALSYCIRLTSNGQALVGERYGRKGNCNRVSAMCVQLNGS

SEQ ID NO: 10877 - protein, 597 aa, Chlorella protothecoides
  MOD_RES (309)..(312): Any amino acid
  MOD_RES (536)..(539): Any amino acid
MGARPRLAGICLLGCVQCARRVRQQSEGQSPAGDPLLLCRPVSRHRVSCVEGWRAQEVRRAMLKPVGFSCVDNHPHSSPDGVHAAPINSSACTLSPSQADVLARIQFAGLLRAQCSLAEPPWFHFQVPRVLRRRDRLQPHARVSFGLRCRVLSVPAHHHTGPEEQTFRVELTCAGCLTLPSTCTPARHPPTTPFPTSDHDAPLEELASTFARFFGCVDLEKSDLVAGVVLTGLLQTHQRRSALEREATRRRGVSGGKKAQVPGPMPALPPSSHSWDEVQGLVDRYCSSVAPGCPRCQGRAGPGRHPGGXXXXECPRCQVDQLQSTSNDDALQGRTQHPDDEQLPPRGVQALGGIPAAPVQDVAEAGGDSDFQGRSGDGSAGGGGSTPSSQAPSSEAEGGVLRDWDGPFLRWVTAVAAGCSTYVTPSHWAGEEARAAGVDPDEAARASAGAPQPASQAEVDDAAYWARHAIAAYGSTAYIWTTTRRGGVCVVVHLELLAQSDRAGPIPVPQEEGGGCGLPSRPEEDCGGQGGPQALXXXXAAAAYPPLQQKIAEDKEALRHYVGARKVPCVFADFESGGTWAVQSAKGKACGGTLIAH

SEQ ID NO: 10878 - protein, 319 aa, Chlorella protothecoides
  MOD_RES (126)..(128): Any amino acid
MHCATLHASLPSPHHSHTPPLPHQSTRPTRTVVLSIRGSSSVEDLLTDVMDRPVQINDWLPADLTAAHPDLGEVRAHVGMYSAAKAVLRDLDSHRLLDTLLTGRPPPSEEREREAGRYAPDARDRXXXTRERRVRAGGGTVCARRPRPRVVPCPAPPARRGLGAGVKAGWPGGWRGLGPRSGRPGQPAACLAGAGPEGAGPPIPWPGPRRGAAGAAARAVAARRAAGGAAGPRGLRHAAGGAARGLPRLAAGADGALAGRRGGGAGGHAPADPGAGAARLGLLAAGGDGHAQPLAPAGGLRDQRRDWEGRHPTPGHHHL

SEQ ID NO: 10879 - protein, 365 aa, Chlorella protothecoides
  MOD_RES (171)..(174): Any amino acid
  MOD_RES (303)..(306): Any amino acid
MEIADAHASALRSAGPRRRGRAGGQPAPRGPPPGRLLTDRGAGARARGPRRGGRRDARARAAQRHAHRPQAGQADGDDQRVRRDLRGRARADHLAPEGARVPGLAPHVQGLLLLCKGGSDVLGCGGTHSVLGQWAVGWGFKEGSPVMLDIPRPIPLTSNPLFQFSFPHPPXXXXCWTFLAPYPSQATPSSSSHPPPPAAFPPYPPKVTLECLMEMFSCAKDIMNWLAECAKLVAGTGATVQWTTPLGLPVVQPYRRTTRHHVRTLLQVPGWYGRVLDAREGGVARMEDPGTGRGGLPWSLEGXXXXRVRQAGGGDGGHCAVDHAAGPAGCTAVPQDHTAPRPHAAPGARVVWGSTGCARGGWVRG

SEQ ID NO: 10880 - protein, 378 aa, Chlorella protothecoides
  MOD_RES (247)..(250): Any amino acid
MLLCHSCSPCHLPAQSTHTHFLTKPATHTTTEAGGGGEQRRAAGDEDAAAHRLSPQLHPLRGLQPHDDDGHRVSQGRCAAVGQACLGALGRAEHCEGGKHQPRASGTWRRRWCEAPRCAAVGQACLGALCRAEHCEGGMHQPRAPGTWRSRWCEAPRNVASLSCIAGMSFAGVHDSFWTHAGDIEQMNSILRDAFVELHSQVRGLQRGQHGCHVFEVQTAWAGALASLEENDGRCHWSALKAHLRWXXXXKRGQLCCHVFDVQASWAGASTSLEENNVRCHRSALKAHLRWSLWHGHGDQLSLASGSHHPCPCLCTLAASDGKDVQINIPHSHTLSQPLLENLLADFRASLPEVEFPELPKRGDLDLEEVRKAEYFFS

SEQ ID NO: 10881 - protein, 263 aa, Chlorella protothecoides
  MOD_RES (187)..(190): Any amino acid
MAALGVHSATLHPYTLVARWQPLAMGPKPAKEWRRWRPSDPPRASRSMFPRVNASMDTATVDCTTARDLSNVLSLNNIRQTLIRLEDTIIFGLIERAQFARNSAVYEEPGVEVPGCSRPGCSLLEYILRETEQIHGRIRRYTSPDENAYFPEALPSLLLPPITYEQEAFSASFQGSDPHRPPPQVLXXXXVPDGEQEAFSASFQASDPHRPPPQVLAPCAASINLNESILKLYLEHLMPEITEPGDDGNYGSAAMYDVMILQV

SEQ ID NO: 10882 - protein, 177 aa, Chlorella protothecoides
MAHVSRCPESLYPVPAFSEIGVYMRLTTSPLARSHCQALSKRIHYGKFVAESKFLSQTEKYTRLIHAHDSEGLMAAITDAVVEAKVRSCMDCRVPECPVLLVIFHTLQSPGVSGSQSLPPAHRRRDCGHGLGGGGAECQGATTGGGAAVQGLGHAPHQEGGGGLPAEAPGRLVHDSL

SEQ ID NO: 10883 - protein, 365 aa, Chlorella protothecoides
MARNAHFTNLHPSPRLHNNPPHHTVSIDVGSCDFIHTQTIVCRICKDVRLLGGGTDYSCTLTATLAASDSKWSGNWSVARVYLRATRYSAVSGTRHGYRIPSTPQNQSGIVGRRHRIACGGAGGAMLSRPLRACYKALLRQIWELERTPLAFKLQTPLDKHAWLRQGGGHGWAKVGSEHRAQTARLLLPWLAEVRDAGSDGARGDAGYFVVGNTLQGIETLTASSLRTLVRDQFRQPLPPDAEPNDLDRAIQGIRVLSDQIHLARGSSSATTRGVQVEVTADFVGVSAGSESSEPYMVIVASGAKSMPAPANKSPTANPLPNTLQHEDDIQTLQIIEEGEDEEEEEEAGGSKLFYTYRVRVANVG

SEQ ID NO: 10884 - protein, 256 aa, Chlorella protothecoides
TLGAAALAAGLYVGPLLERAAPVPVDGQLSRFTVLVMTYAARRPMLAGFVVHYAACPSVQEVVVVWNKGEEGVGWGWARVFHPKRAAGGWGRGCEGADKGRGRVGGVVCLCSAPRAGQVPVAASAMGCACGGVGDALLSWPPPPSTEAGPTSQHPPSPTPSPPTHTPGPLPEPGVDYDDRAVPVRVRAEAANSLNNRFRVDPALRTRAVLSIDDDIRLTCADVEAGFAAWRRAPETMHGFFPRRMAGEPLTFHGER

SEQ ID NO: 10885 - protein, 114 aa, Chlorella protothecoides
MRRCQKCVVAGLWSVARVSPLRQESVTAPHPDINTVRQSLYTFEDCLGGGVPKAQAAAEALTAVFPGVDARGLAMSVPMPGHVATPDEEAEVRGSVRGLLPTAQLLCTGVCRGR

SEQ ID NO: 10886 - protein, 169 aa, Chlorella protothecoides
MTACDEHLKTCGHFAHLVTIAGLEDAAADAGAAGPAVSCHPLTEWSSLAIASQGPRTYLALQDSSCETERPSASLRPLLLLAAARWKVRSLDVLCLRQRQGRSSAQGSIVLGVDLPGVDLEGSAPAGAGGWEVNSRGKPGPRVADLAAAMDPKRLAASGGQAYGLGGRS

SEQ ID NO: 10887 - protein, 151 aa, Chlorella protothecoides
MRRYHIQDRDDYKKYNKLVGMVTSLTSVLKKLAPTDPARIELTEKLLDRLHDMGVITTKKSLVQLEKLSTASFCRRRLPVVMVRAKMSETLKEAITFIEQGHVRIGPDTVTDPAFLVTRAMEDFVTWVDTSRIKRKVMQYNDRLDDYDLMH

SEQ ID NO: 10888 - protein, 71 aa, Chlorella protothecoides
MRWRAVPSLEVGSLSSQRCLLLGAGTLGCSVARTLLGWGVRRLTLVDNARVSFSNPVWWRRWSQSWGRCRI

SEQ ID NO: 10889 - protein, 200 aa, Chlorella protothecoides
MFSPSNWREVVDEVQALDAIYGTDFRVQSLTRPGWGDAACTHGLSSEELMQMEDPGPGATWSLACAVTLDLSLPAPGLPLCVEAGEGPSSSSPSADDPPPRIQYLPPLVLRLTLHEAYPGLAPPRLALEASWLAAPLAAKLAAALEALWHADLATQPAGYAWAEWLREGVLDRMGAGSGALRLQVRDEDEAQTLLANLLR

SEQ ID NO: 10890 - protein, 171 aa, Chlorella protothecoides
MRGALNAMLFRTGDQSRDFVVVLATNRPADLDPAVIDRMDEALEFALPAADERRRILDIYFDRYILKAGTAQGGAGAGSNTGAFARLGAWFRGRGDVDRIAVKGVDGALLDEAAAATEGFSGRELAKFMASVQAAVYGSKDAVLDAPMFRRLLDMKVGEHAQRRAFMAPEL

SEQ ID NO: 10891 - protein, 328 aa, Chlorella protothecoides
MGRVGARERAQGLPAGRQPGPQPSGGCLPGAAHHAGGRMAVEGRRLTQAGRHEARSDTLCDRKKRTAAAHSRLPCPSRRRRRRDTIEAGAYNVILTGAAFLDSATAFPAYWADAVAPARATGAPSGAGLGWEEGARWTSSLPPDLERWRWRSTAGGSQGPLHADLKRALEAPAAAWHGIQRTHTSTHTHVHPLIPAVDRLFNGEDVLMNFVLANRTAALQRGASNAAPVRYISFLRPKVRWEQVVGGFLESQRHRAPSICAGTALSLLFDRLKPVPSPLRLPPPPAPVQRRVDISKLSPVGISHNFAKFLDATQTVSGQRISWRRAGR

SEQ ID NO: 10892 - protein, 87 aa, Chlorella protothecoides
MAMLAAAKKAGVLGGLAVASGLGTVAYCEPDSKYFDPEALERGAKALREINQSPYAKKVGLGMLGRVGNGVTVRNAPCITLMITWQS

SEQ ID NO: 10893 - protein, 133 aa, Chlorella protothecoides
MVVALASTRLTKLRVLTSARSAALRRLPRNKVFYQPRDIPEEALRYVLHYKHLYLPMYPAGRVMHLRRVEREKGSRAWDAVWVSHRCLIDEGILVSRHQSSDHSIARLRSVFAELAGKDVPELAGADGGEDLV

SEQ ID NO: 10894 - protein, 111 aa, Chlorella protothecoides
METTKGRLMAWHWHEEGTETVQLLGRHWIIQDSRGVTVTEVPRGTRGVIGCTPIIKPGTCFQYYSGTDLDEAPGSMHGSFQMAVLDDRSQPLESFDAEVAPFHFWPPSTPA

SEQ ID NO: 10895 - protein, 501 aa, Chlorella protothecoides
MPQVFEQIKAQEATKQAELKAKEAEFKAEAEKAAIVSQWGFVGMALFGAPAHCRCCDRSGPDLAVWHPGTPSLTPPQHPPSSTSSQQHERVRWEEQRKAMQQDSQQKAQLAQYQDELARKRAEAEHEKQRARNAELVALQDESHRRQEAERAQIAAQIEAERRATEAYKAGLEKEVQRERALAEAEGRTAERRANADLYRSELAQKLEEERRRLVEGINTVFGNLGAAAAGLLGDRDRLLAAVGGASLLALGVYGAREGTRVAGKAVDRWFGTPRLVRETSRRPLLGLRAAPGSKSAEAVRRDFSDIVLEPRLQDHVRALAAVTANTKRHGAPFRHMLFYGPPGTGKTLAAKRLARTSGLDYAILSGGDVAPLGGGAVTQIHDTFDWAERSGKGLLLFIDEADAFLCECQGVVVFFSTWSVGIPCCGARITRAPAPLHPLHLAGLTPSRGHSPHRSHADTPLGAQPLPFLSTVTPFLLLLTSRGPSPLSPPPLTQPAAVRG

SEQ ID NO: 10896 - protein, 184 aa, Chlorella protothecoides
MAAEAQLSPDVLSIPQQKASQAIASPVGDLLATLETMGRVLSFQDTPPPPPPPKYPRAFSPVMQTMAYHEQFMDETPEGKALRDNWRRQVVLETRAVEAAAARYRRDLAAAVQRGEGANLPASRRLLLRWYAPLVDAIKEEQRKVRRRSSARCGGVAGAEGYGCRDGDALRATASMGVLPHDAL

SEQ ID NO: 10897 - protein, 175 aa, Chlorella protothecoides
MEAAGSLSPHWTWPDVPIRQLEPEALTASGAGLASCRAGDEHAQTDSAGGATRGTCCANQGDCSATAPADSSVGELRAAGYRWSGTEMGAGPVTYIWIGAPDAPALQLLQLTRSTLPWWTLDPTTCTLEEGLPVGVRRLLRRRYALMERARDASIVGAWTGRVTGVWGRGMITEH

SEQ ID NO: 10898 - protein, 175 aa, Chlorella protothecoides
MWGCHCPLHVRQCSDVITASHLNHPHSRPSASAPPPQIHTPKCQFRTSYFPGLGWMLSSRLWEELGPAWPQQHWDHWMRMEGVARGRDCVVPEVNRNRNIGEVGANMDRATFRKSLQTMAWAREAPAAGFGDVRYLLQPAYDAAARAAVAGAQILPPAALRGAAPPPDLRGGAAL

SEQ ID NO: 10899 - protein, 315 aa, Chlorella protothecoides
  MOD_RES (212)..(215): Any amino acid
  MOD_RES (306)..(309): Any amino acid
MCAGDGVGHLGARGMARRDPPYASLLTGTLCLLIFVELVWVQLRFASVLPGNQRDAVKSVARDVGVSHAPLHQDPPSLLNPAIIVFCYDRPGYLNQTLTSLAALPELADFTLYISQDGNHIGVQGVIETHRAALAALTAGFESWQRPRVPQLGPRQPGHAWLAQHYKWGLDRLFLKGGHSHAVIVEDDMLFSPGKPSSRLKAYKKGAGSLSXXXXKGGHSHAVIVEDDMLFSPAQPLGQQQDYWYSPSHTDFLTLFMETGWLLDADPTLWCISSWVREADGDHKGLCPMGKIVDLHRRCKMQVALXXXXLVGEGG

SEQ ID NO: 10900 - protein, 199 aa, Chlorella protothecoides
  MOD_RES (64)..(67): Any amino acid
  MOD_RES (167)..(170): Any amino acid
MDAGPLPAPVAKAALKQLFEAVGALHDAGGWYYGLRWPGSCSVYFLNLLDGHHCIMLCTSGPGXXXXDPVPHNGHLQRLPLPSHSPPPCPGFAHRDLAPSNALLTDDGRVLLCDFGQARRLEDGHPQADGEAPEREGALTPVVGTRWPLAPQHRCPSTSPSAPTCHXXXXRRLGDGQRQADGVAPDREGALTPVVGTRW

SEQ ID NO: 10901 - protein, 455 aa, Chlorella protothecoides
  MOD_RES (198)..(201): Any amino acid
  MOD_RES (266)..(276): Any amino acid
  MOD_RES (298)..(301): Any amino acid
  MOD_RES (323)..(326): Any amino acid
  MOD_RES (400)..(407): Any amino acid
MESGLYLHKPLAPGNCAGGSPGPLAPQHRCPPTSPSAPTCHPTTKPPSTPTFPIASRYRAPELLFAARSYNHAVDCWSLGMIAAHALRGAPLCPGASDIDQICRVQAALGSIEEASGAPVADWADWGKLVFPPSPGQPWEALLPGTEPAARELCAGLLCYDPGVRWGLGCSGGGRGLPSLPGRLGTVKTWEGRPLACXXXXDGAWDAAVEDGAPQPAWQAGHSSNVGRPTPGMHVLHCAACPSPSRRFPANTQGLGCPIPCLLPRXXXXXXXXXXXSAIILWPCRAHGTSYPAVTSPXXXXCHHPLAMQSARHFVPGCDLPLXXXXALAQAGAPRPTPKDSSVPFPAFFPATLQPSAGVWPVPCHQTTLTAPRRQQTWLRTLPTCLSESQDVLNLRSTSXXXXXXXXALAELLNPLFNATPGGCPALLTLCRHCCIVHPFGVQGSWNESGPSPNV

SEQ ID NO: 10902 - protein, 228 aa, Chlorella protothecoides
  MOD_RES (56)..(58): Any amino acid
MKKGYGMECDWWSLGAIMFEMVGRRLPPRPVRPAVCQSQSSQSRCPHAPPPRAPTXXXCRGDVFLLGQGDLPCASPSRRSHAALTPHLPVHPCSKIVNWATYLRFPAEAEASLSPAAKDLIMRLLCDVDRRLGGHGAAEIKRHPFFRGVDWVRLYESPPPYRPAITHELDTQNFEQYEDPERGARAGHSPGSASSRSRPVADPNFIGYTYKPFEAVQRSDSGGSPFIS

SEQ ID NO: 10903 - protein, 326 aa, Chlorella protothecoides
MDRPSARRFEGKVALVTASTAGIGLGIARRLGQEGAKVVVCSRKKASVEDTVAALRAEGIEAAGRPCHVGDAAQLKAIVDFTVQTYGGLDVLVSNAAVNPASGALLDCPAPVIDKIFDINGEWAGGGFLDLRGLRKLDSLPCWRVMPPCRDTAPGPRVGVQCFFHPLSPPPSMKPCSEVCAAADPGGREAHVPRQLHRLHLLLFGLQPPRPHRAVCHQQDRAAGPDQGPGHGTGPARHPRELRGPGHRAHQVCVGLGGRPGAGGRAARRQPHAAAGPGAGHGRGGGLPHLRRRLLRHRRDAQRVGRHAQQALGGDRHAWIENVQRV

SEQ ID NO: 10904 - protein, 264 aa, Chlorella protothecoides
  MOD_RES (91)..(93): Any amino acid
MEVDGVGVGKFRGEAEGQAEDIHSATARVVARDSTTIRALSHTGALMLLSGRGETPPVPPSHHFPPTPSPSHRHQHNPSRPLTLGVKVGAXXXTHWALMLLSGRGETTPVPPSHHLPPTPSPSHNHQYNPSTPLTLGVKVGAALAAAHGQRGECILEDLLKAQELDDGQGDRGVEAQAALVGADGGGELDAHAAVHLPHARVVHPGHTEDDLALRLRQHAEGREVLWVLFEDRGDAEGHAAHGLQELGLLRVAGVDLLQDGLAT

SEQ ID NO: 10905 - protein, 949 aa, Chlorella protothecoides
  MOD_RES (108)..(111): Any amino acid
  MOD_RES (208)..(211): Any amino acid
  MOD_RES (250)..(253): Any amino acid
  MOD_RES (476)..(479): Any amino acid
  MOD_RES (627)..(630): Any amino acid
  MOD_RES (751)..(754): Any amino acid
MDAQMSRDGHREQLVKVNCASRVSCGVLDGQGECRGGTSGSPMKRSDGICLESVQLLIKCGRCIAQQPKIVLLTYKTTQNCCSPGGRTWENPRHNRGFHDQVQGPLIXXXXHIMFYDTLWQQLGASHDLETSTVHSHLSQGRPDEYCGPIRPLQRGKREARLFDKIRCPALAFCASPSPSVHVSYTGLFTLFLCLAVSPTEAGGVGRXXXXGRNMAAPDQQSPTAGPQQLWLLPKPARAPDLHVLPQRVXXXXVRDALKPLTFTSVPRALPQAPNSFGSFPNQPGPRTFTYYPNESLRRLWQEAKDEIAMTEPDPAQFKNQTLPLARIKKSRCPAEAHRSLPCSVLQIMKSDEDVRMISAEAPVLFAKASGVYGCVGVIAPPPPPTPPFNSCPPLLIPLRPASLRVLRAGADPACLAGGGGEQAPHAAAQRRGHGHPAHRRLRLPAGHCAVRGARARRRRGRGGPAPALPRPARRXXXXVPYEEPAPDGTGVAAAQPPPSPAQPGAGAPPTTVHPVPGQGAAYHAQQAGPGAYGTSPRFLQTQGMQYPQYHPSMGPPPQAGMYGSGGGQQQFVAPYHQPMAPVGGPPEPTPGRPVNLSPVRSVYSTPPRRPAGVVSEASLTRRRAAXXXXPLPSAFCVLHPFKATCRSRFQSVPHPPPCSAVPPTFPRLFHVMCQGPTSVPDPVPPPAPCFPLRRSSLSHTLLRCPGGGTTWSPSPGTRLPGVAGICSWRATFTGCAFEEQESAQAAVSQXXXXCSWRQHSQAVPSRGKSQLRRRSVSPASLNTPPAPPCPPRRGSGPRRQAPGHGIHEGLGEARVGEAVGAAPGRRRDLQPLQLLHAQHPGQRGGVLLLGDAAEARGGGPARPRAAALWLHDVFPRPARVVDYGHHARGHELHDADAKVLVAHRVQAHHRLAQQRLQLREGEVDQEVDATLEAQLLRQGCGWWRGGGG

SEQ ID NO: 10906 - protein, 220 aa, Chlorella protothecoides
MVRRGQVDHVRAERNVLAEVRHRAVVRLLCSFQDEEMLYLVMEYMPGGDLMTLLIRQEILPEPMARFYLAQVDGVAHKGLRGVRKGRRCTLCCPCRYAWVTLTTLPRLTVPPVPLQTVVALEAIHAAGYIHRDIKPDNLLLDASGHMKLSDFGLCKPVDVSLLPAFKAAADPVAFRWEFELGDGELGQRTKDTDPNTGVQGGSPRVLQCRRVNVHLTPQG

SEQ ID NO: 10907 - protein, 126 aa, Chlorella protothecoides
MGYEDEYFSEEVLAKAKTAKVYIEHLYKVQSQHHKDRKDRRKALEEELQNPGLTPEQRDAARAELERRERDFSRLQRQRLSMDDYEPLKLIGKGAFGEVRGAGCGGEGPHLSCADPEGNMVPLVGC

SEQ ID NO: 10908 - protein, 143 aa, Chlorella protothecoides
LAKELGLEGSVDFLVNLPFPELQALLGEAVVGLHTMRDEHFGIGIVEFMAAGVVPVVHDSGGPREDIVQPEGGGPGSGGATPTGFRCVTEEEYAAALTRVLGMQQLERLEVAAAARRRADRFSDARFAEAFMDAMAGCLPPRT

SEQ ID NO: 10909 - protein, 289 aa, Chlorella protothecoides
MERPMRPSRVCVESRGCHCINKNKAPSILGQRRRKLLGAVSLAGASDGTVEGSGSATTDSGYSASGQVAGSASGNNALAEAGLEATTSGSGSSIDGFGSGSSDGSFTAQTSGSFSGVAAGPGRLAESNYNAFSESSQPGPVSAEGSGAAAADETGATASGSSTSEANGITQIITGSASGTTGAQSSGNTTIASPAPSGGSPTPEGSPSPGPTPSPSPGGEPSPSPSPSPSPTSSPQASPSLSPELSPTSSPSPAPSPSPSSSPVTSPIPGPSPEPSPTPSPSPEESPSP

SEQ ID NO: 10910 - protein, 524 aa, Chlorella protothecoides
MLPMGPAKHAFRLAKHACFSTRSSLQEEELALQDQMGFTEYSAGPPRLGWLVNLNTVGLHATCSRAAQCLHGMIVLMSSTGGPASTITFVTSRVCRFRQWTRVLMLQSVQSWATSSPRWATCWELCPAGRLSHPATTITPVPQDGTMFRSAFPFSPYFYLHVKAGQEAEVDSWLRRKHEGLILDTELVEREDLDLVCKDGPAQNKAEAQGCRAAQLWCCVLGAGRLEAGPAPSSDRLARHHRLHADHPPCWPEVVRTARQPPPPLPLSGKPPVGREAHPPARVFPHPGSAVQGGGQGGAASGTPARAGRGTRDVAPPSSPSLAHRRCLQVRRELMPILYRNKSKRGTASVAGEESSRRWNRKGQVGVACPAPRIGVPGLAGLPLSAPASARRRAPPLPRAGRRGRAAGHEGARRPPPRALRHRHRRALWGVVLRLGSGARAGRVPGSGGCWRGLAAPSLAPCRLVRAGVAAGRGEGSPRLHTSPLSAGHPQAALSAAPPCAAREDVAGAQARNGAAGGGTGVRL

SEQ ID NO: 10911 - protein, 300 aa, Chlorella protothecoides
MLNVMVAANNTNDQFAVSEARASGFVAKAWIVGCVYLYAFGSISIRHAHLVGHHQALDSDLTPRRATVTASAPTHPRRQVLHDDRTKEYRTESRMSIEFEVDGPYKVSLGAGPAPIPGYVAMILPASKEEGKLIKKRYAVFNHDGTLAELKVRFGDAHLEDPCPWDSHGLQCWRSPGSAARRTQLAPTATLTLQGFELKRRGELKLIKVFQAEIFDQFLRGDSLQGCYDAVAGVANRWLDMLDTQAPIALRAKNAWRLDLDRSCPCHFTSGVSAGHGPDRHRARGPHLGDVCHVQEPGGL

SEQ ID NO: 10912 - protein, 140 aa, Chlorella protothecoides
MLFSPTIHTLQGLLDNLDADLKYAIETEGKMDMGDVTNYAESSLCKEMITIAGVDHSCGLMTELRSSLRPLRDVVASADRTMCKLRSLVNIWFPQIRAAIATQLEALRDCPIRDETPLIYHLDVAAMYPNIILTNRHDGA

SEQ ID NO: 10913 - protein, 201 aa, Chlorella protothecoides
MVQCLPEGAEFAASPPPSRPSPHNPNLPPPAATRTEYFSLKTQLQSEMFPPLGPGAPQRSWYELTSEERSKNLKARLKGYCQKVRAGGASQCGRLEARTRRHLSNVPCCHAMHDPCQQPGPISRAIPTTHHLGAGVQASPEQAHYGAEERRNLPEREFILLRYRRVLQSSPDQGCRSNPDRGAGLGSEDGDGALPVRSPAG

SEQ ID NO: 10914 - protein, 79 aa, Chlorella protothecoides
MHSEAAPGPSCPPAPSLQRANELIGQIGRPLELDTDGIWCALPGSFPETFKVPGRGVREGKGIPVLLPGTRSLCTCMRS

SEQ ID NO: 10915 - protein, 84 aa, Chlorella protothecoides
MHKLLLHLVSELRRLGVTVVHADATSLILCTGKRNLAAAVGYIDYILETLGKRELLQYLSFTPTRMWHALLYKDRCANWACRKA

SEQ ID NO: 10916 - protein, 198 aa, Chlorella protothecoides
MSQARLLQTHGEELEVSAEELNAPRFDYHFTLKAREDVWFGRQGARVQILGPSIWQADTASRFRQMRSPDLHLTAFKLSMQDFLPSALHATFMTLVTEFLWLPWQAAMQGLEKGPSQGGSQASKDTSQSLEAQTLWLRTALPNQFTSNLLKYVKYISMHVGANDGIEAHAFPERAGSHLSAVSGLVGRSKGRIEQPAS

SEQ ID NO: 10917 - protein, 178 aa, Chlorella protothecoides
MGRDWAIDAADALFARQLRAAGHLLWVSTPDAATAGGSLAARPPDRAEALLLEEQRTRTEVAAPGVYRTAHPPGRERRAGGEGWPQGRPPGVWGLGTSHGEAQCAKPWSTRSSGWVEGDLAWLNKPVPPGPRTMQAAALSELEGTALVDDGKGCGAAFVVLRSLAQAWLDDASRHSNV

SEQ ID NO: 10918 - protein, 356 aa, Chlorella protothecoides
MLGPATAKPSIGLAGAPHAPVEEGQPRVQGYPVALRAAALSSEEDPASGEEAPSEACPSRHENYAQWLEVKKRLWRQGVEARKKRRTAAEPNHRRGGREGPAQNPEAGAGGLAGMLRQQAVSAASLHWQGRGGRWHLAGASKRTAGIRPEAWPHGSGGVGGGTRPCLEALPCPALEGTPTHAAKPAVLTPQHTPLHDTSCPPNPHPTLATGVYKCWAVLGGRMHAIPLRIPRTFFANLLAPPSHPLVADMGVLARRALPHGAAAATLVQIVMDEASFRAEQAALNERLLALRALRVYEDTLPPTYNACLQVRRPFVEWLVVQGGLLACLGGRVVVLCTRHQDCMSCAVEPAGVASH

SEQ ID NO: 10919 - protein, 281 aa, Chlorella protothecoides
MQSNHHDAGGTAAASPSPGVEAAPAQAPGVPASIPGMLPGMMPFFSNISSLSEVSGIPSHLLNNPAMVLAAQQIAAQRFIQHQYMTGQMTGAYGHAIGPPPSGTAPRPAAAPAQPPASVPSSHAAPQGAMQPHMTAEPAPLRAPAALPMAAGPGSAQPIAASPRDYHPSTAPEAPATHSIPTPVPVPDRGSAPAPAIEGDAPPRSPRTDPGGRLVWAKVGAYPWWPAKVLTRGRDLSFPPSEEPPRPNAVPVRFFGTHDFSWIGSKRAIMDWEEVRTGWSR

SEQ ID NO: 10920 - protein, 251 aa, Chlorella protothecoides
MVHVKEFSAEAVFQVGQHWVLPLRTPCCTGMKILELPPHSSLQVVVIPLIVVEPPQDPCASLVLRDVICPHCQDCQDLDVCKDPQVCCIEQGPCCRSACRAWVDRMGSFVAALSCPRGKGLAPCNGLAGRVPSSCIPITRTPSPIHAHDWRCGACGAPRDPVEVESALGDALGTLCDASVLQDLQCLKCHSVATEHLRAQCDHCGGPLATCRPAAETLARVRVFERVARFHGMPVLEELAGWVLAQQGSTA

SEQ ID NO: 10921 - protein, 184 aa, Chlorella protothecoides
MDRAFTGSQVVEPTAAQVAAADALIAHLQLGEFSSDIIANPHLQRHYQVLEALAMGEEPGEDVMDDTLPDVEAFRAVGPVVRAFREQGAIPTRILSAPLWQEAVTVAEASPSPGSKRKGAPPSSGTHSETFDDDACIRQVQVAAEAGTLGKLPISTLKPWLKAKHLPVSGRKDELVERILQHMS

SEQ ID NO: 10922 - protein, 210 aa, Chlorella protothecoides
MPEADMQAPKLYFPNTKDAHYKYANFPKVYLEPHEIQSVKAAPPHTIRVLGFKSTSCLKEHHQLRSSSFVYPGEAKLHQLTPPSPLLHHTLWADDSGVPGSSQVFVALHSAMLDQDQVAFGVFARSHSGGLRLVALLPQEALSDEEGIQVRPWCAVPGSNLEGLSRCGACVAIPCRARNVLLEPHHHSSACLTQTARGPGVPCHLPAFCG

SEQ ID NO: 10923 - protein, 75 aa, Chlorella protothecoides
MRGVTTCSPGDDFKFPCLVLTLRHLEHAVDGLPTHPTPPRPRPAERPQSMASYSVSDAVATYYLYMTYVHPFILR

SEQ ID NO: 10924 - protein, 514 aa, Chlorella protothecoides
  MOD_RES (202)..(204): Any amino acid
  MOD_RES (265)..(268): Any amino acid
  MOD_RES (487)..(490): Any amino acid
PRAADAEARCARFRLAGTAAAKALQDGRLLDLPLSPLMWRMVAAVDGAAAEGLAPDLVDLETVDPGLAHGLRRLESAARAPGPARGLVDGVPLADLYLPADRLPGYPGYRLAGVDDAPGALVGVASAPRYIAAVLDATLGAGVARQVAAFRAGFAAVLSPDVLLRFQPEELELLLCGGLSNGAGGGSVDMNGPPPDMGRRSXXXLSTAAKGRPSPDCWKKRSSSRHGKEAGHQPHAVPNLCTETAGCLPSQNPAPPPPPPPFLRXXXXTETAGCLPSQNPAPPPPPPPFLRPAPRVGRGVDGGGAAIRHPLRPRVHPGLRPCALAGGGAGRPGPRPAPRLPFLHHWRTAAAARRPGRAAPAPDRRAQERAVVARGGHGGAPGATQPRVLVWHARCGFFAGTGGCTRRGCRPALRHDLRQLHQAAALLVQGRAGGAADVRACGGPGLIRPLLGWLDGFCVFSGPPLWGGSSEATDMSIPWTRRPSLGXXXXARPARFLRRGRGLHWTRTLTCPPS

SEQ ID NO: 10925 - protein, 704 aa, Chlorella protothecoides
  MOD_RES (32)..(35): Any amino acid
  MOD_RES (207)..(210): Any amino acid
  MOD_RES (234)..(237): Any amino acid
  MOD_RES (411)..(413): Any amino acid
MAGGLCQWLHACCTIHAGAMDLVCRSPPPVAXXXXVGWWDGGWKRGWHGRGPLPVASCVLHDTRRGNGACVPVTTTSRPCATQVEIIALILANPRPAAAPDAEKGVLPNGFSHRPAESASPPVDPGDPPPAPLASSPHADNQRMPGGTLVVCPPALVQQWRAELAAHAGPGVAVAVYDGLRGLAPLTPAESRQTMIAPHPPSSFPMXXXXVQRPCRQPAHAGGDAGRLPPGPGXXXXDWGGATLDPGACAACLAPFRDGQIAPHPPSSFPMPDCADTTCPPTFLPGANSAQAQREAELYSRLAAGEAPWPSFSPEAEAGEAAAKLRAADVVLTTFEVLKQEVHYSPDNKLLGSLRYAKRYHVPVCPLLQPGQDAGSRGRGCAIHTRDAACSRPDTSPLSPWASPPTPFSPXXXRATHARDAACSRPDTSPLSLWASPPTPFSPSLVPPTTTPRHKTSTDPLVAAGGRRGADGGPAVGGGGHGGAHVRGPPLVRHRHAAGRLPRAGRPARPADRAGPRPAGRLRGLAPPGAPPPGRGARRPGLARAARRAAAPALAQHQGGGGGGARAAAAQPGCLAPRLPAGRGRVLRPGAGAHARRARAPALPAGGGGRGWGGCRGARGPGAGAPQEGQDGAEQGGGGGAGGRDAAAPGLYPPAADAALEEPAERPAADSGRDAQHGGGGGQAFTGVEGVPHQGGGPPAAARE

SEQ ID NO: 10926 - protein, 166 aa, Chlorella protothecoides
  MOD_RES (61)..(64): Any amino acid
MQRLVDKAQFELQNLERALCATLNTLALVLVESVATGAGAEDASPGAVDGEVRVEVKREVXXXXSRRRGRQPRSGGRRGQGGGEEGGEGGPVAPGGPPSALRSARVGDCRAKVAHGRGRHGVHFDPKTQALGAGEAERRRGEEGSHQAAGAVLQVWKGGVNGVLVL

SEQ ID NO: 10927 - protein, 582 aa, Chlorella protothecoides
  MOD_RES (10)..(13): Any amino acid
  MOD_RES (113)..(116): Any amino acid
  MOD_RES (264)..(266): Any amino acid
  MOD_RES (462)..(464): Any amino acid
  MOD_RES (529)..(532): Any amino acid
MLRRGGCTSXXXXVCEGGGVWGAPECSSCHASLRAGRDDPPWVEGHPRTSLQTNTQHTAPMSPRRTRRLRRRVSLTTRHRRRLLAACTLARAVSLLHAPLSPPPPPSALTHSXXXXGGRGRGRERPRGLSLRGAGRGAPAAPGAWHGARAAAPAHTHTPPAAPRHQAQVVRGGRVVGGAGGGAMADLTAGEGSGAGWADGPPGRRPAGQTAGWGQALAGGWGRGDCGAAPRNLPSSTTTTPRPRGGERAWIALPTRPPLPPHAXXXALAGGWGRGDRGAAPRSLPPRPRPRAPWRGTSLGRAPHTTPLPPHIHDPPSPRACIHPLPHPLPSNVLLGPGGVPKLADFGMSVLVGAPEAGQRHVIGTAAYAAPELLEQGPPAAGVAALKADVYSFGVAVWEALARRRPHQGLDGYQIQTRWMLDPEAMRLPGPGRGRAELGPAAALLWVGRLSPSGGGGGKKGXXXAGPGGHAPAGTGPGSRGAGPRRGPALGRQAVPGGEGGEGGRLVAARAELSPGIPPPTGLSSWRRXXXXGAPPGGGGGEKKAGGCSRRIVARHSTADGVELVEASMQIAASDLEHSFRA

SEQ ID NO: 10928 - protein, 78 aa, Chlorella protothecoides
MSGTFIGNSTAVQEMFKRVSEQFTAMFRRKAFLHWYTGEGMDEMEFTEAESNMNDLVSEYQQYQDAIAEEDAEGDEDY

SEQ ID NO: 10929 - protein, 629 aa, Chlorella protothecoides
  MOD_RES (438)..(441): Any amino acid
  MOD_RES (561)..(564): Any amino acid
MTAGLERVCVCGGQGQDESPGLDAPRMACTDQSADGGLDVVGDPLHKVAAVLVLDVQHLLIHLLQWCGGDGEGWEWDGEGGGHGMGGGISLKARPSGRVEGWVMTTTAFVTRRMTGGLEKVCVCGGQGQGKSPGLDAPRLACTDQSAVRGVNFITGRSSSFNRAHPIPPPKPPPSHLGGHAAAEHDRGGEVATVARVGGAHHVLGIPHLLRQLRHAQCAVLLAAAGGEGREAHHEEVEAGEGDQVHRQLAQVGVQLAREAQAAGDAGHDARDEVVQVAKGGIMCTPPQTGPSHLGGHAAAEEGRGGEVAPVPRVGGAHHVLGVPHLLRQLRHAQCAVLLAAAGGEGREAHHEEVEAGEGHQVDRQLTQVGVQLAREAQAAGDARHDGGDEVVQVAKGGGGQLQGAEADVVQRLVVQDHALVRILHQLVHRQRGVVGLXXXXRSTRRRSPPADAPTAWRCRAPPRCRTPWGRAPPSRCTSCGRGRHHAVGVLLPDLADQQGAHAGAGAAAQGVGDLETWGRWVGGCGAVRGGQSRGLGGAWATRSRLGRGLMAVEMQPTNEXXXXPREWHSWKPESGWGREREDAWVGGSNGCNTNYGGGCGGGLTSQSSHMSHILPVCRGMEPSPTPPP

SEQ ID NO: 10930 - protein, 182 aa, Chlorella protothecoides
MGSGVGAGRRRSPILRQRGPQIQPGAGVARELGQGPQRDHGHGDVVPRRAGCEVRYPVPSANLLLPGFSRRRALLTTTVAWRQPCHALVYPGPRRCQALHPSASLCPQEPGTMDAVRAGPIGQVFRPDNFVFGQSGAGNNWAKGHYTEGAELIDSVLDVVRKEAEGCDCLQGEVVGCRGSWM

SEQ ID NO: 10931 - protein, 341 aa, Chlorella protothecoides
MAIPAVLKVTESGNVSSRLPGSGNEQIGPGRARATGGTGRSCGTCVPSSGHGTRKRARVSYVETVEGAWGPSKRVRHDPMPVTKGSSAKVVDAGSPHSVLGDAGIDDCDPAKLTQPIKEVKDKYQLLPAFLRVRGLVRQHIDSFNYFINHEMKKIIHAKGNERVTCDTDPNFYLKWVAFYWVAEEDAQGLHSSPKGGVLSLPHLFLLPFSHPHFLPPNHHQVPEHLRGQAQHRGGVHRHRHLAPAVPLARHDLLRPHLRGRGVHAGQGDRDEAREERTGRPLPGPHAAHAAQRPLRAEGQVGGGAGQAGRVSAGPRRLLCGQGNREGDPDPGAAVQEPHHH

SEQ ID NO: 10932 - protein, 111 aa, Chlorella protothecoides
MSGITCCLRFPGQLNSDLRKLAVNLIPFPRLHFFMVGFTPLTSRGSQQYRALSVPELTQQMWDAKNMMCAADPRHGRYLTASVMFRGRMSSKVGGGRFGRGNGMCSTEQTL

SEQ ID NO: 10933 - protein, 411 aa, Chlorella protothecoides
MMTTSPSLPHRRCPSIPPSWSSYAPEQVKSCLQAVLRVATEHVKKLARGQAPEDMGLLSRLPLPACEARLEAMRSQVRAAWCFVHGYPTASITRRTPPTPNQVHLLRLLREEHVQEAALRLRRAQLADTDATLAAAAADPPEKRAGPEVLRRRVESLKAEALELAARRRYMAGRAEEAKQALELPGLAGMGAAGTSADAPAAGPTADASAAGPTSQGTSAAGQAPGPQGPAGAQTSDAPPPSQAQRAPTAPALRGTECPICYEVIGEGEDVYVFGGCGHSFCKECSAQQVLQSGRCAVCRARVTGKQVFRVAASCTADVSATEACDPDARLHPTVGAWVSWAQLRPAGWASKVGQPTAPHTHPPLRSPALPQVAPVRGEWSIKITALLRRVLHLQETAPQEKSLVFSQVVG

SEQ ID NO: 10934 - protein, 199 aa, Chlorella protothecoides
MMTRITSQFEKTRKVSGPRALQPSQWGMLCPADTPEGESCGLVKNLALMTHVTTDEDPAPLARLAAALGTQPLSLVPGAELHHADAALVFLDGCILGTHRRPRALVAALRTLRRAARLGEFVSVHVQHDAVHIAADGGRVCRPLIICDAGVPRVTGAHLARLKAGEWSFNDFLTAGLVEYLGGYVGGEGRGAEPSAPGL

SEQ ID NO: 10935 - protein, 393 aa, Chlorella protothecoides
MEALAAMPDIPSDASATVHAWKLLQLNTAAQLASLYGAEGRTEDGAAMERDARDKAAYVRAAAEMEVTQVESRLAQTAGQYAGAARVLDSGWRAAVAAGFPRAWGLDPAPDPAAWLAGVRAAFAAEQAAEAAELEHQASAVEHMLGTRVQKLLAHLDTGLQGGLGALERHVNGALAEAQVARMQRTLASLTGRKEGKSGMEKLYSACHTPLTPRPNPSTNAELSTEAELKAACESAMPVLSLLHDYQRRRIMSQWFYLLPAEAVEGRRGRARPGSRAGPEARGVLQETDDGNGAEQQCGERPSTGAGDLPAVLDGEAAELRRLLAEQAAPFHAASAWMGAAAGYVFKLGEAGLGYYADTPVEAAPLYTPTLVRGLSAFQEAVDRTAPSPMVMV

SEQ ID NO: 10936 - protein, 249 aa, Chlorella protothecoides
MGVESDQEFVQLVGSEPAFGSLLAPTLQHCREESTGVFTQAQALEFLAARVKSSRPPGGFQRRGRSRVDEARDILSGVVLCHVPVPRYNFQAKVVYLAVMVRRMLCAMLDPGFVDDRDYYGNKRLELAGGLLALLFEDLFKKLNADLKHHTDATLSKANRATQYDIAKCLGTHTITAGLENAISSGNWTIKRFRMERKGVTQARVMERTRGDSFVCTGQSHAALPWLPGDVEEAGVVHWARGVPMRSAG

SEQ ID NO: 10937 - protein, 145 aa, Chlorella protothecoides
MILDNEALYDICFRTLKLTTPSFGDLNHLISAVMSGITCCLRFPGQLNADLRKLAVNLVPFPRLHFFMVGFAPLTSRGSQQYRALSVPELTQQMWDAKNMMCAADPRHGRYLTASALFRGRMSSKVGGAGLGRGAHDLEPRDQGV

SEQ ID NO: 10938 - protein, 580 aa, Chlorella protothecoides
MAGRAQRSRAMSVDQHWTAWHSPSINGKPPHTESCPLPPHSDVNEENNALVALYECFCNPATTHLEIEPFTVLGVVAGLIPYPHHNQSPRNTYQCAMGKQAMGNIAFNQLQRIDTLMYLLQYPQRPLLTTKTIELVGFDRLGAGQNATVAVMSYSGVAPLPPSPLPSHATPPNHRYDIEDAIVMNKASLDRGFGRCVVMRKYATTLKKYGNRTQDRITRPAEAAAPAGASSTTTTRPGGRFSVLDADGIAGAGRVLTQGECLVHKQVPLNTRDAAGPGGGALPESGYRAAPVMWKGFPGERCAVDRVMVTSNDDSACVVKVLVRHTRRPELGDKFSSRHGQKGVVGCIVPEADLPFSERGVVPDLIMNPHGFPSRMTVGKMIELLGSKAGAVSGRLHYGTAFGEGSGLADRVDALSAELVAAGFSYSGKDLLHSGITGEALEAYVFMGPVYYQKLKHMVMDKMHARARGPRVVLTRQPTEGRSRDGGLRLGEMERDCLIGYGASALLLERLMISSDQFEVHVCTHCGLLGYWDAAARRARCPGTGRADAMATMKLPYAAKLLFQEMQAMNIVPRLVLAEA

SEQ ID NO: 10939 - protein, 667 aa, Chlorella protothecoides
MCSPYQTTQPTTNPHPNTQAEQDEKERRRKEKAEAHLYTLVRVSTDADMASQIGRERWFDLVDHEGVATFKLSKRAPFSALRAEAARALGVPPAAQRFWRWAARQNGTYRPSLPLEPESDEVPISSLRDGRRDLRPGTMSTLNLYLETAPDGGGGVGGAAGGVGAGADGAAPDGGSPGAQDGAGDASRATNTSSTRHPAAARRERHPTLLQAQFVPDPEAPALRYAGSLQVHRHSRIGELAPALRALGGLAPDAALEVYEEVKFEPSVMVEALRPALTAAAAQLENGDVLVFQAAAASLQAPPDCPREHLSAPAYMSHVRNRVRVAFRPLESPGEEGLLLDLRKDMGYEEVSGALAARLGLDHPLRLALTGQNPYSALPRPAPLKYAPGAMLEEMLRAGQYGAAAGSTLYYEVIDLPLPEYEKLVTFKVPARESGGRGGGERMPRVSFHNAKAEEVSAHSVRLPRDARVSQLLEELRAQLPAGAGVGDAPLRLMEVYQWRVWQLFDPDQAVGSMSGDALWHLRAEVVPPDQRGAGGEEGLHVHCLQVTEEAHNRAFAFSDPFIMRVREGETVGELRRRVQVALGVGDEEFAGWRALLCPPLSAPEPLEDEEVVTARLARTDLERLYGHHDRACIGWEHENRNPRKTHAHLNRNAAWYGQERQLKIKA

SEQ ID NO: 10940 - protein, 255 aa, Chlorella protothecoides
MTTPEVTDAEIPKALLKRLIKAKLSTVAGADPTRDYQIHKDALLAFQEAAKIFIHYLTAPANDVCRDARRQTISAEDVLTALNDLDFGEVTGELTEALEGETLRFQGLGPGGVHRSISHDIRLYDDLPASHTDFRTEAREKSKKKAEGKKRKAEDSHPSCSFLPSASETADAGEGEQAGASMPAGTRDTDGAEQADTVHAQPPSQNPEGLQVAQAWVAQAGFGEAGPNPEAPAPPVTAGDSLPTSIAPPAVNPSA

SEQ ID NO: 10941 - protein, 526 aa, Chlorella protothecoides
  MOD_RES (326)..(329): Any amino acid
MRPLSPPGCTLEPCNAGRACCTNTWGCLGAEGVPGCQACNYRSSPSRLSIQRCNPHHSPPLLLPVLTPLLTPRPRRPTWSFSVPKRMTFTSSFSMYCSFSCSTSRVSSATKARSPSSRAAAASWALSARVAAEASREGSSRAVSASSSSPLAASPNSEAGSATRLESSWPASPQGMRFRDFFRCLYRVKSSAASGSSSALFRKAAANFIPPDERNVAAGLGGWGVGQTWAGGSLQVIPSGTRLGAGVYLGGSRYRGCHSAGRHGPIRVPRDMGSQGCSAAPAGDWCLPLSGYGERRVGMLQGLCSLRGITSLRISASESEAVNSKXXXXAGNYLSANQWVGVRGRKFGVGPHSDCSTRRHGIFVAYIPWIHAAPECPKERGGRARHTEPEPHNPHRASQDRHSEMVSATPVLPCPARTSVVKIQPPELKGFMEKKLSSELGNHHSVGQLTATVDLTMLHAFLPPTPHPAVHLNANRHVTGVLRGFDQFMNLVLDNTVDEKLKVDIGMVVIRGNSIATIEALEAIGE

SEQ ID NO: 10942 - protein, 118 aa, Chlorella protothecoides
MSCRDALPPNPDHPKPNQPQAAAARSRQELQRAYRAVVDFHGELLLVLHWSILAYTGLVKVGGHGRCRGDTVGYCAAAQVWPGRWRCVGRPRASSWAPPTDARGPTLPIGVKLHVPCP

SEQ ID NO: 10943 - protein, 152 aa, Chlorella protothecoides
MKFAAALRNSAEELPDAAELFTLYKHLKKSLKRIPCGDAGHDDSSLVADPASEFGEAASGDEDEADTALELPSLDASAATLADSAQDAAAALDEGERAFVAELTRDVEQLNEQYMEKEEVNVIRFGTLKDQVGRRGRGVRSGVRTGRSRGGE

SEQ ID NO: 10944 - protein, 277 aa, Chlorella protothecoides
MGARWLPIRRGCWALLLLAIVSTCRAWNSSNTCEFIEEQPRYVALRADLRLVASQSSLYLGDALASTLQTALGLPPCAIQLSQGTACNPSEAVASCSRPFYVCGEQAMSSDLHALALTGTCLEGNATAVPACDLLIASPDLQDLAASGSCKVACLTPSSGEAAVGFAAAMPPTVNQDTGCTRFSLSVLLSEGEEVEEVSAALTSDATAAAVVGGVANFATRSTQFYATPAGEQWQRDPISRQGLGPLKPCVSPETQAASNLSPSFLICVASVHEQAS

SEQ ID NO: 10945 - protein, 587 aa, Chlorella protothecoides
  MOD_RES (25)..(35): Any amino acid
  MOD_RES (119)..(122): Any amino acid
  MOD_RES (225)..(228): Any amino acid
MLWPGSGRRPVDSLAALVVEGCAPXXXXXXXXXXXHPGTDLVIVSRASFSPWSEDGSDALPQFFNNHNSNAISFHRIRHFRAYANAEWANEQALEEVSRRLPPHPLRSPPPTQGEYSGXXXXSGPTSRLLRRAHAACRPTHSVSRLPRRASTLAQSASPPTRWGAWCRPCWATPRPARCSSWGSPRARPAQQRARPARLRAPRPDAPEAGPGAAPSAGPRNTRRXXXXPRPDAPEAGPRAAPSAAPRNTRRWRLGGRRAVLLPFREPRQKPIHQYPSAIFVLLSPHVPPPFTRLIAHPHALHKRNFPLSIYTQKPCPLIFISGTSRVVLRLVYRTQTSHVHPNVDRPRPSWSESWEYRGPSHGQVARAPGRDVQARRRDAACAAGPEQETGAVCPQGRELEVGPKAELLCPPWGLIQTWKLACTLWSGPQGFFATPIRSSDLRRRQAQLESQSTVVDDALLEKIAAIEALEIQLLSAGVSVPETASPSATPQCLRVVEQAWMPNRGSPVFPREQPTSPGCRFIDIPTPLTGWMRWRTVPVSRCLYKLFGGTLEEWQLPFPPCCPMHGRHSDPNQAKRARSHSWVKDR

SEQ ID NO: 10946 - protein, 188 aa, Chlorella protothecoides
  MOD_RES (5)..(8): Any amino acid
  MOD_RES (63)..(66): Any amino acid
  MOD_RES (176)..(179): Any amino acid
MALRXXXXRACQGCGGAAVEGQGDHAPARPHGAAPSLGRRAVPWAPRVPWAPRVQAPVCHPQXXXXPLGAECPLGAKPPGTCLPSPVPPASRPPGSNVYGGVDWVAMAMSGDEGADLTLPESWTMSTPLGNPASVYANEMRVLFDVAFRPDKGVCGGGRGGAPWRDHNGDEEGGRXXXXRLPAGQGGV

SEQ ID NO: 10947 - protein, 266 aa, Chlorella protothecoides
MFSATWPNVIRKLASEFLSNPARVIIGSQDLAASHSVKQVIDAPARDARLHALLQQYHGSRTNRVIVFVLYKKEATRVESLLQRKGWKAAAVHGDISQAQRSAAVDAFKAGTVPVLVATDVAARGLDIPDVEVVINYSFPLTTEDYVHRIGRTGRAGKKGEAVGPSGPTASCLHITLPPQPSHASPLNSPIMTPGLAHTMFVGANDKPRAGELINVLNEAKQEVPASLFQFGTSVKKKESKMYGAHFKDVDLTKKASKISFDSDDE

SEQ ID NO: 10948 - protein, 241 aa, Chlorella protothecoides
MSTDAVEKAERKRLKKEKKAAAAAAAAATGAGPSASTAEADPTPSKKEKKEKKKKKREEGSEAAPAPTGKKSKKAAPPAGPAPLAEVGDRELVAKRPPLVKALYSETAEVASQSDAEVAAWREARAIVVEGCSLRPITAFAQTGLSSTQLHAVRAFSAPSPIQAQCLPIALSGRDAVGIAATGSGKTLAFGLPALAHIAAQIGAGVVTGKKPIALVIAPTRELAIQISVVLEEAGQPCGIR

SEQ ID NO: 10949 - protein, 450 aa, Chlorella protothecoides
MYSIAMTPRLSSCSRTGGAGADRLAAFRPSRGPQRPTRAARQVFAKAVATPTKEASTSASKSASISSETAKELYRDMVLGREFEEMCAQMYYRGKMFGFVHLYSGQEAVSTGRAVGVSMRIEVGARPAIAAHLPGSTSLDLQACLRKDDYISSTYRDHVHALSKGISARKIMSELFGKKTGTCRGQGGSMHMFDAEYGLLGGYAFIGEGIPVGLGAAFTSAYKRRVLGDDGADQVAVNFFGDGTCNVGQFYESLNMASLYKLPCIFVVENNRWAIGMNHLRATGSTLGDEEPWIHKKGPAFGMPGVHVDGMDVLAVREAALEAVARARRGEGPTLIEAETYRFRGHSLADPDELRSREEKEHYAARDPIPQLRAYMLKHGLASEADLAELHASVAAEVDDCVEYADASPKPDMSQLLENVFADPKGFGIAPDGRYRYELPGFTAGTAEVS

SEQ ID NO: 10950 - protein, 569 aa, Chlorella protothecoides
MGRLPCHAAGHDGSQPRPLICPERSPLNTSAGMKSRLQVSQSQHNNRGEKSRNGLTARSILHPPHARGVLFPEAGALPMPNRLPADPYQESQETSGRLGRGCSGIQPGGSEPFLMGQIFRAVGRRLRPALPRERGGNGGGWMDLGAPPLRVASWMPWVTILTTAGSEEDGPCNPGRTLARHPPHTHQQIWISPDTGLGKELAALLSSVGSSSEVTMVLILTLFGVVHSGLAALRPQGELELSAVVGRRGVWTRQSATPGLSQAPLRPQDHFGADDPRRSQNPLAHSHHRHQSRHHTHTGEALIGARAFRVVFASLSLPLAGLAVMYFINHRYDGVALWNIRRVCVLWGMLGLKGCAGGACPLDARVKAHASRFCMPLSVSTPLPTHKSAFNPPHPPKHARHTMPRGLPGVHSTVWALSFLSFYFLYPSTFNLLEVAAVDEPRLHLWETGVARITRHPQAFGQFVWCAAHAAWVGSSFMMVTTAALLGYHAFGCWHGDRRLEREHGEAFRALRDRTSVVPFQAVWEGRQRLPPDYWREWARLPYLAITLFCFGTYAAHPAMQQAAYWLGW

SEQ ID NO: 10951 - protein, 87 aa, Chlorella protothecoides
MGVGCTIVHHVAAFVQIALAVAIAVIVGIKLFRVDVSGDGEDPTVTSTCLLGEDYDNESLCVYCCTCHLCGLGAILDTIFAAAGTAW

SEQ ID NO: 10952 - protein, 371 aa, Chlorella protothecoides
MAIHSRIPMIGFKVCIIKPALPSSSMSQGQFEAALKLAPHPPNLAAIEASIYLVGQRKESEDVVMAFRSSKGVCQGLGECLQNWGETTLSAASTLPDDVLTCEVEAEAQTRACALFRRAVHAYGAAVPCDQPSTSAAATPCAAPSTSAAPRADVAVNCANTLASWAEAAVEGQEGPRQLLAQALHLYRAALSSEPDALTWGNLADAEVATAVAAAGDGDGAAAEACAERARAAYATACQLSSTDNGDDLPGLLANWGTGLVALAGLMQVGADGGVNGFPLTLGSPVHILQPSTYQQDSATKLATLEEAVQRLRESASFDRADPAPLCALGDAFVAAAEADADGPATLRALCSALEDGYGAALRVDARHAEA

SEQ ID NO: 10953 - protein, 197 aa, Chlorella protothecoides
MPIFTYSTLVTEAGAAVLTLAAACIEGSTPRHDPRSAHYGLFQWASSASYFPKIAYLAVVPGILGHTGFNALVKYMDPLILTLVGTMEPLVGSFVGHAMGLVELPHPLTYIGGAVVLASTVIVSVAGHHRAGRRPVRLCEGMRRPSPRRHRFIRKTSNDQHVLFSMLLHSDDRQRPVDLRHDAWSLWTPNLCTGAVT

SEQ ID NO: 10954 - protein, 142 aa, Chlorella protothecoides
MTTAIMVPAAVFEVVAQMDTNTRWRLARAVWTLLLNGSLLALHFGLWVLSLKTTSLPHAMLFVCMAPVIVALSMWIMRQPISWGKGNLGLPGRSRRGTSGDSTCCCVVHHIKSMSNSLLNPRLQPPNRACPPAPARMLGSAD

SEQ ID NO: 10955 - protein, 33 aa, Chlorella protothecoides
MDGEGWIPVRAIAAFNRVRMLTPEPGLIAQAMQ

SEQ ID NO: 10956 - protein, 510 aa, Chlorella protothecoides
MIYSLGPAHVPTTAGFPIYVASVNAGPRPCAPCRSRPAPPPPLPLPSRHLTPPPPQNSRCLFTLLGHLDYIRTVQFHHESPWIVSASDDQTLRLWNWQSRTCIAVLTGHNHYVMCAQFHPRDDLVASASLDQTVRVWDVSALRKKGAAPGGAGPPSDDSMRLPPINSDLFGGSDAVVKYVLEGHDRGVNWAAFHPTLPLVVSGADDRQIKLWRMNESKAWEVDTLRGHVNNVSSVIFHAKQVCWILFPFFCLGRASIVWTAGTIGAPSACPTADSVDARAPPTPPQPAQDLIISDSEDKSLRVWDLSKRVGVQTFRREHDRFWILAGHPSINLLAAGHDRDAGLGPVEAVIPFAHRSCGVPSTPLAAVPPLRLAAVSQSRGRAQYRHTLTHKSNPLSIHSIPSRPRPQRHDRVQAGARAPRLRAARRHAVLRQGPVRALARAGQRARRAAVRAAPQPGGGVQPGRARAGVQPGRALGAGLERRGRRRVRAVRAAARAGGGQGRRRGGGAA

SEQ ID NO: 10957 - protein, 633 aa, Chlorella protothecoides
MQLTVVAEIDGRVLLVDKYLAHPRIQLDGSDELSTLTAIVEAETGIPAAAQRLTLGSRTLQPDQTLGAQGLAEGDLLMLSLAPTGRAPAPSQNPSSLRAFLRPDGSAEDPGALLRMLASNPHALSQLPPELARAVRDSDIPAFQDEMRRLTAERVRADEEEARFARMAAEDPFNPEVQARLEEAIRQKNVAENFEAAMEYNPEAFGNVTMLVSMGRTSPCHAAKPELLTQFPVPLLLAQVCAHASKWGGPEDVRGQRGPGDHHVTVLCGALRPAASHGYPLPGHGCGRGLCQDPRPIFARTGRIHMAPLLAGGHHLPISIAILDNLGQDFIFGLDNLRRHQGHSAGYKPRGARSGMCEHMHRGGLWKTKTALTPATLQCCVDLKAGVLRFGSTEAQLPFLPEHEIPQGEPERNPMGGLSASNNAGVCICAGINKVCQASADAVAGALRLNRAETGGAAHLKGFLPLHALAKVLYRPTPLCIVVWRSRMLIFPLLHRAESHHGCQCAAGNSKPCSRDPSVRTTRRCGPDPACADRGASWVGGKGVETGGAGILKGAEPGCPQIRPGKRGRCCIHPVHLIGLRNVGGRAPFSAPLNPAACWAVPASSIDVCTSLWPGTLSVTNQAGDTIFQGWWR

SEQ ID NO: 10958 - protein, 438 aa, Chlorella protothecoides
MRATAHIHSPCRPPFPGRDVDRSKIGALAHLWTKSWCPGSGPITAEPPGPSTSKGILTDAGVPAPQAQSCVSCETFGSPLLRTSAARMFPGPGDSRSAYPAALQSHSGRWALYLARRVLDPCVRGAVMEYLLSCKVVGYSELCLHAGHSQRSITSWDMPLDSSLCLTKWYSQQYSLPCDPSPQPLHARLREPRAPLPPLRALSPTPAASPPPTLDPEVEDARERLRRAALSCSRWGWLSFWVQLVLCTVAAVITLFSMAFTSQVALMYNRPGGYGSPGDMLLKTLGGQVQAPNLSACRNSAKSPAGSRTTHPEHALPSYHHYPPPHPPLSPSDWPWRLPAPQPVWHCHGLPVHLLGVWVHAPLAPHVPLSGHWVAPHSAVRRHRDPGEGGIAGVTRGLGACRRINNWMSGRMARKGCIVEGPAHACFGEQCGSMHGQC

SEQ ID NO: 10959 - protein, 83 aa, Chlorella protothecoides
MKLILRFIPMYYKHVKAERKTLLVRFFGVHRVSPLLGRRNALPTHLRLHRRYDLKGSRYGRTAGAERETKPFVTLKDLDLDVR

SEQ ID NO: 10960 - protein, 198 aa, Chlorella protothecoides
MRRGKSAVSMRVYDNGKLEKEEILEVAGPSHKTKASRKERKKAKETYRSPRPGEAVYRGHRSFDLVQQLQLGLTYSIAQSRSQVGRLGGSGMVGCIVGGKCIMQASTLPLQAGLGPAEWEAHTSRSNVMSPTQVHAQEAFQQPLHPQKDSGNGDADLNGEEVKKAAIPATGSVPGFVWKDYLPSLFQALREAFGIDNG

SEQ ID NO: 10961 - protein, 192 aa, Chlorella protothecoides
MLPAGEELPAPLPRGATPASLLPNQRVAGYVRGAGPAGVFLALGRALDGRLRLSKLNAEGSRVEDVQAAFPVGRLVLASVIRVQDGKVELTRKARKTRPERDVAALGRLAVGDAVKALVRRVENFGLILDLEGGASGGWAGRAWWAGCIDGGGKGGSSWWIWETVKSGKAQGGHACWQTTVHWTHSMRTEDQ

SEQ ID NO: 10962 - protein, 667 aa, Chlorella protothecoides
  MOD_RES (528)..(531): Any amino acid
MIPAAAATSLEFVKGKPEPSVPEVKLTRSRDGSSGVATFRFPSPSVFQEEADMSDITGLYMNDEEGTLTTVEVTAKFVNGKPDAIEAKYVMRSRCVDVGRTSTHATAHARPAGTHLTQSTTDTRTPLSPSSAVPSSGTGSCASWSDMQRSRGWASPRADHPAWACSSKGLLPPRRQAETCAHWAGCWVGAFGKGLLGSMRRCNSGTKWPSWDDLHRPRPGPLALDEEDGRPQCGDACQAGQDGNHCRGPPLPPGPWGAAAELGEEGRSQAQDGGPCGLDACASWGPCIDSGCTDCELGLQREGRPRVNAGRDQTPPMTTCTPHSTRSPCVRYRSAEGGTARYSAAASLASASAPGPEGDRTLRPFSAAYTAGPSEPHANTACLQLCSEGSWQGVVGGVQKWWRVASHVTESCTSAIHVPAHTPCCVQQTPSPSFRCPALTPPAPLDSHCGQVEGHEGVGGEEQVEEAAYLVQVCHVVGKPGEVPAQREERDLQGRLVQGKKVGVQLWVSLLGGETCNVMDGGVWGRGXXXXKRRREPDPSGRWCSEFNLPACADPWVSFIAPCQFPFPPPQPQCEWPSYRAQQGVQQAEGLRRRQEVGPRGIPQVSHHQLTQHGGAARLAQREQEHGRDVVQALVVPDIILVPQGAQEDTAQGQPLECPSLLGPACG

SEQ ID NO: 10963 - protein, 489 aa, Chlorella protothecoides
MCAAGVVSPKRETHPILPPLTTPPTLSPPGEELKEVSGALSIVDVDFNYPARPDVPVLHGFSLEIAAGATVALVGESGSGKSTVIALLERFYDPTAGAVLLDGVDLRSLQLRWLRRQLSLVSQEPMLFATSIRDNIALGRAGATDAEVEAAARAANAHGFISALPSGYATHVGERGVQMSGGQKQRIAIARAILKAPKVLLLDEATSALDARSEYVVQRALDALMRACTTVVVAHRLSTVVGADVIAVVGGGRVVEAGTHAGLLAAGGAYATLVGMQRASRRDEAAVRAYEAEEAEEDDDDSGEGVAELGMAGSGRAASGGLVPADFGAPRRVASRTTSRTLSQPGSPVGARMDSLVGAADPAVMAPSKALTPGMTGTAAIGGWARFWKGVGATKGGKGGAPCVPRPHQRPDEAKPKAVSIGRIARLNKPELPALFFGLIGSGALGFMMPAFSIAFSSLISLFYTVGEGESGACHVMGGGRFPVPCSPK

SEQ ID NO: 10964 - protein, 1027 aa, Chlorella protothecoides
  MOD_RES (24)..(38): Any amino acid
  MOD_RES (429)..(432): Any amino acid
  MOD_RES (618)..(621): Any amino acid
MLATPQPALRPGGLNPPPPPPPPXXXXXXXXXXXXXXXPGGAQGRDPEVVPGLPGHRLGRHALLHHPVLCFWAHGSAPGEARARAHDDRAAAPGGGLVRPGVQQQRRADQQAVHRRPGGQGPVRRHHGTPHPGLAGATDPGVHLLRRCRPLFPPPSIQAHVLTAPPPSSTEPGDLHRRVRAGLQPRLEDDAGGDVGGAADRGGGLDPDQVHQGRGDARGRRLRLLQPDRAGGGGQHPHHRRLCHGARRDRPVRGPAGGADTPGQAPRPLRRPRLRLLPVCALRCLLPGLLVRRPAGVARRVHPGGGAQRVLRHLPGCLWRGPEPDVLPRRGQGPRRHRARLRHRGPCPRDRRLRPVWRPHRRLCGHHRAGGRQLRLPPPPRRPRLPRLLPLRPRRPRRGAGGRVRVRQVHGRGSRGALLRPPLRLGAPXXXXGSGKSTVVGLVERFYDPLSGSVRLDGRDLRELNLKWLRSVVGLVSQEPVLFTMSVADNIRYGRPDASMEEVEAAARASNAHKFVARLPEGYHTLVGEGGIQLSGGQKQRIAIARAVIKDPKVLLLDEATSALDAESEAVVQEALDRLMANRTTIVVAHRFVAMLFRWWWSVGNRSGVGLDEATIHXXXXHTGDHPRRIAVPGPSARQQPKPPTSTPPPTSHITHSPTTPFPQVEHHPARKQHRRGVQGRDRGERDARRAHGPAPRRLRQAGAASADWAERLGCEALDAFACEGGDMRHPAFQNMNRTARRGAEVSPNFILCRTAAHLHPPSFPEIRQRSPPVCTPPHSWTRPLHFWPLPRSPVDPGPFCPESKTRQAAGQVHATKIKQRRGAAHCTAPGRCHSPASRQWGPLPRPLLCAQAVHAIVDGPDESLRRPHAPLFLLLWGNTGPQVQPQALGMDARGVPLLVPGIVGGGDRQAARGGAGIGDAVAAQLGCAFQPGSPEGQLLGGGVCGCRRLCQTWDRGGRGVMGVGFLGARLRGQWGATVRAAQAGHGIPRHTGLCRGGGVDVNQGHVLLNGCQQGVVRGLPQGKHVS

SEQ ID NO: 10965 - protein, 532 aa, Chlorella protothecoides
  MOD_RES (149)..(152): Any amino acid
  MOD_RES (237)..(240): Any amino acid
MHVPLHGGHDDDTRVVAAGLPAPRLLLLDVGDEVCHRALHHPRRLDDLGQEHLARAEEVAHHVHAVHQRALYDLDGVGVGAAGAALLRVRHHVGVDALHQRVLDALGHRQVAPGVLRLGGEGGRCGCSVSFMCVAGGRQEKEGRRNLAXXXXRGVGAGVLSASCVLQREDRKRKVEGTWQGERAGNLRVEADDRGPHWAKNGQLGAYASRQTPRCSHILRPVYSAGQAPDPPALTPXXXXGSTLGEERATGCMRKQADTTMQPHPEASPTNCPPPPPQPQLPTPNQSTRLLLGSGRAPNLTLALDRGGVALGVKQRRIVQQALSGILAAVQQHVLHQLQQLLVQQLILVGNHLAAWIFQREKKIAWAHCTPDPPLIRRPTLPASTHPPHLGGIHDAHVHPRRAGVVQEGGVEGAAHGLVAAEGEGDVGHAAADLGAGAQALDLARGADEVHGVVVVLRHARPHGEDVGVEDDVLRVKAHLLHQDLVGTHADANLCRGKDLRKEGCMQAAGVVFRVEQGSCRARHDAALRAAE

SEQ ID NO: 10966 - protein, 272 aa, Chlorella protothecoides
  MOD_RES (224)..(227): Any amino acid
MRSTFLNIGERCNVAGSSIYKKAIVDGNYDKAAAIAVSQVNQGADILDINMDDGLIEGVGAMTRFVNLLVSDPEVSRVPFMIDSSKFHIVEAGLKCCQGKVIVNSISMKEGEAKFREHAAIVKRHGAAVVVMAFDEEGQAATFEDKVGRLWSRRRINSGVHLVEHAQLSSCGSLPAPPFPPAPLHPTMQVRICLRAYRILVNEVGFDPQDVVFDPNILTVGTGXXXXSPQPCVHLVGQGHSELHFDERRRGQVPGACPARASPWGGRRGHGL

SEQ ID NO: 10967 - protein, 88 aa, Chlorella protothecoides
MVAWEKILDAAVEHNADVIGLSGLITPSLDEMVTGSAVRSGALGSRGFGVKRSVYGCPQLRRTLQAHRVGPCALAAGVKLGCLSPSAS

SEQ ID NO: 10968 - protein, 145 aa, Chlorella protothecoides
MDMGIVNAAQVIADKYELIDKELLGYVEDVLLNRREDSTERLLDFAALLDPKSPPTAVRRLKEESALASLPPRVNPIAPGVDTLAPEADLPPVPKYTPYVDRMRRTEAFEQLEELLESRICFIDGAMGTQIQKWKLTEDDFKGDR

SEQ ID NO: 10969 - protein, 163 aa, Chlorella protothecoides
MWLHRGVCLLAYAPSCPFFAQCGPLSSASTLRFPALSPCQDSWRDLPVTKRIEHALVKGIDTHVVADTEECRTCGAYPYPIQVIEGPLMDGMNVVGDLFGAGKMFLPQVIKSARVMKRAVAHLIPYIEEEKARSGKTGSDNAGVVIMATVKGDGWAPSFGLES

SEQ ID NO: 10970 - protein, 616 aa, Chlorella protothecoides
MPGHGPHPPPTNQPATHLGEESHGVAELALDRQGVGGQLAGQHAAVVGLLVEPAHLLAQQRGHHEHAHALPQALTHEPKSIGLDDGEEHGAQADAQEDQAPLPGPGLELLRTPWAQRRLRSRQHDGGWGFATSTSLGAARHRKPPPTHNMTCPTLPLTDGVEEGDEGRKGDGEGGHHEAQRPRPDQAEEERGQLRLVQARDAPDRHRLGLGLVGALVRARDAWRAALPTLGGPHALPEASPAADGRRPRHAWGQGLGWGHDRRVGGAHQTVHARADRRTGLRQRARGGPRGDAPRRAKVGRHQAAGGRAPRPGHAQLSHALPAVVVVLLGLLGLVRPHRRFVATAGPLHAHQGRVGPARSQQAGVRPGLHHAPAAHHRDHVGAHHGGQAMRHHHGGAGAHERVQRALHHVLAARVQRRRGLVQEQDLGRLQDGARDGDALLLPAAHLHAALAHVRGVAGGQRGDEAVGVGRARGGLHLRVRGPCPPQRDVVADAGGEQHRLLRHQRQLAPQPAQLQRAQVHAVQQHRAGGGVVEALQQRNDRGLAGPGLAHQRHGGPRRDLQAEAVQHGDIGAGGVVEVHVHDRQRTRHLLQLLTWRGQSGRGGEGREDGVGLTLR

SEQ ID NO: 10971 - protein, 114 aa, Chlorella protothecoides
MPSRRTPYCPLTSTAAHTQGIRPAPGYPSQPDHTEKQTMWDLMDIEARIGMGLTESFSMTPAASVSGLYFAGAASQYFAVGKISTDQVTDYATRKGMPQQEAERWLRSMLTYEP

SEQ ID NO: 10972 - protein, 224 aa, Chlorella protothecoides
MGLECTAFQALPTTWEATLHHFCTPPTTPCHEPSLQSCRQAVFACGSDGPAVYAALKGLKVLSPSGPGADALARDAAALYRAVPPSALRYLDLGQAVIPDAYLVQGLWKVPAQPLDRTQGGHGRGLVPARIHPRPALPLQPQLTVSATRVDAWPPTCTGIKAARATILRLRATFLPQLRGSSPGARRKRRSAAVVAVLSSLTSIAALGAAILLIQGQRAWPGPV

SEQ ID NO: 10973 - protein, 182 aa, Chlorella protothecoides
MADHPGQRKFVAGAIGPTNRTLSVSPSVENPAFRGITYDEVELAYYQQAKALYEGGVDLFLVETIFDTGNAKAAVFALERLFEDLNVRIPVFISGTIVDMSGRTLSGQTNEAFWNSIRHAKPMAVGLNCALGASDMKPYIANLAECVDCYILCYPNAGLPNAMGGYDQKGHEMAEEIKPFCE

SEQ ID NO: 10974 - protein, 279 aa, Chlorella protothecoides
MEERGLKLPLLIGGATTSKMHTAVKIEPQYSGPVVYVLDASRSVPVVQSLLDVRAKAEFAVDVRWKKERGNGAGEGGMGRVRVMHHVLVLLASAMPEQYAELRDEFYAGLEDRRYLTLAEARAAAPKVDWASAENAPHTPSFTGVKAYEDFPLEEVVPYIDWNPFFQVWQLRGRYPNRGYPKIFKDEAVGPEARKLFEEAQAMLKVPEGWVEGAGRRLVLCAGVDQSAIWRESQGCLPMTLCTPPKPLAPSKRPSGHHRQQEAAPRWRGGHLPRQLGGR

SEQ ID NO: 10975 - protein, 80 aa, Chlorella protothecoides
MGVEPLIEAFKEAGDDYSYIMMEALADRLAEAFAEKLHAIVRQELWGYAPDEDLNVDDLLKVKYQVRETGLPQGGCAVGE

SEQ ID NO: 10976 - protein, 158 aa, Chlorella protothecoides
AGSQDADEAGPGHISAGVVPEAGVSPHADQDASTQPPPSSASLERHLLTGHSGTVMALCASHDLLFSGATDCSIKVWSLQSLACVATLRGHRDPIRALTVCGTHLASLGAKTLRLWALSSDFTCASVLAVADVTGNAKTVVAPCPAATASAAAWVYVG

SEQ ID NO: 10977 - protein, 115 aa, Chlorella protothecoides
MATPGTPSTAVQTWDLLPRVFQYLLPLLGAELDSVRSAAADTLGGLLEACVDAAAIRAAAEAPAAGRPRGLHALVSALESALSAHSEAGWPGALGLCARLFAALGREGAEAAAPL

SEQ ID NO: 10978 - protein, 478 aa, Chlorella protothecoides
MFAITTIKLILWYPRNQAGGGRGSPVACRVAVRCSSGRRRRAPCTSGQQGTAATFCGECKPTVLAAMRFHARNGYSTTAVLVLCAIAFFTGIMVQQYPGLPSAGRGLTVEREGGSARSLQQEESVPAVSTTGPTRNWTSFEELLEWSGMLADRPVLQSGETGLDHYVVQRQGSRNPGASLLSFHPNPSLDPTLHTQPFQLLSIYPRAYIFPKFLSEAEADKMVELAASRLAPSGLALKRGDDPNQQKDVRTSSGTFLSSGMDKTGTLRAVEEKIAAVTGVPSGRDSTQTLTPPRCSPPPNPSAYGEPFNVLRYENGQHYHSHLDAFPEKDYGPQSSQRACGWQGGGERACVLLQASAGAGWNGVHMRQGFLIQYSTLRWSTMPAPQMVWLGTSASDIHSALPLHHPAQIATMLLYLTDVEEGGETTFLLEGKDGLDRLRNIDYTKCDTGIQVSVGGRRGEHGHLRATESTQPPPAWPR

SEQ ID NO: 10979 - protein, 103 aa, Chlorella protothecoides
MASSPSSHTPPQDVSGWADDSPRYASIPSNLEAQLMPFQREGVRFALARGGRALIGDEMGLGKTVQALAVAAAYRDAWPALIIAPSSLRGAACSFELGGGFVL

SEQ ID NO: 10980 - protein, 1225 aa, Chlorella protothecoides
  MOD_RES (54)..(70): Any amino acid
ARRRAREASTPASAARASASGTPGAGRATSDSPATTEMVQGQTMAKRRAWDTAXXXXXXXXXXXXXXXXXCRRGRHRPVRGHPGRGGGSGGRGGRSRVLGCRADARRTGRTATPGWGDGWHPPRPAAGCAVGDAIGVARGVGGRWEGHDRRAARQQQAVRHAPGQRRGRAPADVAVEGYKPATRADVGHRRGLDTGRRGAMLQRHIGARDPAADLRQLVVGHARTARQRGRPLEQRLEPAQGQHRRLQVGLGQPEVHAAAGLRRRLLLPRASLLQGGQALLRRLGGRGHGLGGLRRGRRIGPDGRGGGRDVARRDVVAQAQVEGAAAGVATEHVDVGQLLPHRQAAGGLSDLAQERAVACWIGHGVAQALAAAHAPAAVPHQGQVVVGEQPEAQHPASLRGLQLDGGGQLARHPAHADLDQGLGDGAQQRARLRWRERGWGESSPATRSGGCPPHPPPGMPARSSAVLAHSCAMAHLLRGDHGRLVRREPGCSQHHGHLLAGTRVLVDQPRLQPTIWNCRSRHDFGHATEAHALAGVPYGELRQRHGVPERAVAVRARLHALVAHATVLCQPVLKREPGRRGAGFHGALWRRAQYKFSSAYGVVRGASTGAVLTPRDTLTRRYLIRWGAIPVTGPASMVSALPRGCASGRYRVSSETSGKTRLSAQFRGLCSKRLGRESAVPGTPRSAGISPTSGCVRASRRESGSGGVIHRTKYLYVIRGPPDSAIINVIPLASPPVLTLLGRHEVTLQGHPLPRWGSCAAPACRRAEAHPWHASGLGLGGGGQVHHLLPGEDVGLVVAAKVAVRGGVDVAVPTPLQVQGLADHARAEVELGQHQGQDLAVGDGARAVGVHKHGQRLRHADGVGHLDQRAARQLPRHDGLGRLARDVGAGAVHLGGVLAGEGAAAVRTPAAVGVDDDLAAGEPGVAVRAADDKAAGGVQVEDGAVVQVLGGHHRLDHVLQQVGVDLLVGHIGRVLGGDQDGVHADGHNCAAVLAGRVGAQRGDRAVPFGVEIKIPVPKKMLRERPGSGICMRREQGGATAGTPSPASFNPPPPEQPPYLGLAVGAQPGQGAVLACLGQPVAQLGGQDVGQGHQLLGLVGGVAKHVALVARPRLLQGLGAHAVHALADVGALLLQVHQHLALVGVQADVVGGEADVAHRVAHHLLVVHLGGGGDLAEHHHHVGLGGGFAGNLGLGVLGQAGVQDRVGHLVRQLVGVTLIHRLCSG

SEQ ID NO: 10981 - protein, 568 aa, Chlorella protothecoides
MPAQQDVYPAWAHSPEDVAAHFNVDLDHGLSDELVAKQRALHGFNELDHAPATPLWKLVLQQFDDTLVKRPAIHPADECHAVVPKGKPFPPPISLPRQILLLAAGISFALAWFDEGEGAGAGVRAFLEPAVIILILVLNAVVGVWQEGNAESALEALKEMSAETAKVFRAGHLVPDLPCRDLVPGDVVEVHTGDLVPADVRVVRLGTALFRVEQAALTGESAAVSKHAARLAPAACELHAKDNVLFAGTGVAAGTCRAVVYATGMRTEIGRIQAQIQAAAEEEGDTPLKKRLDEFGEALARIILYVCVAVWLINYRHFISWKTLPGSAFLPDPASVEFSLAKATFYFKVAVALAVAAIPEGLPAVITTCLALGTRKMARRNAIVRKLPSVETLGCTTVICSDKTGTLTTNQMAVSHVVTLAGAGGELRTLDVTGTSYNPADGEVRGLGAAASGAGLDAGLAALAATAALCNGARIATKHGHAVAVGQSTEAALLVLAEKLGAPDASERDDAAARAPLPEDGEVELRACDAYAARCADAVLVAARPGGCCVTLEASVEGPLGGRGGGPC

SEQ ID NO: 10982 - protein, 426 aa, Chlorella protothecoides
MTTDTFLFTSGYLFEAGVSTIGGRAPPCSPQPITPSPTAESVNEGHPDKLADQVSDAILDACLAQDPESKVACETATKTNMVMVFGEITTSAKVDYEKVVRDTVRNIGFTSDDVGLDADKCKVLVHLEEQSPDIGQGVHGMGTKTLEETGAGDQGHMFGYATDETEELMPLTHVLATKLGYRLTEARKDGTLPWLRPDGKTQVTVEYRKDGGAVVPIRVHTILISTQHSPDVSNEKIHADLLEHVIKPVVPAKYLDDRTIFHLNPSGRFVIGGPHGDAGLTGRKIIIDTYGGWGAHGGGAFSGKDPTKVDRSGAYIARQAAKSIVAGKLARRALVQVSYAIGVPEPLSVFVDSYGTGTIPDREILALVLAKFDFRPGMIGKALDLKRGGDRYIHTAAYGHFGRDDKPDVFTWEKVVDLTPAAEAKA

SEQ ID NO: 10983 - protein, 195 aa, Chlorella protothecoides
MNCTSPASYTARARRYIRNMRPHSPPLPGNQPIDPRPGVVELFDAARKDGLKVAVCSASTKIAVQYALQNVLGEDRFFSLDAFLAGDDVAEKKPNPAIYKVVSHENACQPNRSPPWSPQEAAEKLGVDPSACLVIEDSAIGLEAALRAGMRCVITYTHQTASQSFAGAEAVVEDARKLPYTDLVEGKLSGVDDRV

SEQ ID NO: 10984 - protein, 443 aa, Chlorella protothecoides
ALGAAPESLLLAASPGGGLTLAVGLATGLLLRTEVDPVTGALSDTRSRFLGTRAPRLFRVALGGAPAMLALSSRPWLGYADQGRFALVPGSHAALDWAAPFASEQCPEGFVAVAGGQLRVLAVERLGQRFDQRAVRLRYTPRELLIHPDHKGVVPLREQEGLAEGALAVPEAAAELGPPPLPDGGAAAEPGPSDVQFHAVGLEAGEESAAALDQVGCPTGLPGRWGSCVRVVDPLALATTDCVELGGNEAALCAALVGFEGEDALVLAVGVARGLSFYPKQSEGAVYLKLVVFWGGAGSWGRGCQRGGHERSEGGIQGETPGPGWGAAAATRTDDQPSGGACRLGSVHGTPIVEHRRLALQCYFGHAWIPLARPLIPPPHHPVSLHNSPHPRRRHPHLPLRPWGPGTGAGAHHTPRRHPSGHGGLPGAAVGRGGGLRPPLRSG

SEQ ID NO: 10985 - protein, 304 aa, Chlorella protothecoides
MPAGPRGLGCVDASATACLGMHPLAARGLDPSCAPFDECHASLLRTLTALLPPFQPPGGGDGDGAAAWNAAAGGAGSAHLLHNPGWPGHPVPLCQPRGPRLLPAPGAAHAGGGPAATGPRPPCLQVRMPGSRVAAEPGAAAGSQGCSLPQPGPLCPVSCERGAPSRPVHGVYHASTPAPDRPLSRSAYFPVKSVVDGDICEQFAQLPIDKQRQVGGMRGRWGRQGPDQGRECEWQGRMDWPVPPATGTLQAPGVVSGIAQAHHPALPSDRERAGSQPRGSAQEAGGCAKPHNLTHAPVCWAPNL

SEQ ID NO: 10986 - protein, 389 aa, Chlorella protothecoides
  MOD_RES (118)..(121): Any amino acid
MIKLFSLKVGKVSSGRFALGNCCSDLENTSFTGEAKADGRYRDKNPQAVPRRAQATESSVKISFPNGKEKIMSFDVVLTPDEGMYRGGAFLFTFTVPPTYPHDPPKVKCLTKVYHPNXXXXPCKPENRCPGVIPSSHPPLQVYHPNIDLEGNVCLNILREDWKPVLTISSLIYGLNFLFLVRGVGLRSGRGVEIALLFAWSRGIHIAQRLASIKPSALSHAGTKSGRSTEQRGGRGHAECAVYICTARFCDHHAGRHHRRGVLPSGQGNSIRTSPVVRPRGDAAEPCRTLGGPVSGSEARKLGVLRACTEHSKQTHFRESHSGASRGSERPGTLSRGPDSTAARVSYIRPGRLELIKRSAQGFDPGKNACRPRGLVRPGRRNLSLSHRW

SEQ ID NO: 10987 - protein, 343 aa, Chlorella protothecoides
  MOD_RES (47)..(50): Any amino acid
MVIKEDGILGLMGRGLKTKILANGLQVGQHLTLRRLHDPWAAGVAHXXXXVCVDHEGGECEVRIRVSLQHSSSRSSHGVQSQTQNAGCRSKTYLGQDLVQLPATLKSLNPEYRCPHLRLPRCTVQPQATPPATHAVEPTAANPPGEVSGPGGGRSRQSSVVQDADAAGPDLGHEDGDAVLALHLHGGLQRVHGHEEDAEAARRRRRRCSLDGDGQILGGRRLVEQREHAGVGGGVPEAAHGALNEGGADAAVEAEHAPLLVQRLHGGRGGHAICGEGRGVAQGGVQDHVCQDDALAVHSGYHSPGPDQLWLETGRLGTGRRHPSPKLTPWQSRPWNQTAMPDH

SEQ ID NO: 10988 - protein, 231 aa, Chlorella protothecoides
MADETHTRKRTFRKYSYRGVDLEQLMDMSTDELVELFAARQRRRYALSHLGVGRKVEMGFRSVPHSRARPATASPSRAPCGELCGCSEMQLVISRLSHKRLESSAACPSLAMPLAHLWTCDTLRALAASAGLPCPPTSQLARAQDELPPSTFQRGLKRNALALIKKLRAVKKDTPAGEKPEAVRTHLRNMIILPEMIGSIVGVYNGKTFNQVRAGVLQLSCTAGGKGSSPW

SEQ ID NO: 10989 - protein, 97 aa, Chlorella protothecoides
MAWPASTQAFSTPIVPALASQPGYCEAFGTRSRPGLRDLVPAVAYQPSEATPLSQVLRNAGKKALGGGIPGAAAMGIQVVSLMWLRTTVNYQYRCED

SEQ ID NO: 10990 - protein, 931 aa, Chlorella protothecoides
  MOD_RES (462)..(465): Any amino acid
PEHASLRTIDEAHSLPGSAVPEDIPPLVPPSQPSPLPSIPVLATSARSSSSCALASTGSLPTSHTTHGTASTGANWPATTLMAPGQGPPRSSDDWQRLQALRALGLDFSVPEPRFEAVTGLIRSLFDVAVASVSLVEETKVHFFSAAGDFASCAEREGSFCEWGMESPGVFVVEDASRDRRFRDHPAVAGEPHIRFYAGAPLLSPTSGHCYGLLCAIDYRVRSFDPSQYAMLAHFGGIVVRELERDRQFAAQAAALREAAAGRGRMLRALDVYHTGIMLLNVRQGHWPLHYLNEAGAAELGAVPGDVVSTHAGFWQLFASPPGEAGAAADGVADAAAGRKFELTVVPARSRPGATPRPLRVAFRPASCDDAAGLSLTQGTPVVTRDASTPSSSGSSATGGHGWGGASQLEAAASAASIALLPLTSPFLADPSVFLYFGVFEIAPGVDAGATPGGGGDPGAAXXXXADAGAAPGGGGDPGAAQQIEAGSPESGEADAPAPLLASQTSFIAHRPKIMQEVILGPLLGVGSRGRTYRGLWHGSRVAVQVVEWWSRAGDAGGGDRGRASVDSTASGRSAAAPEDPVLAAALSRALAHPHLVGTYVYGTTSEEKEEEVGGAEVRKRGASSGFGVWGIFFPAILRGQPGAGGVRASCARRQSRAVVGMGGAVRAGLLSCLAATSVGRAGSLSSSTPEALGSLNRAITSPRRPHLKHHTHSPPPLSHQNGAARHPDRVYHQTWIVKCFCNRGNLKDAIERGMLLKPDDTPDLQGIVATACEIAGALSYLHACGVLHGDLTGTAVLLTSVPQDQRRWDQRRWVAKLSDFGLAELVARGQGRTRALARASVASVAHWAPEVLVGGVLSEEGDVYSLGVLVGGVLSEEGDIYSLGVLLWEMCAGRSAWEGLTAPQILQTVGREGRTPALALLPETIPQDLK

SEQ ID NO: 10991 - protein, 168 aa, Chlorella protothecoides
LADAERRGLLAAAPPVVARIHEVLEGDFDPLALCARLAPLLEALPGALPPAPASGPVADWDLGVYVPYLQQVALAHTVRQLSHVYSVMRVEELARLAPALGHGAAERLVVEGVRAGYFSARFDHRRGTVHFGGRGLEGEHVRGHVADLARALGAALGTPGAGLDAGVA

SEQ ID NO: 10992 - protein, 153 aa, Chlorella protothecoides
  MOD_RES (29)..(32): Any amino acid
RRGSAPAPGSPAEGAAGAASASPTHAHGXXXXGSAPAPGSPAERAAGAAAASPTHAHGLFDVGSYLELTGEAGRADAAAAPLSLPRLSSCTSAGSEALCPVCMDAAPGVRLAGCGHAFCAACLRQVVAGQRGPVPLRCPLCRGAAYALEPEQG

SEQ ID NO: 10993 - protein, 233 aa, Chlorella protothecoides
AQPRRAGPSPAPGRCAPRSRCGTGDAPAHPRAPLRGGWGVLGQGGGCVGTCSGDGLRWQAGTPGNRAMEAGPAVHQSLSRLSPAAHPRRSDCAPAPSAHRPPLIAPPLLLPQLTSPASPASPLIQRTPPSQPRTEVQAQVAGAERVEGVGAARGVAGDHRPAGLAADGAGGAVQPHTLQPRHHALLRQVCLRRPQRADRVHPAPRPARRAAEGAAAQRAQRAGHVARAAGQAP

SEQ ID NO: 10994 - protein, 702 aa, Chlorella protothecoides
  MOD_RES (656)..(658): Any amino acid
  MOD_RES (692)..(695): Any amino acid
MRRRGARSGTSWTPASSSPATWRSPCVASRAAKWPTAPAWRPRRRGWRPTTSPTPGWWPRARAGHAGWCPPCPTPPSEPGGGSAVRVISAVSGVRPAAGHRDVTGRGVFEMEECHRVGRCLRRKSAWQGGSCPSGDFGEGPCGGASRGGERARGVLRVVPTRLTCGALGPAAGMVVARRGPSTHSGALPDRPLVAPAAQAPIPRVWRLPVLRPQLADQRRVDLGRVEAGARLQNAQRAAAVHARAAPRGEQRPDGGAQAAAPGEEVVVEDAGRARVGEAVGVPLRHGVRREGPVPLAGPGVVVVHKGHGTRGPEAHQPRGAAAGVAQAPVLAALQRGLQHALGGDVEGGGAPPRRVQPGQQPAAVRVLVVVGRAVGAVGQPVPELADGEARGRGAHVVGDVGAGEAADKVQAPAVQADVGAQPGQPGAEVGLDAGGGVVDVGRGVEGGAGGGGAGAAVGGVVAHDGRSVPVQPAAEEVVAAAGTAPLCAAVVQHHVAQRQQAVGVQRGHAGPQRGLAAVGGVQVVQVAGQVALGADRAGGWGQPDRGETRVGDLARARRQLVVPAVPPGLPVEALEQDLTPAALRGRGRRGGGRVPGAVGQPLAAGPEGAAGAGAAARAGQPGVLRLAHALQLPLDGAQALPGGQGVRLARGGGGXXXGGGGRVVMGVGLRGGRTCLWNGDRAKTQDGVGCXXXXGGGGGGC

SEQ ID NO: 10995 - protein, 241 aa, Chlorella protothecoides
MGSIVSSLANRILAQAAALRPLENRRYLVGIAGVPGSGKSTLAAHLQARINALTGGAVAAAVPMDGYHLTRAQLDAMPDPEEAHMRRGAPWTFDPGSYLATLRSLRTPGAGEWDWRWCAVVGGADVGPQVITASAVALSRLRGTLRSAHAQRHRMKTRTRCTPLSLATSMQSAGSQACPSFDHGVGDPRPGDVQVEPHHSIILTEGNYLLIGRHTLCSVSLHRPDFPGPACLPVPCTTTSV

SEQ ID NO: 10996 - protein, 314 aa, Chlorella protothecoides
MWDRVQTASFDVMCGVPYTALPIATAMSLQHGTPMLMRRKEVKDYGTKKAIEGAFLPGQTCLVVEDLVTSGASVQETVAPLEAEGLQVRDVVVLIDRQQGGAARLASQGLTLHSAFTLSFILDVLVAAGRVEAGLADATKAFLAANQTGPAGATGAAPAAEAKPAAAPAPRRLAYEARAELAKNAQGAELFRLMARKRTNLSVAADVESANDMLALADAVGPHICVLKTHVDVFDTWTPDHAAKLQALAAKHGWFDFLEGYSWAVGRPGRGGKGLFDGGTRDSNTQLEPRARAFGGGRGVRHYTPRLVRLATAP

SEQ ID NO: 10997 - protein, 160 aa, Chlorella protothecoides
MQYGGGVYRIADWSHITNAHLVPGPGIIDGLRQVGAPLGRGLLLLAEMSSKGTLARGEYSAGVVAAAEANQDFVMGYISVSPASWPSGPGSPGLVHMTPGVQLSAGGDALGQQYNTPASVIGERGSDVIIVGRGVIAAQDPAAAAAEYRRAGWEAYEASL

SEQ ID NO: 10998 - protein, 588 aa, Chlorella protothecoides
MAHRGVGGLKPCASPVSVRASGCRCVGGATAYGCLYVYWHSIECPEAGPEKESSGVAACDCGFWHPPTRQEQCSPFHLVAPCRCHAAPSTQQTGHAPFTIGTLEEACRSAERSLVQYRFKPAKAQAHPLSAWQRLRAIERELEGVSEAQHARLAGACSGSSPCSTLWPRGEGLTYGAWDAAATAPPPAPEGSGREVLLQGFNWESWRHGWYDQLASRAGEIADAGFTAVWLPPPTRSVSPQGYLPSDLYDLDSAYGSEAALRSCVAALHSHGLLALGDVVLNHRCAERRGPCGRYNLFGGRLDWDAAAIVGDDAAYGGTGAPSSGAPFHAAPNIDHASPRVKADLCAWLAWLRSDVGLDGWRLDFVRGFAGAHVADYMRASAPRFAVGEFWDGLAYGPDGAPDHDQDAHRGRLLAWLNAAGGRAAAFDVTTKGVLQAALERGEHWRLRDACGRAPGLVGLWPSRAVTFVDNHDTGSSQGHWPFPAHAVAQGYAYCLTHPGTPCVFHDHFFAWGGGLRAAIRALLAARRRARVHCRSALRVLEARAGLYAAEVDAALVCKLGPEDWQPPNARDWSLSCWGDQWAVWERA

SEQ ID NO: 10999 - protein, 964 aa, Chlorella protothecoides
MVLRPRSPYTCGTGRGGVAWRGRGRGRQAALRLARHQRVEVLVALQKVPRRQHKVDAGHVAGVGHVLQHLFQRGALAHAHGPHLDAAPALWGDARVTPVAPSKASPNASPSVSSAPHSQALPLPPFTKDPHPHDIHGRGGDGPRDELPPPSFPGAPLPPFAKDPYPHDIHGRRGDGPRDEVLEQVSGLQAPKLDVGGTVVPHDAVLPLLHEAARSALAKVLEHQTDAVHPLARGRLDDGHPLGGAGGAQQHAVLRRQPDARAGKHLLQHLLLAPAEHHHLRCRPLYGHACTAYPRSAPGWETFTTPLFSPLHQVVTPPKHPPLSPASPQTHVNPPSSHVDSGVGGEGGQRGDGVRVDAGAGAARAKGPRRVPYARTVRPPPRPLLSRRQRGVVAQDQEAPRRATERSGHVRHGERRRHAPRAQLRLHRRVVQLGDEGVGPGLRSVHGDVRVVVAVALAPLALRHAQRVADGRGQVGHVPGVDQEGARAQALRRAGKLGEHQHARVVALAGHVLVGHQVHAVAQGGHQRDVGDGVQRHQLVEGQLAVQVVDGHVGERAIPAVDAAHNFVHHAAQALVLRDVGPAGHRDLDQEHAVAPLRVLLQELLKGQQLLGDALDHVQPVHAQHDLAPRVPVQQLGHVGAHLGRAQRRGEAVGVDADGEGGDVGQRPVVLHALRRGLQAQDAGAGGHKVARVVVGVEADEVGAQDGAQQLLAHGQRAVDLGGGEGRVQEEAHLGVGSVPCVGRWVERRRRAEAISPQHTDLHVGAALLEHRGKEHEVVVLHPDDVALLVVLHHRVAEDAVDHLRHVVEQLPQHGVAEAVVVQVHHLLVQVHRRVALAVQRRGQRVALRSRLDVHPGPADPLGLEVGHAHERRHQAPRADLQLPLALRVAVRRHRQAVGHHDQALGGAAVGECGVGRRGAEIGGGAGAAGAGVHPGGLGAGHAGLVAKQYCGALALPHALEQEA

SEQ ID NO: 11000 - protein, 505 aa, Chlorella protothecoides
  MOD_RES (150)..(153): Any amino acid
  MOD_RES (396)..(399): Any amino acid
MFFPPHSRLTHTPTLPQLPAAGDAAGSGGLGTRQAPVSGCRARRGLARPGGRRPRPPPRPPRVPQPRALRPRGGHLRGGRGARQAPGAVRALPGRRGGRAVHGQPAGPPAARRARRRVLLRLCHARRGQRRAGRYLPRGGGGVQRAVLGXXXXMPGGGLGRVWGGQVGMKKECRHDEVSDREGCIVAVLGFGSRPAVSMFRRLVFRRVPVNREASHAGPEPYQAPCPIPLLPPHTTAEDPIPRLLSWRAGSGAGRPEGASTAGEPTPPSEGLANNIAVGAERFSSLPGLGPLSARPGRVAEEASGAGARSRTGGPAAPPDSAEEAASSSAARGQQLKDRFSAAATPPIRVRWREPEGTGQHRRTPRCGNPGLDAEGCALALPHDCVPPQLPPGTHXXXXCGNPGLDAEGCALALRHDCVPPHLPPRTHAQVVARTAGAAARYLAAPLGAAASAPLRAAPNFTPLGRQLYVTPGRVIVRGAAADAALRAQAELMAGLGAGADAGDV

SEQ ID NO: 11001 - protein, 394 aa, Chlorella protothecoides
MLSQGWAYVRTVAVGLCQSGRSDGVNGPSPLACMQYPSAWAPPFSDRQVHPLPTHPEQQAALPRGCNCGGGDGGRVCLPRGGAGPAPLPGGERGALGAGGARLLLPPAPGGLPLGHSRLPGAPAGVSWHREVLVWLEWSWSHAELVPSTFAMDRPSTSNSRPGSDLEGLASICIDSHPLKNSSRILRWPKRCPAAPRSKQVGLGVGTCWRHWWGQHWWLPPPQLDGHGSWVSVASVWCAVGVESTGLIGGQGCWMQCLMMGRLTLRSHHLPQVGILPARYDSSRFPGKPLIPLLGKPMILHTYDQVGSCPLERAVAGVGLSLLRSVRVLSRESSQDNPDTISQALLSQACKATTLDAVVVATDDERIASVCRAHGAQVVMTRPDCPNGEPEVHA

SEQ ID NO: 11002 - protein, 215 aa, Chlorella protothecoides
MPATPLMVGASQRGGGRGLRTWFWRRLRSWHAVAVAVPSAASEQTHSPYRLPMPMQAMEDLEQLKVLENGYKMKCKMVDGVGLQTPCIPASARCVCKPTLLTPLLPNPLATGGGGEPQRAWRGHARGCGLHRAPVDRAGQCGGGSRRRRPASVDATSNLGGLLAQGFTRGRVNASHGLLMHGTAARRRAWAVSTVGNPPSQCCSVRRSRQSVHRV

SEQ ID NO: 11003 - protein, 527 aa, Chlorella protothecoides
  MOD_RES (17)..(26): Any amino acid
  MOD_RES (136)..(138): Any amino acid
MPRTRRECSSCPPAVSXXXXXXXXXXALKLEPENPEFLSAYGAFLSETGSRDEAVNVLRKAAEVQPDAGFEKYIAASECPCLVSLLEFSIRASTPPALSTPCRYLGQLLHGELAEAALRRGVDILRVELDRSVSRXXXGSGAQERRRHIEGRPGPFGKSGRMFSALRVGSGVRMCSLRVSNHPLNNRDLFSAAALINAVGRRGLKSPPPRPRSPRVTGHHIFGSFSIIHLFHAEAAVPWHRQPACRPPKALVCPSSPTISPFLSPPNFYHQNALIASPDTEDELASHRAALSSQLSSSLCCLAEEVMSSAAAAAEEAGGLGPEAAARLTSAVEPLLAEARALDPASPEPFQNAAQLALQCGRADAAADLLRQSLGLWYRPGADEGGDEGGGDADEEEDLGSEDSGSGAGAGDEPEPPSFEFRFETARLLLELDVERDSTLGVLGGLLEENDGVPSVHLLLAEALTRGGEYDDALEAAEEGLAAAAALGREGAEPDVVTSLEELREELRELMRHGPAEPMEEGSQPAL

SEQ ID NO: 11004 - protein, 269 aa, Chlorella protothecoides
MARALLAGTSVVYDGDPLRDLTPAAFLDKFIARRPKAGGRARGGSAMQPLPGVAETGAPDFGQLSEADVAPEDVFFLKYYSLAGVARRRAAAAARKARAAGAGEEEEELLSDADSEDADAYLEGEEEGGEEGIGADPDRAAGYDYSQLADAMADSGGEDDSDSESDAGGLEEGDGGEESADGEEEVVGGDDEGEAGGDDKEDADGSELEGAEFSDMSSGDEDGDSDDDLASLPDSGAQPEQGLRGLEIMSWMRIGGGGAWSAMDLLAGL

SEQ ID NO: 11005 - protein, 703 aa, Chlorella protothecoides
  MOD_RES (90)..(92): Any amino acid
MECHPWPPYHVLPSATSCPSGRSGSMRRPRGLIRSNHPCNSTHEEPGTRDRQPGTIYWCPFGCRNPLILLPDWLIPYRIPNDFYLIFLGXXXDALILLPDWLLPCRTPNDFYLIFLGGLSCKHGGGDRETGGSGNASRGHRCKDRTSSIWISSIEHVLIIFISLPQGRLRQSGTSTAHGVPATVSVPQGGSKSAPITPPTSKYQDPDSFSQVISATTAFLDVAERIGGEVGGLCLQGIVVGLLPAVTDPCPPDRDMTNTVSDHPSPHPLPFSSKLSGPEELQQLLAPVATQLEAAGRLGSGSRSPYLNHFKVVGEAAQALSWVAYSGPNCGEEEGKRGRSGCNCLLYNRHGVEGVMDALPYHEHRHAQPPRPCVGCLAGCRILCKQGWSGCAANACNPRPPPPVFAQVLKDWRPKDAAHGEWVAALKAVLKAMQSSCRLVGPHTLADNHHIFQPKRIRATPPSCQDFCAAEYPRGPAWKEGGLSAACFLQGDSGAPSSTRAPAAQPPSAPPAAATTSQPGAAQPAKRAGQVPRAPPPPPPGHLTKPRGGPADEESSKASGPTGVAALFADLNRGTAVTAGLRKVTADMKTKNRPAQEGARAAPTPAAQPPRFELVQGQKWAVEHQVGVPDLVVADTEPKHTVYVYGCRNSTIQVCMFGGKGAKLTGCGVANAGSAPATLETEHEHRRPRMKPGLWYYPIPQQT

SEQ ID NO: 11006 - protein, 702 aa, Chlorella protothecoides
  MOD_RES (158)..(160): Any amino acid
  MOD_RES (283)..(286): Any amino acid
  MOD_RES (310)..(313): Any amino acid
  MOD_RES (407)..(410): Any amino acid
  MOD_RES (457)..(460): Any amino acid
MSWGGKGSKLTGCGVANTGSAPAKLETEHEHDRPRVKPGLWYHPIPQQTWASHPPSQYHPGQGQGERHLPGQVLASGPALRPGGGVRGAHQLLVRRRPVHGRGAHAGHRRLRRRAGEERGAQARIGGGAFTERGGTNEDQDRGAGFSNCGLDGDRRRXXXGQERGGCFQGKGSTPAPAYHTAFPPLSPPLQLYLPRSSLDTDVTTAKSSGVNIIVLAGDEDGGKEAEGPAEAAVPEQFVTRFRDGAWVTTPVQAGLGGAAQRAGTQPPLHLQPPALPLHVPHXXXXASPPSPPTASAPSTSFSSSSTAGXXXXTSSSFAGPCSAIACSTPAFLYSSRVRGPWARGRRRPPPAQRRRRRRRRRPQSRRPRPRSPPPALRGSRGHRAVCRLMVCALAARPMADAVASSXXXXCRLLVCALAARPMADAVASSIRGWLACAGLPYLLTPAPKAGCDATGXXXXLHLRARHTSSHQAPKQAAMPLAIAPGPPMTLNPPRAPARPPTCNVWLQGGLLQEGEGHVPPHNGHRAILGGEVAILGGKGGAGGRLSADGPDNTGLALEAVRELLAWHGVATHSAPRAIRASAPPSQPRHDIQGLEAALHVRLGGLARGGGGENAGAQDRCLLHADPTGAPPVQLPTSSHPDRQHLRSGAHGKGPVVIVIARWTVVEDVRTCKGGRTRSCISVRYLAQQCGLIQRPGGGCNA

SEQ ID NO: 11007 - protein, 244 aa, Chlorella protothecoides
  MOD_RES (150)..(153): Any amino acid
MLQQSKDVAVMATLKRAPSELSSYQRKVFKVGSRSGESDIFLFACSSTCPSPVMPEPQSSTTRLPPQIDDHMGIAISGLTADGRILCRYMRNECLNHRFVFDSPMPLGRLVRQLADKAQNVWDIACMHLGSNQAGAAGVRPNCCRAQGWXXXXIDKHNTLAWKDENVYGTLQVCTLALIRRGRQVSGPTAAGHRDGFTHDQQTVLRFLQQVGTQRSWKRPYGVGLIVAGVDESGEMGRRIYVGP

SEQ ID NO: 11008 - protein, 92 aa, Chlorella protothecoides
MRQLLEFGLFHGDPHPGNIFALHDGRIAYVDFGNVAELSQRNKEVLIDAVVHAVNQDYSGMAEDFIKLGFLAESERWSWELRACYGPLPTIR

SEQ ID NO: 11009 - protein, 200 aa, Chlorella protothecoides
MGVASVAVMDSGTFSVPSRAALNAPRRRRQARGWLAPETFVFDNLPPHQKDNQYIRRYYRANYSWKRSLLSLFSLHNETGNIWTHLIGARGRGVVIFVCLICATVRVAPEPLALGSSALSKLEQRLYAYGKTNLYELLETVESWEAKVLKVGSSGLGSIEERLGSFGLHNLHDLVEFQETLRRYGKRGVKELSGFGRLIR

SEQ ID NO: 11010 - protein, 77 aa, Chlorella protothecoides
MKKATVLSPCVFSPASPRQAAKTYMERSFETFTDASVDELVRHALLALQATLQVWTRGLSAGDLGCHAAAGWVVQTP

SEQ ID NO: 11011 - protein, 172 aa, Chlorella protothecoides
MADFNFRTVTTKFNELVYQYPIRVPERYALVIRWVPQGLGGVAEDVWALRKGSGPTSHPPTYIHRSLLTQEGVCLSIDPNFQFLAVAYPYIARRLLTDPDPSLRSRLIQGGKFRWDRLQNLVTLAQSGTGAVAADLTTTVSDGLRVSLVGRSRLAGSVELCWAHKGLHHFAI

SEQ ID NO: 11012 - protein, 219 aa, Chlorella protothecoides
MEPETGGAPSGAEALSAGDLRNMLGQCLKLASENKITAKNTWGLPLIEHLDDLIKAEPDSTNFQRASVTLDAGVKIYGTRVDSVHTETFKILGGLGRAAAPEEALEGTAYLFQTEPKHPADGAQGEEGVGEGATSRRRKVLALDQNATLESSPDALNLKQFDLAFDVDPLFQQTSAQFDEGGAQGAERGGRSMGIVTWMGAVAYPCFPLVRLYLVSAPP

SEQ ID NO: 11013 - protein, 246 aa, Chlorella protothecoides
MNPVPEARLPLPPCTHVPRPRSSGSFLVHPALATVPPHRRFSRSGMEELASMEQRLVGLGPRALADADEAVQRALAAVLDTQWPARRWPVYVFMAGAVVCLATSSLCHLFGCCAAHVSTRIWRLDYAGIAVLTVTSFYPPVYYGFMCAPATRAAYLAASTGLGLAALAVTLLPFFQRPSYHRVRAATFAALGLWGVVPLLHASLLNAGVKEVQAAITLDVVMGVIYLVGWSGWVSAGRVERGGLLP

SEQ ID NO: 11014 - protein, 209 aa, Chlorella protothecoides
MTFAVGAAGEGGCWPGEESEASPGGDPVTTVTPRSPPPPPHGVDLLTPLAAACADPALLPATLPWVTRYLWFLAWDGEARAAPHYRAALRLLARLAASPKLLPGDARFGPAARCLRGVLDAFAAHCPLWPGGGGGNARREVDGQGVGPPDRGAVAGPDAIGARRPVSTPCRDRVRASCRSPRPVRRWPERQTHACWPCAAPGRSGASAC

SEQ ID NO: 11015 - protein, 135 aa, Chlorella protothecoides
MQMPLVEPDDGAQDALRPGAGEASGSGPLAGGDTGSPSTGPSNRERLQGGPATEDRATALPCPALVPSAAIAPPERFNLFALEEQMSQAKHPEVEAEKRKKVANRGDQKTQTSDAKFDERFKFAHGLTGSSSQPW

SEQ ID NO: 11016 - protein, 380 aa, Chlorella protothecoides
MCNLCACTSACTPTPARRRCWAHKAGVCLTHKKSTGGDEAWLRNWRIRCSSTGVAHPGPGLDTRHRCRAATDAVPAACIIPVANLRNRSRGLGESKARPRSSSRTDIGALPNRRHHACRAALGARGEDKAQVWSQTGGLASQPRPNPRYTRKVLVEQQVESSGRSAQSCQGAMASALSSAPAFAFKTNVGRPRVSISRLIQCKESRIGVKAIPVPKGVDVKLDGHNFVVKGPKGELARTLSTLVTVSRVSCGKRAWGLLRWCPARPRPCAPEQHGGGCVHRLHAHAHACGSGLPSRSLGDEADAQSGLLQAGGAGYSRRRGGRHAWECPAVYTCCRGRSQRMSTANPHRICRQVSVVKNTTVNIHGYDKEVVGQFAATIR

SEQ ID NO: 11017 - protein, 98 aa, Chlorella protothecoides
MLSAILAALTADARAQSLCTLQGGAGGQGKGCRESVARGMILTGGSAPRRLDAPFGTETNPVEVTSEFSERIVGVADPDDDSLVSEWNHGVIDRCDST

SEQ ID NO: 11018 - protein, 302 aa, Chlorella protothecoides
MGFTRPPKPRRPLRSDLDAECTCCFGAGPVGGAGHLSCPHVGREVRGFSQTGLAVQGPSRSRGAPVCGFPNQPPLCLGQGCCGVRGGAPPRPDRAAGRPRAGDGSAGLARSSPPPRPPHQRGDFAQPLCEVRVPLGRRTPRPSMAPCSTRAVFIVSETPLPQGPAGARGGGRRPEPTRPAVPVPRVRCQRRTGPAVCRAARPGPAALPGSDELLEPGGLSGWRGGCAVGDVGESRGCTRLDALPQADPGAGAGAAEQRGDSRAVWPAPAAGRQTPGEQLCWPGLMRSLSSRGVVVGVPLDRA

SEQ ID NO: 11019 - protein, 258 aa, Chlorella protothecoides
  MOD_RES (155)..(158): Any amino acid
  MOD_RES (230)..(233): Any amino acid
MGFKQQNIRLPAFQRGCHLVTSDIVREINPLLKGIHAGLCHIFIQHTSASLTINENADPDVRADMETFLSAVVPEGSKAPWVHSDEGTCQVQHVWSVRFHPNHPRTASTWNMAGGVAMVGSASRAWMCPRRGLLHGGQPWIQPGTVAATRDLRFXXXXMCPRRGLLHGGPPWIQPGAVAATRDLRFSTTLRIILHRASGCASTEMRGGEGISSSRFRGSEGQKVSDPGGXXXXGVKSTESTLVETSPTDCTSGRTISW

SEQ ID NO: 11020 - protein, 368 aa, Chlorella protothecoides
  MOD_RES (283)..(286): Any amino acid
MRELLVAHVGCTLLHKRGALQAAPSPLLELRVQWLPGPLMHSQGVLPRRGLPLPPPRLSPLCFQGCQAWLPACRASAASHSPSQGLCWRCLAGRGIRGRGGDHECIMSFRGTGSCRACKLAPVWGLTVFSWCLRGWSLHQLDTALPNPPPSCPQEPSANALEDSASVMPSMIPLVLELARRGNLYALAHVASDVGEATVRGALEHAGLLGPNHGQLPPHRLLFCGTREGKASMVRQLEPQLHIDADAETVRRHPAGGWERVQRRLRGRQVARGCGVYVAGGSXXXXLEPQLHIDADAETVRRHPAGGWETVQGRRRGRQVARGVWSVCGWGIDGAVHPCTSSPYPCMDSSPFKVLPLKSLPIDQTSPP

SEQ ID NO: 11021 - protein, 430 aa, Chlorella protothecoides
MLASLQLSVVVIILRQAPNSHSIRLAFFWRPLGTCKGGGAVGGNWGMICSSPTKISKDYFYMNLHAFDSCSANAFLLARETMAPQNPGEVRPHNTTIEEVFRTVDALRIPRYDITPLVRMVELLHVGATAYPYFVKMDSLLRACPVVPIILRSLTNISDGALAYPWKASAASWKVPVRSAGRIYYPNVSHDSRIPPQRRQHRSYVAASKNACQRASLRSTPTWRTAGNGPGHVIVRNSLADSWNNPKESTKRLDVALEMATMVHEMHQRNVAHFNLRLETVMMRKDGDDRLLYFTGLDYGEMRDVSQCAAPSKGRILGCSAEHIVAWTPAASPMRSNGLRLEMGDMQPHMTNINGYYASPELLGEMENLTIKSDVFQLGIMIYEILVGKKIDKWFRFHSAIGWFGRAGAWGGYPAMDKIHICWIVSSTSS

SEQ ID NO: 11022 - protein, 512 aa, Chlorella protothecoides
  MOD_RES (68)..(92): Any amino acid
PTPPQPPKPIPWTTQGDGRVVAELDTLLAQEEHVAARLAGTLAALEALGPSADAAALLGVAGGVLAGXXXXXXXXXXXXXXXXXXXXXXXXXPTRPSSAPTRRAMRPSSWPTWRRWGCARPPCSRVSASTCRRWWSSCAASSAPASPTQRTAPFTLTPRPSGGEGSVEVGGRVGMRVEGRSLRCIAPCAGTSTPPRLLAQLKPRRTHPTSHRPFPPPPPPPQERWAHLRQAGAVVCGVGGPGRRGGRGRQAPPFRLCSVEGAEARGAGLAVALGRGTARLAHRVQRHGLQDPGSNPGHSHWGGGPALPAPRQRAGAGGRAWVCMRAWYGDVPRDPLGLRLYVSEECRRSLPMYLSPPTQPNGLQSEAHYHACGCRQWVNYFLHSGHLGIDGLKMSKSLKNFITIRYWRLEVGSWGEHRVIWMEATGQPAQNPGCGPSTRGTQLAAWGQEMVDPHASSREGKGFPCHKDFIWGGLGSTLAARRDAAPPRESGDGPVPLGTSVAPLPLGRPLHP

SEQ ID NO: 11023 - protein, 141 aa, Chlorella protothecoides
MAMVLIAPQVGRWRIKHASPAVPGDLCLHVSALCPADDRAPFAPDNQPLQAEEEVLQAALESTAELVHAALCDNINTRGAMDALGDLIKAFNVYRSARGPGVLSKKWGGTASGGATAGRHECRESCEGVGRWWTGPSRCLI

SEQ ID NO: 11024 - protein, 154 aa, Chlorella protothecoides
MPSYPPRLRAGSASPPQRLLIRSVASYVSRILGEFGLEFGVTSSAGPEAAVRDETPAVLDAFAAFRDEIRRLAKEGAGAGQVLAACDRWQGSGRGPRGPALCRVVLCWVAPCHCRLSHGVGLPSLIAPSTHRRTRPPPTFPPFHAACGMVPWWT

SEQ ID NO: 11025 - protein, 144 aa, Chlorella protothecoides
MVCNPKDDPRLHRRMRLDGATPRTSNTLHGSLGLRIVESRPAFARDRVGATPSWRLSPAPVHPLQEPRMPSPRASSPVLVAGSACREIRDRISSVKNTQKITEAMKLVAAAKVRRAQDAVVRGRPFAENLVKVGLWAGIEEAGG

SEQ ID NO: 11026 - protein, 296 aa, Chlorella protothecoides
ALQAPLERAGLRVVGPGGGPGAPAGDGHPAEGSEADRAPQSNVSSPALAVPALPVSCVDGAGLHEVHAMLRALPCAPVPDAPPSPARRQPLRFRVEAWHARPGGLVLHGTAVAGRLRPGAALALGPCAGVAAWAPVTVASLQCCGRDVAHAAPGTLVSATVRAAGDRARGDAGSGLRHAFGAQIAPELAALHAAWAATEEVAPGPDAVDMDGAGLRTLDEMSVHKGTGWIRGCGVPGDRTGRCLDPAGGHPQVPDRHPCSLRLLKPAGSLAAGLESGAQSQPHFPGGTRLGPAISV

SEQ ID NO: 11027 - protein, 883 aa, Chlorella protothecoides
  MOD_RES (300)..(303): Any amino acid
  MOD_RES (365)..(368): Any amino acid
  MOD_RES (680)..(683): Any amino acid
  MOD_RES (753)..(756): Any amino acid
  MOD_RES (858)..(861): Any amino acid
MEEDTGTSPLSFTDFLEKMKDPAAANLVRTVKRWEVVLALSANNNAGMTSPRTRSIRYHPRCGAASSRTLRSGTVKARPQQKTILHVCRYDGCGTEGTEAALLGTLCAICSHSTLRLESLTVADGHRYTHHSSPPCYRIARSARHSSRNRRSSSGFTPSGGGVRPRSWMRQWSPQLARHSSTCTPGGPQYGDALELCVLSFFPPPHSWQGLEKYLMSKVWRLTFATSPEDVERDERCARILDALSFVSLDTLMGSSGVEPDPALLKVAVGELLKMDKYKVGWGEAESLVWQMKRFAVLLXXXXQDGQVQGGVAGGRESGLADEVLESLILKALPGPGPGSAAGGMARYSAKGTTQTSCSTPLLNXXXXRYSAKGTTQISCSKIPPKIQAPRDKLVCLVNVKTTAESLVQVAAAAGARIGGADAFFPALLLIVIQARPQRLASTIEYIKRFRGSSRLRGQFDYMLANLVWPRVAGGLADVHVVPCLASQSRWSIQGLQFFRDPPVHPTPLHPLHAASQESVALYLDTVNYEHLHISREEFLARLSAAGLPEAALELEKRASLPCSPSGTAGPSGVWPLESMALGSAPSQGDGRGPIQDPTTREAPSEARLPGWEPSLEAGTEHEPEGGQTQTLPRLSSQDELAGLLDVATSPLQAPKTTGDFESDSQSSEIGCQRDPARVXXXXKIWKSRHRHLPLSIWRVRCQGDPARVRPPQPLPALYLHTPSTTRNHPCCRLLARDSWQQRERVYRLTTLXXXXPSLLQTPGPRFMATMGAGAPVDNTTGGAALHSRAGCRRGGCGAARGSRRAAAAQVPLHVCLRRRPEPGAHRGGLDSRRFWRVWIAACCAGRTTCPIPSMRPXXXXLRRRPEPGAHRGGLNSRRFWRG

SEQ ID NO: 11028 - protein, 585 aa, Chlorella protothecoides
  MOD_RES (127)..(130): Any amino acid
MPRLINARPKTPSEVIFSAFCSGHHRGNGCQQPGALLHHGEWVPSEGMPGGLCLEVQCLVTECLGSIGQRSSPRACSARSSARSSSALSSVDSSWSGSRWGQRVVDGVAYVGFPCISIHGVPMSICXXXXRFEQRGFKLVGLKVGTAGGGRGCVLVPSKDIANVHYGEHEGKPFFPKLVGHITSGAVVAMVWEGKDIVKTGRAMIGATNPLASAPGTIRGDFAIDLGRNIVHGSDSVDSAQREIALWFSPDELAEYDPTNANTVSRSAASKTRLIEESRAMFESCSSYLMRWPEITGGYSGQDRDDCNRLHLLKITHAPAPARSNGSTCQEAVKSPKSPSFTMAFSFGNTAASTPAFGTPSTPFGFGAGTPATAAASTPAFSFGNAPAFGASSPSPFGASSAPAFGASSASLFGASSTPAFGFGSAPAFGASSTPGFSFNAAPTQAQTASAFGGGLFGGASTAVTPFGGGPNAQQAQQAATSLLTTDGRPLGHNTKWDDISPAAQNQLLELECVCGCGWDSLRTPPRHAPPHPLQEVHRAPAGGLCGAGRRRAPEQPGRRQAAPARGQRGSGAGAGRSRRAPLTG

SEQ ID NO: 11029 - protein, 453 aa, Chlorella protothecoides
  MOD_RES (140)..(143): Any amino acid
  MOD_RES (216)..(218): Any amino acid
MPAHPLQPRASGPPAVAKDKSEKKEKKVKTPKAEKTVVVADTAALEAADEFKRANVCAIAKPLANEKLAKKSLSHTIQSGLEAGEEGGQAEADQEGGEGGDQGHPQGQQGRGHHRGRHLPHRRHHPAARAVRGCRHPLHXXXXIIAGDISPIDVITPLPVLCEDADIPYIYVPSKEELGAAGCVGLWRWSARSQGCMCREGWVASPTARLKTPAPXXXGAAGCVGLWRGSARSQRCMCKEEWVASPTAPLKTPALAPVCRLTKRPTSCMLVLPKPIKGAPAVTEEDGFDAAFDEARPQGSVLVSCSLKKEFMTQLCAVEGVVTQDAGVAWPPLSLFHRALSPLQTYRRPVLAISPSSPPTSCGGWNGSLSALRRPHQYPHAEPALACHDMYVGPQSGIVRFRDPRHCSTSFPTWLTVARYGQAHPLRPIHPYTEIAFRHSVTQIRGIHARAPV

SEQ ID NO: 11030 - protein, 216 aa, Chlorella protothecoides
  MOD_RES (72)..(75): Any amino acid
  MOD_RES (95)..(98): Any amino acid
  MOD_RES (130)..(133): Any amino acid
MPLRPVDRRWPAWANPASLLGVICPKGRRPLSATLMFQGGAWIRPCSAPAFAVNDPRDMPTLSRPPFSLSPXXXXPTTLGTSPHHPALPSHSPLXXXXSAKRVSAWADQARHCSSMRLGALTRLGSRGTXXXXRGIESCGILAGTLSVDDAVFTITTLIVPKQEGTSDTVQVLVFLVIWGKGVGLGRPSTPLFIHAPGCIDQIGKSRHLDYDRHAS

SEQ ID NO: 11031 - protein, 871 aa, Chlorella protothecoides
  MOD_RES (57)..(59): Any amino acid
  MOD_RES (132)..(135): Any amino acid
  MOD_RES (249)..(251): Any amino acid
  MOD_RES (355)..(358): Any amino acid
  MOD_RES (489)..(492): Any amino acid
  MOD_RES (657)..(660): Any amino acid
MCLLRISSKSEEENRGGATGGVIAGKPEAAALARQELIHPLQGNYDLRSKWLNVVRXXXGKPEAAALARPRGYQLGPGEHAKFGVGCLGHVPHKLRAKRVMRGIRHAWSCTPASSSPRRGACAAAAIFGKCXXXXARLVMHPSVVLATEGSMRGTRDSGEVLTMDPASRTLHYIAHRACGWRGLWEATGVHGKGSNDVVHALTSSNHCWLHAAEACAPPSTCKGGTRQCQSAQEAREAGTCPRQDGNRXXXTCKGGTRQCQPAQEAEEAGTCPGQDGNPAKCPSRGRQSLSGAWSLCGTRRQPQLHPSRSGASVCSFFNLITKAQSVLETLNCVMIHDPSLSALLPISRMPPLHXXXXCGTRRQPQLRPSRSGAPVCSFFNLITEAQSVLKTLNCVVIHDPRLSALLSISRMPPLHPNHPQEPERSGSVPNYDSPPPLLNTLLNKAPEAEGEYKSLGGGPPKPGFPASTHTNRTAPNIVPFLPFPQNQXXXXPGFPASTHTNRTAPNIVPFLLFPQNQILLAVASVAIGAIFILTSVDFGGGSPSGPSTSSSASRPEQTLTGPERSALEAALEQQQVTLSSNPQDVKALEAAATIAGRLGDFRAAAASATTLTEQNPGDPAAWQLLGECQEELGDGQAAEASYVRGWEAGGRTDLLXXXXGAGGRAGRGDVLRPGLGGRGEEGPPGAGAPDHPALQAGPARAGLGESWEAGRGGPASAACGGVERGHSNGSLWSDTGFCCGVDGPPDHSLSLLISRIHLPSVQQQTICPPPSPCMQALERIDSAPPSVLSSLDAQLARGRVLASWPGHSLDAKHLYDGLIEAHPDDARPMLAKGLLLRQQGRGVDADRAFLQARALVPPEQRAGLDAVIGR

SEQ ID NO: 11032 - protein, 278 aa, Chlorella protothecoides
MPELERLKLSLDLKDRTSRLFEEEPWAPTKQPGTIRLAAGNVPEVHWRPHGGEAVGSGGAGPVDALDQRAHGAAPPLDPFLLPGAAGDAGLTSAGLTSAGSGAAAAPLPAIADLRLDLPRSLRLPAASAAARSRHAILPSWQQPAEAATRDAGPGSTQTGQRAGLYPALPADLAQLDQSTGPGSGPDQRPPNPLADARPPDPLADAVLGLGPQEVGVEFVAGPTAPPRPGESCCTEPPPATQTVPAVGPATTGVAEVAKRQSVRDVHVSVALMDEFLR

SEQ ID NO: 11033 - protein, 134 aa, Chlorella protothecoides
MTPRFSNPHRCSFHTQSSSKPTVTISGTDDHALYTLIVTDPDAPDPANPTRGEYVHWIITNISKGDISTGKEILSYQGPAPPIGVHRYIFLLYKQASEISYEAPEARFHYKVRQEAEKYELSDPEAIIYFVSSK

SEQ ID NO: 11034 - protein, 151 aa, Chlorella protothecoides
MPAPRGPRAPDSSLVSRLNATIQMRPANNLMRVDKYYRSADLLDRQVRGDRRWVKAARTRLQKGLGAEAVLLKPPMPLVQARQYRRQANEEQLYVMLMRLVSLVVETIPQHSGFHREDPIYQALRKVGRGLGCRGCRGDERDIKTFSNDLR

SEQ ID NO: 11035 - protein, 283 aa, Chlorella protothecoides
  MOD_RES (267)..(270): Any amino acid
MDEWVPLANLQLDTVIPPEPPELGDKYAGMGQGLPTLTALLVTHAYRTRQQKRKVDDEHSEEEGEGHEDFDPAQLREHEEFTKVKNIADIELGKYEMETWYFSPFPPEYRECKGGAPFLSGEGMQMPFLLFALHQVFMHHLGSPWVLVSPRHHPTTLSSLVCTQKMYFSEHDLCFFKHREHMLAHVKKCTMLHPPGTEIYRNGKISMFEVGLSGKVLDCALVYEHGEPLPRPLCSSTFLKSVHVLCRFCCPNPGPNTACPSARWTGXXXXVLIHCPEVGACAS

SEQ ID NO: 11036 - protein, 122 aa, Chlorella protothecoides
MPLCQVDGRKAKGYCQNLCYLAKLFLDHKTLYWDVDLFLFYIMCECDERGAHITGPSWLSPAPKLLTLDPAPIPQSRAATDTLARRRAARRASTWPASLRCLPTNEGCGVGGRVGWDRVPGW

SEQ ID NO: 11037 - protein, 90 aa, Chlorella protothecoides
MNTRFDVIGGALYYLLVVSVLPRCRHLAAVLEAPDWGTGLSLLLGAAADTVGDIFLESYVSLLALLCMAALALGFAATGGIGAKGGEPAR

SEQ ID NO: 11038 - protein, 442 aa, Chlorella protothecoides
  MOD_RES (42)..(45): Any amino acid
  MOD_RES (327)..(330): Any amino acid
QGGGGGAAAPCARLAPAGLAGRQPRAHPGAARVARSHGPVGXXXXARAWRLLASQAASPVLIPGLPGSRGAMGLLDAVGALLRLALRKADDAPRRRVALGVVAALAGEGFWSLLGEGGGEEWVRLGFLVLGGAGSKGPRPALARSSSAAVLVDSNLAAAAESQAEKTAELMTRIDNVPVPSASFLLSHPPIFSSLTAEACLAADAGSAPAAPSGVGSYGQPAPSPRGSSAGAAPATAAAITRVMSALGGEALALLEGPLSGPERAAALQAALLLQVCLSVFALSFYVCCDREGLCVAPLSCHPCSEHNARHIHTLHARECPFPHTLXXXXAPLSCHSCSEHNAGHIHTLHARECPFPHTLPTITHPGGGAVVGPDAVQDPAGRGRPRLDPGAAGPAERNGAGVRARAARRGGRLPGPGPRGGGHVPRRLRARGPGRAVGRGG

SEQ ID NO: 11039 - protein, 577 aa, Chlorella protothecoides
MPAHPPQRVQEDNTGAGLLLEQAAHSLLRLQPPRARKFAFHLVLAGLRYGACDQDGLAQRCYRWPGVLMGWEGGALGGWPGEAPKREPVLCRAAMRGRAGLRCPAAGPRGGAPDMAVCVPGQARCRWCRMMGAAWISGITSSHSSNFRPAVVDKCWRCTEARAGAWWRSTCTMCWAGTPGRLASGWFVHPRERGRGHGAIFSQGFGRWAGAGRPGLRGALPRRLARRAAQRARHAALPPRPAVRRRQAGCRQGGGAWRRGKGCSGGGGWGEWDGGQATDCSRRRDVGGTKSKGAAAPGSPPGPSGREGHDSGGTPRAAGQLYLIALPPDPPLPQVALPPLELPLPEMDLERPGLVFQGQTWYGNAAARQAPAELWRPLERAVVGDVREAGPSWLDGGEGTMIHVPCCPSSTGIGCGPEHLLRLHTHPDRIPNNLPVGHTYSLLDPPRPHPSQTPTCNRGGAAARAAPRACLLRGRAGEHRPEDQQPAVRRPGGQPPAAGVPAGGRGGCRVIGPRRHVRLAPNRRRRWGRGVGGASAPPRRRGHRGLPARGAAAPRHVAPGRRGLDAGRRGGRAAPAG

SEQ ID NO: 11040 - protein, 158 aa, Chlorella protothecoides
MRSLADLALMLGDVDGAASTLRLLAADLKADRAFRHYAGAQEALGVCAALSGAPSAEVNACLREAFYRHSQGGGGAAGARSSSAAPGAPGPAPERQGVRYATRAALMLTEYCRGAGLHGDAVWILMKAHYRASGDGGGGRVWRGGVSLPEAGRWGQEC

SEQ ID NO: 11041 - protein, 573 aa, Chlorella protothecoides
  MOD_RES (135)..(137): Any amino acid
MAAIPAHKPICAGKYNSAHSAATYVYSSSRYLDKLMYAAAWLFRATGEAAYAADAYAFWQSAGSGDIYTSWDSTFAPAINLLLKLASEGKTVPGRASYEAWMTSSFLSAWQTADGAWGHGAVHDIRAPAVNHVRXXXRGLDDVIVPLGLADRRRQLEHREDARGPGVPLLEPVGEPALRQQCRVHDGPARLLLLHRPREEPGLGAGAGGLCPADDRPQLRRSHFREIKADEECVVIVHLVRGLGGIMSLRKHHPGRGSQADAGCPGQLPYRIQLILAWGKVRSCHHATILSFKDATSGLRSTDKQECIEYFTPVKVSLAFTGLVIDTNCSIPRNTAFAAGSTSVLTRCGSRFSEVGIRHSVENESITARYCIVPAPFGSCGRQGGEGERMVIAVTSIGCRTVAGSTSRVSPNNFTMNNPLQIEDAWDNHAEIQSLRQLQSSETVEGMQNAEALQRSLNTVNALQGPHRSLLATKPPPPPPRKRPPPKKKPPPPPPRKKPPPKKKPPPPPPRKKPPPKKKPPPPPKKGKPPPKTTPPPSPPSTCCVGCICVASFCAYRVAECSAWMWIPKCPAS

SEQ ID NO: 11042 - protein, 321 aa, Chlorella protothecoides
MKSPPPPPGRKVPPPPPSKSPPPRKSPPPPQRSPPPPPPSLALYKKVGPLALVHAAGHALDLAQSTLGWPCTITDLVSPFPPLPRPWLHPGSSTRLRSVARSPPGTGLLTEGIPTWTTLCPAAGEYDAGDFLKLNFPLGVSVSFLAWSVLEFPGAYAQADATTPALNNVRLAATYLADCHTADYKYVGQIGDPGPDHAYWGRPEQQPGSRPAYIWTAATPASDLLGAVSAALSSTGLLFKTRDPAFAAKQLSHAKQLYAWGKKYPGDVWSRYFPVWCGCVCQQGAGSRLWLDGRRMGTGEGARLRSQQKGAGMGEGAEEGA

SEQ ID NO: 11043 - protein, 146 aa, Chlorella protothecoides
  MOD_RES (100)..(103): Any amino acid
MLKSCALHSLICPFPTPVSYPLHSFHSRICEEHIKAPSFLKDGELLRFCQRCGVSHPLAEFDGQRKSCRKQLEKHNARRWAMWYLPRSATAPCWSSQAAXXXXPEVGHVVPAWVCDSPLLVLTSSDVTAREASSHTSATPRHAMQA

SEQ ID NO: 11044 - protein, 515 aa, Chlorella protothecoides
DDGQLLWGWPVRRAVLQPELKGGELLGEEGGGHVLHRAARRQHGGQLEQAGLGGHVPGLPHGMLVRGRQARVGDGGAAVRAHHAVCQQEVAEQRGHQQVLAEEALEERTRQHVPRDGVGDGGEHPVQLAQRRLAVRLLAGHSVRQPRAQLLLGQRVAPARRAARPEPAQRHLDGGGQAGGEEVGGEVRGLGQHVGLAAGAQQDAGAHGVGGREEEMGCPVRSGAGVGAHSGQAGGGRVTAHTRAVDTRPACMRGLKPRHTRPPRHIRTQRKPEPTPHPALTREGAGGGGRGGGRVGAAVARRPRRVALRLLRALRHELLEAVQDLARGAAVKDVDGGRAQPGLQVIQRQRDVLGVGAVEHPDLAVGGRARHAVPIVVEQHALAPGRAPAGGGQLLHVLRGGVQVHLVLGARLPALVLHLQALADGVQGLGRRHAQRVDPALGARAGRHADHVGRVHADVEAHHQGHRRRLQPLLLAPARDQALARPGAGAGGGAGQLVVPRLAQQARARVLALLP

SEQ ID NO: 11045 - protein, 87 aa, Chlorella protothecoides
MDPYAALGVKPGASKDDIKAAFRRAAMKCHPDMFAQSGAQAQERAAANFKALTEAYNALMQGAQGAGAREGLHDACAPNTAVPHGRD

SEQ ID NO: 11046 - protein, 403 aa, Chlorella protothecoides
  MOD_RES (376)..(393): Any amino acid
MWGWNSRPLARTLVPSVEAAVFSLAACALDCWAPGREWLLNSWARAPPPSRSTQRQVEGPGGVACERAINSPFPGMWKVLDQGKERLFTSDSCIGRAVSEGGARAVWARPQNIVLCSRIQHTKTYLVPSFKSPVDSLLYDTAHPPPRTSSAAEHDGAAALCQQDRGTRAGVPGRVDRLQPKPHPPGWLSPRMVTKVVYDRNHDASKVAVISGKAAEGGGGSGHEPAMAGYVGAGMLAAAVAGDVFASPSEDAVLAAIRAVGGPAGVVLIVMNYTGDRCMAQLACVYCWGDEGVDGAGPSVQMYSPSCASGESATRHSGAPPGASSVATRLNFGAAAERAKVEGIPVDMVIVADDVAPIEGGTVKNRRGIAGTVLVXXXXXXXXXXXXXXXXXXGGGGGGALSL

SEQ ID NO: 11047 - protein, 268 aa, Chlorella protothecoides
MSFLSRSPAPPARTVAGQGSGRRRAAGLERGGGWRAAHPHLRPRHHLRQVLPGGDRRWLASPTGSSEAGGAWSKPAATLRFGCLLRVAATCCTVVIKRSCCSAPHYIPTLLTPCSPAQVLEDISAEHARKTVTVEPHPHGVAGVQAASIHPCRHANVMRKLAGVVTEGRADFRVEQCVGLEEVVCGSWVQGSWKASKGGVRCAGMLRRCRHWCAATTAAHWDPPARTLPALGIEHQISHPQSPPSPHASQLPHPVPQVHRERGAHHRV

SEQ ID NO: 11048 - protein, 467 aa, Chlorella protothecoides
  MOD_RES (71)..(74): Any amino acid
  MOD_RES (141)..(144): Any amino acid
MLEATVALAMTLRRYSFSLAADPGLASGATIHTAHGLRCSVQRREGPAGAGQGLRDEKETNRGNLRSARIXXXXGREGDGGPFMKGFLWSCDHCTLWSWLPGMPVSVCCGLEQTESEVRQNIQRPESAQRKALKVRSRNTXXXXTAPRVSSAESFESPHRARGLRQNVGSSATDPLHVQDRGGEGPPNTVTVGFQGERGADPARICDRGRLPGALVPDMVLVRWGTQMDALREAGDARKARPFLPDDKQYLITRNVPCLRRAADVEEYGERDEFEVEESASGGDGWVTASSRPSAPLSSTNEEGFEEIPSISGEAAMPHVVGWRAEGRDVRCPPDATFVSWASDFKHSCKAGSPRGRPVDLLALELGCQAHTRSPCCLAKHLLRALSLAPADPLKDLTLGDGAGASRAAARLEEEDDDAIPDLADLDDSEDVGTVEAVRHAVHAVLPAVMGWLALGRDLEHGTGLAA

SEQ ID NO: 11049 - protein, 144 aa, Chlorella protothecoides
  MOD_RES (64)..(99): Any amino acid
RGGRVSGGGATPAPVPTPLRDALGLNEAAASASSKREEAARLALLRNDLRAGLAQLPGPRNEYXXXXXXXXXXXXXXXXXXXXXXXXXXXXXXXXXXXXGRGRRAGRLLRGGCGRCSAAPRRCGRGRALRRAAPRLAGRAARPA

SEQ ID NO: 11050 - protein, 868 aa, Chlorella protothecoides
  MOD_RES (316)..(319): Any amino acid
RAVAARGDALGAELVSRTAGAGAGAGAPGASASEPSAPEALPAEDSLASEEALVGVHALLASSQLMLGLVAGAGVPGTRVQAMLRSTAMRHCRALLESMHARQVARLAREFGGGEGEGLCLAAQVGWDSGMSWGMRWMSIPASAVFCLAAQCTELLWEHVDQKGGLVPGGCPAQHPAHRGAAGKRGAAPAGRQREGRCRAGWEGAVGRPGGAGRRATRGWHWRCDRCRWLPRSLRIDGRRAPGTTWTPRSDSACASRSQPQPFPPAATAPEPGDAPSLPAAVPAHPHRASTPQPALARPPRHERRPALATCAAHPXXXXSTSDAQRSPRAQRSPRAQRTQIAIPGLPLSPGATGRSPGSATASPRGPVPRKFTITVPDSHTALAGGRGAAAGADPSATQPPPAPTLAVSGEAFACAGAALALVRALGEYAEVAAAAPGICPEAGQRALELLSLFNSRACQLVLGAGAMASAGLRSITARHLALAARSVGALAALAPALAHVLGAGAGGGPRAAALAAGFARAARDMHLHADEVCAKFVGIMRERVEANLAGLGESLRAAASGGGWPNGEGSVGVPRASAGDNVGGPSDSNEGTDTPSLRCLPPPSAFATTTARQLAILSGVLGPLLSARQLDAVFGRVAGMAAERCAEAFSTLEAPGAGGARWSLAGAARGAPGRAGVTAAAFDRQVESDARELLACLGALPVDPVALDQALEPLRGWVDWQFVTKPRLAAEQAQQAEQRSPAEQRSPAGTRGGQEGGDAPGQALSEEANDLQEANAPEEGRPGASDETSVPAPEGDQEDNDLSSPYPSSSGEAGEDERQDEDEGQPPVKEEKPGQDSPTADGVEGTTSDREPDASVAPTSKAGEQAR

SEQ ID NO: 11051 - protein, 672 aa, Chlorella protothecoides
  MOD_RES (200)..(203): Any amino acid
  MOD_RES (511)..(513): Any amino acid
  MOD_RES (629)..(631): Any amino acid
MFGWESLEPWAGGWGGRVASGLDILGNPSDTWTLPKTQSPNFFSTALLVFRDRGGEEGACPGGGGDCGAIHEDAQAPGTVRGYCVEEGGAECQDCDRNPACPSRRARIGIATLHTPPGMSILRSDPNANLLPTSRIDADKKRMGESGDLQQRLEKEYPWIPSEREHFGRPGTDYDFAARDPEEVSGEVEGTWLWLNMPSXXXXTDYDFAARDPEEVSGEVEGAWFCENMPSPSDSGRMRTRAMCNGSDSSSGNEDLSAGAHPHGHYSSNHPNLCPHQHPTSQAYAEYEAACKTLESMNKRVNKKVMAMFDKAEAEYGELKRKRDVVEGDKRKIQEVMEELDEKKRAALETTWHKVNGDFGAIFSTLLPGTSAKLEPPEGETFLQDPSDQGPSLPPRISRTTFSVAHINTVATPPRMFTSPTFSPSPPLTYRLGGPGGVWWRVEGVPQRALGWAEVPAGPLPHPGHAPLQARPHLHPGRGGRGTESEEGFVRALSAHTDKEDRSTCRSTASXXXVGGGPSPRKALPSLDGHHPAGGCRAGPEPHPEHRAHDQDPLPSVPVHRRVAEGGHVQQRQRPLPHQVCGRRVQRLPHREQAHGGQASGGQGLLCVIGDGCSKLHGNSQGDSARSTXXXHREQAHGGQARGGQGLLCVIGDGCSKLHGYSQGDSARSNLV

SEQ ID NO: 11052 - protein, 295 aa, Chlorella protothecoides
MPAYSLHPPSGRSHPVEHAWSLCPPRLDVRAVPELQQCAPLSARRPIPAAFIDADEYLTVLEPAASLRSILADYEHLGGLGVHWRIFGAGGGWGAGLGKGEALKGGGRHSRFKGTLGSHSCVRSGVPIALELPATLPCSPSPTSPPLPLPVSAGRIRRPSGRIVEDYHMCCAVRSGEDRHVKSILNTEFAQHFQSVHHANYTGGRVTTNTCGEAIPRYTAAAPCLERLALRHYVTKSLWDFTQKLARGSGMSRRKDWTYFYRVQKMAWQDCRLPAAWPLGRGPVDEGGLGAVTAS

SEQ ID NO: 11053 - protein, 392 aa, Chlorella protothecoides
MPTSLGCAGPTQRHMDGWPCPDGAWQGSSHFVSMHSTPSMRPGCRPVSQVTAACKMLDQDVPKEHLRAGQAPFPSTDNGIRTSTVSPASGNLDACIAQPIMRASVLRSGSPRQRAWASRVFLVVIVSALVGWTLIPLGRVIWRPATSYSGLEAANILKNISGKISLLADVLCWGRGCAFPMVLGTDIARGHLTPGSSHPLAAKDGHTSGGRAAKFEALAARAESQAPLVACPAPWDWTLGQVDASKGPVCDSGMARAAYRLLDLATGEGKLMGLEWGTGTLTPLFLQGKLAGLVSIEHNATVAEIAARVKQENATQLESRWAQRTAPLPDGSEPGEALQAYLDLVKDGKPQYQVIGISGPAAIAALERSVALLVPKVGVEGRGGGRLALATH

SEQ ID NO: 11054 - protein, 119 aa, Chlorella protothecoides
MLAARTWLLLGVHGWPQCKLRRLGVRCTRDHTSRHGSRHVRHLIPHILHPLTQLLGELLLDRVNVKIMMQYVSDVNNLILMMNLLKDSSRSIQFEAFHVFKVRTGWCLLSTWCVTGPIV

SEQ ID NO: 11055 - protein, 311 aa, Chlorella protothecoides
MQDVTGVQLEFSCRDQLHCSSVVSKGIHENAWRPMRASCPLRDIEAFTIWLGVTGICLLTWAWLRFPAPMSVGERVTPPHIFPCSDNDLNQGRWVPGNRSSCPPLRGEATCDPSFGKQWRFDSRATQCGLIYQPPELVNATMPSKHILFMGDSIARYLLQTLLRAMGRNGGWHIETMSELGRVGLLIELRHLPYRCQGTLAMDHSPKGEPTTCNSTQGWSPGVTVPHAHSDLNYSLPGTAGALEFWWRPFPLNISEALHNLTTITTKPDAVVTSFCSWHLGFIRDLEEWKDLLETLRLAGKVWEWVHGEPV

SEQ ID NO: 11056 - protein, 141 aa, Chlorella protothecoides
MAQEPRIVIGLALGWFLVWCAVRHPFPGLVVNRLVVQFGPCTDATFNRGAWIESGATTCPPPAQFGTCAPNFGKQWLFSRRAHQCGMRYRSPATLNSTLAGKHVLFMGDSITRYLAEALLRATGRSGGSWEWFSGNLNGVG

SEQ ID NO: 11057 - protein, 171 aa, Chlorella protothecoides
MNFLQRMRVKNVAELAQKAHQSFERLPYESKQDRVVEDISKAIMSIKVGRGMKIGSLDGSRDRGGRLLGSEFADVPFNTPDTPTHLSQEAIFGEDEQSSSKEHAQGIASEACRVGLVSDLVTYLTVLDFETRKDVVQIFCAIIRITLEDGGRPGRDYVLAHPDVLSTLFYG

SEQ ID NO: 11058 - protein, 296 aa, Chlorella protothecoides
MRFATDSTHGELGEVVGRGHGDGVGDDDLGEDARGQALDGGRGEDGVRGAGVDLARALRVQHARGVGDGARGVDHVVHQHCHLPAHVPDHVHDLGDVVRGAALVHDGQRRVVQLLGKGAGAGHAADVGRDDDQVAGGDALGGEVVQDDGVAVDVVHGDVKVAHALPAVQVHGQHPVRPGLGDDVGRQLGGDGFAPRSLAIRARVAKVGQHRGDGAGGGAAAGVDGDQQLHQRVVDGGGGGLDEEDVAAADGLAHLAVYLAVGEALDGDGAQLQAQVAHHLLAQLGVGGAGEDAQAG

SEQ ID NO: 11059 - protein, 179 aa, Chlorella protothecoides
ESAAAALGVDAVVRGRGIATADPAYREFLDRAVAVARDARRPRRGDYAGVSLRVGAPGSAQGVDAASGAVELPADLPAASLIATLGALGRSAAQGAARRRQADAALAGLARQVERRLRLRRLVREDGLAEARFRAACQRLLQHASSLQPLVGGLALQIGLTNRLLLDRQALCIAWDFEV

SEQ ID NO: 11060 - protein, 290 aa, Chlorella protothecoides
  MOD_RES (6)..(71): Any amino acid
MGLEVXXXXXXXXXXXXXXXXXXXXXXXXXXXXXXXXXXXXXXXXXXXXXXXXXXXXXXXXXXXXXXXXXXVDVLGLAAGDGDEAGLEVGDGEDAGLAAGDGEVAGLPAGDGEVTGLAAGEGEDAGLAAGEREGTGLEVGDGEVAGVEAVGVDVLGLAAWDGDEAGLGVWDGEDAGLAAGDGEDAGLAAGDGKDAGLAAVDVEDAGLASGEGEEAGLAAGLGDEAGMEARRGEEAGVEGVGLLVLVMAAGEGIAACCVGGILLGDGAESCSGTGTASVICVSKWRQGWVR

SEQ ID NO: 11061 - protein, 723 aa, Chlorella protothecoides
  MOD_RES (42)..(45): Any amino acid
  MOD_RES (304)..(307): Any amino acid
  MOD_RES (417)..(420): Any amino acid
  MOD_RES (475)..(478): Any amino acid
MGEPLAHVNTEARTWPLPARECACPACVGTCNPVGARLPATXXXXRATLHAPTSSLVPPSTLCLDMGNRSPMSTQRPLAGPCLHENVRAQHAWVPATLPEPGTQPLDPMEHATIPCQKRETLLGTGARSNAYTDFHHTVFHVHAPRVNAGTGAPMLAQVLDALAEIAFEPEFLPSRIEKERKAVTAEAQMMNTIEYRVDCQLLQYLHAENALGYRFPIGKMEQVAGWDRAAIMDFWARGYHPANATLYLVGDLEPAAARAAVRQAFDRVPAGRRSVRRDPQGVAAVELPEEAHASASATGAGTXXXXGGPALGAPRCAGRGRGGAAQGGTRECERDGRRHRRRRDPPVAAPHLPAPASAARLGLRRGGARQAAAPDFRIPAPPAPAVPAVSLLQAAHPAPDHHAGPQARGALLLAWXXXXDHHAGPQARLRAHAGLQRRAGSAFGPGGAAVGRCAARALALITFAPALTRCRPIXXXXGLQRRAGSACGPGGAAVGRFGARVLALMTFAPFRVNARYVEADPPFVSIELDHSDSGREGCAVSTLTITSEPGDWRGAVGVAVAELRRLQRHGVSPSELARYRTALLRDSEQLAEAAHSTPSAEHLDFVMESLALGHTVLGPREAHEALVATAEGISAEEVGALARSLLSFASHFGNEAQLMEEYAADPEAWAAPGPSVATAAVACLPAFTDASGHSSGGGVPLARGASLATTQHVDPAALRATA

SEQ ID NO: 11062 - protein, 485 aa, Chlorella protothecoides
  MOD_RES (29)..(32): Any amino acid
MSARRRHEGCAIVLDRVEVHPIESMSRLXXXXGWGGTGWGRCDDSAPAGMSAGRRHDGCASALDRVQVHPIESMSRLCPCHPRMPALAPTITRPLSLHPHTWPRPEVLEGVLGVDAALNGVALDLDVLLAQAQGLAHGRPDLLLDQVHARDHLRHRRLYKMGETMTEKDVKRVSIRLSTKPTHLDAGVHFHKVEARGLPQELDSAYADVADAPGGGGGRGAHGLPNLRREHGAWRLLQQLLVAALDGAVALPQVHHVPVLVGQHLELDVARILDIPLQVHRAVAKGGLRLALRGAEEGQELLARHCKAHAAPATPRRGLDHDGEADGVGHLHRLLWRVDQAVGARDSGHARVLHRLARRGLVPHHADVLRARADELDAVVLADVHERRVLRQEAVALGVVMGWGVGITPGCRSGGRLSGVLRPHLQGCSTQDLWNPTLLKAVATYGVDGVGAAADGRRDDGGDVEVGLGAGSLPDAHGLVSKLIG

SEQ ID NO: 11063 - protein, 430 aa, Chlorella protothecoides
  MOD_RES (128)..(130): Any amino acid
AGAAEAPADPDLLAAQRADERAAGAATLLAQTFARLGFSLGRLKTGTPPRLDGASACPARCSPAPSDATPCGRAWAQPDPTPHPRPPPARRPHTTTPLLPPPRTPQAAPSTMACASLSRATPRPRPSXXXLGRRALWPGVGPARPRTPAVPATSLSPSHHRTHPPPTAPNTAGRTIDYGVCEPQPGDAAPTPFSFLNMEAGDWAPRQPQVRCHATHTSAATEALVREAMASGRGAVFASGATVAGGGCVEPRYCPSLETKFSRFPGRAHHVWLEPEGLGTAVVYPNGISNSMEVADQARMLATIPGLERAVMLQPAYAVEYDYVDPRQLLPSLESRRAAGLWLAGQINGTTGYEEAAAQGLLAGANAAAPGDPLALSRSDSYLGVLADDLVGRGTSEPYRMLSARAEFRLALRADNADARLTPRGVAAGL

SEQ ID NO: 11064 - protein, 221 aa, Chlorella protothecoides
MAAGFLHTLAGADHLAALTPLTVGRHPVASSALGALWGAGHCTGQLILGLCMVLLKERFDQVLPFQGPWLRWDAVSRAAGCPLVPLLDRWGGASVGITLLIIGVLGLRDSLAQPEPAAPALAGAGPGVGAGPPPHAARGLTAEETEAQEVAVAVATRSKSLGSLLATYVTGIVYGLQPDALFVVIPALTLPSRLAAAAYMLSFLVGTVTAMGAYAGIIGAL

SEQ ID NO: 11065 - protein, 369 aa, Chlorella protothecoides
  MOD_RES (27)..(30): Any amino acid
  MOD_RES (223)..(225): Any amino acid
  MOD_RES (265)..(268): Any amino acid
MVRHREWLADQVQEMVTPAILEHSLVXXXXFLDGVAGPAAHGQTQRLAGRPGAGDGGPGNSRTQPVRRPPSRRRPGGPGPLPAGARRAGHGRARHAFLPAPAAQPGPRQAGPLVRRGPGPRPGEEGPAAARCELWAPSCSGHVGAWMLAAAFWPGGPAVPPGPHGGRAAGCARPRHLAAHAAHPAVPGACLVLSLGSEGWGESSARPLIISSPVKHSAASLSXXXCLVLSLGSEGRGAAARHGEPAGADPGSLPHTRADPGGGAXXXXTVSLLVPTLGPSHTHGLTLHAVRGCSRRHAGGGAAFAPGPGDWPFTGGRAALLDPGAAAAGAHPAGLLLTGHRDGRVRVWDAVAQVSGGCRRGMWSFIAGG

SEQ ID NO: 11066 - protein, 676 aa, Chlorella protothecoides
MSSHLCGTHHEQGLTGVIGQAVGTGRKPGAPRLADGHALPCQGVGGQCLGLSQGGRGLLQSPLQVSSCAFHDCDLITCNGARCCSRSGVPIWGGPTSSRGARRAAATLRSSLNRSRPRARPGLQFAARVTRRCCKSLPIYLESPASPAAGPHAGFLVGRAGTCCGRLPPGCPPPPPPAWHPQTMKKGMVPPCAARTTSPPSRPCSDSVRPSPHPHIRPKRHAPATRTPHRVGPPHAARQRLEWAAWTALNLGATLVTALLLRTLPGEDRTLFLLYYQPLIPALAMLWFWTVAVWHWERRGVRYAACFSPEDARHLPGSAVLFRAGTALSAVTTLSGAVFLYQLAEGQRGAAALQPPLMYGSLAVALLWPGPGFHGVRAAGMGVGVFVAVCPFPPLARLLQPPPSPPHPPPPPLHTAKDTRRFLARTLTRVALPVHAVSWADFFLADVATSLSKSVGDGARALCAVAAGPGAAFGSGTCGESGALAPLGSALPYAVRLVQCVRVFRDTGARSQAFNAVKYATAFPAIALAGAAASVGPELWLTTLRPLWVGAAALNAAYSYFWDLERDWEIGFFSQMGAWEFVVLLPFLGGGMREWWRGETTLDDYVVGKTKAMGWSCMPWEPAYSTRRKPVCGMPLLLLHKCLVSMASMASRMTRHGSRAPQPLGARPLAAPVYPS

SEQ ID NO: 11067 - protein, 220 aa, Chlorella protothecoides
MIPPPPPPPQSYEGGIGGEPGNEAHGGYTYCGLAALCLLDRCQALDIPSLGSWVAALQAPFEGGYAGRTNKLVDGCYSFWQGAVLPLLDRYAPSNARATDTRTEQRPDQDLSPETLAARALVHSLAVRLEAAEKLEAKVGGTGLWRRIAMMPVSDQGRVLKGMSKVLLDCPSSVDGMGLVGLPFIAGPILVSFRSLTMPPSPTSSMPPGRHNTRPRGSER

SEQ ID NO: 11068 - protein, 250 aa, Chlorella protothecoides
MQCHKQCKRPGPIHSVPVRISGLGCKSYMAVLLDPAWPGAAGAALPRPAGPRLHHHLPGFLPRSRGRLWGRPLPATPPGSHIRRHSGGGYGLPVSSLKARDSSSPLLSPRLASCAAVAALVTLGGPQALSVIDRPALMRFLLRMCIPPEQGGGMVMHDGGPHGAWSQPVVVASESLSAWPGETQHKPTSSIPPPGGEVDVRGCYCALAACHMLNLDVQTLADCCGMVDFIRRCQACQGKVLNILRGTARV

SEQ ID NO: 11069 - protein, 131 aa, Chlorella protothecoides
MVEFRRNVTKLNFRYKRGPHAGRRNHKGAPARFVSRRCNSFDLASHFLQVRTDNIALPLRLQMLDDGIASDTSREQWALEVRVLDLYRHLDARLLDGDDGALELYRDKHAKFLRKGLGCLNAGEVPGQGAV

SEQ ID NO: 11070 - protein, 153 aa, Chlorella protothecoides
MRLCGVWPATPGVAECRATTEACCQPCSADPAQHGCVWRQAGGRLFRVQIEPPPAPAFFLTPPPEIVELARYLTPLPEEAMQRNAAIQRVRDVVACIWPEAQVKVFGSFATGLYLPTSDIDAVVLGSGCEDVPQGLKALASALHRKHLAKDIQ

SEQ ID NO: 11071 - protein, 127 aa, Chlorella protothecoides
MKGTARHLQRALQQASAPLRESQALPPDTLTRQSVAIRQAGGTGFPASADSLAYDSSQSLLVVGTSDGRIKLIGALGVEAVLQTPSQSPTSYLAFLANRGAIIRVTQGDAITAVTPLPSAPYLLIGG

SEQ ID NO: 11072 - protein, 42 aa, Chlorella protothecoides
YCTAGVHPTRCGEIEAAPEGAAAYWEALRGVLEEGKREGKTV

SEQ ID NO: 11073 - protein, 592 aa, Chlorella protothecoides
  MOD_RES (201)..(204): Any amino acid
  MOD_RES (274)..(277): Any amino acid
MAMPLVAHQESCPSMPFAPGCAVRTPPARRTQDTPAPTPGPSPGVGLHRSASTPLFQDHQASTCLTGAAPPGPGGEGANRLPAPPPPRPAAQPPIIFLSFQRCQSCFQTRQALPQGPRRLQSSPGAPPTNSLPPVPPMHFCPNYMPGPASCLRPACSLPGPASPPYCRRHPPLLDVVLPPCSRGEGVRGDGSDRQRRPGNXXXXVFARRRGAGECIGSTAAPRQRAWPRRGCVDGLGTAAHKGARPGPRARHPLIRPTRGRAGLASARGSPAQXXXXRGCVDGLGTAAHGWPGQGPVLGTPSAVRQEGEQGSPAPEARRPSADPSDHRLARPSPSSRRSSELVVVAQVVVVVPCRGLGLGQDRRHRVLHRLELVLVLLRLRLAIVLQPLQRVAHRGGHRVGVGLVQLALQLVVQRRLGGVQVRLQRVARVDPGLDLLVRLRKLLRLLHHAVDLLLAQPPLVVGDGDLLRLARPLLHRGHVEDAVGVDLKGHLYLGLAARRGGDAVQLELAQLVVVLGHRALSLVHLNAHRRLLVLVGGEGLALLGGDHRVARDELGHHAAHRLDAQRQRAHIQQQDVLDLVAAVARQDAPLR

SEQ ID NO: 11074 - protein, 250 aa, Chlorella protothecoides
GGILSGDGGDEVKDILLLDVCPLSLGIETVGGVMTKLIPRNTVIPTKKSQTFTTYQDQQTTVGIQVYEGERAMTKDNHQLGKFELNGIPPAPRGQPQIEVSFEIDANGILNVAAVEKGTGKSEKITITNDKGRLSQEEIDRMVEEAEEFAEADKKVKARIDARNSLEAYLYSTKAALDDKLKGKLDKADADAVASAVGDALEWLEDNGEAEAEEYEDKLKSVQDAVAPVLAKAKAAAGDDDDDLGDHDEL

SEQ ID NO: 11075 - protein, 783 aa, Chlorella protothecoides
  MOD_RES (64)..(68): Any amino acid
  MOD_RES (321)..(324): Any amino acid
  MOD_RES (498)..(500): Any amino acid
GRAGRPRARARDALAGRRAGRAVPPRRRAQDRRRRGRGGPGGGAAARGRARRLGASACRAGRGXXXXXDLAHMALQMTTPCGGPECRAGGPQGLMLPGWAVRVREAIAPDLAHMALQMKTQSPRREVTFPCTARVDCHRPTPNPRGLRQVPGSRRWGIILALPPSALHPCPWRPDLTMGACHDDHLNFPKTKKEETEGEESGDEEESEEDSGEEESDDEQSYPDVDVPLMARDWEAVLDESITCLSMDPSGTYIAVGTAEGPISLLSAASGQTGIELAGHDWGTNAVAHLGLRRLVSIGEDGHARIWTLPVGELEPKVQAXXXXPTWVSGDWCLLARTDMPVSGHSRWENWSPREGYSFIGAPAGAPLCSRPQPIASPLECVTPVGPCVRHLAVRGNAFACAAGHQATYFTVEPETAEVKAYPQPPTKGTVLDVRLPVDGSLVVATSKSVALLEEMEITSKQPNPLDMPVEVGGREHVVQPSILKDSSQSCQIRSLPXXXHVVQPSILKDTSQSCQINSGPVAAKNTHGAPPPLHPILPSSLQGACLSVDVDASGKHVIVGCQDQAVRIYQLKRTAKGAEVEVGAERGRRMVIFDLIVISLMPVVLDFHSERGKVRYKLTAFTTPANFHTQEFAGGGYHGKVTHVTFDAQGHKMGSVGGNVGIVLDFEGGPEDSSPTLLVGHSKTINALAWQPVGGLVATGGDDGEVIVYDLQTATPGKPDYCSPLAIGDCKGDAVTAVVWGDGDVLFSGHESGAVRRWKGAPTRLIIEEESSSSDEEMLPEE

SEQ ID NO: 11076 - protein, 211 aa, Chlorella protothecoides
MSWQAYIDDHLLAELPGGGVLAHAAILGHDGGVWASSPDFPDITEAEVDAIVAGFDDSSALAVNGLRIGGEKYMVVAGEPGEAIRGKKGSGKLPEAYFWGVGNCIVGMLMLLNFKTMPSRCLERRLVCGLYEGLGVIMAFSMVHFVGVPLRMPTSSPPPPSPESPPPSSGGVTIKKTTTALVFGIYGEGVTGSECNVVVENLGDYLKDQGI

SEQ ID NO: 11077 - protein, 129 aa, Chlorella protothecoides
MSGALAARGASEEGNRGRVEATKVRRYWPGKRPDWVGNEEEEDLAVPSTAPAAEDEPTSVQRTGLGVGPPGPLASLPTDIAAPVVVRKEDPRLRRLQQQQAELAVSEPGRHRDITEPQVRCAPVCGPTL

SEQ ID NO: 11078 - protein, 343 aa, Chlorella protothecoides
MKMVRRPRPRTRTPWRGDEQLSANGEECLSWESEESEEESSEYETESSEEESLAPRLLLKPVFVPKADREVGPGLGGVYGRQPAGELEVGKPGILLLCPVLVVFYSQLHSPALLPVHDTLSSPCQTIMERELLARQEEARLAAEQARAEIRKVETKEILAHRLEVEAAEEASAKVLRLWGQGLPGGRLGGNAARHPPGPSTRCMSFPRHPCLHLQEGPRGMDDVVTDDDADDDEEAYEAWRLRELRRIGMAREAREREEREAAEKERWRNMSEEERRRHLALNPREVAPKPKKKWGFLQVRLGDEWGRGSPASNTLMAQCGAGCDWWQANAGAGVGEQLHVRW

SEQ ID NO: 11079 - protein, 375 aa, Chlorella protothecoides
  MOD_RES (162)..(165): Any amino acid
MSGARSPKTQHLQTPGMHLQSGGLSTVHPNRPTTSVKMESTPSARWRILSRMVMGSAFLYFAPCHSSGRWFPDSLRDYTWLEYAIKGQEWDLETPTASRNVVQEHGSASRIALRRAVSYEGEVDSDTLLAPSLPPLSSRFVCSKGRIADTDTLIASTPASPXXXXILKPQPPVETRFRSIGAARPRVPWRQGAEYCFTCIPPRGDTHSKLEHEANLADIRRSVQCAKNKVSAGLDDGLVGYLLQHTRETEVLKDLRRETAELFPAAARMQISPDQGAFMHWLVATLRATRAIEVGVFTGYSSIATATALGPGGKLLACDPDERALAVARRCWDRAGVLDRVSQCGRGGVYASRMCGSRLLCGPDPLQGAGGLVPG

SEQ ID NO: 11080 - protein, 103 aa, Chlorella protothecoides
GPQGPIPARAAPGQTRAELARARRAPLEKVERPITNGTYINRLHVTQQMAQLLFPQPEEARERGRAPGREGDAPANFNSLFKHRLVIVDEADEAWPVQVCPFL

SEQ ID NO: 11081 - protein, 245 aa, Chlorella protothecoides
MTSITLTLSPCSEAAHSRSSHPTFHPKDPPGPSLQHHVQISVRVTGCGRRRASRRRAGPGNLVRPRHQGLVPQAAEAFVDPSRPLLRPGMECPVHPDGLRCLQGVAGRCSSPGHGAVHPAAGPEPGLATPHVQGASGRQWEGSTVSSLVQDPAHDLRAASYDITVYVRKGVLQIPLLAILTPPPTPHPFPHCVSTALLVVLAATIVEFRKVDPAASTLLLPYFAFSAFAAALTYAFRQRNPPKVD

SEQ ID NO: 11082 - protein, 254 aa, Chlorella protothecoides
MHPHPCMAMCAAMQPQSSCHTSPPTGAQDSGGEVQGQALLLPVGGRGVTASPGGQLWDRVSGRDGGCGEEGQGGWGASPAQEGKSQGRVGKCFRPHAAHCCPLVRLCPHPSGTLHARDSMPWLTCAQHWPFACTRRPHLRCMPRPIDMPPPPICCASQPHRTNSSPISPHRGYGYPALVAVNPAKGKFSSLRSAFEAANVLEFINSVRTGQERVEPVTGALAALTTTDPWDGKEGVLEVEEEFSLEDLMGKEEL

SEQ ID NO: 11083 - protein, 255 aa, Chlorella protothecoides
MTARRTVQHLAQYCQRAHGASLRSLVCEFARDATGALCLLGVLRADWASSTAGRAVRVMRAADEGDPGLGRCSGHAGLCPGQTLIFSTTLSSQVVAASPGRRPTSCRLPRRPPGRGSPRSRPFGRRQCRRLAVGGTRVVQRRWARRGRLNWAGRTWQSPRFPQDWMAAALVCRGCSGIDPASFGGLPGGAALCWTHDPPPAALLHGQGWGGADLPPHPPTCGRGGRPGGQVGAGRAAGGGDQGAAARPARHHAGL

SEQ ID NO: 11084 - protein, 78 aa, Chlorella protothecoides
MHSPFPLALQPLGGLQRGDSQSPAPTHTRAEEDAGVPELKAKQLCVIAFLPDILDSGVAGRNDAIEVGDLWVRGGAVQ

SEQ ID NO: 11085 - protein, 169 aa, Chlorella protothecoides
MPPRRRAAEAAAEQPSAIQRTDDETGEPQDLGTARAQAAQRGDAPATGGEAHVGGTDARHLGPWNSAVELAEARGAALERRQEKLREAAGAAAAEEDWRPARDPSLGPRCDGAVPLLSDLALDQVVSNIEDVETLAGLPYILKVRAQGAVEEVGRWWGAASHWPGMSMP

SEQ ID NO: 11086 - protein, 124 aa, Chlorella protothecoides
MSAHAVELLTGDQPDELVVADCTLLEPAQLEAALLRVAGPRLEVVDLGLCGRGMTDATARRLAAAGPFLALRTLRLAGAYRLGDEGLLALLRACPALRTLGLPESSRLTGQALERWAEEGPGLE

SEQ ID NO: 11087 - protein, 207 aa, Chlorella protothecoides
MISHPTSHRQAASIAVPLAGGTLIGLALKDETRGVWYKTLKKVDVVGHTMEVVLGNLASISSPQQGMSPCTLMSPSPLPTFLQPSWNPPAWVFGPVWTALYSAMGYASWRVWQAGGGQLPLGLYAAQLALNFAWSPLFFGAKALGVAAVDITALVGMVAATIYEFQKVDPVAAQLLYPYLAWVTFAAALNYNLAANNPSGQVRIYVE

SEQ ID NO: 11088 - protein, 146 aa, Chlorella protothecoides
MLTVAAVDVDSEKDLGAEYKIQGFPTIKLLVSRGQGKPARAVEYKGGRTAAEIVSWAMQQAAKVADKRLGGGDGASGGPKQRASARASANAKAGQAPEEPGFYKGTGGRADALQEVALAGGWACVPRLTSHLALTFSPARRRGADG

SEQ ID NO: 11089 - protein, 270 aa, Chlorella protothecoides
MKRQAVLYHTALTSAGLAHMVSKGGNASFLRANQLSAEAARPEVRFWQVLQFLDPQLQLQADHHGERYSLTQLLHTWQADLHSVFLNYCLYDREFAKAWPPQLGIQGWTAFLKESGVSTSTAKPGAENATGEAALELFSRLAEGQGSCEEPGGSAQPGTDALAQQGAEPSPVTASASAVPPLPSAEPARLGFQLFCVALVRLARLLSEARQPPQPVAAASLTELTRQVLTPILAKAGRLACKTLATPTRTGKGRRDVAGKGRPTQRAGKL

SEQ ID NO: 11090 - protein, 265 aa, Chlorella protothecoides
MDGRLLARTLPRLGPLTSGAPRGVLLTYVAVSREAIAALCHMTVDHHKPMFPWPSPTSSLPPLTPAATNSNHTVVLSGCDIPVAELLGEAGVLPTLRALGLERCAGVSDAALASLAAAHPDLESLDLGDCAALTDAGVAALAQHCRALRVLSLRRCQRVGEEGLEAVAALGTLRTLCVAGVPAAGPGLAAALAARGGKALETLDVSWCRGLRDGSLGRLVEACPGLRRLEVWGCSQLTPAFLHGHGGHDLELVGRGEALRPVLTI

SEQ ID NO: 11091 - protein, 126 aa, Chlorella protothecoides
MRTPSSQCGHCKALKADWIDLARRLSGKVGVAAVDCTVSKQTCAEFGIQGEAGRGGLTLGREGRVEVPGWTMQPGFPTINWFATGESQAEAYQGARDAGALEAFALARWAATAPPPEVRRRCVRRA

SEQ ID NO: 11092 - protein, 229 aa, Chlorella protothecoides
  MOD_RES (136)..(139): Any amino acid
  MOD_RES (168)..(170): Any amino acid
MAGLDRGGHLTGTTRVSLNHRAFGVHRPPHVRPLALHAKAESHTEGIRPRLQQRADLCERQLSSLDVSTTGTGEPGLGGNILPHARPRRRLKVAVDVDEGAWCEEGPVGKLRHTHPTPPAVLGRFLHSLNQFCLEXXXXGPGGAANGRTRGLLCMVGSGNTGMCRRAXXXEHGREYQVSDYFLYDFAKVWKCSQEASNVMVHNFFKSHHFSAGIQPIPGAARRGAGGDW

SEQ ID NO: 11093 - protein, 758 aa, Chlorella protothecoides
  MOD_RES (134)..(137): Any amino acid
  MOD_RES (532)..(534): Any amino acid
  MOD_RES (672)..(675): Any amino acid
  MOD_RES (746)..(749): Any amino acid
MTKCHGRNRGMRDPPVHSDPRSITAQTPCYHTHLLHRELDRSFTGIRVVHGQQDHPASHGPGAALSPFCRSCRAGEVVTRVRFNPGSGARDLHPRGVAHEHVFMTASPSTWRAFGAFHDNLTPSSRCWRKLVCXXXXGLFMTILLRPQDAGANWCAAERECRELWTRQRPSHARPHSNGLCFQPEVSRRLHVHHYASYSSMGCRSIAIVCLQGARMMHIRARESCMISSSMLSFFPPSHARPSPPRGRRPGPRSSLTTSASMRSGLSIQGHQPTSPAGWAIIVDSLRRADVQLLSPQEVQHALQAGTQCVVDVRLPAEFEAGHVSGTVNVPFFRPISGWDAVRVLRRLAFALFGIRTGTELNPLFVEEVSRVAADSSKGIILMCNIGGVIEHSGKDGRDVQSGLPKEVVPCPSDRSVACEVSCWMLVCLSHRASTPNPLARYSPRPKLVQGRHAESFAHCCPCARRVGQVWFHQGPEGRGQWLGGIREADRRNVKPGLDAGHLPNSCLGLRAPQRFVVVHPAATSTRRHYSXXXISHLRVGGRAPPKQVPGCARAAESSRCAPCSNLYTTTLFTFSVTISDFGIFRTEYFPPSRQHTWERNSFTPCGAPGALAGPHAHTASLGTQKGCASDLQWRVRVSGNCRNSSSTTASFPAAAGARVVPMRTSLHPAEXXXXPTRSSLWVHDHTQPCEGQTFNGVPVPAWRTCFPCRLIRQYASTALHCVSVLVTKVDFCSLARSSGLGMIEXXXXNLALLWVQS

SEQ ID NO: 11094 - protein, 250 aa, Chlorella protothecoides
MRVHDARARVPELVLVHVETVGADAPHGADAGVGADPAKGAPAPNRSTQKASLERYRSDPGAGGGLRSTAEVLTLLHAQLPGAVIEKASIDEVYIDVTAEVERALSRHEAHGGLLPEADSVVIGGPLNPGSEFERRLGQGAGLAARLRAALFEQLGELRVWARRPRGDWHWRCHHEVAVQIPVQIPLSHQQAMITPGHPLHRLHQLGWHRQQQAAGQGGICHEQAQSPDHRPAPRRAVPDAGVTGGLGAI

SEQ ID NO: 11095 - protein, 117 aa, Chlorella protothecoides
MTGRVVLLAVDDSDACEGAVKFTVEQMHQGGDEYHVVHVIPRLQLSSQYGAPSIDFLPQQDSTAYEALLQRAQDFLAARVVTHLGDVDPPPMLHLIKVAGCSVSVRSRVGAATRSLV

SEQ ID NO: 11096 - protein, 455 aa, Chlorella protothecoides
MHRSYFRCYVVHATSFATLKNNVAFNSQGHCYYLEDGVEEQNVIDRNLAMFVNILGTVGVTVMAMVWEGSGGWAVSGPAAGIDQSGVTLTTSGTGLENPSDSSAAGFYITNPYNTLTNNAASGGYSGFFYPVLPAPIGLSRSTQLVPSQRPLLKFDSNTAHSSGAWRGGAGTKADVDEWMGGDAGALPPCALSRGADHCWSLMGSTLCIAIAATTGRTLGASTLAASCTTTATTSPTTLAAWSLTPGAVGSARWGRWRQVLHEKEQVAWTRWAGPKSTTSQVKYLSDSECTVHMLNPPPTTHCPLHRALDGVTKGFMDFTNTKSFLCMSGHMSWGARMQLLNYTAYDIVRGATMFGSVSIYVFSLGRYRNLVPGSLTARAWGNCALIQDGYIQYSSANPNSAFPGATADLPPAAGFQWYDTSTQTIIADTTFANYTYQPSLGTFRPSVFYVSMVS

SEQ ID NO: 11097 - protein, 265 aa, Chlorella protothecoides
MGAGEVVINADPVYPDPTYPTPTCPSTAPTAVSIEGGMRHAAIASNHKLAHISSNSSCPLSRLPQDGRTDCPFLASGLKRWNDPATWGGTVPSPGTSITLPANSKVLLSGCMISATATYTQVIIPATSEGHMQGCTPDGESHARAVPTRAHPLVPTSMPSRSPRSSSWMTTPWCGTWGPSTCMVPCAVAAQPAASTPASPSCSTPSTGSAPSSLAFACDPGGPSSCMARCTRPPGPGWGLPSPQAAPKSPSRSAIRRGSQRWSVV

SEQ ID NO: 11098 - protein, 199 aa, Chlorella protothecoides
MLLEGWRVALYTPPPALTNHQHAHAWCRVLSQGSSPCRMAPLRCTSAAEPFGAHMEDPRTRHSLAQAGLAMRDCIKIGRLGAGAGTTNQIRLRWRTSEVVRLRCAGKPAADMKSLAQALETATGGQVVYRSGGTIILHRGQHWQSGALAQPLCSAEPVVLQGVSDEEALCNQAMPADTADLPGPQSATSSLAGLLASNG

SEQ ID NO: 11099 - protein, 378 aa, Chlorella protothecoides
MLTLHACLQLDTQPPFHPHNSGDSSGLVFSPDGTLFALTTPSGVAIHDTASRTLRHALPSPGTLAASFSPDGRFLLTQARPAKDVDQDRNLKLWGVEDGAVRLALHQKHFRREEWPAIRFGVRDALAYYQVTSAVHVYDTSDFSNGVTHRVPIKGVSSFAPRPSGGGGALLAAYCPEAKGSPASVGLYSAEPGADGTPICRKNFFRESAGQGCRKGMAIRGFVGAPSPLAGHAHCLCAGARGLTLGWTLAASDPAHSLYIPGRGTFVPTSLMLPSNSQSNSAQLLWSPSGCAVLALAASDVDATNQSYYGEQKLYFMASNGQNECAVQLPKEGPIHDVQWSPKGNFFLVVAGFMPAKVILFNSACVPKFDLGELNWWI

SEQ ID NO: 11100 - protein, 95 aa, Chlorella protothecoides
MKRALMSLAEVATRLWPHSQTMLFGSQATGLTLPGGDLDVVILGVGSELDTAGSGFSARERQQKVQLLEDLLDALLATKLLQGRVELIDARVPII

SEQ ID NO: 11101 - protein, 360 aa, Chlorella protothecoides
MRAHAWPEAVPAQLFELVLTRDHCKPASAAAIAARGGNPWDTVKPLAHHFPRLDQVLLIDDSPHKAAADEAPNMIVMPGWAGPGAGKGDSALPVLVEALLDLAATGQALAAAGKPVPDLRRHSGAISARLAALAVPATELRAGSALEASDDASSADPVRSSAGAQSAGTTPAADVVGLALVWSEAGGSTQACEGGEALVAGEPLVAGEAGEASTGRRKRSKAGITSEFPEVTQADVDRFADMYPPQTPGVLPEWAVQAAVTLLGHVVEVRCAVHHFSWWWPWVAAVGCTDPACHAAGCQGSAPALAPTVACCTPLDALQSLAWPWTRPGIDRGSASHVSMGLLLGLLRRSLPPLLALTAV

SEQ ID NO: 11102 - protein, 161 aa, Chlorella protothecoides
MLSRARATGHLPPEHGAEEGSVTAPSLEEACLLWWQGFFLALFLLSQVPSDGAFPKSSSQQVHKRIKHSQAVVQFSPLGRQVQGSRPLLLFDLNGVLLQHHYLGIGQHSFDMRPGLVHILRLLPYFRLGIFTSSTHRTVLKSVHKLHAKQHAAAAPRQAGE

SEQ ID NO: 11103 - protein, 252 aa, Chlorella protothecoides
MVRWNPFGRYFVLAGFGNLPGDLAFYDKKADGKCKPMGTTRAENGVALEWSPCGHMVLVSTTAPRLRVDNGIQVFRADAARLAARPYPILLQAAWRPAAPGSFSDAPLQTPGGAAGAEPALPPPPAVTGYVPPHLRGNPAAAAAARSKFSLARDAEDRGGKITSGGVVGAPPAAARMQPALPPGGGVRGWELGLGAAGRATAKSLTTHFPPSMSSGTAEATPELSKAAAKNAKRRAAAAKKKAEEGLGKLAI

SEQ ID NO: 11104 - protein, 202 aa, Chlorella protothecoides
  MOD_RES (100)..(103): Any amino acid
MRIFECEPPPSYSQDWQSELRCPLMRIFEWPTGRCRRCSPARTSRVLPSPSKSCELFKTRCAAGENHFREVQPHDTLIFLHLFLPRAPRRFWAGFRVASXXXXSCELFKTRCAIGENHFLEAMQAPTTTGATPAVPLTTADIQQVGVKLLDHVNQALRCRIARMSALNSELVHTLQMLEENAKMIQAVVENQNLNKMDECLQ

SEQ ID NO: 11105 - protein, 338 aa, Chlorella protothecoides
MFFSHPCWTGEECRLFVGDITLQPNLGDGGAGVTYPCQQVRSGSDICMRGAKIRAVPPATALATCRTPPHPHLQWVSRTEHSQLQYEGKDGIDSGEYRLQVQTSDLRGAGLHPAGRLFVVLEGELGRAGAEGAVRWPPQGKDSAWTSHGHRHLPSPPRPCFLMCPFQFGPSAHSSNPPFQRGQLDAFELVECPDVGALHSLEVWVEGSRKLNWHPAWIKVGPMYGDALPTHFPCQRVHQLFQPLSPSSAGILSHPVTLSLSMSHAARSLTHADLTPRWIRGGTAWRPTGHVVFYAEPECWAGVEVPSRGKGDWEDDSGNDCLERVLEGQVLQGLRDWA

SEQ ID NO: 11106 - protein, 538 aa, Chlorella protothecoides
MASLTLPERPRERMRLVVSMRAAWSALEEPCRFLWRVSEGVGSLAAPCLMPPPHGLPTPFVTGPNAPEWPGLMSAVILLHFGPPHVLESTEIRREGGTDGQGVPAGGGEQRPWHATSRMHSEASTSKIESKLAGSQYSKTSASSCCGRNSIHGMRRLLRLAGSVIDPPGHVVPQCRVMAGPGPAPEGEASASATAARNMHGKLSHLMKKYGRVALGVHLSVYACFFAGCYVAVESHLDVPGYLERFGLMTPPVEGEPAQEKGWVHKALAGSSSSLALAFIANKALIPVRVPITLGLTPPVAKGCSRCLRQCMIKLTSEPARPPGSRWNSFPLPSHSSQDEAWHLHNQLIACLILGCCRPFSLDEEFWSLSGSRSQPIAVADPVWLKLLRKANPLPRLWGALAGYYCTLVIMHVPRLGHMLCKLGYMPPAEVRVVEATSSVVSSAPDVHLLGVYGEDERKVGDRLEHAGGLEIAHKGDAEGNLRNHRLLKMGGGRLRTCDHLGRRSQRHTHPYAYDCTAIMHRLSNPVRFQHLEMGDPL

SEQ ID NO: 11107 - protein, 339 aa, Chlorella protothecoides
MPSPDSTDSTLLITGSADKNLKIWGLDFGDCHRSLFAHADSVMQAAFVPGTHYVFTAGKDGVVKYWDADKFEHLLTLAGHHGAVWAMAVSSLGDWLLTGSADRSLRRWCRTDEPFFVEEEQERRLESLFEADLEGGDDRRPVGAPAPGDEGSAAPAARRTLESVSAADAIVEALDAAAAEEAALEEWRAAARSNPSLPRPAPSPLLLGLAPDEYVLAAVRRVRGPDLESAALLLPFGDALRLLGYVAGWLRGPARGGAAAELMARLVALLLRVHLGQLSVTPAARGTLTALRDLLHARLGGAKRALGFNLAALGTLGRLVAEQGLGAAGVKRSAAVAGL

SEQ ID NO: 11108 - protein, 298 aa, Chlorella protothecoides
MPAPRQVVLAADRLCYAPSPDPEEEARYIPLDRVPVRAMPRGYAPGIGAGLVDDRHLDPGRTRAAGAGCVFSLACGSHVHLFAASSPEDAQVWVSKISRAWTRCFQEPRRSMSPTKTRRDADPKMPRLLLEPPGPGPWPAEATPPAPPPQVAPSAPPLRQELSPPRRRAATGTGSHVPTARPLAVPAVYEIRVTTGDRRDAGTSAQVVMELHGVEASSGEHTLVPAPGTVPFQRGTQSTMKIRCPCLGRLRAVTVMHDASGPQPSWWLDEVRVRQRGSDANWAVFPCRQWLCTERGDG

SEQ ID NO: 11109 - protein, 444 aa, Chlorella protothecoides
MASTRPSPKAAAQSHLTHLCKHWAPVRVWSLSSGELEATFSGHRSGISALRFSADGALLASGARDTDVVVWDVGAESGLFRLRGHSGEITALAFLPAAGALVSSSKDGLVTALAFLPAAGALVSSSKDGLVKAWDLGTQHCFQTLTGHPGEVWALAVSEDQRRLVTGSTDDLLRWYVVAETGGAGGAADAGGSAAGRELLSPLGTVSRRAPDRVAALSFGADGVLLAQSAGRGVDLYRMCGEAEAARHAKRRRRRRREKKGKAGAKGGEAGGADAPPPEDADDSDEVAAQDELETLPVLRSKHKVRAAALVPGARRGGTLGLVLALANNSLEVWECAGRAGEDAAPPARLALLDAGGHRADVRALALAGDDSVAVSASTAGVKVWNPRTGSCLRTVEAGYGTALLFVPGNRHVVLGTKEGQLAVVDIAAGEVQLELEAHTSTVW

SEQ ID NO: 11110 - protein, 249 aa, Chlorella protothecoides
MRHGAAREPTPSETRHKNLQGSSSADQAARIETTKRIRSLGRSGRVRDAISELASLARLGVQPDAMAATSLLHACVENGRADLAENVFNELFGAWSEGDRHGTRLSSAWLERVPQLVRVDYTLGPHSPAMPYSPPLPHFPSADDALVPDEIAFSVLIRGMGRSKPPRWDSIMALLDTMEGRWGLQPSAPVFNALLDICVRTEDDARADTLLDRMWTGGVAPDAMTLETVRQNKKLRSRVKRLGAEVGRV

SEQ ID NO: 11111 - protein, 167 aa, Chlorella protothecoides
MAQDFEHEDSQQRLVNATQVRLELVGEQSSSGVLRLARGRRSFRPGSEDTFTFPHIPWLGDIRCIRVATDGSGLFPAWHLRCVHVWHLSSGRRWRLDCRAWIDRRCNNSRWLSVAEEGGAAAEGQGLRPHKQVPAAPGPRQGDDSSIKAGWALEQQHPRQGGWHQQR

SEQ ID NO: 11112 - protein, 853 aa, Chlorella protothecoides
MAWKGGLGRQSCHRFGHRGDPLLHPPPQPNLPGASTAFLCRQWLSRDRGPGQTRLTLVSHRGDPRAAPHEYSVQVWGPGVAASGALAAGRVRLHGDRGSSPWAPLDAAGHAVVRAAPLGALRRLTLEAHPPPAAEQQAYRLEEVRVACPSLDLLVVFQAGRRGREGQGTSALDLFPADAVLAGRAAGGADEVARPPTNAAHSVPDALPTGTDAMQYRTAQYRIRVATCPGTSTGMSAQVALSMHDAKGCSVGPLRLSGAGGAFQPGSSTEFQAAPMQGGVHKCVLPDPRAHATQVEAAALEGISSITLEMDASSPAPAWKLDWVEVEVRRSKRGGDHGETYRFPARRWLGDRHGLSLTLQPGTGQPPCGESVVVRQPVQVATTGVQTGSPSPIVAQTVLQGSLRCIHCPIQTCATPSRLLPAPSSILAPPLNTSPVPPQYPRLQPAQPTRIAIYTSDCVGKGHPQGLTLAIWTADPGQRQTLHLSPPAHATQPGRVAELDAVLTLDLSDIMGGELGPGRVAELDVVLTLDLSDITGGELGVTRVSPAGATWHCEFLALSAGARVLYLAADAELGRGCQSATAPLAATWRNPRADCELGWRELAPGAAEAAWQLRPLGALERVELRCDRGAGPWLLDSVLVEGAGPGARLAFLALHQAWVAGGDRLDLPFMPAGQAAEVEVSLHCQALCLGPSARPYLVVLGHGGSGPPVRAFLPAGPRTELRRAVLTHTLTLPRAVKIQALAVGVQGLGAAGYLALDWAVVESVGEAAAPQDSGGWTCEKVCGLRMAYFQPAAWYFESSEVLEGGGQGGAAAEVSMTPVQAPPERDCVFEASGGCGGNSLCWVTWQRLWMLGI

SEQ ID NO: 11113 - protein, 289 aa, Chlorella protothecoides
  MOD_RES (250)..(253): Any amino acid
MSGSRKNLKGCSLLEFRKYAWVLGFPPPPAKKSPPPPAKKSPPPAAKKSPPPPARKSPPPPSRKSPPPPARKSPPPPAKTSPPPPSRQSPPPPSRQSPIPPAKTSPPPPSKKSPPPPSLPSPPPTPSPPPPPQRATIEFSNPVDGKVAVKVVLTTDGYVPYTITADLYSASFDNLLELTSEHNSEEVTTLSKEDVDQTVAARYSFCILAIQPTDWGILDIVYARVTLINPYPPPSGPSPPPPALGSISGXXXXIVKRRFSLKYPLWAISPRDFASLSSTQLALRSKCIP

SEQ ID NO: 11114 - protein, 335 aa, Chlorella protothecoides
  MOD_RES (244)..(247): Any amino acid
MLCALQLSWTWCTPFWHAAPPFLGDVLCLAQMCDVPCSSVISDPGPCHPSQTPTRRGSTPLLPPAIPCSSIGAGVPLHPPALIRDALHPVCCPLPNPFSPPAHAATRKLLRRALVNAAQTSNATDVDVRCGCDICPGALPHSQVLARMRASRYCLVLAGDKASSRRGTEAALSGCVPVFVGPPWHTVALADDIDHAASSVFITVRRVTWVVANASQGRPESHPKVLADWYLDTELPPGAMLHVXXXXGGGQHLAGQGRQSPQRADGLVPGHRPTARRNAACRHPGRGGGRAARTAAKGPGCQAGRTGAGGLQAVLAARPGGGQVAAGGDCSEETV

SEQ ID NO: 11115 - protein, 244 aa, Chlorella protothecoides
  MOD_RES (117)..(120): Any amino acid
MSLDASSEMVRDRKCRRRQDAVGGTFSGLFPLHPASVPNVVPALPGAGPETEAPLRDRDLTCSIPTPGHIHQSTLWGLASRHKTGPWESVRPHTSIGGDQRGMKNMAKMTRVGYMDXXXXHTAHQRAGEGHGMCLDDTQAVGWGQQGQGGSHSSLRMISAEHFGDKAGIIPALQKLSFAGKNLDDAQRTLAQYGGLRKGSVIWYAQSALDPARPCSHTISACPTIHFNAAMEWHTGMTSFPSGH

SEQ ID NO: 11116 - protein, 149 aa, Chlorella protothecoides
MQNEYRGGEGVGGGDGKDGGGGDFFEGGGGDVLAGGIGDCLDGGGGDCLDGGGGDVLAGGGGDFLAGGGGDFLEGGGGDFLAGGGGDFLAAGGGDFLAGGGGDFLAGGGGNPRTHAYFRNSSRLQPFRFLRLPDMLKQWWPVPSLLFPQ

SEQ ID NO: 11117 - protein, 1005 aa, Chlorella protothecoides
  MOD_RES (61)..(64): Any amino acid
  MOD_RES (420)..(423): Any amino acid
  MOD_RES (520)..(522): Any amino acid
  MOD_RES (609)..(612): Any amino acid
  MOD_RES (965)..(967): Any amino acid
MPKRKAPPTDEADKASRAAEAEPDDHTEDVDPKEVDAHKASPSTKVLAGYYHRTMPTTRRXXXXHTEDVDPKEADAHKASPSNKGITTEQCPPPGDSCMPTAGRDYVSCKEALLLAHAPESHIHSAAVSSRPPLKINRAPVLTLWAAVVAEKQGFHWDEAVTIGKYIAGVLAHSKGKSLGLYHDSPVTEEDREARRERDRNMGVEHVDAFGMSIPVRKKGRHHLAFSQGSTLAPASAKTYLSHAFKDHLEDVKHLIEVVQTEAKQSILWPSRACTLDEEGYAAAMLVPSFSASFALTGRDGPPGVSRARGRAGQGVLPPVRTLPPGMERVGPERGAGHRRHLPAGARRRLEGIRPLTQHPPQRPRGTAVLCQGHHCLHPNKGSCCTQACMEVHRRLVCSGWPGSAPPHTKNRPHGQRARXXXXAPALGVQRLVGVSTATHQGQAPGAKGSERRGPGTVQAPVGPPFKPQSPGPPPLGGRTPGCRRGPRRRAGAGSPAPAQTPLRSARRRGGGTGQRSAPXXXGPRLLPKPHYCRRSVGKVELGKGALRGEVARGEGQGWAGVWVEPSWQRGTGQHVHCRALRWHGEPQECSPEHLCAQVPPGPLAQTLXXXXGQHVHCRALRRHEEPQECSPGHLHAQVPPGPRAQTLSHFTQPPTHADKGELGGGVGPPLRLLLLLRAAAAIGPIPRRPHALPPAQGEDVRGAAVAGDRQPLRGRGGQCPPPPAEGQGVDARGVGAAAQLLQPRAVGGAPDAEQRAALRGGGQVLARGCEAQRAQRARVRLDEARAPRRVRLQPHLPAVQPGAGQQRGVGAGGQRQQARRVGRGLHAGGQAQVGEGVDQDLVLQGHGQQVTAQGHAAHARAEGELADAAPLVVVPQHHLVGRVTGQGPAPHQGQDVAAEQHLHDADAAVGELPPELRGRGGHSSRVGGASAGLCDLCLSKTRPLGRGEPRAMRLWDGRSCRVAXXXRRWRTPAGTARAWRTFIVGWWGECGAVRLVSVQDEAFR

SEQ ID NO: 11118 - protein, 500 aa, Chlorella protothecoides
  MOD_RES (404)..(407): Any amino acid
MPCNGSESRSDMDTPLAEHKLPTEGTGALLCKLAVIHPPNNHIELTAHGLTRALLGRQEDCIAPDQCLAPPGFYTSLQPRIPSASVLNKSQVALSPEASRHPLRLSHFGLKYRREPRRDTAPSRMQSGYRPPGNQHDWDARPCLRGARNRLGLAPGVQRRLAKHSIHPPWRRSTPTGLFVVPHPADLPPGKPAACPGRKAQCCHDCNTAPECVTPPIAHAGRSTCALCVLPPHHRGPAPAPAGGRAQLRAAGRAGHGAAHVHQPAVPGDADLPAGRLTGALRHVRHAQRRRAGGAGTGGTRGVCLCGQGRRVLTDRPGSQLCPAPTLSAPMVASRITLSYAYGACSVKCAVCNHVTPVPGAPEPSAPRTQAVIVENPSSVDEAGFEVRQGRNMSVYPLLSWRRXXXXVENPSSVDEAGFEVRQGRNMPVYPLLSWRRGAIGTRCGLGRGLRRSPASGRPPCQPTTRASHATPRRSQTWHWESRANDRSAPDARLPLNDVE

SEQ ID NO: 11119 - protein, 397 aa, Chlorella protothecoides
MSATPTQFRREFSNGGIGIVEMLFRSNILALVGGGPLPRYPPNKVMLWDDHQGRCIGELSFRSRVRRVALRRDLLAVALEHKVLVYAFSDLRLTASVETAANASGLLALSTGPDAALLACPGLHSGQVRLEAYATRRTRFVQAHSGALGALCLTPSGKHLATASERGTLLRVWSTADGTRLQELRRGTDAARIHSLAFSGGRGALAAAPPEWLAVTSDRGTAHVFSLRRGQGVGPAGDRADGGGGAQQQQQPEGRANPTSKLAFVSVSRGLGEVTQSLGPGSWWDLRMQMPWAAFLWLLMPAQGSTMYSYLPLAAGYFSSERSFAQFHLPDGAPTVFHLPDGAPTVVGFGQEPGTLLLLSSSGLFYNLVFDPLVGGACEQVSCVQFMEEAPRQGGGY

SEQ ID NO: 11120 - protein, 467 aa, Chlorella protothecoides
MVILGPKLSQKTLNQVLLKHLAKLQVDEEPSIRANTTVLLGTLATHLSEATCRKVLLNAFTRALRDGFPPARAAGLRESGRACQPADALSQRSPDPPTPPQSPQAIIATAKFHSPEDAATRILPAIGPLCIDPVAEARGGGGRGKAFQQPVRASALDCLEHFSAVLKAHQQDLTARAEASTATGGGPTASSSGAGSATAGGGRMTSLGWAASSLGLARAGAASPVPTAAGGSGQVGGPAAGGSGQVGGPAAGGSGSGAGARAAPAGPTPSERPRSSAAPPSPPDTSASARSQQPLGADEGWDEDDADGLAEHGGWRKSVCLLGSGRGSLAASAFQVGCLALASPGTGAHRRDLPGAEEELAARRRLASASLRPAPRAPVQAKPRGPPSHAKPRGPPSHVAAPAPSSGDDWFDQPAAGAAPRPRAALAPRRAAGTAAAAPRRSGAGGGMKLGVSKLASDAKPADFDEW

SEQ ID NO: 11121 - protein, 429 aa, Chlorella protothecoides
MGALCPGRCRAEHDQWPSVRHTSTLIQFALTNPNLNLTTPSNSRLPELYAALGRDLDVMEPKLPEDVYKMHLVEGRVPTGGQGKEGGAGCSWGCVGDNAGGREVTAHFSTWWEIVVEPVPVSFRPGPRRLLYPCQSSPLQGKMPLLTAIPPPQLHPQGPAVDSARANLSATFVNGLVNAGFGKDKLVTPGVEDDAVHWVFKNKDHGKLSAAASLGLVMLWDLEGGLPAIDRFLYSNDPHVVAGALLGIGVLSCGVADEVDPALAILSEYVGGAEAWPRIGAALGLGVAYAGRGRADVADLLAPMVADPDTPMEATVAAALGLGLAFAGRAHGGAVEAALQALMLRGEAELAHPFGTMLALALGLLFLRTGEAVEATLEVVRTLPPALAEPTLATLRACAYAGTGDVLHVQALLAIAGGAGGGAEGAAGA

SEQ ID NO: 11122 - protein, 282 aa, Chlorella protothecoides
MTSVPAPLKFLAPHYTPLEAMHAALPAGHPAAAPLSDVLSALAMTSAPGGSRACLRYKLTGAAGADVAVWGHEYVRHLSGEIGEEVGARRAAGEAVDDLLALVDLIVPYDMSHNAGAQGEGACVGVAAFLWRGVLAATAPRLSSTCPRNPPFHTEPDAIDLLLEVDRVADLPRHVDAGNAERAARYLQACAAYLPEPEDEAALRAVHAVHMRVGRHAGALRVGLALGDAELVGAAWRAAADGGERCQLAYIMGRAGFVPDLEEGSLAVADEALRERYFSCYR

SEQ ID NO: 11123 - protein, 83 aa, Chlorella protothecoides
MAENRGELELYNQWFVLADTDKDGVVSGGEAVKFFSKSGLPTNPTLFKVWQYVAGDRPSLNRREFYTAMKLVSLAQVPEVFCL

SEQ ID NO: 11124 - protein, 140 aa, Chlorella protothecoides
HSPPPHPPPPPPTPRLYEGYNLRAKFKGHANRSTQIKASLSPSCDTVICGSDDGWVYQWAVPSRPGARPEDAVVKEKVLSYECFLAASDVVTVAMFAPERALATWPTQPGKGGAVGATPRVILAAGYGGEIKVFEDLHQP

SEQ ID NO: 11125 - protein, 497 aa, Chlorella protothecoides
  MOD_RES (21)..(23): Any amino acid
  MOD_RES (350)..(352): Any amino acid
MCRWACLCGTRARTLATARTXXXAHPAAPHRARRVAGHAGVGPSREPSRPLASHAHHHPRLPRHELQLQRVGVHAGGHGRRVRARRRGVRRDPGGRRRRRDGLGAPERALPLFHRVQALPPGTAERLGCGLGGEWGGDRELKDGRSDILQLTEYAHVAGRGARVRDSTETCPLSPLLLLTKVDIVAASEADFEVWEGWVTSRLRLLIRSAGSIVEVRPWPKPLRPPADPLACSYFLGLSKKRAVALTGAYAPHAPAPAARVDLTQPVNDFAHRVKDWAERRPGMELAVRHVLQKQLPEWVRAAGPGGASGLAAGQGAEEAMQDAEGAMQGASAAPTPANSRTAVDASKGXXXGAERAVQGAEEAPTPANSGTAVDAPKACPAQAASGAGEELESRPAHAPAPQNGEGLPPMAPPRRAPDGSARVPEPAPKRSRTEETGGPAPSDAPRRAASDLSVMDLGAAAGKADNVCSTTEASSMVGFWMGRCGSGGSCMLVHWE

SEQ ID NO: 11126 - protein, 406 aa, Chlorella protothecoides
MQGTEILPSLSRLQAGNLTLDEAAGLGSQGCEEEAKVRYGFLKEEKEGLSDEEVMAEFKESKHGDEGGVFAAELPRAEVPRQPKGVPASEKENASNVSVGPPKFLTAAEVQEILRCVWAANADIMQLIYPADVAQRKRRQGASEAQAAAAGKAAAQVLDGDDWAGNYREFFIQTVAVTPNRFRPISHVGEMVYEHPQNTMLVKVLNANLEIQRLGERACQPATGLSALMLLSVQAWLLKYVLYRASLNTLTNKPHLWSAAAETDQDGEPLDITDGRMLRTWLEMQNSVNAFIDSTTAENEPNAIGIRQQLEKKEGLFRKNMMGKRVNFAARSVISPDVYLNGGEIGVPPYIAARLTFPERVTPWNVERLCEAVMAGPGRNPGAVAVENEKGRLLMLRDDAKVRRLT

SEQ ID NO: 11127 - protein, 341 aa, Chlorella protothecoides
MVRIVYEASGDESVLERALPALLAEHAYWTSAPKQVEVLSPDGSTTYNLSRYYADWDTPRPESFREDQETARKAGFDPAAPTAATRQLYRDLASGAESGWDYSTRWLAENSTDLSTIRTTRVLPADLNAFLYQMERNIATFADALACADVADRFDAAAKARREALDALSWDPAAGQWYDLIIDAEDGDGLAGPVSVAPNAVVFPSNWFPLYAGVAEAGSVQAAAAVAAFNASGLLMEGGVPASLVESGQQWDYPNVWPPIQGLLVQGFRNAGGAEAEALAQTIAETYVNQALRTWEETGANFEKFNSTLVGRPGGGGEYAVVTGFGWTNGVALHLIQQYDL

SEQ ID NO: 11128 - protein, 108 aa, Chlorella protothecoides
MASKEVQRYVARLSLLLEGRLAEAQGINVGASSSARKAAGKEGMELDEGSGGEGSPTSVVKGPLPSRRTVAMTGQSLEAAIDTMSEIFKKQPPGRCANCGAHSPSIKK

SEQ ID NO: 11129 - protein, 132 aa, Chlorella protothecoides
ALLRAGDKCVARYEDGQWYRASVERVHAADPTAPEYDVYFIDFGNRQRAKGAAVRPMDAALAAVAPQATPATLAFVKVGGLVACWSEGGGRKGRASKPPRQRAWCRSPSCADSDAAGRGGVHPWPLTSEWVA

SEQ ID NO: 11130 - protein, 111 aa, Chlorella protothecoides
MEAWLPGRLGARASATTDDESQYNPSSSPQYLRAQNLYESREEAELREEVLGALDTLVKEWIKGVAAHHGQPVEDATAVIYTFGSYRLGVHGPGVLLLLGLSGLYCGEQAF

SEQ ID NO: 11131 - protein, 198 aa, Chlorella protothecoides
MASAQRRPWGRESPSWRRSWLRRRQPPRPPRPRAPRPLPTPPTSAQRWEGGRIGGLWVLRAVHANEAEVPARSACCWSRAWECVWACLGEDATPSITPSWRVLRAAESGDRAQTVSPPLPLIPPLPPPPSQLAGARQALAESRHADVVDYQRRAREATELLFAKQAQLERASADRAALQLALERETANARAAAAEARR

SEQ ID NO: 11132 - protein, 161 aa, Chlorella protothecoides
  MOD_RES (36)..(38): Any amino acid
  MOD_RES (75)..(108): Any amino acid
MRGRGAAPAARGAPPLSARASCAGGRRRGGRRPCPXXXGRTYRPSAEEFADPVAYIARITGEACGQGAAHIIPPXXXXXXXXXXXXXXXXXXXXXXXXXXXXXXXXXXAGTRPLHWSAGRRAPAWSPSASPSAASPPPSSACAAPASARGPAAAAAAAPRT

SEQ ID NO: 11133 - protein, 547 aa, Chlorella protothecoides
  MOD_RES (264)..(267): Any amino acid
  MOD_RES (426)..(429): Any amino acid
YGGGSRPRGNWELRGDVEKDPFAEAEATNKDADELFAGENTGINFDAYEDIPVEATGSNVPEPISTFQDIDMGKELMENVRRCKYTKPTPVQRYSIPIGMAGRDLMACAQTGSGKTAAFCFPIIAHALHGGFQPGARGRKAFPLALVLSPTRELSSQIYDEARKFCYQTGVRPVVVYGGAPQVQQLRELERGCDFLVATPGRLIDIMDRGRVSLAKVGGCGCACSENGFLVVCVCVCEGCACWRLGEGGVRLVAAAWSLLHRPXXXXRFPGDTNTHTNITSPPPPRAQIRYLALDEADRMLDMGFEPQIRRIVQGEDMPPVGRRQTLLFSATFPKEIQRLAADFLHDYVFLAVGRVGSSTELIVQHIEFVPGHEKRQMVLDLVQSLAEGLTLVFVETKKGADALEDFLLPLRPHARAGGHRRRGAXXXXHVTHVINFDLPADVDDYVHRIGRTGRAGKKGLATAFFSDKDAGMAGKLVELLQETNQEVPGWLQNTAARAGSYGGGGGKGRRGGSRFGGRDFRQDRGFAEERYRRGPGGLGHESREAD

SEQ ID NO: 11134 - protein, 444 aa, Chlorella protothecoides
TLTSAVLAEVAASEARAAAAPLAAAPAVAARARGGVLEPAGDLLIGLLQQLHQLPRHARVLVREEGGGQPLLPSAPCAPDAVHVVVYVSGEVEHGRAAGAEAAQRGLALRLTTVAVDGGGGDAVAHQEVLQRVSALLGLHKHQGQALRQRLHQVQHHLALLVPGDKLDVLHDELGGGADAAHRQENVVVQEVGGQTLNLLGEGGGEEQGLATAHRGHVLTLHNAPDLGLESHIQHAVRLIQGQAAGGGHQEVAATFQLAQLLDLRRAAVDDHGAHPGLVAELARLVVDLGGQLAGGGQHQGQGEGLAPAGAGLEPAMQSVCDDGEAEGGGLAGAGLCAGHQVAPRHADGDGVALDGGGLGVLAPTHVLHQLLAHVDVLEGGDGLRHVGPRGLHGDVLVRVKVDASVLAGKQLVSILVGGLRLRKGVLLHVAAELPIATGAAAAA

SEQ ID NO: 11135 - protein, 261 aa, Chlorella protothecoides
MDRESVWGGRTERRRENSRRPAPLHGDWPAAHSRRDGSTWLPTVGYQQFPDSPSTSLPPLLPRPFPLPRPLSLPSLPQPPSLPSLPPPENHSTQVDDDGVATQLTQLLTSQRAGRATFMPLNRLRATEAPRPDQYGDAVAPLLDFLSFDPALRPAMLQVFGKTLVCRDLAAAARVARETDLACVTMDGDVADRRGALRGGFTDVRRSRVAAAREKRRLGAELGALDAELAGVRGRLAQAQQDIALAGEALGREQAQQSHIQ

SEQ ID NO: 11136 - protein, 359 aa, Chlorella protothecoides
MLAVQPGAGDCAYEELRAVGARPSVGHGKNAGLGVLQRKVLVLKGWAVDGGAASAIPLLHVTPLAHEVGNDAVELGPLVAEEHPLGTHTSLPGTQAPEGRWDTARFERSWRAMVPSNPPYCTVVSNCSSSPEVLGCARDHIGEQGHCNAPESLAIDFYVEVDAGVVETISRAGHESVSGRDSSGIWSAVKVSPRRMRPHSIVHRWESLGARNWRVMQRCRQEEMQVYSKTLLLKIVPSDGSYTCTLPPPTPISGAEQITVDLKNDLSITGTLHSVDQYLNIKLNNIKLANPAKYPHMLSVRNCFIRGSVVRYVQVTFCWRGPLLGMQLLCRHGHGAWNGRQGMNHLMLAPSFSEEPSPP

SEQ ID NO: 11137 - protein, 631 aa, Chlorella protothecoides
MAGSADSLDNPRVYFDIEVDGEAFGRIAMSLFADVVPRTAENFRCLCTGERGVSPKGVLLSYKGSKFHRIIPNFMCQGGDMEKGDGTGGSSIYGPTFEDENFALEHTEPGILSMANAGPSTNGSQFFICTVPCPWLDGKHGRCELVTEGLSLVKKMEAMGSRTGKTSHVIKIADCGELPSRRQLLAKVRAEKAELASLKAEPHAVDANAESLKRLQALRAPSGGGPAAAPSYRTAQDELRELEEQERAVGGAANEGGDAGPSQPPGQGADGPDAGGAGPGDAAQQEEEGEEIDLASLPPRARRLHELKLRMRQVEAVDGAGAGLCGHAIGLDRWPIGCTIPSAPPPRAPAPSQARKANEGAVISEKRKELAGKGKAEAVSDPQSSKRKWYEDKKKRQVRAAREGGWCMCLEGGCSWVCSVTTCIAPGIRPSTHDLQKEELKSLGLGPEHAHRLETAETAAAIYEKTRKTPAPKGWEAFNQAALYGAYERRTAAIKPSAEEYEAAKAADPEFYRAGDSLKHGGQGAVSEAGVARMVAELNDRWAGGVRRGSKRKGEPGGCVTLPDRLHPSKPRRRQRKAGNFSRRRAFDDAKDVDYINPRNAHFNKKIDRAFGKYTAEIKANLERGTALPER

SEQ ID NO: 11138 - protein, 342 aa, Chlorella protothecoides
MLNACTILPLQAIQKLRCYHSCVCTYRRGLWIIGGFTIVAAVFGFIGSARVRCCLGLHAVLSVIAGLGHLGLVIYLFVDPAGAVQKLQDYAIDKGHAPRSSLEKAVSIGRWVLLGLLSLQAIAVIFALVVRRVLRRRAYEEFKDVEAPSQQDRRAQREADMQDLREKVLGSQHALAGGAPPATALDFKIATVAAANRAELMGAEDGNLAAVDPRTSAVALQAGGAPAPLSRCVDSCSGSGWLWSYGEAPDLMAPHLLSSPSSHFSTGPYLPGRQSSMPNLVRPTSSPAGPGQLRLPRRRQSSGTASSTSSTGKCLVDMCAPQLVEQTPLDVGLLTSLQIYVL

SEQ ID NO: 11139 - protein, 165 aa, Chlorella protothecoides
  MOD_RES (90)..(93): Any amino acid
MAVWALQQLPGSDGTSGQMCTCIMTNPQYIPQLDTAIVSGKKTLQRWKHGMRSALNAFNMFVKTGSVREGEVVWRLDGAALAAEKEANAXXXXGEVVWRLDGEALAVEKEANAEKAARQRNKPLSGAQRRKMKKAAAAREAAVAPGSRRRPPAAAPGRPRQTRPR

SEQ ID NO: 11140 - protein, 148 aa, Chlorella protothecoides
TTELNWDLIAKHLGRGKRSVQRKHDNLKGTSLPTGSGSSILPINDGKKWSPEEVGELLRLVEDGAYRKEVMGMEKVDWRILGQRFGRSYESVSYKYSYVKNTGRLGEWVMGCGGVRALGGGCCGPGWEEHEVPRPPRWEEHEVPEAAE

SEQ ID NO: 11141 - protein, 258 aa, Chlorella protothecoides
CRRGARPRAAARCGCAAAQTRAPRRPRTTCATCWRPPCAPTPAWTWRWRSCAAVSSPRRVAPEAVARAILWGGMRSAWAWTWEGPPAFCAVRHMNPWPGNSSRTCGHIQTWNPLYPPTHTHVNSLSHKQGGGEVACRVAPLSPGSSLPPLRLTQRGEVRGIVIRAFQAGRVPRGVADRMARAARAALGANLATLVEAEEVEALPPCQAVGDGCGVLLAAHTSSGCVLGASGAAQADAEGVWRVVIWVGPESPSCCVRS

SEQ ID NO: 11142 - protein, 331 aa, Chlorella protothecoides
MPRAMVGGSGHGQPGSRSLLNAGVHGLPPVPGVVSSKQLICPPPAQTLPSPRPLHTRPRGAWRLGRGGGAACRRRAGGAPGERGLRGRPRRRPAGHLRRHGWRGEQAPDGRAHAAHPGSHRGGRAAHRSAVRPADGGGPDPHGLPWGRTDLETVERLGEGLMNDDVLGEGVGRRKACAATGRDTHPSDLSNIAWGHSWSSSISYLPLVDNPCPIIPSRCATLSIHCRIDLLPDYGWPAHSYRRGAEGPRPAAAPPRVCRQGPVSPCRLSPQLRTQRVVFGTGPATVCSPVPQPISGRSPRAKETSGLVIPAASRPCPCSSGLCNPCLTSQG

SEQ ID NO: 11143 - protein, 227 aa, Chlorella protothecoides
  MOD_RES (11)..(14): Any amino acid
MTLVDLPGITXXXXGCGVVGWIGLGGACLVLVGPSLAQPFGWAASTRPTDHLNHRSLPRTMTLVDLPGITRVPVGDQPNDIEARVRAMVLDYIAAESCIILAVTPANQDPAASDALELARRADPAGARTIGVLTKLDLMDRGTDAVAALRNEVVPLRLGHVGVVLRSQEDIASRRGMAEARAAERAFFEARPVYAEVAAACGVPRLAAGLNAVLAAHVRAALPALRT

SEQ ID NO: 11144 - protein, 216 aa, Chlorella protothecoides
MFQALSQPTPASRVLPSTTYRVLCIAGRVQLDELGLSSDACLPIDRDTPGAAQPIRYLHIFEDGEVSLGIFCLPKGACIPLHNHPGMTVFSRALLGRVHVLSFDWAEAHTDAMAGTAEGAAAPAREARRVLDCVMGSGDDPALLQPTSGGNIHQFTAVTDCAVLDLLTPPYSLDDGRDCTYYHVEGPGSGDGTFLLREAEPPSDFVVGALGMYDWG

SEQ ID NO: 11145 - protein, 500 aa, Chlorella protothecoides
PPLPPRLDALRPPLQLLVEGRRDAALHQQARGGAADLSVGPEHAKHGPLHRARHVGVVEDDERRLATQLHDCRAQVPGGCQVHRTPRARGPGEGHLGDARVGGQRRAGVRAQARDHVERAGGQAGARGDARQLQAGQRGGLAGFQHRRVAGRQRGGHLPRAHQQRVVPGRDEGHHAQRVAAQRTLKPLGAEVHRLVLPRVQGRRQVGVVVEAGGHVVLPQGRWRREWVIVHCSELGGYPGSHPLNLCPSTPVQTDTGHWKASIQPHSTPMHTTQRTTSHSASAKGLPLSRLSRVARKAYRHKALGTEPPPSCPPNPIPNHTHLVGDGMQDLGAVCARGPGPLAAVHAGLGSRDGGIDIRRGGSGDGANLLLGGGVDDGQTTTLDGLNPSTANEELALGDRDGHPWARAGTRVGALFAPFHYPSTGCRDGPTGSSAISRVAAAWGPSPRTQCFSFPASELWRAVYPSQRIDQPIKAGLPLFPEWFLKNTGLTQTGCSAPGC

SEQ ID NO: 11146 - protein, 332 aa, Chlorella protothecoides
  MOD_RES (274)..(297): Any amino acid
MRRRRGSVRGRAGGGGAAASARRAPLPAPARGVPGQVRSGLRRARAHRALRRVDCVVNLHVREGVECRERLTCESGCMHNLFPDLRLMTPSPPSLSTKYNANPPLPTERLAKAWEREHTRFLADYNARLLNGLTLCSIAGILLFRFVVRVQLGESVAWGAFVFFQVCWAAGSVWWPCPRGASRCGVICKVGVYLRTLLTAPSGQLRNSTSHHSVPCRSTHPDDAHHDSAPNPNRAGVPALLPGGCQHVRPGMVAGPGVGVGGSGLQPFPRPGAXXXXXXXXXXXXXXXXXXXXXXXXPPPGHQEVVEAEGHAGAAALEAPATRPGGQGERRT

SEQ ID NO: 11147 - protein, 425 aa, Chlorella protothecoides
MVDYFLTNNVLAHFAQILQQRANRRGGVAQQVLQTLSILLQNVRTQQTVYYLFSNNHINDIVGMAFDFEDDEVLGYYINLLKTISLRLNEATVQFFFQAGGPGTPASLPLYSEAVKFINHRDGMVRAAVKTLTLNVYAIPLPALHAYLTAPPAAGYLDSLATYLAEQCGELDRRLAAAEAASPAAAGALAACLAEIEDMLSYCNDILATGVEPLSALLLDRLWSVLVGPVLFWPLIQDDVAVAHIATLAHQADQDQQGQGTGGVGGAHARPAPPAPLQRGVVGPLASLYVLERLLFAVLDTPFLSALVGALLGAARAPGAALAQHHSAPPVGGQQQPLPAHLRALLQYEPAAYRGALLGMLHGGEPQLAAAAARLLAALLRSRTLDEGLLEGIGAWWRNLLLGCKGHMAVGLACLLEWERGSLDG

SEQ ID NO: 11148 - protein, 134 aa, Chlorella protothecoides
MGLVGEGTGTGSAGLKPGISPPGAMPPSPSGSVAGRASTVGSEAGAASVVGSEVGAASVVGSEVGAASDTGDEVSPAGVAASVVGEEVSPVGAAASVVGEEVSPVGAAPPATGEDVSAVGEEVAAPGEEVSGEG

SEQ ID NO: 11149 - protein, 487 aa, Chlorella protothecoides
  MOD_RES (315)..(317): Any amino acid
GRAGARRRAPAGRAPRHRRRGGRRAPGAARTRGQRRLGPGRALQPPLRHRGQRAGAGQGLGGGRHPVGRQRGCQPGPGLPVLPGPGRQEQAIVEAGPGRNLSQPVPGHPPGACSNLSQPVLGHPPGACWRWRTCWRGELRRRPAPGATARRRAPAATSPCSRPLAPRGPLEVRVRVCVCKCMGSPLSSFGGSGGRGGARSGICVHAHWSVVGQAGEGFAAVSKGGERFMVPQRPTSSAVWNQVRPPSPPPAPLHRLAGCHAEGEAEQGRVLVWMHTGVWWGEQERVCGSVQGGEVHGAPAPHKLSYVEPRAATLXXXETEAGEGGWAAAGPPAGAPHGPRIATVAHMFIADYSQPDELSVFEGDAVRGVGSWGRVQGRGSWGAGSVDGGGGEGGGYDSPCGPLHLADPSLPPRPMTHTHTRHTKVEVLEESEGWALVKDPSGAQGLVPLSYLAFPSAGGANGGAARPDGSFGDAGGVTRRSRSLSRT

SEQ ID NO: 11150 - protein, 273 aa, Chlorella protothecoides
  MOD_RES (69)..(72): Any amino acid
  MOD_RES (140)..(143): Any amino acid
  MOD_RES (246)..(249): Any amino acid
MGLFYGYVGVVGLALYAALRYFRAGVSLAHVWCTYGGLWWGARRGRRPFHGRACPAMPCRGGGVHAPSXXXXWCTYGGLWWDARRGRRPFNGRACPAMPCRGGRSRTVHGIWGVLAYPFHEPVKTRSPAPNPAARQATRXXXXYLSNPDPLPQTPLLDRLRAGGVHPHGLCLCVPCGDHALGGGGRGHPDQRHLHPQQLPGGGGGGRGRQVCAALSCHGRPARRPGPGPQALLLPLRQRLRPSGLXXXXSGPFDGLFPFLFLSCPHSTLQAPE

SEQ ID NO: 11151 - protein, 288 aa, Chlorella protothecoides
MPSNPFPHTGGAFPEIHVAQYPLEMGRPNQRPGGAGRTDQTVALSVNAEGEVNYDAVVRQGKDAQKWVATTHAALVPKLEQLNSDMPRPDEEEVEAAAKETAAALQAVVSRKQAAVNPKTLPSQPGAPQYIKYTPAQSGGAHNSGAATRIIKMQDMPVDPMEPPKFRHIKVPRGPGSPPVPVMHSPPRALTVQDQADWKIPPCISNWKNSKGYTIPLDKRLAADGRGLQEVQINDQFAKFTEALYIAEQKARASVDARAKMQRELLAREKESKEQELRDLAARARMDR

SEQ ID NO: 11152 - protein, 130 aa, Chlorella protothecoides
MSLLRGLEQPAKALGRGCFSTSTGLQAAAPALAKTAEKGFLSGLFGGSNRVTTPLTDPLPGVQLPTPAPAPSSRPETHITTLSNGVKVASENTPGATATLGIYVESGSVNETPANSGEATGRSREPVLWL

SEQ ID NO: 11153 - protein, 92 aa, Chlorella protothecoides
MSLLASLPAPVKTYTAPDAPAPTGPSGEDSRRPVKEVPPYGRRQGFVPRRVDDFGGGERKGDGEHRAAPGPGSAALSSFRDLNGSIKTSFDS

SEQ ID NO: 11154 - protein, 74 aa, Chlorella protothecoides
MPAPGYKEKVWDHAAGAVLVTEAGGCISDCHGRPLDFGAGRFLEGLQGGIIAAAPPTLHAALVRAYTEAAAVDA

SEQ ID NO: 11155 - protein, 208 aa, Chlorella protothecoides
MPCASPRPALCPLTGVSHLLEYLAFKSTAHRTHLRLVRDVEALGANVLASASREQMAYTIDLPRTLVPEALEVLADAVLAPRLAPHEVRDAAAKLEADLKGLADNPQLALLEGLHAAAYSGDLGKPLIAAEGAAARLTPADIADFLAENYTAPRIVLSGGEGRRRGRWGSRRHAWADSAPRVCHRLRPRAASFMRAWPGVAGPALAHP

SEQ ID NO: 11156 - protein, 211 aa, Chlorella protothecoides
MAQEGGLLTCHLAGVLQTQAGGWSLLNSLPRDGIHKLRLLSLTPHAEQSWTGEGNAASMPLRQLTRGLAGSVEAESGAESRYSISNAAPETEEASQPHLQAGDEELGEASTCAGSRNELGYISLEPDSSRHRPRQDTKPDMVWVELWARTPKTGLASILNFRRVDVCEELLRQGMESGADAALPHRVDTGKDTFFDVYLLTAGCVWHREAA

SEQ ID NO: 11157 - protein, 371 aa, Chlorella protothecoides
MSNDHASTHHPSLLSKVDSGCLPDDAAVLQLCRSLRSLLGREEANGTSNGAAGPGPHPRSDFHALERGPVLMGELGDAAPHPSDLLSGRALIQGRYQEGEEEEFTVMRPKDVLKLRKQNERAEKVQRAAFAVHQAQALAAMKGKRVTVLRNAGGTAVRDIHLERFSVSNGGADLIDDATITLAHAHKYGLVGRNGTGKTTFLRALAEGEIKGVPANCQVLHVEQEVMGDEVSALDAVLSTDLERAELLAEEQVLLQALEEVGGAADAGEGEGAAPARDATPEEEGRVAELAGRLEDVSKRLLEIDAYGAESRAASILSGLSFTKEMMVSVVCCAGGVGGYVDLGAGGQGELGYPVSSGTWGEAGRWRGAPI

SEQ ID NO: 11158 - protein, 204 aa, Chlorella protothecoides
  MOD_RES (193)..(196): Any amino acid
MGSGLCGVWQDFKGCVAPPHPASSCVYGCCNEEETVHRFLEPASCAAPVTNHTPKPSTPGHLCPAGHSAEVNSLRWGPWDSRHLLASAGADGLVQIFDPDTGTVVHRLDRHGANVPHLRWSPAGEYLATGDELGQVLVWSTKSGAVVRSLQVGGDAGLGGVSSGGGTWEGCNWLSAEVGGSNGREPQRQWRVXXXXGGMQLAEC

SEQ ID NO: 11159 - protein, 363 aa, Chlorella protothecoides
  MOD_RES (63)..(65): Any amino acid
  MOD_RES (278)..(280): Any amino acid
MPPKFDPNSIIEVRGGAGMPGGGGAILRALAGGWGGREPCGAQYNQVCPSHRAGLRPGNRRRXXXQPRGAQYNQACLSHHAGLRPGNRRRSRCGLVPGPEDWTPGPVPQEGARGGWGLRSVRQGVAPSHPHDPQASLPTQHPLSRPQIGEDIAKETAKEWKGLRVTVKLTVQNRQAKVSVIPSAASLVIKALKEPVRDRKKEKNIVHSGNLALEDVYEIARIMRDRSCAAGFAGTVKEILGTCVSVGCQVDNEDPRDIQQKVRLRIAVSEPQHITTAXXXGGGGAGWHDCVRRGVGACWGAEVPRVERSGSLCHTRLRIGVSEPQHITTALLTGKYSRYSLLRSTMASSRCQVHRLDAMALAL

SEQ ID NO: 11160 - protein, 198 aa, Chlorella protothecoides
MRREGVDDDSRYLANMGVYVFRREALFRLLSPAKKQAITHIGHHVVPNALAQEMKVYAYLHDGGWVVEGLVGGRRSGRKESKMSSSMVGSLTGGCCVVGKLKLQARQATARIRPLAHVRPSPHLHTAGYWHDVSSLKDFYETNLDLSDEDSPIKSDMSVAARGSMLPPAQLHDADITRTIVGDGAVLVVRGWEAWRWV

SEQ ID NO: 11161 - protein, 241 aa, Chlorella protothecoides
MALTSDHVNFLVYRYLLEAGFAHTAFTFGAESSILNSGLPGADVPVGTLVSILQKGFQFAELEANLTEESTDVFGEFTPLSAEAIMTGDVEELRATVREWHEKRDAAALDVLASGPEELDPGACLGLGGAEGPVYACPWAPAGPPRLAAGFADGSLRLWDFPEGTREPPPTPRVCATGGEITAIEWSPGSSLLAVALMDGSIQIWEADGACVLYSVGLPRLPRSQGLCGAPTVAKVAGLVA

SEQ ID NO: 11162 - protein, 327 aa, Chlorella protothecoides
  MOD_RES (204)..(207): Any amino acid
MAPPKAPAGMAPPQAPAGMAPAKAPPGMAPAKAPPGMAPPRLPTGMDTPELPTAMAPTRVPPGMAPPTLPAGLAPPVRRAGQPAQAALVAGDGSRPLDGATPPGAEILRQGLEMPGAAGKETARVALEAFEGLLRALGIHAFSRWEKEVPRMQADPRYKASKDAMSGWSHACFVRTRGCLGQHACAWCRSSHRMQMRATRATVXXXXFSRWEKEVPKMQVDPRYKASKDAMSGWSRAYFALPPTERRAAFEAYCAKQGSAKKPAQSGGRRGPPGLKPAGADAGEQLGEELPAADAEKAFMCVPRPCLWVGMKGWGVLAYGQGQLSWC

SEQ ID NO: 11163 - protein, 283 aa, Chlorella protothecoides
  MOD_RES (19)..(21): Any amino acid
  MOD_RES (99)..(101): Any amino acid
  MOD_RES (146)..(162): Any amino acid
  MOD_RES (208)..(226): Any amino acid
MTSRCPRRPPRWITGWWTXXXRHPGDLRPPGRPGRGGRAVRRRGVLGRPRAGSLGGGLHRHRAALRGAAEVARTGRGHLSDPGPPSGAGGRGRRTAARXXXAPRLYDLVRCGDERMRPAFFFALRDTLVAADLDQAARIAYGPDPXXXXXXXXXXXXXXXXXWRRVVTLAGEVINEAGTLSGGGGRPKGGRIALGTAAPRAGAASSGXXXXXXXXXXXXXXXXXXXAAELAGAEKELGEAEGVSSRAAEALSRAEAELTAARAALASSESALPRARLDAEAAA

SEQ ID NO: 11164 - protein, 280 aa, Chlorella protothecoides
  MOD_RES (81)..(84): Any amino acid
MAAALERANEEFKEYERKDIAYREELKHLKAKLAKTAERERRDAARLESAEAEAAAAEAEAPALLEAAAKLGAQLTREEAXXXXYREELKHLKAKLAKTAERERRDAARLESTEAEAAAAEAEVPALLEAAAKLGAQLTREEARLEAALEGVAGEGETLRTKLRAARAELAPWEARGLGAGGRAGRTRGGAGARGARARGGCGVGGRRGGSAGQGVDRAARREGGRAGSSEGGVRRANLAWLCGPAPGGADLRQLGLGGGPGPGLGQGARCHPGDLRPPG

SEQ ID NO: 11165 - protein, 108 aa, Chlorella protothecoides
MQVRVEARCHPALHQETLSIGLFSSPTVECHADRMAEAMASRNEGGAASAKPAEPEAEEEGEEVDESGVEAKDIELVMTQASVSRSKAVKALRAADNDIVTAIMELTM

SEQ ID NO: 11166 - protein, 174 aa, Chlorella protothecoides
MAQPRKYESLRGAVLARRAIVLPAFEPGDAGDVGVEVARGAVLGGKAAAAAMSRDGRLKPFHTDRYRAGHRATDYARWLTARTPYHIRYEEGYEPYVLVARRFVPWYDERFVGYRKNKVVHLLHLAQQGTLFVVHPNAFTVHSPHPRARTWKVTRKTGLWDQVGLGGGKGGRGG

SEQ ID NO: 11167 - protein, 130 aa, Chlorella protothecoides
MERPVSSWQGSLLTGFYLLCGSKGSAVALTSPPPLPSPWAGDDESGRSKQSRSEKKSRKAMQKLGMKPVPGIARVQIKKSKNILFVMTKPDVFKNPTSDTYVIFGEAKIEDLSAQAAAGAAEQFRCGEAG

SEQ ID NO: 11168 - protein, 154 aa, Chlorella protothecoides
MVGESDARPQRLIITEMVLENFKSYAGEQRVGPFHKVGWSAWVSRGAWTTSVPMCPTFCSLPWHLPTSTQCFSSVVGPNGSGKSNVIDAMLFVFGKRAKQLRLNKVSELIHNSAGRQGIEQAQVSVHFQEIIDTVRGAAAGLVQSAQLLLCCGD

SEQ ID NO: 11169 - protein, 211 aa, Chlorella protothecoides
MAPGRSIPGLQLLRTLIIAVRSSRGGMGRSLIPAAVCSPQPTLCSVHTHLSLRPSPQGLLAAAHGDLTTDDQFLCPTPHAIPNLPILKTEASISSGKERAPTDVTLVTQLSFERLQPTPNNRLYMLEGQCDVWSGTISAAVYIALVGGKAVSVELNSNQDPHLIALSRVVAAFRQFHELAEQKGVAMRWLACLGCARERMSLVELSTRIST

SEQ ID NO: 11170 - protein, 139 aa, Chlorella protothecoides
MMKPKAQTEHETGLLEYLEDIIGTNRFIEPLADSAKRLETLGEARAGLVARLKIAEREREALEADKLAAEAWLDKEREACAAQRLLSHVLAHQAQMNVDKIQGNQASLEGKLAYEREKLGQYSAVLEEHEARCVCVGGG

SEQ ID NO: 11171 - protein, 115 aa, Chlorella protothecoides
AAAATAHLSALGALGARGSAAIAAACDLRPRLAAQCLRNLERYEGAGAGEEGATLAPLATATLTSLRGFDDDAFRAHVHDLFPRLVALIAAEGAPPELRRALSDLFLHRVGAMLV

SEQ ID NO: 11172 - protein, 797 aa, Chlorella protothecoides
  MOD_RES (263)..(287): Any amino acid
  MOD_RES (331)..(334): Any amino acid
  MOD_RES (365)..(368): Any amino acid
MPTEEPAFQSEAKPGQPIKLPGQVRTRLGWEGAHWPTPPCRLGWLRSIGQRRRSHRRIADVCGLQTVVATSVPEYVERGLFYATHVSASCLLDTDAGEGGGRSGLACVLGHFGKSRGLGGGSLPPTNGPDRPPLPRAANSRRHHFLCALCRIPGIDPSDFFNYGLNQRTWKDYTARIEKFRQEFTMQVGCSCLAGAERGRGWPWDGPGDSRPEPDPDPGSGPARPAGSHWRHAVPQVCPISSEQRRRGDVPGLCDQREAGGEXXXXXXXXXXXXXXXXXXXXXXXXXTPLPDGIPICGLPQLLGCAAAPPSCPQPGLELNMRPAVPSHTLXXXXRGSEEAWRGICRGPMGVHRPASRWALGLGIXXXXLSRGSRSMCDLPSLPTRFNSLLAPFPAACHPWALRQSLGPHHRADGWGAAPRPRTCPHTGGRRATGAESRPQRRRQAQQARPRRCQGGPEPCCGARRAARAQRTRAGCCQGAPLAARAAAARCAPTPDRCPAPDQAPSAPRLPQAAAGRPAPTVPQSDACPCARGGSARPPCQHAAASILAATQLPAALPELQPRWGYGGGRRGALGGTPTSCARSRRAGALSRALQPLKHPEPPPSPLVQGRRPNRAMPPGSAAVTAETRGEMRHPPRVGATAAVPGHLERTDRRTGARGEWEGERDVRACTLHSCFPRASPCTHASHARLARPHPVLPTGATSDSGSGRGRTGMVAGLRMPRLPGVPGETGLIGCWSVAWQARGQRPCGRSGPSLGPALRPQACTTSPRDTQSTLHRPLQAQTAGSRGALAAFARTG

SEQ ID NO: 11173 - protein, 208 aa, Chlorella protothecoides
  MOD_RES (39)..(42): Any amino acid
  MOD_RES (62)..(65): Any amino acid
MFCLLPSVRWRQQLPGPFSRHHAWGLLQQRAHFMKQIDXXXXQLSLMTCYSARRVYISFFPXXXXSVRWRQQMPGPFFRHHAWGLLHQRAHFMKQIDKFELLGSCRAGQPPEVLPQLQHLNTWRSDRLRQPHGITLVTQASAGRLHMLENQCTTYSDVIAAAVYVSLLNGRLHAPQHSTLHGQTVGTLRKAVAEFHSRMEAEGGLTRL

SEQ ID NO: 11174 - protein, 256 aa, Chlorella protothecoides
MGATLFSGVPFGDVGQRHAIRSCDHRRIGTPAFTTRRIRCMRWATVSCSKGPVVLTREHGKNEELESLLKSKNIETLILPMVETAKGPDSCLLREKLQDSAFDWVCLTSPESAAVYATAWLEAGKPSIPVAVVGDGTARALARATDSACAPSFVPSVANAEHFGAELPHQTNTSARVLYPASVRAAGTLQSLLEARGFSVTRLNTYDTLPVDQLTEEGLHQAQQAALVAIASPSAIRYGDNGSPIERTLSTLCMRL

SEQ ID NO: 11175 - protein, 1046 aa, Chlorella protothecoides
  MOD_RES (361)..(364): Any amino acid
  MOD_RES (900)..(903): Any amino acid
MHNPAACLRELQGLHCTMFGIWLRLVDCLPQNATNCNWQPEMCTISCQNAKSILSVLRHRKQSLRMYLAGMVSSSRTVLKKNEYSGSQIGIPGWTCMRFWWAVPGSRYHIMPDAKSILSVFRHRKQSLRMYLAGMVSSSRTVLKKNEYSGSIPSCPMICYDYWKEGYKLSMFHYIATCPTIEEYVRSDTRLYLLYRTSVTHSLLTCSAGDVNAAHVISIEDRGAVHATSGWKYESIWGVFQCRHTGTVYGMPLLFLPCSPGSSCSCTHRTPEVTDAITLSRIRRVIQTLLTDGRDGVYIGIPDTSESTHQYCQVIVIDLAETAGNTSNSVLLDENLPSHEFGSPRVYSWRGRKSCAFLTSXXXXMICYDYWKEGYKLSMFHYSATCHTLEALRQNLPQLQEGNEYVGSDTRLYLLYRTSVTHSLLTCSAGDVNAAHVISIEDRGAVHATSGWKYESIWGVFQCRHTGTVYGMPLLFLPCSPGSSCSCTHRTPEVTDAITLSRIRRVIQTLLTDGRDGVYIGIPDTSESTHQYCQVIVIDLAETAGNTSNRVLLDETLPSHEFGSPRMYSWRGSKSCAFLTSTTRHCFPPDGARAPIRWLPESLLPAPLSLSEGTMDPFAELLEDVERAVIAQETCSKQAMEIVGKCLEEVQHARAILGGGSPDGEVVGATAKALSLLKVDAKLASGTKNLHKAVGTLGKTIDKTFTSDISKAWGGQPSDTNLLNQAILEHLHHEGQFEVASTLAAETGLSHAHALRQPYEAMHAVLQQIHSKNLDAALAWVETNRSRLEETSGTLGSFEFHVRKQQTSDIADVGQGLHWGCFLRSCTFTPRMWCHPPGRLAALQYARQHLQGFQQTELTSIQQLMGALCFAHSPTTQSPYTNLLGDEGLLWGCFLRSCTXXXXADFVSQSCALLGQVSGRLCDGYLAPCYSVLLGMLLRPWRGRRVRSWGRLVGGCAMATWRRVTLCCWGCFGDLGVVGEQQIGLSDAMCTAFHAPLIIDFSPSSCRQSSPGTGQSPPCNSGRGCSFAAHHSQARQRHADAAGPRR

SEQ ID NO: 11176 - protein, 128 aa, Chlorella protothecoides
MPSFFLSEELHEQEQYTRLRERLRQGRVMVLPAFEMSRQEDGREVVHKLAQGGKPALAKAYTGGQVAGFQIKLWSRGHMVTDYTKWWTATEPYAVTFKKASRCWRLSPRMSMMLRRGERPPPCQSGGA

SEQ ID NO: 11177 - protein, 310 aa, Chlorella protothecoides
MTPRRCQQVGCRLADRRLTTCLLVGEGNGCRAISEVCQRLVHSSCKVLVSVDHQLQSALIERLASLGLLWDANLDRRLLLPTIPFPAAQTSVAVLSVYYWAELRHVTWSKSNQDSAAQTLSEDLVNELNAQREAFLAGVQNTTVQSNCKADNTSEYLPRLVEHGTWRSAHRRDAPSVTLVTQLSLDRLDMLDGQCATYAGVIAAALYVPLVRGERVVSPAAKEYDGEPLAAASRALSDFHKAMERTASACTAPAPPLLPRPHAAACTLDLQLVGEEFDTRAEAGLYPFNAIRNRALMLAQTEASRVAVRV

SEQ ID NO: 11178 - protein, 826 aa, Chlorella protothecoides
  MOD_RES (174)..(176): Any amino acid
  MOD_RES (605)..(608): Any amino acid
  MOD_RES (628)..(631): Any amino acid
  MOD_RES (649)..(651): Any amino acid
  MOD_RES (669)..(672): Any amino acid
  MOD_RES (713)..(715): Any amino acid
  MOD_RES (741)..(744): Any amino acid
MSWRSLLFAALLTVCIVASRSQEIGLNADWEDDYLEERGTGPNPRRLLASASTLPTCEADIFYNVVELNPPSNFSAVVSITNNREVSMSHWQLVWTYDTFSHVLLSTTDGAIALTAGSPGGAPVRLVDTFTTDGIAPALGITQKLPCTSWNSLALHHFPSLAFSLLVLEGSQPXXXRWALGSVLTNQVSQPGLAFQGGPCMLIPRQTALGITQKAAMCIMELPRTASLPLPCILTPRPGREPTHCLPSPGPGGGAYAFLTVGQFVPSGLYPDDSLLVNSVNLNGLDCSRVLPDPGLTLGCSQDDDGSSGGTVAQGGCRAVYCCGYVLSTPAALPPATENGGAVPAAPPIAGTPTAPIESTGDTGCIPHAPTPRPPPTPSFLPWHQPPAPDTVYAANGPPAPPEAAPAPPTAAPAPAKGGVSLGMVVGLVVGVVLGLSALVGGSWLFFARRRAQRLAAAEAAAASTARKDTAPDRGPLARTHDSLPWQGEGSGWQDSPGSAMPLTSHGTLSQALSVNSGATLTLPNLQPSGGSGSVPSALERGPSNAGAAVAELGRLKSADLATQVTLHDQLGSGAFGVVYRGELCWFLCVVGGEMEYYCQEMVCXXXXAQRPGEGTQRRRRSGGGAGXXXXIWRCDFRGTPAGTCACLXXXDLEVRLSRDTRRDVRLSXXXXGELCWFLCVGGKWNVAVKKWCGVWSPWTAHRNALPGCIRGXXXTMQASAQKLTGLVPTSQLMSSHTLNXXXXRAGLTAVANWIASTQPALAKYNAGQCPETHMPGSTQSTHALPHPQTPCSRVEWSPRRREGCDAGCLASLPPSLNTQTRLVGR

SEQ ID NO: 11179 - protein, 194 aa, Chlorella protothecoides
MCVRCLGPHITFRGGGDHSSLPISPLVPALSTQVAREASSRVLGLRPFDVQLLGGILLHKGEIAEMRTGEGKTLVAVLPAYLNALAGGIRGLSMPEEKMYGEAGILGVKIMADAMKLCMEGLDVSLRRWQEWWGVRIGGSWGAVGSWQPWCGVAVQSLKPRVAGLCCSAEVSGRAERGALQTSLARCQPGFQTS

SEQ ID NO: 11180 - protein, 583 aa, Chlorella protothecoides
  MOD_RES (206)..(209): Any amino acid
  MOD_RES (490)..(493): Any amino acid
MLDLTWAHHLQATEIRAQDGGSHLQQSGGALEPSVYWLPTRARPTSPSGGEQQGTRMHWEHASPNLTIISDLLKRSTRALARTDIPLRPPRVDIFGERAALKAFVAISVDMMADVSIECLVTGKISSNYDFKRLVSGYSGPPLIGGAPSLSRSPGFGVWAQARQLHPQRYSLGRCKDWKQHPPQHVNLEDFDREPTDPCRGAGGKXXXXSTTVASPKVSTGTMQKLETASTPTWNMAAQLVHSQSAPLVPCSPWGTWRSQNHKFFIRSSVVHDSRSSTAPRAGRRKLVLVPASRSPLGRSVAPRRRAPALAAVPKAQGGLDFINSNVTPLALISALLIGCAQGRAGSRSCRSRRCRGLRAPRIPVLHSRSDPSPPPLTLTPPRWHFPAYGAAAAGRNLAPLSTAGMFFLSGLLLNSGEVGDALRCPAALAYGLTAVLGLTSALAPLVLRLPLAPPELAIGFAVFCCMPTTLSTGVVLTQVGMSWRGRMGXXXXAPPELAIGFAIFCCMPTTLSTGVVLTQVGMSGRGRMGNGSHREPPVLSKPWRVLLGMDHGRRLWHAPSQTPLLMCVCAPGHPGAGCLPRR

SEQ ID NO: 11181 - protein, 392 aa, Chlorella protothecoides
  MOD_RES (359)..(361): Any amino acid
MHLVARVSHRSGAVGSPARLGWPLPPALPALRFPLSIPCGAQIKELGCKAGVVLNPGTSLDTIEYVLDIVDLVLVMSVNPGFGGQKFIASQVGCCCRASGGGPLVGWKTARARGGLGLRAGEEWFEACVGGWGSQFRQHSPPWSSSGPGGSVQTRATHAVRPHSTASSDCYPSARAPLTTQVRKIKALKAMCDERGVNPWIEVDGGIVPDNAWEVIEVGANALVSGSGVFKAPDYAKGESRGLFRRGVACVAAWGRCVLCAGLGGLPRSASGAGCRLPGSRLARGLDRRSWPMPDPKLNRLHPFVEPAQPAPAPAWAGAGPLARLAAALSSRSAQGSTASPSPCTCTDCDKRGGPLRVXXXQVDLTQGQCMAEVHHGGRTGIGWEGNTQSLE

SEQ ID NO: 11182 - protein, 100 aa, Chlorella protothecoides
MSLRFAAPDGVKVGCTVSAWRPLRCTPEPAIERELLPSTPQVYTVAGGKNLPTWVSDKKKRSLRKDEDYNRRVIFKRSMYIWHPWLEGELSGEPHANAIC

SEQ ID NO: 11183 - protein, 395 aa, Chlorella protothecoides
  MOD_RES (91)..(94): Any amino acid
  MOD_RES (324)..(327): Any amino acid
MPMQSAEASSSCHPSSPPTSPIAGWSWCKTLNSRPPASASRSLRTSSTSLPAATTRQGWVDGQSKGEYGTCAIQSWFCRPFPSPPSLQFQXXXXKGEYGCCAIQSWFCRSFPSPPSLQFQVRVYDVNQLSLKFERHLNAEIVDFQILSEDYSKAVFLCDDRCLDFHAKFGSYHKTRVPRAGRCLTYSHPTAELFVAGSAPEIWRLSLEEGRFMAPMPAASPGVNALGLSPAHGLLAAAGEEGLLECYDPRVRASVGSLEAARAVGADGQGLTALRFDDSGMHVAVGTSGGLVAVFDLRSQVRGWETGGGRPGGVSGGPGSSTTXXXXRPQVTGEGMGDGGWAAWGPERGAREFHHLMPCSKTCLGLARERVISGPFPVYLSAHAARCFPSLSGWS

SEQ ID NO: 11184 - protein, 353 aa, Chlorella protothecoides
  MOD_RES (74)..(77): Any amino acid
  MOD_RES (225)..(228): Any amino acid
  MOD_RES (327)..(330): Any amino acid
MQVVQQGQECGGSLRLRSLSGEAGRPEAGGGAKKPDLHHQEAAQGVCEGEWGLRGALNCCCLRHSGPGSAAPAXXXXKKLPKRCPGGLQPPHPVTRRRTVLEVNATTAARLLGEEGEDGPKKRKAALPNLLEDTRFKAMFEDTEFTIDEASRDYKLLHPNAGASLNGLEALRGVLARLWDLSRGVGTGGKHPIHLFSPLCPRRPHPCPPAATPDPAKERRLVREXXXXGGSIPSTCSTLAAPDVLTLALPPPPQIRPRRGGWSGSTLRRWRVTAMPSRHRTLRARTTTRLATGSRPPGTGWVVYFEVGRPSMNGLTAIHSTPCPVAXXXXEGQDDDQTRARKPAARHRVSGVF

SEQ ID NO: 11185 - protein, 90 aa, Chlorella protothecoides
MVVKDHQYESPILDIKWPTTAAGRSRALVASADRHIIKFWDAGSGEGFTNIEPKDGDINDICLWPGSGLVMAGCDTPRIQASDFTFGGDA

SEQ ID NO: 11186 - protein, 107 aa, Chlorella protothecoides
MTEELEERTAPAVYDDYRFITRAELVGGGFQGWMAPFPGMLDALWLATGRGDSLGLANLVGTNMLKPYMHGFFLDNRSDWEGVRRRLLCAVHGYACLSRSRVASRPD

SEQ ID NO: 11187 - protein, 164 aa, Chlorella protothecoides
METSRTGVLRGRLPLHPVFPPKLTQLGKTSKHHKAKGNSNGRTYTSKFRGVHQTFPTKRWEAQFRRNGKPTSLGCFDAEEEAARAYDKMMLWCELHHATGVKGGITNFDHSDYEQDVSWLLNITQDDLVQLLRSDGRQQAQRRTMRQKRDQVLYSGAGASGDDD

SEQ ID NO: 11188 - protein, 134 aa, Chlorella protothecoides
MGSVLTPPACGFEEQGRLGTPDVMHSSGRQFYPLYATPTHRNSDHAVERVRAACVKSLAALRLTYLDLYLIHWPVTGIPGPALTPSLRDTWDAMEGLVREGLVRAIGMSNFSARKMEEVMQHATIQPAVCQVGE

SEQ ID NO: 11189 - protein, 254 aa, Chlorella protothecoides
MNPLPLDAQRRILLSPLLSALQAGVADSDLAAMGMVSEKAVGTWCDSPGGHMVTWGPTPFFLLAPRNAQPDLKSRDHALRGRMAVHGVMPQLGASKILQLPDMSALSRQIVGCPAAQASSQLSGLICPRARFPKPFQGSNTGLQTRRTGRSHVRQPLRMPLAMWKGLGLSFTTDPAEKVRKKYQGSLDAMNALESGLKSLTDEQLRAKTEEFKKRLGRGETVDDLLVEAFAVRTGGMAVPQVMCGWWCSRIPVS

SEQ ID NO: 11190 - protein, 103 aa, Chlorella protothecoides
MLSPLSFTAARQVKAVDEAGADWIHVDVMDGRFVPNITIGPLVVDALRNIPDKPLDTHLVRKDGIRRRISREGVCVWMARLHLAAGREGYQMCERPFQPLTAS

SEQ ID NO: 11191 - protein, 187 aa, Chlorella protothecoides
MARLKLREVLMPQVVSQVDLAGTAPSARSKAKVKSWAVSPELYPTKLKPETLALIEKAVESAVAAWGSRQVSRPGRKSRVVPERQLEALDAEDRLAYACEKAPTDDPVLNESVYPFPPQTHALRHPYPHPPPAVRPDLQLRAAFLATEAEFKAVTELEKQEVVALGGLHVVGTERHESRRIDNQVSP

SEQ ID NO: 11192 - protein, 152 aa, Chlorella protothecoides
MGQANLAKSPWIESYRIDLPGCRGSRTTVLDFVASPGTPRDLPAQAQAAEVRELAARKQARRDATKALYARVDVPRATLASGGSIPLVGLGTWKAERGQVRSAVHAALKAGYRHIDCASVYQNEEEVGEALQAALGSGAIPREELFICSKLW

SEQ ID NO: 11193 - protein, 619 aa, Chlorella protothecoides
MKAKIGGQTVKICLPQPSCIQTSGALADSSRARPAMQKQGAKLLRSVCPGPVAYTPAVLPPTAAGLARRCICHPYIFPTPENYKPKPSAHACVASQQDVSATPCHVGGDGHRPPAPRLRHDLGLALHVFRLGVQHAVGDALFAQQTRQVLALLHRGGAHQHGPPLLVHALDLLRHRPPLAALLAEDDVGVVGARHGAVGRHHGHGQLVDGLELGTLRGGRPRHARQLRAVGPAPAWHSAPRELVHDHDLAAAHDVGDVAQEEFLCLDGVDNVGGPLLPRVVEDKLEAVEGQAAGNQRVAGRLVWGWMPAGMHQSRQKFGSRLVYSATVNSPGNRSPSETWVSPARDHSLPPPDTSFQSSHLEHVLRCLIPVLGQEDRALLLVHGVVHALDQCSGQAAGLGVLVPGRVRGAGDDERRARLVDQDGVYLIDDAEGEVTEDQGFGLLRQVVTQVVEAQLRVGDIGDVRQVGGAALGLLRGREEGGSRRVGECQLGWTPALHLAREGTPFSSTRHLSAAAQSRDSRLQRLDRDTTPGLPGTHCSPGPTNPHTPPLLPSPQTHIQPLLDQADLQAQELDRHEGLPLPGPHLGDLALVQQDAAQQLDVKGAQAQHTARRLPCHLG

SEQ ID NO: 11194 - protein, 537 aa, Chlorella protothecoides
  MOD_RES (98)..(100): Any amino acid
MLDSAVVASWDTGHLFLSPAQVLFCQEGTALVTGLNNDAEPGTALDFSSGAQGPLLPKIEVHSRFRIAGCCCGGLAPVRFLRWCSGNPPLGSRPGMGXXXPIPPCRVLLWRTSAGAIFVLVLRDSSPGVKAGDGVVCRLRAILQVVDDAVGATTKRDYDVVDVPGEAGAGREGVFWEQHVKAADMSRLDWVKGPGQGRTWSPDQLLDWRGQSGQAAALPSITPGPRAPLLAAQIPMADREQIAEALYTGVPCVDVLTPLGLGQSVQLSGRDAGERAALCQAVAHGAVASGLRTLYAATGPADGAGVGPATVDPGVTRFVASPGTNVAQRLYLLCAAVAAGEAVRAAGGHALVILDSLAPMVGWRGGGKSGEWPHSCVWLGSVLVSLAPGSLSDLNSLMAHPPPLKPHPLTNTHTFTHTTAFLGSGVGHPERGRRPDPGGRAFLPRPGLARGGGGHAGVSGRGGAPRLPFQPGPARRQDGPQAGRRLLVPGAGSAGASSHRHPLLPLPPAPGVPVPRAAAAPGGGGPAAERRGGGGRG

SEQ ID NO: 11195 - protein, 213 aa, Chlorella protothecoides
FERGDDRPPRPRLTPEELEAQRVRTVFVTGLAPDVAWQDLKDHFKPAGQVEFARVVMGQDGLSRGFGLVRFASEDDVQHAVDTLSQTELRGQTISVRPDAGSNALRGGQARQGGYAADPDVAVVLLGLPLAFTWQDMKALCEPYGELGRVELRTHADGTSRGWGMVRFKDAGEAEAAIRALNGTELEGQTLRAKFDERVQRNPDQGWHGAEDN

SEQ ID NO: 11196 - protein, 101 aa, Chlorella protothecoides
MVVVKAPSTAAGAGGAVCSGHYPPCRGPSRPFTPSMLPPRRPRSHGSFAVRHSVDEEDWEAEMGVFRQRTLAPNQLETLRKYEAGAVELGKVRPGMENVVF

SEQ ID NO: 11197 - protein, 277 aa, Chlorella protothecoides
  MOD_RES (89)..(92): Any amino acid
MKVADFDIESLDFVGTGSIVHLPRNEHCEVRAVIKCLETEVGRARGSEAEVYCNAEGIQWIDAYRVIVVSDRAKATQPYHCDEHDQSVXXXXTERKPHSPTTATSTTSRYTSLVCQVPHPRHLLRSTGNERRPFLPLHALSAHLYVLQGSVTFIRDGRLGQRSCAKSAGRFHQAIRCARCITLRLGLPFDEVLIGSGFTGPHRVKSRACPNFKRQKAPTVVDKDEIHVFFLIILALAIAHHLLDYILSKILVPIDAPSAKLSHLAGWSPTSWRNAWP

SEQ ID NO: 11198 - protein, 391 aa, Chlorella protothecoides
MLMDVGKVEGRAAATNLISNGIGCCAMSVLSQGTQTRTHLACNTKLGGPRVATFCAARPKYLARRVMAVAQASAVAPAGLSAALIDGKKIAETIRGELRVEVEELKAQKHLAPGLAVVLVGQRKDSQTYVRSKKKACEEVGIVSYGVDLPETATEDEVLEGSRPHLTQVVAKFNADPNVHGILVQLPLPKHINEKRVLDAISLEKDVDGEVANDRVLGTGFHPNNIGELAMRGRSPMYVSCTPKGCLELLKRSGITLAGKRAAVVGRSNIVGLPAALLLQQEDATVTVIHSRTPDAQQLCAEADIVIAACGKAEMITGDWIKPGATVIDVGINAVDDPTAKRGYRLVGDVNFEEAKEKAAFITPVPGGVGPMTIAMLLRNTVDGAKRSLEN

SEQ ID NO: 11199 - protein, 638 aa, Chlorella protothecoides
  MOD_RES (176)..(179): Any amino acid
  MOD_RES (312)..(315): Any amino acid
  MOD_RES (352)..(355): Any amino acid
  MOD_RES (578)..(581): Any amino acid
MTSQSPLLARLTRNDPFDELVATCVFSSCCLAPLGRRATLGRGIAVKSREASCSARSHEYYRYQGQSRRAREQVSCWRGRLLEVHAFACLRAHAAHSSFQVHAFVCLRAHAAHFAFQTASRISPWWVGGRRWRGKLSLCSIAGALHTVPPSVFVQQKAEEVAQEKNRALKAALNAXXXXQKAEEVALEKNRALKAALNAELRKDKGNLLDSAIPKLATIAKDMRKGSTQEAAQLREQQVQELAQAVDDIPDGMGTMRSPGRVGSAGSAMLTPYQPNQMFILMLVSLWKPAVIHRPPIQGLPKLHSVFAAPTXXXXPGRVGSTGSLRLKRWRGMSCPSFLGNFGCHTIHVHAXXXXSELVEACRYSPSSYPRTPPTALCICSPYSEVAACMHLGAASPSTLSSWTGVSRVRSTTSTQTRARLSSLRLSRRNGGRTRLLNGSRMGWARSRVSILSCVGISEDWRSRGLIAYHVGSGCACLKLGTSSTCNHGLAELGTAMGEEIQRHDVIIDEVNAKMDTITSDLKTNNMRLKGLITKVRREPALGQWCSTWGLRLAQAWVSSAGSETTPLMQQVRSSRNXXXXGANGVPPRGCAWLKPGFPQQTQRPLLKCNRSAPPETFASTSSSSASCWHLGCTSTSC

SEQ ID NO: 11200 - protein, 190 aa, Chlorella protothecoides
MHPASGCCGEPPFSPIVTLPGPTLPLSPPPSPEELSYESEAAERLRGEAVALTSALASARNEGDAQRLAALRAEEERREAVARAQEAEAAAAAARRETTAAAVRLAEAQRACEAAERRAASLSADAGASIDRRIVVKMLVSFFERGGSGEVLDLMARWGGVVEAIEPPIAEPRHDSSYTNPPCILLYPSG

SEQ ID NO: 11201 - protein, 856 aa, Chlorella protothecoides
  MOD_RES (466)..(469): Any amino acid
  MOD_RES (591)..(594): Any amino acid
  MOD_RES (796)..(799): Any amino acid
MAAPEAGLRNEDLPALFWDELPNDPEHPDAMAIKAIIDESTPEDRAESFKEQGNRALKTGLQQKKKFYLRQAIEQYTLGLELQCSNATLVAQLYGNRAHVSLLLGNYRNALEDARAALKADPTFVKVHCIAALSPCPRHTPIQRARKPWFSPSCHQAYWRGAKAAAGLRRWEECRYLCEEGLRLDADNADLARLRQRCSDEERTDAQRAEEEKRRAAEKRAPARHLATAMLEKGWRVGRPQFSVGHGCASVLYLHAWRLLGHQPPHVPISGNRKPSIDADGAIHWPVIFFYPEASMQQDVIEDFSVTDTFRWGWRVQAGLLPDCDMLFPCMQAGFVHASTAGITLTACLGQTVPHWTGMWQATMAEASWRCTTSRTQARPCHWKPSQRYVSVKWDQAVFGSRCLGWILGREYMPSRTRSMLAAIFLDNAGGKSAQITLFMNGDLGYLTSVLTLFTSAKLTPPPSHXXXXSDHTFHERRRWLPYCCTHSLYICKPYFPPLPTQALYGGWPEVRDEGPSRYGPNAATWQRVEEGWTLEQALARADHVVPGIPVFFILSSSTPYKARFLSGDIPLLAARQASTAREGVTQGCSXXXXTLHSLGPFPFSLYNHHWADVSKRQGRTPSKHCQGGSDPGALQRHRDCSPCACGVVTAAPGMPGAAKPLQPSLPRQRHPLPEIHATPGLQGLRARRRLVRGGVRLLGGLCRVVCLVLPHERVLCCDGLDEGVPQLIQDAAALVNGGPALDEQALVGAGQGGHIHSNELEHVLALHGKQARAGDLPGCNDRGPEQPGGRKVRNXXXXDLPGCNDRGLEQPGGGQKRGSKATLPPPGLPQGVPLQLQDRHAVHTRSGSASQKPTK

SEQ ID NO: 11202 - protein, 443 aa, Chlorella protothecoides
  MOD_RES (127)..(129): Any amino acid
MLAVPAGVHRFEEGGKEGHAVHVYARDEWDAPLLHLPGHSKVWARQHGAGGPAQCPDVFPRGILGPKSSLWPPLPNSRWWPSASAPSYSRNQSLLAGRTWVGKPSTCPTACAFIIAPPPHTSVHARXXXVQCPSSQIVAGSTGCIWSAFIIAPPPRISACSAQLVSHAHQERVDVEAGLLFFTEHADPVDVHPMQVATLDSVVVYDTASPTPLCLLGALHYDSITDLAWSGDARYLAVSSRDCYCSIAVFEPGELGEALAGGEAERWLGGVGKPAPGPQPADAAVALPDSAVQLDQLDSVLPHGPAPAQGPEQEHARPAACPTPVLKKARRIVPEAVPCQPQPAPTVAAADQSSADDSFTFPAPPSAPPSEPPTACDPLQAARCPAQPAKRRLVPTPVQPLTGSAQARFSAACQVRLSWFWPPLVEDIALQCPVLSPQAMCVF

SEQ ID NO: 11203 - protein, 431 aa, Chlorella protothecoides
MTPYLPELDLLVCPGCCEAGSSREIHRVDRLLAMPHDLQSLHLHTGRYSIQRNDAARPSEHETCSPRCRAICIRFEARCIGSTRKECHVAVFSTIRHSLCPDRFSGAVINLFQELHPISSSMVRCWLDIDIGDAAQYALESRAFARAQALFDTIKSQYGWPEELSSLDEEQRDLLTSAYDSDPSWRDQGTMQATPPTPLRAGRLTIELFTEAAPRACENFRCLCTGERGKGKSSGKPLHFKGTKFHRIVKGFVCQGGDIVKGRIGVTPSFLVFVVCSGTDGGARMVECLWVLEQCRFPAASSRPSSLQPISSKTPTLCRGTDGGARMVSLSLPAGAHSLHSPPLRRRLRWGQHLWQALQRREGGPQAQARCSGHRIHGEQRVGGVLMGFRAMEVPSSFLPPVLIAAHLFKNPNTLPWCAGRTATPPSSFLR

SEQ ID NO: 11204 - protein, 230 aa, Chlorella protothecoides
MCRSFPSLFLPLQLEFPWFLPTYLAYPYVIQRVDAIRYFILYHHGGVYIDLDMGCRKRVDPLLAAPFTAPLTHPVGISNDVMAAAPGAAFMHAAVHALRGWNLWLVIKYVQVMFTTGPMFLTVLLSHFPDLAAVAVISKADYGKYDASGDALFYHLHGSSWHAGDAPLIFWMERYGKVVLLVVVAAAALIAALAYRRQRSAPGRPGRRTTLMERQCQSKYGDKQVAYCPV

SEQ ID NO: 11205 - protein, 112 aa, Chlorella protothecoides
MSLPSEYRDYFVRNLHDALSGHSSSSVAEAISYSEQSKTRCIGMTIETRPDYCLTPHLTAMLSYGCTRLEVGLQSTYEDVARDTNRGHTVAAVGECFQLAKDAGFKARPGRK

SEQ ID NO: 11206 - protein, 249 aa, Chlorella protothecoides
MARPGSAMHCHPRHPSSASLPVPGIPWHSQALSVSLVILGALYLRRKYTIDPNTVYRLAMVRLNTHPGLLEVMGAPLVGSPVRATVLTGGKLRFKGLVPRIQSRRAQIIFPLRGSERKGLASLEAKKRKGKYVFKLIAVDVPTLSGPDQRLFIEGGPAIYQRGGILDELRDPFIKAIAAEDAFVREDEADDAAEAAEEAHAAANKAATGPQPLEAGGGMYFWERVALTWQRGLQRLRGTPVPPASHKSA

SEQ ID NO: 11207 - protein, 173 aa, Chlorella protothecoides
MDVGWSSDGSALVSASIDNRAIVWDMGDRKRGAMLAQLAHHKHFVQGVAWDPVRQFVVTQSADRTGLWLALWEAPPSGMVDAQLQGYRAAGVKTQGPESGQVTRAPEPLSPTNPCEVGMGSDRPSCIPTPQSVSPQAAGGGEEGSGKSRGRHGSCNCQGSLLLRHAEQGRHPG

SEQ ID NO: 11208 - protein, 472 aa, Chlorella protothecoides
MRCRQHRPGVCRVPASPRGPLASSIPQPPGCRGEYVINARRAMHLQAVCKSRSLGVYTPPSGSASWAATGGWYYTCNIRPWVLCLQALLAVATSATIIWAEATIGSGRSPDLSPFSLAIHTRVARREFLEQLIVAAPLAYMCACTYFSLFKLGNFGFYHMGHARQPCGAFQCTLHTLLTHKVPGATWSRSLLLSGSLLARFAAPLCYNFLHVIRMNEYLKDGQVGRAMPQRGQRLRSWALGGHVWLPGCPGILKQAAPSRTAFPPPHPQQMVFIAKMGSAFQDVPILGQSFNTWFPLLLVVYVLLLTFNLWEQCASKFFISEAVRFDVERADDEHSSKGQRLVLAEQDALLRGGAVGDGIDLFGVSGSEGHDPSAAASAGSDRQHVAVQMAMTEKRGRSSPHAAHAAPQIASAGRNKDDVARPASEARIDDLFGDLGGRRAFTPAGTGPGNGEQRLLPPGQTSSSSFSWKLR

SEQ ID NO: 11209 - protein, 77 aa, Chlorella protothecoides
MARNKKGNVVLDPAEARLRAISDIVGQLIAGLHTGKDVDLNQIKRIASTKFSLARAPKLVEIIAALPEEHRAALLPR

SEQ ID NO: 11210 - protein, 80 aa, Chlorella protothecoides
MTQVSQGEDGYATIQHTASLTGHSKTVNCIRFSPTGRDLVSSGDGGEMLIWQPCADAQAPRGNLSAEEEEPCMKRAAVLR

SEQ ID NO: 11211 - protein, 196 aa, Chlorella protothecoides
MALARLARSLSQACRCPTQISRAYHATSQGTLKACLDSGPRTDKGFTAVQGLHRTHSRLGALGRGLRAISTAEKAGNAIRNAAASTGAAAKGMAGALAKVPSTAYSLLPAQARLLAEATSKPGVVQRVISLQLNSFWQQHGNKMYAVGGIFLAYCLWRTMYGVASTFINLSETMAAGGFLVRLCGRGGVPGNGCND

SEQ ID NO: 11212 - protein, 130 aa, Chlorella protothecoides
MPMSLLSASPAHAVSEVAQLADGRASLLGLLLVPVLGWVLFNIGQPALNQLKQINDSKSGNTPGRKRRSVVGAAGIGTALALAMAQSADAVSEIGQLADGRGNLFLLPLFPALGWDSSAEDLILSIALIP

SEQ ID NO: 11213 - protein, 129 aa, Chlorella protothecoides
MVVAHGTLLIPSLAGSAQVVAHMMPDLPNVGWERDLESFREYFENPAFRSDGLKLYPTLVIRGTGLYELWKQGLYRNYQPEKVNATGCLHAPTLTHAPASHPSILLAFAALVPPAPSHLPLWPFVRRSL

SEQ ID NO: 11214 - protein, 228 aa, Chlorella protothecoides
MAPMSGAVQQALSQLGLKSIQAGDCKLMYKGSPVDLNAPLRFSNLPSGSRLELLTGKEVALGVRDSRELKASPAAAAPSASCSAPSVAVKAPAFQPDDAQPTGPSWQPESTAPDHGNGTSRMQAHAQAETHSAGVEGASNTTTPAVQAEDLEDDPSVALFGRKVHVFHTQDEATSVEAANQDPPDDFYDFNESDYRHVVAGYAAQKAKQAGAVLKTRQVRCMHVMGGR

SEQ ID NO: 11215 - protein, 91 aa, Chlorella protothecoides
MRVAQIAVQRQKRLEGCPLHALNPETSLHTICKVCIEDPFELSHDLGRTVDRQTSGVLRKEFLRAATLLRDSPNPLHQLFERFIGKHHAET

SEQ ID NO: 11216 - protein, 564 aa, Chlorella protothecoides
MSACSPHPLSFTRLLPTLQLREREEQARFEAQADTPVPIRLVLPDGHCLQAVLKARETTGRLYDLVAAALLPGLSFHLFVTPPKMLLPRQDGTSLWKAELLPAARVHVGVEGGPAPGTLLRPEVEALVQRGAPAPGFAQAGQQGIGRGPQEREAMPQLPAAAHPRRPPTGGAARSGRMLPRSSSRRTAPGGGACCSIAGGTARRPSSHVQATQPQRPSSEGLHQPTLRPSLCSGHDANFPSQYTHPQAPPVAIPVAQLLHGPALPAIPALKVHDARVEALERGAVPDAEHGDACADGGAVQRQLAVGRHRAGALVQHGVGRRVEEQARHGQPLLLAAAQGLGPGLDLVQAAAARGQAVQLHGLQALRQALVQRLARGVGGGGGPGRDACAGGGGGHRQHIARRLGVEQLVAQRAGDEVGALGEVEELALGGQRDLACLQRPQPRRDAEEGGLARSVGAHDHDAAPGGHVEGQAADQGRAVRRGQRHAVEADGGALMPPRLGQRIQPGGAGPRRRVQAGGAGPRRMRQRPGGGDVAQVELCVHALGVVAAQVLDLWAGSGADGGW

SEQ ID NO: 11217 - protein, 76 aa, Chlorella protothecoides
MRPVARPSKPSPCPRCEAAGLPYIACRVGRSAEKLADASTELEKVLAIALATTQQIPRSDAHLRPLSDAVVKCAAA

SEQ ID NO: 11218 - protein, 146 aa, Chlorella protothecoides
MPLVSSGVEKGNLRELALARSAELGLKCRDVRTREVGIQDIHNKVSGPERQPELRGRCSVVRELHVYGTAVAVHARDASKYQHQGYGALLMAEAERIAACEHGSTRMAVISGVGTRHYYRRLGYELDGPYMAKDLKPLGPAPPCWD

SEQ ID NO: 11219 - protein, 487 aa, Chlorella protothecoides
  MOD_RES (205)..(208): Any amino acid
  MOD_RES (465)..(468): Any amino acid
MPGTKLHSPPISNIPRDEVEECIQRAQQRKLLDARVRDGEVGECLVSSQADAADECAGLEFGEAMSTQGVRGTPCEACAVLGAAGRGFVGSASTPGPGGQGDVILSRELQKGLYRSSCFSPLTSRLSGHHDRTRHEPRPCWTLPACISQAPAQLCLACHRSNLSLYATCSPPPPIGRSRPCSSESSQSSACRGGSASRTSCPALXXXXPLPRRSGGRARAAVDLHSPQPAVEVAPAAPPVLPFRVGHGWDLHRLEPGYPLIIGGIDIPHDRGCVAHSDGGVYWCRCAGHGIWNQHPGGTFESRMHLSHTLHLPTPPVPQAMCCFTRRAQRHLSAGERAADGRARLLPGEHRLHHRGAAPQALAAQGVHPGRALLAPGGAPLSRQHQGPRALRCEGRRVMAQCRGEQQSTDAGRVADCCFPPHHPLSTILAPAQAKTHEKVDSLGENRSIACHAVVMLYRRDDAKXXXXKRTRRWIVWVRIGASPAML

SEQ ID NO: 11220 - protein, 204 aa, Chlorella protothecoides
  MOD_RES (33)..(36): Any amino acid
  MOD_RES (120)..(123): Any amino acid
MAPQKASELLEGLGKRLESEEELRKSLCASIKXXXXQHGSPESFGTAGGPWQAPRIRGGIEEEPVCFYQGRHAAEGGATICQGVALLLNLGVQRILLPLCLAPITSELRTPRSLLSCSSXXXXWSLDLPVSRPVAKPGSPKSPSTLGPHHLRITHAAQSVVVFVIDKEEWTLDLRPGQGSLSKGSPAEKADLTLTINGANFVQL

SEQ ID NO: 11221 - protein, 117 aa, Chlorella protothecoides
MHALSFACRALCVIGVRPPSRRVVVGPGRAFLGARLAPSGRSGGVRPLKIPLAASLQSRQEAITREMSLLPKEACLIRLFNAAGCHQWDRLAPLAREFYDLGGSLEELVATTRFLVT

SEQ ID NO: 11222 - protein, 23 aa, Chlorella protothecoides
MQIFVKTLTGKTITLEVESSDTI

SEQ ID NO: 11223 - protein, 137 aa, Chlorella protothecoides
MSGQLASFGIISHFAGAVGERLVAANLSWPVVFGLLNAAYFALHYMFASQTAHVGALYAAFLGMMQVAGVPAVLGALSLGFMSNLFGSITHFGSGQAAVYYGAGVWDWWGGPGERLTGLCCGAGAQLLELESILMGT

SEQ ID NO: 11224 - protein, 724 aa, Chlorella protothecoides
MGLILPRLAGPNPSLRPAAVPCSRRSRGTAEGARQVGCCPVRDTGWLALCLPNGSNEHDIQLQTWDRKRLAQSPHGGAKAIGLSGRPTQAQQGWTGFWMQLINPCQQAPMFFDDLPVWFRLEAARSSRNSKVFEDGEQGAQFRNLGDRAAGNLPGLTVRLSTCFTARQAPPARARNTLVPRVGRRPFRRTAKAFAAAGAAPSASSDDPAEEKVSLETALREAQEALTFVEEFQGQVTSLPSARLPTTVRRKGLGICVRNPAHGFLSACSCVVEVGAMRSARQAGMARQLSSQHISSPCISPHTPLDKKPPPTHLCCPQLDMVLAKLKPVFQVAGLVALCAAIHALGIPGRLVGGLTLALSAASWGLSRGSLDRSGAAAAVVVGWITIATSMTGGLLLLTFFVASSKLTALCDHEKELDDDHKPGGNRDWTQVLSNSAVPTALLAAAAALGTAPTLGPRHLAALHAAVLGYYACCCGDTWASEIGQLSDAQPRLPWGRPVRPGTNGGVTLLGTAASAAGGLFMGAMAAVGCLVRPGRAWGWAAPTGPLWGVLLMGEWVRQKCVLFGWGGGGTWGRRVGGGGCSGEAAGLCCRIPWAPELPASVLQVHPGQHHQMNSQSCTLRIPSIYPTPTLAVPASRSRPRGRRRGLLPGLHPGRHRAVHGVQPGHTQGDEPDGGAHLLHCRPALAEQQRGQCSLGLRHRAGLRSSHAGLGSVRAVGARTCTLA

SEQ ID NO: 11225 - protein, 390 aa, Chlorella protothecoides
  MOD_RES (106)..(109): Any amino acid
MSAAAVSLSTKPFALHTKHAQELLPEKRFLFFPELPSVSGSDALQARVTALRPDIHIFGHTHFAWDATLDGERWGPATAHVSSSQGNHEPPLRGAQATVCISASTXXXXGNHEPPLRGVQATLCISASASVDDVLWGMRQSFRVATTPTSACHTGTRYIQAPLCSFRERSRRLQTLRLGLKDLKSVDPATWLPALIYEFPLDATGAQRAACAIRKRAVEQGIAFVGPGHAHGLDGVAGSCPLPTTCGRRENPGQAGGIRRLTPLRQAALPASTQGASPGQARAGPSSRVGPCHPPTRLPGASTTDAASGTLPIPSRRRGWPKPRRGGNSERPAAGRPTLRPRVLSPEFHVEGVQPSLAGRSGGSCWDQDCSWSPSHLSSQILGMQVTLRL

SEQ ID NO: 11226 - protein, 321 aa, Chlorella protothecoides
MIVEQCPTIPAPSWESLSAMMSCPAEGLSAGTLSRCRDDVLLFAGDASDKLENVEWAFQTLASAFGMVVYVPGNHGALVWPGSHLHADTGCMLPGTLQEGIGGGEELSPTLSVASLPDLQDELWVRPVDRARGLHDSAAKLDQIQGLCREYDVRTRPFLLHGTAWVVPLLSWHHASWDREPGMGGKRHAWAFSDYSACVWPDSIPGAGSVGGPGLARWFDAKNEGEGWAAALAGVREHDVISMSHFLPREVGRGWGLGGSGVEGEVCWSGTPAHAQEQGEASLMGPGMQGSHRVDDAATMDCHLGPWSPLTLHPCPWRLYP

SEQ ID NO: 11227 - protein, 347 aa, Chlorella protothecoides
MVCRPTTRPSPTRLQSLVMALLIVSQSIAIAVPCPWFKQSVSLLSFIRWTLTNSVSNGAVGPTGTGVDAATRSSAAQTTMCQIHTLVPRCCCCSCDPASAPLHLVVPLHRAGLSSRPRCGGTILTSFFGLQHTLICLQPTHLPDPISIQILAWMCVMMRGMCWYRGSVQLPDPDRQLTIDAPWRRQAWANLPTLLIFLSTETVVVAKLAYRWIDVQEAVGVPACRTYPYDCTPSTGEFVINIITTVCLLVYAVYYIYLVVQARADHAKVPFTRYRVTYLYVQMHVSARGGRRGGGTGVGGGEITVALTVWVRSAAPSASSPCARGHNGTWACDRTPVPPLSSVHCPA

SEQ ID NO: 11228 - protein, 730 aa, Chlorella protothecoides
  MOD_RES (649)..(652): Any amino acid
  MOD_RES (703)..(708): Any amino acid
MPGFDQSWPQTGARPEDLFLHIDTEQPSKRTLHISAMKSGTTRAPADSGIFKSLGVVPAFLGFEAPGVTTMSEIQEPATGAIFPSTLRPWDGGVYKNLGAGPRIMKVAFISIKVYAVSLYVPIERLPLASGTALSEAGSPRVIQVCCSTPACPTFEQQVYYTTVRQDSANSPALLPQMQLARNIAGSQFSDTMRKSMGPSMSAPRPVPIHGSQDLASLTKFCDFITQQQLQTGTVITLLLGPASEVDVNVDQVSAVSGGSNPAILKGVASSCANAGMGKLTLSPLFIQAKPQLSLQSEAFCASLLQIYLGPKSVIPEAKKAWLANAGRAARTGVCDNNNNNNNNSLASCTAIIDGHPPMLCYGGLNRNVLASVPSTGCWGRKATAAQARQSVDDHPTARGRAAVGPPSRCVLGELFGLVRIPGVACRAKLWIRPMLFRKLRPPWPHPLSNAATKVGQHSKARVRNRTLTQWTLTLWRPDDAFPTSRPLASAGQVNVVIGVDCFVDPYSTGLDAIEVQHKEASSKYTTGLDAMEVKHMEASSKVAIATQRRKHTSHPGPRMPPVQLVSVNELAGDENENCQARWSAAVNEWRTELGEAGMTGRYGKVIDDYATTSVKTTWNGFRGLPKKTKKTMQQQERVCNALRPTVDXXXXKKKTMQQHERICNALRPTVDNIVAVITESRTVGDLFANFHAIRMVEEFERXXXXXXYMFFPGGPRVLTIRGVWEMSDL

SEQ ID NO: 11229 - protein, 137 aa, Chlorella protothecoides
MLASIGLGLAVRFLVPIPPEISLQAWTLLSIFVSTIAGRYAGAGAAECGTDMRAIPRIWCIAQLLHLGLVLEPLPVGAWAFLGVTTAVATKTLTFAQAFTAFTNDVIWLIVVSFFFAKVRKFCSRTASCAGPSAEQG

SEQ ID NO: 11230 - protein, 161 aa, Chlorella protothecoides
MPTLHMHVCCPVEVFEVGYLSKELTDMAYLAACTSLQGLQSHRNARYRSAEVILFKSCTPHFPCSARYRGKGTDLSRVPAFQRSPTDSGSSEVQIARLTARVAQLTVHLQEHKKDYASRRGLMQVLSRRKQLLLYLQSTDRPKYEHVLQSLGIRAPKSGSI

SEQ ID NO: 11231 - protein, 312 aa, Chlorella protothecoides
  MOD_RES (229)..(232): Any amino acid
MSAEERPSESVLFNVQHSPVALQEVCDFRYDVHVEALGVSRDLKHKLACGSLVVAFRMEYWEFWTRGLQPGRDYVQLTNEEDHVCNETAAAVRDMNTLFSTVGQSALRGPKQETPSLARALAELRRSPGAAALLAGASEDDVPAPDANGTYSWGSAATPWEIAWAGYDFLHGNVRLEDAVVYTRDLLAAYAALQDFKVKPQAGAACFNGPRLLERLGGAGSARGKRVAXXXXSRRRGRPASMGRACSSAWAGWGVRGASASLLHTPGSPTTTATATPPKSTGMTSSRRRCLDGLAGKGCLGRSVARPSLVRM

SEQ ID NO: 11232 - protein, 129 aa, Chlorella protothecoides
MDALSVFGAQDYTRLPPTVASPFSMTLHPRVPHSNARHPHFTSPTLKPQIPDVDAVVHAGDVPCMRKKWMHGGPPQVLLGVQGSVRHFDVPLPDYTLWVDELQLIQVLRCRSGEQGKGAGVGSWCGWDA

SEQ ID NO: 11233 - protein, 60 aa, Chlorella protothecoides
MQGVDGEEVVSWQEASHLMQEKYSNTSLLVRVPQAMWRGDVLDAKHPERGQLRYWLLDGG

SEQ ID NO: 11234 - protein, 419 aa, Chlorella protothecoides
MDAGALKATLPIAFSTAVMAWGYESYTAAFSDVGAADDLLSNIRWGSDYLLKTVQAVGGSTYILSRIGSVADEELLWRRLEDITAPRPAYVVDMAKGASDLGGSVAAALAASSVVFSGTGDTAYAATLLAKAKSVYAASTANLGYYSVQDWNISAVYNSSTFYDDLAWGAAWLFKATADDAYLSDVYDYYVKHLEFEAAVSDFKFAFDWDNVFWPANVLLAQETGGATFLTQSELYLKSWICSNMAANYTEKGRAYNAFSASLGSTMNTAFAALALADVLGDDQADTVFTYRCWGLAQVRYVLGDSGRSLTVGVGKNPPTRTQDRDAACPEAPQPGELAPCCIAEDRFPAPSSQILPPKLRLPTQVCNRVTGLLSPEEDTHVLEGSLVYGSGRSDDFADVRDSTATRVGIESNAGYIGV

SEQ ID NO: 11235 - protein, 161 aa, Chlorella protothecoides
  MOD_RES (80)..(83): Any amino acid
MMLAMGTFVYATRAIAGFGAAAVAGHEILRTLWVTATQAFSSLDIATQHSLATSPGPLARGGACLSIRASFDHAPARTQXXXXDVPHLQPSRTTRGGRAPPHGAQQDLRVDGDTRYWNNALRSPQAMLPQWPADQAHGAHGRAPSTKPLTSRLRVLDKGMQ

SEQ ID NO: 11236 - protein, 228 aa, Chlorella protothecoides
  MOD_RES (60)..(63): Any amino acid
MVVQAFKRWSLDAHQRQVCPACLRVPWSRKHSIPCTNHQAPHTPPLCNPIHSPAPRFSPXXXXSHRSPSSTHSPPLQPNTLSSPSIPPKPLAPPTHRAHGLGGAVGGGLPPPRLLRLHGGEEEHLLDVVGVGEEHGESVDAQAPAAGGRQPVLQRGAEVLVHKHGLVVARRLGRGLLLEQLALAQRVVQLGVGVAHLAAVDKQLEALGHAGQGAVPLVCGWGVWGEMS

SEQ ID NO: 11237 - protein, 340 aa, Chlorella protothecoides
MWLTQRAPNPWPGAVLLPRISRTPSGKCRARDDPGGDELRSKLSKWTGLSRVRRQAPESGAPAPPEASVEQGGPAVPSQWSDWAGAGPWSLAWVHFEHAAWQTAHLIASHDQDWDEWKGEAEPDLDDAEDIAALRSAVIKKRRARKGRRSVTRDEWLRPIVDFQGIRDRWVGAGVEVGGGRGLAFDEQDSEERVFIEAATNQFESREAVNAGQNVTTLIPWAPLPPFNSRSGLIFGVSIVAGFAVSRLLAEPLWTYAAGVNPAAFAMSDQQKFEAVEEIHAEELRLQMEATVGQAPPLSDAGVLEHLRAEAKRIQGAERGAGWGNGGPGFGISDGVGSLQ

SEQ ID NO: 11238 - protein, 101 aa, Chlorella protothecoides
MHRKGSLRWRTGGEPCANPSVRRGGVVEAWEPVHVSKHQDPPSRPYSGKITYAWRPLATAACAGDDSSPCLHAGSSLVLPGYGVELAIKNMEYNAADDKAG

SEQ ID NO: 11239 - protein, 182 aa, Chlorella protothecoides
MGGVLEDLPRHQQPDACPSQPCSLITLRVKAVMAAKARGENPYPHKFATTIQLPAYVAKYKDLEAGEQLTDTEVRLAGRQLRGRAAAMSSGLVRMPVPLGIIAATACTRPHPLPRFSLPGRVERKAASGAKLVFIDLRSAGSKVQVMCDARCARGLMGCSMECESRLAGRQCGDKEHLGRSR

SEQ ID NO: 11240 - protein, 212 aa, Chlorella protothecoides
MGVGQCALACVLLTTLVLLHPSLADVGRGADIQLRAKWNSSTFAHEAAEFLAAQDTAAFWSFAGAFTLPQDSTDCLEHVLRQARSLLHDEPSRRLLGVEVAARLHSPRAELFHAAAARELGDASPSMPCCWASVGGAPFLSLSALRAALAAPATGRASEGPRAFDHVHPGPPEGAPEVPFVALYAPLGNACGAAFHAELRALASAGGHGLGS

SEQ ID NO: 11241 - protein, 125 aa, Chlorella protothecoides
MSWLPRPSPAPDVSKHGQTPFSKSPPAGGTYRWGSNLTPTQIAAAGQAFVRDKVRMQDLLLYTRDMLQAYAAAQRFTPAPRRKARCVDGAAMLEEFGTPYAQDAEEVAYAYPWLKDFDGGCANEA

SEQ ID NO: 11242 - protein, 76 aa, Chlorella protothecoides
MPSPATPLQLRGSRTVRAANERFTARMRNRVSWKPGEEEGARVLVSDVDLTVTLELPGWFPLPRGAVQATGEWCGV

SEQ ID NO: 11243 - protein, 312 aa, Chlorella protothecoides
MLEEAENMYDICDGDMFRFQIISGKLYVYHVTARGFGWYPAQLGPGHVAAKGRVPYAMLLLLDVLRLFPGQIPDLDAVMQLGDFTCIAQEPGAGRTPVPMFGYTTSEGYADLVLPDFTYYGHEYDYLMDPWGNPAHGWPAQASVLLTKYANVSLASRLPQAMWRGRTMDSNYPHRDALRRAFLDCVRALRASGREDDAALLNVDREPIVMQDFDDYRYQVHIEPLAWVSNIRHKLAGGSVVMATGIKYYEWFARALVPGTHYVEIPARVPEMCAQAVDVVRGLVVWMRRVRGRDGGAGKSVLTGGKRAGPGG

SEQ ID NO: 11244 - protein, 149 aa, Chlorella protothecoides
MTEELLSGLALRLTGSYVIGYHPDGPEGPEVQIDFTPPFRRISMVSGLEEVLGVKMPADLESEEARLFLLDQCRRRGVECPPPQSTARLLDKLVGEFLETGCTNPTFICDHPQIMSPLAKWWVAGVVGFIEVGVRWVSGPWGVRVGGEG

SEQ ID NO: 11245 - protein, 107 aa, Chlorella protothecoides
MASKSPLAPLVGTGQPGPAVPLAAARASSHEPTTPPTADYMALPASQYSVLDAETVERLDDDTFLCHVAGLTFFSFEVHPVLTVSVSVGPTGPTVDLLKTEVGSVAS

SEQ ID NO: 11246 - protein, 79 aa, Chlorella protothecoides
MSSEWKRRVTQASKEKKLAEKKVGSAVCSIGVRARQAAAAAAAAAAKADKPAVAALDDDATEETDPTKYFENRCVGVAE

SEQ ID NO: 11247 - protein, 197 aa, Chlorella protothecoides
MNAVKRGDIVGIVGFPGKSKRGELSIFPTSLRVLTPCLHMAPGTRTGLKDQVGELEGLGEGSGGGQGHVSPGKGHVSPGKVPRAPPPSLRDHSWQRAVGWRVVTCLASNPRQHHAFLPTCPRAAQETRYRQRYLDLIANPAVSDIFRTRSHIISYIRRFFDDRDFLEVETPMMDKLAGGATARPFITHHNDLNMQVR

SEQ ID NO: 11248 - protein, 126 aa, Chlorella protothecoides
MTERFELFVNCREVCNAYTELNDPLRQRELFEQQAAAKAAGDDEAMFVDENFCTALEYGLPPTGGWGLGIDRLTMLFTDTNNIKEVLLFPAMKPEQARGGEAAAHSTAESMSTGIPGADVHLATSV

SEQ ID NO: 11249 - protein, 244 aa, Chlorella protothecoides
MAVVLGVGMSLLLWTQGGAALRAMGAGPEVMAVGMPYFRARCLATPSVLMFYVLAGVFRGLKDTRTPLIAGLLSNIVHVALDFGLVYWAGWGVLGAGLATSLSHWVTVAVLGALVIRKGHLRCEACQAFGITGLVVEGGEVGRVLVDACRVRQGACMLRHALHGRASAKPLLWPLASPQRSACSVPHLRRSPKPCHAPPCSSPPPLPERQSPPPPPAGRATCCAPPTWPRSCPSCGRVSCSPPA

SEQ ID NO: 11250 - protein, 376 aa, Chlorella protothecoides
  MOD_RES (286)..(289): Any amino acid
MQSAEDEDVKAVARAGELATLGQALEEAEDWLYGEGDAAGSEEYVAKLEALKALGDGLRTRGRERSARPQVGGSGVWCGANVGGGVHGRSQRVDSVGGDRTAPSFNPGGLINHPPTTPLPPLLPSTGCGRGQEYAGGVHGRSQRVEAVGGHRTAPSFNPGGLMNRPPTTPLPPLPPSTGCGRGQENAGGAEPHRGGVGSRQAMAARVRSGLGQRKACGAAEVADPGGGRPGQEEGDRRAGFHLGGVRPGCSSHIGGSQSGSLASSVLIPKSSTPQLSNAVGQHARXXXXKAQYSTQNLPLPNPPMQSVSMLDRRPAPPTPKPTTDATADGAKKKAAKKGTGTNGKAKPSQGPGEPEAEVQAPEEPAEGMETVKTEL

SEQ ID NO: 11251 - protein, 521 aa, Chlorella protothecoides
MAARILGRDLPASRIHCLYHYPCHDGVFAALALQQYYSKCNVPVVWVPHTTFKPLAPSSLGIKSDDLVYLLDFSGPPGFVDALAAQHPKRVIVLDHHKTAAADLARPEIRGLEGVEILFDMHRSGAMISHDYFQPLVCSAWCGEEAMSPMLPALQIAQASPFPDNLPSNLAIEAFALTPLLPPCTPHALQDLPPRVTAVYEFVQDADLWTWKLPGSRVFHAGLAAAGMEYDPNLNRGLWSDLLALDPEEVRRAGEARLAAQEERVQAALAGAIPVRLGPADGPLGAAQGLATVLDDGDGEGRSVRSVLGNALAAAAGSRAAPFLPVGVVAYREEGMAGHSLKLSLRSRGGVDVSGLAAALGGGGHAAAASAVVPAADFQAHSVVSHTFKPFTPPNAGRHDDTEDDQRSELSMALQRPVRLYWNYSPRPDLWPCQEPPPHSFSSVPPTARRTQAATSRRIACAPAARWRHRRGGRQSATGQRQSACAADTVHAPQSYPLVCCGAAGAGCRARCLSREAWRMG

SEQ ID NO: 11252 - protein, 692 aa, Chlorella protothecoides
  MOD_RES (220)..(223): Any amino acid
  MOD_RES (480)..(483): Any amino acid
MATLTAVDVSSNGLAAVAALLTVLAGLIFLLYRQKGPVRPAASVAAPPPAANGVKTGSHVEEELPADRVLILYGTQTGTAERFAKSLRFQLEARYGGSGKKFVALDTEGYPAAKHLHHESCVLLLMATYGDGEPTDSAAEFYDWAVETAESGDDPELLKVGLVCEEAWNVCGGDCWSVWALGVAAYKGSGKCVSRGLEVGCGCVKRWSQDRSGCWKLQNXXXXGSGKCVSPGVGVGCGCGKCWGQNRSGCWKLQNRELLGGSPSAVSMTGFLLRKHRRPPITQRHPPHYQVPAEEPVPQRRTHALLHPPPPQSVTYGVFGLGNRQYEHFCAVGQRLHGVMADLGATPLLDPGLGDDDDDIDDDFDEWTLALFAALDARGDLGAGAAGGAGGADAIPAFAVETAPAGAAPADADAQRCRQGRGTAAHDPFLASVLEVRELHAALSTRSCVHVELDLAGSGIMYAPGDHVAVFPRNDDAVVXXXXPRFPHAPASMSSWTWPGRASPTRQGTTSPSFHATTTPSWPRPRGCWVLSPTPASRSAPRRAAPSLPSLVRPRAGWQGVLSSGQALGRRVAVCAGGFQAIGHGCPLGGLFQGGVAGTQTPLKPLNPHRPPHPRAHHAAGGAGRPRGPAGPAQQGRAFHPGGVCQGQDGGRAPGAPGGAGGPGRVPRRGGGPPAQPAGGHAGARLCPAQPG

SEQ ID NO: 11253 - protein, 858 aa, Chlorella protothecoides
MENSGVTHQYGAISLAQRGGAVSGLWPGSMNVASTGRATCDSFSLNPPLRGSPLLPHKHTGIWRPEGLQRWAVVEAVQWREGGGRPSRWVGTFHPPAKDQLPTLTPPPHTTPRYQDPGLVPGPEAQHAQRAARGRLVPGLHWLPRRRRRDPGLRTFPARARAGAGHAGAQLGRRGGRRRGPDLQRRGRAGLPPAPHRRGPGPSCARGGDAGVPRRRRGGGGARGRADRGLLLPAQGAGAGGRRGWGSRRGRSHRGPLRRASAAPGGAALHRRGGGHGRRHYLLRPGGGHRAARPLRRGDVRLLPQAAGPGPGLPRGLRHHPPHLRPAQDQRAPDPGGHLPRPAHQARGAWGVGVRGGRWRGFAGGTGAAGGKGAGESSAWLLTTLKLSPPPHPTTLYRKGQTFYPHILCQFPSDEQATLELDITDEALAAKNEKNGGKLQRSYSGPATDVFARVLRGLSGSKLTRPGAFRDAEGSGFAVKCSYKVGRGLGMRHRGCSGKRLCMGLLVCTVRRRRSAMTKRALVRADLRAHTHPPHPMLHAGGRRIPVPAGARLLLRPETAPAPRLRRRGRRRVPAPRPGWAGRGVAPYAADGACSLSLRRVVCWAPPSTPRIPCPTLHSNAGVTAAKTFDLSVRLRNSQDYLFRGIPRGEWTNLFEFIQAKQLRIENFKEAQQGPGATAVSYAALGGGELRVWWRASLPCSNTMWGNTAPREAWKGRWANFFWSQHVTPPSQFPLTTHAMPGLGEEGGDLEEDEDEEDEDFEAGVESESSDGEDEDEEGQPIVVPEDDEEVRGRRCEGARLGVIYDHGHRRGDRVWIRANSGFRGGFVSRMQSRAGADRPGTVQLPLSACTATEGMCP

SEQ ID NO: 11254 - protein, 162 aa, Chlorella protothecoides
MTTLRPCTARGEVRRFRRGMDYTVAHHGVLAAAPCLDAVLCMLGSGPGAGEAWEGGEVGGYEAYMLADDEGEGGAGAAETAEVYRSPGDAAGESESGVLNISPAANCLSLVLRDEETELLKFVKYVSAAAPGSRWDVAMVSGHERSGVQGGWSAECALQPVD

SEQ ID NO: 11255 - protein, 438 aa, Chlorella protothecoides
MGRAILPSLILLGCLACLVPGARSSIMAVDLGSEFMKVALVQPGRTPISIVINEISKRKTPALVGFVGRDRLVGEEAAGLATRHPTAFVANLPALLGRSPDDLALAALAAQGLPLPRLVPAANRTGALALDFGEAGHVTPEELAASLLQYAAGIARAASATGTAPRDLVLLAPAHYGPRRRQALLDAAAAAGLNVLGLVSPAAAAALQYGIDRTATFASGGPQHVLLYDLGSGGLEVALVRFSTYPDRKMCLQQCHARAEPRPRTPPSTTARPSVHPGYFMHRQGAPASQVEIMDMAWDEGAGTQLLESLLLRHFMAQAGEALGEAGTDLAASPRAVAKLRAGVKRALRVLSANLEAPLSVEELHAGRDFRSSISREALERLAGDYWARVTRPALDLLARNGVAAADLAAVELLGGGSRIPRVKAELSQALGGRALDV

SEQ ID NO: 11256 - protein, 95 aa, Chlorella protothecoides
MQVGLSNHCLSTSFLDAHVLPGQSQPGPKLDLHASGLLLAVNDSPSLESAGGGTHWSLLAVALDQGSAWHVDSLGGANRRVAQALTRKLAAGLDR

SEQ ID NO: 11257 - protein, 274 aa, Chlorella protothecoides
MSLEEGVGAGQGDDHSSSSTTRPREEPRNARTRPSCTPERDSQKRLRVSVDEPLRDLLSRDEGAPSASSVGDDQHGAIAPEQGPAAPTRALSPIQQESLVVPVTRSKAFPITDTPPHLFRNILPDKSHWLTGATDPSSFPTSSKRMKYLQSELGKLERGFREPVVPGSGVHPIPCPFPASSRYPLIPSPPPTTKCRFNYIPGIPLVACASEGQSALLRHLLRQEGVDPGVRDLNGNTALGLATANGRSEAAGLLRTAQAAGAREDGVAAQGAPA

SEQ ID NO: 11258 - protein, 308 aa, Chlorella protothecoides
MTSGELLSIWSMATTWPVRRLHAPLWKATACTSFIIYLFNDTHDSTDSEPVPKKAKTAGHAVDIIRPSVTGTESREALAAAYKAAQPYPHCVITDICEHDALAAVREEIISNVQATYKETDLFNMFQTGQLGIACLHLAPARLHHGRGDWGMDTWVHTLIPLPPQPPAGDLANLDGLDAESAAKLPTVRALRDALYSPDFRAFVSAVTGCGELSDRTDCACNVHARGGHLLCHDDVIGTRAVSFIIYLTDPERPWKAENGGLLELYPQDPGRAAMLRVCAQWGAHLGGVVIAGCSEGLGSVSRLASVE

SEQ ID NO: 11259 - protein, 238 aa, Chlorella protothecoides
MAMFAVQPGVSFHSIQENFTVDQPRMSIQVCRRGGWCEAMPSPAPAQGWFHRDTPPEGADSATLRQLQLQSDPRTRDFQLMPGAQPGGSDAAATAGPLPEAELEVLARYVNPVYLAEATWPKVAARFREEGSVQLQAFLKPELARAAMAACQAADERDGLGEGPPPASYTVGLGPSWEAVGPAFKQRYLRYSGEPTCTPEAGSDPGPILERVREELLTSSAFAHLVEKVWNWPGELDP

SEQ ID NO: 11260 - protein, 416 aa, Chlorella protothecoides
  MOD_RES (50)..(53): Any amino acid
  MOD_RES (151)..(154): Any amino acid
  MOD_RES (312)..(314): Any amino acid
  MOD_RES (339)..(342): Any amino acid
  MOD_RES (360)..(363): Any amino acid
MGLYAASPSPFPPPCSDSPAAPSIPHFPPDPRLLPAQPVEAVPGLLLQVXXXXHPHPPPSHQTPACYQHNPLRLSQAYFSKFQPDTLFYVFYGMPGEDAQVLAAEELTNRCLVFGCDGVLCVGRGERGGAVGLDGPGPLRGRTSGHPRRSXXXXQGGIGVEQWASMGLGLWGRGPVAILAGRTCPCVCRCLGPPGPLRLAAPQQSRTLVTLPAPSTVPRGWYFHKELQAWLTMVPGTDPTQKTDRCVAGSGKGALLPGCPRQGLRADKPARGTVDPGPEVDALRGARASPPPIRPTALTGEPLPSLSLTPTXXXGTHPEDGPVCCWVGKRSFVAGMSTXXXXRSPACRPGLDRCALAGCXXXXGAPSSSSSLPPGSPACRPGLDRCALAGCERRAPTRARDHASASCMTGKCMEVV

SEQ ID NO: 11261 - protein, 1176 aa, Chlorella protothecoides
  MOD_RES (193)..(196): Any amino acid
  MOD_RES (664)..(667): Any amino acid
  MOD_RES (1050)..(1074): Any amino acid
MLTGRGSGRGPSSVSSRSSGVAAVIAAAPVLALFTAGAAPLPSLRRSALSMLRPLAVGFLANSSDTDSKPAVRATEAKIPVASSPCFCGVCHGMCLEHVGEQPGLVPPSKQILSRGSGLPAPTNMPAVLRTDKEFPGAFRIVCCPGASPCYAGDYTALTLRQLLQLQMLVQRGHCQSPRALTWSSAGECGACXXXXLMEDALPRVNRLGHCCSSSAGECGACGLSQAKGQASLILPPRPHLSHKLLVSILQAPRTEVEGAFRALCLHLHRLLPALQRKVTVAGLGSANTIISPEAPSPSEDARHSLRARVHLCSDLDAQFRSRAYPPSHQITVPGGKSCRSRCHRFVRPGASPLGWPFSASLPQGPLQVGTERNHSEARFHPLGVQGLLSLLACQLPGLHRPQHTAWQASQAIAALTRRRSSCFNHSCCRCHPWHCWVSKRPRRSQSRPVLREDLTGSCRWVAPTRAVECQPMKLKRTRNSPLNTRSQGGITCTLSWESPSRDPCGLSRSLERSLYVSRQSILGAGSSHAALTSDGDIGPAAALWHFETKHALHLKVLRSSRFRLHWVLGTTRSSTLAQVICRLYTDHRPVPDRQRPVRSWLHLRPMQLRAHACLVACLLISAVVGAVAVTSETPVAKTRQLSQFRLAKTDGKAPHSFTLPLCXXXXVAKTRPLAFPFSVNFKPQDTWAPEAVFGVFVFLFLINIWRGRQSNERRAIFWATQSQLPDNFALIGPGNSGEGEVLVRESMNIYCVHVSGRRYCKVCMGHALMCLDLAWPLSGRGLQRSGGQVCLVNWQPRRPCVNTPSPLGRTAEWPPDLLLPEATGPAGLGGERHYPVPRCPGHPNRPQPRVYPASGPADRKGWPCQDTGQGAGRCQMSVCRSPSTVWCAHDDILSHQAWLMSGSSVTIRHILLLAVAQLVSRSTTPPNGQTFTKLLEVKKDRLAAWPSIDLAVYAEQASAFYDLMTPYLLSHSFGQGAWEELGTCFRHLHITSEGQGDDTKQARRANAGSSAVPPWTLLPSSHYVALTPSFGNPDHIHPCDEQFINLSLXXXXXXXXXXXXXXXXXXXXXXXXXWLRAVIILIDSLGTFKFTPGTSRCIVLGRGRNSVGQRRVRVAILCTFTLHAHPCAEQAKRAAENRAKKEVLALKAAEQKRQEELMARREKKAEQDQVGSLGG

SEQ ID NO: 11262 - protein, 237 aa, Chlorella protothecoides
  MOD_RES (73)..(75): Any amino acid
MTPASASSVAAQPKCPTPWHPVTQLVNSSFEGSGALTSHVRLQQGVFAEPPAKGQSWRSGPHQVSRARVQGAXXXAKGQSWRSGPDQVSGARVQGGEGPVARTAHDGDARSMVEGCKAEERSGGAHGRVTAQNWGRPCHLSGHGDHGCSSQPSQPDPEPQHELVRVGGVVAREESAAQAPAHPLLRVPVLGRPGVGPAPCERGGRRLGRAHLAVAPALLPAGQAAARGGADGELALP

SEQ ID NO: 11263 - protein, 789 aa, Chlorella protothecoides
  MOD_RES (350)..(353): Any amino acid
  MOD_RES (726)..(729): Any amino acid
MPASSNPGAHVEGEGVSRGIPATPMRLRQEAREDASTSAHTLSRHVGQSSRDQHIPRSRRSVGVWERCRPAWPASLALCSCRSRSQRPPPPVMRSRRVRGVQACCLWRMCRCRRTPWGGRITRSLTCIPATMHRPPSHPVYILDEVLSLVGSNRDAIDTATNAIVQRLKARSATVKQKGQKVTPTSPCSWTDSSSGPAVSGSALPRRATTRRIMQALRLTRHACLKGDAALRSRLTHLASPAVRDLLSYRCDPDPFKGDIPWKRVQELAKDTLTAMHAGPEAAVGGASHALQVIICVCVGRGTHVSPVRTRCAAPGSARQSRGHATSAGVWGVRHRPLTPSGTRTPLPTXXXXCPAVAGARHGRRCCGVRHRQLTPSGTRTPLPTPRAASRAWAAAMLAAAGRPSAPPPAGWLALAAGRRGPRAQAPPAAAQVSGRAAAASLAAPRRTPVPHPSEPRAAGACCSRAPWAAVGPRRRCHTRRPRPARRRGSWPGWRGRGACAPRRAPRTCAASSRPPWGWTAPGWRRRCGATWRCDRRRGGVGKAVVSLGPWGIARPRAQRRRGETPRVEGWGSACGALVWGTRHGIAPLRDPRQPVPRASPAPQGPPKSPPPSPCDTPLTEPRADLAVAAARAVWHRGGAGGAGRHAPGGGRLHPVSVPRQRPACGGGPAAGQRAREGGPRLDPGGRRPGAGGGGWTRWERGRRARRRGARSGESAGGLGWEGVEXXXXWRRADALGEGPTGAATRRQVREEHRRSWVGGGGGSGRLRLIDAGASTVLWERQRAAATRR

SEQ ID NO: 11264 - protein, 797 aa, Chlorella protothecoides
  MOD_RES (176)..(178): Any amino acid
  MOD_RES (325)..(328): Any amino acid
  MOD_RES (441)..(444): Any amino acid
  MOD_RES (494)..(497): Any amino acid
  MOD_RES (608)..(610): Any amino acid
  MOD_RES (671)..(674): Any amino acid
MYQRSMSADPTSQPGIPWCRALHPIPTPVPTTVPNVFVSLDGWCRVGVHLGVHLTACTLVGASLLVSSRDPRPASPRPDADAASPGGHPCGSYRWGGGPQPEVHRVLAAVRVWHRPHHRQGHPRLHREPCWGISPVPAMTRGLGWGLPDWALCHPRSTTGPRVTVPAPPPRRRRSXXXCHDQGAWLGSARLGIVPPPADHRASGDGARPAAPPQEVPNKRTRELTEEELTILRDEVEKYMTEGDLRRFNALNIKRLKDIGCYRGRRHIAVGGVGSLPCALCLEALAAIVMLAQAGCCLRPCRADTPASPVASSCPRRVCLCEARXXXXDRDASPGRVCLCEARGPAPTRAPARASGRGPSPGRRWRKSRGSPGLARGVAGCIEGQRGGQEKVAEHPHSPLAIPRTSLKLALLAPAADVLGLPEPSQPTVRVSAHSFPWRCXXXXRHLMFAASPPPRHTSSQNCSGTVAPCHCLYYTAAEGVGEKGVAAVEPLTXXXXRHLMFAAGRPPRPHLEPELQWHRVPMPLPLLHSCGGGGGEGVAAVEPLTMVRAWPGRHSAMPSPPDDGHQTAGGCSQHWVAAGPGPAMHLHAAATGHPGRADRAPASLQTXXXPAMHAVGAGAHGPGPLRGVWPPRPASWVAHHLRGTRLRWGTDSASLCFRPLWATEPMQCSXXXXWGTDFASLCFRLLWATEPMQCSMTGWHTHRFGGGIHQGCQAGRVMPSGAQAPSYHPASQGAGVPGRRALDAAELPSRAWMGRWAPGRRRRDEEGSGPAWGWLMASQPAQSLRRHCTGWWCWGM

SEQ ID NO: 11265 - protein, 454 aa, Chlorella protothecoides
MGRVPLASDGALCCPGTIGAQAPCRHCPRAHLPPAVGRVGAIGPGARRTCSTTAHGAPTSPRAHGRKKKAKKYVITAVARRATAAAIAEAYFLRQPARIGHLRLDALALLLSLAGLSAHARPLVLDACGGLVLGAAAERLAGFGTVTGVYLGGAPPLREALAQFDAGRVQSGVRHASLASLLRRVAAGGEQATPIGVPGALEPAGGGAGATPICVPGVVEPAGGGAGVGDAGKAGTGTTGEPETGATGEAGFGAAGDAGTSAAGEAEASGPSRCGDATTAAPPPPQRPFNACIVAAPGLEPGAALRALLPLLAPSTPFAVYSPWMQPLAEAMHALRAEHAAVGLALQESWWREQQVRGRQGRAWSPTGGPLHLSSSSPSSCGPPVGGALRLVADTSMLPCVRMHAHGPPLPTAPHLQVLPSRTHPKMQMNHGGGFVLSGTTVAPPTRNAGATLA

SEQ ID NO: 11266 - protein, 93 aa, Chlorella protothecoides
MQATIISPFPQPTPFPHIPPPRPRRSLRRLIRRCCMAGTAFGAATGATYLLFHRPLIRLFTGDAEVAALLGGSTWILVAAMQPCNGLVFVLDG

SEQ ID NO: 11267 - protein, 256 aa, Chlorella protothecoides
MGWASLLTQAAQLVACLIAVHAALPHQHGSLRGAWAGETGPRQPLLEEEAGEDEPALRPPCADFLPASTAPLLTGPRRPLLEEEAGEDEPALWPACADFLPASTAPPLLSDAGGSGTLPPDAAADGTDAHASAPSPANHQQPPTAPASASRAFLDDGVNMLLRSITLQATFFAALVAASRLGTAALAAHSVVAQLWMLSAYAVDGFAAAGIVLGSRLAGAADDSDQGGDAALKWVAGELGGAGCCPLRMCSGLRAW

SEQ ID NO: 11268 - protein, 91 aa, Chlorella protothecoides
MEESVAKALAISGAGPGDLTSSAVDDVFFVLAKAGERALGTGRAPSAVAVLNGLHGALTSRFCAAVQEALVGAAPRLLAAAGAGEAGGAWQ

SEQ ID NO: 11269 - protein, 836 aa, Chlorella protothecoides
RLAQRAQRRGQRAGGPARVARAQHARAQRGVAQQPVQLGLGEHGGAQDHLLVGVRAGAEQVPAPPQPHLQAHHQPLAQRVDGRVGHLREALLEVVVEQVGRARQRRQRHVVAHAVGRLRARPRHALDHHRRVLQPVPRGRHQAQRVPRRHGGALQHRARRHDVRQAVRARRQPVGVGVARRHVPGDVHVPLELARLQVGAQHLAWAQPPLGHDVGRGGEDVAQHADLAGHVDHPVGGAPEAGGAQAVAVQARADLLPVGEDEEGGAVPALLQALVVAVEVGHRRVLGGQVGVVAIGFGHQHHQRLARIRPRPHQQLGQVVQVGRVRLARVAEREQLALAPAPSLGAERALARGHPVQVALQRVDLAVVPQQAHGLRQRPARRRVGRVAAVIHREARDVARVGEVAEEARHRARVQHALVHDGAAGQGAEVEVGRELRPQLALAAPLDQLAHDEELALQVVAGQAGARPQHHLRDTGHGGARHLAHRGHVHGHVAPAQQVKALRLGHGRHDATRGARRGLVVGQEDHAHPRGALGRAGDLLRQQVPGDLQHQPRAVAGDVVRGAGAAVFHAAEGREGLEWGNDRARECAHCTHNGQWPLQETVPRHRIFLTDASQTPPHPPNPRISTGNPDLGDDVMGALSLQVGDESDATCILLPQQVLVVHRHADVGLGVGGRAGPQHRSGLADGNMGRAGGGGDVLGSHCPGFRSATSLQGGVGGARPGGDWASSRAGTKPQAQTTGTRPRSRGPRRRTLRRCSRGLFPVTPKTETGGAACCQGAQGVTCAAVWVARASMSQGPVRPLEGMWCVLVCRLEGRRDVRCVLGGCGGLGLSTLNASP

SEQ ID NO: 11270 - protein, 465 aa, Chlorella protothecoides
MTHNYRVWEVECGRGSLRPVHDDRIGSNRSMSCLEVTTLAPSGIIPRRQKTARPRPAGERGYMSCKPAGKTLTQANTGIHVLANISTPKHIYAVTRRQAIPRRLSALPVHRHAESHTQGCRRTAAGGRTLGYGHRGHSIAHEWRCSWRKAQLSPLVGVRAERQGGPIPSGPGASAPHDPLEDKLASAIQTCDGEPEAGHAHEPQEQEGDGAQSEVELKTTEKTGELANLQRAADFVQAFILADFVQAFILGEHWYMGMASLFKGSQHAREHAEAHQHGSLVYMYAKGSGLCHSDHAASMASQDADALGSLRPQPIVQSGFDVNDAIALLRLDDLYIESFEVKDVKVNLACVRLPMPQPPCRHKLQPAATWLCKTAHTPITSQTLRGEHLARCIGRLAGKSGKTKFTIENATRTRICLADTKIHILGSTQNIRVARDAICALIMGSPAGKVATRLRTVCARLNDSY

SEQ ID NO: 11271 - protein, 387 aa, Chlorella protothecoides
  MOD_RES (7)..(9): Any amino acid
MFPLDLXXXSEVWRHPRGGECYLRVRQMFPLDLKVPTHDLLPVHALPQVVMRDRQTSRPRGFGFVTFEKSEVADAVVQETHVVDGRQIDAKKSVPLEQKPKARKIFVGGLAPETTEGDLGFLSGDLGCAAGNCITRGTWLLCLNPVYGIHPGKPKAFKIYFEQFGEVVEAQIMQDHMSGRSRGFGQIPAAVHSCASCALTWSPSHIPRLSFVTFAEDVSAERVFAAGAMHELRGKRVEVKPATPKGSGVATPAAPAPARIPRPIIYPSHQGPFPFVTGHPTASYAYGVYGYPPPGTPHMLPAGSAYGMQYHPNPYVMMQQVPYGAAPAPAGAYTPPVPGSPYGGPSPSLRIAKPPSVAAPAAGGAESAATATPTSQAISDLRKLNLD

SEQ ID NO: 11272 - protein, 358 aa, Chlorella protothecoides
MCKGWASAQNDHLNREIHPSPRIPGGVHLHVLPTAVDYVSLWTRVAHLRADPRRCRAAAVARGACSAREGGPDIPSSPHDALTSHIVHSYGPHVYLLDIESTNDFCRAKGHSKAGSLRDTTLETLGLAVDAINAGTLKVKTARSTKIIVAVECLKTGQKACTADKAGNIGTGNRGHNNYGDYNAGNNNIGVLNKGDRNWGFNNAGTGLFCNNSKGTRAGGNDCSLQELQVNAYKRITYPSPATRKPSPPPPRKSPPPHQESPPPQKKSPPPAKKSPPPKKKSPPPAKKSPPPDQESPPPKKKSPPPARNSPPPPFHSPLCPLLFPPHILPHIRLPHRLRGRPRLPRPRRHLPPHRPRR

SEQ ID NO: 11273 - protein, 90 aa, Chlorella protothecoides
MWGGKRRGQRGEWKGGGGEFLAGGGDFFFGGGDSWSGGGDFFAGGGDFFLGGGDFFAGGGDFFWGGGDSWWGGGDFLGGGGEGFLVAGDG

SEQ ID NO: 11274 - protein, 906 aa, Chlorella protothecoides
  MOD_RES (8)..(11): Any amino acid
  MOD_RES (197)..(200): Any amino acid
  MOD_RES (274)..(277): Any amino acid
  MOD_RES (887)..(890): Any amino acid
MLKLASLXXXXQGLRFARPPLHRVISESHDPSTSPQTNLHPPFTGMLKLASLVQYVPLPVIGGYLAFVGYFCLAAGVSLASGVHIDEDPMTWAGLASADALLHLVPALLLLLLITAVQRRFSHPLALPLLLAAAPVVFYVVLAAGGWTLAEAQQDGWVTKPTVSRTIAWGSDGVCHLWGGISSHITTGKGMACHEIXXXXLVPALLLLLLITAAWGLIAAPGSDAKSAQAVAKSGCALRGCAPPCTSSPRTLWEPCCPRNAAPPPPKSTPVLWXXXXMRSQRRLLQGQDVPSVVAPRPVPAAHERCGSPAVHGAPHRRPRRARPCCGATAISTRSCAPPFPQPGEKPWKFWEAWSLFGFDAFPPTTIHWRFVPKQAGKILALYFVVAFGSSMDVAAIQADVATPLDYNKELVTVGETEAGSSLSVCWGWWRGGWHLVHVLALPTQGAALQRISHLDIRWAERGGGILCMSLPCQPKAQDEQPGDGYGGRRLHRLLHLLPDPVQPENGRGLARHGHHCRRWVLWMWGAVERCEMGAKARRGRSWRIVGPADHAHTCTPTSHPSTHTVSEARTSSRRVSGRSGGGGAGEHCTLFFACLPGPHVESVSAPSISNDTPPCQVHAPEVSSSHLPTHLSGPFLMLDIFELTCPYRISLLPSSMHRTGCSSPTSVCRTWSMRSCWPRLGPSRCGGWSWASPLASRLPPSTSPTRASMLGRDGRKGRFAMAGLPEGRSSPVASLGPHQFCGPQPTCLRCRRTLLPLADRPATNHLQSIPRPLSSFIRPSSRHQPPTHMQVCAGDAAHLQRGAVAVGRGAHLGPSPGAGALCAACSRLQPAGLPLLRLLRPGVHQGPGRGTGPGGQPGPAGKAGEPWPAAHAAREREAAGRPDSGXXXXGPAGKAGEPGKAAHTA

SEQ ID NO: 11275 - protein, 265 aa, Chlorella protothecoides
  MOD_RES (256)..(259): Any amino acid
MSYSDYVTTPSGLQYLDVKVGSGPTPKPGQRVTIDWAGVTIGYYGRPFEARNKPPSPPCSHPGLLWAHHASAQTKGGAFTGDDKEFYHFNLGSGSVIPAVEEGVAGMAVGGIRRLIVPEELGYPNGDMTALGPSPTTFSGAWGMVSVRLREHAPPEQGRPALGECSQGIGAPTPARPLSLNHPSHAPSPAQVSGPWTLCCATRASSTRPCSSTWSCWTCADAPSRPWRLTRSLLTLWSMNTRTGGLKGALPTKIAXXXXELLDVR

SEQ ID NO: 11276 - protein, 704 aa, Chlorella protothecoides
  MOD_RES (305)..(308): Any amino acid
  MOD_RES (519)..(522): Any amino acid
  MOD_RES (622)..(625): Any amino acid
  MOD_RES (686)..(689): Any amino acid
MPAWAVPRPGPPLPEVSHLIPACGAKTPPLPHPPPPQQGLSFCGDREDPVSMGLTVFHQLLRRHGVSPSEVGHLQVGTESGVDGSKSLKTYLMPILEATGNTDVEGVDCVQACYGGTAALLAAAAWVESRAWDGRLAVVVCSDIALYAPGPARPTSGAGAVALLVGPDAPLALERRLQASHMAHAYDFYKPTTGYPAVDGPLSVYCYLHTLDVCWARYAERFERALHAPCTLDAVDHVLFHAPYNKLVQKAYARLWYLDGCRSGALAGQLEGASALLGATRGGAAPDGVSNGGADPSPAHSHAPXXXXGAAGRHARRRRGRRREQRPGRPVPRPLPHTHRPPLPAHRHAAGAGEVSAGRDARQLRRQGAAGDMRAAPVRQHVHRQRLVRRGPAAGDHGRRAGGPARPALQLRLGHLGHAPVAARPRRGPRVAVLPGPPAGRVGPGGAPGAPPRRAARRLLGRRGAGGGAARGQGLRHALAPCGGPGAGHLLPQGGGRAPPPRVRAPRRIAVAMGGAGRXXXXSRRWTSATAVCTGGATNSRRDGRGGVAGRVGAHVGRGEARRESAQGNRLVPERSASPHPPMPGAGCLPSAARSGERAGRPTPAAAAARDTRQRQPPPGNXXXXGVCAGEQARAGAQRLAPPPPHAWSRPPAIRGEERGASRSTDPGGGGRSRRKAAAAAAGKQXXXXRLPPPTAPFLPLYRA

SEQ ID NO: 11277 - protein, 219 aa, Chlorella protothecoides
MHATSVMHARPFGAVLFRVCAGPPLRHVPAFKATHRVHGPRNTKRRLSWTHHAGPPRAIPSQGLGVADVVALDELIDHLTAARASGSFPEAVAKNLLSFDRGFWLRLAARRDTASSEAEAESLTQLASDVMLLVDEMVKESESQVQRSSRLLQRVLEAGADGDSGQWQLPLSTDKRRAMRGVMAAHSTQLDEAFVTSAMAWIRKSESDSIEGKGLRQRQ

SEQ ID NO: 11278 - protein, 353 aa, Chlorella protothecoides
MAGPGPSSMSQARWELENAVQTVQDSDVDAVYHWNPAEQREMQQARPWLQDPTYFKRCLAGRGDSGQGCRLQCMQDLTCADPHARTHHRVRISALALLKMAMHARSGGDLEVMGVMQGKVLGDTFVVMDAFPLPVEGTETRVNAQAEAYEYMVEFLETNKVVVGGGWRDKRVGVYRWLAGGWSLGKMGCDCLGDKAQDHPGYGCWLSGIDVGTQLTNQKYQEPFLAVVVDPHRTEAAGKVELGAFRTYPEVGGRLVAAGDRIAALGAGRSILAAPGRAVLCAPRTSLPRAWTASSVPILIPLWHLPAVPASQQGYKAPDAGPSEYQTIPMEKIEDFGVHANQVRADVEAGVEE

SEQ ID NO: 11279 - protein, 221 aa, Chlorella protothecoides
MEAGLHFCEEQFLDVAIESGLCSPRRSDVTLAEALLAHRSLSDAQAEPGGPARFEAAAALLGRYVRQRKLRAAEARVPTPFNHPPTRPSVREGEALFESGDEPDCFFIIKSGTIIVEVSFAENEHQGKPGVEGAPTLTRAQNRTFHHDPGAVVGDFDFFAGRRRTFRALALTPAAVWVISRAVLQAVADESPSTVVLLQSIILRAASLTAVHAFEVLEKLT

SEQ ID NO: 11280 - protein, 452 aa, Chlorella protothecoides
MSTHAPGHTAPPIATAIRRAARTHGGGARARRQVLHTGPERGVSLGPAQRLRPRHGGQEVGGRRGGAARQAHRQVRPGLQAGQGEPRPWGHGAAAQRQERGRDARAVAVEQDAPALQRGARGLQQLGHAGPDAGGVHVAALALHACPRPHLGVVAGVRRAQQILLQPRRHGGGRAGVGDGCVGVGGGRVGPAVAHAVGRAAAALGGGRVGPAVAHAVGRGAAARGAQQRRGPLQLPRQRARPAAVQVPQARIRLLHQLVVGRVEEHVVHRVQRAGRVQRALEALRVPRPAHVQGVQVAVDGQRAVHGRVPRRGLVEVVGVRHVAGLQAALQRQRRVGADQQRHRARAGGGARGAGRVERDVGADHHRQAAVPGAGLDPGRGGQQRRGAAVAGLHAVHALHVRVPRRLQDGHQVGLQRLAAVHAGLGAHLQVPHLGGRHAVPAQQLVEHRQAH

SEQ ID NO: 11281 - protein, 124 aa, Chlorella protothecoides
MALLLRKVLQMFAGCSLLDIQPGGQGRPGVMDAFLEADEEQWTSMLQDMAGKQGSRHHPQHSISSHHSGAELLQGIQVMMEHVALQGAAGSQAQRVQIEYLNELKTRALNAFSNAQGTDDAGAT

SEQ ID NO: 11282 - protein, 434 aa, Chlorella protothecoides
  MOD_RES (62)..(65): Any amino acid
  MOD_RES (98)..(101): Any amino acid
  MOD_RES (147)..(165): Any amino acid
  MOD_RES (215)..(218): Any amino acid
  MOD_RES (300)..(303): Any amino acid
  MOD_RES (408)..(411): Any amino acid
MRLLGTARGDAAPLVHACQSALPLSLLITQEDLPVHPPTPPPADVQLLITLPADRERAGEIXXXXPISRSAPCVCEAPPEAMPHPCACVSKCSALVLXXXXVPIEAMQGRTVVVVTNLKPAKMRDVMSYGMLLTTLPADRERAGEIXXXXXXXXXXXXXXXXXXXHLGSEGMVGGHGIRASGVSVAWPSSAAPPGNAAHHDHCVRPQPYQPQVLXXXXAAPPGNAATMTTASALNPTNHRCSVHPTMRMTMWTPSSCLRGCRWANASPLRGKYCIGVAYGMANYQHSSKFQLRYTREPEXXXXSCDSIMLTDAKGKYRIGVVYGMTNYQHSSNFQLRYTREPEAQLNPRKKQFEKIAPSLIVLPGEAPGIVTSRGCHHDARQWSGRSVTKCWQIGRAVQPGQQAGKTXXXXEMLAEWEGLFSQGSRLARQTWKD

SEQ ID NO: 11283 - protein, 484 aa, Chlorella protothecoides
  MOD_RES (34)..(37): Any amino acid
  MOD_RES (339)..(342): Any amino acid
MSPAVLWARVGLGPDSVALQSLSLQMWTSGSNSXXXXKCRQQCSGREVGLVLTAWHCHRCPCGCGLLRSAHLPPKKPVSGKSGMATLVASMALRVQIPRSQIFRHGVLHPYARRSQFCVRSALPLSRQAFTSTLHPSDIRPNVSGELDRPPANKPAHGGIELIMGPMFAGKSSELLRRVERLEAAGLTVALVKSSKDSRYSDSHVVTHDGVKKCLPVRVVDVELHLDLQFVGPMASPWASTRAISLFSVDLLQACYAVPSLEVFRSMAGDRWAKYQVVAVDEAQFFPDLFHICSSTADGEGKLWVLAGLDGDFMRQRFGQVGFGMEGADSSLGEAWGSXXXXGRFWDGGSGYILGGEDLEDASDQNEHVLVSKRHCLRLFLSNVSMQDMPQSVHPPHPQNVRQMLDLVPHADSVTKLTARCQYCAQSGVTTAAPFTVRFSVADQRQEVVGGAERYAAVCRQHFGRMLGHDAAAPEGDADAQAAT

SEQ ID NO: 11284 - protein, 278 aa, Chlorella protothecoides
  MOD_RES (246)..(249): Any amino acid
MLTRFRVGRLGMRGVIIPPHYPMPRTRHGLQEQNAAQPPLLRHLMAVPGGHVEEGAHGLHPVVARLLEEGLGYLVVGLHALHILLAVDGLHEPVALVLATRLGGGGGGTQAGVGHHVVRRIVGGVVLGVRGAQLFRRRRLRAWGGCARNPCCEGGNLDDMIPCGMHAKFSGPSLPNRPARSSPCLSREATSPGDGSQHTVCVQRPGCRWNLVRTRACFKAVDLRRGTPQGAVRRCLKRMYSQNNIXXXXKGLGVDGIWYAHGRASKHSIYGAEPPRVL

SEQ ID NO: 11285 - protein, 405 aa, Chlorella protothecoides
  MOD_RES (113)..(116): Any amino acid
  MOD_RES (252)..(255): Any amino acid
MLRHMRSLRSMKRDRGWIHTLLEEAENEVRAAARLACWGFRAESGTLGVRNNGSPFWRSSRPTSSPGTAIQGTCKCVPSQGSLTGHPRTCPRISPPSHPPFPVQRMHLLTFLXXXXALLFKAHACVCHPREFDRPSRNMSPNLPPNPPPSCAAHAPPDLPAVQGAWALDEGHRAPRPGCVADGPGAGLELHQLHRQRPAYALSVGILPARRVGDAMSWKTPYQLVMWGCFVSSLHCYLQTAPLGLYEQVSGXXXXCCRRVPQLLPPCLHHLTPHLPQLCRVSALHRLSDGKRVVGGCTRWCAFSLMQEENLPTRDVGDASSRHFAATYKLRPWACTNRYLEEEAVKTYTRCIKVRYGGWYRLPVCAHATWPRGGCLDSSQGSAPSAPLVHTGKPHPFVPFPLPGP

SEQ ID NO: 11286 - protein, 93 aa, Chlorella protothecoides
MPHGRAGDAWTRRRAVLPLRPLFMPGNPIRSSPFPCQDLDAGLIPQWEKKALPEIAIKYWQLSPDATMRDLLLAVRADEVGWMLNEGRTRFLQ

SEQ ID NO: 11287 - protein, 379 aa, Chlorella protothecoides
  MOD_RES (19)..(22): Any amino acid
MFGPPRFRLPDRIRQPILXXXXLQEGNVSQAMLRPVRYVWASQVQSPRPHQAAHLAGPCFAPPPPFLVMRASCGCHTPPLTGLPQPCEPRLLPHEAVRGESLPSRDGARALKDSARIAWLWPHYPAYSPPTQDVRKNEMTCGRMRCVLLSCMEFERKLFIWPSPSPLDSAHNASGGEGPTVGLRLVPLPLHGLASITAEPIWPGMDPLELPIRRFATPIAEAVRDNAVVVVIGETGSGKTTQISQILLDAGLGAGGMVGVTQPRRVEVGYAVRFEECCSRRTSIKYLTGGFEEGRGRDGRARSPHAGLGTLPGRQWQRDTTCLGGPVCAQPLSARGCSSGTCGYRHQPGHALPDRDRWHAAPRAPARPFPLAVRCDRAG

SEQ ID NO: 11288 - protein, 134 aa, Chlorella protothecoides
MMMRRTAQWPAAPSPCPGPVPLAPESPPSRPPAQARVFRPAPPGTRRCIVATNIAETSVTVEGVVYVIDPGMSKQKDFNPATGLDRLEVGPISRWEGGVGAGVSRLGAGSDGREVVVFKRMHAKGSTHDEGGKV

SEQ ID NO: 11289 - protein, 173 aa, Chlorella protothecoides
MTLLQTHALKTGMGAPSPGPVCPLCLGSLQEEPHADGEASLPSASLQPAVQAVVDKYEVPVGQGFSLDVSLPAAAAVRARALAVRHPGACAGACVDLKEALRLRFTPPLEAVLGTSCAPGAGLRLTLALSAPGVAGEGAWLAQGIQQQVDQSRRRRHTGKRRHGKQDIVPAGG

SEQ ID NO: 11290 - protein, 61 aa, Chlorella protothecoides
MRVRLVPSSSCFLLGLRTQSGTYVKEFVHGDLGRTVPCLGDLLGMPVTILQLDVMDIHMDF

SEQ ID NO: 11291 - protein, 66 aa, Chlorella protothecoides
MHLQSQAAGTLGESLVPPRHPQAEIDKAVCQLNAAVRALPADAAGDLLVLPIYAALPPDMQARVGA

SEQ ID NO: 11292 - protein, 938 aa, Chlorella protothecoides
  MOD_RES (286)..(289): Any amino acid
  MOD_RES (413)..(416): Any amino acid
  MOD_RES (520)..(523): Any amino acid
  MOD_RES (550)..(553): Any amino acid
  MOD_RES (908)..(911): Any amino acid
MTRCLTSSLYTRRQRLSSTAMQHNSTPMATEVPIPLCELQACHETSAEGVQALFKELAAATMEAATLKRLDGNDAPSLEDLQTELGWLFLDACCLEDAVSRDWQAIGRHELSWLQGEGPMPLHLLPWRLRASVDELGQHAPCWHGSIGRAPPSSPAMGSADPLSLASSQLCKHAAAAALWTRRLQERTPLQYLTHTAHWRDVVLAVGPSVLIPRPETELLIDFAESALRRDARLAARPWVDLGTGSGALACGLARLKGGPGSVHAVDLSPTAAATARTNARRLGLXXXXDLSPTAAATARTNVRRLGLQHSVHVVQGSWAQPVLPDLAGACGGVVSNPPYIPSHCLPELQAEVARCVLVGRGGGGGVTEWGVVLAMPDRGTLYWERTLCLRHAPCANPWPQARALAGPGRRSXXXXRYSLLGAYSSSKPCPLCTPHPPGHRHEPWLALDGGVGAALDCFEPIVQGASALLAPGGFLALESGGGEQAASVASLLERTGAFSDQGASSQPLKENSEGLGHSXXXXGFLALESGGAEQAASVASLLERTGAFXXXXPGLAPPISLPLARPARQSEGTYSSDSASEADSASLRGQGLTITFWSHGSNADSGNPPSQPDVALCGCIPCHVSDHHPAPARATHTCCRHPRCTLPASPWRRPGAGGQRPSGPGARRPGSRPPPRRPRSPPRTRCSPASGGAESRNCMPEGGALDTSLTRRDEGRGPCVPPTEKWPPNSHLHRTCFFLAAGLPLAKGEGPALLLPNPDPLWKGLGRMRATWRGERVGGRHRGAGPSSRHETHTFPFSMPSRLNTRDTIPNHTHSHLGLDHGGGRLLCLRHGQLPGGCGPGLALGPQVGGRPARAPRGRGLLPRRGGVDLLVAAGRAKLPVLHDHHAGAGGPGRGERAALAPLGGRXXXXRLAPRLEAAPPARRTGGACFRGAGELT

SEQ ID NO: 11293 - protein, 95 aa, Chlorella protothecoides
MGAASSVPSAAEPAWPSDSTGGPVYVSDRPGAHDFDLLRRIVLRDGSTLRTLSPGRPTPDSLFADVCRDGKSLLKVGGVGVSFEGWGIAQAGLTL

SEQ ID NO: 11294 - protein, 512 aa, Chlorella protothecoides
  MOD_RES (396)..(421): Any amino acid
MEMFVGVGPARVRDLFAQARAQAPSIIFIDEIDAIGRARGRGGFAGGNDERENTLNQLLVEMDGFSTTANVVVLAGTNRPDILDRALMRPGRFDRQISLDRPDIAGREQIFRVHLARITLDKEVGYYSERLAALTPGFAGADIANVVNEAALVAARRDLRAVGMPEFEAAVDRVIGGLEKKNKVISGEERRTVAYHEAGHAVVGWFLRHAEPLLKVSIVPRGSAALGFAQYLPNENLLATGEQMADMMAMALGGRAAEQVMLGRISTGAQNDLERVTKMAYAQVAVYGMNDAVGLVSFPQEEGAFNKPYSDDTARLIDGEVRALVAGAYRRTLALLEEKRGAVEAMAQALLEREVLGTEELEALLGERPYRSAELRNIDKFRDGFAREAPAGEAPXXXXXXXXXXXXXXXXXXXXXXXXXXGSRWSRRRRPRRRPATGPGEGCVPRWLLKGPAAGEVDGMLVTSSASDTHSPRPAGVHHTPHPPLCIISLILECMLLPQDCLVERTAKMLCA

SEQ ID NO: 11295 - protein, 64 aa, Chlorella protothecoides
MPAIVIRQRKAWRRKDGTFIYFEDNAGVIVNTKGEMKGSAITGPVAKECADLWPRVAAAANTIV

SEQ ID NO: 11296 - protein, 281 aa, Chlorella protothecoides
  MOD_RES (72)..(75): Any amino acid
  MOD_RES (161)..(163): Any amino acid
MARVRQAEVVRHTCMRSRWPSLVAWGRPPPTGRRGRTSRRSATGRHTGPYVPEPARQEPVASCRPSRARATXXXXSRGGAAYVHVFGMAIAGGVGAAAAYRSQRQNLFEICNWQAHGPCMPRHARQEPVAGCRPSRARATDSSFRPISDDSANLHPHLPSXXXTHSGLSVMSAPISTHICPPQYPRQPGPPSRTLTLLAEVGLSLLAGGHDHVAGRGSGQPVQACSPAVHGNDVQVLASAVVRAVHGRSHGETQGPAPSVVQARGETARAPAPGQSRKSPD

SEQ ID NO: 11297 - protein, 214 aa, Chlorella protothecoides
MQAVYRGHKTGPFRILVGIAAQMPVAIGVFSTLRCLAAAQVPSYVQGGALWFPDLSAPDPLYLLPLAVSASFAAALRFGMDGMQQPDGSGQTETIKTMMRWMPWVMGPATAFLSSGMQLSFLVSNVIGLAQSIVLRSAPARAAMGLDPLPPRGGAAPGAAPVAARDATWTLDPRGSVQQVVVGGPGQSARAARPAGVAFAPPRRKAGRKGGSKA

SEQ ID NO: 11298 - protein, 154 aa, Chlorella protothecoides
MSGETGAGRALQPQPVLMPSPFFVPGSLPSHAAGGPGARLARHMSNVEASLAGADAASALTLGTSMPISIPMMPRPAKPAARGEGPRFVPPHLLADGEGLGPETDVAELLGSSRLSPTTSFRRDKLTTRNAIMRATGFLEVPGGGAWRGRGAGG

SEQ ID NO: 11299 - protein, 163 aa, Chlorella protothecoides
MRRSTKGSRRLVEARYIPHRGHHQALFGQSEGAGARAVSPRACTTDGAGPATSLPTGDSTNLDVMATKRKGGVGGNKFRLTLGLPVAATMNCADNSGGKNLYVISVHGWGARLNRLPAAAPGDMIMATCKKGKPDLRKKGESARGRPWLPWVLWRADVGGDWR

SEQ ID NO: 11300 - protein, 787 aa, Chlorella protothecoides
  MOD_RES (139)..(142): Any amino acid
  MOD_RES (291)..(294): Any amino acid
  MOD_RES (744)..(747): Any amino acid
MPCWTSRGCPPRSSGERGGGVLPCPGSGWEPAGGALGPRGILYASPGKKRVPAGLLSEQSCLLTPFHVVLPPPRPICSAIDKLDKEPWDFVRREMVVDKGLEEGVADAIRPFVELRGQPQALLAKLLDKGTWIQGGMCXXXXSGWEPAGGCQGGGAGREPHQAAPTILQHPNQPPGHAFAGHAGARAALEELRTLFGYLEGMGALANIVFDLSLARGLDYYTGVIYEAVLKGASVGSVAAGGRWVHVCVCERGVIRSCKRVDVVAREGSSATCGTACCALVPPVGEATNQXXXXSVAAGGRWVHTCVCVRGVNLVLQASGCAGEGGQLRNLRCAPAGRLPWRRLGDQTTLHPRLGPRSLLQPPPPHHRRFDTLVGMFSGKDVPAVGVSIGIERIYNIMEEQARAQAKEVSRRPTGQGVRVHTLCAAELGGPEAESVVQTLHTVALVPPVGGGYKPVGIRRMHPCPTVAAPSHQGDRDTSACPSPTLKPSSDCAGGVQHTRDRDGGAGGLHWQWLPGTENEHRLTVVGPGHQGVPGAQDCGESGDAICHWFREGAMHLHACNVKFTSLLSEWARSDQPADCVGAIRPIIPIPAPIKAEFGFKANPKMSDSLAIRAPHPDALPCPNASPSGSVFPAGSFQDQKPGGPDGGDGVLARIGGGGAEELGGIAKATGHLHVQLRQQGDRGRGEQAEGECLINATRLPFRFVSRTTPTTRQGIASVRRRHRDADEMANVDELGSTPAQQVXXXXTTRQGIASVRWMHRDANEMANVDEIGSTPAQQVALDQWPC

SEQ ID NO: 11301 - protein, 268 aa, Chlorella protothecoides
  MOD_RES (58)..(61): Any amino acid
MFDRETLTGKYGEDSKLIYDLADQGGELLSLRCRPALMNMLDAACRLMLSTQPPGQTXXXXCPSGQTRAELASCSSRGRHTLELHGAHPPPSQHHHVQYPRYDLTVPFARYVALNGITNIKRYHIAKVGRRCLLGSEWAMCKSAPSGAGAGGSLGTCVTAAHLHIAQVYRRDNPAMNRGRFREFNQCDFDIAGVYPSMVPDAEVLKVSQALCDGGVGFGRDRPGASCRAQPHWTTRSSLNALAGPTPPLTVVAAFPSPSTPGADRDPG

SEQ ID NO: 11302 - protein, 85 aa, Chlorella protothecoides
MAPKARVAKPKIPKGTRDFKPDQMTIKQEAFEKITAVFKRHGAVSIDTPVFELRCSACSGVARERHAGVQAFSFAGEVKIMQRGQ

SEQ ID NO: 11303 - protein, 283 aa, Chlorella protothecoides
  MOD_RES (59)..(62): Any amino acid
  MOD_RES (134)..(137): Any amino acid
MDHPLESFCNDKWCTGTTNACIFHSNTFVSVSQTLPRCFHRLRIGAAWPPGTRARTSLXXXXFPSLRPCPGVVTDSEQLQLGRRAPEHGPPCGLHLVPGGAKSHTSASNPQGTPMPPDEHTRKIIGAMGGTLLXXXXFLLAYILGLFLTFLYLFWKRALITWICILIQLGHVDAVGVGETVDLLLEDISEGMDMRWLWVKFLVRITFLPTLLRAASIGYKTSPCRVGSGGPPGQGIPGGAVLQRTEGQKGSPGAAEPGKAGAGWHTRVPGLPCGAEHFTCGIG

SEQ ID NO: 11304 - protein, 545 aa, Chlorella protothecoides
  MOD_RES (182)..(185): Any amino acid
  MOD_RES (452)..(455): Any amino acid
  MOD_RES (486)..(489): Any amino acid
  MOD_RES (530)..(533): Any amino acid
MKPERRGGPLWTLFAALSSTRHARLHFDCRGYSTAFRVRGDAAALAEIAGSLPGSLACARNLGALDVYPATSGKVSAARHLAARWGADLSRALFLCDDDNDLELAAAVGRAFLPSITSESMGSAARTGGDAFYVARMPVPWSTEEVLEAVEAELAQADDHGSSSMGAEPGPVEAGSGPVEAXXXXRQMIMGHRPWEPSRCRWRQGRGWWRQGRGRWRQDRGRRARRPSHKARVSRHMVAGRSPSCVVQRQTGGPLQSRCMSLRLAVGVGPPRDAAPLFLKTIPLCYSHSSYDTVTLEHGICSVKICNVPSKQHAPPHASGSCRCDGICRDGRLHVVIVLPHHSLVKGQAHLRREPGGRDDQGGGPGKGGWLSPRGSSAPKPATQENGVAPHPWPDLWIARQPPAIPSSKPSSPSARQDPLSAVLQVILLAHQLCRLHSLRLLGCNQGEGPGXXXXHPWPDMLIARQPPAIASSKPTSPSARQDPLXXXXAQNGLANARDPGAAVPAPVLALIQQAVDLLAHTLPIMPHPXXXXEGWCGVSGRMHA

SEQ ID NO: 11305 - protein, 165 aa, Chlorella protothecoides
MPDQTTINVIGAVGGVVLSACLLPQLYRLYRTRSARDLAYPYLFAYCIGLFLTFLYLFWEGAIVAWICELVELGGALLVLSAKYYLDFYGPYSKRAKEREEGETGDATSDGGNPRSLPGPARLSLTSCNGDLERGASPRAPTDVDGLGLGGVTHKRDIGLTKHET

SEQ ID NO: 11306 - protein, 156 aa, Chlorella protothecoides
MLASTSTSRGGTMRSFQPFVASSPAVPRPRAFGHCLPQPRPRSLVSRALDFEQLTLEDLTQEDPPLAPPPPPAPRSGRKMSRRFAAETAKVPGKHVALKPSEALELVKATASTKFRETVELHARLNIDPKYTNQQLRATVSLPKGTGEGLGAFWGG

SEQ ID NO: 11307 - protein, 234 aa, Chlorella protothecoides
MLPHGVQGRAADLAVLGAWADSAWLLQPASSIGSQCGCSPRTSATSHAATTPTHPSPHRLPPPLPRRPGKELRVAVICQGDNEKVAREAGADHVGSADLIAEIAGGMMDFDKLVATPDMMPRLAKLGRQLGPRGLMPNPKAGTVVTDVATAVREFKGGKVEYRADKAGNVHVGIGKADFDPAALLENLKAVQESIDANRPPGAKGIYWKTLTLCSSMGPAVRVNHAALREIKLQ

SEQ ID NO: 11308 - protein, 368 aa, Chlorella protothecoides
MLLSGSPLGFPGNSHHVPKPWPCVINTWRIILSEGALDYMSNAMPAPVHAHIDAHPGAWQAQGWPLLPGPGCARMAQRRAQDGCGMALVCLQSSVGGRGSLDVQGREPWWVRNRAEQRHTARGDAVDKAWCALNRVVRLTPDEKKCAPSFGAWVSVVKHHVTGHSRSGGIPGSPESSCENQSPAGIEHVACVATLTSLNRPSGLEVRSSGYGLGCQPRVAPRIEVGGSVLSHGSIPCTILADNSTPPTLLGASLPGGHLGSVGASPDQSQCVCVTRPRSRAPSLYPPPQRYIVRIIFLVPVYAMASWPSLIAPGSAVYLAAARDWCAEGCQGGTLLPHLQHVQGVYGARGKVVPGERIPYSPTPPFFP

SEQ ID NO: 11309 - protein, 605 aa, Chlorella protothecoides
  MOD_RES (566)..(569): Any amino acid
MHHHPCFPPFHSQEGEAGGPEEAGHLRRPGRRHLGHPRPRRRGLAGLAPAGHLPGHHCRDHHAAPPPRRGGHDGPGRRPAHGHPHLPGRLQRLCQRDPLAHRHRLLAVGRLHPLRPGRAHRLLHRVGVRQDHAGPDLLTDPGRGPAGAGHPLRGGSRRGSLPAPGQGAVPGMRMVHQHGIPTISLPTPHPFTPNLQAPCSSRPWRPTLSPSTWRRRRWDTPSPGVSWGEGLRCAGMEGGAGRRALENHHMSCHEAPALDSSQSRAGPAGPAGAAWEHWYSMHLESHLPPHPCPPMHVLAGTWALSALAPGLVCLLLTPALMYVLYPPQVKDTPDAPAKVCREGSWGGGHTRLRLDSQTGQAHGVGATPDNGLILKQVPLNEFLGPCGRSAEVRSCFQSPPATRLLTQALDLPWNPAHTLHVPFSTLQPPFPHTHTHAQAKEELKRLGPMSRDEKITAFALGLTVCLWIGGQSLGINAVAAALAGLSILLVTSESCFVGGETAAGSEDAGIHSWFPHHPCACWLYQQTQAGRPPPDTPHTCLYSRVLLPCTRPSPSPSRCGDLGAVXXXXINKRRRGGRPLTLRTPARTQECPSHAPPIPTSLKMW

SEQ ID NO: 11310 - protein, 303 aa, Chlorella protothecoides
MPPLLPSKQLNPYVTELALYDIAGTPGVAADISHINSKGRVKGYAGEDQLGEALKGADVIVIPAGVPRKPGMTRDDLFKINAGIVRALVEAAARHAPGAILNIISNPVNSTVPIAAEVLKAAGVYDKRKVLGVTTLDVVRAKTFYAEKAGVDVGKVDVPVVGGHAGITILPLFSQTVPTPNVDLSPADIDALTKRTQEGGTEVVQAKAGKGSATLSMAYAGALMADACLRGLNGDSDVVECAYVESTVTDLPFFASKVRLGRAGVEEVYGLGELNDYERAGLKSLVPELQASIDKGVKFVQEA

SEQ ID NO: 11311 - protein, 206 aa, Chlorella protothecoides
MVQAGQHADELQELIEFLSDKRAPVDSRIPVLPPACTKSLTGLSQVRTHAAELVEGLTGSPEGMSTLSNRADTLLPPLLRLIADTTEASRPALTALVNLAQEPGVQSALLALHAPARAMDYLRENACAHPGLLISLLANLTASEDGSEALLQLGQSSVEGLHTATLLKLFLQPVSGCYGDGVVEREAGMTLLCDDLVWCGCQRICP

SEQ ID NO: 11312 - protein, 224 aa, Chlorella protothecoides
MLAQVVGSEDTYEHVATILPNVTRLAAGRQLLLQPGRGLLTALSSQLRSKSELRRRGSARAIKNCFFAAEEDGTLEDILAEEAALTTMLDVISGGEAEGEADGEAREALSEALLCLVRVPTARKVLWRLDAPKLIGKGYELEEHRGVCAAMEAIAEFFLEDGFGEEGGKEGPVEDGPAGFVMPEPGFLPPGVAQGLSPSARRHSSGETSLPSNPHRLAHIEEIE

SEQ ID NO: 11313 - protein, 211 aa, Chlorella protothecoides
MSDVSTVKHHLLQHLPVYQVSPADFSGDAELVNQVYLDNSSLELYHCRLDKRPNAMALRLRWQGGAGPTLVHVDRKTHKESWQGEESEAASIVLPEERVVGFLEGEYSVEEAAAEWAARQAPPPGEAAVEAFRAVFTDVQRVVDAKQLKPTMRTQYMRTRFQASSWGGAGPNRAGWMARVPEGGSVTMPEGAPRCPRARHVSSQASAPGAL

SEQ ID NO: 11314 - protein, 138 aa, Chlorella protothecoides
MKVWYMDFLRHAVTERVLRHRFGKYLLEKSRAEWAGEYVDYKALKDLIKISAADYESNTLPSFSPRTTSLTVQRVQNRRDSAEEDFFKCLDSEVEKVGRFTAQLVAKLRERLEHVRLAAADVKPEDAEALLEVRGLAW

SEQ ID NO: 11315 - protein, 276 aa, Chlorella protothecoides
MLYEQGYRPCCSMPPPSPMPLQGTGAVDLAHGGPAGGAPDRGLPRARLRGPPRPSSLGDLLQHDPPAHALLLTGPALEEEQGCSPGCFREGTVGISPGIAFMCKSLTFTERLPPLRSDPHTAQGSTLLTSTPLPTQAAPEVSPRTARQRAATSLPSAKDYGLWPYLTYLFYPPLYLAGPIITYQDFGWQRRRTATSVPPLQVGTGKRRAPSNICGTVCAAFCRRPAVSGAADTPALLQLAGQASRRRQAGASWTDARRLPGGADGVVGPHLHVAEV

SEQ ID NO: 11316 - protein, 1317 aa, Chlorella protothecoides
MQHRGLLRPRTARSASTLLPLKLSRAPAPGVPNQHHTPFNPSRQEGRRRLRGERAHQFRRLRAPPAGGPPARGPAPPAPPPWPGGGAGRDRVRPALRRAGGGQEDGGAGLHAPQPRHPHPRHRSLPAGGVLEGLAGRRRPPPQDRCVDRGRGLPGGVCGRLVYFLPAIPGYYSPEEVPAHPALTLVANCEQVLSTRYSRRLITMEKTAGYDTSAAEAYHTASGPPRACLAYARRRSLPTPVSFCPPSSMAVDKLHEHVRLAQEDNITAGPGHTCSTFTFPCCSRPRLWNPVSEARPRGPLPLTRQGRVPESAARQLYSRISGWEALEQGACRVAKVQALGHVEGYAAATPSPFAEHPLRHHALPDRAAFAIRHGRRNSERDGPDLIPSLDGCYRQPAGHSGEEQRLSFPVHMTMSKGYSKLICTPVGRKWSEEQKKAEPTFFSKLANIQTPQWLWIGCSDSRVPPLGRGHVWSHPRLPSGCTPMPPTAALRSGPTTPHQANQLMGLGPGEVFVQRNVGNLVTHKDMNAMSCLEYAVTALKVKHIIVCGHHNCGAVKGALTMPNRQQGTGSRTVCLGPRGTDQITPGIVGPQPEGMSRSSLPPWAAPGLIHATRQLCFSTTTMSVAPSTLTDVLLRLTCPGLVNLWIQDIRDTRDRHALILKQFKGDEQVPGGAGGHKGVNKLAELNVLRQVRGNAWCSFCGPGLDEEAQWLADFAANPWTLQAAQPCFFQPTLRSGALQPAQVFNICSSPIVQAAWEDGQHLSVHGVIYALNDGLLQVKGAPGSMGKRANVRGGAGPSGKWRHVCTRMRTASKSWRPSTIPTSARVAPGGVFTHQARRSAEPELNPAGTPELQAGTGSVRRVGGGGAGRCAMPRSLSGARARMVSMASSDRTHTPCIDELSDHVLAGLCGRTLRGRQGASPGNDAPRQSMDDITSCQMRPPLAAVISHTSCIVRLASRHNVSHSWHSFEEGGRVYTSSMSTREDAVTDLECHTPGQPSPSSGHPPFSPQASGWSQGRCRLSSLDTSLSHPGPTCIVEGVAARPVEGGYSTPLAEQSASGMMACTFLFMAQMEPRVGEETGWVWDVRDDSAEPLPSSEEPSTWGSQLQSQPMSSPKPRRTHVLLPDISTVAASRVEDRRFRHGVERCPMGLTLTHGRTSPGQYLRACPTSLPPTVSESEGALREPYDPAPKPTLRRTSLEELPEIWLARQLSRARGSWVPDTALARVVHRGARPTPPQKNNLSVAARRRAPCHGRTGRAGARPRTPGGLAGLPRQPVELPALLYTLLRSPVCIRAGRMEIWGQPVMGSSGPAWLLYNE

SEQ ID NO: 11317 - protein, 133 aa, Chlorella protothecoides
MHALSAFALHTAPGARRTGYRKRYPPCLTSMQTGELKPFTLRIYTKPSCPLCSSLEKKLLGIFDRSAFLASPISAGSLEAVDITSRPGLQERLELQVPVLTYRAAEGEEAEEVRAERRLLKLDYDQGATGPGH

SEQ ID NO: 11318 - protein, 138 aa, Chlorella protothecoides
MIGVSVRPQVCSCPIPSHRAQGKICWDRGCGLSRQSNGTAFPARHCRCHSIARSPPLLSHASLSQCRSQVDKVIQTIASTTYTGEIGDGKIFVHPVADVIRVTCVSCGSSSYAPPHRRTGETGAIAERMEGGMSDRTS

SEQ ID NO: 11319 - protein, 299 aa, Chlorella protothecoides
MFGVASGRRHCQLLHPDRLRPQASRGPKRSATAFAVLAGMFVMFSPAHLAQATCDPSIKFVGLPTAERVCSWSWSQQSNPCVHAHPQVAQQDSIDQRIQSRCLLPVSVCETPRVTRGMLHTVSIVCLCGALPVGNHTEALYPSNQAMVSACPLHRRARGFAAAGASANLTVTPTQPFEWYSISTINPETLEFCVPSKSAFCQALAAVECLPEGVDQCTADADGNIGSGNVGSNNLGNDNIGDYNKGNGNHGTGNTGSYNWGLDIVCNNMRAGQERMCSVFALRTNDTIVLDAASAAPLP

SEQ ID NO: 11320 - protein, 164 aa, Chlorella protothecoides
MERPALLHLAFQALDAFAVRHGRLPAPGSREDGDALLAAVHELAASAPGPQVEVEEQVVRWLASTASGQLNPMAAMIGGFVGQEVVKAASGKFHPLHQWLYFDSIESLPAEIPEASQLAPRVRRRGSMRTGTHSTVPAAERWEGERVWASREPFFSVRPAAAPM

SEQ ID NO: 11321 - protein, 194 aa, Chlorella protothecoides
MAIAGPAVITRLDPGVVNRIAAGEIIQKPSSALKELLENALDAGATSITVISKDGGSKILQIQDNGHGIRRSQILLFRPHHLGHMVPPQEEDMPILCERHTTSKLRQFEDLQTLQAWGESGFSACSSCNAGQMVQSFVHRVSQAATLSYLPSPPHLPLDAWIPRGGAGQHQLCVPRDHHDSASHGYPRPACNLP

SEQ ID NO: 11322 - protein, 121 aa, Chlorella protothecoides
MQMMAAKLGVATGRHLAEHARENYPIFPRMVLWVLVELGVIACDMIEVIGGAVALNTLSNGAVPLWAGVLITACSAFGVLLLERAGMRVLEAVLVALIMTMGGTFFYMFFSTDVDYVEALK

SEQ ID NO: 11323 - protein, 390 aa, Chlorella protothecoides
MPRCSVAQAADQELEAAGKPATRLGDCGDQLRKCFAVALQAPGNQGKRLAALDVVNVSIKTYFKLNTLRLCKNLTRTLCDGAGEACGMVPCILRRQRGLAFRPWMLPCAATVSVLRPEPTDFTQSHMQVVSRQFAPFELFPVSQRVTYKFYVGRLAVFDENFVSGPGKWIGVGNRWRPLPQPEPLARTYHSHIHLADASPPSFTFPSHQQEARESLEYALQHCHRGAVRNKAKILKYLVPVRLRCAAPVQLLLGRFPSAALVQQYQLQQYQPLMQAMRTGDMRLFDTTMDVQQFTFIQEGTYLLLEKLRLAVLRRLLKQMHAFMIAPDHDHGPQPLERAGACCACCSGAGKGNPDPLGLGPGGPEVSDSCRTAAGAHVVLLAAVTGGVGP

SEQ ID NO: 11324 - protein, 290 aa, Chlorella protothecoides
MTHRRMLPAGLVEVLKNYTYVGMADPTCVLLQHGTRLYAANVPVLLQDLAYQQASMLGRRDLGLGLLAVLLVMWTRGSGHDTRLLHGPRPCELCDLCFTTTGAHIRPAHPPADGCLASLPALLDTSMPSPLGLPSFILALACTVDWFHERPCFRAVAEVGPWPEGCRVCGLLCPFCRAWAASSLGTGLHELLPRGNPALNLLVTALPCSSPQALAALFGQHTMLEEEGTPAPTQNLPTQGSPFASHDWQMQHQLLPLLRARLVPDKLRARDGTVQELTRLEQLYRVFERC

SEQ ID NO: 11325 - protein, 85 aa, Chlorella protothecoides
MLGCIRLMALVDGLDPPENMPQFFANNFDVEVRGVGGGKYLYIPLGGARARLLIIWPIFMFVAVWHDLEVGRWESGMQERKTLHC

SEQ ID NO: 11326 - protein, 100 aa, Chlorella protothecoides
MQRARRLVLRRGLARACKAAACAAGCGQHAIPGGEALAKGHGIHCLMSPPPSLSPPVQSQLAQFSLAYMVADVLFYLVPFTPGDFMFLVHHCISGFYVLG

SEQ ID NO: 11327 - protein, 448 aa, Chlorella protothecoides
MSHAHRSSHRPAPKPRVFTKPLHTSRSEFEGLLEKTPAEANAFLADPEKYIASVRSASDAAAREQLERVTEVLVSEHCTTFEECIAWARRKFQQQFHDRIAQLIFTFPEDAKTSTGALFWSAPKRWAADRFPKPLEFSASDPAHAQLAQAAAILKAQVHGIPIPAWATDVGRVAAIAAATPIEPFVAKEGVKIETDPKASSVAHAMGSDEAVSGPGTGGGVGAAPAGAMLRVLCVLQPACRVAHRQPEHARRALPFPPPPPSPTAHVCIQAIEANIAKLQASIRPGTALQPIVFEKDNDANFHMQFIAGVANMRARNYDIPEVDKLQAKLIAGRIIPAIATTTAMATGLVCLELYKVFRGAPLEAYRNTFANLALPLFAAAEPIPPKHCAFRDMRWSLWDRWVLEGDLTVQQVLDWFREKGLEAYSISCGQSLLYNNLFPKHKVGWLV

SEQ ID NO: 11328 - protein, 379 aa, Chlorella protothecoides
MPGQWIPPVSRIPVEACGPHAWELKYGACCKLGSTSEKWGTTTLLNFNSRKISNMLTSLNSAFAGLSLRPPAQARRPQPFLSSRSKETTVMKSRHTFQVELERDDPDPDPGPMQIVVGSEEPQDIALKRFKREVMNTGLVQEVGMSRWKGVFGDSIRCGAGVASRTRWRPRSGRTGRTSCGQSGEVMDCVEVHASGVALLCLLSCIPLHKVRQYGSRAQKPMAGLQGPSVFTDLFGSLDDIFADDFDNGATQQPRQYNNNYKGNGSGGSGKPYNGATKAPGSFTPSHTVNKPASVSTKPQLTGLGGLGGGKPKLPPATSTHPTKPPKEDASLLGRARQSPSLNPLARSLRGTNLIAARNTPRSRHDYISVEFALTFTRA

SEQ ID NO: 11329 - protein, 160 aa, Chlorella protothecoides
MAGKERFEVAVKGLPKDGAKSSFEGKLGDCELSEAHPEKKVPAVKDLNSNKWIADSAAIVDYIEDEIPEPPLGKTGDSKNSHKPYIHGKSVGPNDLELAPKLHHVQLVTKQFKDWDVYTAFPAIGEYAGAMQNRQSWKNTKYEDGLVIQEWGDKVKSFKG

SEQ ID NO: 11330 - protein, 63 aa, Chlorella protothecoides
MLCSSQPFPTSIPGTHPKPHARTHARRYEKLQRWDEALRAYRKRLETTKPGSPENIEALLGEC

SEQ ID NO: 11331 - protein, 199 aa, Chlorella protothecoides
MARELFAAGFVSCWSELEESLQDQLVRSLEAALASPTIPPDIVTTLLNLAEFMEHDEKALPLDTRESMFFSFMGVTARGGALVNGAVLLREGLTDGCERSVACGRREQSSPGSTVSNAHHRPPSTLTHRTLGALAEKCHAYAKALHYKELEYNTSPSTAIEALISINNHLRQPDAAVGILTAAQKTKEMTLKESWWDTV

SEQ ID NO: 11332 - protein, 79 aa, Chlorella protothecoides
IKPALEAIRSLGTVLESSLQLLLPVLVRLITPGASAAPLAVQEETLVTMQEVLPKMQLAGGWVGAIFIGERWPWGWREA

SEQ ID NO: 11333 - protein, 236 aa, Chlorella protothecoides
MTQASTRYLSARAMRMASARLRRPRGHLCPAVGRKPIQSNTSPPRLQISTGYSSAILHPLTRLLDSSSEELRERALDTICAVALAVGPDFAVFVPVIKKVQGGLGGAWSSTPLRVGAQDAQRQPPDALQPQGLYQSGQPRHGLASRHQHMHARPLTPKQPPAGGGAAPDAAPRRLPAHRRQAAAAGPALHVGCGGLGAQQRLPGRGAPGAVPEHARAVRLRGRPRLPDLCRRGAVR

SEQ ID NO: 11334 - protein, 452 aa, Chlorella protothecoides
MPVATVPSGMWQPQGLLQHLLPHHVSQQWRSWCMHGISRCLCLCTIVCFIPCVLSENPLQQVPPNTFDHLGQMKRKVEAASDLEAQIPDAALSPKKGPRSSGKKADVAETRAVEDKPAPSSKGKKLKEGDSLPSFKLLREDDVKVDVQVGSGWGLDHSHRGVLALPSATQANTGGCTKQALGFKENHKTLQDAGFEVYGLSFDKPKSQTTWKTKVGCLCLHPGSALPDPEWLSTAIAPHAQASPHTPAVHQGPGRIQAPAQRDSVPHRRCQGREDRELPHPDQPGGQLCQGRRHGGRRGQVGLSVSIPGGDRAGFNTVEFSSISTDRWGAGLLSIPLPSRLGAVPVRVYALQCSVRQAAGSGGWESGAGVWGARRLVVHRKSHRMRCTSRRSRRYSKSPLLCSACHPPATPWAPSMLQQRTPQRGAVHCMADFLEPPPALPGPAQPPPGVLV

SEQ ID NO: 11335 - protein, 66 aa, Chlorella protothecoides
MDAAALKSIKVKTGTLRRLRKELDMYIQEQVKESANVEKLKADGADIHDVKYAVSGNVLGWWDSSI

SEQ ID NO: 11336 - protein, 66 aa, Chlorella protothecoides
MTEAIDAHVLKKYEIQQKLGKGAYGIVWRAVDKRTGDVVALKKIFDAFQNATDAQVPGRGYIGVLR

SEQ ID NO: 11337 - protein, 149 aa, Chlorella protothecoides
MSRTVDARTKALVEPVAREIRAATSDPKADAVAEREQASFDANELAVYMQGGQSVLDRNVKAIQMLKQFPWGDKSKRPFLTRTEEYVQGLEASVTIWKMANEGKITNEEAMAMRKQLNWPAGLELHLGVRSAGTWRSSCVHGGLALMMG

SEQ ID NO: 11338 - protein, 179 aa, Chlorella protothecoides
MTRTTPSLPLPQPSNVLLNSECLVKMADFGLARSVAQLAAEEGNPVLTDYVATRWYRAPEILLSSMRYTYGVDMWACGVAQGWGPVWTGSGLLCCVPGLSCACMGPPTHPSRPSLSLARNSAFINHCPGCILGELLNGKPVFPGTSTMNQLDRILEITGRPCAEDVEAVQSPFAGEAGG

SEQ ID NO: 11339 - protein, 189 aa, Chlorella protothecoides
PVRLAPGDYAAVRVVAATGGALRAVALARTTLTEFVAVHGSALPLARAELTPAELAAAAELLAAGRGEEEPGALQASAGPARGRGGSSPESPGSQRPVRVPAACHEGEWQRGEPSNKHPSKPGAANMSGAPHHPVRQPVQPHVRQRLLHGLLGRPACGGDHQGADGDRPLAVRQGMGARSLWGWVCVEG

SEQ ID NO: 11340 - protein, 62 aa, Chlorella protothecoides
MLSPTTFIGGRPDPSPSGPAAPERPAVLEHETDPHRLAQRQKQVDFGKNTLGYQRYREAIPR

SEQ ID NO: 11341 - protein, 202 aa, Chlorella protothecoides
MSELRSISCHSHDAPRPGPHRSQRRRNKDPSTPDVHKACSKRAFDGQIKKWRRQLHEWDPPTQEAGAADDVALATGAVMSLEAAGPAGREEPAPGGDAVRGSAQEGAACAWCTGSCPCTPVSHAPHALRRVPAGWPGHPRVKKRTGAAWEREAPPPSLRTQRDEQEAARPGEPGGVWRAARPPGDKARVVHRHQGAKRSRAG

SEQ ID NO: 11342 - protein, 71 aa, Chlorella protothecoides
MAAAAMEAGTPHAWGRHPRVSPLYFPPTPLSSKHRLQGIVLKLRYNRAGHMFEFPILLSPLLDWNILAAGE

SEQ ID NO: 11343 - protein, 117 aa, Chlorella protothecoides
MAAASSHTEDQSLYAALGVGPTASEDDIRRAYRALATSLHPDKTQDPERRDDAAQLFTIIQEAYEVLSNPDKRDIYDVYGKEGLAAGLELGERETARIDSQVNYRGAYIFRADASGV

SEQ ID NO: 11344 - protein, 302 aa, Chlorella protothecoides
MDNDTGQLMAVKQVHVSKAGSSKVSEHVTALEAEVRLLQQLDHPNIVRYLSTETTNDALHIFLEFVPGGSIASLLAKFGHFRETVVKVYTRQILLGLEYLHAHGIIHRDIKGANILVDNTGLVKLADFGASKKIEDLVTIDSGFKSMKGTPYWMAPEIIKQSGHGRQADIWSVACTVIEMATGRPPWSGLGSQVAAMFHIASSKGPPPIPEHLSAECKDFLYLCFNRWGWGVAGWGPCSAHWMDGCRPGGGWVGWRGAITCHSPTSRMSGAAWRGRLAPHPRAAWPSVVDVDGSLSHSPCGL

SEQ ID NO: 11345 - protein, 104 aa, Chlorella protothecoides
MTSGVDIPVDTRDWGVLAADQDIVHLGGLVNVRKNVGGGSFLAGYKRVYSDYTTLDVNAAVGLKSLFSVSSGVQLSPHAQANLTATWQPDEGVGLQVSCGWLCG

SEQ ID NO: 11346 - protein, 461 aa, Chlorella protothecoides
MDVGSAVLDVAALRQLTNPADIPRLLSAALVRERAIDTELEGMLGRREAIQAEMLEMTASTSEVNICGRQSTSRALETFAAMQEARECEVPFYSPSWSLTLPIVCPFPLHFSQALQMLAVEAEALEESTAGSANLAQRVSSQVRALDATQTRVQGALSHIAGLLGRAAAVEGVARALAREDYEAAVHCVDEYLTLEEQTLAALGGSGASPTAVAGSKAGGAGVAPPAEHGVNSVACLAGVSAEQAAAFAQHRRSVEEAVSACLTAAVAAGDHAAVLRFAALHPPLRQAQRGLDALLRHLAGMISSRAAADHDALVGAVEGTQPDYVGALTNLFKDVASAVDEHLDLFINSFGLGCWAFGSEEGTSRPAGCPSITLRTDPPTSPPLNPRLLSFRPGHDGGADAARRGGSARQPHPTALRGPPPSGAAGGPGGLAPRRPRRLGGRAARGAARCRGLSGGAAGA

SEQ ID NO: 11347 - protein, 319 aa, Chlorella protothecoides
MFRIAWVTLGMWACTTVMCIARLRAAHRAPPPFPDPPSQTAELERLAVWESPLDTKAHAAVACDWPTVAQWETLAAAAWIASPRLALALKVWSEPCDGGRCAGQGTGCAARCMQFVSAKDRFPGFPALRLELERFVLVNAAAKSLQLLPQAGALLAEMAGEPAAADKLVHLQSWAPLPLLQALAVVNSAGGKKPEVLEYLSRSLHECNPEEVAFFLPQLVQMLRTDHDGVVARFLLDAAAVSVHFAVVLACQLRSEGTPPDEAFDPQVADKLRTRLMSGLPEDVANLLKDELAYFDDITEVSGKLYPVLKVRIVVCGVG

SEQ ID NO: 11348 - protein, 159 aa, Chlorella protothecoides
MQDKRKSAAVEFLKAVELPRGDLFLPTNPDCTVLAHIPESAAPMQSAAKCPILVAFKVHVRQDVHPGFADGEVEEAGSQGSGKEDEEPETRACIFKVGDDCRQDILALQGELTDGGLAEVFAREHGPPGTERHEAARKNFIRSCAGCGGGSMCLGLRGA

SEQ ID NO: 11349 - protein, 205 aa, Chlorella protothecoides
MYTDLATIYERAGRIEGRRGSITQLPILSMPNDDITHPIPDLTGYITEGQVYVDRQLHNRQVYPPINVLPSLSRLMKSAIGEGMTRADHSEVSNQLYANYAIGKDVQGMKAVVGEEALSSEDLLYLQFLDKFEAKSRMLPQCLNNSSPTKRHQTQGLYENRSIHESLDLAWTLLRLFPRELLRRVTAKTLDIYYDREKPAGSSSA

SEQ ID NO: 11350 - protein, 251 aa, Chlorella protothecoides
MYAEIVNIRLGDGSARRGQVLEVDGNRAVVQVFEGTTGIDNQRTTLEFTGDVRARRGCLGVGRMVQLAAPSLSPFRNPCPGFHCSSHQRPTPSSLPSPPVLAEHFLDINGASINPAERTYPEEMIQTGISTIDVMNSIARGQKIPLFSAAGLPHNDIAAQICRQAGLVSHGEGEDSAREPFAIVFAAMGVNMETAHFFKQDFEENGSMDRTVLFLNLANDPTIERIITPRIALTTGGGSCGGREAGGGRGG

SEQ ID NO: 11351 - protein, 106 aa, Chlorella protothecoides
MTEIIDPARSKTSPSYLHFKELCIKGFLTARSSAESIVATVAMMASSHLPCFRGPKTAVELRHRFRLDLGEKEAAAHMDGLVEAAYGRWTTGFYDWIQYLQNNIPK

SEQ ID NO: 11352 - protein, 325 aa, Chlorella protothecoides
MGAPARRWRMLAPVPLLTRSPPATAPVFSNHPPPPCPSQAYAGRMVFWQWRGILSSTPCSCSHSEAAAASSSGPRWRLACELVLPCYSHVVATGTPGIPLAEPKHQSHPTQILSDKWTAFAPDFRELEENEEYIEREDEFDVVQRAATPATSCKAASLLRIALPHLSPDQSLPANVDADLDIVTRGPSNTPTPASSDLLFLPVVIQAESDQGQEDPDADAAGTVPNGGATPMDEDDSDGGPDLTVQKRARPGCRNIDTLSPCWRPQPPTAPSLRWCAVPAPLRVLQEDHQHQFNTGCREDESLRLVHGVHLLAALEVLGAAPVPE

SEQ ID NO: 11353 - protein, 584 aa, Chlorella protothecoides
  MOD_RES (297)..(300): Any amino acid
  MOD_RES (402)..(405): Any amino acid
MQGHATGTPVAQYISTTQAPSHCTHSGAVRCLVWSPDGHSIMSGGADGSIVTWDVLSGRPTASQPLGRGAVVSLCPGPGPGQLLLTFRAAPPAVLTVGGGGIQHLPLAGWSACDPPEAPEPAPAEAMSAGAEAGKDGRGGASLAEQAASSGYPAATAPGSALIYAAMRGALLVVRASDLAIIDAIRRSESLAQGPVLFLLKMMLCVDNHSGPAPCSSDRASTFLPCAHDLPHSWSFFLPAHRGQSHHSARCPSLLSPRPPSQVQAALRVSSLELDPGGTRLIVLANDRAVRVYALHXXXXGGTRLIVLATDRAVRVYAMQAPAQGLEALPARDPGEVEALVAAKVRGSGEWSSDGRGQGRCGVGQQHAWPGSRARGEPRRPACAGPGSRPSPARTPHEPLHXXXXGPAAAPPLRESRTSVCTHIVQTRRPSGSIFYEERGALLRPSRRFEQQIERNTWSAATFSGGGSSEGAPLPWAGSLAVSVRAPVCDAGWDSAPGRVPTHPRHDVPFHPKFNADGEYVLAAVAGQTEHVIYAWNSHYGHTDRVLECESGGTGKRSGVLGGKWRRHLSKQSACSRRTSSDAV

SEQ ID NO: 11354 - protein, 450 aa, Chlorella protothecoides
MRARGVRVEKVINPAPPRSDDPPLFPWQVCDPSLPGMAAYTLESAAVRCSDTLSLLVSPEVAEFCRSKSEKYGPGLSGALFGIGVWFWLDAVAISPIKVPFSQARRGSVRGGACKPLEGLAAGVRPDPPHRLHSPTSLQYLPGLVAVLALLMITAVRSVQLCHAVASRDEISYDPFSDDGVYCRSRSWLLAAYLVSSGAVTGSVFVMLHHFGSSAQGDGWTLGMGPGSTSKSGSAQILTGFLPGCPAARAAADACPWRCRASQSQHCPQQAPPGLKGGMFLATIYLHAWMPSQMVLLSPCAPPSHHQPPWAGLQSGIWVSTAPLPLIPLADTRWVGIASVLEVACILGSALLFFMSRSPGDEGGYDASRAMGAGTQGDSLHAGARVRRALLPRVTPQLRLSMASALVVIGALAPFLPCNLFEQRVQLEVLHNRVVRICIGVLSIWQLPLA

SEQ ID NO: 11355 - protein, 149 aa, Chlorella protothecoides
MRLTCMPALARELSADLQGWCAGRTVATRIPSPMGQNESSGVEMASEEAAPRPCALVVVGPSGVGKGTLISKLMQSSSKYGFSCSHTTRAPRPGEKVRDCWCGVGVHGFQAPGRPALLCGRLHAYCLGIATARPFLGTSAPHPPYPPHP

SEQ ID NO: 11356 - protein, 126 aa, Chlorella protothecoides
MRGPAKDVAPVSSILPTDAEAISEDEDVEEEVHEWLLGFVETPLSPESLLRHRFPSKLGGRPAWLDPLRLPSPAQLAGPDEGSPLSFLLQVYAPVDSNAAAFHRTVFVFIHTDVSSTGRAVGRRER

SEQ ID NO: 11357 - protein, 715 aa, Chlorella protothecoides
MSARDVQSHPVGENKSGGVFGAIRNTFGLGENTTSAEKVVSERVETVTTSTSASAASKETTDEWRKAEAETVRAEQAAAKAEVLASKVDTINAQAAEAAKLKAEAERKLRDTQGRMSDLDGQAESKQAEAADLERQLQAARAAAAQAERRRAVILEEASKSSAPAADLKAEADKLDAESEAAHKKAIDLQKRIDALRTSKPAQQAAEREEEAARLRAQVGSLQRELTAEERVAAEKQQAADTAMRAASDKIREADEIAKVYWAARDLSKELEAHAKELAKEAAEAAKEAERKRAAELAKEAAEAAKEAERKRAAVDKLDGRADGAERAAEEALQRKAELEREAQALLGSKASAEDRAAQLEREAAARRAQAGKHEEIAVSKRTEAERVVIPVRTEAERVVIPVVPDSDLARRAEEARRAADAAAAKKDGLESDVERLQKLKLEAEAASQDKLSSVTTYRDEALALKQKEEEHWARAKEHGDAAREISNEETKRRLQAVGSGGTTAQHSEVEHQKVTTTSNRGRVESSESGQREEITTTNLADTVPSKPKGTSAGREFPPAPDATTSPPISRPSIGHQGRHFLRRRSSVDSQAHHPLPLAHLELEASGGTTPGAGWDVLLPRRLLPARPQGPCARFKAVAQALRRLTCNLQGKIKERGEASEWQERQRVGGSLVSCSHEANAAPVLQQAAIPSRQPTAAQHRTHPPTLAEKAAKSL

SEQ ID NO: 11358 - protein, 163 aa, Chlorella protothecoides
  MOD_RES (138)..(140): Any amino acid
MPGARRKRPILPGRDVAEQVLLRQQSASMHPAMLITPHAQRMQLSASAAAASFLPIWQGCRMRPALILRRSVRTFSGMAGGPIEISIKDPSEKQSPCRAPCRKLTAGLQPVTLKLTNESHKHAGHTGNPTGAPDAETXXXEGPAMIRSASCGSCLAPVMVMHE

SEQ ID NO: 11359 - protein, 155 aa, Chlorella protothecoides
MWPDEDSDEYRRHAINVRMSQGHEPFTILNNLPSSLQPPQFEFHDPKGPIYTSPRFLPPAKIIRSRVTDAVVSHGSLLRDCFVDTSIIGIRSRIDKGVEMKVRAGDAWLGGVLLPPGQRFRTRRVACWKAAPPITQPVDASLPCAGGPHDGAGLL

SEQ ID NO: 11360 - protein, 124 aa, Chlorella protothecoides
MDYMKFVEAHRASNADISIGCLPVDHTRASDFGLMKIDGEGRIVDFAEKPRGAALEAMAVDTTVLGLDAEAAAANPFIASMGIYVFRKDVMIKLLKDDPSRNDFGGEIIPQSAKDNKVPCWDCF

SEQ ID NO: 11361 - protein, 100 aa, Chlorella protothecoides
MLPLFPTERGLGWGGWGHAKAPGLPLKKPLSKLVCLLGSGGRAWLPSPMQASNLPPLLRTPSHPHREGVQEASREEEGYFIRSGIVVVARNATIKAGTRI

SEQ ID NO: 11362 - protein, 108 aa, Chlorella protothecoides
MGCVPEDLAQAWNARWTTPLPPLQHTEEEYGENVDSEGRHSGGPFLLEVSPAMRIEDLRKLIKYGGLRKGGVIWHAQSALDPARACGHPLSACPTIHSNAAMEWHTGM

SEQ ID NO: 11363 - protein, 181 aa, Chlorella protothecoides
MTEITSPPAVWDESAMSALRADYPDLAVLSTDAVTKHNPTPGTGRTGYMAVPPNNYPFYSEDEKYVPIMQADGGQLSGTDPSSLGGRDRSIPWMLTGAPLVQQILRGAAELNFVQSKCCPGVQSPRTPMKQSGSQCTTPLRSKRRRIAKRHTSLECPTASLRRETSMQAFPPSPYRSSASW

SEQ ID NO: 11364 - protein, 104 aa, Chlorella protothecoides
MLPGISNFTCEIARPPRHFPSSQRFLADLAAVDHSSPDAEDSSRSRVRQLALAWRAEAGSRALADGHGEGDAVPAQLGARKGGGGARHLGLLFRRSLRQVWERE

SEQ ID NO: 11365 - protein, 96 aa, Chlorella protothecoides
MEFLAGALLITLPRDKSIPLGAGAVLAKAVDGAVRAVTKPRSAHAAASIEQAGAQAVTLVWDRLTCILKTKNGQVRALLRDIQGTARPGRWAWIGE

SEQ ID NO: 11366 - protein, 453 aa, Chlorella protothecoides
PTPHPTPPLPTGGVHQGGAAQPQERAAARAGGGEAHPGRPPGHRPVPGDGGPSDGHCGQHHRLQLLRAHPVHAEPRAAQAQRLGGHAPALQRAGGRAAARGGQHHLGDERGGAARRHLCRHRGHGRAEAGDPGGGGAAPDPGRAVRADRHRPAPRRPALRPPRHGQDHAGQGGGAPHHRRLHPRRRLRVCAKVPGRGAAHGSRRLPPGQGECALHHLRGRGGRHRHRALRRADGRGPRGPAHPHGAPHPDGRLRAGHTRQGREWAPLGSRRRGTGQDTSLQAPEQQGPHRRRPAPEAPGFPVLHLQDESQPGGGPGGLRGTPRQDQQRRDLLHLPGACTCVVGRSPGDACQGVDAWVSGWHGVLNPGVYGGIICCKEHSIVGSLSIWVGNAPLPFAESANKSAPTPSLPTALLVQEAGMLAVRKNRYVILPKDFEKAYKVVVRKSSDSFEFYK

SEQ ID NO: 11367 - protein, 155 aa, Chlorella protothecoides
MTAAYTWPEPEPAEVLTGTEGAYQPYCNQIINDELNFTAQRLLSRLKELTSLEQGMAPGFSPPRRFFCSLKEVSKVVPNAALLIVAPDVRPSATAAIKPVKILTALLSAAARHGVPVVFALSRRGIGQVFGREKSMSIVAVSVRGLDTGKGLDRG

SEQ ID NO: 11368 - protein, 436 aa, Chlorella protothecoides
  MOD_RES (347)..(350): Any amino acid
MMPAAASRAAAPCGPGSVVGAGPRAPGHAGPPVRPRGACAAAAGPHAGPELQVEACGRRAVLIGAALAAGSAALVPPGAWAAPEPRSRAIRPELTPDPSSYPPSARQGLQEATNMVQKGLNAPTLEQEIAAWSEEIAAWSEVVDRYSLSNEPWAAEVAGRALGNRGNARARQGDMEGALADLDAAADKCPWAVDPVLNRGVVLEALGRWDDAIADFTEVLAVAPRDPAAWNNMGNAHAGAGRYAEALAYYDGAVQLAPAFSFAAANKALALYQLEQDELSLHEMRSLLRRYPSFVDVRAALTAALWRAGQEAEAEDQWLRVDDPRYSSCSKPARDGREYASPPGRGXXXXSKPARDGRECALTPGRERQRLRLCCQECRRPALSDGARLAGDQAAMAPAPGGRPAGLPVAAEHRGARRLTRALTFTSRACSRDGMA

SEQ ID NO: 11369 - protein, 542 aa, Chlorella protothecoides
  MOD_RES (98)..(101): Any amino acid
MANKVGMGTRGLGGQGAGVAPRAPRMEQGTGARRRRTVLHAAPRERHPAPARPHRSPSHSPPVPLGPLPRSVRMVCPDGAPVHDPGGSSAGDRGGGGXXXXHAWSRARERGAGVRRTVLHAATHERHPAPVRPHRSSSHSPPGPLGPLPRSVRLVCPDGAPVHDPGGCSTGDRGGCGCRAARQAATRRPRIALATPHPGTETPLPLRPTQALGADPSQAKWQRGLRTLEINPTHPLVRELKARVAAAPDAAETKNRAMVLYETCLMESGGSGFGSGSGSGSGLGLGWTGSTGYGECRAGGVQGRGWEGNCDGEDACMAPGSLAYADVAGLLRHAPHLCLSVDHARRVPGGGRDGVQLPCPAPPGRQPGSGGPGGADAAQVQGDEEEGCWEGRRGGVPQIWQGGECAPRAARPWDGAPRRASLIAPFHAFQLDEPKADKEEEEDDDGEPKTHTFTSTVKLGVDDLNGPITIPVGTQDEVAAEGVKEKAAGDAEAKDGEASGVGEAAKDGEAAASDAAAAPAADVDAAPASDDVDAAAEVKDEL

SEQ ID NO: 11370 - protein, 666 aa, Chlorella protothecoides
  MOD_RES (115)..(117): Any amino acid
  MOD_RES (303)..(306): Any amino acid
  MOD_RES (479)..(482): Any amino acid
  MOD_RES (514)..(516): Any amino acid
MIQENGKNSSKVWPEAEDRSAPPSGGEPWVSALGRAPSCRMERAPGSTRHKRSCVRSVNRPRSIFLHSCKSTIAARHRLTSITLHAAVPVGYAQQPQLLETLTSDSVVSRHVHVXXXDAQQPQLLETLRPAPAALTPRPDPPCMAVESESRARSYGLRKRRSSPECVMLLQSPHDDKSTLEQVLATARKVVIFTGSGLSASSGALTGRAQGVGPCAQGVLHTAVVSAQGSGGCIGGQGACGTTCGVRRFLRSAGLGVHVASCGIVTPVAPSPGTAWCDVPPAIPPAPFPGSSCRHVHLQHQGXXXXSAGLGVHVVSCSIVTLWHHRLGPHGAICLQPSHPPLSLALHAGMSTFSTKGGLYERAQKRFRVVDGKSLFTYAFYAKHPRPAQAFLAEVHGEAVRATPAPGHYALALLCSLGRLSRHYTLNIDGLSQRASSAFSYSKACAWHPDDNPGGAWCTCMSRCVDSRAPAGSLLCRVXXXXSERRSVSGWWTASPSSPMPSMPSTPAPLRPSXXXPRPAPGTRTTTREQAWRHPLITHPPHIPRPPGGAARQHPPVGVRRLRRDPAGRPCPGVHAEGGGPRRLPLRRPGGHALPGHAVRRRGGRAHHARRRAGRDGGRREGRGRGALGGHLLPAISLHALLPLCAALAGRGGAHAGLPPGRGQPQ

SEQ ID NO: 11371 - protein, 215 aa, Chlorella protothecoides
MSDEDFALLMQQQELVRGFGGVPVGEPGGYTSATESAENEGDYHDEEYTYEELSALGEVAGTISKGLSAEALAALPRMSWAEAADSRSGALDTMCTICQLDLEAEEEVCLLPCGHTFHSECVEQWLSLNKASRKREVERLMLVRCAARKSSVHLPAEVRWKKLCHAALERLAICGHDQTARKMKGRWPIQTEKSHADPRALQQIPERSATFIMRC

SEQ ID NO: 11372 - protein, 618 aa, Chlorella protothecoides
  MOD_RES (543)..(546): Any amino acid
MPAMGTSDGDNEYERQRQERVKRNRERLSALEIPVLAARVAPKPARPRPAVRPAKRRPTVESAGPKRRSARVAKLEADGNQIESEERGRIVTSIMLPKPDPVPAERHPKRELGLGSITFAEDPADKYLPGLSPGDLAMQEIDGLAATDAAYISAWSSRLGTGPGVGMEKPEPSLPWLASLQLDAVDVAKVTRSATTHLAFHPTSETLLLAAGDKEGNLSLWYCAEAAQALDRASSRGDAGSSEGELRVWAKEGAELAREGGSSEAATSGTAESEAEFDGLVSLGYHRQYISGLRWAGGPGHGAGLFSASYDGSLRRFDPGAGAAILLTSSEDLGFSAMDITLDGRWGLWAGSSADRDGEGRESWWERSEDLVGIPGLLIGPVAHALTKGLPSRSQPPLTTRPTFSLHRTAVLGTNRGDLLVVDCRAKGPGVLSEDGHAKKINTVHFDPGDEHVRGGAGGPCFVPCHGEVLCGGVGPSHREPSTNYPLRPLPAPLLSTPGAGLCHILHRHLCQSVGRAAPGPDPKTRRGGRTPFQLPGSALCAXXXXFSSATPASPSSCLPGCRSLPHPPQTPVSECGMCGAWARPRNPSRRAHTAPAARQRTLRPTVRRDWGGGRGCM

SEQ ID NO: 11373 - protein, 540 aa, Chlorella protothecoides
  MOD_RES (22)..(24): Any amino acid
  MOD_RES (447)..(450): Any amino acid
MRTMRTCLFWGEENAGGRSSAXXXVEDAHDADLFVLGGKEHAGGRSSVPQGRRAGSARCTRSNLWRQVLGQIPSTPLPLLCQSLIPCVASHKQGPTTPIHPIAPSLIVFLFPPLLPSPPAQPPLFAPPHLQVMLAVVVHRQRLRGALALVVAGALADGVHVAPVGLGLGVLQGVAVDLGGGGDEEARAAALGQAQHVQRADEAGLQRLDGVILVVHGRGGAGQVVDLVHLQQQPLHHVMPGRGEGWERGPWSGPELITRSRPAPNKHSTLCVSSPQQLKVGLVQEVGDVVLAPREEVVHADDLGRPRSRCMVRTCPGGWPGATSIVRCAGAPAAMLATLGRHITHFISLKRMSCSHDRPGPRGGSGKRHLIGYARIRGCASHKSPVTLNLSMHTHLAFGRGVGGHRKFWSARGGRHVYLHHLGTCTRWGGCREGGTFTSHDTACHRXXXXHVYLHHLGTCTRWGGCREGGCSHHMTPPVIGHIFKPSKDTETAFPTIIVALNGMCGLPRQLLVVKPGYQKGGQSPSRTPIRWHIKPTVQR

SEQ ID NO: 11374 - protein, 227 aa, Chlorella protothecoides
  MOD_RES (94)..(97): Any amino acid
MQFLEIPDVVIAYYRFGNASTELPPIVLVVGFSGTMKDWPITILSDLAEDREVIIFDNRGQGSSRAFGAQRYFRRLTPFHRRVAVGDPGGARTXXXXNGDGGSHAPAPTPPPRLPTTSTGALSCLGRPTPHPARLATSLSTFATAKPQALDLARPPHLFGWSMGGMITLKAAAMFADSFDRFAVFSGGPGSLRSQLPSLEILEKFLLEDTMTEVYRLGTLFPLNTTS

SEQ ID NO: 11375 - protein, 128 aa, Chlorella protothecoides
MPTPNPAAHAFLGGLQYLEIPNADIAYYRFGNNETGRPALMLVNGLNSVMGGWPLRLLRALAEEQEVLIFDNRGQGLSVVSRGFYARPEQVRRKDRLAHDSGAEYSMCSKRPGPSFSLPHRTPTPPRR

SEQ ID NO: 11376 - protein, 239 aa, Chlorella protothecoides
MGGMITITAAALHGDTFNRFIPISGSAGGNSSLGFSEKMMHSLTHLAQMDLYDLMDMYFPMPHPLGEQSREGGGGPGMWPAGHGFLYCGDLVPALQCTSLVAGARVPHSNDSPQESLPLPFPPSPPGLLTACWYTMEAFDRPMIPTNATTTARQMEAILDFFQDDQVYDLLPSINSRVLVVGGALDPVIRPQNQKLMAKRLPAAWMTMFPEGGHATYVEYWSTLVDVLNVFLGRDADEL

SEQ ID NO: 11377 - protein, 242 aa, Chlorella protothecoides
MRSAVFFCAALALAMLCPSQATSAPGEDKSMAAMPDGLHGYSTCENDGLWTGRMLWAFVADCRQRHTSTSTEAPLPAEVWPGETLEELCGSNYTDYDTATEFYGPLQYLEIPDVIVAYYRFGNASSELAPVVMVMGFSGTMKGWPISGWPISVLADLAEDREVIIFDNRGQGFSTVRRLGGVGGLCSVPVSSLPQGRHDVSEANWLYFRPAQSWTIPNYDAGHQPRRAPEHPLNGQRHQELC

SEQ ID NO: 11378 - protein, 77 aa, Chlorella protothecoides
MQYFDDSTIDALVDTERHILVIGGLLDIVVPAQNQKLVGQVLPSAWMAIFQDSSHATFFQHWGTIRELLEVFLQREE

SEQ ID NO: 11379 - protein, 96 aa, Chlorella protothecoides
MVTVMDNDEHKGPFNVGNPGEFTMVELAEMVKEVINPQAEVGSMCVALFWRVGYTGLVHWARARLERAGAEATASELGLVRGQTARPCGRTPAGPP

SEQ ID NO: 11380 - protein, 119 aa, Chlorella protothecoides
MALDDGRVVSNFVAQALKNEPLTLYGDGQQTRSFQYVEDLQTRSFQYVEDLVRGERGCACGGGCGWGSSVWWVWGVVHLPGGGVRGGGVRREEVGCSYELYPASSGACANRIPEAMHEA

SEQ ID NO: 11381 - protein, 838 aa, Chlorella protothecoides
  MOD_RES (240)..(243): Any amino acid
  MOD_RES (730)..(733): Any amino acid
MSARNFGVEFRKCDFPEYFAPFSSKPAISVPCLLPLPAGARHPTKRGSTAWGRKETDACRDEFAGEHTVSSLAWQGRGGGGALPARRGLLVGGVSAPRLVPLRTRDKGTHRRFNWEHGSSPFFKSHALAGGAEGDGGGAMTCHSSQTQAIVRPGRKKGKDPHRSRLENHKTVPARAGSSAPASGSGKDPALSAATRQSVAAPLRWRCRPWGRPWPSPLRRRRAQPWWRRARRCASRRGRXXXXIARRLQAQGRILPSLPRRDRMPLRRSDGGGARRVAVDDLLRHLSAHDGAPGHVPRKGDGHALHGDALGLGHHEEDEDGHDGHEGGKEDKHAPLHGAEHGEEGLADDKGEEEVGGDGHRHPRRARLQVVDLRGHQPAQWAPGPGKGGDKDADHDEHADGGGGGQVAVLVLAKLHGQHDAGHDLGQEHLHTALQEPEAATQAVHGQDGEESGHKVDGVDDDGVQQRRAAPTPQGVEDDGDVEHDGVDTWMSVGRRGNTSARECDGAWLGLPGLRCRARCPEGVRQAPSIAPFIPHAGRSTHRPVPSHPSSHTLAALPTGELLEEGDQAGQDELGAVGLGQQHGVGLAQGDEAGQLRGLQDVLHLRLHVLGATQALQHGTPLLHLPTLDERVGGFGQHDGADQEAEGKRGGQAQGQAPACPPVLDPIIDQAGDEDANGGEQLEQHVQATAEVEGRDLGQVQGDHGVGEADAKAQEGAAHEEHGQVLGAGXXXXMVVKSWNSMFRPPRKLKGATSERYRGTTVLAKPMPNPRKARPTKSMARFWAPACRPAPRMNRQAEVNMVALRPSLRHMVPAKKEENMPARNMVEVKVCRTWLSYL

SEQ ID NO: 11382 - protein, 302 aa, Chlorella protothecoides
  MOD_RES (147)..(150): Any amino acid
MQRQTHTPSHSVMSRMPPWIFQCTVCLPPSPHPRPISLSRSQMGAGLRFLDVGGGLAVDYDGSFTDSAASMAYSLQSYANDIVSAMQAGGSREMGLAGGSITHALEVPGRRRRRGRPGLAPACISCFLPIPSGHYHLSHLPLPCPKXXXXRIGHAGGWKQGMGVAGGTTTHAREVPGRRRRRGRPGLAPACISCFLPNPSGHYYPSHLPPSLAQTQAGGVRAPRHPAPHPDLRVGPGGGLPRHGGGVRRGQPPCPLRGAAGGGGGGGGQRGVQPRQAADQAAEGRRQPGQGAVPTDHLQGGV

SEQ ID NO: 11383 - protein, 833 aa, Chlorella protothecoides
  MOD_RES (195)..(199): Any amino acid
  MOD_RES (270)..(273): Any amino acid
  MOD_RES (303)..(306): Any amino acid
  MOD_RES (383)..(400): Any amino acid
  MOD_RES (474)..(477): Any amino acid
  MOD_RES (636)..(639): Any amino acid
  MOD_RES (784)..(786): Any amino acid
MLMGPLPWTKISTLTHPNPLNLSTEWNGEEREGSGREPEQLQGARPREPKSVSQPRHPLPPPPSERCRGGTHLPAHPRRRGCPPPRVQGGCPELLGQGQWRLHRRDHGRPDRRPGAGVGHPGALRAPAHREGVGRAHRRQGGLCAVQGPLRHLLHRREAGGARGQPDAGGERPAAAGEGYRGPAGMGRLAGVRVXXXXXAYQRLQSMLIPPTHTCQRRFVHRSSPYSWTPIHTHHPPSTSLTPTPRQALADKISDWSKIVVAYEPVWAIXXXXVCPWACGMLWAIAAGTPGMHGMITGAQCIXXXXEIWHCYQCLSMGVWNAVGHSGWHFGHTWDDHWRTVHRASNIPEAAVDAHPPHTHFSKEVCPTIISLIMDPHPHPPSXXXXXXXXXXXXXXXXXXRLTPRFAPGWPRRWARTRRRPRASSMAAPSPPATPRTWRARPTLTASWWGWSVLFVCVLRGGGGSKGNLIGCAXXXXLFMCVLWGGGGSKGNLIGCAVGGGVLPDASSRRRTNRVAVPVLAGGWSVPEARVRGHHQGGCQVSCLYNTHLAHILSGCCQSFPSCGSSFLDTCVGVQGRMQIDRHAWEFGEVCKSNGQVGVQSVGRSNGCHSVHVCVRYRQDSKQALRASRSSHLLGXXXXNGRQSVHVCVRVSARQQAGAACLAVVTLARLMVDGVRKGWPKHEMELGSGKGGQSMRWRGAAVPVGLTETGSWAPGELAATSRHSSCPWSVQPHCAWPPRSKGFVSSSTARASALLALELTGAHRPGGAPPPARRPGAAAAATRXXXQQGLRVVVHRARLGAPGAGTHGSTAARRRTPARPVPRRRRRGHPGPH

SEQ ID NO: 11384 - protein, 240 aa, Chlorella protothecoides
MFYVPVIFNSLGSGRRASLLNTIIINAVNFVATFLSILTVDRLGRRFWFLEGGVQMFLAQIVTGVVLAVQFGKYEDGDLPTATAIGVLIVVCVFVSAFAWSWGPLGWLVPSEIHNLETRAAGMSVAVTTNFLFSFVIGQAFLSMLCAMKWGVFIFFASFVAIMTVFIFFMMPETKGIPVERVPITFARHMAWRPIMSAEVAQQIIDRDATRTASRAATKAARDADAGEKAKEGPMGGTAI

SEQ ID NO: 11385 - protein, 80 aa, Chlorella protothecoides
MKGDGAKFGLRAREIVAAVGELATAGMLDCLVLLHFHVGSQITNIRMVKEVMREASFLYAELVKARAGNEVEGEGWCACG

SEQ ID NO: 11386 - protein, 126 aa, Chlorella protothecoides
MDCAAGVERKLQSTGCGYPSRASQLYDLDTTSAASSGDLLLDFKPVTSEADLQSSRSPSQARQLGLSPALGREGSTWSTEASRALYNVDGWGCGYVDIAEEGNLAIRPLGGGRGGQPYGQGEHEFV

SEQ ID NO: 11387 - protein, 668 aa, Chlorella protothecoides
  MOD_RES (65)..(67): Any amino acid
  MOD_RES (353)..(356): Any amino acid
  MOD_RES (663)..(666): Any amino acid
MSYRRGRTTARSFRTSVEALYAEYLERCSMSISYGRLLIVGREGAPEVEFPLDKKLVLIGRDQSXXXCSGSRVPSGQETRSHWKVRCSSVWWNTSSVVNVVRNNSNLPLSVTRRDQSCDIWIRNRTISRKHAEVFVDDAGAWHSLAPLGRERWRVPPSSTAFLSRLRTDRVNPLPLHPLPQVFINSLGQDPVCLNSQPVTSPQELFSGDRIEVRLDDRTRTFFFQGDEETIKVQAPTRALQQANRAVPQAARASPKPASARKRTRASLAPSGKEDVAPASPGRGPGPAKRRGAGAPPPPPPPLPSSRTLGRAALGLTAPSTLTGPASSDAPAPVPGAGQPPASRPAPGPARFXXXXPRRWPTPSAEASPGPCTLRSQRRRPGRTQGRCSAGGGRGERGGLWLGVCRAFGSLLTRKQHEDMRLRKAAGSAQADVQAASDAVPPALLPETVPGAEPAVPAQGARDVGLKSPRQPGAASSPLTTLNTGRKTPKSTVRRKSVRFQAEAGGTPEGAPADVTITLHLRRGGLVRAVDVDGALDTLAFSEWGLGSMPAEGRGAGAGRSVAEAGAAGGDGSEEGLPAFEDGQPEAGEGRVPPDALTAAVNQPGEALLALTFPASASSDNKETGTVADPASVLPPRDPIWTPGGPSQTPATQLRRLLPGTLXXXXAP

SEQ ID NO: 11388 - protein, 280 aa, Chlorella protothecoides
  MOD_RES (178)..(181): Any amino acid
MRWMEQCAFVAAARVARGAYLLTASMDSIAFAAPTRVGDIMYIEAQATAIFGSSVEVMISVWAETPEAGGLFECGDAYATVVSMNESGVPQDIPFELAPDTPEDHTRHAGAIRRRRDRLQMREAMRQTKRKRKALDGMTDRWGSTDDFLSHALHAGSGNDSPGSGPASRARTEHEAGXXXXAPGQARPRAHGPSARLGPKEVKRRAGRETTMASSCGCCVWQTDAALPPPPIPLWAIPLSIRRPPTRCACFFPLSSPAAPLPPDILHRPMVVPLCKAGHL

SEQ ID NO: 11389 - protein, 576 aa, Chlorella protothecoides
MGHMQWMTPSAVAQPLLIIGTLHMSRPPAQAGDAENRSSELWSLQGQILADLRAQLQQEREARSLERAEWLAQMTALHEESRSLRAELLSLLGRHVAGAHDAHVTAVEAARSTKGGGAVLPASSPAAVPDDDRSETEVPQPAPTSPPMSSDQETERAPWKDDLRLALAASEDTDILSIPAENFGDYLASRRRAGKDEAAQSGGEMSPEHAVSLPTMAAQPVAKLDLGPSDPARPAAPPPGPPPLLREGDDDISWMNALHSAMAEAGYHAGEDDEEEWYFGSGTTSALLTLQAARQEFYAPHRSLLSFQISKQACEGLEETGVADEPTWRFLLGDAYDAMVNASAQGKAGPQSGGVGPGADAGDAEPELFLEAAELGIDAWILEEDGPPPPGTPPPGRERGGGGDGERWPILNEGDGGREVKAMQIALDGAGFFPGTDDMRWWQFGSSSMRALATFQVPSGVPALGAEPAHPQCDAAEVPVPPPLATQPSRAGVQWPAREREVGAVGEAGVRFFGQGCALYSLHAAMRPCHRARGGCRGRGRSGRGPRRVAAWGTALGEARQADQGLTARRGAFERR

SEQ ID NO: 11390 - protein, 1120 aa, Chlorella protothecoides
  MOD_RES (485)..(488): Any amino acid
  MOD_RES (794)..(797): Any amino acid
  MOD_RES (861)..(864): Any amino acid
  MOD_RES (970)..(972): Any amino acid
  MOD_RES (1057)..(1060): Any amino acid
MCQQVGKRRCDVDNCASRVHAGMHTLSEYSKLDTTHTPPSRSPSPSRKDCIDCDTLLTGPACRPRPVPRSSACLGLGTPWVHSSSAWDLFGPDASTMCAFVWRGCWPEGLPGNSSRPLPPPQAEPVRRAPCEAGIWYKSVEGEEGGSGRGPPRPPQVGACACVVLRGCMHNPCPLWETLSCCPHPSPPSTSILAPGDMQHGWASPPHSCSTPRPPPPPPAPNLGRAAVCRRRTAAAATAGPCACRGPRRCWDLFAPRGDGFEGVVSLAPGCPARASKAAAPQGTPCPNPSWAADLLGLMIPGPASSCPAMLPLTHTHHGDTAPTRSPPQITQMFIKQYREQTGVDVRFRLSFGGSGTQARAVIDGLPADIVALALPLDVIKIAEAGLLDPDWAPKFPHQSIVVESVVSIVTRAGNPKNIRGWDDLIRCVVVGVWGREGGCRHTDPGDRCQVRGGAAAACRSRAGASRRELHRGQRQDGGRGALDXXXXVVRAPHEQTGLHTDPSTPAHTRPPIPPPPPFPLHRPDVSCIVANAKTAGVARWIFLALWGVRAARGEAAAIDYVTRVYDQVVIQPRDAREASDVYYKQRRGDVLLTYENEAVFTNLVVSPHEQLPFISPDNNVRVRGVGAGGLGGHCALHEAITSQQTAPGAGPHPETPAPWTLAIAATRSPAFHQIQCPVALVDRNLDEGGPVARHAATAFVNYLYTTEAQRHFTACGFRSQDPELAAATDLPAVKGLWTVEKELGTWAQIIQRFFSDGVRAHGRRGGAEEWGGCPRCQGAQGLDGGMLVMGGSXXXXRWSAVPGSSGTGRWDARDGRVKWGMFQGRMEMRWPWRAGLEQCAQARGGCTPSRPCTQERLHTXXXXMRWPWRAGLEQCAQVRGACTPSSPCTQERLHTRTSHAHAGHTGQDTAGCFSAKAGCTAGEDAQQSRSARLSDTHLMLKSLPFSAQCPPCGWTSTLRCPAMRSERAXXXSQTQSLAGGSQGVSHEDQTRCPAMRSERARTRLNLLPRRQRARATCCPFRNETHSLVWTGRSSRAHRPSRDIVCSYGTVGIGREXXXXSSSATFERHCLLVRDCGHRARSLYLPRKACPGCTGERSRILNSSSSFYSEDQFLLHGATR

SEQ ID NO: 11391 - protein, 229 aa, Chlorella protothecoides
MHARPSSPDAGVAVAQGGEVGLDLEACGRLARNDPLSFARRRFSPLEAEAMQGAGGVAQAGSVLLQQLPRGPRRCCQLQRGAPFPALPSPGCTSEAERRALFIRLWVLKEAYLKARGTGIAGSSGLRSFAFGIEDRAGSPAHISLRPDPARPDGDWTFWLLEPWHGVLSALCMSSGVSEHGPEGAGLRLWAMDAEGARRGCRPARMIACGRHTAQPSWEDGPTQARSRL

SEQ ID NO: 11392 - protein, 587 aa, Chlorella protothecoides
MAVIFSHLWALFVAGSRPRPQTDRVSPAPWRLTLRPRFPPMQTARALESALLRERSRRLQLEAVVRAALAAEEGAATAGDEDEAVDEGVADEGSEPGVAEAQEADPPAAQQQRGTHRAHAENSLLELLANTSPRSIPLPDPHQVVVVGSTAVPEPSRTVLAGAVRVVRTSPPLGVPSATTPTVRTLPGAARVCRPATGPADAPPAPPSTVVVLRPTQGAPPASAGPSTVWRRGASSARRSLAGVAVPEWLHGEEDALFYASLSSRLAELGGDVSGAEEPAGGAGVPAEVDDEVAAVQAEATVATMEEATVAVGEATSAAPAPPRESAEQGPDPAADSGSEAGEFCAVCGSSQEGDVLLLCDACDAACHLACARPRLQAVPSGDWFCGECSAAEAAEEEAKGARSTPARVRRGEEAKPAGRRGRGEAEPTVSEQERGAKPTRSSHKAEVVSARSSGKEEAKATRSSRRDENKAMGTGGKGGAKPTKSGQEDEVAPKGKKRGASARTSAPAQSPEKKRGPGAGRRREPAAVVEGKQVASPAQSRRSTRGTASQPATGSAVAKAASRRSTRSEAGKDEADTAQKRRTRRG

SEQ ID NO: 11393 - protein, 222 aa, Chlorella protothecoides
MADPGALIALMNQVEALAARVKDLESKPSNGNGMDFLQRHEGLSLRRPPSLQSLAGAGGPGMPRAPSYTNLSHVEVPMPSTRVVMTQIVSPADTTGAGICSGGTVLSWIDVAAGLAAKTLARAPVVTASLDTVHFLRPCRLQSIVTIAAMVNRVFASSMEVGVQVEEEDLSTGSRHHCCSAYLTFVALSRRGGAGGGAPPQKKLPPKVVPTDSYYQGEEGGR

SEQ ID NO: 11394 - protein, 344 aa, Chlorella protothecoides
AEARRTSTRVWLDPAKVNAALKRVALLALEHGDVETRASPRGKKRRASAGAAGNGAAAGDGGAVGESHPTPPHRVLLERPFPLAAAKGVKNAAELAGMVEAHLRDGVALVTFLAWLEAEVGAGRSLTEVEVDERLTALRAAQPGYRDTSFDTIAGAGPHGAIIHYRAEPATAARVGADTLLLLDSGGQYDCGTTDVTRTMHFGTPSEHQRRCFTRVLRGHIALDTAVYPEGTPGCALDALARAPLWQLGLNYRHGTGHGVGAALNVHEGPQSISGRWHITAGLARGMVCSNEPGYYEDGAFGIRIENLFVVTEAQTPFRFGGQEYLTAQPLTVVPIQKKMMVRE

SEQ ID NO: 11395 - protein, 357 aa, Chlorella protothecoides
  MOD_RES (157)..(160): Any amino acid
  MOD_RES (260)..(263): Any amino acid
MSARLSGLRLRLPTQLFSRSLLQRRPFTHTQRCPLKAHSVSSQEELRSTPAGSTEGEGVRFAELSPALHDALNAWGFTTPTDVQSSAIPALLESRGSDFLLASHTGSGKTLAYLLPLDAPCTACAGCPGAWSACNSKERCTPFLTCSMACCLLHSPXXXXNAPCNACAGCPGAWSACNSKERCTPFLTWSMACCLLHSPSHACPTPTSPFFLPPLRSAKPEGGRGEGHGHQAAPAAGPGAGPHPRTDRPDPKGGQVPLPXXXXEARGTATKPHRPRALVLGPTRELTDQILKDGVGWGVQRSLLRDRRTLSLPGARLGSRQLLEGPLAWCRVPPAKGAAGPAARRGGGHAPAHPPAR

SEQ ID NO: 11396 - protein, 641 aa, Chlorella protothecoides
  MOD_RES (259)..(261): Any amino acid
MRRFTLSTSDLRQILSKRGAVWGRTEATGSQGPGPCQACRSHNRHISQVLRSHRTPPARSDSVPPFWRILTSHSKHALTLRHGVRQERCRHEGQTRPEPVSIAFSTLEGRRNPARKAMHCFMASSLGELFSWKKPFNGRAVYPPLLLSTDRYPLEVQERFTLADMQASTFPRSGLAHSKVEEPNLRAVAHMSAPQPPTVGPTSIGEPLTELKELDQSEFYSFIEEHSQDRLVVVDFYTACVLHLKIYPMAGADRANSSXXXLNLKPERPAPKNLPDGRCGPCKLIQPTLVEWANEFAGEVELVRFECKKENKEIGSKPITSFNTALTNVQLGIKVAPTFFLYKKGEKVASLTGAKTDELRKLIETHNRDGHLPQHKVIWHGPLGVRGRASDPSTMAPLKLIIDTDPGIDDSMAILAAFHSPEVEIIGLTTIFGNVPTSMATRNALHLRALAHRPDVRGGGEGRATCVMTRRSTEDGPKASQLVLPGTQFPQSWNAQVPVAQGALTSLKGVAKERIADFVHGSDGFGNTDPEFSQVGGMGWGMVCDSSAGRGDRHLMSCVKPCGCVLHHVYQLQDSEAATPGNAGGAAAHLSCPVHRGVCRKMAWGGGGAGPGTADKRSAGHTPESRPAAAAGEVAGVGRGC

SEQ ID NO: 11397 - protein, 277 aa, Chlorella protothecoides
  MOD_RES (12)..(15): Any amino acid
MNAGPQGLRASXXXXTTSTLACRGGGQGPSCLYQCRATGSASINLPRLHGQRPLTLGLALGSPSIPSYTPSPTGRRSSYGMDAVFVHDAAALSAVLRPELFQWHAGAVLVDTEGAFRGHTLGFRHVVPQQDHPGGGRPRRRGCLPVVLILRCPRQAGPLRSPPGLPPITLLSCNTLTPATRHCRREEGVGGDERVADPAQDQGGPGRRRQGADRPRAPAHEPVRQHAKAKKGGLRISQASVPRLIVNIKPVYAAVILLIHGADCIPVALGPPSLAAC

SEQ ID NO: 11398 - protein, 194 aa, Chlorella protothecoides
MGLLTPHGPPAWHPAPAELQAAARAAARAADAHGVDLPKLATMFSVANPGIATHLIGFSTPDQVRDGRSSVAGGQHLLCPEGRGMPQMAPDWQDMHGNGPTYSRRIHHPDGPGLVLTNTVSFALHTSSLNSMVPTLQVRDAVHAVLQAQGLEENAQAEQEERAMVEIREILAGTAQVTWPSGLPENSDEQLAAR

SEQ ID NO: 11399 - protein, 120 aa, Chlorella protothecoides
MYLGYVVTGARGCECQCRLEGGWFGLQGWMPNPPLCSQDVHQDTATEAVRTAFDLGITLFDTSPFYGLTKSEDVLGQALRDAGLPRDQFVLATKVGRYGQDTFDFRSAHSQPLTIAAAPG

SEQ ID NO: 11400 - protein, 274 aa, Chlorella protothecoides
  MOD_RES (93)..(96): Any amino acid
MYAADCGGQGTCTSRIFTPAESRSSWSCLAAKTTHAGGVETCAWKHIIDLSSTPISPGMAKSWRRTKVAGSPRSGVRCACRLIGWPSTSLQLXXXXIIVLSSTPSSPGMAQSWRRTKVAGSPSSGVRCACRLVGWPSTSLQLHSPSPPPHPARFGIRQGPFPLHYQTGSFSKHTLLEAGSGIGAPRRVCTWQGAVVAHIVSAPDMSKAAGLYSPLLFKQAIDALSAGATPTAVQTASMALVLSGAARALSSLTREAQHPIFTPISQACGLVESA

SEQ ID NO: 11401 - protein, 651 aa, Chlorella protothecoides
MLRLLKTDNSVVDGSHALPTAAASVADGSAPARRGATRQQASQGLAVHLQNVTYGYPGTTRNVLKGVSLSAAPGESIAIVGLCLRMCSDKEEAIPQAHFAVAPIINEGHLPPLLMPGPSGSGKSTILRLLVRLFDAGSGAVFVNGVDVRELRKKDLRGAVGVIPQDTVLFNDTLRHNVAYSRPSATFEELEKAAKAAKLDAVVARLSKGWESLVGERGLKLSGGEKQRVAIARAFLRQGAWKGARVLVHRRHDIGKPVFVIAGGALQCMACPHQPPQPPNPLREPKLIVCDEATSALDTATEKSIMGSLREVRALDYESDRSFRATRRIPGTLTVLYYTDLSLPNPAGLRQDLRAEGRHRGGAGEPSAAAGKGRLVPRDVAPPGSRAGPLDFTVAGWKKSAISDCLKHTSQPSPDTPQAVDSICSHDAEDAVIDGPLPGTKEEEVWREGWREGWQQGLEEGQAAGVENEELGGGTPAQAASSPVLFIAWAAASRFLLWHHCQIGLYFHSDADSRLQGNMGELRWVREQAPIAKSCTSAVERTCDHPVRPRVHGAHPPPQPRPARPTGATRLTQPPTPLCSAPRRLPSTPPSAWPGVAWASYGGEGSTRNGGACQLAPRHGVPPLRTMALRATAPSPETRSTIHRKTSGGAP

SEQ ID NO: 11402 - protein, 225 aa, Chlorella protothecoides
  MOD_RES (39)..(42): Any amino acid
MYVGDFCRPLAPLLWLALLTQSPQTGPTPDRTADEGHPXXXXASCLMHPRCAGAYRQTLENVCWRLLPAPRTLALACASDPIPPTGPTPDHTADEGHPVRGRPSHRPCSAAGAAAGAGSIHQQVGGGGGGVCLRGAASQPWGRLGRRQPHRTNSLAQCREGFLGLSVTGTIRQCHKLGLKDAAARFAREHKVPEKQAQLLALDAAAAQHDWVGLQAKVRSAAVFL

SEQ ID NO: 11403 - protein, 75 aa, Chlorella protothecoides
MPLPPNLMIPLQEEAAASHVRVVDHLGRSQATGKRKTSIARVWIWEGQGALGSCGGLGTRDPLLREVACRGACRT

SEQ ID NO: 11404 - protein, 971 aa, Chlorella protothecoides
  MOD_RES (44)..(47): Any amino acid
  MOD_RES (408)..(411): Any amino acid
  MOD_RES (625)..(627): Any amino acid
  MOD_RES (645)..(648): Any amino acid
MFAGKHINHTEDRAVLHTALRASRDESEPSPPSLPGDMSADPSXXXXASVGCTRLPECSPHPVLHTALQQVFTDGKDVVPDVHAVLDRIKDFSVRAIPPESARGHVSRPQQGPPQPPGISTQPPPLSLPKPAERVRSGEWRGATGKKLKDVVAVGIGGSYLGPAFVHTALSFDHKSQEEAEGRKLRFLANVDPVDVAKALHGLRAETTLVIVVSKTFTTTETMLNARTVRCACLEGWCREGLGVCVWVFCSEKVHSEHLRPRQSSTSHLCGRAPDPKRAHRTTVCTPQDMAEGRTWTGGSVQAYGRGLHQPQAGEGVWHRHRGAMEKGGIGRGWGVVSPISSVHSVAWAGGRSKGVICHPGEASLPWLRPAPSLAFTSMPSSPAPPPPSFPLPERIWVLGLGGRPLLXXXXRWASCPWHCSMDTRYAGAGKRAEGMQQKRDCPLHTAAVMIHHSPCHAAESGGVPGGGSGCRPALQDGALCIQPAGPPGPAQVGTAGGEALHEVILKDMGSVLLKPLSPAHVPILPISPPLSLSIWNSTFMKRSSIAILPYCQALAKFPAHIQQVQKLGGFADGWGSRCVHSANRVLEAGHCVAEPGAPHIGCPPGFPCALTLPALLFFGRIVVXXXQLLTYPLTGPPPPRCPWXXXXTIDQPTHWSAPAQVSMESLGKQVSMEGDALPFKAGEVIFGEPGTNGQHSFYQLIHQVQGGPRGGRLETCVSNALHTIASTLHTRSVGPCRARRVHRRGEEPAERVSQGRAGEQPRRAHVQLLRPSRCAGHGQGVSGAAGRGPSPVHHPPQNVQRWVAACTWGVGEEWRGGGVILFMAWRERDAELVDGRLLEDWRHVWRTTCLRDPGVACLSGKVPAALITALSAPSASPIPTSTIPAQSTGNRPSTSLLLPDMTPFTVGQLLSLYENRVAVQGFIWDINAFDQWGVELGKVGHGGWATWSGLQRGMAGWLGGSEEEAHARQA

SEQ ID NO: 11405 - protein, 134 aa, Chlorella protothecoides
  MOD_RES (72)..(75): Any amino acid
MQAGCACHVIVKHTGPKAPDTPPSQQTPGPGLQGEDEDARGSHQAAQDPEGGRLQPLLTQDDQQVSGGQGPXXXXAWHSPTEHDPPAAHPTPCRYLEGKAQLLYPEPRDVFPCELIHSEACVAPWDKHESEAED

SEQ ID NO: 11406 - protein, 552 aa, Chlorella protothecoides
  MOD_RES (26)..(29): Any amino acid
  MOD_RES (475)..(478): Any amino acid
MLTLTSTASECTQFTSEYHRSWFGLXXXXPPGGRERRGRRRPLGTTNCPLLTTTSTLHWSLQYVASEYYPYIRSSTPDFELWNRPRSGPCNLFVWRERNLVSAEELSGTLDCRTYKSPGRIDTVTGVARDYLVVKDAFTVDDLSVTVSIAHPDVASLKVVMCCLTDCSTYGWMRLQVCRLPQHRVHEIVCNAHGNPPRARRGSLTMGMWKASTPLSSAQVTLTAEPPIVSAEALPTSSRTIVLKQGGVGGAGSILRKTTFNDSATSGLSSAESVDLEGGGSWTFSGPEWPMPQTHHDLYLSGGLLHTEWARSAFNCTNAPLTIPLCYLQQSDAPFTDSYIPTQRLGFMFEDGDGKDASDGGSEGTWILQVEDPLENSTTRQIALNGWALTLCGMQEVGGICLMFREWSGLGSGCTFLMGLQTRPPITCAPATVKGDQESAWHGVTSLPHPGRDHLTYPTLLQAGEAAKAPSQEAXXXXSPLPPGEAAEAPSQEATTPMMERPLVTASNGPPPPAALQMNVVKSPATRCARDREVRPLGCLRNSSRKALRASS

SEQ ID NO: 11407 - protein, 129 aa, Chlorella protothecoides
MVLAELGQRVTQALASLSAAPVIDEAVLDACLKEIAAALLQADVNVRLVASLRNNVKKRVNVSELGRGLSKQRIIEKVTGNIHACLQSWPSLDPAGLRTGEQMRSIDDAALRPHPPTSKSLTVYLAGCV

SEQ ID NO: 11408 - protein, 217 aa, Chlorella protothecoides
MTSTAISCHLLVFSSEPLDLPPGAGKTTTCTKYAHYYKRKGFKPAMVCADTFRAGAFDQLKQNATKAQVGAVLRFSDDSGQFPVPGLLCGNLKAAAGSYLHCGSRSSYSAAEQCPLGMHAVALMVHSCPQQDALFNTHHFPDSILRELHRDRSGGDCSARCRTVQAGEALLGVPSTCSSSYPFRDLIIVDTSGRHKQEESLFEEMRQVAAGEQMGDG

SEQ ID NO: 11409 - protein, 226 aa, Chlorella protothecoides
  MOD_RES (10)..(13): Any amino acid
MPSEPCMDTXXXXFCSESWQRWWVAIWTEWGLYAIGALHGHGKGLHLDLHLELTIPRYTRQLAAVQPDHVIFVMDGSIGQAAFDQAKAFHDSVDAGLKPVEMSSTICTACWEDTLSGMLLRLDLSLWKCPAPFAQRAGVGQVIITKLDGHAKGGGALSAVAATQSPITFIGTVDSLTPTGEHMHEFEHFEAKKFVGRLLGKGDWGGFIDKVKDAIPEVSSQWPCPG

SEQ ID NO: 11410 - protein, 428 aa, Chlorella protothecoides
  MOD_RES (266)..(268): Any amino acid
  MOD_RES (414)..(416): Any amino acid
MKSPQVALPASALRLVMGECSTALNAGQQHAQMLGGHRPPAAAAGRHKDPTPRHALTCNMNGKIVTFSHAWHVGDITLQTTHPACACLMQFRMASRAPCRCTRARSMQQGASSGRRATRPCMQSWVRAWPGGYTSSPTTAPRSDTGPGRAAAASSLPICISPAPPRQEPWCVDGRLWRVGWVREGSNGSVCVMQDSRVQPLPSAPSGVLCHQPPVGRQDPIAAAAAPGPGGQQRCNSRGAELAKRLFVYNSSENAMLKALALAGAXXXGAHCTHPLSAIASVPTLETLQVAAAPYRGLVDCLVKIGRQEGIRGLYKGLVPSLFLVSHGAIQFAVYEELKALAAGRRRSTAPAQRAQREPGRAPLSSLEITVCGALSKLSASVATYPSQARPSAWGSVAGCRGDERGPADSGPSXXXVATYPSQARPPA

SEQ ID NO: 11411 - protein, 114 aa, Chlorella protothecoides
MRSTPMLSPDQGQCWVLADNEELQPPAVLDSRTFGPLDLSSIIGRWIIVVDRSGDWHLFVVELSCGYPVPLTWTANSRSPSDHGPVENSTAAMQADVAVLEAELDIDKLCKQEQ

SEQ ID NO: 11412 - protein, 159 aa, Chlorella protothecoides
MATRAWNLRYSLLKLKHAVSEAVASPHQGSVADVLQTTVEAYQRRLTQVIALAGVSMAPTLNPLGTKDPGAVEQLLVRQIPRPSTSNVWVGDVVALKTPSSLQPISLANTEHVDYMVRRVAAMPGEELVTDDPEDEPVVLQQVGTRGGVACPALRSTDV

SEQ ID NO: 11413 - protein, 380 aa, Chlorella protothecoides
  MOD_RES (258)..(261): Any amino acid
MDEHPCTRACACNFRIRLQRASFVSKQQKLQLGSSADHGAHPRPELSCRGTPWPALGCTLTVPTWSFPKAPHGAWGRSPWYERFELIAWNPLLFPDQPVGCSACLTVGGAALPLLARNHTGLGCRHPLTISSVAARASGGNEDRNTSRDSNDPVWGWLSVPASCHASCQTAALTCISNGMVLLRVLATWSLTQTLQSSKEPIEFGHTRKDVVLIGVGLIGVSVPACTARGWEPTGTHVPSCTPSPCVPALMPGHHLDXXXXLRAQPGVGSRLAPMFCPALRPPATLRSCLDTISTVQALGLDAGSAGNWVQLSVFLGICVFWIGSYIWRVGTKNMTYAKQLSDYEAAVMQKRFEELPEAEIQSILKEQEGSKNSGPLSSQ

SEQ ID NO: 11414 - protein, 294 aa, Chlorella protothecoides
  MOD_RES (176)..(179): Any amino acid
MSKCLPLPCPFPCPRHQDLWTSFLCEFVVHVVRQPVTVVGNSIGGFVAASLAGDHPSLVHGVGGGGSVARWWGGVFHACVSAHSASKHPEQCSRLRDADSTICHPHTLFSAGLVLVNSAGKVEPGYVAPEKTYSDVAQSGSPLLSPTLINLVSSVRGLAKGRGKGAVLDNRIDVLXXXXGVGQRNSAGQSYRCPGHTHEKSFMPIPFQGLFGLLKGNVKRQLKQLYPSAPERADAWLAAEIVRAATDPGSKGVFTSVFYLQKPRPLNHLVAEMYGGPVLVLQVLGGGKEEKSLA

SEQ ID NO: 11415 - protein, 91 aa, Chlorella protothecoides
MLERGSRSIAVIFRAIAFTAIPTFLELAAVCTILARTFDARVSALVLTTFAAYAGWTIAIARVRAAGGSTRLIVGWLGRSGGGMLHGGYLQ

SEQ ID NO: 11416 - protein, 199 aa, Chlorella protothecoides
MDRFQRMLGQGGLGGAGAVAGDAPQQDTSEQIYISSLALLKMLKHGRAGVPLEVMGLMLGEFVDEYTVKVVDVFAMPQSGTGVSVEAVDPVFQTRMLDMLKQVGRPEMVVGWYHSHPGFGCWLSGVDVNTQQSFEALNQRAVAVVIDPIQSVKGKVVIDAFRCISPQTMMLGQEPRQTTSNVGHLNKPSIQVQHGGRVV

SEQ ID NO: 11417 - protein, 385 aa, Chlorella protothecoides
MTGGSQGGDGWRIAEQHTASIAHSSLIAALMTVWPSQFPSSTSAKNSVRKRLVFLNGAPAPAQTTVVPGDTLCIRQRTRTVQRNPLPAATQEAAAAVRVVWQDGCLAFVEKPRGLATRAGSGPGPTLAACLPAVLAPGPGADALPDPAPVHRLDGPTGGLVLVAKTRAALRLASTAFAAREVRKRYRAVVWGRLAAGGVVDIPLDGKPASTGYSPLRWHPMEPSGGRDAGGGTGERGAGSLEGNRWTGPRGAAPGSALAVTVLDLAPVTGRTHQLRRHLALMGHPIVGDPKYTSGYAAQRALALGDPAAEEGWRAGGGQTVAPGAIAGATPHLPTGLHLWSVGLGLRHPITSEPLTLQLDEPPEVAALLEALQRMHERWRLLHGV

SEQ ID NO: 11418 - protein, 135 aa, Chlorella protothecoides
MLLNLQASTLALVYVGTLVAKDDVYLKGWQCALASEERLMYRSPVLQKHTWTKGLKLTDFDEHALKNGKLLTEAQDLTEKYEKLIVEEEDISLEKRVVAKAGKMDAKKRLEENVQTLLSDNIVQCMGAMVDTVVF

SEQ ID NO: 11419 - protein, 127 aa, Chlorella protothecoides
MMVNKQPYDQYFKTLPRRNDVITPFAVTNTLGSFDVMVNVIGGGTTGQSQGNLQHCLVACIPPPPQTMQAVRHGIAKALQFFDPAHRPELKSAGLLTRDARVVERKKPGRWAESSELMGKACALHAV

SEQ ID NO: 11420 - protein, 70 aa, Chlorella protothecoides
MEGVSALLNAGQAFVLAAGMAAVLLVTVRSKPGFTAGDLGLLLQVWSPLSFLGWFYRELRQSLVDLVSVG

SEQ ID NO: 11421 - protein, 134 aa, Chlorella protothecoides
MAQALTSPRIQRTSPGYGVFKGCWRAPPQPAFRHARNPRGVVRSRAQPTKAVIDVSESTFEAEVLKEYKGTLKVVKIETDPNPGIVEKYKVYGLPCLLLFADGKEVPGSRHEGGITKQGLVKYLDKNNVAAKPA

SEQ ID NO: 11422 - protein, 67 aa, Chlorella protothecoides
MATVWDEAQVRLYIGSASRPDIHIYSAAGRQLGLVLWERGSVLAAGWSSAEELLVVEEEGTVRGLLV

SEQ ID NO: 11423 - protein, 182 aa, Chlorella protothecoides
MPLHAGEPTPQADAAPAPKGKAKPAGKKQKETKLGMRATKDGDFSEWYSQVVIESEMISHYDVSGCYILRPWAYAIWDEIKNWFDAEIKKLGVQVITEGVGGGEAWEWLTVLQVVHQNPEWSQGLVCEWKHLLWARRELPLDARANAYFPLFITEEALTTEKDHVEGFAAEVWGGVDADSLE

SEQ ID NO: 11424 - protein, 280 aa, Chlorella protothecoides
MTDPDVEQPDWELSKENFQPLRQGRKGAGLKDNTEELRSANLDAVKRFIDWTRETYTAGGHKAELIPLLERCTSTLQSDERYRNDPRFLRIWILYLTLPFLPHQKQYKADCLAEPEDVFSFLAQNDIGQGHALFHIAHATCLELRGAFGRADAAYLRGIDLHAAPLERLKAKHTEFQYRMVGAGWYGARRIQRDAAASATALGPVETGAAAPARRFGQAVGALGGARPPGGRPAFAPLGRAAAAAAGQVRGGSAAGAAPLSVLADDPGAPACPGPSLTAR

SEQ ID NO: 11425 - protein, 150 aa, Chlorella protothecoides
MFARLTALVGSGNSLPLEVTGEPSLIWGSWTHTSGKWKADGSAVSVFRVASSNPSDPKLAAARNGTKRLRTVSSWMLEYGYGGGAGQASREGEQPRRSTFHLQLRHPNVLIFKETLELEEKGEQAIYLITEAIVPLAEFLESTTLTGTDR

SEQ ID NO: 11426 - protein, 202 aa, Chlorella protothecoides
MEQLEAEGWEPLVRRLVRRRHYHLALSVARAQGLPGEAVLSAWACDKVTACGGLLGDAELLAALKARLLKSGNVEEGGPGLCFVHCSSRGRRWEATPEHATSNRPITPTFHAPPQSKLDGAGGVEWANIASHAAGQGRPKLAALLLDMEHRAHQQVPLLLELGAETGKRRGPAQGAACAAAARRPVCGSAACDLFIRTPISA

SEQ ID NO: 11427 - protein, 504 aa, Chlorella protothecoides
MCAILYDRRQLARSHSLPGLPLALSACGTLLALAAPHPLEGGLWLARAAGRRSVQFASPASLAAAAGAAMGLDGADRACAGPMRPREVRFAPGAASLAFLADAGGCDSGPEAATAFVARVPRAWRDAGAGAVWGSPPTRQLVALRLPEPPLALAYRAEPPSTKTPRPRNLLIVWTATGAWQVRLPANFADGLPPTRRLAGSEAAAAGASPASCAMSPDPTTDRLLLASTDAETRDVAQERRRYATLDLGTGRLRLVGEYSAGVGLGGGPLDREGSPAPSTTQPPAPAAFWSPDGRSAAFASPHSGGGWQVYVASGVGRGDDPGDGDAAGTVAGVTSHPTPLPPRSVFVEVGAGAGAGTHGAAAWVRDGEVALNPLPAAQGPSPGWLAGAWLAAWGAPPHPASLFGREAPGAPRESVPALDFGAWLLRTLRPGDRLWLRLDVAGAELELLAQLLQDGSLARAGRVSVAWGDGVRPLSGQLAATWRSVFDLLGVAWSDPGSPALEP

SEQ ID NO: 11428 - protein, 277 aa, Chlorella protothecoides
MGRRGMPRQGPRSPGSRWWCRPARSAASSFQVLPKFLKAAVTAIHLPNMCHIVGRAWAWQVLPTPGPHVRRAQHAEHPRSALGILGAKMGWPVPCSHIPANVISRVVTLGLGSSLGVVGRQSPLQARTSIGSGSHCGLRMAGIAHSLRQAPCLAALRGCARLSTSAPVRGLEELIVKAPKEGEAVVKAGRAWEAAELRLKSWDDLHALWFVLLKERNRLHAERMMHQHLKTNMPEITRYKKVKLSMNRIKQVMSQRALNEHTDPIVQAKLKAFINAL

SEQ ID NO: 11429 - protein, 289 aa, Chlorella protothecoides
  MOD_RES (39)..(42): Any amino acid
  MOD_RES (107)..(110): Any amino acid
MLLPAPGRAPASLLLHPTCQCQAWARRLSRKHCDMHIRXXXXPGDCMPWYWMPIWLPLECSAATGSIAICTFALPPPTFSKCPSPPSPMPPPELERALEADLSFSPXXXXIPTHPMAPPELERALEADLSFSPEFSRFREAAKSGNLVPLYERVFSDQLTPVSAYRCLVRADDREAPSFLFESVINGTQQGRYSFVGAHPSLEIVAHANAVTVLDNEAGTTRSFEAPDPLQAREWMCCLNRGKEWWGGRESVWLRDAACFSVAVVLGMCSGLHLLYPAEFHGGACSSIL

SEQ ID NO: 11430 - protein, 250 aa, Chlorella protothecoides
  MOD_RES (82)..(85): Any amino acid
MGVAPRELDPLSASGLPIPVPTPTAQVGPAEAAEATGREVIYNADVLHEKLEDFGWSEQERWEETLVITSEAPTSIANVEDXXXXAVGGDAGDHGRGPHHHRQRGGRPRAGAGLLQPGRGGHAGRHRAHGGGGPGLGPAAGLPRGDGQVGRAHGQDQGADAAPVQAGDRNGAAEEGPRVQALCQAGAGGEEEGAGAGEEGLHLRRVQAAQAAQAVGAWACSVWGMVSFLHVLWGEGDGLGLAAGEQRTEE

SEQ ID NO: 11431 - protein, 705 aa, Chlorella protothecoides
  MOD_RES (433)..(436): Any amino acid
  MOD_RES (572)..(574): Any amino acid
MVSGRVLEGFCQRGGPFNCWLSLSLGTGHRPFAGHGLPPAVHAASLTAWATLHVLHEGAARQVTVPLTTPFKLIPVHIHNRPPSYFILGGLVFTPVTVPLLRSEYGKEFDYDAPVKLLDKMMHAMADAPGQQIVVLAQVLAADVNVGYEDIVNTQVHAVNGQRVTCLAELVAAAEGGAGEYIRLDLEYNQVVILGKEEAAAAMPAILEQHCIAADRSEDLRPAARGGGWAGFRAVAGGGHALERGPAGAAGHETWDASQRPRGLLGLDQEFDRGRALTSPDPSMTHHLESETPSTLPLARPPPPEPPFMCCSTPVHCPALLIITAAAVLVMSHRVCFQYQAPMHASMVGDRHHHRPQRCPATTIRGAWGSGWRRQRPPAAPGTGPSWRPRRPARPRVGAAAPRASTRHSARAFPETPRACAGFVRGDWTRWPXXXXFPETPRACAVSCEGTGPGGQGLVCSARLRPSCLIVTQNEAWEPQRYSPLTRPRNLSDTVRCPSQASRSSPPPSPWQNLHRLAWPWRPGRSRRRPAHLPRPAAGGARGSPPAPASPPAGPPAPPPAPPGPLPWGALXXXGVLPRPLLLPSGHPRGHPRLPALCPGVHRVDPLPLGRGAAPRRLAPVPRCRLARRGLQVHVVGDGRRQAHRRAIGRRRPGAGETPGVARPLRRGSGDAGVELGGQGAGVPLSHKVPEEGMGRLRVQVTVAR

SEQ ID NO: 11432 - protein, 323 aa, Chlorella protothecoides
  MOD_RES (29)..(32): Any amino acid
  MOD_RES (201)..(204): Any amino acid
MRIGEVVGIGEVIGIGEVGAACKLSVFKXXXXGTLRVRDACSYGLRACFSMSSAAGIGVQTISFQGLVLSKSSQTHPCSMPQVDAAINSGNSGGPAFSDRGGMSRGKGGHAGGFRQDKAVVMGQRRPTHRGMLSHACEPLVCLWATPSSSPPSDHQFYRPPPAPAGECVGIAFQSLKHEDAENISYIIPTPGVDSWEGGPXXXXLKHEDAENISYIIPTPGMGSWDVSLHVKLPRMACTFPPACPVIEHFINDYERNQAYTGFPSLGVEWQKMESPVLRKALGMQVWPWGSKGGDTQGLWEGLMTQRWGKRQQRGPGAVSQVV

SEQ ID NO: 11433 - protein, 327 aa, Chlorella protothecoides
  MOD_RES (47)..(50): Any amino acid
MRVSCQRSPYKRYSLVADDFGGVPRPHARRKYHPCSLAQSPALDPDXXXXLIMAPRSKNQASKLPEDSIQKSPALDPDTSNGPSSQVSTRSQAPQKRRTPAGLSGPATGSQAREQVDTAPGSPTQGGRKRRKERLAASAPGSTSAAALSELDCGGGGEGAPPALQAYAAEDDGGASPREAEMEAVVKVFAVHSEPNFSLPWQRKRQFSSSGSGFVVAGRRILTNAHCVDHHTQVKVKRRGSDAKYVASVLAVGQECDIAMLTVADEDFWAGLEAVRFGALPRLQDSITVIGYPIGGDTMSVTSGVVSRIEVTSYVHGAAELLGVQAG

SEQ ID NO: 11434 - protein, 347 aa, Chlorella protothecoides
  MOD_RES (4)..(6): Any amino acid
  MOD_RES (274)..(277): Any amino acid
MSSXXXVDVSPSCMHEHSVYECENAIKKHVIRHFHPQETSAETRGNASLLGKLLTTQLQKRTVVVLSCGRMHLPYIGHPKLMCSSGRDKSGRILENARSLHLHAFSAFCRWSMHSCPSSLKGIQGPARSTTICQLTLTGSPTSPCWERRDGWGFRLPGLCGVRIAIGHAPIPPPGDYSPFGCIEVVVCMAMKREWSPEWGARELRSHDSEAVARYGSTILRKYARKLNQTEREWGRARWARLDPICAPAAALSGAANPPTDSLYAVWLIHEQTXXXXAAASPGAANPPTDSLHAVWLIHEQTAQAAMDTHNEPLALSISQNVLARFPKGARGSRLAVRTEGASGISF

SEQ ID NO: 11435 - protein, 291 aa, Chlorella protothecoides
  MOD_RES (193)..(196): Any amino acid
  MOD_RES (265)..(268): Any amino acid
MNDTEVGFRGQRVCVEPLRPPSAVILYVGLQIFSCAPRRSPPPTPPGHEDDRANGPLHPAGGGGEGQRDCRGHRGGGGCRPLDSEQAQLRVTFNISKLQFVEAEKQRIKSEFERREGAIEVKKKVERSKQLNESRLKVLQAREDAVQTLLTEAHSRLAKLAKDKAKYKALLTELLIQVGTLCYTDMPEAKGSXXXXGGAVEMKRALFALVRLVALENMYRHAGSQGLQGRMCDGCPRLPLPAENWCGLRSRRTSPAQPHRHRACXXXXADAACVHPAPHQHNLTGTAPAGL

SEQ ID NO: 11436 - protein, 113 aa, Chlorella protothecoides
MATLEPYSNPLVMPLAEWIEHPIARELVHEGATLQLLGISNVSRWGGEATRLRRCFHAHAPARVELAALAARRLDGLAGAGTLEQLHASVEAHADALGERPEAWEGFAPAVAW

SEQ ID NO: 11437 - protein, 181 aa, Chlorella protothecoides
MAQSLQPGVAVVTQLRDPTSRVISAYEFAVSVAAESLGAGGEGPSLQAPEHLNYVNTMEVWPWSILIPWFRRNMQARVSVRASWNEVLPCFGPLAESRGNCAEPSCCPAGIRVGYTTGSVYRYTGLPRHATDPLHIPTAPAGGAQEGGDQRWHHHMAEVQDQEGAGVLVEQVHQRDLPHRG

SEQ ID NO: 11438 - protein, 165 aa, Chlorella protothecoides
  MOD_RES (138)..(141): Any amino acid
MRPLLLLVMLTAAQAVICRASLETNPSDEQCAAWIAAYRADHPVLDKQALNGTRPSQVYFMHIPRTGGKTCFSCFLKSAVPPSQRCLKAYDGPRLALSSPSCGLISSHDDYSLVDVSVLGWCLVGHHILRAPDPPMHXXXXGCERARLVFGRTSPPESPRPSHAQ

SEQ ID NO: 11439 - protein, 261 aa, Chlorella protothecoides
MAQGGASLLPGMCCGVETRHSRAVECCPQHVELWLALARLESYKNAQKVLNRARQAIPTSAEVWITAAKLEESAGQAEAPAKIIPRGLKSLQANGVVLDREWWLHEAEAAERTAPPLPATCRAIVAAVVDEGVEAADRKRTWVADAEEALRRGAVETARAILAAALAAFPGKKSVWRRAAALEKLHGTPEQLDALLRRAVQYCPQAEVLWLMAAKERWRGGDVGGARAVLEEAFLRNPDSEEIWLAAFKVEFESRELDRAR

SEQ ID NO: 11440 - protein, 261 aa, Chlorella protothecoides
  MOD_RES (23)..(26): Any amino acid
  MOD_RES (81)..(84): Any amino acid
MTGSGGLWMRWMVQGLGEPETWXXXXGGGGPWMRWSVQGLGEPETWQSDGGGDAGSVMGTWRPRVLPSHAGGAGLPTPSHXXXXGVEMQDRRWGLGVHAFSLPMPGVLVCPLPHTSVPTYRMILARAREHPPASTQRVWMKSAIVEREAGDAVAEAALLEEGLTRFPTAWKLHLMAGALAERQGEVERARAAYHAGIKRCLDCVPLWIAAAALEEREGALGIRTPLTLQCMHLRPACSPTVAVVGDRDLPSRAAAVPRWLS

SEQ ID NO: 11441 - protein, 260 aa, Chlorella protothecoides
  MOD_RES (14)..(16): Any amino acid
  MOD_RES (67)..(70): Any amino acid
MPLTINNHKIPATXXXGCALMALLTSPPPTAHASHHQQPQNPSNLPPSPRPSKSTRARSAGAGAAEXXXXPLGPQTARARALLEQARLKNPGQPALWLAAARTEARAGNGKAAEALLARALQACPDSGAVWAESIRAAPRPARRSRSVDALKRCNDDPTVVAAVAQLFWGERKVEKARSWFDRAVTLDPDVGDHWALYLRFEAAHGTPEAAAAVLERAVAAEPRHGERWQALAKDPVNAHQPLGTLLKKLAQTIEKDMAM

SEQ ID NO: 11442 - protein, 74 aa, Chlorella protothecoides
MAAAKLETSDEARKRVLLRALERIPQSVRLWKAVVEISDEDDARILLRCMRLEAYRKGERVCFSACVAALRRDT

SEQ ID NO: 11443 - protein, 170 aa, Chlorella protothecoides
MSIRPASSRPPQAPGAKIDFNALRAPANYVPGLGRGAAGFTTRSDIGPSMPAPDMASQACMFVRGGAGMQRGGQHHVLHTLHRNACAAEGGDDDSKFDEFLGNDGGVLAGTGAYDDEDREADAVWDQVEDRMDERRRVRAGGWGREGRGLIQGSPPGATPLAPPPRRYPP

SEQ ID NO: 11444 - protein, 229 aa, Chlorella protothecoides
MGKNSREDRSRSPSPSRAAGVSILGTCHICTLSLHSLSSRHSDLDSETAHAFFRDFVREWNSGALPSKFYTGIAAAATQRTGYTWGFSGAGTAAADRTSVGLTAAIADDMNLEASAREAAAGDRREAARRSAAAEREWIDAVHPRAEGREARVAARGREARVEARVARREEKRAREDSPEHLRLPGGGDVLGGGDSFQAAKARRVGAGSARGLGGDSSARLGRDSGLYR

SEQ ID NO: 11445 - protein, 167 aa, Chlorella protothecoides
MSRPHAMTPRGRLAGGKYSSLQRHGPPQAFCHVGAQAPAPYNPIKPSCRPSLPATGARNVDTCAVKTLKKRRLPLNTTRSPLNGFNGTPEVLPAAQEAPKIPDTSPWWMQLGPTWSLCVLTLAYLHHSTTGYALPALLPIISEDLHLVDTQAATLTAGYTVRSGWLF

SEQ ID NO: 11446 - protein, 62 aa, Chlorella protothecoides
MSLGQRPALSAATSNMTKAQFMAAVERTKEHIQAGDVFQLVGSQRFERRTFADPFEIYRQGG

SEQ ID NO: 11447 - protein, 151 aa, Chlorella protothecoides
MAPPSAQVPQTGAADPPSADEAEEEEEEARAVKRPRQGRAAHSRLALAGLRAWPPKCRPFFPPCSLIWTDALHCRFLEALETIGGVDKAPPKAIMKVRRCMLLWALPVGLGGLRGGISCGPNLAAVGLCCAVAILAPITNTLPIGQRRRWA

SEQ ID NO: 11448 - protein, 112 aa, Chlorella protothecoides
MSQRRASAKNPGERFKPRDITKKRARKDSKFGFGGKKRLLKQNDAVSSADVDGYRPSRRPDSPGGRRGGRGGGRGGGRGEGGVGRSRVSAKKGGAGPSQNRPGKARRAAMKR

SEQ ID NO: 11449 - protein, 179 aa, Chlorella protothecoides
MQIIDELEVTRRGPYGGGLGHVSFAGGLDMALALRTMVIPTSSQTSLYQYGRGSAGAPPRREWTVHMQVRVCIWEGGCRVCIWEGGCMGGEAGGRGCRAGAGAASPCRCGATRLHHAPAHQGPPALLMAPLLQSGAGFVADSDPEKEWEETVNKAAGLGRAIDLAEQAFVGQAGREQEG

SEQ ID NO: 11450 - protein, 252 aa, Chlorella protothecoides
MKEELERFRAANPRIGDLFTDLKRGLAELDASAWEAIPEIGDTTVKRARRAEIFTPVPDSLLARAAATAGDAPGLTSLDPGGVGPGTETPGAATSLTAIGAGRSTVVQLKLDRLSDSVTGQTVVDPRGYLTDLKSVTLKSDAEISDIKKARLLLKSVIKTNPAHGPGWVAAARLEEVAGKLPAARELALKGCELAPGYIDVWLEAARLQEPENAKAILARGVAALPEAGMSGYCAGVRGGAGGRKGPGMGQA

SEQ ID NO: 11451 - protein, 134 aa, Chlorella protothecoides
MAKPMHAWKSAPTIEDSLPLTSDTAPPSVASPLAGTRPRGATQEADEALEADLLADEKELAEHIMLVDLGRNDVGRVARHGSVKVEALMEVERYSHVMHISSTVTGRLRPGLNAWDALRAALPVGTISGAPKVG

SEQ ID NO: 11452 - protein, 519 aa, Chlorella protothecoides
  MOD_RES (51)..(54): Any amino acid
  MOD_RES (177)..(180): Any amino acid
  MOD_RES (469)..(471): Any amino acid
PVQVQQGHEVEQLGVHTVLPGNVGQAATQRQQGPAHLVVSNEESEGSRRDXXXXCPAAVAGQQWVGGAVLGAAGALLGFCGHHGLQAGMAHVASSPVWRGYRGGRRVGGGGPHIWCKQRTEGKMDHVVVQLPRVLIIDLCATMCESTLEPKLAIHAPQAAMRPSPGAPPKPHLHRTXXXXLRQPRGHHQGGRCRRRLCAPRHVHHARESRAGHPGQRPRRAGSAAAWTPGAGFGGGGHGHQVCRDPGEARCVISSRSESPAGRDSTLDFAGLFGFGDEVRTMLPVAILRAGPRAGVQSVILRPATPPTRTCADKESACATPARAARRTGFVPPGLATPVKHGPDRGMSPCLSAARLPSLRPLPACTRAGPGALPSPVPSMRVIFVTTEVAPWSKVGGLADVMGALPPALAARWDGVGGLGRAGHPGKSRDPWLGPVPECLWVSGRTATAVPSRLPDPPTLHTPVQGPPXXXSPCSQVGWSGWPGSGWPSWQVSGTLAWASAGVLVVQRQGGHRRSIALS

SEQ ID NO: 11453 - protein, 142 aa, Chlorella protothecoides
MTVSPRYQAAEDVLPTDLSVPLDLPAPEERGPDEGDEEADEALDTTARLFLARQDGVDHVFVDHPLFLAGGDIYSCGPSLGVTTYMEAGQGAAAASLDLRYSVLCQAALAAPLLLWAAGVREAAAAAAVGAAMGAALDAAAA

SEQ ID NO: 11454 - protein, 162 aa, Chlorella protothecoides
  MOD_RES (88)..(90): Any amino acid
MVMRSRPWRAANSASCGARAMVPSSSSFTTSASAPAGKQPARRVRSTPASVCPGRCSTPPWEWGAGGMGLRRASPVRWHRGRDPGPRXXXPWEWGAGGMGMRRTSPVRLHRGRDPGPHALRGAGCWVEGGGPESGVPGAGCRDAEEAPGPAWQHGAPAVALP

SEQ ID NO: 11455 - protein, 71 aa, Chlorella protothecoides
MPPAPHSQGGVLQRPGHTEAGVDLTLLAGCFPAGALAEVVNDDEDGTMARAPQLAEFAARHGLLRITIADL

SEQ ID NO: 11456 - protein, 199 aa, Chlorella protothecoides
MLRLGQALRQQAPRPAQRRPAPPTSPSPAAKARPPAPSRVASWAAPSSRPTPATVARWRAVRVGSEVQGEMRRRLESWAVPDWHNHAPESCVPRTPRSPNPLPPTQAVCLELEADNPRDKHATLVLDAGSGAALGHVPREVARLLGPLLAAQLVAVEGCVLEAPASSRASVPVEFQVGAAGRWVACLCRGGCVCEDGRG

SEQ ID NO: 11457 - protein, 896 aa, Chlorella protothecoides
  MOD_RES (323)..(326): Any amino acid
  MOD_RES (810)..(813): Any amino acid
MPRTSRRMALSAPISCSIESLGALYLRPFTGLHIERRNWLRRSKAGVEENSDRLDEFRWRVLAIMSDAGMAENVQSLSLEEPKVPSEGRSEAEKAAKKAAKAAAKAQKEAEKAAKAASRGQKQASVTEADPNDPLASQYGDVELVQSQTISGNVWTKVEKLDPSIEGTTVLVRARVQTVRGKGKSAFLVLRQELATVQAVLFVDDNTVSKGMVKYASAITRESVVDVTGVVVRPLAPVEGCSQSEVELKVTAIRCVARAGPLPFEIADAGEAQKGNAPCTWCGGHIQGHGSWRAGRHRLAGHASGQQDHRSPHPRQPLHLQGXXXXSAVTQLFREFLLKEDFVEIHTPKLLGGASEGGASVFKLDYMGQPACLAQSASNTHINVPHPSCNVCSRHSFTSRWPSVQTCLVCLRSARSSGGQKYTSERPGFLTVYEAKVTPHPVVDCHADAPKLSIPFHARAENSYTHRHLCEFTGLDMEMTINESYHEVLDVVDRLFHTMFESAQRPLSNVPPRFNLNLQSPAPSCAPLNPQGLNERCARELTTINSQYPFAPLKFLPKAPRLEFAEGIKMLQEAGYDSPVRLTAHAPTLVFQVDPFGDLNTELERVLGKIVAEKYNTGASYIQRLPPHPADFYILHRYPSAIRPFYTMPCKDDERYSCSYDIFIRGEEIISGAQFPVASESSSYPTMSQRIHDPSLLERRAKECGIPVETIQAYVDSFKYGAWPHGGIGVGMERVEATSAKSACLAFAPPADLLSLTQAPSCCAGHALLWPGQCAEDVDRPGGHVVAQDLDIQERDRGKVLEDEQSLGSXXXXVVAQDLDLQERDRGRLLEDEQSLGLSFRPSRGALWDADISDPSPGQPTTQGLSTISHQSDCAPWPDPESSWLPKVALDATRTA

SEQ ID NO: 11458 - protein, 645 aa, Chlorella protothecoides
MSNEPAISESPLTGTHLATSEGLSSATAILVEGKGIDEKTHELTPLALVPATRILIELLLTQLVPSADQIGAMQCARVTQPSVAGNGIRWEGDGRDVSDRPMWCAAPSLGGHDGGLRPVPAFAAWPSPTTRAAGPTLMLARIPLMTRCGTGETCWGCHEVPGSIEQADGPLSLRFSLPSPLSSLSAQQDIQRGRDMVDSLFQGGQAIGGTHNAILSSEEYLSTAQRTLGNIEDGFYISPAFLDKLSIHVAKNFLDLPKIKVPLILGIWGGKGQGKTFQCNLAFKKLGIAPIVMSAGELESGNAGEPAKLIRQRYREASDTIKKGKMSSLFINDLDAGAGRMGSATQYTVNNQMVNATLMNIADNPTKCVGAGEGLWTPVASIVLTPCEKHTRGIGGMLPFLCAHHPIAHSLAHFSSGITQNESCPALTTAPTRPAHVTRSVQLPGVYKQEEIPRVPVVCTGNDFSTLYAPLIRDGRMEKFYWAPTREVGDWGDLCHACTCLAVSDCSWQSRQRVLYDQGASPPDRVGVCNGIFQHDDVNLKEIEKLVDAFPGQSIDFFGALRARVYDDKVREWISGTGIEAIGKRLVNSREGKVTFDKPMMTLDVLMKYGNALVGEQENVKRVQLAESYMSGAALAGSTGSSHAE

SEQ ID NO: 11459 - protein, 103 aa, Chlorella protothecoides
MTYLSTAKVGCQGSGSLPLGGGVILGHRPFTPVYDLHPSIQLIPHDIRAQRHLQQHGSVHITALGTALSSLVTLSEVLKNSKLVDEVKLTTCLEHFKDEFRYG

SEQ ID NO: 11460 - protein, 321 aa, Chlorella protothecoides
MLASQTFGPGSVCGRRRQTISHGQDKTGAGDQVYCNYFRVTCGWPFIPLEEGFRTASRIRQAARRSYSTIARVLPMVPESVEWLWAVVFTSVSRVSQQGRGYRHRRDNSVAPCVHRIQAAEKAAEIAKNASQQGLVGCGFVSEKFRIHPFAALSRFYAATGRQVLAGGAAEQAAKKFGKLGLQEKLGPRAAKERKPSPDELAAVGINDSYLNMVSELHFSTFRQAGSGGCQDAGRSAISVSPTAGLEACMPNPVAVLEPSLLLYLFPTACRDFPKDKLLPVQGQPVDDQEFLLNPWQIQHATLLCAEAKDIHELRFMLCPR

SEQ ID NO: 11461 - protein, 158 aa, Chlorella protothecoides
  MOD_RES (115)..(117): Any amino acid
MQHERLAAVFHESRRRFTESQSQEPLSASPSGNDDSAAWRGTEAEATEMIVHHASILRNKRLLFTYMYVEKVPAAGGSESACSRALRGTLLLLVCMHGCASKQDRHAGKNGPSTXXXLRSHAGSWESTRVTSSSQWSLGVFKDGDSIDRYLSPGMVNF

SEQ ID NO: 11462 - protein, 210 aa, Chlorella protothecoides
MVALPSRIDMCTCHSSRVNIDVFFAFHYGKRQSPLFIVLGNSKCFYNSSHPIRCRRERTDRLQEFRWTHRSLPAHVQNNLSPLELQYFAGYDQLLNKYMRSGRLGVGLDLTADPTPPEDPFVQVRVLRDYGEVMFSSAEGHGKYCRKGIRGRVEGSIRIVETQGMRIQVGASSFCATAAEGKLLHRTRQFGTPHVAGAGPVVALHSARHI

SEQ ID NO: 11463 - protein, 522 aa, Chlorella protothecoides
MVASERLEHLLPVSLKEDVKGPCFGHTGMLAAAQAIFMDMKERGILTPLVGSEAAADDYSAPRGEGPPQRESQYDADTGPSPLRAAMGSAGQAIREGVAAVLPAGGWTGACRPGDAAGDDIEAQRAAARGEVRGERGVGAYSLPLPDECIPPGSQQTSTIPAHHASRFRRTTCHGGQAGGAKVAGPEGGGADEGEAAGGRLAAHGGGTQVSDWYRKACLQWGCLCSGQLLTLVRNSAARCKTRARLLPCSVAVLNSSNACLLHPHTNIHPNAHSLGAGAAALISLQLLDHCPGLKCLAYSCPGALVSKNLAHAMASFTTTGGAWDAVGLVVVGKDAVPRASVANLGRLMDEMVTSLARCKQPKLKVTFYPWWKRKKQDFKNLFWDYDKIPEESLEVLRGYYDSRCGERGLACVILETELLRSGRAWPCMAGDVHQFLAGRSLVGGSCCPPLSCRVSGGQPMSMYPPGRLIFVRPIKTRRKKAWDCVWISPEDIIGKTGGRSVLPDATLNRKGLHPTSAMYSS

SEQ ID NO: 11464 - protein, 329 aa, Chlorella protothecoides
MVGHLITSSILNLQLLLLKAAVALRPTQGCLHDGHISLVHAAGSRCDVVIASIYVNPTQFSANEDFGVYPRSTERDLDLLAKAGCVAVFMPAALYHPGSSSLGSGDASMVVGAAQGEAASDAHSTWVNVEGLSQGLCAGSRPHFFRGVATERVSPHINTLSLQVVTKLFNIVEPDMAFFGKKDYQQWRILERLARDLDFGIEVVGLPIQREADGLAMSSRNVLLAPDHRAAAPGIYKALRALEAEVATRRRASGTASVLTVQEAQRSVSRSLEALGGAVDYVQLVDAASLRPLAAGADLAAGPPMVLLAVAVVFGRVRLIDNLEIQGRA

SEQ ID NO: 11465 - protein, 610 aa, Chlorella protothecoides
MRRRPAGKRPPLSNIAELTSGLLSHVDLEATDLMTAVILTSAAQNRRRRLRLAKALLPVYEALRQTGSRSSRSDPGTAASSAGGSDSDSEAESGDEAGASSDGSSVHDVPASRRLTRRLEGGHSERGRAAAPRETVPRGPSRFDPGPGLAGPRSRKIVTFEQLVSPGQPVEGGEPRPEAPEVVIDTAASLPLTESNVALMDRLASASVGGEESAAGGGDDGKQEAAAVAVTNELHDLAANTGQGGEASESVAKGLGKLATSVDATEGSKEPHARASVPSPASSCDLFECLSCTGCQALILECQMSGTSPPYSVQHSAPARSVLVPCTDAGELADALADAIQDELEDLGGGDIGATHEDAVLQVDKAPSLDLALLADGASSIWLNPSVATQAPSVSNQGEEAAPGSPRRTQDAEFPAGVSDSGPPDSPSVPPATGSSPSTQPPPVTVPEGVDPLPSREAVVAARQAGAPGSEGRLPSEASQGARSGSVRDLASVTLRFPTVITPSQYVNRLAGKLPPEALADIYAGRHDRVGVEVLEEATYFLKYAYAVYSLQPKIENPSSILDMACWKPPAPQDVSRGEGRGGGGWGSVDLGYQGWRSATVSSSHTPAAP

SEQ ID NO: 11466 - protein, 217 aa, Chlorella protothecoides
MPAVRLWGRRWHFSTDIVPIPAAINGAFHFVWICVLLFGAIGSGEWPSGCNSATGRQYVALFAGLFGAFVLNLIIDVLLYIHGMKGSPFEVSKRHWVPTLLHISTLPIVAQFVFTGRSLGGPQRVDVIRCLKAVARRGPSVHAFRIRSLRHRKLCPKEHTSQTKFSKFLPLDFLTAFGTHVVNQQLDDCWPADVRHGVRVVARILVYSTWGLMAIIA

SEQ ID NO: 11467 - protein, 244 aa, Chlorella protothecoides
MGVNTPVSSPARAEPSQSDPRTASKPGDRRKASSENQYASSVASTVAGALAGAVSRFATGPLDVLKIRFQVQLEPVWHAAAQSGRPLVRSKYTSIRQALATIIKEEGIQGLWRGTVPGQLLSVPYTAAQFFTVQQSRQLAKRWGVDTHPAASFLTGALSGAAGTVASYPFDLLRTTLAAQGVPRVYNSMADAAKGIVANNGPAGLYRGMGITILEIIPYAALQFGLYDYFNKCWEVSFVCGVGS

SEQ ID NO: 11468 - protein, 106 aa, Chlorella protothecoides
MPGPCVDREPGAVLYAPQTQPHPTTCPPLCRFSYCALYSLALLRRLDAADVPAAVDFLRQCRNFDGGFGAQPGGESHAGQVFTCVAALSIAGALDEVVDADLLGWW

SEQ ID NO: 11469 - protein, 173 aa, Chlorella protothecoides
MLKGGGVGGGLRGVWRHWSCTCRRAATLRRLAHCATTPLRSPFIPAHSHSPTLDPCLRISERQTPSGGLNGRPEKLQDVCYSWWALSALSTLGRLAWIDAPALTAFILGCQDLELGGISDRPDDAVDVFHTFFGLAGLSLLGHPGLAPIDPVFALPVTTVTRLNLAAQRLRCA

SEQ ID NO: 11470 - protein, 171 aa, Chlorella protothecoides
MAADTLYLTAPTGGSELLCRPRTQFEAQLASMASTLLSLSLLQLVQAHRARYPSLPGSKDVQHLVCGLASGLLAKLATHPLDVAKKRVQVAGLARSTAYGERVALVATRSLRGCLADIYRREGFAGLYKGVAPSVLKAGPSAAITFAAYELFLRWLSVAQEARRSEAASGE

SEQ ID NO: 11471 - protein, 253 aa, Chlorella protothecoides
MHVPQDLEGGPALPPSTQHQPSPGPAPSTGQEVIQAEIVVDVAPLSPREGGPQGEDGAGPPPAFGPPPLSSLARPLEPLSDAALQLLQSQSAAACDQDLRAMRHDDELALLSARRGLQVRFVVKALRTYMPLSEMVVEAPEFATVEYLKRRIFRAKLQRGEVRAEEQGGRGRCDYVGGASASLWPCWGVEARGLRGTPRGQHMGLGCMPYIDPRLALPHLAVPPCLPLRAEEACDGRQSRARHGQHPVAVQQR

SEQ ID NO: 11472 - protein, 241 aa, Chlorella protothecoides
METAKALQNRLDAVFGGLEGAGSSTKPWLPTLQPVFRAGRIETHSDDEDEKVEERRRQGLEGKLSVLMSDACLLCRLKISSGPQVCPPHAGIEELLEEDPDRAPSYAFCRVVDGEEDFSAVDAVADPLAEDPSLPSLSTPVDEAGGEGAGTSSRLGPPPQQRSGPLPAALKKGRLLDHEGQAVAPSIVPDHVRHPERYMRYTFDQEIQVGGGVAQLAESATTQVSGKRSEEGLQSAWYLYC

SEQ ID NO: 11473 - protein, 560 aa, Chlorella protothecoides
  MOD_RES (495)..(498): Any amino acid
MRAPSSSSTSLSSGEVKRVRPVSVCGKVWRVADGVAKGSRFHCMTKSQPGAGPQLPARCHTEVLLGGLVLDILVQDARLQLHLLVQRAHQHAVHILHGVDHSHLCVVEGVCRGVQRVGGMGGWQHSSRRPSLYLAIEFSGDQPCVAHLNVRQAAVPTHLCMRASASWRRLTRRGAASGVGKSTAGRIADRTLAAAAGIGRRAGCTRLWPGSGALSGQGCSQVSADRHTWRTACAVDERFKLKLASRAVFQRSATPPPGGVLGREVPSPHRLSIGPIPMCKTMGDATVSYKARGNEEYAKRNYLKAAALYTHGLQADPKNATLYSNRSAALLNLNKVTKALADAEACISLRPDWDKGYFRKGLALEAAGKGQEVGRDVLGREESMLRRYLYCTLGQPKCTCPTVTYAIPVAGTRGVPASIPTWGRRKQPGSTQSQTTNKAAWQDQQSETTLTMKVIGWENVEVNLEIPTSARRSPPSESAPCRAEGKCSPTSEFYXXXXLSARIWGCRLTKSETTLTMKVIGWENGEVDLEIPTCARRSPPPESAPCKAEGQCSPTSEFCN

SEQ ID NO: 11474 - protein, 596 aa, Chlorella protothecoides
MSQFVSELRAGGPVTKGGSEAASDNGAASAARGAAPAATSAAPAATDAPAASGSGRAPRDRRRIKLTERFYASAQDIYECFTDARRVLAFTQSPAELDARVGGALSMFGGSVQGVFRELTAPSRIVMDWRFSNWAEGDTSCVTIDIEEREKGAVTLHLVQTGIPDCDRFGQHDVVGLTQAGWANQIFHRIRQEARPGAWAQLECRQGHRSMVEAGSRPNLLTPWTATAPLLTTTPTCWSIPLHCSSTSSPLLSLLCKNLTPSSLTHPIMLHVNWATSGTAVCDPLEFPITKSLQGSRRPSSSPLRASCRARPFYLVLWTAIHQRKQAHDIGVGAWGVGKRTLARHARLHGKAEEGHHGEPPVLDLLHLQLGKGLGVVGQAQGVKGTAGVEGVQALQVRRLKLTHAGGVARGASACVVWGWSKRLALQAGSTALPQAKQQEFPPPPCHMEYKQVDHPSSHAPPHQTTPEAPPSVPRTFAAEGLHLEEQDQLDEDGPRQGQWVAHDAPGHREVVERAAVEHLRPRLEPGAAVDVGAVGLQALGDDGPGRGQHGPARVQQLVGAVLLQRLGVLGQSQRVIAVVARQGAVEHGGDLVPVQ

SEQ ID NO: 11475 - protein, 150 aa, Chlorella protothecoides
MVDYLTGALGGREEQTLASGVVRMVIAGGLLASSAALARAGTYADARTREGALAGLRDADAALSQLAAALPLDVMPGEADPANASLPQQALHRALLPWAAAAGEGLVRASNPHEFDVEGVRFLGLSGQNVDDVVRVKASLVNGAQRLHGP

SEQ ID NO: 11476 - protein, 420 aa, Chlorella protothecoides
MGAGVALCSTQRAATSAPPSRHAPHAAHAAVNRAARCSRGDARADAGPLLPPRHAGRLCGDRGDDDCPRGPNHLSQIDLSLADPAAPGSGCPGLAPALQALFARALSTQAPRHHFGAGMPGDAWMTHDELASEPAEARWPDGTQGPMEGEAGPTQGSQQLAAWEDAGKAASWGVYQGPAPRRWGPFVQSRNTSPHPISPPSCAGAQGYEADMWQDDMGAASLTPASMGVRDVGEGTAAGILGGDPALPPLLESAPGSAPGEVSLLTTATSANPAATSTAAFDAHVQPTHPPLATKVGTSGTSSGAGRPDGFTARTQAVLETLGARFATPDVGAKRRRGRDASDPGQATQLGFSALVAGRGRSEAARWFFELLVLQDRGHVRLTQEQAYGEIAVQPGMAAVAAGAAAGTPGRRPLGPRNAA

SEQ ID NO: 11477 - protein, 356 aa, Chlorella protothecoides
MPVQVQNLFKKAPAPIKKAAKKAEGQVKSNVKKVARNVPSPKQLQKGLAKNTGGGRGAAGLAAQQTGCAACGVPPPRPPRPPRAHQSPLIPPRYGPDRALYLPDGLLDRDEVSPVLNGTLPGDYGYDPLGLAKNSETLEKYRANELLHARWAMLAAAGAIIPEGLEANGANIHGGTWFETGAEMLNGGTLNYFAVPWGIVGNPLPLAGAILIELVLLFQVETFRGKGARNGGGCLWCRLMGRCAFRPPPHHTGTGPPGYSPGVGKFESSDLQGLDPLYPGGPFDPLGLADDPETFAELKVKEIKNGRLAMVAFLGFAVQAGVTGEGPFANWSKHVADPFGYNLLTILAGEDRLPSL

SEQ ID NO: 11478 - protein, 176 aa, Chlorella protothecoides
MKLKPSILDEYVKDKTTQQHLGMAPGGELGASAGLALGHAMESGSGRTRFTSPDDKLVLEDEGARIVLTGPVVPTASLVTGVVASVRGRILPSGEFCVSEICYAELGAQPVAPPPLSLHSPGSGPQVARAPARWDSAGGWWRGQRWCQGARRQLRRWHACGAASPPRRASMPLPTP

SEQ ID NO: 11479 - protein, 303 aa, Chlorella protothecoides
MTQALQLAEVEWRPVGPDVVCQGYLPSSGGPAALLAAQLPGRGQGQTGPAQQQQGPRPTEPDDAVPAAPAPAPTMQAPAGPAPPAPRLFYKCWDALGCLSNFSPHPVCLPAAPLTSADLLRHAAPARAPMTASLDEWVCPLGEGEEGVAGAAPHASSARLWPTSEHYYQAQKFAGVAGEAAAALRAAIAAAPSPEAAAALARAAQRARPRLVRPDWHRAKVAVMLHVLRAKFASHPDAAAALLGTGDAPLQEDAPHDYFWGRGLTGTGNNMLGRLLVQVRSELRAAGREGLLNGSPQNVYELL

SEQ ID NO: 11480 - protein, 716 aa, Chlorella protothecoides
MAGESTATLRNSNPWQNNARFKPLEFSELMEMPEWRDRQEKWERLAEQDKWDEVTKEFRVLVKPVLDEIRVSKPVSDLRSLNKGPLPKSAGPTTDTINWVDLVLSGTGLEGVAVEASWAMLMWAMYWPLRMQVSGSGVRLMVPGVGMMPWPRTPHPIVLAIGGASAGAVAAFIMGAVRKSPDAPVADDLLRLMVEMPTSTFDDGVLFLAVINTLQHGMRGDGPCAPIGIGTALKNSGLHPGKTFEDWLKNLMNTYGAGTLSDLKAKCDLSKIEWLKVLDVFRLHAGTEFLTLLSAGRTCCLSECAPATEHPPLPLPPSLHRDFSPPYQVEDGRQPQDVEGLVCCVAADITTSTKAVLSWERPVNFDQPPVTHSELYMANPDGENPGHCVRASMAVPFFFFPKKFPVQPGEKIPYAGQRAVSLPDTKWKEIGFEDYIPDQVNVGRCWDCEVHPGALCRGVKGGGVEGALTVPAPTRPRRIRNLLARTCMLVGSVPTDWSADSSKDSACASSCSPQHSTRSLLPQRAISRTTFSPPPHRSRSWMAASCPTTQSTSSTSHARRPFGAPPSVSTCRRHARHFAPGTSSRRPLRSSLQVPKRATSSLSPRTRWDPGGKGEGWIRPVARWAWPWVCTAHGDANPVRSPTPSPPTTWQEYNLLSASVYSGGISALNFDVSPVGKYVLFYNGVVAAYNFLVGGDASKGPFNWEDYKSKRKNATY

SEQ ID NO: 11481 - protein, 146 aa, Chlorella protothecoides
MTRHIAATQQKYTQSGGVRPFGISTLIVGFDGAGRPALYQTDPSGTYSAWKANAIGRNSKTVREYLEKNYEAGGPRDTLKLALRALTEVVDASSKNVEMAVVEAGAGLRFLADAELDELVAELEAEKAAAAAARGGAARDAQPPAS

SEQ ID NO: 11482 - protein, 486 aa, Chlorella protothecoides
  MOD_RES (3)..(6): Any amino acid
  MOD_RES (154)..(157): Any amino acid
  MOD_RES (479)..(482): Any amino acid
MVXXXXPRPLGKSPARDPIGRGPCCRQWWENFGGDCAGNSGWIVQRWRLWKWCGNDWAGVSQKRLPGPREMRYQSSGLPLTSMGGGSHHSHVGAIEDLGIVLLCYGNGPLQQLAQKIVQGLGCMGVCIRLAVSASSSNPCALTFDTQTSLLRPXXXXCAAVLRQWTPPVTCSGNRPGPWLHGANTHRPRSQMRMGLALVTLPTSSSDCIIFLMRAVKGAWFRKNLEFEDKGPSSPVPASSGIDIEAADGQGQQHPEERVTSAMPGGVWVRRKLNTARARPCRPCRERWHRLGTHQSHVSSMRDPTEILRVTNNTLRYSSRVFVADVGPLQAALPLSDHSPQTHVLRSVHASRSRGVFPSRSHASRPLRSQSLADPSHHDPRQVGLDNAGKTTTLYHLHMGETVKTQPTIGSNVSARGGHMRSANDQSRHARALRSGPSYMYTVRLPYLMRGDRAQWMPAMVHFTLFPTQITGGAGQGRXXXXLHVH

SEQ ID NO: 11483 - protein, 223 aa, Chlorella protothecoides
MGNSQSGATARFSQAEALGELPGVTYKDTLGGGRFLKSSLCLTDDGQSVVAKVRMVRHGKPTHRLEKGRRCPPPLLAPTPPRCTPKSLRRRWCACTRSDLRASGAQAAALRPAGSWEGALSYWCRTGLWACSAGSGVLPCMRQLQPPSPHPSLLPQYRLPEHRLPACAADAAHLRVRQVRLPRPPVPLCQPGTAHLHPPLPHGHREGARHSQGPWPAGLGVIC

SEQ ID NO: 11484 - protein, 662 aa, Chlorella protothecoides
  MOD_RES (60)..(63): Any amino acid
  MOD_RES (208)..(211): Any amino acid
  MOD_RES (350)..(352): Any amino acid
  MOD_RES (551)..(554): Any amino acid
MQEPLAPPYFPQCLYIAALDSSPADPGRGPVPRRGCVPRRHQILQLPADLLALGVPGRPXXXXAGVCHGDIKSANFLLTSWHWVFLADHAPYKPVYLPADDPVRAGGVKGVIGGPASTTPEQRGRGENSAGAHAEHPSSFLRGLLSPDRNIPPPHPFTPLHRPTTPSSSTRTAGAQRASHPSALWTWVTAGRCRLPPTPAPLPWTSSXXXXFVDVGHGRPLPPTPPACTPAMDVFSLGCTLAELFLDGQALFTYSRVGRCGEGDVEAGVCSTGGTGPCSRCSGDPAGILRAIFLDRTFLALMTRPYSVAGLISISTGLLVPLSPPNTLTTTSPPPPTHTKRSCWRTGRGXXXSRYPPPHTHTKKTQLLAYRAGSFDPGPSLDRMPPGVQDLVAHMLQRDPSARAGAQAYLDGELGRRAFPAWMGDVVHPFFASMLRAPPDERVALACAELPAVHAQLAGTIARAMAAAGRGFSLGNSHMESITSASWACASPHTLFYRQRPARPDSGRPEALPQQPKRPCAGACAGPARTCRESGSLSPRSRLWLGGRRRXXXXTDPEPMPAPPQPGNAGSRGPLPPEPDFGSEGEGERPGRGALPGPKALLEEVQRVAGRLEHGGSAGNTEGRQGGDVAAAAASSEARGPGPGASQGASASHRRPGPGDAP

SEQ ID NO: 11485 - protein, 219 aa, Chlorella protothecoides
MAEDSEEDDLEALLRQELERPASSLSEEEAGCVGAGGSFHGRSAGVCACRHGYSACLPSLPIQVAARQAAIHGPVPARRCDGGPWSSDSWLLLLPGSSAYTPLFPCPSTSIADAQAPSPICPPHPGYMGGLCIRCGGLRPEGEEGAGVALRYIHAGLEGAGVALRYIHAGLEVSQREAARLRRGAAEHAAAQRKLTLVLDLDHTLLNSTRFIDLTEGGE

SEQ ID NO: 11486 - protein, 160 aa, Chlorella protothecoides
MLGWRGGQGGECARTVEKPECGKPCGTDPSPPPSFNPPAAGRSADVRPLVAARRRGVLAGVGLLLSRIVPLTSPAPDAHPLWRLATACGATCTLSPGPQVTHVMAPDWTQKAVWGRDRGLQVVTPQWLAESGVCVRVCVVGAGGGEASTETEVTNAGIAA

SEQ ID NO: 11487 - protein, 1204 aa, Chlorella protothecoides
MFPPPVPQEESLGDKARNAYEDAKNAVGNAAETAKEKISGAADELQGAGEDIADKTKREARSAQGTAERKLDNTSGSAKGTAERKLDNTSGSAKVHWIWVICIPGNSASLILFQIMPSACMTSSHRTDWLHPAISLLTLPPQSAYNDAKGEAKDLGQQAKDQFNKAKGAVEDFASDVKGDAKDATRDVKSGGRDLKSDAKSAARDAKNEGKNLADRAGDAIKDVGDKLKHLQIQQHKPVPQRPQRDGGQVPDGVCVQGVPEEWGKVQHLQQAGCIQAGNEDQQRPAAWVGGALPRPPCPAQPEQGLQEAQGQAGHHPAAVVKAAGEHGVHARQVGHAQHGAQRRAAPRGGGAHASQRAQRGYVHAQRHHRAGQEVVGALRGVRVARVEGGAGQPGGEGEQAVRQVGRPAAAPRAPQRTQRARVRRGVEQGGHGGEGLLESQPAREGPLAVVLLRRVCVGRRGGAPRSGVPRSGLLERGPYLRPLHRPHAQVPAVGLAGPRRPAQDDGRRRAALVPVTRVAQGGVDLAAAPAALHAVVEAAAVLRGLVSRAGQAGGAQRAQQDAQQGQRPHAGRPRQAPSGRARASLTSACHCSARSATSTSSAVRLITCGCRPDRKSGPYQAPAGSSGVLGDGAHHQAVVSWHDGGEVQARQARGHHHCNHGAAAVLQIQARVCALTDRALVTKQCSERLLESVSRGGIGESGGSPCVRYHQGDACWGCHQTEWSPASLSQSLPSRAGMRAIPITPDPTHPLPKALRTWIQTRSNGAPHSVRRRRRSSVGGSLCLESSNSNSAREETVGTSRPRAASNPFVNFGQGHAGRAHTHAGPSSLLNIDSQGCQPPRPDPGARRAAAPCAMVTTSSAVQAQPPPAAASGEPAVLDRMKGAVTTLLECIGEDPKREGLVDTPKVGEGGQGLAGHDAGERPGSYRVSFVGGRPSWCLMLLPADPSVVVPTPILLTTHHPSAFGSALFHEPCLAAASDGLVLVRDITFAALSSSALLPFYGAVHVAYLPRHGTILGLSKLARVTKVLAARLQDQAGFTRSLLAAVVAELAPAGAAVVCVARQLGGIEADSGPRVTCLAAGALRRADRLIELEAVLDLAPGALDLGAEGAAGLDTELLIGSGPDHVDVSRERRPPSALNPEPESLDDSAGRAPPATRARMEAAVRVLVEGVAEAHGAKVDARALVASRRYVAWLLRATAGYGA

SEQ ID NO: 11488 - protein, 844 aa, Chlorella protothecoides
  MOD_RES (114)..(117): Any amino acid
MRRPATSMRGVSIALFILLAVGAPQAQAEQAAGLPSYLRSLVDRIKGSYVSNDRVVPVSTNLPGHVGEVEYIRVTLGAHQLSSCCHHQYTSTSPMHPSSPLRPRAPPPSRSLFXXXXVSIRPAPHCHFYIRALAGHLPETDPAPGKSLHHRVCEYKPNAPQFIARPCAPPPSRSLFGRAWFHAKRLAGLGGSYQDAVYAQAQGLKNSAGESWDQATETAQKAWESGKETSQQSWDDAKKAAWDTWSSTVSFPARKAAEAKSAAAGAYDRASGKAAGAADHATGKVAGAYDQATGKAAATADRASGKAAGVADHVVGAVKGAWEQAKGAAKGTAAQAEGATKGAVKEAKGAAKGVVKEASATVKDASATAKGAAASAASSVGSGAQQAVDTAADYASAGYDKAAAVASDWAGAGYDQASDSWRAAMGQAYSAYRTGAGKGKGTWEDAKATAYAAWKKAEGKAHEGYDAASDVASGAYERGLDAAYTNWEKTRSPETWEGARDAFVDLWRRGTEDWEDVSARTWEQWQRTKHETGQTWDEASRAAADSWRDVRSSSWLSGYFPEPKKAASSVWLKNAFRSWWGSKEATQQPWDEAKATAQRTFGVLQDTSRSSWEEAKAKAQSAWETTKAKTGESWEDASAKTWRNWYNAKAYAGGTWADAQKAADAYWAETKGKSKDGYQEFADAAWENWNEAKNSAGQSWDEAEKAAKSYYSGGFWGHKKKSWEEAGKEAWQNWVTGSARRGHPWADVETAAKRRWEETKSASGETWEQAKAAAEKAWNARAPGHSWWDNLTDSIACSWDDTKCRASDGWTSLKKSVGPSEAEKARVQAHQKVDEVFEKTKQEL

SEQ ID NO: 11489 - protein, 260 aa, Chlorella protothecoides
MSKSPRLLGRWHTDARERSRDWKARHALPPSRASSRVLPVQAPPASPLSRAGSPHRQVRGAGTTSERSLDSPTPGKGAIAAPPPSRRSLDEPDIMSSSLVWELVKKNNAFLKKNINGIVVSTEPGNLHQSMLIVSSRCSSSQDEQAQLQVLWPGQLWQDHGRVCRRVWSADQHQQQEEGRQPPVLCCKVPRPQGHQVCGRHCRRHPPRPQGEWRVSPGWALIALPPPLVLTAFAPLTNHHPIHPNVHPQDAARAKASALA

SEQ ID NO: 11490 - protein, 307 aa, Chlorella protothecoides
MMELARDAMTAQGYDVLGGYLSPVSDAYWKEGLAPAAHRVAMAQAAAASSGGWMSGLWICLFGDLGPQDCGCVGIQRGPDGAKRRMLGLCDGGRMGGGAAPLHPHPGGAAAGAGGTGPRFLDRGARRRGGAGQLRRPRAQPARGAGLRRGRAGDHGGPLTLAPGPAGRAAESARRGLRDARRRAGALPAGDPGHAPAPARGARVHRAGARAHRHQLLPGQRAWNVVGWWERMKGGPGGLPRYHAAEHAPLATLPPPRSQVRKELEQGRSVRYLVPDDALTHIYSHGLYGSLQQPAREGTQLHAQQHA

SEQ ID NO: 11491 - protein, 146 aa, Chlorella protothecoides
  MOD_RES (96)..(98): Any amino acid
MTPWSHLRPVGYHKPIPRSSCRQDEVARSMARGGKGVERAATEKKIAILERALHHHPGSERLLLALLEAVSWISSGFHIDIPLEGIHEDMGCIMGXXXLALLEAVSWIGSGFHIDIPLEDIYEDMSCIMCGQFLQGTCLTMPLPIH

SEQ ID NO: 11492 - protein, 623 aa, Chlorella protothecoides
  MOD_RES (488)..(491): Any amino acid
MCSLTYKQIVLPVSSSHPPLCIPNLKIPTTNTPLSCSHWVLTKGAPEVIRGDLAAVPPQYDATHRRFAAQGARVLALACRRLPAGLAAADLRALPRERAEAGLDFAGFAVFRSPLKPESEPTLGALRASGHQLVMITGDAPLTACHVAAAVHIVVRPALVLQAPAPGTGRGRKGGEGGPAAGGDAADSALLATPPLEWVSPDESLRLPFDPALGAAAALAADHDLCLTGDALAALAATGAAPAYVPLTSVFARVTPDQKELVVKILRGAGLGVLMCGDGTNDVGALRGAHVGVALLAPPEKKKKRGDEKKRGDDKKRGEDKKGSRALAATAGAPSSGPVAAPAAPGAPSPPIAPAPPPGPGAKMLEDMAKKGRPITPFMRRMAKAMDDMAAAQAGAGDEVAMVKPGDASMASPFTAKQGSVAPCLDILRQGRCTLVTTMQMFKILGLLCLSSAYSLSVMYMDGIKLGDMQCGCVRGGLARFREPLPAXXXXATCRWVVEARFREPLAAAQYGRSSALRGRARGPINECASRHSSSIVFSCMLALSSNTLHSPHPPGHAGRRADGGHVLLHFPRQASGDAVAPAPARARLQRLHPGEPAGPVRGAYLLPHVHAEDGARHDAAGE

SEQ ID NO: 11493 - protein, 590 aa, Chlorella protothecoides
  MOD_RES (31)..(34): Any amino acid
  MOD_RES (110)..(113): Any amino acid
  MOD_RES (140)..(143): Any amino acid
  MOD_RES (219)..(222): Any amino acid
  MOD_RES (263)..(265): Any amino acid
  MOD_RES (468)..(471): Any amino acid
  MOD_RES (502)..(505): Any amino acid
MLLLAGSCIVDEAVLTGESTPQWKSAIDENXXXXFPLSAGHAEGGRGEDIHAYPRLSHIKFDGHRTQHQLPRSCRPTVPQHGNHVAGEQAVPRDLGPLAPSVHAERLGGXXXXRGRRRGSVRAQCGCVWGGGDDEKFWVXXXXRGRRRGSHLPRSLALTPAPTSQSHIMSPLFSPPKAVHQAGQGARVVRRDQGPADHGRAGRQAEDARQRLPGRRAPXXXXRCAEHYSQHECSNWLSSGPLLAQQSSASPTPARPPMRRDLXXXSDARSTTASTDAQTCCPQVPSWLSSPQQAQHQRGLPCDEITRSSRSTPSPLALPSPTSLGVCRARTSFRFFSRCTTTVHSKVTSMKRGPEAHTEDLEAEEGGHELVGQQRREAGHGHLEAVVAPPLQRGGRGGLAAQARGGEVGAHRVMRGVLELGEGAGVCAVHEAQLAEGESVARHAGLGSAACSDPKSQIGKEQGAKGVXXXXNRLWHRPGCVQFREMAVGVGGELLPVWLPGXXXXTGFGTAQGLLQRPKYAALEMLPHPFTGPTLLPHRPADAHDPVLHREGVGQQCGDLPLHRLPPRLGHRRLRLRPVLRPGGAHCCGA

SEQ ID NO: 11494 - protein, 321 aa, Chlorella protothecoides
MEVEAQYAAAVRSVAGALALRRARGADLAELEAWERQLAGLALQGVLLMRQSGHTEAFVGSIQLLLEYTLCRPDDWPEDALPDMFPDYWAGRSPLLGEPGSRGWAAWLAGWQAAPAPVSATVPRREPAAAAAAPEEKGESGATAGVWTGWEELGPAIRRRFGHGLDVGGPQGDGLQEAKPEPSDDRGSIFCGPTAGPGSGSCIRNSGVKHPLPFMVSLNLQHPLHPRLGLELEAALESGETMTDAVLSSWLESEESRSAAQWHPLRVLALDPGGEADPGCDGQRAVAWGRVSHLALPLGEGVGGRHGMQGDLGWRDLGGTQ

SEQ ID NO: 11495 - protein, 140 aa, Chlorella protothecoides
MSLPAASRVIIEKYYNRLTLDFDTNKRIAEEVAIIQSKRLRNKIAGFTTHLMKRIQRGPVRGISLKLQEEERERRMDFIPDESALNTAAIEVDADTADMLKEIGLGSLPGISIAKVGWAVAGHWAWLGTGLSGATAGAPG

SEQ ID NO: 11496 - protein, 517 aa, Chlorella protothecoides
MIAHVGPPVSPALLPVAPIARGPAFRCRAPVLQPRVTASSEPRRLGGMEEGPRSLQPHRAASKADAATAPSGAPEAISDFTRVCVSLMRDTVDGMLLGAREAQAEGADLVEIRLDALTAFDPANDIPRIIAESPLPIIITLRPTWEGCAGLVVGKREIDGVSDLNGPGGGNVLTCFPAEVAACQPACLAQCTNLLKCPLQREERAARATATGCPQVCRHSGGGVRRRGVQGGGGDAQSGTHPSQHLVGTPVYFHDWQQGPGARPRLSLAHATPLPPSPPPLPFHFLHRLWRGGPGYPLHRVLPQLHRHPAPVGAGGARGAVPGSAGPRPPGRQAGDHRTRRRGCDDHAGPAARHHCSRAAHDRTGHGRGGGQRPRAALCLGAAAALPPQGAAAGEDARVGRGGAPRRPQLTESTQDILPPFIMMKSALWLNVPSPFNLASLLSSPHSKGPLIHNAMLKAANIDGVYVPFLVNDLPRFLKAAAASGMDLGGLSVTIPHKVDGGWCGGTGAGGELGHIL

SEQ ID NO: 11497 - protein, 233 aa, Chlorella protothecoides
MISSIGKKVLASGGVLTDVKSHGEQALAYDIRRPGERYSQVRCGSAHQPSFALHSQRIGIELLPYRLSLSASRVRTSSFPRPTSGRLPLPPPQRCSRTSTTASAWMRPSCDGSCRSESTWTGSRTRIAWPRWPILRPCQSSLLTLSRRDASFPGAAAARCHYLAGERGLQAISSSLWGPLSLRLACDDELQVIPVRMPLGRRSCGPNLLALSDATALWREGAPHAGRAQRHLQ

SEQ ID NO: 11498 - protein, 471 aa, Chlorella protothecoides
  MOD_RES (379)..(397): Any amino acid
MYTSYLLAALHEGHDGRRLNDYQAMGRAVLGRRVAAWTVAPVQNVLLVGLCITYSVAAGQSLKGLLGAECAGAGCAAGITPWILGFAALELAASQLPDIHAIWWVSLIGAAMSLAYTAIAGVVSCVDAARGAGQGREPGPGREQSAADAVFGVLNALGSIGFTFGGQGVLPEIQVRGWAGGEVSDWRCRAPGPPCVLCVARIVAAPSHHPVKLVLPLVLHKESPGLTPLLCTPKPHPPTPNSPTNEGNISGPPRAALHAAPHDDQRGRGVHRGHRGLLQRGRGRVRGLRHGRRTGRPAQPGRPRVAAPLRQRRGGGPHGCRLPGLRAARLRADGGRDRGAAPPRRRGRRTLGRGAGASFCRRDAASAAPGGAQRLCGGXXXXXXXXXXXXXXXXXXXLVPFFAEVMGIIASLGLIPMTFVLPCVMWLVSQQPRGAERALNYAIAGGCGVLAILALIGSTRNVIVQLKLKHG

SEQ ID NO: 11499 - protein, 389 aa, Chlorella protothecoides
  MOD_RES (310)..(327): Any amino acid
MGVGGGLWSCPAPGLAGGQGPVFRCATPGQSPHFCRSPWGRLAARPASDLLTHLLLHSHASRSRTALRPALRACLSPDTGLALLLGVWPLARDKQSIKDQLVAVLRRAMFGWVCPGSSQGQSVDRGEINRRESRVTGYQLTPEQAAARLKFRTSTRLRAAWAPRSLHAASQPLTSPSRHSQRQGTALLAVRAFLLLVAEEMAGGAGSADPGAAERAPLIQPSMSQRATLCSSDGPGVTLLHELLGSLRRCLSQGVAVRAAVYAGIPHLLRADGTASVSFWHAGGMIGPGMAEGTDPQTHVVLLCGVFPVXXXXXXXXXXXXXXXXXXPPPPPTACVVALIMLIIHCRIPSSPFAERGAGDAPGPTALPAAQCRGGGAGSPTPGSRPVHR

SEQ ID NO: 11500 - protein, 202 aa, Chlorella protothecoides
MALGRSEDDLLARPLKNEAGPWGVTGARLGCRVGCNSRTPPLRPLPHPTGGTLLECQRLLTSMGASAVSAYVTHGVFPRESWRKFQAAPGSDAAAPFKWVAWSCSLRGPEGREALWSIWAMGTSLDAWLSHAQGGMSRCTSSLHKPPQGPLPSHPTLAHPTTPPTRYFWITDSCPKTCQAVENQAPFEILSLATPIAAALQL

SEQ ID NO: 11501 - protein, 404 aa, Chlorella protothecoides
MSPSFGHALVTNPGVTCTSPPRAFDTGPAQWCSRILSRSTLRRSSLSSQSVALGLDTGESVGPSARGFRVTAPNIDVKRVRRRDRPIPKDSPVRHLHVPHKHATPPTSDTRRPIEEGLLPLLPPGMRDPGQGGCGSQQRQRPAGPDHVEVSAGSCTQWSTSYPSEQVAGVISSCFTYPQTLPAAQSLPAVSCCCNASPSPPPLPWHRRFQDGFPKLLVDDAERIRNRHVSFLATFHDPGVIFEQLSIIYHLPRLFVASFTLVLPFFSTGTAERVEVEGDVATAYTLARMISNIPLARGGPASVVIFDIHALQVVTMEMLDHWSERQQHSCSVALCARSASTLGTESCRSLRVGYRSSGVHRVTYQAGMSESDVQHPGAVWKRMNHEHATIPRPPQETTGAASRP

SEQ ID NO: 11502 - protein, 304 aa, Chlorella protothecoides
MGDSEAPDDLDALLAGYEAQAQQDIEEVHRRTQIKGRASKQARSRGEVPVASSARVLLPEPLSTPLQGVQDACGNGVPARTGAGPGGLRTQRASASHAEAGPSGTGTPKSESPEAGEEGGGGGRSACHGACAAARFELFSQASSGQGGRWQGSGAAAACPTGESRVGERLVDSPFYSHHLSSHRHSLAQDSGTILAINARLGDASTYRAYLLTQACENLDSAAGVGNRHGFWQTRAAAEGPDATAMVGSAPVLLEADVTPQLGEVLQYLRTQYWYCLYCGTAYENAADLASHCPGPSEADHADM

SEQ ID NO: 11503 - protein, 408 aa, Chlorella protothecoides
MHELRCSSCGVHRRPVSLSFVMKPEHHRVMRCLPLATLWKLDQTGMTSHARAMSSFGQIHNPPCSLMSPAAFLLDLSPNLHRLKEVAMVAPKAPQFYSPQVKLRSLTEDYCEFVLSNVNASIANALRRVILAEVPTIAIELVEIESNTTVLNDEYIAHRLGLVPFVSSRVHDMKTIYEATEDDDWTDVEFTLDVRCVRMGGYGEPVGDCPKPLGWRCQEIWMCVSFVHASCMLDISHPRALQWRRCTGDETMNVTSDDLLPADTRFPDVMPVGYDERGSLTRKHKSVLLVKLRKNQELKLRAGRHIGDDGQIPDHSPHVICGIGVGITWDYACGETSPSNSLCAGIGKDHAKWIPAATVSYQFLPEITINHDLMDTLTGKALWRVCTSSRGGLCVLTCHGNKISRSCS

SEQ ID NO: 11504 - protein, 218 aa, Chlorella protothecoides
MALTPVALMEGMALVKTLFAGQDTAPDHADIATAVFSHPEIGTVGLTEEQVCLGWWPRKGQPTLDWRFEFIAPSLQIAWEFVGHETCAASPGARPTASPGNLPPTGRGAVWRPGHLHLLLQAHAQHDQRQRGPRLHEGCLVWGGSRARFLLWLALGTLGPSMPPRKRLPSPPFPCNTPPGGPDIWRDHAGLWCRREDGPDQDPAGFGRGHPPNLGRGV

SEQ ID NO: 11505 - protein, 165 aa, Chlorella protothecoides
MTQSSSSDSSAITCRAQGAQSNCPSHPVQVRDFAASEYAKTGMHLHAGFSPVSVTKAADGTFNVKAKTKDGKEINLEGADYVLAATGAHVSDGGCVPASATDALSAVCGRVCPMHSVAVQLQFFAAHPMPPHTCASRTFPGKPLPLFRPQGVAPTSGTWAWRKLA

SEQ ID NO: 11506 - protein, 153 aa, Chlorella protothecoides
MLPTCPTCSFPVPSCLCLLTPCPPLPQFIEGRGRLVDAHTVEVGGKKYTAQNILVATGARAFVPKFEGSEHCIVSDHILEVPKLQWLGALSTARSLTHAQVPKRLVIVGSGYIAVEFASIFNGLGTEVHLVFRQDQPLRGFDGEVSRSLGGWG

SEQ ID NO: 11507 - protein, 118 aa, Chlorella protothecoides
MLAVPFFPFHLSAAHTLATQAEFARCARHSAPVRRAFRLHAATASAAIAAFALEDRLAERGVRGAHAVWHVLSCASVATLGALVEHKEGLRRGEGSPHDSVASLDRLGGGSPKAKALD

SEQ ID NO: 11508 - protein, 137 aa, Chlorella protothecoides
MLPVCSTNQHAPIRPLWPPCLQNFGQHARELVTSEIALGLLRVLADPARELLTLLERRRVGSPIPMLELLAKSVWKVIPLENSRGRAVVEAGRFCERRNGRGVDTNRNWGVDWGKKEPDYDPNEEFPGTKAFRCACV

SEQ ID NO: 11509 - protein, 432 aa, Chlorella protothecoides
MVSLPVSFRPERAAHPAAPPLLASGSRRTCLEGTGSSAHSATSAPQGLLQGEETSKLRPHPRWQYLRSLVWIRVVLNLGLLYLLGLAVVASLYSTLPTLEELARRAASRGAPAAASDLRMAIPRSFDELRAVRGTLALYHAQVPARLAALLAAAHIFLQTFLTPGAVGINILAGSLYHPVVALTFITVVSTAGSATNYLMVRWQLKDVLVALFPHRIQTFSAESRVLPAWVVPPFCAGCCWRATPAVAASLRVLCPSNSAPPLLYRQVKRHRAHLMHYALFLRVTPIFPAWFINVASPIVDIPFSVFIIATAVGHQPHNLITIQARASGGNRTLMRGEDASCVHYKVGPPLRRADRSVSDGSVAPVIDVRTLTMHSLHDLYSLQNVALLLGIGLLALLPRLIRKLQGRRGPLLPISDPAAAGDGDKTPDHNQ

SEQ ID NO: 11510 - protein, 301 aa, Chlorella protothecoides
MDGEVLARGRNLPAGIGRAGRRAACEACLGRARAAAPSATADGPRSTPPHCSEPEANLVREAAVLFQPHIWINVHSGMEALFMPFDHKVGAPGGGGAAASNATLAMLAGVNKEVFGGRCVVGPGGKSVGYLAHGTATDYMHGILKVPVSLTWEVFGDESAAYEDCYRMFNPTTREGLEAVVDSWTAAFFALLSRVPDHMGMPRQFWSPQLAAQVAAVRARDVSKAAPGRKGGDGEGEAALAQARRAAAALGTRREGLGLTRPAVLGSWGLAPWMGASLAVVAFFVVLFRRRGRSRATHAAQ

SEQ ID NO: 11511 - protein, 158 aa, Chlorella protothecoides
MPGSQFCTLEPELLCHAVFVRGVECEGLALPGWEESMSRQGPPKAATPGVATPGAAALPPAPPGVATAPAVELPSCPVCLERLDEESSGIVTTVCNHRFHNDCLRHWGDSSCPVLPALRGRHAPLLHLRLHDRWVLPVHYACVGGGGCDAPCPRAFGS

SEQ ID NO: 11512 - protein, 328 aa, Chlorella protothecoides
MPPINTAKEAALQAADEADGLAAGIGAANTLVWAGPRMTQGCRAYNTDALAALHAIEDGLRRGKERGAGPQNADSDRASSNSGKSSGVAEASSSHSGGVSPGGADAPHGSLPSPTVTHTSQASPLRGKKIVVLGAGGAGRALALAAARAGAAVVIANRTLTRADELAASVRTAVPGASVQAVRLDGVRSGELGGDVLANTTQIGMHPKVGRWGGRGWGLGSGEPLHREQGPGRMARCTPHTHRAGELRQLLCVHTYEGGSPAPEGVSLVSTHPALMLMLSLALRIPSRQVDESPVPASALRRYTLVFDAVYTPLHTRLLTEAKVGGHA

SEQ ID NO: 11513 - protein, 64 aa, Chlorella protothecoides
MTSSPSFFPLPQDTFIFRVEGTGALTPDDMVLTALDVLSGKLQTFGAELDREGAELADLTHGML

SEQ ID NO: 11514 - protein, 90 aa, Chlorella protothecoides
MVGSPASSQSVSSFQDPQVEIVDPELYMYDGEVLAKAAEMGKPGLIDICQRQVGVHGPSQRLVPGRDAQQSPSEAAAGLCGEPGYSSTHT

SEQ ID NO: 11515 - protein, 164 aa, Chlorella protothecoides
MAIEGEGVAGRGGLCLPWDEKRRSTSLHRHRSPLWRLLATQHACCRLDLRASTGLPYPPLPQVVCTKVRDGDARMVQLKEGSPQGRHVVIVDDLVQSGGTLLECQRLLASQGALAVSAYATHGVFPKGTWSRFLPGSQEGSPGFRCALCWVAWSEWEGDGGRAA

SEQ ID NO: 11516 - protein, 59 aa, Chlorella protothecoides
MYPIVGALRYSHGGRWEVYKRVPILAEKTEVYTHLASFDTQPGSTAITAAFHAFQRSQW

SEQ ID NO: 11517 - protein, 130 aa, Chlorella protothecoides
MLVLQRWSSARGTVARGVYCALRAFEGGSGPQNPRAILDGNPWTPAGALSSTGISFPRLSRSFAAAGTQGVPYDQLAVGVPKESFEGERRVALTPAGVAALKKAGFKEVLVESGAGAAANFSVSETVQGR

SEQ ID NO: 11518 - protein, 132 aa, Chlorella protothecoides
MKLFAEQAKDVDIIITTALIPGKRAPVLIKNYMVESMKPGSVTEPTILPPAYLPRPMSTLPPAVDLAAEQGGNVETTVPGKVVQAGGVTCIGYTDLPSRLPTQSSTLFSNNISKVGVVRGDRGLCVWGVQCV

SEQ ID NO: 11519 - protein, 320 aa, Chlorella protothecoides
MQTQKNAWYNSPIKVLTLSVFLKHSKQWHWPPLTNGIVTIVLTFVFPPIAVWRPLPKLANARCPYRWYRSHLTQIPAALVSFQVIGKSRAQLLCGICLKLHTSLRSVVSPRTVPAPGPASFRFCPGQRTLHGTLLIQLYCFASCGMGTGTLAPSLKQALFAYTSFTLLYIFGQFRDFFRKRWSKASLKGYAPIRQDYEDFYTRRMRCPRSTAICWGKGAGDQPGTQQLASCPCASCRTASIGQSLALPPPGWTSWSEHPSTDRSEFGSPTCVVGVDFVRPMHYLSLFCYCCAHSSMALKFSGMHGCTSAMSITGARFAIL

SEQ ID NO: 11520 - protein, 73 aa, Chlorella protothecoides
MEGEVVDLAGFVAVAKKYKAYIWLDEAHSIGAMGATGRGVCEHLGVNPADIDVLMGTFSKSFGACGGYVAANK

SEQ ID NO: 11521 - protein, 220 aa, Chlorella protothecoides
  MOD_RES (115)..(118): Any amino acid
MPCAPVCDGHDPPRRPNGPLRAAPHHWRRRQRPRRAQAVPAPDQRQLLPLPPAAHGLQRPGGLGLPRHAHHDLPAGQAVGHLPRDAASWGGGGGGGLPCHAAAHLPHARLHLRLXXXXGLLRLGFNVLGDWDSPVMPVMIFQPAKLSATSREMLRLGVAVVEVGFPATPLLTSRMRVCISASHTRQDLDYALQLFDYVAERELQGVPALQVPLSSPASPL

SEQ ID NO: 11522 - protein, 318 aa, Chlorella protothecoides
MSRHNMQPPCPASTGGGSGSWPPEPRPRSDPPLAASNLVFLGPADSPPAGQPLGPPNEWVPLAPSDHPSSPPPAWAPLPLVPWDLATTATVLALWLLGFWCLAYGALPCALALAGLDPGSPAPVFQALRHLALDVAQLALTLGLLGRALREHAPRARGLFALRALPLSDWVGPALAGAATFPAIHAVHRLAVALTVPGVPAPGGGGGDAAARALLGSGDGATRALWFFMLAACAPVWEEAMFRGFLLPSLATHMPRWAAVLASAAVFACVHFSRENFLPLLLLGCVFGAAYSHRANLLPCILLHSLWNVFLLVSVCGF

SEQ ID NO: 11523 - protein, 168 aa, Chlorella protothecoides
MPWVGMFLPSRRRVRSFDGDGAPPGLLCAKSALIPDLVEMASWVPLPPSQALRPPGVALLVVVVRGCGVKAARTVPWVGTFLPPRRRVRCFDGDAAPLGLLCAKSALIPDLVEMASWAPLPPSQALRPPGVALLEVVVRVFAGVRDPLAEGGEPLLGQYEAQLVSAIR

SEQ ID NO: 11524 - protein, 818 aa, Chlorella protothecoides
  MOD_RES (88)..(91): Any amino acid
  MOD_RES (132)..(135): Any amino acid
  MOD_RES (237)..(246): Any amino acid
  MOD_RES (348)..(351): Any amino acid
  MOD_RES (426)..(429): Any amino acid
  MOD_RES (709)..(712): Any amino acid
MMNGDTAAKSSTLDRSRCCQLPLFVAPTREPIPCRNLCVVPDLRDGPSEARDASIRARHAFVQRCFEEGVTDVLTLATCAAGEVRVCXXXXEPIPCRNLSCFWDESPITTDESSHPPYTPTCLKVPPPHLTXXXXLAPARVAIVSPITTDEPSHPPYTPTCLKVPPPHPTHSNPLLLFLPSTAPLQGRGPSAGGDHAGPAVPGRAVRPAAGPNRAASHSPGLDKRPLSGLQRRPPPXXXXXXXXXXPAPPGHGHRAGAQRGPACSRPARALQRRLRAPACGPHSGRGPAPQPPAVRAAGAAGHPERQAGAGAESACDPEQLRDSQARDIRNPVAPNSRSPRALHRPMXXXXGAGAGEGGRGWGEVVVHMEHRARFGAEPACDPEQLRHSQARDRREGPSGWVKPGATSTSSGAVLVPRLAAFLEEXXXXLALAPQRREGPSGWVKPGTTSTSSGTVLVPRLAAFLEELLAEGYNEVMSTVSHCVEGSRKDAGRSVLGSLGQLSHLVTTHAHLWPPPIPTTPRQMFAGLRAGLLVSTLMQEDFQNFVRLAAYCTQYVRLKEVRAGGRVLRCAGMSTVHLWVIMTKGAEPSTGPPPQESRLASKGADTPEATKGDGEERPTSPFAGIAATMGFENFHWVRKPLYSYLNRVGMAVSTGPTGMLCTSTGQDSQAAHSQSIHVPGWRRGQTVSSPHLEGLSTRPAPQHNSKAPXXXXGQDSQAAHSRGPHAVGVPDRRPSQPRQADQPCRQALGPAGGVSEALGLGCAAAAVALSGRQDWGWRVLPSPHPPRPRPWDAAHTPPPNTPPPFTPATARLRPAAEG

SEQ ID NO: 11525 - protein, 412 aa, Chlorella protothecoides
  MOD_RES (263)..(266): Any amino acid
  MOD_RES (394)..(397): Any amino acid
MAVRGRRIACAGWLLVSGLLLDGLDAAPHAQHTAHASQPGYGAKRRTAPAATATSGQPRAHGRAPRCRRASGIKLVRMKANPAMLACHGPTISDPSLSANSLPAVSLTKVKKKNKEWKEGIITQTRSYLDEYASAYLFRYQNFRNDKFKDLREEHRATSRFCLGSTKMLKVALGADEASEHTPGSSQLASHMRGSMGLFFTNLPREEVGGGGLAACRGGIPHSRGPFHGSMVDGGWQPSTSGDLQHLCSCARMPPPSPSTTTXXXXGGWQPSTSGDLQHLCSCARVPPPSPPTTTSSSYQVTSIFEDFEHADFARAGARATEDFSLEAGPLTLYGEPLAHTLEPTLRSHGLPTKLDKGVVTLVADHLVCRAGDKLKPSQVRGGGGQANASEVGXXXXEAQPGEGWRWAGECR

SEQ ID NO: 11526 - protein, 199 aa, Chlorella protothecoides
MALTCGLTGPCMRWSLSHRATPANVTWEPVRRPRRARLLTVHASWSLGVPEELPPSETGTVRGHHAPGDQRVGHAGRWVNAAVAAWHDGLDGTGPRVYARHASKDSTPHHPIFPPPPLPQSATDCPLLQYAHKVSLEEVAAFDAWAPLAVQHALRTTVNNLVGNLPSSSFDVIIRTSAPKMALLLFSTLMTGGRWWGRR

SEQ ID NO: 11527 - protein, 223 aa, Chlorella protothecoides
MLPPPSLTAHLHPGYMYHGAWQRLCLNERLGAGSPIVAPHHRTLMDSVHSMDDDEYRPPGGEGSPAAPGAGPDPGYARGSQQLGVTGEVLRWHLAAGRESMPASEYIRQLEREVEQHRAAAAAAPRSPPGHELLDFVRRADGALTGQASPAALQAMTGVVQRSMGESGGRGGSWRSGTRDCVAAELAEQLYWLAIVGWQLRALEFDARRGAADAGGEESAERP

SEQ ID NO: 11528 - protein, 374 aa, Chlorella protothecoides
MDACCAACVALPACNVYVYCHSAAGCGDQLTGTCWLKHARTLDLARPAGSRSDALGWSSGAVATAGDRAAALLAAKQAEETEAARLAALRANASLPLVFLDVAIKGTPQGRIEAVLFPDVSPRSAENFRQLCTGEKGTVPEGREGAGMAYHFKVGARSPGQLAIRLGGLWWGALGVVIDLGASAGPLAVACRGLWWGALGAVIDLGAVVDLGASAGSLAVACPGASPNGLQDNDPLARPARAPSIGTPTGASFYRIIDAFIDQSGINTESVFGGQFRDDAGGLALHHTRKGLLSMANMGPNTNTAHFSIMMGPAPHLDGSYTIFGQVVAGLEVVDAINALSKGQPENTAGPDAGAVIVDAGELRHGTIVPNLEA

SEQ ID NO: 11529 - protein, 190 aa, Chlorella protothecoides
MDPTASKPQSVCIAGPDPVALVLSPSPLRLPEPARAVPPPQPPTLAHMAARVQQLVSKAKSTVAPIYSTARKEVVKQYDGLLSKNSEYVVKDPEQASKLLKQYTFTKLASRGRHATGTFQGPLCPPPCSIPEGIATCKKEAAAARHRLGQWRDLPVTEAAMYAGFAAEVFAWFCVGEIVGRGGNVAGYSV

SEQ ID NO: 11530 - protein, 249 aa, Chlorella protothecoides
MHVHPAGASGLIRLRCTSTLLARPAPSDSVLHHLAPPQRAVLALGAAAETEAAARGGRLDAALGRLAQALDPGFAPGVQAGGRTAALDAVVSLMQAAALLNEGKAAVGGARTGVAKSADESGTVDGTTASGATEATPSADPADATVVMSAALRALGRLVGADAGGASAVALAEAAAGRVETLAAQLPPGFFDPLLPALPGPEGETLRAALVEVDAALRSEYTLRRAMLKERAAVTLRSLLWSDRLEVGR

SEQ ID NO: 11531 - protein, 170 aa, Chlorella protothecoides
MADPALQTLLSTKAALDLGLVTQADFDMVKTSFLRAQQLKAAVDVGVLREEDYEATKSQFLELITGGGGATSSSPTAAPPATAPAWAPPHVQVPAPAPPTLAARPAPSPAPRPASRPQSPVPPMSTTAPPTPGSRAVQHDIPLQLPKIGGTRSKPNGGVSLLGGRGWPRP

SEQ ID NO: 11532 - protein, 107 aa, Chlorella protothecoides
MPPDPVVSLDEVHAARLGDLYSIMDAATSGAGSGAWVKSVRIGAVPDRGGRVEGRARAAPMPGWTARKAGNEKGGLGTGAWHVQHLTTDAQCMGGQAESARGRHLGS

SEQ ID NO: 11533 - protein, 348 aa, Chlorella protothecoides
  MOD_RES (245)..(248): Any amino acid
MSATLVASVLTSSSSCGGGWPSHPSPTTSATPPHCHTTTLPSQIPATQTKYANEPFVHVLPAGIVPQTHHVRGTNYNHIQVFKDRQSGRAIVISGEGEVVASGEVRMFLWHGTFSLHLLKSFGHLLPAVEVRDLANPSRRVGPGHPEPEHHVWDARDDGAAAAGTLPLNIVHKGKACACDCLGRGGRPGRGSTTSRGPRMQGKGGDSAHLPAAAPRNATSGSMQGCLTNEKPQPEFGGERTRRLXXXXTDEKPQSEFGGERTRRLVVQSSKWKRFRARRAQQRSPRSLHRRLACSPGPRRRARPRWTWPPAGPGGRPAPRSACAARPAWPRHAAAGRTASCGCTRRGS

SEQ ID NO: 11534 - protein, 683 aa, Chlorella protothecoides
MHSPPQSHRHTRIQTAGCWHTAGRPRLPESEAPRGWGRGRHTSGCEQYQDSQGRSGVYQSHSRAPTLGYGISGIGSWVGTGDHGLLRVRRCIGSFGVFKLEASALGPFVLSRTHILFLGLPDQLAAATTPRQINCLFRSQATAMRLVASLLCLAVVASAYHEKFDGGWESRWVHSDDAKYAGNKLVVETPEGGSDPALKIPEKARHYGISVALPEPVDPAKGLVLQYELKLPSAGLTCGGAYLKFVTADPGFSPSGLVDSTPYTIMFGPDKCGSTNKVHLILRHKSPKTGDIEEKHLKTPPVFPNDDLTHVYTVELSPSDNTYRMLIDGVEKKAGALADDFLPPFNPPETIADPEDVKPEDWVDEATIPDPDAVKPEDWDEDAPLQIPDEDAVKPEGWLDSEPAEIEDPAARQPEDWDAEEDGDWEAPLIPNPACSVGCGEWKRPTKPNPAYKGKWTRPQVANPAYKGPWKPRDIPNPAHFVDAAPLSHVGSIGGVALEVWTMDSDYYFSNVVVSNDAAEAAAVRDATWAPKHAAEAAAAEAKFKAEAAKKKAAGDDEDEDDEGPVERLLAAVFDSPLLAPHAARLAPVRRYTEENPQLVLGGVAGLTLALLAPLLKALVGGGGGRKPAAPSVAQVKKADLPTKDDDEEEEEEEEAKEVVEEIEEEEEEEEEKTTTRRRARRD

SEQ ID NO: 11535 - protein, 113 aa, Chlorella protothecoides
MFGGFFGGYAPTGRFEASYRCYPVSFIDRMDAEKGDKVFLPPSALDRLCERKKPRVTTTPLPILLRHARATRIELISPSHRSPASDRLPHALQGGEPTVGPGHALRRSGVHRR

SEQ ID NO: 11536 - protein, 392 aa, Chlorella protothecoides
  MOD_RES (205)..(208): Any amino acid
MAEIWMPWGHTPRTHPWHPCQPAGPSLAMCLDALQAHPPRAWQISPLDSRHGPHSLQLATRCPSTTTTRGGDSSLRLARLPGRAPGVLGAGLRDLGASATPVCDRACPCRARAFGLSLTAPTNSTLKLPPIPLSRWILPRPWIMWSRNTRQPPQPPNRPPPPAPTVSLQEGQPCRAGHPVCTAKCVGLRGPVWPSSHPGSQFPAXXXXPAGRATLCAWPTVLDCAGQSGRPHTQARSSLPFVIILTLILDPAAGSGSSTTEDNGDPASRAAAPAEPQFLAFAGTAKRLDGRPAADPRPVPVPRPGGNSASSAGPSTKDGSSDAQASSGALKKAGKLMYRDRLAAKFAAAKDGRGAAAPPPPPPTKASDAEGGAEKKEDGFQPFKGQGRSLRG

SEQ ID NO: 11537 - protein, 394 aa, Chlorella protothecoides
  MOD_RES (40)..(43): Any amino acid
MVDAEDPQPPSEAEVAGTPPVRWRASPMIAGVTWPVQRCXXXXRHSPGTMACSSNDGRGDLASARKAEVKEEEDAGKPAPAAPPAAPVLDTYTNRELKHLERERSGEVQAHYVINDGSPLSGRLLIGLKNVFSKCLPNMPKEYITRLVFDRRHRRVAPGMEGFERAMPCLPALLPTCFGRLVVSVLSHGIAAGHVGFPGPVLSRDPPSTDHQDLPPCSSLQVRRHHPEQHFNHCWHHLPPLSQPKVCRDRLLRRGPEPAGVGLWHTPHELDQGGGVGWVMSLRDRRVSIATPACRWAGPSAMQILVGVADPSFHVLIPPGQPHAIAILPPLPSIPCWQLHARDQDGCQYFLTYADNNAVGYFSKQGFSKTISMEKERVRSAPGWAFWWAGGIAA

SEQ ID NO: 11538 - protein, 488 aa, Chlorella protothecoides
  MOD_RES (247)..(249): Any amino acid
  MOD_RES (362)..(364): Any amino acid
MGWGGEGRATLGRGREPGQAFSEIFMCSSVSWLSREPAPSYSSPFCADCPSTTTTTIADGVVTVGQRTLLELEDLARGYRHPCIVDIKIGYRTWYPEAGDEAYIARCKCVSAGPQGGCRHYWACQPWQCLARETLVCSSNPAPLLPLSTANPPPRVAGKRMRRPRRPAWALRSVACRSGAHARAGAERGQPWGGMQWKADATAGREGKGHFRMSQAMSATKLGPCPLDEGMLRHAILPASTRPPHSXXXIGKWHCCQWALILCFMGFQGAECGQPWGGVQWKADATAEREGKGHFRMSQAMSATKLGPCPLDEGMLRHAFTPCIHPPPALILLDSTPLILSLQKKGCTPNMCLGAHMVRWPXXXRRERAAPPTRVWGPTWCSGPAPDPALMGGCTAQLPLLLLLDPPLPWRAVRPPTIMVGSCPNTPIPPSSPLTDAEGAAVRVRLVDFAHSFRTNSSARDDNFLLGLTSLMQRMRRVQGEDLDIAFV

SEQ ID NO: 11539 - protein, 181 aa, Chlorella protothecoides
  MOD_RES (52)..(55): Any amino acid
MSVGVFQVPAPDGIDASLLPDVCRPCVPGMLRISPCEPHATLGPQHASALHXXXXGMLRISPCAPYASLGPQHASALHILPTSFLRVGAIIMTLHDACDVLLEASKLAKYTGHDAGATALFTAFALSWAGLRLAFFPFVVIHSTRWPLVSGIHGFAGAVPRGIAVRGDVTSDPLAAGTQIV

SEQ ID NO: 11540 - protein, 614 aa, Chlorella protothecoides
  MOD_RES (434)..(437): Any amino acid
MPREALCEHSPVVPPLQGMIPASAAGGSPPTTPHPHTCNPLRRFTVVALQWASVLLGGVDKQHHGIDLFGRDAFLLGRLLTTLGALHGCPVLVGKSGVVPDNPSQPRAPETIPCPWQPEAPPLLASSMLKRCRRPPLIPSLAPRCTGTFLEATAGHVESAGLTAATLELVRCEAVHAHAEPYVRRAAVLAVAQVLQGGTAKFTCAIVKFPTSTIHRVVHGMLCAARNTCPPCHSPTLHWNAGGHLAPPRHPRSRHAFHHLGARRLHAGPPAGVGGGLVGRGARPGLRRHLPGHGGSHAEAACPPGRPGGAGAAGRGGGLLPAGARRAAPARGLRHYNPGAGARCHPAVFAIGNAQSSLSLRPQEREIAVCNPFPLPILPIPFSPLPANACQGQARVLPRDPTRHLAWIWPILFTHSRAEMRHLVGRRAPTPLPXXXXTAGQRCVTWSNAERRRYSHDQCAEGKKREKAGGWRERGGERDRCWPENGGQEKHPKNRNAGWRERGGEGDRCWPEKGGRGKHPKIRNAGQTELQGPEGGSFKAGSPSRMSSILPAVLNFPQGHPSVCYQQDQGEPVDMHDHQGEEEGVESSEAGWAIGQNLHNLKPAAWRCGRVMDL

SEQ ID NO: 11541 - protein, 231 aa, Chlorella protothecoides
MASLEKQILIKHYDISGFYSVRLSLEGGTDYDFELPRTFPQTLCAYILLAGAVTMTSGATTLKEPLTLPAHHSTSGIFWKTRTFENIWDTWKGLHLSQLECLGRPTLDEPECTSACVIYNTIPHPRGQDITFKDVYKWASTRKSHCVKGYLMSTTTPTAADFAEAFPPYPVDWKALANPPSEFLATALLVGELYWAMQCSALKWQVAVWAQMAEHLPDLRFPSPLSSDRRA

SEQ ID NO: 11542 - protein, 564 aa, Chlorella protothecoides
  MOD_RES (10)..(13): Any amino acid
MPRARARRVXXXXGCTGHESKLAINVNKLSNLVADCIITCPVPGRGVLSPDWVHQSWKAGSKQRQLSVSADLARQHDILGGATVVAEPQVCHASADRMGEERRRAFVEALESRAGAAPQHFQCEGNVVSGRECNQGRCTSGGRPVAGHLDVRRAGQTPHSLVAELQREVSTLPTRLLMGVSWSLLEDPATCWEVRQELEEAGEGSSAPADPGDWVEDSQDEETGPPSPHQPDPTQEQGDAQVLLRCPSLTLVFPRDNTGTLAHTCQTHDLPEGGTSALHLLRLVHAFYHATMDREEGMALMQQGGLAGAAGQALRRAFLDDVPITRAHLLGPRLRFEGLSRATRDPAAAVYEARDLSQNRNDKDRRSMSSDVNFKSILDSLEALPAEPSPTWAPTAFALGGPQSTADLRVLAICTHPCLHRRATKNACREGRPGFPVPAPAGSEARASFRGLHEGLHGPVVRRRCQAGGPGSLTGPPARVTEGHAFAPLQEPGQPGRLRPHRRGREQAAQRRLCAQDAGSPCPTPAGLGDELHHVGFEGWGWTGAGEECMHRRGGRCSARCHPI

SEQ ID NO: 11543 - protein, 435 aa, Chlorella protothecoides
  MOD_RES (149)..(152): Any amino acid
MVWADNAPGLRFLNALHGQRRRAWTRRALHVGKTVVSQQAVLQAMEWQWAAGVLLCLTGFDREQRARIREVVETAGGRYSGSLSRRCTHLLVAGQAGRCPSPKLDAALALHSRWGLCIADESWWEACVASKRLLPPSSLDAKENVWRPXXXXEACVASKRLLPPSSLDAKENVWRPNWGQNLTAPCQPELSTGTARSHRQACPPEPPCMAAPPLPDSPLATYASVQPAAPPARTSSMSHSCLLAALRERQAEASLQCPQLKKPRPPAQETATLPRGDSPPDAMDGLRLPAGLPAPAVLPVELGQAQERTSSNLPHQNCLARDSVKQPPAALFGGMRVVLDPALSRDVSQRGLCRGRFVKSSCHWTPHPKLRQLLCIVRSKKARPLILRPALLGARGSWREVEPPCAERMKPRMSCASLPKPAAGCERVRGSPPQS

SEQ ID NO: 11544 - protein, 959 aa, Chlorella protothecoides
  MOD_RES (213)..(216): Any amino acid
  MOD_RES (402)..(405): Any amino acid
MAENMQRLGERGEKLSRLEDRTAELEDDAGNFASLAKQLADSYSNRKCILHIQAAFRLQQWSLVVIMYRLRLQHLRTPERHRRGHVEHGTGSAYGMLRTLNSHVRNVVRPSLAAAQSPPTHLPQVYLPPRRAGPAMSSRGFNSTFGGLPTTIFELMSQLAARHGSINLGQGFPDNELEGPASMKEAAYQCVGGMAGGIVDRMGIRFQGCILDXXXXEGGRVPVRWGMAGGILERMGIRFPGCILDMDSQSGGVQEPAEVQVAEGSMLHDSNQYPPMVGVPELRQALAEHSERYTGLPLDWQSQVLITSGATEALAAAFLGLLEPGDEVVVFAPLYDSYIPIMRRAGAVPVVVQLRAPDWSFDAAGADWRCQGMGGVMVHAAPLQQHHGLFQDCCGSGGLVQXXXXLALPGDGWCDGACCPFAAAAWTVSGLLWVRGAGAKQPTSALPAHPPAAELATAFNAKTKLIVVNTPHNPSGKVTWCTFSWVGDDDTEQTSTSAAAGDLAQGSLRNEHCMAAGPLHNSWRLPYPPPQVFSRAELETIASLVQEHDAYAALDEVLRARVAADAAWHGGAQYPHWVCGQDLQLHGLEGGLGHRPSAHGPGRGQGPPVPDLHGAGGAAAGGGAGAEGGAQLLRRVGGEWGLLEAAGEGGIIRQDIICKDVFRGFNRLSAPTRSPPASPHRKPSRLGPMFLKKREWLAAKLTAIGFKKSTGFTHTPPTSLFQVLPGQGTYFLTTDFSGLLPENSTEEDVEVRVVGSIAANTGSCPSAARFALHHIESQNLSPQFCSRLTTEGGITLIPVSAFYEDRWACAVHHERRTGPPGYQCLGSCVLYMGGECGTGIAQDLPTAADPAPHPKLGKDTAEAGKRIKGSRRGKRRGVLNKGFLGAEGKVLAMQGARRAEIEGGLDWEFRSREQAREVTIWALCGKKREMGRSRPRARRVARSAAGSLLTRRWPPRLPA

SEQ ID NO: 11545 - protein, 155 aa, Chlorella protothecoides
MPADLPRPPPPAPPKIPAGMAPPIPAAHPSYSAEPYTAPKGMAPPLAAPPRAAPSFYGAAAAAGMPAVEVPGETKKEKPALLREAAGKRWVDTTLLEWPENDFRIFVGNLGNEVRWRGGWREARRCRAWLLGWTRACRTVHENSTPGRRERYGDP

SEQ ID NO: 11546 - protein, 141 aa, Chlorella protothecoides
MAAFQNYTSFNKAKVARNGYNKKSKGYGFVSFQDPIEGARVLKEMQGAYIGKRAVIQGGGLSAPQHGPSAHTRRRTTPPGNRPVQLKKSTWDDRQVKDKTGKPIKRLVEEKAKKPDKRARAGASFEAGVGPPVQQAFYTRR

SEQ ID NO: 11547 - protein, 186 aa, Chlorella protothecoides
MNLWQTQALGPTHDPSTLQTRHCMGCSPPKSTACAPVSSSKASTTQRPRLARQLTPSPLQGSPTVFAGVAAALFAAHPIHTEAVAGVVGAAELLAASLALAALALYLSAARAGRGIVRWTALAGVMGLGWLAALSKETGVTVVSRWGISRIAPNPGWCTQMDKRVGRHPSALQLLAHIHVAVELPP

SEQ ID NO: 11548 - protein, 278 aa, Chlorella protothecoides
MTGDPRLQEVLAALLRHTFLKGFEVRARDLVISNGVTPLLDHLFFTLADAGEGVLIPAPYYPSFDMDLMAKDDVVPVPFYLVEDGDVTAQLAQAAAAAAEAGSPIRALLITNPNNPLGIVYSTATLKSMLEWSVKNGVHLVRIWKGGEGCFGRHCTTEKLKVLREPVPAQVVPGRPAAAADPLQSPRPQGNRRAPKAPPPLAARSDEIYALSVHGEATFVSMQRVAQGLVEEGALTQEGVDTHLHLLWGMSKDFGGSGLRLGVLHTRSASLKKVGALE

SEQ ID NO: 11549 - protein, 342 aa, Chlorella protothecoides
MSADWSFSCVAIVKSMWDPRNALSLLLYAWLLATALAAKPWSLMSDWRRVLASGTGARLPATPSSTSTAEEAGVDAKIQLIVAPGAAPGSALYTARWRLFVTAGLIVGPMLPAANLFFYVGTFLAERLLLMPSGKARWQGGEGQPDCMPWSTLQLLRTGLDQSITPVLAVGLAFLVAEQLTAGLSGPRSNRVRRAFSALILASILALGGRRTLQRNRDWESDASLFGSALKVGRLEDASLFGSALKVGRLEGAGRPMHYRRGLPVCLPHSASQLANQPLPWPLRCHHPAQVCPNSAKVLLNTAILSRRSEAWDVSLVLLDRALDVVPQYCDPHYHRGIALMG

SEQ ID NO: 11550 - protein, 547 aa, Chlorella protothecoides
MPSFPPLQPCSHLAAVQPVLVESASGRSRRHTSVAAASGIVAAELLSARFGSPQSCVASVARLVEDLAGVGAVGRQMADRPETSCAAGCSEATEADQERIAGALAALPDLAPSWEHACLAAPAYCAALLPALSWAAASTGPLGAQATRLAAATTQRLVRRGHAQPVGAALAQLAAEVDGMSPAVDVARSKGDAGADDPAESDRGMLKGASAEPCPHQDPLVPFLAPTPPLAWLGQLEDARAGLAALQAALSSRRGAHAGAVLAALGAASPARSPETLQRLLGDRMLPPAAVRAAVTELLGAAGPDPGGSAGRLLPLAQAWAGSCTLPAPRQAALTLGLCAALVAIDVGALDQGPLLPAILGGVSAHLDSPQPEVRRRGMRVARQLSLTLDPASPALFADELALGELEEGYWEASEDEGEGGGEGNECGAGQVAGRCLEAPRGSSDRSDRSPADGSGVAPSGEGMARERPRAESDSEEELGPLTGTDSDDDDELDDTAGLPAYDLAESDEDGGAWVGLGFVEGREGPCGCTEVASCASPVASLCGERQ

SEQ ID NO: 11551 - protein, 195 aa, Chlorella protothecoides
MGCMCVIHAIPGPCRHAMSTAIAPPPLYSVQKVDAHDPWLQAAWAQALEAQDRGKEGVAHARAALIIFQDAAARLLAGEAAAADADAEGEAGPLPLGRDGGSLEPAAALSAMTSALSDMTALMIRAGYSRKTLCDLQQHAEATLGVLRTLTEGRDDHLALLEAKSIEVWRAAEALGCKPSADAASAATAAAHDEL

SEQ ID NO: 11552 - protein, 132 aa, Chlorella protothecoides
MSRSTSRRLSHAFRPASPHLCRARAIVATLGAEPQRGGIALATELELYSPSLDTHQRVLILDALSSAALELAGRVPGRAGLGGGRGPGARARPPLPALGPDGGGRVGRVTWRADRSLQSLGSGGDSEGYTNR

SEQ ID NO: 11553 - protein, 202 aa, Chlorella protothecoides
MQWVCWNGLCTARARRCRYSPSDSDVGSAPDQEGILDQTPPSHLPHPNIKQVVAVPEGLPLAVTLSLAYSVKQMLADQNLVRQLQASETMGTATVICSDKTGVRERGPCWRHCPHTFPPPPPHQMCPLNRHPHPERHDADGAVDGGPGGGLPGGGAHAANQVSARAGAAAAGARAGDAAGKLGGSQWTTAEFPWGRRVSEFL

SEQ ID NO: 11554 - protein, 942 aa, Chlorella protothecoides
MALELFGPGMILRNTWHQNSKTTLPPILQATGTAACIYQGRPRNRDRSLQVAAGPRWEPGAAGPAPPPGVPGPMPALGPKVQSEDRAFVAEEVLWWTVPLQQSVSQLECTHGIPADQDGCPGLQGRLRALPHPHASAVCQRSWQRFRQLQRRRGLHVARSPVAPSPSSHKSALPAHPAPLFLLSRDWRLDMAVAEDLEQDMVLPPVEEPWVSKHSSLIWIFRSSAQLGVCAIEDPLRPEVPGAIAAAARAGISVKMLTGEEGKRERVVGRWALPGACRAREGGEMLPSIGMDWRSGDNVATAAAIARQAGILPRDAPATHGLHVVGVREFETEPAAAGGTTALLPDTVMEGEEFRSRILSPSGAIIEDEFLKTQSSFLAGREALATPARRLHTSNFSRRPIPQIWPRLRVLARCTPADKHAIVMGVRQFTDDIVAVTGDGTNDAPALRAAHVGFAMNQDAPLTHTSPPALRPINPGTSIAKEAADIVLLDNNFASIISAALWGRNVYASVTRFLQFQLTTNVVAVVTAVAGSLATARSPVTAVQVCWEGGGDGVSGGRVKDAVGQSAHGLAGRAGPGHRAALPQTPGPEAFRQGWVGGCTLLFIRLYSSGTAPPPPALQGCEATMEIFRLVLSSTYGRPVIIPQFITPPPIHLHLRTDHQFLAPGSTSLRNVVGQSTFQLCVMALLVFAAPGLLGIDPGNSYPAHTPSTHYTIVFNSFVWMQVGGCGNALCSVEGRVSWLWDGLSKARLFCIILATEAVLQVLIVQARVIEGIFMGFLVASIPGTGNRLSGEMRKVWRVTCVYGSMRTWKVTAPSHTTRASTVPVSPCHPLPNHAVWGPSLPDPTPGAQVLGHEPRHRRPLAVGARGAEDGGERGPVAVARCPPARPQRVVPPSYYLLVIQTRCRVTGRTPSPGWTASPHRIALLLHQLLATWLFQKRRIGE

SEQ ID NO: 11555 - protein, 665 aa, Chlorella protothecoides
MRECRGGPPGTRLAIHTGLSCTFRNSSPLTIAVWHRPGRASRSASWSSGLCRRVTPSRPLTGCARSSLTRRRWRSPAPCRVGGIVGACCVQGGIFDACRRPGSLPGATRPAPTPPAPHTLAGKVVKLHFEAGAMVQVGENLVSIETDEEAGDGDSDAGPAPSAASPAAHSSPEDPAPPSATPSRVLTSPAVRHLARQHSLDLAQVRASGPGGRLTKADVQAHLDSLSAAATSTVAADVAAAVPTTEAAAVRQAVPEQRGTGGDAAAGRIPAAGAGTTAGAGGGTTTVPLRGFRKAMVKSMAAAGAVPHFHFCEEVQMDALVALRALLRTEAVLGGAKLTYMPFFIKACWELGVGEWRFRVEGGERRAVCRALAALAAALALEQFPLVNSSLSPDQASILQHGAKNIGIAVATAHGLAVPNIKNVEVRYLGVGMEMVRCRWWRRRRRMHHFGTGPGLFFDVSKCHPPTHVHAPPRPCGPSAPFSSEPQPIQPDAPHVPHLQSKSIVEIAAELARLQAAAAANQLRPEDIRGGTFTLSNIGMVGGTYATPLVNPPEVSVGREVQPLVPASRSSCFLGSAVAFPPPRNPHHVTLARPHPLPQVAIMALGKMQSVPRFAPDGRSVVPQSILNISLGADHRVVDGAMLAGFAQAWRRYVEIPGKLLLEMR

SEQ ID NO: 11556 - protein, 248 aa, Chlorella protothecoides
MFGLFWSMKTFSAAMDPKGTSKPQVGVPMRAGQGCAFRSFRTDKYKLHFMESPSGIKVRALGFGWTICTRQAVLCQRAGSDSSLTSPQFVLTTDPSVGDMTTALHHIYSVPFVNQDPCVSGHEPGLLTHCSLPDFPLPCASEHAGTAFVRRAADLGGGDASTSPTGSSPDNLVSVPPEADGEADGGGLDKVPPARRDVEHLARRQLPLAKLQSCQAGELGQARLVLEVDGAGVGVHATPVHGDGYERL

SEQ ID NO: 11557 - protein, 346 aa, Chlorella protothecoides
MAAELPLGPGNALWSAPEWGALLATLRETPGGGPAVAALLAQALAALLEPLAGSGAAARAESPEYPSRPPDLPDLLVALCWEKLHTGNWHEVGLAWRDAYTAASLLTCRGLVRRPGRSAPPDPGPALRCLDLAALLGGPLLRRFVDAAIDALDAARPGREEGAGCDAGLEGVRGAADLALEIRSDCPSPAPPPSTPLPLGSLLAPARRLPRVAAPSLEAFWRDFMGGAGPARPVVLLDAMADWPALERWRDPRALAAAHGRRTVPVETGRHYLAEGWGTRLMTLDSFVADHILGAGGAGAYLAQHPLFDQVPELRRDIREPAYCVLGRGEDLAVNAWFGPAGTVRG

SEQ ID NO: 11558 - protein, 183 aa, Chlorella protothecoides
MEEEAAHAMLLPPAEAGRAACVCSSMKPLRLSTHVPLSWTTRGLWALPPELARCPLQRLDLMRCGLTELPIAVGTLGRLEELSLGCNHISWLPTNLQGLASLKSLSLYSNDLRGIPPGLACLTNLEELFLDANPRLQFGGGASVITQLPKLRCLSVMQEGCHHDMVSCGREKGGGCGIRGRTC

SEQ ID NO: 11559 - protein, 226 aa, Chlorella protothecoides
MASLLRSRLSLALATAATAASRRGAGSAWKLCPQLELLQGPLATLQQGAGSLSPTALPAPGLPWAARGFASPRRKPQRGNQPELAAAPLNRCPPGSDFGPCSSVGSARKYPKDCPSAPPQKPTAHHPHSSRNQEIRAEEVRLVYPEAEGKATEVVALGDALAAARTRQLDLIMVSAGARPPVVRIADFDKVWREGCEITGSSWCRPRPHVLALSLHRAIVAAPCAQ

SEQ ID NO: 11560 - protein, 159 aa, Chlorella protothecoides
MRKKAKTAAKQQREQQRLADPKEVRIGCRAAPNDLALKVGRARAFLEEGQHLRLSVLFKGARELAEARGVVLSILAHLEGASSGLVGDEGGWGPFDPRAGRRAAHQRKPTDVRRRAMASEWVLVPQAPLPGSCELWGAQRGVMPPPPRPPSLLPQAWRC

SEQ ID NO: 11561 - protein, 355 aa, Chlorella protothecoides
MGRQAELEPPSLVKYDAWGRRQDQVATCEGWKGQKAVSAREGLVGLAYERHQGEASRVVQAAKLYLYGASSGLFNCPLAMTDGAARLCEVLRSRHPELGEAFSHLTSRDPGTFWTSGQWMTEKAGGSDVATGTQTLAVPEVAGSGGIGAWHRLTGYKWFTSAADGEMAMALARELDSSGRPEPGNRGLSLFYVPIVRDDQGCPQGFEVVRLKDKLGTKQLPTAELALDGLRALKVCDVIVAWMQEGRAWLSWEGRGKLRGEGPDPQTLLFRGSCSPHQSTVQYLHPAANSTLHSFPSPNPGTAQISEMGRGVPLIATMVNITRYHNACAATSLMRRITALAQVGRLRWGSAASTD

SEQ ID NO: 11562 - protein, 364 aa, Chlorella protothecoides
MDLDLDAPAKTLTLQDLKLLGQGRNGEVYDGGVVSSPRDLARGLGTSPHSGLAEDEAGLTARAERYGSNAFPEQASVSFFELAVEALQVLRTWLGGAVKGRVLEEGKGHKTCRPAPAMRGQPGPAMRPQTNQAGCVHHCAPPTSLPTPPHPPHTRTPQDFTVLTLIGAGTISLALSLLVSGSTAPGAEPGGGSFVEGASILASVAVVVAVGAGNNWQKERQFRALQALQRDETVRCVRCGAERALGVQRLLPGDLLLVSAGDILPVDGVLVGGNDLRLDQSALTGEAGEVLRDPEHAPFLLSGSRVVRGSGRMLVTAVGGQSASGAIARAVMQRKGGGGGGDGGELRWGGVCFWAWVSGSGGIW

SEQ ID NO: 11563 - protein, 146 aa, Chlorella protothecoides
MQTAAGGGAGARPAAAGGERAVDAGPPGVPRHHLPRFNPCRACLLTGAGKGGNWQDPRAAPRRTIDAEVGAASAALDALCPMRTVLERVVATPGGALVACWQLLGGTEPARLRTALRAALPEAPTTQVAGVAWKQWGASMYNWLRT

SEQ ID NO: 11564 - protein, 261 aa, Chlorella protothecoides
MPLYTFKSVAWQLLRGVAHLHAHWVLHRDLKPSNLLLMGPGDEHGTLKIADFGLARVFRNPLDPLWHNGVVVTIWYRAPEVLLGARHYGSGVDVWAAGCILGELLTLRPLFQGEERAGLEHGVFQADQLQRWAAPGWVREGESGACMCCPAVHYVIGGVWAAKWGPEGVPCAMGGKGCCGEYPKDSPRPRLLCGCANLYPLFPLHSDRIFAVMGHPGAGGWADLEALRHWRDNTENVRLRRPDHGSRSLKQLLWEESPLLR

SEQ ID NO: 11565 - protein, 1190 aa, Chlorella protothecoides
MNDEGQPEKTPGKVDAKFILKHCPVERGRLYNLADGRKTLQNVFALDLFDNVQILPRQNERNPGQVEVDVMVKEKPMQTADVEAEWGLAAERQRMQGGGRLSSAEPPNNHARLPYTCTDEKNRPTLVSLVPGGTITYENRNLGGRAATVAASINTKSFLAPSDDISYRLMYQKPFIWGLSDENRTKLQATVFNARKLCGVFTPGVALIEGSAAPHRAPDRGPATPTPTHPTPAHRPRRGGGPARVGGPRRRARAADAAVHAGLARVAGPGGPGGGHPRRDGRALRTRRPSVAHGRRGGRRPAHHAGGRRARPPGIRPGRAGAGHHLPARRRHAGGARRADRGPGPGHRHRVPLLQPRHRRLHALPGPDPALAARSPGARLPRAARARRRGAGRPPRLRRLPVGRPLLRARVQRGRAGGVPPLRRGRRGAAPARAGAHALRLCRGRLRPGLLQGGARQSQRLLPPRGARLLPGGRGQAGRAARRGRARQQRGEVARPAALRRAFLKRVLLRAAWWYPPPDPGRRTLPCSFPLSPSVMVRHVAMLGMRGGVCRLHTAGHLTCSTAAGWKLESATAPGPLWWREPGCDGVPRLACRDGVQPGSLILECCAGVELGVACQGGIALDGSGTRWGAGRAGLLLRLRRGREGRAVVQGHVPSGKEDVRRRLHGDVQAHAEGSVGGDCKCTVLAGGSQLCTCPQPIWQDAAHLVGNRRRESRRQHPQGGGPHGGQGSRVQLGQVQRSGAVQPPGGMEAGSEHEDIAQDGSTHVPGRPVDPSKQEFEAERPGQGSATAGVPTKQPQQEQGIHSAGAVGVGFERAGTKRKYVCPIVRRGRLCQAASDPLATMAQVPARQASASQAPPIVEEPIPYQALLVPKQTILTNIKAAHASPLAAVDPWPQPTGRPPHLPSCQVMAVGQQSSRILEFDAVSGCQRAAVDCRFMPSAMELTPDGASLVLFAKVRWGAPFARTPRPHARRAGGGCWKFGSCHAGGHRHGPRFPAPRLQGPILIPSFRPFTDQRRGGVLDGHLGVRELPRPQVQESGVERRGHVRRPWPATAHRLLHRGGRAGAAHAGHGHRQRRRGPRRAGGPGGEAQVREPGRHPRPGRIPRRCVVGGPSASVTGVARLWLWSPGDQGLGGGWKVPGPGNDTLMCMNVTPRGHPRPALPLGDRPGTHRVSHAPPHSAASCLTRPKLT

SEQ ID NO: 11566 - protein, 299 aa, Chlorella protothecoides
MPAPGCSISHASHISSQAMRSSGASGAGQCGRPALIPQARTSTRAAFISQSRPRTRRYLQTRAGIETESGDGAPMQPGRGDPNASSTSLLQQPLLWAAVPVVGPLLAWGCGGGDGNGRGAGGGGGGGGSGLPHEIFAVAEDQDEGGWAWVGSAFGEEVDDEVDADSDDESEDESEDESEDEEEEEEEARPSAKPAAADGTFTCGELEAQGLPVGEGIPTQADLFAGLHCQPGFVCSRKELAQDIKALYASGLFERVNARVVPLKKNKFKVGGGCCGGGGREACGGHWMGPCGFQPGQGG

SEQ ID NO: 11567 - protein, 331 aa, Chlorella protothecoides
MLASSISARQLRNPTHLPNIAARSTLHSNSTTHYISLAMGSSLALRLQLRAVRSLWQGGPACSRPAKSMPQPSLITTRAVHSSVDPPDVRKLAAMAHLDLEEDQVEGLTKELTSIVDWFSQLQAIDVEGVPPALQADVDSQDWQRPDEPHTFENRYGHGHAAVIVEIISKSYPGKSRVAVPGDRGPLPVCSPDCTRHQRGVSGSARGSATAWGHAGMYRSTVTGRQRAHREANRAAAQLQGGVPGRGAPLQTVRSGDRVPGCGVPTFQQVVLPVRPLRSRPAEHQAPPPSSLSIDASALPRSAADDEGAADAPLTRHVDHRVLDLWNAQRG

SEQ ID NO: 11568 - protein, 218 aa, Chlorella protothecoides
MGPRHRTQALANVLTEPILGAVRAEADEAAASGWFWNIRPLKSRGTGNPRGKRMAGPECADPPCPTHATQVNSISSTPGGPTLVLATVDESADLWASNGKKGDSYRTTYQASDAKEGLGCQGLAADLTFFGMGTLCAKTRGPIINGRRRAKFIPSVHSTGRVHDGPRGGSVAHQQRPRHRRLSEAGRWHRSRGRKEEGPGVPPGGSAKVAREGRPAGR

SEQ ID NO: 11569 - protein, 118 aa, Chlorella protothecoides
MRRYRAHACIHSAPVPAAPGAILPPSNPTPPAVLADLKKKLAALPNETPFTMRTMALIKTSIEGWYQSRGYGLCYISHFSGMGTGSITAHVIEGRANKINVGSTSVHCVVWLREERHD

SEQ ID NO: 11570 - protein, 323 aa, Chlorella protothecoides
MLGAEGGQAPGCMNGDGAAGGGGTGPGTPGAPPSPPQPVPQDSSRSVPLPDPGTPPGAPPGLIHCVQGPGDTIFVPAGWWHAVLNLDDTLAVTQNFCSSVGFARVWRHTRRGRPKMSQRWLARLRLARPDLAAQADDAGAQPGEGPDSASSSSSSSSSSSGSGSSSSSSSDEEDGEAEVGGESAMAKRPRVGAVPVVDPPPSHDAVQQPTKEDFIGSATNVGDVSRLCELPWQGPTSHIMPSYFTHFPGISLPASLHASASQPVLDYPFQKAPCSAQIRVSRAVPAYPGGHREHEQMFMGAPAPGKSPMQSEWGDTAADREEV

SEQ ID NO: 11571 - protein, 176 aa, Chlorella protothecoides
  MOD_RES (63)..(66): Any amino acid
MDGEIPKSVKHVVFKAPRPPAPPGSQTGCRTGKGTRSERCMHGLGLGLWAAPQACIKACTLFXXXXAKQGAGQERERGLSDACMAWGWASRQPLRRASRHAHSSGTVLPAAGSRPCHNPIAPISAGCKDTQKACSDWADGGECDNNPGFMVGQKGQAGACLYSCNRCDLMDAATAT

SEQ ID NO: 11572 - protein, 724 aa, Chlorella protothecoides
  MOD_RES (68)..(71): Any amino acid
MHESGCDDAGTAAQRGPVPAGSSRRRPSPHTPAGSPPDLANMQSPPHVNATIQPSPHISPLGGGPLGXXXXPPHVNAAIPPSPHISPLGGGPLGALGDGAGPVQRSGIQRAVGAQAPEDDGVALTRAVGQPRHGALAVPRLAALAGRDSSVGEHRLAPLLHIRQVHEYRGQTVAAVVGPRLVCKQLGSLGGMLSIDDNRSVCGLPHLDTLLPRPPSQFMAPGRHPSSHFPHPVPSLTEEVVKVGLVLLPILVAQHLDALAVADGDHGGLAQPVLHPREHGVLLAVEEHAIGGADVGDAVSTPALHLHHAAALQPGGGGLDDVVALVWEEVGVRGWDRRWHSASPEPGSGSSSDPADTKTCRPQAVPAPADAWAYNKHSNSSSRTVGEDVLEEENTGTPTEDLHSPQSVPCARGSIVVLAPSNQVVLVPFRPGGVYQHGQRCCHEERMSKMYPQHIILDSSPILSAIDAGSGGARPGDVTLGSARSLGMARAPGRSNSRSQQSPSGAMAATCAGLKPCLSTSCRPAGISTRTQCVGGPMEWECGNGHIKMDLPRLDHESLHPFSIAQQVQLVCQEDVSGKPTSSLREGQGGGGGGGNPFGNFGNMMEKLKDAQNLVKTETARLQAELAHAALCALPRRLHFFLPPPLLPPDPLHARTEFEGFSKDETVRVVVSGNQQPKAVEITQEAYKDGPEVGGWAARQECHPLSLQPACSRSGCTPLQSAVS

SEQ ID NO: 11573 - protein, 303 aa, Chlorella protothecoides
MGVSIASSPWLGPSSLPSSACFRSPRSRCPRPTRHLAVRVKKVLSLLCRAFPRAPALRRFSAQPRPQAPDAAPLHPSPLRIHLFCQAGLEPKKLTAQDLRRIQEQGPSIQDLTRTLKVVYEPRSGKVVEPLVLTHDFVPPSALTAPVLTPEPDWRRIPEMPFMELFDGLQRRNWTHPRYDPSLPKWELAFFRDTARLLRPVYSGYRVLVQCPAEGRSAWVALDRSGADAFLRDYSGGGLGGAVHNAKRLPQVLVSPTQYGFNQVFEQVSHPADWEMEGQERGKGVPVPMVVGRGMMARGVALY

SEQ ID NO: 11574 - protein, 80 aa, Chlorella protothecoides
MYLSDVEEGGETVFPNAAVPASQSREAGYSECAMAGLAYRPRKGDAVVFWSLRTDGTLDAGALHGSCPVTKGTKWAATKW

SEQ ID NO: 11575 - protein, 206 aa, Chlorella protothecoides
MARRTYSSVYWYARGIVQGQATVRSVSDAGAFRSLELAFPQEALSGISIGASVAVNGTCLTLTRQDGDTGWFDVISETLARTTLGNLAPGKPVNFERAARFGDEIGGHTVSGHICTTACIAADAVTELNRRLEFEVVALNTDAGCAQPAHAPWVSLSGPPPMQLADASWIKYIMPKGFVSVDGCSLTVGEVTSTSFSVYLIPETQR

SEQ ID NO: 11576 - protein, 635 aa, Chlorella protothecoides
MHEIFNKGFSPRKGTTYSCPADKQLSVTFHQTLPAIPQYGIYGIALSFLAVVLAVGIFKPRKQMPIDLFMSKGKARKDGTTGVGFADVGGIGTAIHDLNDVVAFLKAPLQYAGMKARPPKGILLEGDPGTGKTLVAKAVAGEAGVAFYQMAGSEFVEAIVGVGASRVRDLFKRAMVNAPCIIFVDEIDALGIKRADAGVGTNEEREQTLNQLLTEMDGFSPSLGVVFIGATNRADLLDPALLRAGRFDRRIRINLPDEVGREEILRIHARRTSMDPGVDLAQLAKDLPGLSGAELGNVINESILECLRRRGTTVTQRHVDNGVDRVVQGVRLPPLPKHYAMRRRLALHEAGTGVLSTLLRARSGHVEAVERMSLVGRGRELSRTVLARGRDETYLLVTRARLRDRMRVALAGRAAEHLFLGEASSYCDKDLQGCNPESPPPPRTPQDARRIAMRTVTAYCLSDLGLVSYSPPPVPSMENQMFGFEVNPDRIDDNLFGHAVPGGGFQPTDATWNAVCRAASDLILAAYNDNMEELARHEPAVQAVADALLRQETVLGEELEAIMASHPPAAPVREVPRLAHDFDAMGGMVGEFHRYQRLEAAEREAKKAGEGRGLGAGELWEEAIRRAPIGAGSGG

SEQ ID NO: 11577 - protein, 185 aa, Chlorella protothecoides
MRGQGEMGWPYSAGAECPWPCTNPRPLLHATSHNRKSCNPPQQQALIYPLELVRTRLAVCPSGTYGGIFDCAGKVLRQEGVRAFYRGIVPSMIGILPYAGVDIAAFELLKERLLDEVGGRWERRSWVCSSGEAGGGWMRVGECDRMGDGQEGSLVGQPAGACRRVQLRQSVATPAPLPLRRCARG

SEQ ID NO: 11578 - protein, 141 aa, Chlorella protothecoides
  MOD_RES (50)..(68): Any amino acid
MDCVWQCGDVGASGGWWSALLAARAGEVGRSLVEGIRVVQRKRKPSNRQXXXXXXXXXXXXXXXXXXXPPPLPFTEEGDFTTAYSYYYEAYEQYAALSSPRALPLLKLMLLAKVLMRAWSWERGTVGTLLACLDREAEACC

SEQ ID NO: 11579 - protein, 242 aa, Chlorella protothecoides
MMHGLSCIVVPPAAMKSEAAAIFPRARRALRTRPWDSTSYTGKMAATTELFTRGGPDMADNRGQSMVAKHLDKLQKNKEDAAVAKLKALMPHIGPVAREMALQECGWDTERALALLRKFALSNAQELSTIQKSLPNGHYGTGSAWTSALVPRNPCPGSRRGHVMRRLRWQLALLLEGVEMGLRAIPTRVVSLSGWLGWRGKAGRKQAATCRADQWTAQAPERLLAETHHGYSGCAGGHIPVT

SEQ ID NO: 11580 - protein, 668 aa, Chlorella protothecoides
  MOD_RES (322)..(325): Any amino acid
  MOD_RES (606)..(608): Any amino acid
MPSASCPWSMFLPHDSMMMSRPHGAAPRAASSAPHSHACHARVKVQRSRSRRMSAMPGRATATDDHVCVIGAGPAGLAVAAALHQVGIPVVVLERGTGPPSSGTALGLWTNAWRALDALHAAEELRAQYREVSLCVQRPWVGVMAAGTGREELQGLSFASHSSHTCFAAAPVRPTPAVPPSFPNLARVQLCREGGRLLKDFDLHSCDGGPHEFRGVRRSSLVAALAARLPPETIRYGHAVSAVAGEDQGAGVALTVEGEGSGGQMRFAGVVGADGSASVAARAAGRKPARSVGQTAVRGVATFPSARDMPCDSIRQVWSVGXXXXKPARSVGQTAVRGVASFPSARDMPCNSIRQSVLLSPAPWKPTLPCREGAARLTPQPHFLLLPCPPANQDTELYWFVCYDTPSTKASARASAREQALRVVTGWGWGVEAAVHATPDTDLARNALGDRWDIWPGAVAGAGLALTLAGDALHPMTPNLGQGACTALEDGVELARGLVRAGFRDAGSGVERAARFREAAREYEAQRRRRTLPLTLRSNLFGKILQAPVGVVAAARDAFGAEEAPQATSTSADPPSKPGPVARNLSHTPQGDTGKTGMCPGNLCAXXXCQKSLACAPRGHRHDRNVSRESMCITGLRNPLQRSKVLNISAPWYRPAALVGGAPGTSAV

SEQ ID NO: 11581 - protein, 106 aa, Chlorella protothecoides
MRWGCRATSAQVQGGGVGSDKTVQRISGPEEEPSSPLPAVFTEAEIRASVVFQLSKLAATLLKGTELVAGGSPFDVVVGGEASGKLQEVDALQPGCAGVEVGAAIV

SEQ ID NO: 11582 - protein, 318 aa, Chlorella protothecoides
  MOD_RES (14)..(16): Any amino acid
  MOD_RES (115)..(118): Any amino acid
MTNHYSSAHLTGPXXXTVFTEAEIRASVVFQLSKLAATLLKGTELVAGGSPFDVVACVLVVRSATGDEEVGALGPNLRGIILRHDIPHLSHLEHQTSAPSPWPPVVTLIRGAGSXXXXGIYHQNIKPLHRPHGPPLSHSSGVRARQEQVPFVLVEDDAFFEESIAPLLGKHVTLSSVPDATTLTSGAADAPGLTGKASRGRPEAGAEDWKGEAPRRISKLSASAAVVPLAEVEAGSCGSKAAACSRLSRLAVDSKGNSGSEFAAPPGVVLPFGTMELALEVRYQEGGAGREALAVYSGGQVRNGTDAFGEQGLLTKNP

SEQ ID NO: 11583 - protein, 598 aa, Chlorella protothecoides
  MOD_RES (2)..(5): Any amino acid
MXXXXMYWATHAIPPSNEWRPAAELTGCSLSPLTHQAGGQASAFRDLLGQLDDMLREPEDDPRNARLARLCEEVQGLILNSSKLPDEVRRSVGRRRVGEYRCLALCHLEDATPGSFLRPLCSAGHQGTAGLPACRLTCHCPVLCKRGRLGRPLRLLVEGAGGSTPLAQHTAALEVSNTVLMRAAHFSHTSPSNSFPLSTPPGAGLYDSIPGIDPSSATSLQRSIALVWASLFSRRAVLSRGAGGEWLCVLRRHSLGHPGALSACCSLTIWEAQGLCWVAHASNAVCQSKAFQCPTTPFTRLRRHPLPGRSDGGPAPAPALPRPLLCAAHRPSGHPRRRGHVGRGGPGPGRDPGHGVTRRSLAHGNRQGRRHAAHAFFRQLQHRVAGGAGHGKGWRGHPHSHHCRLQLAGPVSTTAVSTEGHAHLQAPRRPGRSSPGGCWAWAPPWRRRWAVHRMWRAASQPGSSTSSRPGPSHDGECLEAGAGAKLCDFNRPINWNVGCAAHPVAIKLLCENRRRYQHAALCMPFLLGLCSCPVIAGASSLRCSCRGAGLDHPPHNGVLGIELGLPIPQGVQLRERAVRQFIIAVCKQERAKKRMINR

SEQ ID NO: 11584 - protein, 386 aa, Chlorella protothecoides
MLYLGRYLNAPDPILNRVGGESEAPKTSARMHGLIPVWAPRVHVLCLPGSPSSLFPNCWWSAAATMVFTIFSSICAIAFVAIFSWMIFTILRVVFQFFFPRKLVAVKRSFQVGDVTLEELSKYSGQDPYLPILLAVRGRIYDVSAKANFYGPGEPGGRQRVCREPCCSGWPELGPGGVGGGGYSVFAGREVARALGKMQITADHCSADTSDFTEKEEKTLQEWVDKFDQKYEVVGKVWWSLWGPSSTLEFGSSLIRPGIINRRGAVSVRRASCMARQGSRAVVPDLSLTLEQLAAYDGETNPAPIYLAIKGVIFDVTRGMLLRWPTMAVSASSHLHPHGPAERSQFYGPDGAYPFGGRECARALAKFSTEIDGEDTSTGCAQMEVG

SEQ ID NO: 11585 - protein, 108 aa, Chlorella protothecoides
MQLEVCRAQVEWAAAEKRSFLRQRLETRSAAWRAGGRGRALAGLLLEIKDYPAALSLLSKLLSEVKKLDDKLLLVDIYLLESQVPTRLHACMRVDAGGLYMGSMTMIL

SEQ ID NO: 11586 - protein, 312 aa, Chlorella protothecoides
MLVYYYKGSDELGPVGWESECDCRARCVHSRKARLPSTHSIRPPPLSAPAHPHQCLTAPAPKTHPPPTHETQAVPGKGSPHPALTLDLALELYGLDHHEAIVEAQQDLTCMLGWSAARRTVVLAFRGTSSMANVWLDLQVWRRPHPLGMGRWWDSTRPLVHSGFHACWLERGFGQRVLARLRAIVAGEGAAEGAAEEGGGVGARGPDGAPWRVLCIGHSLGGALACMAACDVVDLSRALERERAEAREGRGEAAAPAASGSPPAAGPILVASSYTYGCPRIGNHAFAKHYADVVPDSWDVVHTNDAVARNGK

SEQ ID NO: 11587 - protein, 101 aa, Chlorella protothecoides
MAPATIIGGLLGLGVQLYCNAVRKLPLMRNPWEHVLFIGAGAAFGNWLVDFEERTALELKGRKGLRGKGWDPWEVTSCNPGGEVLAKREAAFNHSSAERDA

SEQ ID NO: 11588 - protein, 185 aa, Chlorella protothecoides
MLCACIFSHETRVGTEAHKPTSSFPILNTPVQEYPEQLTEDVNVSTHLAQLYSTLLEKNLLRLIEPFSRVEVAHIARLIDLPLPTVEAKLSQMILDKQLAGSGPGTKAGAQGRARPLRRGSTDLPRPPPFHPSPGTLDQGAGLLEVWEEGTKDEVFPPALAAFENIGRAVDLLHARSLKLMAAAN

SEQ ID NO: 11589 - protein, 401 aa, Chlorella protothecoides
MHALQEEALGEAGPGGLPLDPVCISPAECGPHGACEAGRCRCVVLYTGVVCGHALVLSPTLLAPGLPRFVPAYEGELMLHAQTRHADIRVLRPGPTLEWDLLADAAETAALNRILPPSDLVFKSKAYPTCAVVGSSGSLLLRRLGPAIDAHVLVLRLGATPSAGHEASLGSKTNLRMTDERDWAWRERPEDLALVRSASRATVTGLLANAASPAPAAIVALDPDFESWLADGLGFAADLELAGTLLALQTCRAVTLYGLAPQGPAQGVPEAYHEPCKPAVGTTGDPPGGAAARWAALQALARVGLVAWGEPCVEECMAAPAACDTCRAALGIVPKPVDAWCESARAAGRPPAEEAPGGGAAGGGRGNGTAVGNESAAAGSGQGAAAKTEHNSTAAATTTRR

SEQ ID NO: 11590 - protein, 231 aa, Chlorella protothecoides
MCALIEDQGPGNQGETPPATPTLAPSRLRTHQLAGTAAGYREQAVAHGIPSRKHGLFADDDALLLELCASPDMAAFEKHLPGEAGPYQPLPRGGWVTGDEAAARGIDLRMFYRTPAPGEEHGSLEGVVRLGDGASIGIGFWVSAHGGAVESVLDEATAELAKCEFTPVLATVEANFRIKKAVPLHTTLRVECRVVKMRGIRCWVDGRLTSPDRSVVYAECAAQLVNISSWL

SEQ ID NO: 11591 - protein, 118 aa, Chlorella protothecoides
MMSPQPSSTTHQDIELNIVYVSRAYHEAPRPDRSTFRVSQLQWHRRPEAAGPDAALQLRCKARHGPDSVACTLEMADADSASGVVTLATPDQGLAPGQFAVFYKDDICCGSGVIEGGL

SEQ ID NO: 11592 - protein, 226 aa, Chlorella protothecoides
MQWVGNGTLACAESGGHHRPNRHAELARSMFRSLEWVLAEGGKDGEAQALALLARRLQAYLPSFDAAYTASTPLTRIRDIAHRYRIGGKCAAQRACRQRMDARIVINTTSLSLPPPLRRRNDIPHELKQEIKHTIQNKLHRNAGPEDLVATEAMLRRITRHPGEYPDAFVGEFRRFHAELSDFFSAGSLTDSLAALRPSLGDDPSDIQVAFWWAGGSRWEVAAVWC

SEQ ID NO: 11593 - protein, 291 aa, Chlorella protothecoides
MSGLPLLGPPPVPASLSATPPSCLPPFLFHPPPTTPPHTSLPLPCHQGIGGLVDDNFLAILNVTVGAICLVTLLFALWLLLWRIHRAMLSGRTWTRPRRFLVNLALWELGLQVVNLTFFLAPNAAWLADPCTPFRGIVHGAVFVQFSCWLGLFTIFVISVQGFMPITPGTASVRGLPLYSWWLRRNGETVPADATSVLDLPTWVHADLVRGSGGALDGWRWGRDCSRPSDMQGRDDVNLLLLAQRFLLRGRTGGLEGCALQTASEELPWQVLARVCWVDQQQESRRWLLLP

SEQ ID NO: 11594 - protein, 203 aa, Chlorella protothecoides
MAHLVRHPRIHAFDNVEGRFGLESGYEAVRLLGRGGTGQTWLCRRRGTGEEVALKLQQRPLPKHTLDLTYNEVVIQAEVGWGSPHMCTLQEVMLTPSHLAMVLDYEAGGSCAEYVAAQIPKVARLELCVDEERARYMFRQLIAGVEYLHSLHVAHRDIKLDNSLMDGADPARVKLCDFQFAKYWGKPEYARMTTHLGCVLRGG

SEQ ID NO: 11595 - protein, 267 aa, Chlorella protothecoides
MPPSATTHHPAPALSNDASLLQGCEPGPRLRVAALLSGGVDSSVALALAQRAGHEVHAFYLQIWFQEDFRNTWASCPWEEDLEQCREVGSGWTRRVKLGRLSEECHVPPGTRPNVPTVPPFPPQVCRALGDIPLHVVPLTAEYWALVVEECIAGVRRGRTPNPDMLCNSRVKFGAFHAWLARQEPAFDRIASGHYARVERGGAGGTGEATPHLATSPDAVKDQTYFLSRLSGEQLARCMFPLGHLQKTQLRQRSAQECICMYVPVHL

SEQ ID NO: 11596 - protein, 116 aa, Chlorella protothecoides
MASALQTRLEAIDGASSDAAQQLRALLTGEGPNDGESVKVKESALTRLCEVLVSSKDADALSSLLLDLRPLFAVIPKAKTAKIIRTVIDAISRVPNSTQRLVSLRMWQSSLCNFAA

SEQ ID NO: 11597 - protein, 184 aa, Chlorella protothecoides
MSWGRCLTTALPQSSTQFVSISGSNVEWESGSNHVVPAPEADAAVSLNWGAAEAVVKKAEAGSPFASSPGPDPGTQGPASDDSPVRARWSGKEPVFMQGNEHSRERQGRWETEGLEGATLEIVNGDRDAGSWLQKLAVAEKLLVQSAPRLRPRLDAVAAAYVYLQVRRLWVLGWGGLGSWISSI

SEQ ID NO: 11598 - protein, 130 aa, Chlorella protothecoides
MLLTRRRGSICQPRPLAGPGPECVLTPQHHPSPASPHPALLPTTHPPPTSPQIMKGDVAEVPAIINSKTGATSTESREVASMRAVAEAYDSRSLHDFQAVLEVSTGWLGMGEDLPYRKGGGEGSEEPPDP

SEQ ID NO: 11599 - protein, 342 aa, Chlorella protothecoides
MALAVFHSTPCVRHSLTQRNAPLIRLPFRSSFVVCRRAALLPDKVSLSRKAASQGVKSSAWASPRGTHIHTRATLSGSGPSSSASDAELPTRNLPGVVALLVLGALGVVGYRWLFQSEVGSAWLEATRTALARSGFARSGFLAAFSLIFTSELGDKTFFIAAMLAMRLGKAISFRVPASIETTEFLGQWLGAALLAFFGIRTLLDAWQSEEKRADEEKDAEKSRACDLEKRADEEKDAEKSRACDSTGKISARGSWRGILEVASLIFVAEWGDRSMLATIALGAVQAPWGVAGGAVAGHAAATLIAVTAGALLSRHVSEKTVGYTSGILFLVFAAATALNLF

SEQ ID NO: 11600 - protein, 161 aa, Chlorella protothecoides
MPHHSPTTQIVERFLEAKRKLEAAGSSADMNDVVDTLHTLGTLRALLCSRLSSGLRNDVGDGVLAGRLAFLAVTERPLVHGVADTAPCPVSMPRWRQAEIQAEDYAFVLLSRFSNLLESQVGWVRWGRAGPGGSGLWAGTFPAVKKTPTSSQRLEESAMAE

SEQ ID NO: 11601 - protein, 188 aa, Chlorella protothecoides
MYVGLRRGGLGALPLCADSCPPDAQWVPCLKIPLLALQVKRVRCESSGVLVPKDKAIKRFIVRNMVDASAIRDLQEACTIDSEYLGYGKGVAGARRWRAPARQGASSPTPALLPHTSHAETHSPYPSFPTLYLQTTLSPRSTGVQSFGKVYYCISAAIHSKIVRVRSVKNRRNREPPKRPGFGPRPER

SEQ ID NO: 11602 - protein, 356 aa, Chlorella protothecoides
MCAPMGYVMRLLSIHSPIALAMRYLDIVGLVGVRQQGQALGFGHASSSFSSSCLLYPRNIYAAPLIRVSPFVLSFHMPLALASFKSGGSTLSVTGNRIGLGRGKVQVTFVPPPSALPGGATGSSDCTAFLLEKSTWCCCFEVSPPQPLLVSFRGIRPSELLPVPPGASPTMAQQVLERDPLFRRMRMKPENKVCFDCPAKNPAWASVPYGVLICLNCAGVHRSLGVHLSFVRSTTLDSWTEEQLAVMAAGGNGRARTFFKQHGWDEVGSDKIEAKYTSRAAQLYRRQLEKDAAKLLEGDAGAAGGAGAGDASDPWSDSYRSKGKAPEAASPARANSLASQRPSSAEAAAPEAPDHQ

SEQ ID NO: 11603 - protein, 363 aa, Chlorella protothecoides
  MOD_RES (294)..(296): Any amino acid
MLASQGFKKAQVEKALMALAEAGKISCKEFGKQKLFIPSQEGLPELDAAALHSSTSHCRRRTPSSRGSANCSRAARSLRPKSLLSEKVRGDVDHSVTSLHPVHLPLSTELAQLNSVLTVEELQAQIATRLQQVQEAETKLAAHRGGGIVAVSAEDVAAAEQVRSCLWGTRCLPGLSCSVHRMQTLKGPVHACPDRACILSLQRSWCCTHCATLRRLNAPLSHPALPKQRFATGLTAWERYRRMFRDIWDTVSENLEANQVWVGVSIVLHLFNPDLLIGHGKGPLRVTWSRPSPXXXLLNPGLLIGHGKGHLRVTWSRPSPPSSRLTSLRTWEWRQMKPSARPWQHTSTCFQAGKRPRPAEILW

SEQ ID NO: 11604 - protein, 506 aa, Chlorella protothecoides
  MOD_RES (167)..(169): Any amino acid
  MOD_RES (203)..(206): Any amino acid
  MOD_RES (243)..(246): Any amino acid
  MOD_RES (461)..(464): Any amino acid
  MOD_RES (498)..(501): Any amino acid
MVRRCMQGSRRFAMTSRRHPGRASDELCSAACEVEITECVAQPDGRFGIHVVGRRRLRLQGVQDIDGLLYTTPSDLRDGATSEPPSPELRARVAEVERRAQAWIDRLQELVEHSPGPLYSHPRTLTIPSLPALPPLSNPIQSKPGLRALLDAASDRPEPGDHEALSXXXSDLGSAPPTATLMPPRNCHPDLWAPSTRRGPCPXXXXSGRCVCQASCTPASPGCPSLVCIPHPCMCGLCCIWPXXXXSGRCVCQASSTPASPGCPSLVCLPHPCMGGLCRVRPAWACLFPRPCVSTLPFDPGAGGTGGPAVRQPCQVSPGDHGDGEHAGAPDPGLQPLVCRAEEDHGWVLHQLRWGRCSNSPWEAATTADGCLHDTPRVSILVLDKYTRSTTTRLRFFPPLVHQGRACSQCLPCRNCCSEDCLVLIIVVVELSIISCAPCSVVVYDLRLPLMFTPNIQFDQXXXXSIISCAPCSVVVIMMVEEDVGCMWSQQYEQEPKXXXXCCCEG

SEQ ID NO: 11605 - protein, 227 aa, Chlorella protothecoides
MSIVCTALHGSHPRRIPWAPCEGTPHAATKQRTARQKYRFRSRLASSAPVPSGDEDQEAIQSAYNKAINTSNPPDVFIQDMRDFATSVLRGADPKNAPSPVAAEQWFAEYDLNGSGRLSSAELAAGLRRSGVEISDAQTLAFMEAAGISASPEGDLAVRIEAFQNLLQCMARAEFYGQRAFSANTPTAGVPAPQPPKGEDLEIIQVSFGLGWGGVPILQDEFLEKVL

SEQ ID NO: 11606 - protein, 351 aa, Chlorella protothecoides
  MOD_RES (89)..(107): Any amino acid
MLPPGTWRMRQRSMAIIPLIRSLPNATFVRQRVPAPASLVHSHDPEPSHAVLAGDAARCGRGRGGRRRRGGRGGSPGGARGTCGGRRGXXXXXXXXXXXXXXXXXXXGEGTAMAAFVQSGQRIPRRGEVGLTSSEIDNFESAGHQLSAAEEGSGLAKPGKPPGRMPVLVPRRRLEFQAPVPPGATHGALCRVYAPTHPAHRPVIVSPPHAPAPSLPALVPPAQVRNVREQACAHERGAHPQGEPGVHGGGEGGAGHVQLRGEQAQGGQDPGRHEAPGAQDAWARRRAGPGGGGGLTGVGGLGSGPGVALCAWPCQPAACDPHPLEGGGGAAGTPKVQQAWGGRHGGALRFQ

SEQ ID NO: 11607 - protein, 614 aa, Chlorella protothecoides
MTTTTQHTHLRNQGFARLLRGRVGGVAVEGDKGVDDLALDGVLHGHHRRFGAQMVPHQRRLHLRGADAVPRHVDHVVHAPQDPDVAVLVAARAVPGEVVALVDVEVGLLEARVVARDGAQHGGPGALDHQVALAGALHLLPRLVQDGGLHAEEGQRGRPGLGGDGAGEGRDHVRPRLRLPPGVHDGRAAAAHHLVVPAPGLGVDGLAHRAQHAEGGALGARDKLVARGHQAADGGGRGVEQADVVLVHDVPAAPGVGVGGHTLEHHLAGRIEERAVGHVRVPRDPPAVGGAPVDVGGAVVKHVLEGGGRAHHVAGGGVQHALGLTRAARGVELEGGVLRVHPLDGRLGGLPGHHVLPPHIPALGEGHLVARQRDGVVVHQHRGHRVRPWQGQRLVHYLLQLDGLGAALDARGGHHHGGPAVLDAPRQRLRGEAGEDDRVHRADARAGQHGGRQLRDHGQVDGDVGALLHALGQQEVGHLAHLVLQLLVGHGARLVHIVSLPEEGDTVAHARLNVPVHGIVGQGVEGWGEGWGGESSGRSVCDGKVEWDRSRGMDTECRTTGRKQGYIDCTICEEAGRKKGRLDTVTPRHAERATSMRPDSLHHWSHRTQLPISP

SEQ ID NO: 11608 - protein, 578 aa, Chlorella protothecoides
  MOD_RES (169)..(171): Any amino acid
  MOD_RES (243)..(246): Any amino acid
  MOD_RES (481)..(484): Any amino acid
MTGTKMASYPPPPGLQCPADLLASVDVLWDRQVHSGAGCLDEAGALRLGVALLEAKAAGHPARGAGHLRARGVGQGRAPRTELGEESHHAWSRRQDGVMVCGEEVPGAVHQLDGQQGAKGMAGGRMACESLHLFLWPMPRAPSDPATQPHLAQGGPHQAAVPPTPHQPXXXRPPASSSASGTPHGRRPSHATPAPSQPSPSPPWSPAGGNAPSRLTGMQRCRPRCPAPHPVGCCSTRGGRARXXXXGTPRLIPWVAAVLGEEEHGCVHPDALGHSDLGGAMGTAAAHGVQARRAGAALEGEDGGGGVHTVPQPPRVLAEPALHGAARGTCRGVEVSVTGMSRRGIWPVGRCPASSAGAGLLEFSSIASLTRYPDGHAAEAGGGPGEQPMSLIPSTFWSRRKGHSLAEYRRHGPVHFVNADLLDTALTACKDEAARGIQGGRGIWEWNGMGDALNRMSRWHVWGMGSTGAAPCPDAKILLAXXXXNCMSRGHAWDMGSTGAAPCPDAKILLAMSLGPHMDAASPATRGLSRHPHLAEGACEAGHTHSLAHCLTWNCHVHLGCCNSMTEPRFHEGTGGPS

SEQ ID NO: 11609 - protein, 117 aa, Chlorella protothecoides
MYKEDRVLSNPRGSRISRLNMSRALGDGNFKSPQRLVEATPDVVRVALRPHRDQFFILARWGEDCAAGLGGAFFWCCDGALGLTGIQNQAVWVEDSRAQIPAQPIEAYEEAIAVPYI

SEQ ID NO: 11610 - protein, 80 aa, Chlorella protothecoides
GLQIVVHGLPFAYKWQDLKPLFEGVGEIERADIVHGRDGRSRGYGTVRFTTLEAAAAAIEQFNGTELEGRTLSVKLDAYA

SEQ ID NO: 11611 - protein, 156 aa, Chlorella protothecoides
MEDRHTILPDFQLSPTTSGIPHQFAAVYDGHCSARGSEHAADRLHELLAEQPEIQTCQGMREVDDTAIQRAFARAFHEMDLEMVDVASAAGQQYGTTAVCALRIGRLMYIAHTGDSCALLCRGGTLVRLTEDHKPASMPTERARIEGQGEGVCWVV

SEQ ID NO: 11612 - protein, 536 aa, Chlorella protothecoides
MGDRVAFFWEGNDVDQSRTVTYKQLQDQVCQVANFLLSKGVKKGSDVTIYLPMIPELPATMLACARIGAVHSVVFAGFSAESLAGRIEDSRPSVVVTTSGVKRGAKPIELKKIVDEALALPGTDSVTTVLVYDHSIALPRDKVAFTEGRDVWWQDVVPGQSTEAPIEWVDAEHPSFKLYTSGSTGKPKGVLHTTAGYMVGAATTFKYVFDHRASDVYWCTADCGWITGHSYVTYGPLFNAASQVVFEGVPTYPDAGRCWDIVDKYNVSLFYTAPTAIRSLMAAGDEFVTRSKRSSLRVLGTVGEPINPEAWRWYNEVVGGGRAAIVDTWWQTETGAHMITPLPGAIPAKPGSATLPFFGVEPAILDESGKEVEGPGQGYLVVKRSWPSMLRTIAGDHARFEQTYFNVYKGYYFTGDGARRDEDGYIWILGRVDDVINVSGHRIGTAEVESALVGHHLCAEAAVVPVEHAIKGQVIYAFVTLYGDATYPPPEETRKALIAQVGVLGGGGHDRGGGALGDSCRRGGREAECPPDTLAP

SEQ ID NO: 11613 - protein, 192 aa, Chlorella protothecoides
MGPRRRPHCPTKSTKAVPTGENGVFTSLFRGVTKHRLTGRYEAHFWDASHKRETKVRWVWVWNRAGAREGWEHCRETAHPEARVRCIRTPSHPPMMGIIPPPHPCRPSPQGKGGRTRGRQVYLGGYTSEEEAARAYDLAALAFLGAAAAINVRFAVAKRCRGGVLAMTDEYMGADLMQCRRHHLNPFPVAMT

SEQ ID NO: 11614 - protein, 212 aa, Chlorella protothecoides
MVELRVLRTILEHDPGGRWHCVRLLDWFDYRGHVVMVFERLGPSLYDYLRKNDYAAFPLDLVRDTARQLLEALAFLHSLGLVHTDLKPENVLQRGVEVVRASWPSGSRLARRLPATHALCLVDFGSAAWDADAHAHVVSTRHYRAPEVVLGAGWSWPADLWSLGCMVVEMLTGDALVLAGKLVLEGTEGALRGRARAPWGATCILLTRHGDS

SEQ ID NO: 11615 - protein, 195 aa, Chlorella protothecoides
MARKPIPLGAPPPNPPHTLDVGITRTHSGAGSTLPQDRTGSSSVPPPQPHASEAIEQAGPGPSSLPPSPGNSSDSQEADTSTQVPVLPGEAPQKRPRTVYPPPRAALPEPIPPSELLFPDRTSGPVHPPNSAGHFQYEVGENLTARFKIMRKFGEGTFGQVLECWDRRRGEYVALKVIRCVQVGSGRCSRWEGGM

SEQ ID NO: 11616 - protein, 144 aa, Chlorella protothecoides
MEELTSDEVVSRLRRGSVGFASQGRTIMQRGLHVHGNGIRIQGQECCHVEMTSHRLIAQTPPRLCRGASQYRGVTKHHQHGKWEARIGRVDGSKYLYLGTFESAEEAARAYDRAAVKFRGRKVPGGLWDVGSAGAGWWGCKLIL

SEQ ID NO: 11617 - protein, 403 aa, Chlorella protothecoides
VAASSDAPLVAVSARFDRLTAALGSPATLRATGALLGAVRARHPGPLPPLGHLLRRVFPPSAARVPRYPARVVLSAYAVATHPEVVLSGLGGQEAGLVHAGARLAAALRAVALAWVEGGEALDGDAASRTATQDPTPTAALPAFDAAWVEYLELFVAWKAADAAALEADLIRIAVELQASAARKREESAARDVRARSAPDMAALEAALQADLALLRERVLQLTGRAGLRRLEAALRATPGEGEAVGGAPGLDGAEGQGRGTTSQPAAAAEEGGEGGVAQTIDAWDVDAFLAQHPNFRLLWQLLHEPTWRLPTEEAEGAWRGAVRAETGPDMASSPVVDAGSGRVDAARLRTIAEAAFWDGLRHDLNKADTAGTAGETARRGVLQRVGKACGLTSRRKGAAATS

SEQ ID NO: 11618 - protein, 122 aa, Chlorella protothecoides
MPSWPCRLLPSAHTSPPSPRSRVWCFPAARPSTRSVAGSATRRGASTALDPPWMWASGWPSRPPRPQPQVQTAPSQPSATLWNLPAPTRATWPPPSPSTAPGSGCTPTHPVPSAKLAPSPQA

SEQ ID NO: 11619 - protein, 1101 aa, Chlorella protothecoides
  MOD_RES (448)..(451): Any amino acid
  MOD_RES (853)..(856): Any amino acid
  MOD_RES (950)..(953): Any amino acid
MFSIAGKDRGAGPARPEHVPVSQPPHPITTDVIPDPQRLWFVRPSHPFRRAVLSLARWHRTTPRRSTCFGFEGRLHLRCIQDDCTDPLILDTILKVSFQKKISVNPKSASHLERLELLTSHFELSGGVLNLGGIIPHWHSKRPMDRVKPPGYLYHQCMASCANNALHSRCIIVTSFSSISDRHLHPGWQTMPFCKGAEKALTWEKGGGHMMPWRTLHMEKLESGCAHILDLQCIGRTRKGYICEAEEDIGEKENCWRKHHLLSKSAVLAAALRCTHQPCRMRVPPAHICQKPQLPRTVASTYSSLIVYGANREPLHPPRAPSARRSVVSQQLADKHMSTSNSHRSMACQAGAGLQARDRSGLASASGWGFTARVNSIRSSVSACGRCTHVGRYDGEEGFSAILPSTICRAPGLTRHSYHAKAYVVTRLPCVPLPHLATPTPLSNHPRXXXXCCWAVNPPAHMHSIRCDPSTVRALAPSCNPYTPSQTTPVQTPGRSLGGHARPGPGSHCRAPAAAAAATDVPPTADAQRSERTFDIPGARVRVEVVTRAPCGTQAITVATDKPGSLLLHWGVEGGAGYEGGWRLPGPGARPPRTVQYKQRALQTRFSPAADGGQAVSIELPGPEASDRLNFVIKNEGKGEWYDLNGANFQVQLRDGKGGGAAAPAGDVRPALLPADAVPNLPQELCGVWAYLAWERAGCPARSGAEADAEYDAGVAELVLLLRRGVGLDELWAVARGQVPWAQFQAALGGAVGGEDAAAGRAEGAPSPPAPAPPAPAVPEHLVGTQAYLLWEAAGKPDGADFGADARRVLREQLAAGRSVQELEHALGASPPEASPTASAPASAPAPAPAQTXXXXAGCIPARGLANGLADGRTAGVSASASANFGGVGPGRLARNAQRGPPGPDQAPRGRTAAGRCAARCPRLAPGALAVQGSVGGQANERGRTVGRRXXXXDGLKRSRGLFVGGQANERGRIVGRRTFPGAVGLFRAQLIPACRRPPPRQRRALSPLSPPRTHVYLVSRCHPSHLPPSPPPCSSPSRQTFNLGDGAQLLATVRRLGDPHAPADDSPELMVELVSDAPDALVLHWGVRARDDGAAWLPPP

SEQ ID NO: 11620 - protein, 298 aa, Chlorella protothecoides
MSCIPLYLRALKYPGASSFPSDTRASIEVEAARPLVTWLENQKIRHYTIPQRQGLLATSADDWRAAYGQYLTALECPCSSEGLPATLQWLCSRAVSLEYADRNEQLNASTSAAVEVGGAVSDWSEHSLPPFADTASPAVAAAVMRMLRTLHMDQEEVLASLYPPPLLITPRSAGDPLHRGAAELGAGHPGPAGLAWGRGHRSPLRDWTAGRLSRRPDRAAGRLPARLFHRIAALRRGGYHPAHAVPARPARPTGRRGSGAGAGAGEHRGGHGGQGLRPPGAMTARRRVAGRTTAVWRV

SEQ ID NO: 11621 - protein, 170 aa, Chlorella protothecoides
MNATIEAHIASGFVAYNYFDRFTHPTGAPQLFAYDRCRGGSGVALLGPHIMGHAECSDRSPCPNLKPPTPRRQPPCAPPFHFHAAPQVPGGGAPAACLDGLHRRGRVPHLPGGGRAHQEPGPVPLHQALAGSRSLARARGGSGCWPDRAPARLTGGADLAPALPPVAMLA

SEQ ID NO: 11622 - protein, 124 aa, Chlorella protothecoides
MPRGRCVCSKTGACTALPMCTPQPRLPMHTRSGSPMASMPQAADDLDVTSTVISPSFRSAPWNQEAKATLAGEPEPSSQTLVLFVSESGVCRSALAAAAFQAAIQAVGLEDRVRCQAVVSHACV

SEQ ID NO: 11623 - protein, 163 aa, Chlorella protothecoides
MRCLPGTHLRPLILPQDCPSRSAVPAFARVNVQSGQHPRSPGAPPSSLALASAAPAHACPSPPCAQATQSFNVGEGPERAAVTAARARGLEIPPDFAARQFDPGADMARCDLVLVMDKFTASDVLREASGLAVGFGGLTPWVSADAEQGRANTGVSIHHVPHQ

SEQ ID NO: 11624 - protein, 122 aa, Chlorella protothecoides
MADLKVQRAIVFRTLGDTSVLEDVKDWPVPVPGKRQILVAVKAAGVNPVDASIRGGKDFPKAITKLPQMVRTGGTPCHSGVAVSSFPQVAGNPGDGTIASSPPYMRCIFLSLQRVSSLTRPQ

SEQ ID NO: 11625 - protein, 200 aa, Chlorella protothecoides
MPSQVSGCDFAGTVAAIPEGTETNLKVGDRVYGLADGWAPWASDGSFAQYTVVTAANAARIPEKVSYTDAAGVPIAGLTAWQALNATGLDAGSGKRIFISAGAGGVGTFAVQFAKLRGLHVTTSASPVNADFLKVGEGKVQGGLGGLSVIHARHESSRYCYQLPFQDLGADEVYDYHKKNLVELYKDNPFDAVIDSRGGG

SEQ ID NO: 11626 - protein, 105 aa, Chlorella protothecoides
MFSTPFQAPRAVTGQRVAFGASRPVRVPHRHALRTIPRASVADVARYLADAAAQIFNPAESDVKWEGTSSGFTGGACPMDGCAWVPGQGYAYLPSSAASSLENAT

SEQ ID NO: 11627 - protein, 101 aa, Chlorella protothecoides
MAVWSAGQHMCAAVPWHTQLLPHHSNVHRKLTAIARLGPSFHPIFGRASGKDLTDIVGLVAEGKVKVVIDRTLPLGQAAAAHEYVGKGHTKGKVVLTVDEE

SEQ ID NO: 11628 - protein, 237 aa, Chlorella protothecoides
MCPSKINLFLRVERRRPDGFHDLASLFQVVSWGDDMEFEPLGSSAGADVLTCNMPDVPTDSSNLAIKVGHGWGNDGVVVAGALDLFRRKTGSRERYRVGLRKRVPHGAGLGGGSGNAATALWAANQLAGRPAADDDLLAWSGEIGSDISVFFGSGCSYCTGRGEVVQDVRPVPLSTNTPLLLVKPPAGLPTPAVFKRLDLERCSREDPLRLLQGLQGLRRASAALCVNDLQAPAFQL

SEQ ID NO: 11629 - protein, 251 aa, Chlorella protothecoides
MEFPDPVIKVAIEPRSKADLDKMGAGLVKLAQEDPSFHFSRDHESNQTVIEGMGELHLEIIVDRLKREFRVECDVGAPQVNYREGISRASDVRYVHKKQSGGSGQFADIAVRFEPGEPGSGFEFKTEIKGGAIPKEYIPGVMKGLEEMMSSGSLAGFPVVDVRAVLYDGSYHDVDSSVMAFQIAARAAFREGMRKAGVQLLEPIMKVEVVTPDDHMGDVIGNLNSRRGLVQEFTDKPGGIKVGQGRRGAPP

SEQ ID NO: 11630 - protein, 66 aa, Chlorella protothecoides
MSGSGSTVVGVGSDAVPDSIAAWRQDLFLAPARPVLREEGAWYAAPAPELLRELGVSAVAQPVGGI

SEQ ID NO: 11631 - protein, 220 aa, Chlorella protothecoides
MKDNGPSLSILRSAVLPALGGYLFTFYNSKKADERKAQIQRINDQVRLLYGPLLACVHASRAAYAAMVRQHSPDGTVGGFLAAMRRDPKGHEGSAYRHWMKDVMQPLNERAADIIVDHVNLLESAEIDPRLLQLVAHVSAYKVIISRWDRGAVGEWSAISYPNTLLDYVRTEFQRLKRRQAELLGIKRPAKTAGKHAAPSSANGDEAIVASKASQTRSKL

SEQ ID NO: 11632 - protein, 201 aa, Chlorella protothecoides
MRRRSGLVLIFACLGCLALLACGQETGGAADSNQIGNNPPFPQPVHTASLVSEAGAEAVAQAIVDAPNSPENGEGGGTGQAGHPTMPQEAGPSPPSSEPLPNFESTPAPYQVPLEMQDMQPSPEELTSSTFLTHGDQVAPGSVALCLAVRDAHEDILEWLLHHKRLDMHRDWQRRSCLGCLGEVRLDTWLGLPEEKPMLAV

SEQ ID NO: 11633 - protein, 89 aa, Chlorella protothecoides
MADLTCFPPSFCTQIIKALVPLAEMFNYVSTLRSMSKGRAQYTMQVHALPPLPPRIPSRQLENYEVVPKHIQETIVASSAKGEKAKVAA

SEQ ID NO: 11634 - protein, 573 aa, Chlorella protothecoides
MDRIGDGQGLGTEIARWDQAAGRCEGEQVHLGAPAGGVLPLQPDTQGAQPQIARRSGAQVEAFAATGSRTGGASQVGVLGARGAKDQDVSSRVQYQCVLGQVPCKNMEDASFASHQKARGSPLFYLPSREEAGAVVGTLGLLLWGLGAAQPPSLEHRLLQSLPAHRVDVLCRPAVPRPYMSSGWVRGGPNTESPSARTCDRASSLLGPSPPTCLRLKRRVGKEVRAACHLYTPMPRQPHQHQFALVALQVSTRRRWGVPHPTQVRTGGHCTMHSLRWGLGTDRQATVVPDIGGARRPIQGPHPADHLSVRFSFAPLKGAGSRRILPQFDREPHARSFPNGPMSAQVPMTPLTPSYAPHRSPCNLCSMSAPALYSSARTHAAQVSVGLRCHARSYLLPHPQCLSTCPASSHAAAGWADMVFGTLHSPNERAATSTTRSREGLRRPGSPWERGLEGSWGEGSCWNGPGCRHFPEPLAADMVKTGTCLLQKCQPELARCLIDGECVENLVCLQVCNGKDDESGCQVKCADRYKNDIIDKFNACAITSGGCVPQKIEKGRLGWVMFAGLQSPSQLEM

SEQ ID NO: 11635 - protein, 240 aa, Chlorella protothecoides
MQRFVQDPGNPGVLYNHDNEYLHYGTTTVPAAGGMEGMHGIACWQLGRRCDGPFTSPAVIAEMDACFLTHRFLPMPVVAEDDWYVVGWEPDSYAFIVYKGQNDAWKGYGGATVYTRFVNVRSRGECTGQTLWGCLATCGTGCRSCCHAGCVIAAGPPALQQFPHLTPVPLHRQSLTPRMLAHLQGLLIPTRAHKQDARAGEPSRTEMGGVQVDRQLVWTPPTPARWYDRLRAGGEWSGIR

SEQ ID NO: 11636 - protein, 247 aa, Chlorella protothecoides
MPEAEVAQGGADAPPAQPIRPPSPQLAATPIPSPSPTDLPHPGSDWVPPPALFYVGTAFLGASYTLSMTCMETFLSKKVTQFADVVGNNIGKYLSLFYMAISAGRFAGPLIVGSLTRISTPNGESGWEGGRWYPLSAAMAGACMTAGRLVLGEGWTLGPRAEEGWLDDPGCELGSLQLAGPARVDSACREDMCSPRHLHRSMPPLLTRRPLTGDTFVCTTGWIYEPTGDVLCTGPADQQCGVTASDY

SEQ ID NO: 11637 - protein, 517 aa, Chlorella protothecoides
MIACGALSSHAFTTRPLRHGADLARAGLVRGAPSARCVRPHGAHDRHPPRSSLQSSSSRDRTGSKALKTLQISAQGTEADGARPRRHAASIVMLLGMLALSSWHPVTALASPLDLIASSPAGPGPLIPGTACACQAAAMVALQEATISVILREGTECLSSHCMPALAAGHGTSVEHLQDVPVFAVHAGPRPQGVSSLPRTGCPSFPKLKPSNPVSPPPPDPGFLGDSTLREGAVSAFFLIFLSELGDKTFFLALLLALQLPRGLVFAGTWGALAIMTLLSVGLGRALHVAQVVVPSLPGGIPLDDGLAVVLLAAFGVQALLSVPDADEAVEDERAGAEGLVGGLLAKSGNGIGGVFWGGLWGAWLKGKEGIGGWDPVGCPCLKGGGGESEWMLVLTGRRHPVCIVDGVLIQRRPAQRVSPRYTEGPPTPHRLPRPWSLFPTHRGLAGPGGVLLRAGICRRVGRQVLPGHHRPFGGLRSPGCEGCWERRAGGPSATLVGESVPSLNALPGSDALHHRE

SEQ ID NO: 11638 - protein, 461 aa, Chlorella protothecoides
MLIRMTDGCKNAWCRKVRPPGGNCHTDPGIMEKVNNFGTSTKCGDRRKCARRVASAGVVPSSLAMAESIGCAKKRARPCTPDQDSQLTKCVTGTGVMRHATPTSGCTTPHSEHGPMAHADGLVSPIVFLTPPCPVKYWHGGLWQPLCLHARAGHPCIKIVPISIPMRSHSNVMRSQRCREVPCPRWAAMNLCPGQTIPSGDLLCDLSRTHVDHPGLCPGGENLAGRRRSRDSLQGRAFQRAHCGNEDRQRNGGWGLHMVSDVEAWILVGEPGCDRVDFMQGQTFLTEWNVYVALTHKQHCKWIPRAFQFGLHSAPTGTAPWMTMELLGPSLHDLRRRRVIAAPQVKALGSHALDALQWLHGRGYLHRDVKPEVSSLVCEKGWYGSGAVRIDVWNLVMPHGWVPDLEPAVRLIDLGMAQQWQAGQDPPRPTFAGSPEYSLPGNTIKERVGVCSEATLCILWQ

SEQ ID NO: 11639 - protein, 67 aa, Chlorella protothecoides
MPALPAPQDVAEERETLSAPPSVPSDGLTSAPGQRSPVTPYFFWPKEEAWDLMKETLEGESSWIPEE

SEQ ID NO: 11640 - protein, 151 aa, Chlorella protothecoides
MMFIGDSITRHLAAALLRAVGSTGLGGALLLVTLQPPGKSSTADEVVVGHADFDLTLPGRDARLSFLWRPYPWNVTEALLEEVPALPRPPSVVIASFCLWHALHVRDADAFAEDAAELSAAAAKVGEGWGWVVWSGKGSRKSQRASLHLSP

SEQ ID NO: 11641 - protein, 290 aa, Chlorella protothecoides
MRASDPYFNKLVRIMATRCMTQAVYFNSGELSVPEYHHYGLAAPLYTHFTSPIRRYADVVVHRVLMAALGLAPLPGSMRDRPRVADTVDNLNVRHKNAQLAGRASVELHTLIFFRGRTVVADARVTRGISVEPWSLGGGGWRAGFVSGQAVYVGCASSAQPPKYLPTVSQPSLTHNPTLPISQVRANGLLVFVPKYGIEGPVHLDDADRAGKEGVSSSAPAAVDSAPGAVPRFVYDEEKQTVSREDGGVAYTIFDTCAVTISVEETAGNRRVLALRLTDRAQLPDGERMG

SEQ ID NO: 11642 - protein, 333 aa, Chlorella protothecoides
MVPGGYDAAFRVLAAGLPVRLGCAVDAVADAADGARVSVRVAGAQEERLEADAVIVTVPLGVLKAGAIAFSPALAAWKTAAIQRLGFGCLNKGHVKGAVLGSVPESTVHASTRPFPHHHHPQVVLQFPRIFWDNGLDYFGGVAPAGEQRRGRCFMFWNLARHNGGVPLLSCLVSGAAARRLEAGSDEEAVAVSLRALRRLFPGEGTVPDPEASVVTRWSADPHARGSYSYVAVGASGKDYDALAAPGSCRSPGSLRGPHTHSWLGPANLGVGRPRASSTTSPPSSQQVRRRILFAGEHTARAHPDTVGGAMLSGLREAVRALALLDGSEGLEV

SEQ ID NO: 11643 - protein, 95 aa, Chlorella protothecoides
MLPKPLTEDICSLRSGVDRLAFSAIWEVTPDAQGILGNTPSPSTSHHSLQSSPPPLQILSTRFTKSIIRSREALTYAEAQARIDDERLTDDVSVS

SEQ ID NO: 11644 - protein, 174 aa, Chlorella protothecoides
MDDAAAALADMPEAASAGLSYGALLERALRQREAEGTLFGSDDEEEEDATGGAKSVGGDAREAGARDVPEAEGGAPGPSGATRHPAEVDAEAAVRTCMQAMLRAVEGAEDGAEPGSQTPRRRVGPRHTLLPEERRLLEWHWANLEYGCSASLSEVIDNGGSRGEGEEGMWKSPA

SEQ ID NO: 11645 - protein, 174 aa, Chlorella protothecoides
MASDQGCRLVLKRTLHTLHCPANPQVGDYLERGGPPPEFLAKQAALSAAAAGQAAEAASKKKVIVIGAGPAGLTAASHLQRHGVEVVVLEARDRVGGRVHSFQGHGLRAPVDLGASIVTGTAPDVKSGLRPDPSTLLLRQLGRDLHTLSRDLPLHDGPDPVDAQLDARIERWVL

SEQ ID NO: 11646 - protein, 245 aa, Chlorella protothecoides
MRSQKSKYHWDKRSKKYVKLQADETVKAGRRIPGSKVRFCVGWMSFGRHGTQGLAAVLSEFLSRYWQRHGAFKGSLLSARHQEHQPASQVPAPHAQSGGKGKKEEGSGLYKKWAAKNKMQVAGPKEAAGAAALAKQMGERVCALRCCGEGALPTPHGPGRQPSTRCAPAMPRRHRAHCNPSRAPGTHARTPIDHPSRFKRGGRGWVNPLKPEAGGDDPRARDEIKNPEQVRKQRKLDERMRERQQ

SEQ ID NO: 11647 - protein, 436 aa, Chlorella protothecoides
  MOD_RES (23)..(26): Any amino acid
  MOD_RES (301)..(304): Any amino acid
  MOD_RES (361)..(364): Any amino acid
MMRCVQTCGQCPRHAPAHFGPPXXXXDVLCANLWPAPQTCASPLWPPRPVPQAGTEIGRQQGPGRPWSEQGHRLRWRVLGCPPGRLLRGAATCWCHGGLRGLAIGIPVLNGWGLTETSPVLACRSMTTGPNIRGSVGRPLPGTRVRVVDPGTREEVPDGTQGLLLASGPGLMSGYWNDALGTAAVVLESQGQRLEGAGGWGRSSGGSGPHRAWTSAVRCSHYCWELHPSGRQVGCLSRDATPLFHRTCQGHDRAVQWRERAAPVPGGRHLYLALHNLCCAAPRSTCFPMSGMTPHLAPLFXXXXCAGEQWALDGVVGDGHRALGALLVPNRETLGEVPGAIDDSGEGARRLWPGLHPPSPXXXXCQPRAIKEHRWTQAPTFAIWPTPSTLSLPQDPAPPLPELVAPGVVAGMLALQAGPLVEWREFCQPRAIKEHM

SEQ ID NO: 11648 - protein, 438 aa, Chlorella protothecoides
  MOD_RES (296)..(299): Any amino acid
MYTTMGPAMDSLPGMSRVLPLGTGHTSQLKPWRTRPFMTHSKGTRNGRVHRIKRKVAEVQYSPAPQPLERTTSSRKPSLRVTEAASLPDLWQQLSEVHGDAVAFVDPHQQPVSSITFRQGAHGVEQWRARLNPESIYQDIQMVSVCLIMTVSPVQAPAQQFMCHNREFSETIDRFAAGLQSLGLEKGERVALFSEGSSRWMVADQGIIKWCASGVHVNSLQAPRDFGRACSIACLLACYDHMYLHSMLDGFFIGAWYCKPGRGAGADSAQLAGVRISHPGCIEPGRAPAPTVRGEXXXXAGVRISHPGCVEPCRAPAPPVRGETRVPNGRLGWKPLTVTALQGVPQRQLKFVVQLWGDVAEEARAALPCSVLSYAELLARGAETSLQRVDLTEDDLATLVYTSGTTGNPRVSAPVWGTVGRRMGMEAPSAAWGTGLQV

SEQ ID NO: 11649 - protein, 1091 aa, Chlorella protothecoides
  MOD_RES (163)..(166): Any amino acid
  MOD_RES (237)..(274): Any amino acid
  MOD_RES (297)..(300): Any amino acid
  MOD_RES (395)..(398): Any amino acid
  MOD_RES (673)..(676): Any amino acid
  MOD_RES (766)..(769): Any amino acid
  MOD_RES (831)..(834): Any amino acid
  MOD_RES (878)..(881): Any amino acid
  MOD_RES (968)..(970): Any amino acid
  MOD_RES (1078)..(1081): Any amino acid
MGHCNMKQVHSLRYTSSACQKGPGPDQPLKAGAQCRHWGHVTGEVQERVSPGAQLEQESQPRPHLRPFPQPQPYVCRLYDPRCRLFVCCPAPALPAATARPCARPRSVIFFPPSTPAAAPRAASRSPRRDSRSPSRKNTRSPARSNDSGSPAPRRGSRSPARXXXXPQPCSQQRLAQPRTQEGVAQSRPPRPFSQQIACCGFSPRIMEGEGHSKPDAAGPCCRGVPGLCVRRAAAPXXXXXXXXXXXXXXXXXXXXXXXXXXXXXXXXXXXXXXLMSDMAGEFGVAMQWVGERGWGXXXXMEGEGHSKPGAAGPCCQGVPGLCVGRAAAKPCLGACDVQAKLEELFDKGTLKSSDLDDALMSDMAVGAPGHALRSSKPGHAPLTSPAPSALPVAXXXXGGSRCSRACFEELQTRPCTAHLPCPACPPCCWDPLSSPDAPPTHPSPPCSSWGGGRPLRRPAPVRVGLFARPLHRRLCQWHHPPRAAGRPRPRERPDRHPAALREAPGRGPDRPGVVGGMKRQAGEWGDSLHGAGPPRKEENVRSGNPGVGALSHADCYSAALGAAPTSAPSRLGPSPCTAADSRPPMSLDAQDKIGKHEVDARMVRALADLPERLGEEACTRFDQSVDSGVRSRQGFMVGFEGGICRGKWMRRLPGPAAQSGPGPVAVDGLAHXXXXPLPPGLHERAWSRPSNMPPSTHMHPLTRADGHHQASGGGGPLRKAPASGLPKERVGGVERDAGWTVISTPVPDLFGELARFLSRCWLAQXXXXAGCWMDSHQRTCARPVWRAGKVPIALLACSTPFWGTFCILGPAMAAAVAMAAAAVATAAVAXXXXGTGGGYGGYGGGGGYGGGSGGYDRGYERPRYDDRPRYEERPRYXXXXAVADMAVADMAVAAGMVAALVAGTAGTVAAAAMVVGRGAMTAGMSAPDTTTGHATRSVPDTRSAHAMTTAPATTTGHATTIGTAMTXXXPWRGSLRWEGRVPSWVFASAALAKASPVDLILVCTLPVRSRTATGEYRGCRGPESEPAARRVRRTLSSSMTWHQAGDAEFTNNWASATGSLLRSKTRTSRQNSPALTXXXXCHRKPPAQQN

SEQ ID NO: 11650 - protein, 302 aa, Chlorella protothecoides
  MOD_RES (172)..(174): Any amino acid
MTHPPNHPTCTASPRAGDGDRRAPLVSRGLLPRLWHGPAHLPGVLPRHLPGGVSVDDWYPALSVAKEDLFNSLTAGGIAAFPGIKELIAAARGAGLGVAIASSGSPGKIARNLQSSGLAGLVPEELVSGAAVAGRGRGDVCLPAESLCRASSRRSTPLLCQPHAASPPRGGXXXAGLVPEELVSNVAVAGRGRGDVCSPAESLCRASSRRSTPLLCQPHAGSTPRPHPSSSIAPPRCWSPNHTQLADGERGLRGEGQAGPRRLPGGAASPGLRRRQPGPGDRGRSERVPGGQGCRLLCRGGD

SEQ ID NO: 11651 - protein, 713 aa, Chlorella protothecoides
  MOD_RES (28)..(31): Any amino acid
  MOD_RES (314)..(317): Any amino acid
  MOD_RES (619)..(621): Any amino acid
MPRLLPLEDLKATTMAAVTPVQITPGAXXXXRFWMPRLLPLEDLEATTMAAVAPVQITPGARGITGVGGRRWQHQGHRCPGHLPCGGESGEVVSRVAGAIAAGVPLPVAGLGGFPHSKSVGPPPRRHRLHPGGGAGGRECARALRPRRLSQCRGATRGMAKGVVTSAPASLCCPGGLHRGIREAPPAAALHGNRGGPPDGQRRPGRRGGAGGRATRAPGRAAQPRLPGAAGAVRPHGLPARLRQRGVQGVPGLPGRAGLRRDRGAGLRGPGRRRFGRLVLYQGGAAPLPAVPRGAGPRRQLPGGRGGARAGGVXXXXCRAALARGGNCLEVETGPGPAAFAWRKRDKLGAGGGATAEPSLWVEPLAWMEPALRDGATQGKLYCPRCGSRLGTYNWAGMQSASGRWVVPAFQLHRSRVDTEAPLAGERTAPIARAVPRLLARRQPVVGGARQEGNEAADAGGGAGVNTGDGGGAGPGAATDAVPGPAQASTGASGDGESTGAADTAAALEGGLGTGVRPTPAGGATAAIGPPASLPSFPAFTHLILDCDGVMVDSERPSCESLRLAVKQVPRQGGIGGCGHAASLLATLPARTPAPIGAGCWPGRSVADWFRAPAPQQAXXXAQLRVPPAGGEAGTQTGGNRGLLSCRFTPRHAPCPHASADRGWLLAWPQRRRLVSGTRPAAGREAVPEQCKTDLIDDSSTQPPDLRCIPTCR

SEQ ID NO: 11652 - protein, 93 aa, Chlorella protothecoides
MRRLLSHAQRRQLAQVKAERQGLLGALISLKNEVGKSGGELQQQDIAALLREVAAKKERLNDLREEVRVLQTRQGGPGVGQFTGPQLMQPGRL

SEQ ID NO: 11653 - protein, 120 aa, Chlorella protothecoides
MLMIPGPSETEDAATATLAALEATQSEITSLQAARTAAAAAEAKARRDQAQASAALLEATRLQEAASQDEATLVQAVHDTSIAREAAEQALHKAATMSEQVLTDWHKKVKERAKEVGALG

SEQ ID NO: 11654 - protein, 553 aa, Chlorella protothecoides
  MOD_RES (367)..(370): Any amino acid
MRQGRLFFRLCPASVSEFCKRCTQGITARLCQGPLRTCSSSASNPASVPFLPGSGRAKKGGSGGKYTWGGLLEDEESGATDAVTDRRDPNYDSGEDGDDASQHVFWRDAARSEVAAFKAGVTAALAEFYGTGDLTEVAACLRDLGSPQYGYWVVKRAVVGALDRHDREREMTSVLLAALHGEASGDILPKWRPPVTQLLTSSDLRKGFQAVAAELEDLELDVPGAADAVALFVCRAVVDDALAPAFLSSLDTVGPAGEALARKCRAHLAAKHAAERLARCWGGTAGFDLEESRASIKSMLEVGSVFLEGKRAGIVRWGTRSVGWALWESGAMGLIEAAALDHGTATRHAKLHRAVSRRAFLPAQEYXXXXSIKSMLEVGCFGGEGKRAGIVRWGTRSVGDSARKLHHAVSRRAFLPTQEYASGRDVEEVRRRLHDLAVPFFHHELVKQARGVGGTGRVEEGLENVRRRGRATLMSTSSQRGVTVPAPSAEHGPAYPSHAGHRQGAGDGGRGAVRRPAFQPGGRVRAVHQPSRKGEVGPNFSARLGAGHGFRCR

SEQ ID NO: 11655 - protein, 240 aa, Chlorella protothecoides
MALASLDTLVALGLEACRVGDAGAAALGALRSLERLDLSDTRVAGPGACAALARLPRLHTLSLAFTGVDDAGVVELARCTSLRRLNLDARGVTDAGCAALAGLRALEALDLFGARVTDAGCAALAALTSLRSLEVCGGGVGDAGVARLAALIHLRTLSLAQNAGVTSRALGALAPLTRLRALNLSQTGVSNAGLAALARLPALETLVLHGTRARASGAVRLQAQLPGLAVVGVPGIASPK

SEQ ID NO: 11656 - protein, 205 aa, Chlorella protothecoides
MRIEEVASTAKSSRVSPHTHIKGLGLTPAGDALPLGSGFVGQEQAREACGLVVEMIKQRKMAGRALLLTGAPGTGKTALALGIAQELGTKVPFCPMVGSEVYSAEVKKTEVLMEHFRRAIGLRIKERKEVYEGEVTEMTPVETENQGGGYGKVISHVIIGLKTVKGTKQLKLDPTIHDALQKERVSPGDVIYIEANSGSVKRVGR

SEQ ID NO: 11657 - protein, 67 aa, Chlorella protothecoides
MQGFGRVSDLLADIELDVPTARETFEDMVAAATKAGWLEEGFQSGGETPMGGSTWEERGGGGGVALD

SEQ ID NO: 11658 - protein, 141 aa, Chlorella protothecoides
MHSLWKEFLLPRLPVARCRVRPCPFPMLTRLSISARSDAYATEFDLEAEVYVPLPKGDVHKKKDLVQDVTLHDLDAANAKPQGGQDIMSLMGQLLKPKKTEITDKLRQEVNRVVNKYIDEGTAELVPGVLFVDEGSSSSMR

SEQ ID NO: 11659 - protein, 255 aa, Chlorella protothecoides
MIFTGRPHPSSPSPNSPFPHQAVQLALDRKDRERELVSALLPTLVPSVISHGAAPRGPLAKGHAVGPAQRAVCLTGCLVAAAEDLTLDIPDAEPLLSLFLGRAIVDEVVPPRFLVESVPRLRGDGASLRVIQHAGAHLSARHAGERLGTCWHERVSRPAELASAMREAVNLSGRIPRRARPPDRHQSPVPAPLPGCMHEYTATHDVHEAERCLSDLAVPHFHHEFVVRWVRGALARFDGGCGGGIPPRPLLGCGS

SEQ ID NO: 11660 - protein, 150 aa, Chlorella protothecoides
MLDIECFTYLNRALESSLAPIVVLATNRGMCAVRGTDVSAPHGVPVDLLDRLVIVRTQTYTPEESIQILAIRAQVEGVALGEDALAFLAEVAEETSLRHAAQLLTPGAVLARSAGRGEAARGDLEEAHALFQDAKASARQLSAQADKYMT

SEQ ID NO: 11661 - protein, 145 aa, Chlorella protothecoides
DALEIRAEEVEPLLVRAIGKKLLEARIDQLAHTVSVSKSAPRAFGDGDWKALQATLRVWQVRRWPTRLERRGCGVGSGDRGLLASTPMHQAHCPRVWETCLWTGALRQGANLSTTSHSQGALERAEQIAEDRKGLLQQGLTAIKA

SEQ ID NO: 11662 - protein, 93 aa, Chlorella protothecoides
MGVDADENELITLEIIHEFVEVLDKYFGNVCELDLIFNFHKAYFILDELLLAGELQEPSKRVVLQKVEAQDQLVEQVKSGLSDEKIVITGPRG

SEQ ID NO: 11663 - protein, 437 aa, Chlorella protothecoides
  MOD_RES (57)..(59): Any amino acid
MGEAAMEDGPAASQRGLEDKGCWPVPNRQRWRQFTPQTRPTPWLPHRNETARLMASXXXTWPTPWLPRRNETARLMASALGGMSDAEVGPEPPQYVTFREAARAEMLTIRTEMTELRGLHGRATLSRFDESNDDEIQVQHTWQGGVCGLPWFVMREAAWGAVVIAARLLDPSTLVSNAVQEYLPFQVEVTTQQITKLFRRCEARLQKFGSVPSENEADEKVRCGMLPDLQSCTGSAASAAFVSLPDTLRIPHPPTHPPPYSHTRHDAQVKRNLQRTLAAELQELSIQFRKQQKAYLAQLRRREAGSAAPGGALGGLALAARDGDYDTGFSSQQALQADTLSALIDDRDREVAGIVASIHELAQIMKDLSVLVIDQGTVLDRIDYNMEATAAQVTEGVKQLAKAEKKQKQGLMAVCIMFLLVAIGILVLFVVIKAIVF

SEQ ID NO: 11664 - protein, 1245 aa, Chlorella protothecoides
  MOD_RES (237)..(239): Any amino acid
  MOD_RES (492)..(515): Any amino acid
  MOD_RES (710)..(713): Any amino acid
  MOD_RES (763)..(766): Any amino acid
  MOD_RES (795)..(797): Any amino acid
  MOD_RES (915)..(944): Any amino acid
  MOD_RES (1006)..(1032): Any amino acid
  MOD_RES (1096)..(1098): Any amino acid
  MOD_RES (1182)..(1185): Any amino acid
MHITEGTLLVCPMSHHAPPATATDVNMLTPGGSGGIHVRDQILGTPGHALHRKLCDGDGLRQGTDFGAEGRGAPGEVVGRVSGFVSRRRGSGDSLPSGILQDRIIAVHRAWPLDDEFVSRRRGSGDTLPSGTLQDRIIAVHRAWPLDDGEGVSVVGTASESPTSNFLQVWGGLERDADASRCAACGFTGRRDDFQCVSRGPRGRRMPVPSALTPHPLPHRLVPAARRRAPSTTSSPXXXPPTGLTTMTAGPSGARALGPDRPPAPPPAHPCSPTTGPEYHLFAVFDGHNGDAASTFAQSSLVPVLEAYLPVPEMVEGVDGAAAWAGAVQEAMVKTLLEIDRRFAARGATGGTTATLVLQIGQLVTCASVGNSRAVLDTGAGRVALTREHVVASNPDERERLLAAGCTLARLDVAGGGPAVISSRGTGPLRVWPGGVTLSRSLGDFSVGPALLAVPHVVAVMLPPAGGRIVLASDAVWKAGVDAVLAAAAAAXXXXXXXXXXXXXXXXXXXXXXXXAHAVLKALGPRLRGDASVVVADTLPRGETFPQLAARLAQGGGGRAGRPAPMRAPSASRLWSLLKPRRAEEAAPPAPALSAGEGGGARVLTDCDVATLMGLTTLTLGEDDPQPIWGGRRWGDCDAGWPVTTGDMRSPGLRLRGARVCAAPAVSRWAATSLGERPAVEERDAVLSHIVEQATPRPADWSGERAGTGXXXXREVRDLLSKGGMRHQPCFGRDGLTPLSQHELPPSTGCSLTHPPTLPPLHXXXXPLFPNTNHHPPPSAPSPTHPTFPLSTPLXXXAWRIWPAARAMALSNPALASLRPSRSIGTLSELVGWSAPSSGAASPRGGVGRPPGRPSFSRRSCLKQPGESTDGGASDALGAGPGGASSDETLASPLASKRVSFAAGERNPLRRTSSXXXXXXXXXXXXXXXXXXXXXXXXXXXXXXLHAAQQLAGRPVRRRRGQRARRRRARAPRRRRPRFGQCRHGLHAQPEPAPGRGAAAAAPRRXXXXXXXXXXXXXXXXXXXXXXXXXXXPRAGGTATAPPPRSSPSAARRASATAFGDACNGVGRRQPHGEAPAPAGVQRLVAPGPQNAGPAXXXGLQRRWMAPAAWRGPGPSRGLATRGPRTPECRPRSPHCVDISACTHTHTYTHTMLPGHSPGNPCTPPTVLIIAPPTPLDCAVQXXXXLPGHSPGNLCTPPTVLIIAPPPPLTVRSKAQRRAVPSPRRQFSLERSVAAVMHPFSLPLP

SEQ ID NO: 11665 - protein, 384 aa, Chlorella protothecoides
  MOD_RES (295)..(297): Any amino acid
MGARLTRSGTIIPSARGNGPAPECRPGIQIADPGGHVVVEIHPRRTHAELSSTHKLIGSLRLFLTCERRSSVDAWDAASRAHDEAPRTHAATARRPARSDSSPWRPECPASSGASIKAHCACPFEPRSTPHLQHRAGPAAPGLRARSSAMPHPELRRPGPQKVACPARILASPHPPCSTLDPVLRLEQKGINPQGVVLCLGLLVYLFATPGVLPGAIDTYIKAPLQRLRAQPYCSEDFTVGKKVASGGFGTVYRAEMKDPRRPGETRNGLLGTAPPGFCVSLCEQLASFPKTWVXXXRPGEWDAGVGLVQVAARGCPCWVASPAIPCGCCCREGGMDFWKQLPQASVCLHVKNWHRSPRHGLVMLGHHASLSSVDSPLAPPLLQ

SEQ ID NO: 11666 - protein, 109 aa, Chlorella protothecoides
MSWGCPPPLSTSLLSPSPAAAGIVHRDVKPHNCIVSTVDRRIKLIDFGAAADLRIGINYVPNQYLLDPRYAPPQQYIMSKHTPRYRAAGGGGMWVCGYGVCCLGRTGPG

SEQ ID NO: 11667 - protein, 193 aa, Chlorella protothecoides
MRRWRSSAAARTVLMLQDRVVLQESRPAPDTLSPSSPIPSPHPTHRLSAQGALRHPWFDTSPLARLGSAFGDLTQRVSQATTGLGGQWLGEVMARSGTAASGGFTEAQLSEELEEDGEVWQAPPKDISSTIAWWQQREARLQKAARVQQRKAAKQLVNLRKDTRNTVKEIKNRVSLLYPLLGGRSGRETGEGT

SEQ ID NO: 11668 - protein, 116 aa, Chlorella protothecoides
MNERMARTNPLAVADFVAAFTEFPSARTATDPLWLVWQFEGEHTLAELMVRKDFPQCLAPLLFEDPSVVPPGVAGQVFLLKTVMQQLLEGLAACHSTGARLACLRLEAQKKGWGVP

SEQ ID NO: 11669 - protein, 154 aa, Chlorella protothecoides
MPWIQSFPIRTFPILFPVPTFLPFPKGLGSPDHTTLLLNCYTKLGDGAKLDAFIAGAGDGAGAPAFDVAAVVQVCRAAGYFSHALAVARAAGDDTTYLDVLLEDCGRWDEGLDHMRGMGRRAAAAALLKHGKVRRDSLSWWEGGAALLHHWARA

SEQ ID NO: 11670 - protein, 66 aa, Chlorella protothecoides
MGHLEPSYVIQRFLSVQRLANLTTYLEKLHAAVWSSGGVRRGEYMGWGTDHLSLSRVLSLGTWTGL

SEQ ID NO: 11671 - protein, 363 aa, Chlorella protothecoides
  MOD_RES (266)..(269): Any amino acid
MVVTSETPWSEKYRPQTLDEVAFHKDIIDTSRSPGRTAGPGCLCVGDEITLLEWPFKASSPCLSHHPPPDNVVKKLLNENQLPHLLLYGPPGTGKTSTILALARQMYGPGAANMVLELNASDDRGIGIGGWDLDKLGSRPHSPPVPPGDAAQPLDASRRRPALVNSPHTHTHSVSHIHSNKFKLIILDECDAMTRDAQMALRRDHPSAAVTLHTLPLPAPPAQLRDGAPHLHLRPRKVSPGRGMLEVGKGDLLVLPRGVAVPKLNXXXXVLGGGCWRSEGGSVGCPRRLRGWKPWSSSERATCDACSIFCRLQAWGMRVRPSAGTRSSACGPTRLARSGDPSNPWGWRQAGILQRSFFCINGT

SEQ ID NO: 11672 - protein, 116 aa, Chlorella protothecoides
MMDMATRLGHNHEEGGGGKRPGAHCITNQPHPFLALTGNLVEVSFAELEADAVGTLRSIYDRLGLAGFDRVEPDVQHYCSTLADFKKNDLERWESWVVGVPVAVCMAGQLGQTRFP

SEQ ID NO: 11673 - protein, 349 aa, Chlorella protothecoides
  MOD_RES (230)..(233): Any amino acid
LDRALSLNFDIHRLHPPLPLRPRLDCIVGNVRLQDRFQWDVSRIDPQGPEIFAQGLCRDLGLHGPWPIEVAIAVRHQLALLARQGAAAAVGGVGNVRTAGGGGAASGGEAASGTTPPHVEHEEPGEWGPRVTVLTREELAALISARSEASRGAGASATASDGSRRGPGQSQGQASPGQDGPSLGASPALSGRQLRKRRGARLAELVSSELAGDGARPVAAPGSSGSPPGXXXXRRPPRRRPGVCRIAPGAPAPGAPRAPRGADDGGDGRRRRRRIRLPWARAGRAGGGPAAGGALGGSRPRARRLWHRACGHVPRDPGGAPGPAREPVCKPLPRHVLRSEGWDPSTSLT

SEQ ID NO: 11674 - protein, 145 aa, Chlorella protothecoides
MPGLGALPGGDGGDRGAGFASLGHPSGPLRPGQEIAAEEIAAEVLSALKPLSPDEFTTLLTNFYRGLKGKYKVPTFAHRDLDLHTVFWAVSARGGYETVTAGKQWKEICRCLDVDLTGQTSASYNMRLNYERCLLDFENYLASGK

SEQ ID NO: 11675 - protein, 198 aa, Chlorella protothecoides
RADLARLVRLAGGQLEVAAALGLAACRRPAGYWDCADNMQRELAAFVAAHWTRFEEPGEAEVGEERWGVGRGDGGGEGARGMGGGDDPRPPPGTPDPAALPPQPSKAGYWYNQVTGRVSREAPELPTLIALADDGSEVLAEPREDVVMPSRGHLLAAGRYDLHYAVTMHGGYRAVGAALGRAPPRPRQRHLGGAQRLR

SEQ ID NO: 11676 - protein, 411 aa, Chlorella protothecoides
MQPAVEHQSGALVMGLALWCVPAVCQHECCPPFHPHTPPTTSGSITDISWTEVKVGDALVVRDDELFPADMVCLQSQLPDRVCFIRTTNLDGETNLKIRKPIDLKGIQVGGCLVAEDVVPSGLDVACLVGKLRLIPSGRDEASGAFSRALRQDTHPIPQCTTPVTGQLGAGGHAPAHQAVCRGPQPQPAPLQGTGHNPERAVCTYPPEPRLGQDGVERERHGRWWVTVWSVHGLGASGSSHRAPCWEGDVAQALPCSRCARLASSCGLDVEPALCQQGCCERWSQHGCPACTGVHSPAPFYPTHTPTRNRGGAARERPRDHERDAAARLHAEELRLHPGPGGVHGAGVANPDERGAHAQQGRLLRPLPQPPDRAGHRLPAGAGHLLRRRQPGLAEHHGCGPLLPGAEPGRA

SEQ ID NO: 11677 - protein, 310 aa, Chlorella protothecoides
MTVAAGPSEAVPAPPAEAAPSTPTSHVEIIPLGAAQEVGRSCVIVRFAGKTVMLDCGVHPGFSGLASLPFFDVIDMSSVDVMLVTHFHLDHSAAVPYVVGHTNFRGTILMTHATKAITSTLLRDFVKVSKGGAGEDPGAWEGWGGEVEGPGQGLAGEAGELHFVEAVWVGLDARTPLAILAVRHEIESPNQPVGRESASDLLSPFASHQQPLPCPPPDAGLYTEADLDASLERTHVINFQQTLCVNGISITAYRAGHVLGAAMFMVEIAGQRILYTGEELWRRWVARVGCLGPGSALGNTRHGVRKTLES

SEQ ID NO: 11678 - protein, 169 aa, Chlorella protothecoides
GGAAPSAAAGPALAAPAPPTQDKALALVETQLAEAVRRLQEERSKPRAARNSFKCPKCHRVTHPEGSPLLLCDTCPRAYHAACLGAAWAELPTGDWACPKCVEATQAALRRVVDLEARRREALDRAAAREREAEERLLKRLLAREEKDRRRGDGVGPGSGAALAGGAAG

SEQ ID NO: 11679 - protein, 282 aa, Chlorella protothecoides
MHETHPGVQDMACETFLKIVSKCKKKFVVQQVGETEPFISELLTGLTATIQDLETHQIHMFYEAVGAMIAADPGVQGRGRAGGTGGSVRGGGGVGGKGGVCVCLSGSDWGESGWGGRGAVFKGAQRRDPTLARCCACEGCAHRSGCRTKKEGGEGHCMHPVDPTCHATRWHAHQAIPPLCRCGAAGGVPGASDGSPKRDLAPDPGPGQAGRGGAEAGGGDPQPADRAPDQRVRCVWDWGFFGGVGLKACVLGWRPRGKVCWQAAWRVLGAVCGSPAPVMGPT

SEQ ID NO: 11680 - protein, 104 aa, Chlorella protothecoides
  MOD_RES (46)..(49): Any amino acid
MAVMQQPLTSLPARSYSACIPQAVVAAVMQAGLAAFIPPGVAFFGXXXXGDAGRTGSLYTSRGGLLRDEAILLLQRFYSAGNPNGMEFMVMSAGIHCTIWEAMC

SEQ ID NO: 11681 - protein, 392 aa, Chlorella protothecoides
  MOD_RES (93)..(96): Any amino acid
  MOD_RES (159)..(162): Any amino acid
MPPSPVSPLCSAQAAQTCEGSQHQAGCSSGEPFQGQYPRSPLLALVLLEPRSSRQTAASKPGLQGDSALAVHLEIVIFHSPSSEGAHVSVDRXXXXAAGRLCTGCASGDCHHASDTSSPPDRKVEVSPCCEHLQDPCDEMLQGGADITTLPVKARTAGXXXXWPCQGTKLTAPFNPDPSAARSDQGWCTPQHVVELPTAILSLVAHGCPPQQRSPLSPDEVYSALTASLSADGTTRTQAQALLQEWEADSSPGFIGSLLNIVHEVNSVPEVLAPFLTLLAPTGGPPDGHRGGQERRRLLLAQDHGHAGVVARARCGIGTLMLPLPRAMRHAGLPLPPLLAHLPTDRNFTSLPPLPTHTSRADAEKAHLDAAASKDYETCRTAAPTTSRPPAD

SEQ ID NO: 11682 - protein, 174 aa, Chlorella protothecoides
MGVCGHLWCSWRGRRAHGWVPQPRRSRLLRGFEARRAPPYGCTMPGRAPGLLTTRCPSPHPVLPTRMWPTPPPPPPHHRFPFVPQPYGYPMPNMPYYPTQGGAYTPGQGATAYKYPPAAAGYGGYEEQPGAAYGAAAGKQERLGARGGEASQAALYGNQAGYSQYQGQFGQGHR

SEQ ID NO: 11683 - protein, 169 aa, Chlorella protothecoides
MHHPFLSIPVAQGVSGEDGPLILGLLPLNVNASAFDAIDGPLPQITPPFTGDTLFHGHSSAEDLLGPLAGGTLADLEEALASGETQDQSLFHPTLPLSPPRAGGPLYHTESRRHPAGTGDAAQRQELTSGVAHDYRTRFLVRMRYQSLHPAPFTRLRGPGNTLGYLICP

SEQ ID NO: 11684 - protein, 1386 aa, Chlorella protothecoides
  MOD_RES (89)..(107): Any amino acid
  MOD_RES (148)..(151): Any amino acid
  MOD_RES (217)..(220): Any amino acid
  MOD_RES (357)..(360): Any amino acid
  MOD_RES (621)..(624): Any amino acid
  MOD_RES (688)..(690): Any amino acid
  MOD_RES (984)..(987): Any amino acid
  MOD_RES (1049)..(1052): Any amino acid
  MOD_RES (1229)..(1232): Any amino acid
  MOD_RES (1256)..(1259): Any amino acid
MTRCVTVLRQKQTPVRDRRARSSILHIQLADLAWVTASHCFSLSTPIGHDLGRKHVKDPGPTTTLGSGNETSIIMLFQGRSVLEGSVSXXXXXXXXXXXXXXXXXXXYNRDTTDCAAVPAAPRAPQGYLGCRSPPLNPAAHLVRGGAXXXXGNPSRLWGRGPSRGSDRGHARSGYSEIRNSSDRSKIGEWDVQNVARYRSISYRHLLLTQHRNTSCXXXXAITMTTTTTTTTTTGAVTITTMMTSTTPFSPGQRRPEPHHGPHSSGKVDVVVACTGRGALRPYCRELGCVCRSGARQLVGERFLPFFHRDHSLSPPSLLTIFTGRSGHERSRHRRPAAQRLPSLSLWPQRHPAHHHXXXXCDDDDDNDNDNDDRYNDSDDNNDDDEYYTILSGSNQSPAINTPTTGRAYFDLDDDEDEYEWTIQVSNVQNLIMAHIHLEWSRQLQEEYFLPFFLHEHEKIVHVVQSFPQGKAGTNGPVIVGLLPKGYPASAFGPNATLPTITPPFSGSNRYSGKFTARDLAGPYAGRPLSALTQAFKAGGTYVRGDLPQRGILKTLPAALAQTKPHDGILKVSDFQIGLNLPLSTPSLPLAPGQPAHHPVPCWAGEGPSHPAVVRPELAPXXXXSLGRTDTVAGQPAYDQVPCWAREGPSHPAVEARKSYQMGLQACSVHSCLRIGGGEVEGMLPWRXXXPYYRSRALSRFEDAPACSAVSGGKEIVSNGTAGLQRSQLSTHWCGGGGGDASLAGVNGSCGDMTLRCCKRVLLIGTSPCFLATRKSRLCTDGVHSRRHQLPAFDYTPVDEVKPPTFSSNTLSALTAGTPAPAKCSPEQVWSRRSTTSLLSEQDQAHRPGAPYTQCLGKLQSGRSIQHNHLHGSPRSKLYAGTTKSGAATFVPSPRETDIIICFTAVAVLKMNDRPLIRTWASKSGLLFRRFWACFPCSKVKNVRLRLQAGHHGFPALLPACRAGGGRPCQACALAQRRLCHGRXXXXSLRSSLLAVLVVVALAIPALSHSDDFATDDDAPLFEFTANVTAAKSVPPIKSNTTAFFAASXXXXLPCSVNTPILFLLQRWARLPRKVLHRRLAAGSVLHPRQGFESINSSPPSSELVGQLCDQRTDHRGPASSGRARGRLRREHPSHVQTPQDRPSPRFQWNIHRRRLRGPIRRARDGRPHIFLLHRGGLREWNECGGSEGLLRTWARVIPAGHAPSSASRRMRGAYSSGMASARACLCPXXXXACLPYTGKHPHRAPPRWRCTRTGXXXXCRLRAGCEVLIAVEWPLPEHAFARPRLSNIVQVDLPWSDGLAPVCSQKHPFPDAECLKSSTQRTLTLDACLPCTGEHPHRALPRWRCTRTGECRPGRVGSWHCPRCFNPPCLSLAEAVYAVNLPLNP

SEQ ID NO: 11685 - protein, 822 aa, Chlorella protothecoides
  MOD_RES (151)..(154): Any amino acid
  MOD_RES (188)..(191): Any amino acid
MPSSPPPPPPQVGMRYFHLNKNKYFQPIINLDKIWSLVGESARVEAAKDTSSAAVIDVTQHGYFKVLGKGQLPEQPLLVRAKFISKLAEKKIKAAGGAVELDRGGGRSRTAGGWGEIRAKQVGGWKGIQQKTCRNVTRWKASRPCARRARXXXXIHAPVSLPHPWRDTGERCAGTPELGGLRSRGCEXXXXSNRRRAGILTAPGGVTAIIGRQVLAGHERGTVQCMGGAGSLERLHQTAHCMLQGLYIPGILDKGGEESEALASQPDVAAAVAAGVAHLVRQHRPPGLGPEVHVEVVVDGQPAVHVVHVDLQEVGPLLHQVRVKLLVPGREQGVGHVQALAVQAARWARGRDGLGWEERAGGSVIRWTEGVSFHVPELDHLGPSQQLVTLHGWNLRLLGQPQLLQTLRHLRGVSARLDGSVAADAAAHPHPPRQPGVLWVGDVVLHDVTPQPVGEVQIPVGVLGWGWDGVLSRDAGDLPEKSPIKVPGATTGAPSFGVSGRDAGGSPRKVAHEGPRGDDRRSLIRSQKGNQNVGDERGLLGQRPALHLGPGLLDDGLGHPLLSARRLGQVDDVGGQGRADEAVARGGVVLEPDLQWDQPVLAQVDGLLQVPPLPAPDVHRVAVLCGHLGRVEALEQRGGGPPGGAGQQVVGRLVPEVVAVLHLTSGPGALDLQVLIQHDEPALGLAVGGAQGGDHDVAVAQAVGGVQEAQPRLLLDGGGLHHLVQARRAGVRHGVHGCRREALRTSKRKARQPIPIPKPWPLAVDAPGLEGGQDEEGPGLGGVAVAAAAGIPARVVKLIPQVGHGQAVDDLERKVGEWRARP

SEQ ID NO: 11686 - protein, 607 aa, Chlorella protothecoides
MDLVMRMQTLKVRRVYDAVLLDVLRLGAPKQAATRSPQISAPPAFPDLTTRCLLRSWEPQSRQQPVTLKIKPLQHPRISPLAVSFIVEEGKGDDGECHDDDGNVYRIPQDVHRQRGAAVRQRQVRRTGVDIRYIQGEKEHGPYGQANAQADHDLGEPSLVPVLRVLEGYEEVDGGCHGEQPYHHHDDDQEPVLHGVGRSAGLAQPGEGPRESVPGGGCGGSLAAPMLCPANPVQSTKWWGRSAPDHQLCVFATVLGQPRHSYSHMISCCLLCGQRRSTRACQHYWGASERPPEWRPAQLEVIRDTNGILGIPHDKSYRADFGLTIPAMLHVLMTSTSRRAGQGLVRLTSSHCASFSSASNEGVKVGESLELPLGFSCHEVPRIQHIPPLTLLHLLPARQQELRRARRASNRRLRELCKGLDRGANTVWSNPVQGSDPRLSGEDAWLQLLLRQCRSKRKARRMAASWRADTGEARGAGHSFNTTGPDRDEGQGTGSAHWWWRRESRGEAPGGQWRSQRGQTSQTQGDPGAADNFCGQGPHHPHARELAVLGMSPAHSLTRKALRLSFLEVARRWHPDLHPPDRRAAAEAQFKSAQAAYDKLVSLLPSS

SEQ ID NO: 11687 - protein, 208 aa, Chlorella protothecoides
MITLHLSSSGPLPPLRQRAPLHERPGALRNLVASHGQQAPMKRALHRRPLLLLPLLTPLLLAVPNEARAAQSPNGGSMCWPPLYPYVPAEAPPAQYYDLADRLVSALGAALDTEESGASESALRRSADPARAAIREFTADWASAAGDASHVALSAAIRELAEHYRREGQRARLPRQVVQSIRQKLEQARQAVQSAPSRQLLVDGGVKA

SEQ ID NO: 11688 - protein, 366 aa, Chlorella protothecoides
  MOD_RES (189)..(192): Any amino acid
  MOD_RES (269)..(272): Any amino acid
MIPSYFAFSRGTQQAQPSPPVSAAPTPCPVAALVCAPPTSAAAGATDDAKERRRSLAAAAIAAARAAAAASASQLYGEERVIETRRFAGKDVTVSRSVPSGGAAASTSGAAGHAAPEKKGGLDAMLASLAGPKKVNVLDKTRSDWTEFKAGDEAIDAELEAHKRSGSQVCGREWEGWGVSCVVATGTQXXXXGREWEGWGVTCVAATGTRCAGHMFLDYSSLGFPLLLDLVRYATHESPPRKKLAIVGVCSTPQPTPRAFVQYLEKQAXXXXFLGIPSAFGLFAVRYPCEPPSRAAVRGGEGPAHARAMMGPANDACLLCLCHSERCAAPLCSIPILSRYLSSTLLPESHWFERGSHGQGQGSNLA

SEQ ID NO: 11689 - protein, 454 aa, Chlorella protothecoides
  MOD_RES (166)..(168): Any amino acid
  MOD_RES (305)..(308): Any amino acid
MPMRPMTLLMSVMQACREEIGNSVCTRSCFTSRFLTRVEGNGEESEGNIAMRHPVNCTCEAHDCMGDGRSFRSVLRHCARAELRPHSQTHQRLLVWGAGWRPRPAAPRAAPTPCRTGHADRLLPDYTLPRGKSNMGCEERLSGGASSPTAQQAPVLPRTASRSRRXXXSHRAPPPSRRRACPGLRPDPGAHSLRPIREVAGARCSRGDGLPDHSLWAGPSRGRGLRPLWPAGERPGELPGGGCVCSRRLGIPLQLHAGAREEQVSSGHARRVLLGPPPSSWIRHAPHARQPLHTALRSTRRSRWXXXXCWVPPPRLPGSDTPSPPPPAPAHPPPQHTTESLGPLGPLAFVTVMSCAECIPLFPTQPLLLASGLLFGTRTGALCILAANFLAGTATFFIARGVGRPWAERLMGADTTSPLAQRAQQLRAVIERGRFWQQAGTILLLRMTPIVPFR

SEQ ID NO: 11690 - protein, 284 aa, Chlorella protothecoides
  MOD_RES (254)..(257): Any amino acid
MVRKLVVAVDDSAVSKSTLQWAAEKLLRPDDELHIISVLEPASGGNFASTAETAYPVSMQEVRRARGQWIANLAWGGDVAFMTVELLPLGVTHCSPHGGLVCAVPLLYLIQLLHCCIQCKPDPLALERAQAFLKKCREEAQKQGVSGGDASSWHMSQLPFLRSMLAGGRAAAEGLPALSAPLPWGPCLLNPHPLSLLKLTHSPMQVADVKLATLVTCVGGAADTGRHIVDYSRRQDADVVLMGSRGMGSLRRAXXXXTPGATSSTTRDGRMPMWCSWGPAAWAA

SEQ ID NO: 11691 - protein, 245 aa, Chlorella protothecoides
MHTSVHCSEGTSRHSGGVGRQVGDRRSFSHVSGWTARQHCPHVHRRKEGCDSGFVLRARRGRVEQAPSCTVLNIQPDGSDTWRLQTAIEDLLASKVGRCDLLRAGSDAVMYSSYEIRQCPAVGLFVGPTAMRHPPRPSLALQIGIIPTDTSPAFVCCLHDRVAVQAMFDIAGLSVSKKLSVMVRGIAELESLTTGLPAANGPGQPALFRILRSTLPGPVSGRALCVFSLGLGRGMNWGQLCLVNS

SEQ ID NO: 11692 - protein, 750 aa, Chlorella protothecoides
  MOD_RES (576)..(579): Any amino acid
  MOD_RES (654)..(656): Any amino acid
MTSVEAPPRPTSLKKLGFVPEASARSYEIATNIYSTAKSYVPASLQPRIEKVEETVTNVSRVWRGRLREVPRPRRRCRLPPPDPPHLPDRRPSQASAPYVTKAQDKGAELLKAADERVRKVLRTCSRQLVPVSGRPHRGHRPGQPGVRQQLCLCGRHRGPPEGLPRPEPGVVQGRTRALPQGSGAGRGLPEARGPGRRHARRSGRGVGAAGRRACRPRPGSHPAAGVGGPPAAPRPRAPRSGGPQARRGRSLLALRGPARRRRLLPPVQARTGRGAERAGTGPGHAAVRAVALRALPLRRALRGARRAAPAALLPARRGAPRAQGRLNSRGASGGASGGRGLLAACSVRWPGSCPGSVPWPLATRPLFLCPRAVTRCFPAFPAHPMPRALSWLCWGPYSPPSPRGPALNRSRSKPFGEPVHRVCNCLAPRMPSCKNGMGKETGFTAARPGTPGWAAPTPRAGILGSGAGGWNRTAASAPGACLGRAGGLGGHDTEEEGKSAWTKQATWLLEHKSSSRTPLTGRAHPIAFLAALARNHATISGVNGIVRLLLLPSPTTSSFPTSALRFSRFLAVLTXXXXGLSLKAHLGPCEAGARAIARELEAGELVNTQPGKGLHVTCLGREAARVEVLRFSFEGLTPALSHLPDPCAEAQPXXXLESFSAQALGLAVGAAAPSTEAALAIGPAAMLISIVFGGLFVNEANVPRVLSWLPKTSIIKYGDHVDARLPKAGDPFKRLCFGTWVWQGTKGLR

SEQ ID NO: 11693 - protein, 115 aa, Chlorella protothecoides
MENWFLIIIMVVVGLLTMASSVYLLIAFQHPEDRNQAWFPKIVVCLGICLAIWTVLLFPLDVANVHACSADLPLADCSTTLPMDILWYAIYVAIVVMAFAVIPFALFYYEGDSEW

SEQ ID NO: 11694 - protein, 233 aa, Chlorella protothecoides
MHARVIPSNRLVIPSVCRRVPVDTVSDPRAPRLHKVVEPAAIQEKTGLGFLHTSHCLGNGDIVVSALGTPDGKAKGGFVVLDENLEVKGTWSGSEVEYGYDFWYQPAHDLLASTSWGAPAALFKGFNPAEVPTEYGDAVYIWSWEGRDLKQTIHLGQDGLIPLEIRFKHDPASRHGFIGAALSSNVIHLTKPPGGEEWVAKPVIKQPWTKVEGWALPEQPPLITDILISLDDK

SEQ ID NO: 11695 - protein, 84 aa, Chlorella protothecoides
MAGVDGPLLCTTVPGRDDPGGEEQAPDLAELADRYCAAGVGFVVAEEGQRWGASTVIDFSGARPTVVRVGDGDLDPFLPYLPDV

SEQ ID NO: 11696 - protein, 61 aa, Chlorella protothecoides
MLQALKRLSFAGTSIGQSLVGQGRVLLFYYWLTYSILQRQTPKYQPVESARPSLESLAAPL

SEQ ID NO: 11697 - protein, 226 aa, Chlorella protothecoides
MMFGGRCRPTAQPPWNALAPDARHQRPLDNPCASPPSFRRLIAEVLQKEERERGRSWKWRRNTRALGNQMIVLEEDAVQLELVYPQGWCAATPKAQGMLLPGRPATSCTGGGASGTRCPVSLPRALISPSNQHPVPSRTSQGEDPEYKWVWMIMKYWLKLVVGILSIGVTISWILQIILYILISPPVSPLLNTAFTKCAVGVWCGKAGIQFRGVVTRPAVELRGAA

SEQ ID NO: 11698 - protein, 137 aa, Chlorella protothecoides
MEECEDLVEAYWLQVDALLSRLALLQERIAATEHLVNLDLDARRNQLVSLGLAIDLLLMAFECHMALTSIFGMNLTSGLEPLQPYSLWGIVALGAGAGALLTALVGRYARRNGLLFLPSFGLAGAEGGAGAPPLRPA

SEQ ID NO: 11699 - protein, 797 aa, Chlorella protothecoides
  MOD_RES (335)..(387): Any amino acid
  MOD_RES (577)..(580): Any amino acid
  MOD_RES (666)..(669): Any amino acid
MLKAEGGAQVDRSAWSCCGGDPHRDQCMSLQPAARMSRSLPVSILQPGTGQIQWHAGGFGGVIRGVRWDECLTSCATHEGLMCSTLLKNEMHHSMQQGRDGYEFSNLCVPMMQGFMCSTLLKDEMHHSMQQGEAILHQVGAHRGRFGGRQGSIGMASPNTQLVESLAPIPHRRRRSLEIIYRLLTSEAGGSALPHLEPGKDGAAGCEVMVRLLVGNHRESSTRSVNAHFIRNSNLVLTAEQRTTVGHEPDGSAETLWGNMRGKMGDKVQRSLPEGLAERKAKAKRDATAGDGAGAKRRRVRWIETREFQSLGKFQLWPCPNISLRDDLHLIPHAXXXXXXXXXXXXXXXXXXXXXXXXXXXXXXXXXXXXXXXXXXXXXXXXXXXXXLAVLKNDRLRVSWCSGLAGTAAAPVGEGAWGGTLLMHYTWKGPAQGRWARVPDAVPMSIARGGCASNAGRTPPSCSNLPPTQPSPPRQTPPPPQITQQDPERQKELGTLLDSPVSDERFALLVELGKRMNDWAPESAALAAGSGEAALDEEGVAVEFDDESDEDEGEELVDVLDDEEEEGGDAEEEAGGXXXXEELVDVLDDDEEEGGDAEDEAGGSRAGVRTGGVDVDAGEEERASGIPVQDIDGYWLQRRVAGALPALEPAAAQRTADELLEALAAXXXXQGPSPRSLANRRSCRPGQPRTPAHTQPVVLEHGQDLVSGALQHAFLLPAQQVHHDGEQGLVGHARLLGAGAIQARGLHLQHRGGSGGLCEKGGCGGVRNEMQPWAGAHLHQPAQYHYWIRMKCAVTLL

SEQ ID NO: 11700 - protein, 259 aa, Chlorella protothecoides
  MOD_RES (67)..(70): Any amino acid
MGGYADDLRGSDRDVGLTRSGPAVFAPRDRVHICLACGGRSVFRVWARRSELNASSGRPDLRLPAPXXXXSCAHLPRMWSSACRSGPWLVFNLKSPASSTSAEAAGTAMAGSPGPSFFERHDNVYLYVPNLIGVGIPLFSGHTVSELRPSRPTPPSLAHSYPPGYARIAFALYGFAVASTSPGAMVLSYALSFVCDELDGRFARMLNQTSTLGQVLDMVTDSFAEPYDRLGGPYNSGKVALVCAVLISFRPVATEAWPC

SEQ ID NO: 11701 - protein, 164 aa, Chlorella protothecoides
MWRSSLAVSLGTGVGTLVCVGGATLLVSSVGLHAVKAVVKHRQASCRPPRCMKYPVFFASPRTPVHHPCRPSGSWPVSHAERLGTAPVTSATVRTHGHGEKLMLCRAPVSARSLKQQQAQSAATQPEPQVLCVCPACGSTAKQRCLNCLGTGKALPEEAGVASA

SEQ ID NO: 11702 - protein, 208 aa, Chlorella protothecoides
MAYEALLSVVVDLLGGQEESVLQGAADEVLAVLKNDRLRLVGGALCRSGLQRGQRARHAALQPVAVDVLHGDARRALLLTGVHVDAAGAHAGARPAGLILGIPALLLVVIQHHVHQLLALVLVRLVVKLHGHALLVQRGLAAARRQRGRLGRPVVHALAQLHQQRKALVADGAVQQRAQLLLALRVLLCYLGRGRGLARRGRLGGRQV

SEQ ID NO: 11703 - protein, 93 aa, Chlorella protothecoides
MGFCCVCCEVLYLCLYLLAWPQYRAWGVLPLPQTWLQLGGSAGVCSAEARGIPLVALVALAALPGVAVKQFVNVVQLGNAMTTLVQLDTAKRQ

SEQ ID NO: 11704 - protein, 103 aa, Chlorella protothecoides
MADESIIVRGNGTIFLGGPPLVKAATGEDVSAEELGGAELHCTTSGEPMGRKGAGAAALGVAQVCRNGKGSASCAVRPEPDARTPRSAPPARCCPTLPPSSPP

SEQ ID NO: 11705 - protein, 86 aa, Chlorella protothecoides
MSAGTLNEVGVRNLQASTTHPPPFPQAVDVLVRTQKVAYDFEFFSLDQEADAPVTVLSCGRSLLKDALGTSLPLAPTAPLGEGRLP

SEQ ID NO: 11706 - protein, 313 aa, Chlorella protothecoides
MPAFAISFRPSLGAGLCRGHDSGVVRPCPRAGSVRVQGAKAAPTTTGRQPRKKHGDFPVEETRRVDVRWFRTLPRVARRGHQGRVLGIRDRVTHLPLSLGLFPPPTPSPPQSVGLVQWYPGHIAAAERSLQAKLAAVDLVVEVRDGRCPVASAHPALAGWCRGKRTLLLLNRVDMVGREERAAWSRHLREAGTPATWTDGRRGGVREVEEAAARLGAALNARREARGLRPRAVRAAVVGFPNVGKSALINRLLGRRAADSAPRPGVTRQLTWARAGEQGNIDLLDTPGRGGVCPQDGACRARAPMPAAAALGF

SEQ ID NO: 11707 - protein, 172 aa, Chlorella protothecoides
MEGEGSARWTAPAGLGHPCLQLQRWGSKPPDPTTSISPQASICMQSCPIIPIFFPSHTPLLSGIIPVSLKDKAAAARLAMCNDIGEAAYTASRIAASFLDQVSVLPREAEIWAAIEARYRVRRGGITSEEYVERIAQRLFNAEVERAGQRILRDFRDLKFGEICLEVPSSTV

SEQ ID NO: 11708 - protein, 85 aa, Chlorella protothecoides
MDLPCNCMGVATAARVPVKRYNFLVPSVFQAAEVEPSLGQTPGPGVDRSVKKLCEYLSRNEHRIPKVRRGLGAQAGDTRVFMVPS

SEQ ID NO: 11709 - protein, 245 aa, Chlorella protothecoides
MLHSSTPPDSSLCRCAVFSGGQGQSGGRRLEVPRRLGPHSGRGRGAHRIAANQRACVGEVLEDWFACGPAGGGRGCAGSQPLMHRPEHPHLLQITFAREYLPDVQIQEKQIEYLVEEARRGAVMGHRAELFAVRVARVSAALEGRDRVDADDLQKAVQLVILPRALIKDRPPEVRGLRGTFACSGKEGRRAAPPAAAAAAPPARPEGGGGGAAGGAGGAGGAGERAWIGVHRGVGLALHVAWTSS

SEQ ID NO: 11710 - protein, 571 aa, Chlorella protothecoides
MGDSVFEGLTRFPSLVWNALPSWYGAPLQPELQIVHGEGAHIPGGQHYLSDFLHGDSALQGSLLSPRHGTELQRIVPNNNIGNQVPTGDSRSIISEIPFERSNPGVGGDRGSPCMPPCERPRCAHAGPGVSSPKRWRRSQVCRASGVAGRFWVQDSWRAEFNNVIAKSIGCDKCRHDAILCAVSHTPPRSTDAPPVPDPPAGEASPEPEAYGALGPRSYPLAAVVGMDHIKQALLLGAADVGLGGIAIAGRRGTAKSVMARGVHALLPPIEVVEGSICNADPSDRGGWEVSLVVAGGVPSCFCASVEGWRAVTPARGPLRYLLLFQSHVGTEPSEPCTMSWPALASLYNSSVTNASPPPRQCSPGWVGGQAGSRPTPHQDQAGALCPNPAGRHGGQARGHRRHRGFHEGKGLIDGAQEPTCFPANSTATRFFYRVSLPRCSSPSTVDLRPHSHLPQLGKPVFQPGLLAEAHRGILYVDEINLLDDGVANLLLTILSDGMNVVEREGISVSHPCKPLLIATYNPEEGTLREHLLDRIAITLSAGELDGVTAGWVKSSPLAIPQSTATFTKSA

SEQ ID NO: 11711 - protein, 189 aa, Chlorella protothecoides
  MOD_RES (79)..(83): Any amino acid
  MOD_RES (162)..(165): Any amino acid
MAPVWGVVADRRMGIHPCLAKDVLRADEFPSTWRRPYLTPPDNTFEDVEPVAVLESRNEGEDREFLVKFHDSEETMQSXXXXXAARYVAEDVMQDFEAGLEYAQGLEILDMRQRGDSRAYLVRCVTGLKEECSGDSVLLFSGVLESLVQVWVAGPSTPNASXXXXGQGCPASRRRLTSMGCGDGKRNAV

SEQ ID NO: 11712 - protein, 363 aa, Chlorella protothecoides
  MOD_RES (78)..(80): Any amino acid
  MOD_RES (207)..(246): Any amino acid
  MOD_RES (274)..(277): Any amino acid
MCPSPLPVLQHRVSKNREPAKNLADDLLRDFEDRWWAAARQGDEETMLAMMKVARRVHGGRTVTKGAVLHRASTTQLXXXCLPSASHGQGAEQVQCSIVHPPPKVASRWQADGKVLARTLDEERHSALHFAAARGKPELVKALVQAGAEVNLPDRAGSALLKTKSNGLWASLAVQLCPPVLSGPNPLPSLSSAGYTPLHMASGYLHXXXXXXXXXXXXXXXXXXXXXXXXXXXXXXXXXXXXXXXXGGVQGPAASWSCTSVSAVAPTTIKPTFXXXXRQVPIRSRRMPRAGGGWRVLGGLGGVQGPAASCSCTSVAADAHTTIRPTFNTPLSAVPWALWRGSERPSPPTTRPSSGGAWPWRTW

SEQ ID NO: 11713 - protein, 486 aa, Chlorella protothecoides
  MOD_RES (330)..(332): Any amino acid
MPIGIAAMGGKASPLSSPFLRLNSRPSSQLCGALADTATSSHHQLSTMRYITHVAKSHFTNFCPPVELPLVSAVPHIHPRDTPVGAAVPPRSACLATSAAALSYLDMGKAKPAHHTSAELRAKARAATQNVGGGAAGKVDRLGGQAGHQKFRWVGGINACRRRGRHMRAQQKSVPGLTTALLTAVTQSPQVHRLRSERPRHQDRSDSLRGKAPEDALGPRGGRRKCARAPWRSYHKGDVLLLWASFSDSGRVCTVLWPSHAVGVIATHPSRWHKAMPECLNVCWSFCCPTAQGPKLISCTLMHAPSSLSFQGVAVRGSMKKVHCPSFKLXXXRDLIHAPNKHSRQCPLDPRHSLRVHCPSFKLFQAIFIHGDAGPWHGLASCKGVLRHCKHPGEPPDWWVGFPWPAVHRLAATSGRCRGHEPADMRDWTPMYHRASPSDMGRLAREFQERSRNVQSFQLRRCFPKCQDRAPGFRVHAGRKLLMVRE

SEQ ID NO: 11714 - protein, 824 aa, Chlorella protothecoides
  MOD_RES (492)..(495): Any amino acid
  MOD_RES (627)..(630): Any amino acid
  MOD_RES (815)..(818): Any amino acid
MMKRRSWGPFRWCATREGVQAVNPEQSVCSTSPCRAAWQHVASLVSCLSQIFWYLTIIVLIKYVTFALRADDNGEGEPRCLAGTRCLFPWTMSQTAHFLAGGTFALYAIISRACNLRSGGATHTSDFELSGYDPLASATAPQGSDVAPAPNANVKVRSGANARVKSESCPEGALVPFSMASGGHAAELRYSQLPRPPIVDGVLTPAISVVSAAQGIQYQSHISNGELGSVGCTLRDLMWIATEGRVGSEYLPLDIKQAIRKIVDSSFPSTTDAVVGISIGIIVIIFSVQQFGTKKIRCGGPSFACYHGLGCLAGHSQNLQLAGLQARSTRPSSSPPDPPCSYLFAPVTTIWFLAIAAVGLYNIFKFRPAVFAAISPHYLYYYWKVGLLRRSVEEGSVLKCIALASSPCQAGAHEAWVKLGGVTLALTGAEALFADLGGCSARLEVSVYTVFLQNEGHFSPLINPFTPQQTASGRTAPDSAKLMRPGPVPAPXXXXNECPVPTSEHTAPDSAKLMRPGPVPAPPKPQPPPLAPSQAQTSFIAFVYPSLVCAYLGQTAFIIHDRSAAPTAFWSSVPKPIYWPMVVSRPALRRGMVLPRITGRRDASLLREVPATTPSAPTSPPGHCHSXXXXSSLLREVLATTPSAPTSPPGHCHSRGHSRISGHDHRLFLHRAAGAGSGRDAPGVMKCVQGRPCPCGMAIPPWNRSNSFCPKIMVACQPMRHNDPSPTGRGPKLLPKGHHSAHRGDAPGAGTWATSLVDPGLATGLTLPCASQASPESSAAHRCSPWGTRMPADLCPTSQLGADGRDGDRHRHIPXXXXAHRCSP

SEQ ID NO: 11715 - protein, 163 aa, Chlorella protothecoides
MAGTVIVIGIFQTGPGIGAAYGERGSFMCLAGVTQPGKGPWALPCPADPYPCALAPQQPPTPAPHHHPSPGLAVVSTFFLTTSLLSLVMLVAWEWNWGWVLLFWLPLSTLEGMLLSANALKVCVGGEHCFCDRWGSVAQQAPGGLERGSTCLSGMADHGMWTD

SEQ ID NO: 11716 - protein, 343 aa, Chlorella protothecoides
MPVTTPAIKVAAVRALGAGVELVGETFGETNTHAQARAAAEGRTFVPPFDDPYVIAGQGTVAAEILRQTDMDSLDAIFVAVGEAGGAEGEWETGGAFEACMKADSPHFHPLTHPTHQHTHTPLPGGGGLIAGIAAYVKAVKPGIRVYGVEPAGANAMAQSLARGRRVQLSRVDGFADGVAVKQVGAETFRLCRALVDGVLLVDNAAISTAIKDVFNETRSILEPAGAVAVAGAKAFLRRPEGRGATVVAVTSGANMNFDQLRVVSVENRAGGLPDVCAPWSSTINTIVLDPLPPISCTEMADIGGGAEAMLVTTIPEDRGAFLNFMEIALGGSPVSVTEFKYR

SEQ ID NO: 11717 - protein, 298 aa, Chlorella protothecoides
  MOD_RES (113)..(115): Any amino acid
  MOD_RES (280)..(283): Any amino acid
MTTRNDNPNIVTHITNPKANLPQSLRLYVTSCLCNSLCASWPSQVPASAAAPDTRIAPCATARTRGGWQGSPKLATTHIGVRGPSGQRASYATLAQPATARSGHISDHRHTRXXXATPYVHRGLPQAPASAAAPDTRSAPCATARTRGGWEGSLKLATTHTGVRGPWGQRASYATLALHATARPGHISDHRYTHRKLPNLLPIGDKYGFNSSVTILAPAGAEDETFELVDEDGRVVGTAPRGDCHARGLLHKSVFCWVMDPEGNILLQQRSLAKKLGRGXXXXCRSQNTCSRERSMRR

SEQ ID NO: 11718 - protein, 254 aa, Chlorella protothecoides
MPGRPPRPPPTPAARATSAPRAWIASCPVRWAPTAPGVLGGGWGSGEGLPGRSSRAGWAGLCTRESPNTDNALMNTLTHTASTHRGSRHTKSPMHRAVPAPPPPPYRTGHPGEDLDMWCAPYAYKRRAGLGCGGADKWGIVPPEHAFPVADWSEGTGSVYCRGGSYCPTTLRSVPCPARHFCRQGTTEPETCPPGAVCPPGTEIFDDNFTGAPAGNQRGRPIVLALAQPPAGRVFGPQKCSPWARAHAYGPRRG

SEQ ID NO: 11719 - protein, 555 aa, Chlorella protothecoides
  MOD_RES (125)..(127): Any amino acid
  MOD_RES (264)..(267): Any amino acid
  MOD_RES (356)..(359): Any amino acid
ERGRPRGPLRRGPDLCRAARPRRHIAPGGRAGRLRGRRRPAAAHAVAHAARAARRGARAGGALRPRQRGRGPGAAALCPTAAHAQRGPAPAPAVEVGRCFLVCEEGEGPGEAVVRTSPRPRMPSXXXQRCVQLLRTPGAALPLRPLSRLVDVSWRVRRGKGPREAVVWISPRTRMPFQALDAPPIPRIPRVAPGVTPAELAAMEAAEADHPVRFTEVALSADLHYYLRRWEGAYRLDWEGADVAIAQFPAAADQKGGVHAGGGXXXXVAIAQFPAAADQKGGVRVGGEGVWDRDLPGQNGVRPVLPLRSGTVAVMWPVAATVPVFFPSLPGTIDGTACGARVPVLDAFGGGIRGLXXXXKCASTGLDTGPLPTLRSRQRCWMRLAAASAACSRSTGPGPGGGPCGARAPEPGAGRKVGGDEAAGAGGRGAGAAAAGAGVWVAVARSALKPGQVLEAGLDCPVIMHGVAPVHWTQPHPPCWFHNPEATAYKQRWSREAKSCKGDIVQGQNAARVCIGEARISGEQRGTPPAPAADAQLVKPGLRPPGEQGLDGPRR

SEQ ID NO: 11720 - protein, 131 aa, Chlorella protothecoides
MAQLGGDTVADHSDPLQAVLAFLSGRCRLAVVSLGEDGCMMRARSGDEARGRARPRQVADTVGAGDAFTAGVLWGVLGGHSLAGAALAGCEAGGVAVEAAGAEPGVAALTALRAPVARTRLDREVCAGRAE

SEQ ID NO: 11721 - protein, 104 aa, Chlorella protothecoides
MPPPGTFPATPSGSTPSLSSMADHANGAGAQPPDGAGEAGPAPPPSPRPQLHIEFFALGLALGPRRKAVLQGVTGCLAASRLTAIMGPSGAGEQDLAATPAPGC

SEQ ID NO: 11722 - protein, 97 aa, Chlorella protothecoides
MVGQADAEDEIFELVDEDDRVVGTAPRAECHSRGLLHRAVYCWVTDPEGKILLQQRSLAKKMGPGQWDLSVAEHLQPGEVYVEVSRAWWDTARHCGT

SEQ ID NO: 11723 - protein, 373 aa, Chlorella protothecoides
MHPDLTVAEALAFAARFRLPSHTHPAQHEAAVKRTLRALGLEGHEAAVERTLRALGLEGVADSLIGDPDARGISGGQKKRVSIGLELVADPALLLLDEPTSGLDASASRALVAALRGIVRRGVTAAAVVHQPSAQVLAMLDDVLLLGAGGRTVFYGPAQGVQAHFEGLGYVLPPRLNPADAFLDIITGDRGRGPEGLDAVAPGFLAEAWAAREAGGGAEAGPDWGGVYGRGDGISERGGEPAGWRRPARLCDPEEGLVASPSGRCGEGSPHALDSCSSPAGPLSSPGKKVTWPALRLWRRRVWEVRGSGWVLLEGCGRREGGKNGWLPSLHRARAVQSATHQDICLKCGPHMRDQQSARPAGQDRSSRLYTGE

SEQ ID NO: 11724 - protein, 176 aa, Chlorella protothecoides
MAPSLAALIEGLPTGTEADQLADFEAEVEATVARLQAVKAGNKALTAEIEGLIEEVCAGRAELLSRGADLAGRLAALPPAPGPADPDAGAAGGAEEVGAELERLSRELAVASEEARRLEAELASAASASEDALAATQAARDEASGLSARAGDLAARRTRRGQERAGPDHCADLVRW

SEQ ID NO: 11725 - protein, 69 aa, Chlorella protothecoides
MPFTTLYISPNRLPATHAQSVVLAPLFVWYELLFLLGYRPQLYADINARIQRNVAEYRAAQRPLLASGQ

SEQ ID NO: 11726 - protein, 362 aa, Chlorella protothecoides
MNALVVWASSSEALQHLSPHSWAEAQPPSLAPVPAHKTQDAAHPAVVDLARACVTAICRPLIMHSDGCSIPPWPDARLSDHQPSSYPGSASPFTRRSAYDAARTGVEVREQFPGVWPSSHLRQPPTRAAPGCGDAYTMTLIQDQLLGAELRAASATLAGGLSQPADGASTEESPFVQAYTRALALQEQAAGQAPDLQRESLLAACTAYQEASRLAGHTHVAALYNHGVALSDLYRLGDNDDGDDGRATLRAALDRYGAALALDPANPQALNNSGLALQELASGLPPAEAGPLLRQAVARFRGAARALPGFHRALYNAGTALYSLAAALRAAEGVDSADLLQQEVGGMAAGVWLDGCVSAAMW

SEQ ID NO: 11727 - protein, 524 aa, Chlorella protothecoides
MGRLGLTRPSTQVATPSGATLEMHGSLLQLRGSAPSRSPLLDPATGSLLCFNGEVFGGLPVCPGANDAQALFCALTQATSSPMEVLSRVQGPWALVYWHAPSGTLWFGRDATGEGPLGIAGCTRSPATSGRPTFSSACVDATTCLSCCKAHSKCSPNPPCAGRRSLLCSLAMDEAESAGSGEQPSLRLDIKTSLSFQQQPGAPFILCSLDTDPGSEGAPPLHELPPGLYSLPLGRPHPASAHQFHPQRHPWPWVAPLRPSHLIPEGPQGPTARPSPEALRRADERVLCALRAAVAARCQLPECARPGHLKTAAPSTQAPLMVLFSGGVDSTLLAALAHQALPPCTPIDLVSVCFDAGRSPDRLSALDALRELRAWAPRRCWRLVRIDCGLADVDAHSPRLLRLLSPAATVMDLNIGAALWLAARGAGRACLGDGEAQGGAPLEGQGAQAGDEAGIQGVGVEEAGGQEYTSAARVVLMGHGADELCGGYGEAGKAEELGMGCVPVPPIPGVGSERHGAGSPSGAS

SEQ ID NO: 11728 - protein, 153 aa, Chlorella protothecoides
MALDMQRLWLRNLGRDDRLVADHGREARHPFLDEGVVAAVLDSPLACVTDLRLPSGQGDKRVLRAALCALGLPRAAARPKRAIQFGTRIGRLNNIRQFGGTRKANMANAGSVLLSDLACLPPVESAAAGRGVGQHGLLSDQPACCPVHRLFPG

SEQ ID NO: 11729 - protein, 448 aa, Chlorella protothecoides
  MOD_RES (117)..(120): Any amino acid
  MOD_RES (370)..(373): Any amino acid
MGWTACFPEREADMRGQSGFSIPSGRGSPDVRPRPLCVLVANNGLAAVKFIRSIRSWAYKTFGNERTGTAWWRGGPGWWGLPPPGGVLSPSHSQPRPGRPWPRMATRVRGVPSPGGXXXXLAATAGQAVAASGDASPWDSLARRYPAGARRSPPPIPPRTRHPPASPPSASSPLRHSPPDSPQPRPLLPSPHRRSQAHRDGHARGHAGGRGAHPHGRPVCGGARGQEREQLRQRRPHHVGGGAHRRGRCLARLVSFVCGVGMGGGPGGSYGGSREFSFYAHICKGVGGGLQAAETPCQVGSSGADDLVNPAGADRGGEVPPPRGISALGTLLPARALAHLTSPTLPSCRPRSRCIFEAEVGRSHPCPPPXXXXLPTLLQGAGEAWRFCGGGGMGPCQGVRPSSSACACSGARQATSWSVNRKLCQIPVIPFPPLATVPEPSDEEWARE

SEQ ID NO: 11730 - protein, 624 aa, Chlorella protothecoides
  MOD_RES (29)..(31): Any amino acid
  MOD_RES (562)..(565): Any amino acid
MMHVLSLKHASYPSAPGPARRPSSAPSSXXXRLESEARILPVRARTGETSQLCTELFCPIYSIGTSPQPALVQAADGPDSRTNASDLYMAGELGWVMFESSCHSGIFGVSWSLQDVELENCAEADQFSRKKLNLVLLLDVSGSMDSPFNNYYYDQVQGRVKRVNYGNLSIHHVHSVVVRMIRFIMATPLNTLTAAPLYSLYHAQFGVQQNLTDEGTAVLRLHPPGSNPAWDFDSFKPGSLRMPHEEQRKTKIQVAQEVLTGILDLLGPEDRVSIVLFSTDACQPLPLGKVGCLDVKALKADIEELVAALDMYMNLGSRVQFYARMCAFLKVGHIFVRLPFNSPTQQRDVKATDSTNTGAGMKLAIKTLEECEACLSADPNEWENRIVLMTGEMGQTGLKRCMNLERLVSSASAKPLVRGRPLSPNTRVLAHKHTSKHPADAQTNEGAVEDSELKSILEDAAAKGIYFTIVGIGLDFQTTLVELITQVSGANYFSVHSPGEGLRTWASLRSWAALLPHPSFAPPFLHPKPIIPPQSLNLLFPLLSCPYSSPGEFQKRLVSQFXXXXANMGELAVMCCTASSPLIRASIPASQAHHPTPVSEPSFPTTILSLLVSRRVPEAPGVPI

SEQ ID NO: 11731 - protein, 439 aa, Chlorella protothecoides
  MOD_RES (5)..(7): Any amino acid
MACTXXXSALCKPARGAGRRGLGCEPESRRRCPMQGRMPSLSSQSPSRLVTIIHENGTPSNKTKHPTGSVDGVHPRSSVLHEPRVANVSRLLLVFSLAAPPFDPGPATRYLVAGEAAGLDLSVVLNKADLVEAAEAQALVDEVIRVVMRGQKWGPGVCGIEGGRLVGGHRWWVGWGGSIGSPPPSLDQCPPLHGCQMHNTETGVGLAEMADAMAGHTAVLAGPSGGGKSSLINALARRATSAAGVDPTPVEQAVGEVSPRIGRGRHTTRNVTLLPLGAGAVVDTPGFNQPGLEGVPPDRLASFFPEIRARGERACAFANCRHLGEPGCRVAQPPWARYQHYVALLEERVAAEREEAARAVGKKARQGTTRVKARAGGRRVLEAKLESKTHRRTSRRSRHQQLAELAEEGMEEGAQHSQSSSTKSRPSVHRGLLNAAISS

SEQ ID NO: 11732 - protein, 179 aa, Chlorella protothecoides
MLCPGSHACLGGSPSQEVRATHIRAISDPGAWRRGMRGQVPAEEGQDFKGLQRQITNPFSNYTRMLLSTKVRAGIPCNGRPCGPAMRAPSLHRSWGHPRPIMPPCRAINIDFSDPDTLVAVGGALLGVALGVGVPAFYISRDRRDEQRLEELRELNRNTKMQTGEYMTKVHGRVRQCME

SEQ ID NO: 11733 - protein, 158 aa, Chlorella protothecoides
MVLCAGSLSCRAPPSGGARLERGSPFVRLGHHARPQARRRMSDLVIRSIAAPAPPPLRPASQPQAPPASETFTGGRELANRPPFSLQDIRNAIPAECWKKDTFKSFAYLALDVGIVAALAVTAHAVNSPWLWPFYWLAQGTMFWALFVVGHDWCGWRG

SEQ ID NO: 11734 - protein, 336 aa, Chlorella protothecoides
  MOD_RES (17)..(20): Any amino acid
  MOD_RES (84)..(86): Any amino acid
  MOD_RES (116)..(119): Any amino acid
  MOD_RES (315)..(317): Any amino acid
MTLEAQFMRLTHMLIPXXXXEYQVAEHKYDLGGSLHAPYSHADPLLTSSCRETVFDSLSFTGKLGRFVFPISLLAYPFYLLARXXXPETDLFTPREAPMSKTSAADYAEKVLAYAXXXXIPRRVVRLVVCNLCEDRVRPLQLAMLRRFWHPPCMRCSLNNAMSTHFPFLPQIRTSNAVQLAFVGVLGACTWALGLPAMIKLYFLPYIVSVMWLDLVTYLHHHGPSNPEEEMPWYRGEVSHGPGIGGRWGPAVECDLEERWTGVVADCFADAGDRLPFFFLYTLHPLGPTSIAWCWSAPAHLLTLTLNPPSSTGVXXXLLLCVHIIPPKPHLNRLVL

SEQ ID NO: 11735 - protein, 168 aa, Chlorella protothecoides
MSINVGERAGLRGLFAAPRFKVSARGRRIAMPSWGSRIHIDVALRFGQAKFRVAPFHIASDRVRIGRFDIPGLGSSPQSQRPHHSPTMASTLRLLRSRALVPRLAGPGPEASAEVPLRRCLTVWDLTFLGIGSMVGAGIFVITGVAAATVAGTVWGVGEECERLMPTH

SEQ ID NO: 11736 - protein, 474 aa, Chlorella protothecoides
  MOD_RES (8)..(11): Any amino acid
  MOD_RES (138)..(141): Any amino acid
  MOD_RES (289)..(292): Any amino acid
  MOD_RES (374)..(377): Any amino acid
MHGCVELXXXXAHVLDLPRQHYVGWWPMHGCVELLVLWHLLSNRDVHRPSHHPVLRARRTGRWSLGAQLCRVGCQHASGLEHGTGDCAFLGGRGTGPVRIRRHPGGGRHQGAADQHPRTRPGAGPPGCRAGARALRPXXXXPALGLELDPLAAGLVLALSGLLIWSVKQGMLFNRVTPQPAANACHLTSANPPIPPFPDPAARSGVYRQARRHRAGAGHGPAPRLARQPYALCPGGRARRLLRGQPGLFLLRRLRDGGQRRRGGGARLGPVLRSDARAPTPQPQLGRAXXXXGGARLGPVLRGDARAATPQPQLGRACRHLHQPTSSSYFPCTPEDHPFFPIQELHPPQHFKPIAPCSPPPPGAGALPGPAPGXXXXASAHLLIILAALEPSRDLPLAILGSLGLTTALYVAASACIVALVPRGKIDTHAAFSVAFTSAGLEWVARAVSAGALAGEGCNLREDVYVRADKAAEE

SEQ ID NO: 11737 - protein, 224 aa, Chlorella protothecoides
MPNRQAPARSLPAIASEPSVDSVAAEPSSLPAMPHIVVFSGGTAFNSVAAYNIAPPAPPTGHFKQLTHNVTHVLPVTDDGGSTAEVVRVLGGPAVGDIRSRCLRLAEEGDAEVGAAGRRRVASRPAVFDSCMLAVRSGMTMQLRRVLSIGRCHMLATESGRRKVDWTVHDRSLAATHSPLGHTLLPQSEAVRQLLGHRLSSTDPEAARQEWYRIVEGEHPLWQV

SEQ ID NO: 11738 - protein, 424 aa, Chlorella protothecoides
MPGSCNIGVQCSCLDCSSPISNFLTLRCISSCILCALTNSHKHNSQILPTPTPQDLTEPYKHTIRAFLVHFQANILRHASRRFNFQSGSVGNFFFAGARIFFRSLEAAIFLFSRVARIPEGTETLPALPSEGALRLGAELADGSWVIGQSAISHPAAAGAEALSVDKACAAPLPAAIRRAFYLSSDGDGAEHEVAPDANPRTLAALGRAQAVIYGMGSLYTSLVPHLVLRGVGSKGGCRAQEGWRGRVARAELDASETPAACALGTGLHWSGQVLPRTKAHGRRVACAMACRATSHAHPNHTPRPHPPQPPTHQILMLNGAVDRETGQCLRRPGAMAASDVLLALTDALNRRGGRRDPGLDHPPSAYCTAVLAPRGGGVEVDADALAALGVRVVRSVSAEWSAEAGAAHYDPDALVAAVRDLLA

SEQ ID NO: 11739 - protein, 190 aa, Chlorella protothecoides
MQSVAGLRCTALRPFIASSRQQALLLACVSRAWGRERAGLHRATPTIAALKPSSEFPADYHIGQTSSVPLTPLCPLLAGTGQVMAAQANYLRVRLEELEDAAGEVAWRAGQAPQDPGMPLPGPGEDTLLCTARGLLKKMQTRVMVGDRVHLSGIDWTSLRGRCLVGGVCRALHGGINGGDCPGVRAGAMA

SEQ ID NO: 11740 - protein, 125 aa, Chlorella protothecoides
MAVVTLEVVVVAIAEVVMARVARVAVVAIAEVVMARVAVVAAVAIGAVVMGRMATVAAVAAVAIGEVVMGRVATVAAVAIGDVVMGRVAAVAIGEVVMARVLMVVRVSLADLEEVGWKVVRQVAS

SEQ ID NO: 11741 - protein, 146 aa, Chlorella protothecoides
MQVLSFPDFKPERTMKGHVSRVSCMGFDPGHTRMASGGMDTVTSLWDLEEGICTQTFYDLDQAIRGVGFSHDGQYLAIVSEEPALEVVNLRTGANLGRQVLRTCPVDVAWNPRRHILAFPGASERDGSGAEHGLVELRYLPEQGQS

SEQ ID NO: 11742 - protein, 141 aa, Chlorella protothecoides
MDDLNWERRRYSAWPAYNASKLCNLLFAKELARRTREAGDDIEVFALHPGVIGTSLFSGESLSNFAVRIAKAIPFFPLLKSPEQGAATSVYAATSPELNGQSGAYLSDCKVTGTSALGQDANLAKQLWEKTEEMIAGALRS

SEQ ID NO: 11743 - protein, 220 aa, Chlorella protothecoides
MSRFSSRSTAQDVVRGVDLTGKVAVVTGGNAGIGVETVRALAGAGADVVFTSRNVEAGNKVVDRLQAEGVKGKLTVKQLDLASLNDIQSRVEAIQAAAPVIDYLILNAGVLSGPAKTKEGFEMSIGTNHIGHFHFTKCLLPKLKKQVGSGESWSGGGLRWRRNFWSVGGIRHQAVGKGQAPCFLAAAGHKSCALIYPCTTIPGSPSTCGGAFFPCSLWCP

SEQ ID NO: 11744 - protein, 107 aa, Chlorella protothecoides
MRLSGARGVKHALAAGPGRMAAHPPLRCPSPTHPQFKQEMEMRGHQDAVSRLAWHPTHPDKLASLGQLTEQSVRCAGLCVARITMRERKRGLPLRAWLQAWSLSAWR

SEQ ID NO: 11745 - protein, 365 aa, Chlorella protothecoides
  MOD_RES (131)..(133): Any amino acid
  MOD_RES (157)..(159): Any amino acid
  MOD_RES (341)..(344): Any amino acid
QGGGGGARARRPRRRRARGRAQRPGLPRAAGGQLGPDLRGLPHRAPAARQALRRDGALHRVLRPLLPLGGERDRAWQPRLLPHLPLAGAGGGDGGDGRGRGTPALECALWGEGGGSKCRGDPWRGGGLGRXXXKGGQADVQAMASHLQDSSGGMGPXXXVFWGGLCDPSAGEIPGGERGGDGLVRPSGGKGGQADVPATASLLQDSSGGMGPRKLLHSGPTLPPHPPPPSIPADLAQPRPGHGPATLVWPVVFVVADAFLLLSIAALALAQTNQIAKNITTNELANWHRCGGQPMGRLPGLSAWGFATGTPVSPPPHQDPTGQATPPRALLKPAHLLMLSXXXXPQCHLRHTRIPRGGPLPPKPC

SEQ ID NO: 11746 - protein, 923 aa, Chlorella protothecoides
  MOD_RES (435)..(437): Any amino acid
MPKALQLQHPGRWHGHVVFASRLGEFNPEVCIPGPPAPPLPQSTGVISKGEDLPCPVDAAGRFTAEVTDFAGQYVKPFPILPSPKPTPQPPPPSYKGCGPWHHQVAQGGWPPGGSGPAGAFLPLLLALRHAAPVQGGALLVCARGGDQGPPAGQQPADVLGAGLRAGEALPQLAGERAGLGHLALPLLGHPPAHLGVRGLLRGRGHRLHRRAGGAHWREGGPELFSWGGRGDSGRLVLVALESLCPYPCSHESAQPWIPPFPPCIVQSTHSWSPPCPASQPSLCPGDGPAPPLHRPPDHPRRRRPGRAAARGRRARPDPGLVLHPHGPLHRPLRQARVQEPDLQRPGVGRRREEDEQAPEELSGVWVRMVDWLSMGRAATAWMSWVRQEPGSARPWGPGRGLCTWSWFWACQEWQVGLLSRRCLVSSQPHACLRXXXRTWSWFWAYQEWQVGLLSQCTPVSSQPHACLRPWSLQQSQHGSLIHLPPSPPPPPRPFQDPMEVVHKYGADALRLYLINSPVVRAETLKFREDGVFGVVKDVFLPWYNAYRFLVQNVRRWEGETGEAFDPASPDYGAASGSTNVLDRWIRAATRSLAAYVHAEMGAYRLYTVVPYLVRFIDDLTNVYVRLNRRRLKGRGGTRDAGQALAVLFDVLLDVCSIMSPFTPFFTEAMYGNLRRALGPDAPVSIHLRDLPKVQRVGGGGKGVVCSSVHRARRACVYVFDAIRPGRAGGRRPDSGQRAPHDDGGGAGAHHPRPPRAWRQGPRRAADGGAPRRRLPGRHLRPAVRLRGGGVQRTRPGGLRRPAALLLAVRRAGVGRAGPAPGQAHGRRGRGRGRADPGPDPGLRARRGGRRGRRAPGPRRRQNRTQLPRQGGAGRRRRAHRGRRGRRGSAGGAGPGQRRGAGGRGPGARGGQPRAAPAQEGGA

SEQ ID NO: 11747 - protein, 218 aa, Chlorella protothecoides
MAGAPTCGLQDVKEGKDYHFPTEEEAVLAFWTEIDAFRAQLERTKGSPEYSFYDGPPFATGLPHYGHLLAGTLKDIVTRYAACTGHHVERRFGWDCHGLPVEHEIDKQLNITTRDDVLAIGIDTYNEACRAIVMRYSGEWEKVVTRMGRWIDFRNDYKTMDPSFMESVWYAFKQLFDKGLVYRGFKVVGGHAATRGDGPASPPGQLACIRCSSCPRSA

SEQ ID NO: 11748 - protein, 1220 aa, Chlorella protothecoides
  MOD_RES (59)..(62): Any amino acid
  MOD_RES (151)..(154): Any amino acid
  MOD_RES (391)..(393): Any amino acid
  MOD_RES (684)..(687): Any amino acid
  MOD_RES (938)..(941): Any amino acid
  MOD_RES (1013)..(1016): Any amino acid
  MOD_RES (1131)..(1133): Any amino acid
MARSIPCRAVQHLQAERETRQQGICLGGNRTRLALFYARFDNRIAIAFLQSTARIRYTXXXXGWEGIANVYCGPFLRTIRQHNCFRLLQSTARIRYTLTDSDLKPLGSLRKANPHRKDWQPMHLYMQSQNSADCLQAGCAHDACWRATLSXXXXAKGRLVQDPNDVYVSVFFLPQVEEVARSKHGDLDQMLDGHAALAAAKLTDAIRKREESKHASQRKAARILRIRAEIQVQRWPASFGWTRHMPRPCSSLVRRTLRTCDRSCRQCHSVWEYGHLTERMMVWKMADGPMLGLLDVQPNRVHGGITCMEIGLQPGLGILCRHVTGRPPRRAPTTKQDLGEMHPTPACWSSGFFEKHQDLKLMWQVLQPGGPTHTRASCPLYLRKAIQHSAXXXTSTHGRIAISPSGGRRRCSLEGQQILMHLVRSTCARPFSILHPAALAPGRRCCAVDKDQHLAHVCTLRGQSVECAIHMSGIRTHTSGIRDFGLCRLRVPVRQTPRRLADARDEPPDGRVVAALGWLWESPHGKDKSIGPLLAGSAPQGHAVNMRCFESSRVARPPWARVLCSRIIAASASCRQAPAPLGPCAHIIALVKVPGPDLSGGERPLLREVAAIVALVKVPGPDLPGGERPLFREIVAIEQRWRRSSGCGVLAEVIAGVDASFQGFDTGMGSQPAGHPHHSPGPSXXXXERGQSRGGAGRLGAGFLQRRSPGWMPLPRGPTPACRASPHATLITAPALPAHLKGEPVVPGGLNHELLVQIVADGPSIRRGRSDAVCIPAGMVRHREGRGEGLVWDSPPGPAAVGEDGRAGAWPWEGACPERYQWYRFCWGALEGACPEDISGTGFAGAHWSRGRTGSDGSAVPCLLESTGIAPDLPLAMCGMVIRAAQAGTQAGQTRSDHQLKARGRQAWSAGMPMGHATPRSSRRLAHGPTPGAGMRLXXXXHKQGRHAAIISLKLVGVRHGQQGCQWGTPRPGAAGVSPTDRHPAQACASPGFPALVARPPESCPPSLSHISXXXXVPRPRNPATRQLPPFLVSHLLDPAKLLVGLVVCLDGQARVHPQVHNGRKLVLVDHDRRVPWGWASGGPGMMSPSSQSCAAPRECRQTGTVPGSEQTGPGARVREEPGAPICPQLXXXPQLRRQAGSGGLAPAPRAHGVHGVGVGGHDDQARRVVAMAAQQREDAVLRVGQHHVALGKELQDEVVRGLARAKGELHHAVDAQLPD

SEQ ID NO: 11749 - protein, 230 aa, Chlorella protothecoides
MAKFRSVGPRHRGGAYRHIILCTVLLGIGLAALSFAPHGLQMKAVGGAKQHPVSPGRSWLESGVCGAQLRHRRSRGVRGWLTVKGHSLCTVQALQMHAVSTAGDQADQQAATEGAEVVEPTEGAEVDEEAQQKEVDAALERAAAAAAAARRERAAAGDRPPEPWMENPAADSGIPGLVAPSGSDKYHVLVTMNGGIYVTWQSRVCYYWYKRMKALYPDSAMGGFTRIIHG

SEQ ID NO: 11750 - protein, 211 aa, Chlorella protothecoides
MPVKGDTPSNFTLKLRKHMRTRRVASIRQLGIDRMVQLTFGTGEAAHHLILEFFAQGNVVLTDAQYGILTLLRSHRDDAAGLVIMAAHPYPVHAVPLGPVRQGRSARTQAPSQSACIRAVPHTTGWMATSSGISGVKGVCGTGAMRRVSIQMPGTHSSPHSRPPARPPPGNSPVMIHKDQFASIVDLWVNTSLAIKADHEADKEFGWVQEM

SEQ ID NO: 11751 - protein, 120 aa, Chlorella protothecoides
MMREQRTRAQGGLATLLLSKQRILTACPCGADPARRGPIDLSLPWGDCKSSTQTSTQVSRPPLLLTANLQMAYYPPSDFPQPPKGCNNTAVRRLISSIGEAARSLPDWDSKTAKAEVADA

SEQ ID NO: 11752 - protein, 260 aa, Chlorella protothecoides
MAVTRHVQAFQPCAVPSFRPGKRASREAERVVDGVVVVGPPGSRAWCLGAPALTRPTRPRRRPRALPSARRSDQGEAPDTSQRVTLSSKPQRPLPRRPDSLQSFPGSVPVGSRWRLAHIPAAPPVTLLGAAGQPLPSHSIPLPATPGPFVLGAVIDGDADVVVLDPTVSGSHARLEVLTRGAGPDAEAQLVVADLSSTNGTYINGARLRPWTETVLHPGDVLSLADPRVSYEVAVDPVRVRGDAPGADAAGAWYDAEGGA

SEQ ID NO: 11753 - protein, 209 aa, Chlorella protothecoides
  MOD_RES (86)..(120): Any amino acid
MEAMRELPWNSWWWVHAAIAPHAKALVSTDLILCPARGKLLPSLTLFPLEGSNLPRSPLGLRRARAMTATQAAPYPRLVAFDLDAXXXXXXXXXXXXXXXXXXXXXXXXXXXXXXXXXXXPPAILPLHSRLPEMYMLSGPPFRVDPDDPQCVLDRGGEQVELMGSSREILAELATQPQWQNTEVCDMGWESRDTVASLCAGLRGDPSMV

SEQ ID NO: 11754 - protein, 88 aa, Chlorella protothecoides
MLLPPPPPPTQTSDLLARSEANKELNDKKRLATSYANLARSRTVSDGTCKFPKNIIGCDLGPYQGEVKYIADDLALECQGKAPGECNR

SEQ ID NO: 11755 - protein, 517 aa, Chlorella protothecoides
  MOD_RES (48)..(51): Any amino acid
  MOD_RES (69)..(72): Any amino acid
  MOD_RES (478)..(480): Any amino acid
MERGDGGRHSTAPPPLALPPAAPRGLPHLSGPGAAATLGAPGWGLNSXXXXSISTLHPWRGVHQDAGAXXXXRGPCTGCTRRVQGVAARKRCRSNLHEHSFHSHIPWQASHVVHAAFGLTAFDPGLPAPSEESKNAIPLRLEALGDDGGCSWRIIAAQPALPAQCHQLCWRGPLSPHALLPSLRINPPSFDSVDPLPPLSAQTSLALRAGRLAVALHEYGPEGRPPLTSIYASGLEAGWHAFPDGAWAARLGGEVSVHLTEPTTLTPAPLVEACMLRIRLDRGAEGSACGGREEQDDVDTDDGVLTPRWQQGPRRAPSQGPGERNTPCTSQPDAALPLDVCELPLSCEAPQQGRTSLHVSATTALRVNAWQWTPSALSRLSGLRRALPPALVLTNATPVAVVVRQAGAEGAHLLGSGEEAPFAWPLPPAVVPGARRRLQLAAAGAAYHKGAAHAPGPETARWSEPVDVRTGCRPAMRXXXPPPTAAGRGRSGDGHALADGGGVRVPTAPGLAGGDGC

SEQ ID NO: 11756 - protein, 233 aa, Chlorella protothecoides
MASAVLTPLVTRLLRSFIRSSAESRGSTLKVSFSSRGTLLLHNLELDLDALVPGLRVHKALARALEITIPWAGLSSQPIQGLRHAHPQVVLTAVDIEVGPEPASADAGPETKAQQTNLASQAPHEGGRGPGWLGGALQGWLLRTLCNMQVTLKHVSLAWVGANGSVAARCAFQSLEFYTDPSLVADMEVRVDGLASGSGKQAFMEWGRRGWQDGRVSSLAQCGHCVTPLHSTA

SEQ ID NO: 11757 - protein, 373 aa, Chlorella protothecoides
  MOD_RES (283)..(286): Any amino acid
MGELEAVLAPLQGRAPFPADAALSYTGPVPRRALQALVAELTDHPRLRCLALQGCGLDDAGADLLSRVVAFNPTLERLDLRGNAIGAQGAQLLANALRTYNVGTLRALCLEGNPCITQAPELFPGGQTELSAQASSTPRAEKGHAMSAPSPLRPLDAKVERRWGLFVLRMRMESDMQDICHVLHQHSESLKQSWWTLTTRFSPCTWLFCPTPTGFPAHGFLSNPNRMLSLEHGIEEAAEQLSSVLTWRERFDVASGQMAAVEHIVSASLPTEGAEGMLQHGAXXXXFAILGVFFRWSMLCLHDYQQTAPRGCSSTVRADALPHPAPTHRQPTQHSAGAGGKRVTRGPAGRGRAGVPGDAAVAGLGRRAVRTAR

SEQ ID NO: 11758 - protein, 343 aa, Chlorella protothecoides
MGVSGPASPAGLTPPVEYLDPISNDVMQDPVVLGDTGNTYERSTISMWLERCARAGRAATDPLTGLVVGDAPKGWASRHYIVDLGRFSKARRTKRATPSKQPATEAAIGTSGSPSTTPASPRTAEHQGSDSPTHRLEGGASRSEGHHAEPPALPPPSPARPLYPDPGDPASARLGLDGVPEALAALHPSRLAAGGYPAQAKAAYAARTLSTLASQREAQDAMMEVRARVLWVQCVRRKPRLCGRRWGLTCCIWNWVLDPPTSCSSGGWGRLFLELYPAESLAPPSLCPILSTAAPSSATGPRPAGQAAGASRRHAPPPPNPAAAGRCGWLAAAPLAIMCWRGG

SEQ ID NO: 11759 - protein, 286 aa, Chlorella protothecoides
  MOD_RES (73)..(75): Any amino acid
MPDRVASSFCRRGTALTQRSGRRPALPSCSHLNTSRAPCFTPFPPYIYTHAPTITPASTTTLTHPPPAHPPPXXXRGRRLAPRQRQVARVGARRAARGAHPARRGGHAGRLPRPLRGHRGGGGPQDGRRAVARALRGRGLALPPRPEPAGPGRARGGETWCSGGVQVGARGRRRASTAPLCQCSAASAKGRCDLVGHTKSFDRPFPRWPTLPQPHTPLNPLTPPTLYPPVPFQKAAACLLVINHLEGPGTAQNLAVQVVREAVRSQRYALAAEAIRFLTPPGEEGL

SEQ ID NO: 11760 - protein, 138 aa, Chlorella protothecoides
MRAWLPAGTALTCPPSAALQAQGGAWSEVASFLGPPGPDAEVHVLAMADLGQTEVDGSVEVDAIAPASLLTSLRLAQEAAGATLMVRRPRRGMLLQRIPSWEECPGKTSCVVGMPTAIAALKSTDYGHSSVRRRGDPH

SEQ ID NO: 11761 - protein, 267 aa, Chlorella protothecoides
  MOD_RES (214)..(217): Any amino acid
MILHLFKVIHLLCALAGGLARGHTPLTDGHGLPTTPHPKSAVNVAAASLVWETAVRLDLNTSGPHVAGEWVEVRISGVIDPRYDDMIALYAPEDVDPRTVAPLKYKFLAAVPSYVERGEGTLSFRLLNLRQPQRFYFLRDGLALPVFAARSRAVAPLDPGEPTQVHLALTGRPSEVKVLWVSGPVGQPLIRWGAGPHSLDREAPADSTTYTREXXXXSRSCGSAGRWTGRSFAGAPTPSISTGRPPPTPPPTPGRPCAGRPPTAQAG

SEQ ID NO: 11762 - protein, 74 aa, Chlorella protothecoides
MNKKERRLALATALQSAAPDMVVVGSVAEAVPEVKTKNLVAKLESIGVFPMVRRVGWEPASGCAIARLCRRAGN

SEQ ID NO: 11763 - protein, 291 aa, Chlorella protothecoides
MYMVMAGWGCMTCWTLPGLHAFALGHRVATAIPGAALSSVGSPAYLAGKDTRLPSLTPLIPPGEAELQQRVDALEAEILQAADHSAHAASALRAAHESLARERELGRALQRRLAAGERSRETMAASWREHKRVSDAARTVQRAYRAYRLRIIRDQAHAGSRVRTGERGRGVLAMRGRTAAASASDVPACGRSGGGRRAGVSLVGADDRPTPPDALTDARSRLGSLAAERDALARKRRADLAFSGQTLVRENLAVLQEGVESIVAAFLLPARDLKSLARYAQKVGWRVRRRL

SEQ ID NO: 11764 - protein, 121 aa, Chlorella protothecoides
MSVSEGVGGISGTQNRTNHPVMWGRIVRGPSHSATPSASSSKQNLISATHIRAQVRSLAAADLGALTRLSPRLDALLADLAASARAAAPGAAEAYLVALAGALAASGDRASPDALSRVGGA

SEQ ID NO: 11765 - protein, 455 aa, Chlorella protothecoides
  MOD_RES (41)..(44): Any amino acid
  MOD_RES (216)..(219): Any amino acid
MPKPGHHSSLSWPLPQQRMWPLPDHIITPSHHPQTPPRLSXXXXPRHAQARASPQSELAPPPPTHVAAARPHHPPIPPPQAPLAFHQAAGGVFNVLFKSGGAASLDSVVPALLASLDAPEAERQAQALEGLRVILGVRPSLLGSMLPRLTRPPPVATKLRALGTLCEVAGAALHAHLGSLLPALLALTSGHPDVSPATAAAHDAQRAVVLAVQEDXXXXLPALLALTSEHPDVSPATAAAHDAQRAVVLAVQEDGLYLLIAELLKGLDDDARRVGAAVGIGQLCRGSRLDFQEHIPALIAGETWGHAEGAGQGPCVGGGTLRAGGVRGCGQAPSIHAHASPIRRPDTHAFFPRMTPGNTQSLVPALAEESEEEVVACWEALAAVTGSIPKEMQPNYVRCLKVRYLRSGGKGGRGHGESACAGEQQVDTRDCHLQVVWDQGCTPHHRLSSAGPLHA

SEQ ID NO: 11766 - protein, 359 aa, Chlorella protothecoides
MPVVQRGLKDRSGDIKKRAARIVGNLSALANDPRDMAPYVARLLPELQAALVDPLPEVRATSARAVGTLVRGMGPAAFSDLVPWLLTRLGSEASGVERSGAAQGLAEVLAVQGDAAVEALLPRILEGARARSAAAREGHITLFKYLPGCMPAAFRVHLARVLPVVLLGLADEAEGVRDAALSAARVAVDLYATSALELLLPAVEAGIMNANWRIRQSSIELLGDLLFKVGGAGEGGGGGHLVSVAEWRGRSLVGYTVAGCAGCGTGTVDALSKHRDVGWPLTPHTETLTSPTRPSHSQVAGTSGRIQQDLQNEEDEGISVEAHGRAIAEALGNERWVGSLACVRKKAGGGLGSGMPVIV

SEQ ID NO: 11767 - protein, 117 aa, Chlorella protothecoides
MIRGSAELREVAAEGLGQLVEITGEEALRPYVVQSTGPLIRIIGDRFPWQVKAAILRTLGILIAKAGAGLKPFVPQLQTTFVKCLLDPEPRVRRRGHVGFRGGWRNSRHAKPHTLSL

SEQ ID NO: 11768 - protein, 263 aa, Chlorella protothecoides
MTRKVSAEVDLVHQQTQNQRYGSSHIGATAKDISNVVTDAASGVVDIFHGIDKAVADTWNNFWKDGKADGFFMVRSYYPSECHADYFDFERIEALKPAIEACGISTLSQSPMLGFHKQMDNRIKLLEEILSFRMQGVEFDNGDMYVDGHKAASDVRDEFVSVTEKLMDELAQCYNVLPQLDINNTIDHRPEGDEKWFLENEKTVTQFCRKLAAERPLKDIRDEYNYPKKKGIKDECSRLLEASTMKSRRGFAIQRLMNAMRQA

SEQ ID NO: 11769 - protein, 332 aa, Chlorella protothecoides
MGPLGWWRDAPALCRLSALLDTTLMSLRGRSEEAWGPLGWRRDAPALCKLSALLDTTLTSLGCLERCSERRGARSVPLFSIHALDIPPLHHHNDNQAMDEMLEKLVLNSTEGHMYIAELDSQGAPALLSWRNPSVAALQHRFVPCPPFCPATSTPSNQDTHTQAPPSFLSPLPSYRKTVRHKMDHLVCFVPGMLALGVHSGAVGGEKGERYMAVAAGVTETCWHMYDRQASGLSPEIVTFRAGGAMRDGGAYNLLRPEAVEAFWYMWRVTRDWKYRDWGWAVFQTMQRHGRKEAGFSGVKDVREAEPTPDDTQQSFVLAETFKYLWLLFRCL

SEQ ID NO: 11770 - protein, 274 aa, Chlorella protothecoides
MLHAWQGYVTFAWGHDELCPISQTGKDDFGGLGATIVDSLDTLRMMGERGWDGIGVDAWDPEVRVRDPLFSSLGTSPSASFTEEYERALGWVRTGLNLTVDFNASVFETTIRVVGGFLAAYELTGDEVLLKRSLQVAERLLPAYDTPTGIPYGTINLKTMAPRNPKWASKASSLAEFGTHQLEWYKLSALSGDRRFADLAEHSIRYLNEQFPGQGLMPLFLSPSTGKFTSRRISLGALGDSYYEYLLKMWLLKGKTDDMYRAMWEQVGLLEGEE

SEQ ID NO: 11771 - protein, 208 aa, Chlorella protothecoides
MRAHPGPQRGPKASPDAPAREAQAPMEGSGHRSRRQHKSLPQPHGNARDLSGPDLCSPRGHAPHPPHASRPPQLDVAIQRHQEQEAWLSTLPDAPTYRPSAEEWGDPLAYIRSIQPEASLAGIALIHAPVAPALAPGRVLADVPGFRFTTRIQALGRQRWTAWDSVRFEEGDREYTLEEFAAEAAAAEAAWYGGLAGPLPPRTAEVRG

SEQ ID NO: 11772 - protein, 221 aa, Chlorella protothecoides
  MOD_RES (190)..(193): Any amino acid
AAAAAWFLLPPALRLLGSGFRGYAGEIAPAAALNELSGWRDGVLVDLRSDREKSVAGVPDLPSAGKLVEVEYAEIGDRRARGALRDPGSLEAEVTAMQVAGLKRAKRGSPIYLLDKNGGVAKTGGWRGVRGVEGTGAWRHAGKALGVICQAVIMTPQCTMLISSSSLATLCSPCTSQPLPPNTQLQRTWXXXXAWPRRVGGGLWGVWREPVPGSMPGRVLE

SEQ ID NO: 11773 - protein, 154 aa, Chlorella protothecoides
  MOD_RES (74)..(103): Any amino acid
APHAELALPGAPGDLAHPLACVAPRALLSKTLTVYDLASGRVVLAPGDVAATVPEAPRAGRLTLAALDEEEVWXXXXXXXXXXXXXXXXXXXXXXXXXXXXXXFFALRAWTSVAGRRGYVLEGSEAAAFLSDRGAAPGDELVLWRDGAWEPPRV

SEQ ID NO: 11774 - protein, 271 aa, Chlorella protothecoides
MTGSPRSRGGPQEERHGGDPAAGVPLRSLVPLQHLVQHVGAGSGLVYSRGVTGGLPGVLCRPIAGGWEAQPQIKASPAPPPSAPPPNCSYNKQVLKTFPHPLTITAFQFFIGSLVSLTMWTLGLHKKPQASTENPIQHTKWTPSPDENPLSLASTPSHGTGDGRVPPGGGAHTGQCADQHLAGGGGGVLHTHHQGPGALLLRPALRHVPGRVAHPARGPVPLPHHRRCGAGLHLRALFHLGGLPGGHGLQPHLPVAQRAVQEVHGQGWVGG

SEQ ID NO: 11775 - protein, 331 aa, Chlorella protothecoides
MGIVTWDFTGELCMDRMARHSDEEANDIQRSLHTPISRCKRRYMSILPPLDPFPTLTHAQVSYMILQRVSPVTHSIGNCVKRVVVIVASVFVFQNPEGCQGQRFVAANLTRSCPAPSSANAERQPSKNSPYMHRAGTAIALAGVFGYSQNSEIQPLLPVPILQCDGNTQIRCHDMDPWRKEDSMGLARDFPERMMTRLPRAEPGWPALPRSNQAKLIPSALACPALLSLLSSDIQAASRRATRDPTLAPTRTPTPKPAPCGTSEQKCTAEEALSQSTPLSDIRAIALGATALVPPRAAVQHVTAGHLPQPVLGAFQVEEEQDKPQAEGEEG

SEQ ID NO: 11776 - protein, 305 aa, Chlorella protothecoides
MAEVTAPGAKTFDLAEVSLHQTEKDCWMAINGKVYNVTDFLDEHPGGYDIVVSNSGAEGGVGGLGKDATEDFEEIGHSKTAKDMLKEYYVGEFVVVALWMSPETCFGMRPGSHEVHGGLTPSPVSQGGELPVKTKKQNASAGHPGHGLGTPGPGSGRWRATEGPRYHITPVLALLFPIQPHALCSVCRNVTSFPSIDKARGRPVIRILPRRQAATEGQTRGQRQGVQTQLNNCQSPDRSPLGGLVVARSVLLLLVLSLCTRNRCGRGCGRRIKGAKDTGCVSRVGRGVVIRFAFRYNPGVPADVS

SEQ ID NO: 11777 - protein, 292 aa, Chlorella protothecoides
MQIHLSHNQLTMVGARALMDSVQSTQPPPAKPLWLRLEWNRISLTDLGQVGVVCVSWLIEPAPSLAKSGSRWWVTTALQGHGSVPHKPSPPMQYLEAQHAERGLLADIPEGLDPGSTPALPHMPSYLAASGGGRPGPRRPSRGHPPSRNKLRFLVHPCHVRLPWLVSQFELPAEAAVLRSAKLQWQGPRGGEGNANEVPATAPPLNAGDKSPSPHPHHASSGPLLLFPDTSALLAMLGARRSAVPPCWLTLERLAELTERGQFGRTLPSNEQVGVGRQGELVIDGGCENLVR

SEQ ID NO: 11778 - protein, 765 aa, Chlorella protothecoides
  MOD_RES (358)..(361): Any amino acid
MQSPDHSTRLTQAPPHLLQAEMKDPSHGHRSPVPALIVKQPQLPHSCPRAVSQAPGRHASDLLVPQLQALQAEREGRGRGGAGRRSLASLAGRTPEPQVRKLRSQGLGRPGACALAAPRGFGHVGLHRARPGVRLPDRQEVGQALQEGGEQEGSVWVRRHGDQPPGILLPDHGMGAPAVHGCRVGDAAMQWGGGKAGLAPPPRLGRAVTVVSRGPGGCWGVGAAWWRSTWGGGGLPASPSSTPIPATSPTPTSRPPLCGGGKYSDGGMKRRCGHGDNKIGSSTPLTPIRPPCGVVTMGWGATDIHQAKASGSMVRMNPCTERSRVWARNHGPVLRTLELGSCPRSGSPHHPSGSDQGXXXXNPCKERSRVRARNHGPIPQGAARPLADKRVVVARQSSEGGALGLAMQSLRTWFGGSATDTEPPASVLAEWNAYSATPSSSRATDRLLTSAEEGAAGVTKFVTEAVGVFNTRVSGAARDVTTTVQSVQLTTLTGACRTHLTTTHRPIPRSIPSAAQWTYFAVFAGTGVLFLLASLFVFLPLIILSPSKFALTFSLGSGLILASLGALKGWRQMAGHMTAKERLPFTAGVLEGRGVQDALHVKLWKHNLVFGVVMIADAEARWGVESRSHALTTHPGCHPPSHSISREPGGDHLCCRGHAQLRLFHHLLRDSGAPRAVGHMSRSSPCSTTWPPTSLAEPRGCSTLWVGWGRGCSPSGPRRPVLHFRDDPYLCTVSTFQRDCIAIAKPFIQGRGWGSSMVSTPSSKE

SEQ ID NO: 11779 - protein, 559 aa, Chlorella protothecoides
  MOD_RES (89)..(92): Any amino acid
  MOD_RES (175)..(177): Any amino acid
  MOD_RES (283)..(286): Any amino acid
  MOD_RES (385)..(388): Any amino acid
  MOD_RES (422)..(425): Any amino acid
MQPRPTGRDLLEITGMAEVCFKYLSGMLCFSFHAKTIQGLCFPRAPYPSHGDFGPGMHSMSRELLATRRPAVGRAMSFFQLMLVTGVVXXXXAQHVTRVAGPSKSRSRKSDVTLSIDAGHWSGQSHSRNHTITLAHADGCHGRQLPVVAVPAGSGTHHPRCTQDGLAPDACATTXXXWYPSPTLHPRWPRARHLRGNGAAFVTSRAPTSDQQGLHAIVVGGGVMGLFAAQALLDTFDRVTLVERNDPLRATVASESWEEVSWSCMTNLRLCDSLGLTPVLTVXXXXESWEETSNRRSGVPQINQPHNFLVGGVMAMEELMPGCRQQLLARGALELDLGKDVAYHDYGGLFPRCVSGLKGLGVSRRLLEEELYAYLLSTGGKRLCXXXXAYHDYGGLFPRYVSGLKVSSLSSDQRTSCKLLSXXXXIPRTMVTGLAWDANHQTVVGTPSITSLRPLGLTYPGIHCGDGSQLGADLVVEASGRRSSLPEWLAEKGWAPPPERRVLAKVVAASLTVSWPEDWDCHKVRVCGKRGIIRECQSSAGSCVQGSAWAPAAYVERGK

SEQ ID NO: 11780 - protein, 306 aa, Chlorella protothecoides
MSLWSASSMQQASAPLSSSSGRCWQRVSSPPFTQRLPRHTCRRCTPSVARHAIKQRPLQTSTSLEVLQALSDDDWEEDDEDVDAADFDLPESSSFPTKRLPAEVRCFDTATIMVAGGTGGRGCVAFRREKFVPRGGPSGGNGGKGGDVYLVGDASQNSLLSFRRSVHFRWAWGGGVEANDVRKGRLQLSRLTISFLRSTHLMGCMPPGPRLVWTCLPGCSAVHDSISPSAPYPPTLPSSSPCRAEHGEPGQGSDMHGQGGKDISVSVPPGTVVWARDAAAGDPPLGEVLAPAPPPSLRLACCQPPI

SEQ ID NO: 11781 - protein, 542 aa, Chlorella protothecoides
  MOD_RES (265)..(268): Any amino acid
MPFMPSLNTPSPHQGRECGPKQLWRHRRCPVRAKGDDRGTDGAAEGAGRGRHPAQLLMPPAFYDGRCSQPEVTAPAGSGAGVVGPGPWKPWPAQHGVEEGRMQASMPPPSPSGVRPSRGPPPHDASLLARLDPGPVQRPLALVLAVVELHLAHHHRVPRPDPGPDQGRLHARGLEHALEARRGLKVGPVGHLREALQRLAADIPGARTRQVGADGEVAEARGVDRRGRRRQRHDLRLESGVGARAERGRGRTRGSRPGDVPAPAXXXXRRQRHDLRLDGGVGAGAERGRRRPRGPRPGDVPAPAVGTGAGAVGPNLPRLLPAPRSPCAIQQAAHAADQGGHPRPRRRRDGQDVLVGQAVLLAQRRAHVGPVIGGGGRVHLVVGQHEGLGRQAGVKQLQLAAHGQEVGAGVGAGAVDDVDQHRAAAAVAQELVAEARARVRALHQPRHVCVCLVVGGSVGGSRRREGAGRGGNVRWDGPTCKHGAPAVHAADTEIGRQGGEGVVGHLGPGRAEHPQQRGLARIGCADDAGVRHQLHLQPQPRL

SEQ ID NO: 11782 - protein, 299 aa, Chlorella protothecoides
MKHHATLTMILIDWKIANPFIQNYHWLHIESDRMVLALPLVFSCVHTSQSCRHGVQAFRSLRPFAATPASLASSKFSSVLNPQNARCAAGCDSAWHSFWHMSWRLQASTAALPLRTPGIPVLRLRPGRSGLVRAAWGADVEFHPAKVTSNKEEALKVVGWEDWNGVRASLHVRLGIPLDIIYSSAGCKPFCPSIPRSQQHRLVIEVGKLAAEYSTPGQFVQAKRRAEDKAGFFAIASPPDLDSGRLELLLKASGATAEELCALKPGTGLWRLVPFPHAPRHGRLSAGAGVLDWSGSPPV

SEQ ID NO: 11783 - protein, 111 aa, Chlorella protothecoides
MAETSTSGASLPELVPKASFIEDVSEYLQGASVDDALNELRGAHQKYKYIEQEIVQRKQRLAFKQPEIEKCLASVKLLAAQKEEGTEVCGGVGGGYLGRVGLAGRSSGLGG

SEQ ID NO: 11784 - protein, 114 aa, Chlorella protothecoides
MVALGPLPGIHIPGHSLNGVRNMLPCDTMALPALPGMPQPLAMTDGYIRCAPLLLESQAVLDFALSDQVFAKARLANVEAVNLWLGAGVMLEYSLPDAQQLLVRPGAGVRHGVA

SEQ ID NO: 11785 - protein, 74 aa, Chlorella protothecoides
MRQGSDASDVPCGIGDRCANLPSLPVLCSTGSEIRVDMWRCDGNHKVWYEWSVSCGTLRGAIHNPNGRSYAVGL

SEQ ID NO: 11786 - protein, 130 aa, Chlorella protothecoides
MDDDCAHDYFDRTTAAVVMRVLTAQATKRVLHQLQESDLIIAQWLNHFCAEHPPLDGNKGGGCVWGGSRVGPARVLVIQPGVHQPAHLPLAPGDLPLSGGPRAGGHNPFADSEVLTVHTVPMCYSGLTTI

SEQ ID NO: 11787 - protein, 162 aa, Chlorella protothecoides
MGKGFRIDTIPVEQYPSILLFATGSALSPAGAGWSSMHGTAAQPWLPDPPGVPCQPRPWTPAHPPVHHPLHPGISPIKALIESGALAGRRSVRLYYGTRTPEHMAFAQSIEAWSSEHGVTVLPVFSSSDDGYVQDAFARDAFARVSGERSGQGACWAAGGRT

SEQ ID NO: 11788 - protein, 334 aa, Chlorella protothecoides
MPSHQPTLNASLPLRRLVQAHGEGSWSTIARAFEGRTGKQCRERWANHLRPNIRRGAWREEEELRFVDCHRTVGNRWADIAKRIPGRTENAVKNHWNATLRRKPCSAPGGRDTLLKRYMVEQGLCPGPPALPPDSGRSKRSRRHVRQGAPPGLADAGPGAARLCRPLDPGALPSPEPMVSTTHPPLPTRGAHDVHNPPAPADAWVGPHHSQHGLEGGAGGGPPWARLPMQAQATAAAAVLHARRRGWWCRAHARRGPAPHPIHPRPGVGWDPGVAGFQQGHHAVCPLCGACEGWRILGFGKAILLPLAPVLGQARSPSHPNKTQASPGPLAVCP

SEQ ID NO: 11789 - protein, 220 aa, Chlorella protothecoides
MLKLGVQVVLRGAPRHTPPGGDESDAGLKLPSNPLRPYWEYLSFLFRKGEIAAEQQPAELAYRDFLQVGGMHMDNLESQTYEVFERDATKYNTYEEAVYCALLDRVPAGSEEGTATVSAQMKHRGQEGHGSGWPLHFSLASPAAEGLSSSAQIDARACLALPGCDGGGSRARTHRGSVPGCGAACKACRAYVCRGEKPQRHRHPEPQSRNRVRRDGMWGD

SEQ ID NO: 11790 - protein, 174 aa, Chlorella protothecoides
MQRSLLCGFDFVLAPLVHPRFRRGPDYPGAFTRSDLLLTASQWSGQVVGSTSPWINPDAPQDTALRSQSEAALRQELHWAAHLSLQACILPGAGGPNQARILNQALLTLTGMALWVRVRLGGPEDAWEEWNTLRFACAHSTRLGAVLEGWQGMKGPALHTWLQGPVFGAMVSGL

SEQ ID NO: 11791 - protein, 279 aa, Chlorella protothecoides
MVTTPHGGRIGGRAARGRGTSGRNGRGRGAGREAPTPPRAPPPGSSYTPAATRTTADHRDSTPKSRRGRKARFSPSPLHRSVADSAAVHGRGAHAVVWEEDAGGLVTVTPHPDAPFLLPSFLEGLADFLSVWQSDAGPRSVQTHVAEASGSGEGAGSWSAETLAAELADLWLRGAPSEAGEAATAGPAPPTPLSLRLERLELGDEEVACVAAWCLAHRSRAAVRKLWLFDNKCGDRGAVAVAGILHLGLEEVGRGLCEPSRVVRGLHGGRLGTGEGCDA

SEQ ID NO: 11792 - protein, 112 aa, Chlorella protothecoides
  MOD_RES (12)..(15): Any amino acid
MQAHPASAHPGXXXXCAFALISPSLVPWAARHGEPNALPSEAPPQNPLPTTARHIEMQFMTEARTTVVYDMPLAEVVMDLFDALKSRSRGYASMEYSITGVDGCGCPMWRSM

SEQ ID NO: 11793 - protein, 688 aa, Chlorella protothecoides
  MOD_RES (179)..(182): Any amino acid
  MOD_RES (274)..(277): Any amino acid
  MOD_RES (626)..(629): Any amino acid
MVWRHGTPRVWLCARAHAGDMATSHPPPRPPRAVVQRIPPPRDTRGDPLRALIFDSYYDPYKVCEVRVPHVPVPVARNEQGADEQGAWAWVAERGDRPVIPPRQALAPSSNWRLDVLPLPSLQGVVAQFRVMDGELRRGDVVRFMNTRCEHPVAELGVLAPKAVEVGPLGVWHVGGGGXXXXWRPRPSRWVPWVCGMWGGGGYLKGRVASRGQLGSSRCLGGVCGGCEDGQRGSGGGRQRRPFFCKPPGRHMYPCGWGPRLSTIITTPHHTHSXXXXLLGGTCTPVDWAPASPPSSPHHTPPTQPFAGGEPACWGGGLPGGCHQVGGRRSRGRHGDAEARARDRGAAGIHGGQAHGLLRHVHHRRRPVRGLARGADQAAAERRRAVLRARGVLRHGLRLPLRLPGPATPGDRAGAAGAGVRPGPHHHRAHCGLPRAHQRWRGARRGLPQQAAARRHAVGCAGALRQVRAGMEVYGRCGGPGRRSPQVGMGWGGIRSWHGGMDMPWQDRSAARFAGVQALGLEKGEMATDAVQMQGWGPMQAHPASAHPRREIATRPRRAHIPIPVDPPFSILHTKQTGGHHAQGVCGAHPGPAPDPARRVSAPFWGPVVRMVGWGCCAHIPGWEAXXXXGMEVYGRCGAPGRRSPPVGDGVGWHKELARWDGHAMAGQRRGTLCRGPGLGIGEGGHGH

SEQ ID NO: 11794 - protein, 330 aa, Chlorella protothecoides
MRTSAQPCTWRSMPQLHFLKKLLLLSNICPALSHPSPASRTSAMPMPCLADTRRASEASSPTTSVISWRTRSTSAPASPREGRMAGGGMGRGAKAQRQGSPEWGEHDGGWGDGSRRQGPAPRVSRVGQARRSSYSISPLPYILSLPAPALQPPTSTNPPLSLPGPPTQHTRRAIPLTGQVYLVQHGDDGEVGLQRKVDVGQGLGLHALAGVHHQEAALAGGQRARHLVRKVDVPRGVYQVERVLLAVGRAAVAHARRTQLDGDAPLPLEVHAVQVLGLHVTLGHAVRGQQQLVGQCGLAVVDMGNDAEVADVGGGDLQVGVGWGRWGPDG

SEQ ID NO: 11795 - protein, 139 aa, Chlorella protothecoides
MACPSHHASSLCHPTPSPLGVISAPAPHTSHTLPCLPSPDVGLQHSRQRGGGRQLAGAVHDVLRAIAGARAEDHSGRGGDEVQAVLPLQPLLHDLQAQEAAAEAEAHGGGHLGLEGQRGVAQLQLGQRLAQAPVLVGVC

SEQ ID NO: 11796 - protein, 208 aa, Chlorella protothecoides
MASRAVVWRRALHVCCAHPGPLDRNRPATPAPMSEGLRMDRRRVMTSLGLSTGLLTGLPNDAGAVQGSIAGRLPGAGEPDDEGFLHYTRPEGKSGGHGVGWSEMPRYSLVIPSGWEEQPVSIADLGGTEIDMRYSSPDEGALSVVVAPILRFLDVGFNANVTLSDIGSPEKVMRGGQRVGGTLVRGLVTLHGASSAGSLPAHPASPHL

SEQ ID NO: 11797 - protein, 275 aa, Chlorella protothecoides
MESRGSGGSLENREEAQLALKLCTGKLVGRGGTVQAAPHAGYAGPIGRVSLSKLWPCRGLLHASSRRPLAAPPPSTHTHTRLPTATPPCSAELLGSYGGEVESLVLLAPYSAQVSAFKRHVSANAALKGRVECSTVDGYQGREADVVIFSSVRWDLGLGCDSREAGFHARLSATKQQATHQPQTYGAPRGRGPQSSLDACHTAPATPSLQGARAVLEGRCWLPGGRPTAERCPHACQASAVGGGTGHHAAVLGTLGGIHRPLSGAGVRHSCAGVT

SEQ ID NO: 11798 - protein, 550 aa, Chlorella protothecoides
  MOD_RES (54)..(57): Any amino acid
  MOD_RES (292)..(295): Any amino acid
  MOD_RES (377)..(379): Any amino acid
MGLTFRHDRISSTLTSPACARGLQIRAIPAGHGPSAGDALIPPAWSGVTLHAVXXXXLRAIPAGHGPSAGDALISPVWSGKHGKALCSRQCAWPRTFPVTSIAGARDGPPTFSLSFTPLPLCYPTPGAWDTESSSDRHPIVNSSPNTAVMHCSTPPSPPLTLGFVPAAAMARPVFGQRQSMAGVSLAPARAMAARPQRAARRAVTTQAKLNKSKINKVVLAYSGGLDTSVILQWLKETYDCEVVTFTADLGQVRAWLEEGFGGMGGWGAVVGTSLVQDRWAAPSPHPPPRAXXXXWEQWWEPPSSRTDGPPLPHTHPLAPRARSWSPRGRRRRPRGSRRSSSTTCARSSCATTCSPCSAPMHCTRAPTCWAPPSRAXXXCARLRVPHVPCQCAVRGDLPAGHLHRAPAHRQAPDRDRARGGRRRRLPRRHGQGQRPGALRAGLPGPAARHQRHRAVARVGPQLPLQADRVCGEPRHRRAPGQAQRAALLHGRQPPAHLLRGQRAGGPLAGAQREHVHPLRVPRAGAFHSSSLLEGGGGVHAGSILGAQWE

SEQ ID NO: 11799 - protein, 246 aa, Chlorella protothecoides
MKTMQEMLRGTQSSLASLNHEKRELLERKKQAEARMKSSKESASSRRPDLRAHALNQAEVVAGTLSALGADIFPPDLAFHAIICDEAAQAVEPASLVPLHLLAPGGKLVLVGDPKQLPATVISCGAAAGMLSQSLFERCQKARRGTLRYLQRCQPHSWEGLGPGVCCTPCSPPGRALARPPQAGTPVEMLTEQYRMHPAISAWPARFFYDAELVDGPGVHTLAAPFHAHRCFPPLAFFDCMEVKRP

SEQ ID NO: 11800 - protein, 123 aa, Chlorella protothecoides
MVAAFLGCAPGARGRAGGKFAPPCSDSRPASGEAVRVLLCAQSNAAVDELVGRLCQRGILDSYGKARAVRVLRLGTLESAAPRASTTHIDAIVAEMERAEAGGAGHGCEWLQLGEGPCGVGPV

SEQ ID NO: 11801 - protein, 92 aa, Chlorella protothecoides
MTPLPPAGHLINLIDSPGHIDFCSEVSTAVRLSDGALVVVDAVEGVCIQTHAVLRQAWEERVRLRRACWPRWGRVTLPLQLQACTATRGMVD

SEQ ID NO: 11802 - protein, 275 aa, Chlorella protothecoides
MVLVINKIDRLALELRLGPEEAYARLRAVVDHVNLVVSSFHSEQFISEADAVLAHENTRSQALQARAGGGAGEGAEDDAGAEDVFSPSKGNVVFGSAGDGWAFGLADFAGLYAGERGGRGLGLPTGWGRSIQCLLSHHNTHHPGLASSNRHRPHPPPQHLPLPCGAAKLGCKALALERALWGDYAFQPKTKRILPIRPGSGGKPLFVQFALEPVWRVYACCEAADPAAELSRLAAGLGLGERLHPRALAAADPRAAARALMQAWLPLAEAVLGAA

SEQ ID NO: 11803 - protein, 592 aa, Chlorella protothecoides
  MOD_RES (350)..(353): Any amino acid
  MOD_RES (418)..(421): Any amino acid
  MOD_RES (471)..(474): Any amino acid
AAARAGADRVPGVAALTPPPARADPLRLTLGVEALGLDGPAAAAWLEAEAGVVLEMSTPRTVVAAFGIGSAAGDGNALVEGLWALSRARWDPGRAARCAAGTGRPARCASGTGPSEPGLTPPPLPEVVLAPREALARRTTAVPLVASLGRVAAEAVCPYPPGIPVLVPGERVDRATLRALRDAAAAGRRVTGCADASLRTLRVVEEGHSPLLPAVDHVSRSDSCSGARLGLDPARCLLTCLSHRLSSCCHTLGPTPDPGSQTYTLMYNMGEAMQWGPGTARHSRFRLRFFSGAAFRTPGAAERLRGAGFPASSPQPSAFTVFAPPVAVSGVCLGMSGGGGMVGACLEATXXXXFAPPVAVSGVCLGMSGGEGMVGACLEATLRPERRCSARRAVGERSLESDSTSMHHLWSAGPTHTXXXXLSAVARRVELASGAHIGANYLIIRSPSAARTHPSRRPAPAPPASWHLPAXXXXAPVAAPSPSSTCLLAPPRARPPRGVYAGDERGLPRKLGEALQQEAPGLLVQRRLGVGLHQQAADDGQDVPQAQVRCPVPLQGVDADVAGGGDVGVEDAGQEVACVCRGGRRGEGCLSQ

SEQ ID NO: 11804 - protein, 334 aa, Chlorella protothecoides
  MOD_RES (20)..(22): Any amino acid
  MOD_RES (190)..(206): Any amino acid
MERHKHCPSLTTHPAALEAXXXAWRDTSIAHLAPRTLQHLRSRPPSSNPEPSFPPPCTHTSTKENRNTTAAHLDLDVHRLATGAAQGLMDHDAGVGHGVALALGARAEQEGAHGGCQAEAVGLDVGTAKLHGVVDAHARRHGAAGGVDEELDVARRVLRVQQQQLAHNGIRGEIGDLAAQEDDALAQEQXXXXXXXXXXXXXXXXXISAMGTGRERGCGTTPYQEDPCGQAWVPRHVLCSARSAGSMIAFQTTPRGLHAPGGHEGLTGGDQQGRGPGCALPGTRGRPATKVAARTATAGLPCRPAGDHGGPCGARRSVGHARSRGCSEVGRRQR

SEQ ID NO: 11805 - protein, 422 aa, Chlorella protothecoides
  MOD_RES (154)..(157): Any amino acid
  MOD_RES (279)..(282): Any amino acid
  MOD_RES (370)..(373): Any amino acid
MYHKANLNRIMSDATGQPIETIEEDTDRDRYMSPLEAKNYGLIDHIVGGEEVGPRLWGRCSRSWATPRTSPRRGGSTSRGATRTTMAHGLSASCAPPNPTPSPIASAGLALLKSSNQAGSIILLTRSVWEGYNQATRPSQPLQRLRPEIGRESXXXXSSWEHHLVDKLCMGRGVTCRLRPPPERRMLMVGAGTHACKQANDHSVVPLYSKDQALFISDCPAGKCCTPVHSAMAFGDRGGRGGRGGRSPGGRGGGARGDCIWYSSGPALPWIADSSPFAXXXXHCIWHSSGPALPWIADSSPFARAPACFATGDARPTAIPAVLWFPHNITVPSWMSTTTHRVAALCATRIFCIASPSHRPPLTPALCPRXXXXALCATRNFCIASPSHQPPLTPALCPRSLRPPRRPGRRSRRPTRRTRWCV

SEQ ID NO: 11806 - protein, 226 aa, Chlorella protothecoides
MTEGERYEALRHCRWVDEVVPDAPWHITEEFLDAHAIDFVAHDALPYADVTGASDDVYGFVKRLGRFKETQRTEGVSTSDLILRIVKDYNEYVLRNLSRGYSRKDLGVSLLKEKRIKASASMRDFSARMRDGRLRVADGIRKHMNPRLRVLPAEVERNVKDFATSVESLVDKVASGDLGVELIENMDRLVSGFIGNFERRYSRFEKSIKSLGRNMRRNSQPLLQSP

SEQ ID NO: 11807 - protein, 396 aa, Chlorella protothecoides
  MOD_RES (41)..(44): Any amino acid
MLRVAGTVPKMQALLCRWYYHPLRGGAPAYFISSDVPPGHXXXXLRGGAPACLISSDVPPGHHRSSHSRGSLPKPFAGCPETHPPVPRCTSATLSRTRRSRCCRMRCVRQEISPVQPLLRPLCDGHHPIFMTPRVSWSSSSDTLPPVGLHALLPPSDAVPLLLSSPSTDASPAAGWPATLLVSVAWRVAAVALRSPLRCVPAPRSLASHPPETTMPIPAGFAFVQFEDPRDAEDAVTGLAGKNGWRVEVARPPRARDDRFGGGPPGGGDRRWAGILLTWLRRVRERWVSNSTALCCSVNKPLARYPPSQALHPFSITGATSAMSQGTLRVSALVGPAAAAAVAAVTATATVVTATANAATATATVAMAATDPVTTGATTGAPTATAIATGARAAGI

SEQ ID NO: 11808 - protein, 932 aa, Chlorella protothecoides
  MOD_RES (80)..(82): Any amino acid
  MOD_RES (278)..(281): Any amino acid
  MOD_RES (396)..(399): Any amino acid
  MOD_RES (908)..(911): Any amino acid
MRDADAGRYARLERLAAAPSPDARDLYGATPRDARRGALAARLAVEVTSVPPSRLMAVIGQALKCCPCVVPPYDSFEDSXXXVIGQALKWTLRHDQPSRYPARPSEKNTEHPTIPKHRQQHQGLLAPGATFDLFRGSAAGARDEVERCPTALDRTIKFGTKSHPETAAFSPDGLLLVTGSVDGFIEVWDHVSGKLKKDLAYQAEERFMMHDQAVLALAWSSDSELLASGSMVGAFVECSFWGEVSGLWHWGWMGREGWEGPRERAGRDSCRHRGCCAXXXXREGWEGPREQAGRDSCRHRGSCAALANVGGRHADGELKWRREEVRAASKAAKCLRDDGKIKVWRVATGQCVRRFDSAHTQGVTSLALSADSSHVLSTSYDGLIRWVAVRLRGGVXXXXVATGQCVRRFDSAHTQGVTSLALSADSSHVLSTSYDGLIRWVAVRVREGGAGSQADTSSPTYSSPTTSSPCSLTRLPTPVQGAWHQERAHAQGVPGPHLLRQLRGVRGAGLARALRLRRRQRPAVGCALLRVPGQLPAAAARRARGRRGAGPPAPRPRQPGPGLRGGAVQHAVPHDADGAGAAQLPVGQGGGRRLRCRRAVAARRVGALPRRGRRAVQLRHGGGGEAGGHPARHRQGAHRRGAPPPPQPAGHLVGCGAAQHVEGGVRDSVAVSIGTTAHRRPAFTDPLPAGAAGGGSTLLDLVAKPPGLNTPRMQRRCACWREANPPLSLTISTPCTIIADHLFAVSPSVTERQAGPGHGVWRERTILPYLREAPGQSPAHALPSSGSVLGGATAVAVHRRRGAPVPAVPLAGRAALAPALGDGAPFPAIPVVAALVVPMHGWGPAGEHSEVRVVYQRSARMSRGSAGGTRSAISTARVAPLSLELQQARIAEAQHTALTSGPAPGSPXXXXATAGQDRRGTAPSIDERACTR

SEQ ID NO: 11809 - protein, 304 aa, Chlorella protothecoides
MMHSQNHPAELNLPPNQYYTQGQWLPWRGWHDRELPQHPAPVVLSIQHKCAAIGCRGAMHDLRVADHPGMRAARPRAMLGRRELQRSLNIGTGNTGTHNLGKCWWKSWLMKEDMDLEKGDQGVGEFAATLLGRGHGNSAPVRSCVEEMEPETPPPFPLHAGNNNRGGNNVGSNNTGNFIFCNNMKTSAVQCEKSSLLTSETLKSPPPPQKKHPPPSKRHPPPPKKKTPPPPARRHPPPPKKKSPPPSKKKPPPPAKKKPPPPAKRKPPPPTKKKAPPPTKRRPPPPSKKHYPPPPKKRSPPPKK

SEQ ID NO: 11810 - protein, 130 aa, Chlorella protothecoides
MDGWMLQIHRGSESSAANPTPFSTGRCAALRLVRGFRGLSRPAHLAPPPPSLCHALQDTTLAGLQMGMRTLQAQLEEHSAALRGLVRDNFGRFISSKSTIDDIQARLRSIEAGGAASGAPSAAVLAGVSR

SEQ ID NO: 11811 - protein, 407 aa, Chlorella protothecoides
MGLREGISAVLGGGVSDTAAAAPATGSGGARAGAHSAAVAPAALLEDPSGSPQFQAWLGEGRMEARRSAAQASDPGLAGLLASLVPGRLSEEAFWQRYLYARYCAEERRRALRELTQRSRRVEEVDWDCEDEEEEEDEAVAGGPGEVGPPAAGAGAASPGAAGKGLAQGTAPGAGDEARAAALGRKSVTESLGAGEPVAALAVPCASGAAAEGSSVAHGVPSRDQPAAGGSAWPGEEVGSPAVGGSACPGEEVGSVAQARVLLAEPGAVSAAAAASTGPGEGTAGRSAEGEPEAEEVAAPTAAVTACGGGPSSPDGADTAPDPAGREQALADALLASPGPLPASPGSSGRAGEDAASTASRHGPSTSWSVISDGPSGESTPMAPPLAPAVGKASKAASDDDWGDDWE

SEQ ID NO: 11812 - protein, 309 aa, Chlorella protothecoides
MRDLASAAGRRLEDTHAEVEPERREEAAADAAVQRRLTERVRQLEAEVAGGVGAGGLAAPASEDGGEAEGEDGSEGEEFDIDSGEEEEGAGDKVAGDGEEEEDASASDPESEDLEGGSESGEEEEESVDEGDSDGGADAGSADEALAGSYAPGLLVDPDDETAVCATLFRGLVFFLGREVPRELLLLTIRSAGGEATWDGPGATMAEGDERITHQVVDRPRQGHRHLTRAYVQPQWVWDSLNARVHAPVERYAPGLAPPPHLSPFVDAEEEGYVPEYGRTLRALREATVAAQRRALGAGFVADLEEGAA

SEQ ID NO: 11813 - protein, 592 aa, Chlorella protothecoides
  MOD_RES (190)..(193): Any amino acid
  MOD_RES (561)..(564): Any amino acid
GDPGGGGGLDPGGGGGLDPDAGSAGCTDGASSSPTPSASRSAPGSVAVGKPSTSRAKASSLGTSVPVAPLGSTRPPSSLSSSRVRGMPMGGRTRLRSNAGSPWVGQFCTQWAPATSHLQQQGGRKVHTSEQSRQGEAGLWGAFRVTKSPWKGKPEHGGRKLQGYLCGRCPFPATLEHGVRCRVKLPSRLXXXXLEGPCCCGQFPAPLEHGVWCRVKLPGRLWGQVLHTSTRTAIDPSGTGIQQEVREDAGRGVDRKIAITQQGNCTPLRDLVSPPRAAVLQRHGSTPAPPAPSAARGALPDLTLPGGGCAGQQALQCGLLLANASGRDVGVQVPAKLIRGPAGVDGVVGGQGLPSDRGGRWRCGGAQRLEAGDGGPLHQHQRGAGDEFRLVRQLLGGARIVEGELLGALRAQAALDSDQALDVPHLDDGAIETHGVLLQGILEPEVDYTRHSVPGGTACSASQGHTAGVAAPPPLPSYPRLPLPQAPAPINTLEGARCQSLIPREVWELRGAAGHHDGDSGRRSQGLLNPRAIFRSLILHVRALGCAVGTGEGYCRCLQPXXXXALGCAVGTGGGYCRCLQPLAEVQHACYM

SEQ ID NO: 11814 - protein, 189 aa, Chlorella protothecoides
MTSVINFRFKNALQQDSVSFDGSVIQVGDIKRLIAVKRGLGPEGAQELTLYDSSTSEELTDEAKLIPRSSLVLVKRAPITSFKPLSAATAPASTPVAGQSLPTDHAVDAGGAADEFGGDLYSDVPPTGIGEEEAALQSLLAGTAATWQREVRQGAARGRGRGRGGRGSVPLEYRCPRWGYEVAERSPVV

SEQ ID NO: 11815 - protein, 213 aa, Chlorella protothecoides
MTRNQALKKLQLKLGEFRRLCILKGVHPREPRRKTQGAHKTYYHAKDIAFLLHEPLLAKMRELHAYEKKVRRARAKKNAAAAARLAARRPRYALDHLVRERYPSFVDALRDLDDPLTMAHLFAVLPAEGGAGIPARVVRVARQLALEWQAWVVRAHALRRVFVSVKGFYLQAEVQGQAVTWLVPHSLSQVLPQDVDYRVMLTFLEFYQTLLQV

SEQ ID NO: 11816 - protein, 565 aa, Chlorella protothecoides
  MOD_RES (400)..(403): Any amino acid
MSLDLPTHRPRPSGVADTNDDAQASKLYVKIPWSIWCGCRSCVGDYANLPSQCRSCVQLGYFQDEFVHHFVKAPVRRAPLINRGAAPWARSLVVGCCRARLGCWTLPHGAPDRGHLHAYLPACSPTEPPTPPTHRLLCQAGIPAPACHKVPRLPASGACAGCEPGGRLRHALLATGAGGCAHLALHRAGHAAGLELWGGMVGGWVTWSASDDQWGSCQQTNTPRTAAPPSHPPQPSGLHGEGGRRGEDARPAPPGGRQPRRRAGPRPGGGAVAGRGIPPGPRRPPQRGPGGERAGPGGARPRRAHPGPGGVRAGVPGAGGKRRPAPPAQRHAQHRRDAAGGRRAGACHAGQYHAGCLVGCIPPVWAWVRRRLLFTSPSPTGMHTDDTTAPHRSHPYSSPXXXXCGGACSPPLHPQSCTPMIPSRPTAATPTPHPHQVRPDDAFGKQMLLNLSLRGCPLLGICRDVDEQAARLRQAGWERAEAAPMDAMYRPGGNEPRQRPWTPCTGEGSRGYHSIAMSLGCRETARRLSGTLETARNLQASTGHLQTQRPGAAGSPSHRNPGDLR

SEQ ID NO: 11817 - protein, 300 aa, Chlorella protothecoides
  MOD_RES (238)..(240): Any amino acid
MRSQGGCCAWVRWRARDDPRVRRRVTPCHTWRPTGRKHLACAVPGMRSHGQPVPPTPSNIRSLSCTCLRTPPHPFTPSRQIMVRMGAIMAAGILDAGGRNATLGLQSRTGPYRRTAVVGLALFLQYWYWHPLAYSLSLALQPTAIIGVDASLRAPADFKVGLVVAVLGLERRGGSMLCGPMPGQRGWDTASCMLHAQMGDGFGEEPRCPPQNILVYDRQRQAANLLHSRAHGGWHSPXXXRLQGGPRACGVGGGEEGWQHAVWANAWSARVGHGKLHAPCADGRWLWGRASLPAPNHTGL

SEQ ID NO: 11818 - protein, 400 aa, Chlorella protothecoides
  MOD_RES (142)..(145): Any amino acid
MEGGTAPATPARTHPCTSPHGAATGDQPMQALAVRLPTPRRHGGQAQQGEGVIPTAPPADRPLPFATVTGRDPELRPRSCSMLDLTMPTTTPSQVPTAVLSTTVRSKARAAAKKEEQGKEMGALVPTTSDPEAMQTEGGEAXXXXEWKVVIPTAPPAKRPLPFATVTERDPDLRPRSCSMLVLTTPTITPSQVPTAVLSTTVRSKARAAAKKEEQGKEVGVLVPTTSEPEAMQTEGGEAAQAGGEAGKGGEAGKAADGGEEAAPAEPPTPAEPSSYVLSNPARVVPAQRRFVAFERDQRWQPVKAVTGGVCLSAQGGRGKAGMHPGGAGGAGERALGCIVVLQDVRPGEGPAEYLFQEAAAGATSAGPAARGAAPPAQAPAVPSAAEEPQPPAPFEYIPS

SEQ ID NO: 11819 - protein, 310 aa, Chlorella protothecoides
MRSVLEQAGVCTWAPLPAGGALRQRACGAHSGATGPRNGLLRGHNILARSFQGTLDDADPHQHHADHQEPVHSFVAVPPQAPVPEHPALQPPLGMAWDAGVWTLAGAFLLAARISRTVHEESVSTPRGLRVGMAVEAAARELAAFQLSTATRSGREMVVAQEAAAADTARVSAAAQRAQQEEREERERQAAYSRAAAQQAAQLREERERSRQEYDARQARLEAEMVEREAAERATIAAQRAEAAAQAARAQRCGAGGRMRSCVQSVVRGGRCTGMIVGQTFAAQAGSGALCFCHPARPKRPKSTIIHQGG

SEQ ID NO: 11820 - protein, 398 aa, Chlorella protothecoides
MALNIRQKQAGESWQEGSDRATPLEPQSHSPGVPPHAEAAALTPMQMRWCACCTSTPRPRAPGGAGRICTKCSSSMQPPRWGARGGGSPEWEDQDVLAPLLRVKDLRRHGVTLHLPLDSNRQPIPDVPAVYFVAPSPHSTARIVADLAASLYDSYHLNFSTQLPRKELEALAEGAAREGSAARVARVHDQYLQYIALEAGLFSLGLPATYVDLNDPSAQDAQIQGAVGLVVERLFCVLASTGTVPIIRCPRVRWCWKVELVRGRRVGGGRWRPLRAGIPAEQGGGGQHSWAPMGACACRWIAAPLRCHACRSSVAPQDSVPPAAPWISPTPCLTPAPIPPHSPTTGRRRGARRLAARCPNKGGPASARQRLCRRGRRGRRRLGRQPTPPPAGDLRPQL

SEQ ID NO: 11821 - protein, 207 aa, Chlorella protothecoides
MTGSRAGPNILITGTPGTGKTTTAELVAGATGLRHLNVGALVKEQELHSGWDEEFDCHVIDEDKEPQLVGGVGDVVRLSLSDTRPPHPTPSQVCDALEDIMTAGANIVDHHGCDFFPERWFDLVVVLQADNTILWERLEKRKYGLNKIQENVQCEIMHVIVEEALESYRQDIVQVLPSNTVPEMESNVDRICAWVAAWKQAAQAGPA

SEQ ID NO: 11822 - protein, 370 aa, Chlorella protothecoides
MGRIVGQTFAAQAGSGALCFCHPARPTRPNPRSSIREAEAAAELEAKERAERAAAELAAAQAAERQAAEERQRLRRSMQTFSYRLDGEVTLQRPPKGTTVMRGPLVQEATLRVATSCGSILGGPGSDLPWTADFAAAVEAGDPTLAVPGLAGCYREAAEGALGALRLQASTGSGGPLGHSGVDPALIEQWVTLGTLRACVAALGVLRPLVEAFVRGGEPAPARFSVKAGIRALPADHPGAASLAVHRAVQALGAQDSEALRASLALLAEEELALAAEDLQSVEDGVFNACFTGQPGRFVGLALAVARVLAMVELVQEGDEDKEAAWKALRGALRCGAQTAASDTLQVLGGRRCSRACCPGLLLRAIMSPQ

SEQ ID NO: 11823 - protein, 202 aa, Chlorella protothecoides
MRDTALGRPPPCPKLVEQVIQHGACLGLGIACLGSENAEAFEDVKNVLYTDSAGTIAGGRGGGHACPPPGHAACPSPTLPPPRLGAVAGEAAGYALGLLCAGSGREERSDEMLAYAHDTQHEKIVRALAVGVAFVHVEQPAAEEHARAGQTPAPAHGRWMDGDPGERLHPFLHGAFRDLGVCHPCRRQGLCRGLVRVPLQIS

SEQ ID NO: 11824 - protein, 331 aa, Chlorella protothecoides
MARLRLPIDRFPLTTQTPELTERKRSIDKHTNLATHLLGAIKERGLDRYYALEEELTAGKEHVEAVLKHLQVEGCGGGGCCGGSALCRDIVFGELFLVDRGPRGMEDAAGCMQAMGSQGTVTDRLRLALVWLLTCPTAPLEAECERVETALAAAGADVRAWAYARRMRRMNLTGKSQVGGFVIMRGRVGQRSCAAPPSWVFETVGGGVLAYDALQPPPVTPGNRRCASSAALADGRGVFGGAAQAQLTTLLGSSFGQGLSSLTKGVKNLLAGEQQAAVTVAVEALMEGRPNPDVDGYAYFDPKRRYSSTLHAKTMGQTKTLHSLHQYCFLC

SEQ ID NO: 11825 - protein, 73 aa, Chlorella protothecoides
MRNTKTDYVSCPSCGRTLFDLQEVTDQIRQKTGHLPGGFEWLRSGVEQASFADLLCEEEKRVCCYPPAWSRAN

SEQ ID NO: 11826 - protein, 237 aa, Chlorella protothecoides
MSHPFLPPHPASPEEDWVDEAAVKATRIAEQQKQVPYAERIWALTNVAGTLAMGGPGETEQARRLAEQAVSLKQEWIGAPRHPCAYEGAVVWPGLLPEFLLLVDILSRNLEWERDAAGLAGVILRIVIEVADAYAEAQDPLSGVILLEGAQQRLAEIAGLRNPALKAASRASERLQVQLTPAQLEALVGLRKRVAPRALQRVAGALAEKLGVQGPIVQRSKIEEWARRGVALLGPLT

SEQ ID NO: 11827 - protein, 67 aa, Chlorella protothecoides
MGCIVNGPGEMADADFGYVGGAPGKIDLYVGKEVVRRAIPMESACDQLVELIKVRRFDVMPHWGPTL

SEQ ID NO: 11828 - protein, 85 aa, Chlorella protothecoides
MSTAMLSSSVRGSPPNTTYEFEYEVDSTRGKKRLLAAVTVAGSKLHILNASVGCGKGETATCAPLEADLQRLRRAIASFDVDRGA

SEQ ID NO: 11829 - protein, 328 aa, Chlorella protothecoides
MPFKVGGGIEAGGASCWACARVARGTRVPCCRSGTEAQLCRCPRGFCSTLWMPPPTHATLHVPPPQDIATSDSIFLREVPAEDDAQARRALRRLQEVRGEGWGGGKNQGMGGAMSECLGGESRSLPAWSPPRDHRCASSPHALGTLTPFLPTPSNAFPSSHRPPSVHVLAEAEALAASPLPDSVAVISLAAALAARAEGRSPLPAGAVRLALAVDGTEPDADVEAAGGLDATLVLLRVAPGVSRVHASRRVFEALTRARCHLPVVHALEFAPGTGREELVLSAGALVGALMVDGRGDGVMLSAPGQDLAYLRTTSFGLLQVREGWFRE

SEQ ID NO: 11830 - protein, 560 aa, Chlorella protothecoides
MAQAIPAINTAEGVLALLAEDDDALKVYALQQINASIHQFWHQASGSIATIEALFEDEEFSHRELAALVASKARRLVDCPCDRPDPHPTYPLPQIFYYLGDLQEAQAYALGAGALFDVDSPSAFERTILDSCLDAYVAARAGLAGDEPGDAPASLDPRLAATVQRVLDRCLADGQHEQAVGIALEARRLDVLAAAVLAAADPPTLLAHALDAAARTVVERGFRRCALATLVGLYKRAAPDDAPGLARGLAALEDAEGVAALAHALLRQGGKQALLAYHIGFDLVDAQLHEFTRDVHARVLALARASAPAAGAPAEAREGEGDAAEEAGLETPLLGEDDKTDAGGATPAPELAPELDAFLRILSGSRGAGAPVPGTGVPCGPPDPEEHQGGGGGQEQGCCRVVWAGRSQRRRGGREWVTAQSPGARRAVRLDAGSQSALLPGLDPAPAGPGCRPPECCGPGLHAFPPFPVPSHPSPPPPRPPPLPRSVCHSATRGSVADGRSRSLLSPYLPAAPGSSTGSPYSEGGALYALGLIHVNSGAGAAQLLTDSLRATQHEVGLGV

SEQ ID NO: 11831 - protein, 258 aa, Chlorella protothecoides
MPPDLNHSARYDTPLVADIHFQPTVAMMVADAFEKIRINPGNFADGRKSFEEINYDDPAQFARERESFRETFMPLVEKCKALGRAMRIGTNHGSLSARILSYYGDTPRGMVESAFEFADMCRDADYHNFLFSMKASNPLVMVQAYRLLSEEMYAKGWDYPLHLGVTEAGEGEDGRMKSAIGIGALLMDGLGDTIRVSLTEDPEFEIVPCGALAALGTRAQTERWGVEPFEEHRDTHLFNRRRALMAGLATCFGGRGVG

SEQ ID NO: 11832 - protein, 174 aa, Chlorella protothecoides
MARGCAGTNSPSRGGGGARRLGHRHLADEVPGRAEYDGLIPLNDEATWDALGNRLRVGSCVEARVHRVRDARLFRYPVQLAPRVRDARLFRYPVQLAPVDPALQALLPRPESHMGPMDLRDGGTQMVGRMQAELWMQGTPKASGTGDSGTYRQHAPLPLPQGPGNPGTRQWQAV

SEQ ID NO: 11833 - protein, 512 aa, Chlorella protothecoides
  MOD_RES (492)..(495): Any amino acid
MPWLPRRPGWTSARLYSAHQTLWPAGFTPTHTLPPTNSLLPPPNPPPPQGAEAFSCEVCKAKTPATKHLRLQRLPQILVLHIKRFKYRGFFTDKLTASVSYPLAGLSLDTYLSPEALVAGEGGALYDLYAVSNHYGNLSGGHYTAMCRVQSPQAPEGEWYCFNDDLVNRVSEDQGLPFWEGRVVEETPRDEQREGMRGGGKVGAWTCPVGALLLLIRTLPLHTTTAGHVTVRLHPLLRTPTQGGSRMRSFFRVQAWESPPHEETFPRNKPPHSPPLSRPRRQRRPPWQSPPCACSHLPALAHASHCCTPLESAPALLLDLVGTPACPAASHFCKAQRHLAGRVGPCGAPAKGAGPRGRDHQHARPLAPRRSLGHRGGERRLSRIHADLLLPLRPGRARRGRTGRGAAVGEGLRQRHGGGGHAVRAGLPGVRRHGRGLASGEVALAKRGLQRLRKQRAQLGAQPLRFLVMVGGGRKAWQAHSNRSCQCPGVRXXXXQLGAQPLRFSSDGGGGA

SEQ ID NO: 11834 - protein, 492 aa, Chlorella protothecoides
MDRVPFRGRKPAVVDLTTGMRVAARVSEAHLSCPEAERDEYLYCLLSCHPGRTIVFVNAVSAVRRLAAILKLLALPVQALHAGMQQRQRLKALDRFRADAAGVLVATDVAARGLDVRDVRCVVHYQLPASLDTYVHRSGRTGRASAEGLSLAMVTPKEQARFLALYRGLGREVPPEFPIVSVEEGAGNDSGREGGGGWEKDAEGWGGKRTRWAAEHWAWGFGHGGRATASSSLLLNAGGHQPPRMSAHPTSAPPLCVGTQRLPLTQRPSSTTPPPIQDLSLLPAVRKRVRLAVRLDAHERKHSKSCAEAAWRSQHAEELGIELSDEELSEDEAAATGRRGGRRGQALEAGDRGVDGVIAAQRLRAELGALLAEPLQPAFSQRYFTAGQASAVAAHAGQPSAHSVTTSSVALAQSLADSRAAACAAAAGPPRAKRKKKVGVDPRQAALAAAVAKAAAGRKRSRMLVVPASGAGAFGRSTTGPDALQALRASRQ

SEQ ID NO: 11835 - protein, 442 aa, Chlorella protothecoides
MSKNKGLWGSKGWKRVNVADALLDTDEDGFVELEQLDGAYMGKIFQAPSGPDVLIPPEAPALGTSKKRKASLATTTTALPVEDMRAQLRRLRQEQRALSAQLKQATRAVGGAGSEAGAEAGSPEGPSGNDDATALAAAKPVALPSSSDKKKKAKKTKKKATSAEAVAPSSQTTTPTPPVDTRAWEGLGLHEEILGVLSTCGFSAPTAVQVACLPSALRDRRDIIGAAQTGSGKTLAFGLPIMQALLNERHMQTPAAAEEGPSEGPSEEGHGDEAPAPAATGGKRRGALRALILAPTRELALQVCSHLEVVGRALGVRVAPIVGGISSQKQERLLAHAPEVVVATPGRLWDQMQSGAAHLTDFSRLAFLVVDEADRMVQQGHYSELGEILGRVDGGSGEDGGPAPGAPRSMQTMIFSATLTLPANLRHRLKKVRRAEEALEGG

SEQ ID NO: 11836 - protein, 315 aa, Chlorella protothecoides
MTLQPRRASLIWKTVEAEVVFCNKNLKECNLNFARGPSARAYDEAMDDSHRLCSYHLHAGNCTSLVRDMFTAALFWGSDEINEDGAARQTDSIPSCRPSGCSGHDARQRDQPGSCQGLDFPNRDGHRQLQQASCPAPNLPSFIYNGYVESYFVPPDPSYWKSFPSYINVALLFFFTPDSQYTAGQTDLANTGLLFEGTSAAQLTAGIQALQSKGTKVMLSIGGASNADRPVEWESWNVKAATDFVQDFGLDGIDIDFEPREPGERGSYITCHALHFHSGLEDPFSAANPSVSPPLATKLVAIIAHDALQAGRRSH

SEQ ID NO: 11837 - protein, 266 aa, Chlorella protothecoides
  MOD_RES (17)..(20): Any amino acid
MACNTDEKFENIISGYXXXXGLTSSLLPSLPHVGCKVSQDTGNMACNTDKKFENIISGYRAGLDTLGSGKLLSAALWSSGAWGQAPWTGLGIGSPQTGLSINMLKATGCALDFIHVMSYDAGPNFPYRDAYQAYRSFYPGEGPGKGCPCMLTFPPASHSTADFVFRADSRGHFSPRVPSRYHSPHTRRILLGMEVAPEAFGGNVLTIDTVYDLGNTVKELGGAGLFLFSFTKRSEGGATATEISQAVCNQFRLGDCTGTIPPSKVQ

SEQ ID NO: 11838 - protein, 457 aa, Chlorella protothecoides
MFSEAYFVFSVGNLKPIFKVLYPDCWVTFQTCSSNLSDSINYSQVSGIIAGQLFIGFFADRIGRKYGSILTASIMLLFGILITASSGSNSGNLFIMFTVVQALFGVGVGGEYPVASTSANERAEQTKHLQNRRGETVVCVFSMQGWGNWFNTMIILAIMAGFNQRGAPYDDYALEVTWRLSYALGLLPLLFIFYWRVFQLRESAVWRQKRESLRSMGKGTRFGARKMRLLLFYYWHRIAGTSLSWFVWDFAFYGNKLFQSTFIKVINPKAGLLEVLEWTLLNSSVALVMGFAWVGVLFLICAGAYHKLLEPSNIQVFQFLYYFSSFWGQFGPNATTWLLPAETIPTEARSMCHGFAAAVGKAGALVAGVVFGLVDDRVKFWISGVCGAVGVVLTLLVIPDLTGLDLKEGDKRWLAIVDGNHDEYTGPAINPRHLSAMEKFIYRFQKNYVAGSEEESK

SEQ ID NO: 11839 - protein, 162 aa, Chlorella protothecoides
MVAVQGTVVAATPIHPVATSLEFRCRKCNSRTRLLQLETGVRQRPEHCASRACRARSMDPVASSAQAVLWRSVWVKPEVGGKHVPAAWGLEGHGEGMRGSDTAEPGLPGQAIQVHLVGELAEVGCLGRRIHVSGIVRPGHGGAAGGRVVWVGRWASKGWGLD

SEQ ID NO: 11840 - protein, 166 aa, Chlorella protothecoides
MPCGGSGLLPSPPSSRRLHPNYSLNKLLNGNLRLFGGSDRRLLRTLASSSDRRYLLQHWPRPGTKDAAKRDLVAAAAGAQGDAPGSLEPLRQAVLTAPVAERRPHRLVAHGDVRVDDYYWLRDDDRSDPRVLAHLQARRAPRGTGVRARSVGRSRGSQPCTSMLPQ

SEQ ID NO: 11841 - protein, 148 aa, Chlorella protothecoides
MLADTEALQEALTAEMRGRIQEADEGVPTRPVRAGGLFVRNGWPDRGEAACPFLCCGRRPEASRTLEGQQYSVHCRRRLGPGAGARPSETDALDPSQPEEVLLDENAEARAHAFYMVGGFEVSPNHECVAGLNFGRWWVLGACVRVVA

SEQ ID NO: 11842 - protein, 156 aa, Chlorella protothecoides
MTCAVDEQFQNIVLQYRSSLAATGCKLLSAALWSSGAWGQAPYENLGVGSPQTGLSINMLKAVGSNLDFINVLSYNGGIVLLGMQVAPEYDGTALQISGVNALSSTVRGLGGAGLFLFSFSKGAVGGASATDTSQAVCRNFQLGDCTASIPRSTVQ

SEQ ID NO: 11843 - protein, 542 aa, Chlorella protothecoides
  MOD_RES (185)..(236): Any amino acid
  MOD_RES (302)..(305): Any amino acid
  MOD_RES (386)..(389): Any amino acid
ALAATADPASGVEADVDVRSAAVAALADLAGACVAAQSAPALTLCALGLGAALAALGDYTVDNRGDVGSWAREAALRALPGMLRCRAGLGGPDCKDGGDAIRGDGEDGAVFERRDCHGDAASGPRAMERFAFECVAAACKQGVERIGRVRRAARDALRELADGELLPHSAAPAICAAVAHAVDAXXXXXXXXXXXXXXXXXXXXXXXXXXXXXXXXXXXXXXXXXXXXXXXXXXXXQGWCTAWAGATRRWQPRRPTRWRARAVRQGRQVGGRWAAPSSACGTRRRGGRKAGEARSQERRAVXXXXEAGGAQGRISPESGAPCGAPEASVSGSANKARRAHVQRLAGVPLLASAEVLLARTPLAGDDAFQLGLLERLRVEVARRGAXXXXWRATPPSSSACWSDCVLKLPGGVPTCPGSRRPPRCWARWARGKPARSRRAACCGPCWARASRQCAAARPSTCTWPCFPAPTRQRMEWRPRSRRWSCWGRGTGPARLGRLPTWQSRWLPCSNYKTPESVWQRTCSRVAVAGTLINCDPACCKCS

SEQ ID NO: 11844 - protein, 798 aa, Chlorella protothecoides
MMLRGVRIPGQSRTSQSWVVTSSDGHRVARRQRPAQGPRCEAVKRSRKRPTASPAPASDEIAKLIRSPETATENLKKTTLEPIRQHRSVLPCRSGGQIAKPIRSPEPATENPKKTTLEPIRQHRSVLPCRSGGQAVRLPATCPPTSPHLGVPQATVSVTEDEETIAVTIQLSGGPLSGLARPPTLLWGVYRGSSRRWQHPAGCSPPRSTLDERSGAMRSPFDMHGSITLRFPARLAPLTLAWVGAAAGRPVLPLVARHFAVPLGTLPGTPVPLGPSLAGRPGAERGANFALASRSAHGACLLLFRRGGDGAWAKALELELDPAVNRTGDVWHVTLPTLSRREGLAYAWRIDGEVAWDGGNRTQPGVWGIEGWEVCRNAGKGTWASRGVGLVPCHFDMPFLGISIAELRWMETMYLQTKVTQPSRRRATVHPQTPKPLHPTPPRCDRPSAAGSDGVVVGADAGGGAGPGPPQGSQHLVAGGGGPRIPAFRAGRAGRRRGRRQARRQEPGRASHSPALHGGRGCAGRRRWDAAGHAGLDPGDPGPRPIGSRSPCPPPSRPAPTPSSTTRDPPGQGQGGGVVLGAGPHAGILARGGLQRGAAAGGRPACRRPGGAHAGPRLEDGKGNAARALCRRPMGVNFRHLTRRTRAQVDFTFTAEGGDDSPCPLSFRGLDHAVYYRRAGVLNAGHAVVRQYMIDVLRHWALDYGMDGFNFMGAENLVQGWLSCPGAGIWEDGSTAGLALCPHDDPPTPNVSLDLRDLVPGHLLTPSPSPPQIAMASYWMRRPWPPPSPTTLSSLGCR

SEQ ID NO: 11845 - protein, 288 aa, Chlorella protothecoides
MYTHSQCADLGAYKAALPWWKIVLAGAMAGMYVSLGGMLLLTVGPNCVAMAGDNPGLARYITGAIGFPYALLTILTCGAELFTGNTAVVTAAVYEGKADLRSLAKSWICSYAGNILGAAAGVGLAVASGLLPQLTRGATALAIYKTGAPVGVTLARAIGANWLVCIAVWQCTAAQTYGGKFIACLGPISAFVTIGLEHCIANMFFVPLGILAGAGCTPASPISSASFPVLSHLAASGADVNMRDFVLRNLIPVTLGNIFAGVVCVATLYSLLYGALGDRIMGKKPATA

SEQ ID NO: 11846 - protein, 397 aa, Chlorella protothecoides
  MOD_RES (73)..(76): Any amino acid
  MOD_RES (112)..(115): Any amino acid
  MOD_RES (145)..(148): Any amino acid
  MOD_RES (302)..(304): Any amino acid
MPERGATVRSRPQPSTLQRRPVVTLTFPSSETPRPHQVTTATSLPSSATPPFPSSSSPAATGARECGARTWAXXXXPASTCGHPYFPLLRNTPSRSGHHDHITALQRHPAFXXXXSPGGGWVGRREWGQGTVDNLGRDCGRLPAXXXXGAWSPTRAGMALTLDGGGRLAAWDWVHRQDAPALEVGGWEERNGVRERWTALAGTWPPTAPSSPGAGEQARPHCASLPTRHGAPQPCGGGGRRRLHPPAPALRGTGHAGQRREGSHGRGGWVRSNLQTGMQLWMVARQATVLKNAPDSGRGRLXXXWMVARQATVLENAPDSGRGGWLTRTPTITPPTTQPRQVLDRGNNREKHLEKAARDAKLRGRRAVGEDVGDQSLPAATGRNDSLAASEFREVSF

SEQ ID NO: 11847 - protein, 35 aa, Chlorella protothecoides
MVGTGQGTILAGNRRAKSQDDKITASFAGGRGARG

SEQ ID NO: 11848 - protein, 246 aa, Chlorella protothecoides
DLADRLTLGAPLGAGSFGRVYRGALQGRPVAVKVLPVSDEASRALGLAEAAVGRRLDHPALVRTLECSVAEGAGEADPSLWIVQEFCDGGTLYDAIDRWTEGLWGVKGMVQREGGEGCGPAGGSGAGPGCGLCQGACAWTAGFASCTGLVHTGPGDRGDQRNRGWLRQGYDGFAPADVRAVLRTLCEVASALAHLHALGVVHGDLTGSNVLLCSAARAPDDGRGWHAKVSDFGLARELPAGGVLSN

SEQ ID NO: 11849 - protein, 392 aa, Chlorella protothecoides
  MOD_RES (52)..(55): Any amino acid
  MOD_RES (229)..(232): Any amino acid
  MOD_RES (260)..(263): Any amino acid
  MOD_RES (346)..(349): Any amino acid
  MOD_RES (368)..(371): Any amino acid
MGETPLIRAAHNGHLATVQYLIDKGAEVNSIDMVRDWFACIHFMDECPTLRXXXXGTGLRAFHFMDECPTLRAASAQKHPFSSTSAIAPSSPPQGDNTALHWASMRGHVEIVKYLLAQGADRTLRNKQEKIPIDLCQPCWSNSYRFARQLLSAPGIGRDQFDETVPACAGTQWDQALRLCTDFVLEGRAPSKGQVPGLRGRWGLAVQHDSGTTSAPSSTMGVHARARGXXXXVQAGTQWDQALRQCTDFVLEGRAPSKGXXXXCTPLPPVLTSLRRWPRLAGSRLRCRTPLRPPLGRRPSWRRPRRRAGRRAGSSGPAGRTAARPRPGRCWAWSAACRRRRCCWRXXXXVHGPAPSPNIPQAVAEACXXXXARKHSAWRGGWGGAGVVSAVV

SEQ ID NO: 11850 - protein, 457 aa, Chlorella protothecoides
  MOD_RES (76)..(91): Any amino acid
  MOD_RES (193)..(196): Any amino acid
  MOD_RES (334)..(337): Any amino acid
  MOD_RES (360)..(362): Any amino acid
MTPGSTGRTVCSTGSPCIATFTTSTTSEARDGWCWGVGGGSAAPSGSLPHAGINRKSFPPAAHYLARCHQAMHNSXXXXXXXXXXXXXXXXTPTQVHCTHPFCGLLLPCGRSPHCLCQRDHRLLPLPHPRVTPPHLPPFHHPHPHRCVGFAAVGQCLGEGEWPPSLEGCLVSKRGAPQPWPIDRRCACLLYTXXXXGFAAVGQGLGEGEWPRHWKGDWCLRGGVPSPDRHIGAVPASCGHAGYEMAPLIPSVEQALSWLVQGPRPCGALNTVVRHRAPGVPGLCPETGGPGPGGELRVCVAVHERRSVELGGMPGARLPVLLPWPLIPWLGKAXXXXPFSSLFSILPIVIRLLETARGTXXXPRADVAGAGLMLRHSSTLERWNKGIPTFPPRPPPFPHCPPALCWQSDASHTTPPPPTSFLLSVLCTRLADLITLGGRGGRGKRRTGQRWFHSGIL

SEQ ID NO: 11851 - protein, 150 aa, Chlorella protothecoides
MEVCTTLGMLTPDQAAALREAGLTAYNHNLDTSREYYGKVTTSRSYQDRLDTIDTVRQAGISVCAGGIIGLGEAHLDRVGLLHQLATLPAHPESVPINALVAVAGTPFAGHAPPSGLDMVRCVATARVLMPRTVVRLSAGRLTLSFADQV

SEQ ID NO: 11852 - protein, 195 aa, Chlorella protothecoides
MQVQRHARAAVRALCSQWQTGTPAQLGLRGVAGSSAGRNAEPAPQPESGPSALPDWRSRLGVVRTDWRYRGGRWVPTPHSPGRIGLLPAAAGPEAALGLTHHGRSREEVGEVYNTPLLDLVHTAAVVHRANNDPAMVQRCTLLSIKTGGCPETCNYCSQSSSWSKETGTKAEKLMDLDAVYEPSPHTPLPPPPPF

SEQ ID NO: 11853 - protein, 174 aa, Chlorella protothecoides
MLTGTALGVLTWGGGASCLFGGFLAVVAASKSRAAQDLGSVREVESLSDLKELASLVPLLVAVSGRVWCARPLTCELSAGEAAIVEVQEEKRTERRFGAVWVGETTPLRASVRETEWCLAEGEGGAGAQVPVLGGAGARGDALQPTGDVFLPAQEGALGALVGELAGHRALGTR

SEQ ID NO: 11854 - protein, 328 aa, Chlorella protothecoides
MPRDGILSLHSGCNVGKAGDVTLFFGLSGTGKTTLSADPARELIGDDEHCWGEDGVFNIEGGCYAKAIGLKKENEPDIYNAIRFGTVLENVIFDEETREVDFDSAKITENTRASYPIEYIANARIPCVGGHPSNIIMLCCDAFGVLPPVSRLTKEQAMYYFISGYTAKVAGTEQGVTEPEATFSACFGSAFLVWHPTKYASMLAEKMERHDTKVWLINTGWTAGSYGVGYRFKLRHTRAIVDAIHSGELGRAEYEPIPVFGLQVPKAVSGVPSELLMPSRSWADQDGYDATLRNLGELFRANFEKYADGGGFVTPEVAAEIVKSGPKA

SEQ ID NO: 11855 - protein, 366 aa, Chlorella protothecoides
MLGRLQTLKCPPLHSIPSCILFHPPPRNPQHHRPSPSSPKPLTPPPPLSCSPSQRSHLNATHPPTPPFHPNHLAETVHAAHLESLSETLRSNARQTGPRVVKGEPKHAYIPGSPRSLAASGSAFAQHVSDTGLKPVVVYHNLTPAELYEKALAHEPSTHIVASGALATLSGAKTGRSPKDKRVVRESETSAHVWWGEGSPNYEMDEHTFVLNRERAVDYLNMLDRLYVFDGFAGWDPAARRKIRVVCGRPYHALFMHNMLIRPTEEELANFGKPDFTIYNAGGFPANRHTSYMTSSTSVDINFKAREMVILGTNYAGCMKKGELGPGGKDIQLIGSWSDAGRGHLLDIRTGHLPLNNLGPSVTPGL

SEQ ID NO: 11856 - protein, 369 aa, Chlorella protothecoides
MGHSRSRSRSPRRTHRSRSRSADRYRHRSSREKDCDEEADRRKYAGSTPAQHQHQSTGGTAASSDAEKKAARLAKLQAWKLQQAGGVSSAQHPAPPVTMVVHQAHPISPPTALPLPAQGGGQGDEDAVDPLDAFMAAEVRVAIHRFSFHKSGGYLPTDPLVISSVGLQHDQRKLYLQVLPEVAAREAEEKKRAEDERAKLKELLAKGKLPKALEELIQDDQEETPDEIIEASGRLWSGLQCEGVLHAMCFIPSNKVKLVVGPAGEKIKFIQRKSKCRIQHAKEEQELEVGFGLGPLYNLPIKTNDPNAPPKMTKLLLFGDSTAVEAARVLIMEAIDNREQKVKQRQKEYDKKKDVSCVLEFPSVRRDPC

SEQ ID NO: 11857 - protein, 92 aa, Chlorella protothecoides
MLSARYLLQQAKRLQRQLYHMRHALDYETLGLPLGASKADCKAAYRKLALQWHPDKNMDRREEAEKMFQNISKAYESLMSTDEDATIQQLAH

SEQ ID NO: 11858 - protein, 399 aa, Chlorella protothecoides
MGGTCGQKEEEPAEPVAKPLSKSQKRKARRVQEEKERRSARDNVLQSLSQTALDPETLQALRPLAARGQKETRKEVSARRQALRAAGHHVEDDDVPTPRHNPNSESEDGSSDDSSSEEEATPRPSSAPARTQFAPRRWDEPQSPQEEAQPALKKARTGGEESGSDTAPHPLLAQALAQARQQLGLGDGLGGADEEEGPARLAPSVPRENLPHPRSVSVERRPEIQAAREGLPILGMEQEIMELLAEHDVVVLSGETGCGKTTQVGEDGGRIMMGVVVRRGGHHLPRCPAAGNVFQCNVWVPKQCICPVAFILYCIKAHYRMPLTHPPWQQVPQFLLEAGFGCSRFPERAGTVGITQPRRIGAISTAERVADELGSRLGDVVGYQVSGGRWGLLLVQGAS

SEQ ID NO: 11859 - protein, 251 aa, Chlorella protothecoides
MHSQQQQGPGGVPVWPLKLVIMSATLRVEDFVGNQRLFPRPPPLITVPARQYPVTVHFSRRTEMNDYVGAAHRKAEVKQLCKQLETTFKAQRRNQPALPASAPPEEAGDIVSGGDAAEEGFGADAIDFLDAELESTFKGRRRNQPASPASAPPEEAGDVVSGGDAAEEGFGADAIDFLDAEAEDLDDFDDGEASAKTSFPSPLPLIDEEEEEEVDVMGGAGFTPEQIALAEAEFEKRLVSEDGGGLRSLPS

SEQ ID NO: 11860 - protein, 245 aa, Chlorella protothecoides
MGDVPSLALIWEQTAPNPTSRAEIESCNPRTPFGTVQLDRLPDVEQILLLADEFKIDELEALNLIQRGYEQVGEVSAAAGAGQLVEARSSAIQTLFAVLEALSTGTPPPSWVPAADIDYVRERLDRGQPCQDLAALLLQRLASPAIPAPADGSRLVSLVNSAGQAAERSLAAAQEDLLLCQCLSLTLTLLSSQAEPPAKHLPQLLQLLRGDGGGMGAGKDNAQGWEVAGLAGRTWCGPSVAQSPD

SEQ ID NO: 11861 - protein, 162 aa, Chlorella protothecoides
MHLPHLPPSPLSTQPLQVWGHSVSEDLIHWRQLPPALVPTPGGLDADGCFSGCCVLDPASGLPALLYTGVRLRSNAASGPPPPPEHDLGLVWIESQIVAVPADPADDLLVEWVKHERPFLDLPPNHVQLTGWRDPFIYTANTAGVLGGWVGVFTEGRVGGAF

SEQ ID NO: 11862 - protein, 755 aa, Chlorella protothecoides
MRPPTTAPPRGPDGTRRPPTSCQAPPAASAALRAEMRANHAEGHVCWDDRDLMHGKPTGAVRASLGYASRASDVDRIGVWLAAPLGAGAAQGCAVLTNSRASSRPRHPCMAHATLQDASPDAGAIHGTATPPTPLPLHAVHFLEEFFVEKAEAPESPRPASTAPRSSALVVTALTLYPVKSCRGIPATEWPLAPPHPSAQTLTSPPRRTPPGPSGLLHDRAWVVLDGAGKPLSPKRCPGLLSIQPRLDWRRGALVLEWVGGVAQMPGLARLSPEMPLGPGAAGAGSCPEAAGPQARSETLAAWLSATLRQPARLEASVARRRPASKPQSRVPEEGPRAAAGAKAAGAETEGATLGGSGGARSIITLGPHSLHSSATPNTSPADGRQGMAALPTRFATSGDLLLVTRASLELLSEHAVHAVDLIRPTARAGRGGVPACPTPMGESFAARFRPNIVVDGPAGGVPFAEDSWTEIRAGELGLRVAGACPRCDRICVDPGDGRWGPGLCMASPWLICCHRPGIALHGCPMFSVFCETHHAGGWGRNPCSALQSCVAAGARSALASFWMCSSPCCQSMPPPTPLLCRCCVSAWRWSAWCKHTLNDVHFPCSEILGGARCQLCTYISRARAIGTESVLWECATSWPTDDLEKGWAQMLLYRAAQRVQPLGWAWKMPGPGYLGITSEYKRVTTQGRWQDPVRKRVGQAVYGGAKLQTGFKKQDRWLPTSRLWQGQPEAEQAHVQRGVERAGGPVHRNNGSAL

SEQ ID NO: 11863 - protein, 193 aa, Chlorella protothecoides
MTEALRVRLLQRVTAYGSGSALRTLALACRPWREARGEVLAGDEAGLTFLGLAGMQDPPRPAVARAVAACAAAGIRVVMVTGDNKATAGSVAAQIGLLGPGEAEGGPSTGTSLAGLEFDELSGEERERAAASLVVFARVEPNHKTALVDLLRAQASESDGVFGAGGGVEDHTMQWGEEAGGRNKGGPQQMPGR

SEQ ID NO: 11864 - protein, 110 aa, Chlorella protothecoides
MPLQSILTGESGSVPKSVEPVAAGKAVYQDKTNILFSVRGCRDGLGFGLGLVDGWVGTVVTAGRCQGIVTGTGAATAIGKIRDAMAGLEDAETPLRKKLDELGSLLSKVC

SEQ ID NO: 11865 - protein, 151 aa, Chlorella protothecoides
MASEAGAQLYASDLHFVKHVKFPPIPLGTATVGVLTETNADRAIEELKAYEADVATVLREGRWTVTPAVEIVPGDIVEVAVGGKVPADVRVAAILSSGLRIDQVRVPFTSAWAQLHAVLGDLGVGLSHRNERPDTLCCGTRRPTVWRRPPL

SEQ ID NO: 11866 - protein, 263 aa, Chlorella protothecoides
  MOD_RES (167)..(170): Any amino acid
  MOD_RES (242)..(245): Any amino acid
MRGINDAMWKFTDDFVVAYLDDILVYSRDMETHLIHLRAVLDTLQDNRLYANPRKCVFAQPSVSFLGHVISADGIRMEEDKLQAVREWPAPSNVRELRGFLGLTNYYRRFVKRYAHLAHPLTELLKDNAPWNWGKLEQEAFAGLRDCLLSAPIVACPDFSRDFTIMXXXXLRDCLLSVPIVACSDFSRDFTIMCDASDYAIGAMLCQHDDAGNLRVIAYESWKLRPAECNYPAHEKELLGMXXXXPPTTPSAPCSANMTTRAT

SEQ ID NO: 11867 - protein, 645 aa, Chlorella protothecoides
  MOD_RES (153)..(156): Any amino acid
  MOD_RES (242)..(245): Any amino acid
MIYALAKWKHYVLGGKVNVKTDNRALQFLQSHQQLSSRQARWLDFIAELDLHIDHIPGTSNGVADALSRHPLRVAGTRLVLTSEPMRDRLRRAAAEDAAVAELNATLDGGPVDGYSKRDGLVYKHHPKGDRLLIPADSTLRRQLLQEVHHSVXXXXTTPRVTGSSSRQISHSNNSCCRRCTTAWATVDSDAPWRPCNAPTSGTAWTQTSSSSSAPATRVSGTSRARAQARTAAAPAYARLPXXXXRTYIWHGMDKDIKLSVRTCDACQRNKPRQGIRPGLLQPLPTPVYPWQHMTLDLVTGLPIMPRGHNAVVVFVDRYSKLVHYVPTTKTVTASQLAEVFIDRVYKHHGLPSVIISDRDPRFNGKFWRQLFGALKTELRMSTANHPETDGQTERANRTLEEILRGLVDPCETDWDIHLPAAEFAANSAISAATGASPFQTLYGFTPPAPAQLVSHYPAVLGATTAPARAAEFQATQTRMRETMAKYNQRMAAQANRSRQDHEFKVGDRVLLSSAHLRIATPNSRKLAAPFVGPFTILDMRNKGAARLDLPADMRVNPVVNVSHLKAYNYNSHGRPPPLYIDGDEETYEVESILARKPAGQEHQYLFKWRGYPEDEATWEPLRNLAHLPMLHEFLAQQHEDVPAS

SEQ ID NO: 11868 - protein, 781 aa, Chlorella protothecoides
MTQSKAKAGCDIDCPFTPGVTSPFDWLARIDRKMRLKGVVDEETRLNIYVANLDGPVLSFATALVDGVNGALPAVTTPAEFKEKFMAHHSRIQGRRPGRIELYQLQQAGTVAEYAQEHRETASWIGDLTPEDFQASFFLGLKPDIKLKDSVRFAANYEEMLERAQWQEQKAALRAAEKSVAARTLPSRGSGGADATRAGHTMSAASSFRPRNSRPSQSTGQRSATAPVTCYTCGAPGHITPNCPQRAASSTSSAVRGARGGGARESKDHTASVRFGVALTGAAPLQHQALTTVARIGRAELTCLIDSGAERCIMDDKEAARLGLKLSPVRRHLLLACGDQRVRGDREARDVAVDIRGHTFTLDFLITPLTGTDAYLGMPWLCNANPVIQWGACQWGYAQQDVPPRVGTEPRVADLEVHAAAPGGYAIGTVGHQTGYSAAGCPGLQGRQPLPGVRACHHGGPGITVDQTEETSGAEVPRVARFVEEYADLFPAELPTELPPKRGIEHTIELKEGTLPIARAPYRTAPPAAHAVRAQVEEMTRQGLIRPSTSPWASPVLLVGKKDGSQRMCVDYRALNKTTIKNRYLLPRADDLMDRVGGARVISKLDLRSGYHQVRDIPKTAFTTRHGLFEFAVLPFGLCSAPATFMRGINDAMRDYTDKYVVAYLDDILVYSPDMETHLTHLRAVLDALQDNRLYANPKKCVFAQPSVSFLGHVISADGIRMEDDKLRAVRDWPAPCNVRELRGFLGLTNYYRRFIRHYARLAHLLTELLKTDDKLRAVWD

SEQ ID NO: 11869 - protein, 66 aa, Chlorella protothecoides
MAKLLPDTSFLAKWKDKIEAVFITHGHEDHIGALPWVIPALDPNTPIFAPGFPMRLVERRLKVGLT

SEQ ID NO: 11870 - protein, 119 aa, Chlorella protothecoides
MQTVHPLRAPAPFVCDAGYIGKTRRPNLCARAEQTGGGPRQRRSGPSTRVRLRGNGTDHLGSSLTLPGTGASFPGPPGTEGPPLRVLPIGGLGEIGMNCMLIGVGDRYVLLDAGLMFPE

SEQ ID NO: 11871 - protein, 395 aa, Chlorella protothecoides
MRFDRLLNESDVRGGRSCLPPLAASGLSGILLQPIGSSKLTASHSHPHPRASGYPSVPGIWTQEQVEGWKPVTAAVHQLGSTFFCQLWHVGRASAPCYQPDGGLPLAPSVLPIPPEWEYFDTKLGKPQKYPLPRELAAEELPGIVEQYRVAARNAIAAGFDGVEIHAANGEPGCGEPGLASSVSLNPPPHPNPPTPGYLIHEFLSESSNHRTDAYGGPIENRARLALEIVRAVVEEVGAERTGIRFSPFNEFLGMHDAHPFALYTYLLEELAAWDLAYVHMVTPIVKGNVDHPEGEGSLEPFRAVWKGTFLVAGGFKRDSAVAAVREHHADLVTVGRHFLANPDLPRRWALNAPLNKYDRSTFYTPGVKGYLDYPFLEDTEEGKEFLASLKPEAN

SEQ ID NO: 11872 - protein, 229 aa, Chlorella protothecoides
MANAQASARQGRVTFHVLLQQGTESGEAGVAGLPHSRSIGSERGSEPAPEQYVYAGRGHKADYLFKSLPKPDPPLKVQDSSGGASGLKWRQSAAQSPDRLKGVRVYCAATRVVPRIMAHTIPTPTYDAYSLVSVGKAHHFCSLAMNRKGGTSVCKGAATCAWQNRTQWARVSQGMLDMGSCRWQSNPQPTLLTVRAPDNIPLDIHVEYYTQRATKGGLLISEGTIISDR

SEQ ID NO: 11873 - protein, 67 aa, Chlorella protothecoides
MITVSKPGSRHCQVLQPADAIVPGPFHIDGIPCLLPTRVCGDKFAEVPFVATREGYRRAGLCKVLIK

SEQ ID NO: 11874 - protein, 539 aa, Chlorella protothecoides
MLPRTRDTLHLEQAHTQCAGLETPSFENSPPSLTESYSYSKLPDRHPKYSAACERLSNAPISVSRTTSRRVTFQEEGIHQWKDVNMMEPEFYSSESVSESVGQLLCSCSWVMGGALICRARDDHPSSDTAHHCDPKRMMVGDDAFSAVRSALANVSDSSPWDIHHIDITCDGKRKRPSSRPGLDAYTPQTNMPPNHHYRYKCSVCEDRDLCQPCFRALVAARARCLEETGNCPPSTSTPGRTTAKGTFILLSIPHTSPSCLPFPPQHSRLTDWARSLHAASGPAERWAELAAAVPCLDPSHVLAAVTAGAERAVVLRLSPGAGADHPDLARFLDAFPPSRASCADVAWIGLEAAADAPAPATPRPGPGAGPQRPERRVEAAVSAWESLAARRPPTHADAAVLAVRFDLRRGKWMLFPSAGREADAAWRAVAAAAATGRLGDEVKISGVAPARADHVLCVYTRDYLDEGDVGRVRDALCALGLRLRRRRMLYKPDIHTHLQLYSRGQGSLRPSVYEAELPAARTAAWRREGRAAQADVPR

SEQ ID NO: 11875 - protein, 359 aa, Chlorella protothecoides
MRDAEGAQPLSPRVLGEDRATRSYILAPETSCPDVPALLEVSSEPGSPLARCNSEPELADLGHPFLTAAALPGLARTHTEVGSRMASLATGEARPTSLPPPRPTSAQSPRPAPSQPPEPPEVRLPTANTRPPSASTAFWAYVGSELRPASAQGLPDDVWGQTERDRVYNAILAVPYQLERFQMAGVLVCLDSFLSIFTLVPLRLALALGAGVRRSVGNRRGREAEATARRHRGAGVAPLGAGSQGLGVRPSKSKQAPHGDKPPQAPHRPQPLTGPQLYDLLLLGMFGCMMAFITSLNVGSIYYWLKDLTHEFLKLSVLYTALELSDKVLCALAGVPGLSSAHQSGPWTLCTWLPPLDAH

SEQ ID NO: 11876 - protein, 504 aa, Chlorella protothecoides
  MOD_RES (316)..(319): Any amino acid
MDNRNGRARCQVAASEAVLPLDARTTWWCNLASCLLPLCDSSSLGHPTPPGAFYMRLVGRPVDVYQYLEPLYNDFRKVRVRESKGAFALSYVDQGRPGQGAALQQTTDFYLEPSLSTCHAIPIALPWQVIDDMLTRDYCFDIALPRLPARKVLEEAGQLQPRVSVLDEEFDEQALAVSHGDRQRVGERARGRERSVEGWETKMSTATDCHWFQPRYHMQVGGQSSFRCSLAGPTLQEEQAEAAAAATSAAAALKLQESAALETATPTEPAAPADAVRARDGEASIGPAAGGEQRRDRPRDPSPWRLSKKERRADRXXXXRGTLALGGLARKKGRLIGRGGGAGRAAPAAIGAGGTTTVPAGRDGEGPGEPARLGGGVGPLAAGTAWIRGDESGVGGTVDHAPRLPGVVAGEDADVVEGEAGLVKKLMRSRSPHREDACHALMPCSGLLSASPGTGTGSVIGGSAGAPTPETPGMGMVESGAVHMPGDVTLSPHSLPSPPVLMGH

SEQ ID NO: 11877 - protein, 97 aa, Chlorella protothecoides
MYVVRLSDAFELWNAAAPCRVQNAQGYALPLQAGGMYGEPQRPSEFLCLILKMLQIQPDKDIIVEFIKDDAFKYLRLLGEEGRPKRRRAGLLPLLVV

SEQ ID NO: 11878 - protein, 389 aa, Chlorella protothecoides
  MOD_RES (161)..(178): Any amino acid
  MOD_RES (200)..(203): Any amino acid
MLTASHRNVSCALGRPSARRSRTMRTAASMRDVAGGWIEEHMAKGHVTGWRSLGGSGWSSAMQATTSQGAKYFVKTSGSNAAEMFQGEALGLQAMYGAHHPSWESCCPSQTLSSPMPAATKTLRVPAVHHWGDGPEAMGSFIIMEFIERAGPVDQGQLGVXXXXXXXXXXXXXXXXXXNTGAGKPCIAQITSLGPSRPQXXXXNLAAMHEATPMDEKAAAGFFGFAVDNSIGGTPQRNTWTQSWPEFFREHRLRPQLEASGSAELQRMAEPLLESLDRLFAGVTPRPALLHGDLWSGNVAGSREGPVVFDPATYYGHAEAEFGMVWCSGFGRDFWEGYHAVLPRDPGWEGRQELYTLYHKLVSDQACVTGGRCPADGMGTALKMGKKRC

SEQ ID NO: 11879 - protein, 201 aa, Chlorella protothecoides
MHIRSHSRPPPPHPETLKICCSFGVDVLEALAASCTRAVAGPVRAPGAALALAADVVVTLALLLTHCGVLLGQAMVFSVALNSKKNALVGLLIAANFGEIKDREPPRKPFAPPNPSVRTHRAGTVFKRFDAGKLYNLTCQDVVERFHLILILAFVVVEEMGNSGHAAPNAGLLAQCAEIFAAEAAIDVVKHAVLGKFNEIR

SEQ ID NO: 11880 - protein, 96 aa, Chlorella protothecoides
MHAPPSRHHRRFPSKPQFQVGCDGGAEHPLLRPWWRGRRGLTREECVALFDRGGGVEEVGALELEGAEEEDDWGAGQDWDQEGGEGTSPGGGTQGT

SEQ ID NO: 11881 - protein, 140 aa, Chlorella protothecoides
MGAGGRGWTLRVTNLGGAQGAALLFFQLTLPQGQFLPSLPPPSAVREAVEEVGVLPPFTISGEIKTVRGKRGQKHFTVFIATLLPEDRQAWTPVLNHEHSEFQWYPVPGLCAGTLPLHPVVDKLFRQGELPLGLVGVAPP

SEQ ID NO: 11882 - protein, 274 aa, Chlorella protothecoides
GGGAAAGSGAPTSSTPLTTARRSAFQLSTVASRFRKQLAVLMGTLDACHPHYIRCIKPNPGSVPGTLAAGYVLEQLRAGGVLEAVRIACAGFPTRKAFLPFAQRYALTLPDGWRERLELPLTPRGFVDCTCSLGFPAPPTCTPLLYISTTHLQVVAVVRRILATSGMEGWQLGRTRVFLRAGQLAQLEVSHCWRSNNRGSAGCLRGIREASRGSGGNHCGGATDRLQHVAPPKHTHTPLSKGARGRRLAGSALRIQSAFRGMAARGELRRARAA

SEQ ID NO: 11883 - protein, 96 aa, Chlorella protothecoides
MAMLVEAPAAVDDALASLLDHPDPRRALSTYIKRIYFPSMLHEPELTGLGARGSLAAVWAHACAVPGAAAGPRAERHGAALVVPGLADLAEALAEA

SEQ ID NO: 11884 - protein, 539 aa, Chlorella protothecoides
  MOD_RES (135)..(138): Any amino acid
PGPGPAPAHEDRARRGLGRAARAVRGRTGLRASAARAGSPGILVDGRGRERGRGLCGTGVGHVGGPGRAVMECFLCPAGDSSGPAPTRLPHLVSSQPGGMHRWSAWHPPLVLLQHGAQDTEEGIQCSRGSTRGDXXXXTHHWCCCNMEPRTQRRASNAPEAHPEGRAPFPSVEVPDRKPATRMPRTHIGDPHHALAESLLGSPISPAQLSSRLQRAISPQLCEHLTRKGWAVADGVFGSDVTSALRTELASLAPSMQHNSTVLVHPGSGTSLLPKLAINEAELRDPATCAAAPLCSALQEDATLRVMLSLFLPGLRLESQAIKAQHNTGGCFPIHTDSDFGVDGRCITAIAYLNPGWQPWQGGELRLYPWPSEAVDIAPLDDRLGLFSSKTMLHRCSWGLASGRSGVRGFVALGLTLSACHTELGGQQGLSLGCELHHHNVCSHFWHPLQGLAITGSRPLLLHHVAVRGAEPGPTPDPTPARGGDERGGMEAPRPPIAEEARGTVVAEGRVGRQPGAGAPTLPCPRCLAGGVLGGSGHY

SEQ ID NO: 11885 - protein, 1135 aa, Chlorella protothecoides
  MOD_RES (159)..(161): Any amino acid
  MOD_RES (221)..(224): Any amino acid
  MOD_RES (247)..(250): Any amino acid
  MOD_RES (346)..(349): Any amino acid
  MOD_RES (393)..(396): Any amino acid
  MOD_RES (483)..(486): Any amino acid
  MOD_RES (532)..(535): Any amino acid
  MOD_RES (699)..(702): Any amino acid
  MOD_RES (818)..(821): Any amino acid
  MOD_RES (964)..(967): Any amino acid
MSSTPSSAERKGMTTVAQASTTGPEPAAEDENATYKSDAFRMQCMKATCAVALTQPPSAPVPPHQVLPCSKRYVHDWTECPFAHPQEKARRRDPRVFSYTGIACPNMKKVGLPDVISVLFGLDLQHVVLVLCLPHLSCLMHVPVASADLPTGLCQRLLXXXYRHSLPQHEEGGPVGCDLCSIWARPAAGAPCSVSDTLELPNARPCGISWPTHWPVPAAAXXXXCMFLLSNLPPPLPVHRRTGSAPXXXXGARGPGSHACPLQPASSAAPPPGPRTVHVPPFQPLSPPLSVHRRTGTVQRWRELPAQDLLLRSLPGRAARAGREALRLARGVGRRRLRGRAGRQPXXXXSRPAGPGRPGRRHGEARRRAAVRAGNPALTLGSPRRWARCRAAXXXXSSGRPSLDSAASVASGQQAGGSAGPAGAQSLPSLVAVLDAARGQQAGRGGTPRAASWGGEEAGGGAGRQPRADPGLSAALGALQGSXXXXKGLDSLKGRPTDVPPLAWHCQWVSHFLPNLADSHAHHHDGSPGPRXXXXHGGEGGGARARAQGFSFAARPTNRRATAPVALLVGEPLPPQPCCLPCTPSRWCPPVPPPTSTQTNPAQARGVVEVVASLLAQDRLAPAQASIILQQMLPSSTLELLHNALAATGAAAVQAPAYAPRAASLGSYQAAQEAQARAAAGGAAEQARRSMEDSRYASXXXXLGAAPRSRRGDPWRTRAMPACCRPTTPWSAPTRWVEWAWRGVEGSSSSSSSSNNNNSSSGWVRYDAGGGWCLPLPHWPSCQCGADALWGCRDGCVDACACRRCANVADLQHCPPCXXXXQQQRMGEIRCCGRGCLPLPRWPPCQCGADELWGCRDGLVDGCACRRRANLADLQHCPPCVACSCPRSPHHGSMPLGPPPPLPFVPRILHRPPLSNTHTHAPPPPGYAPFLYQQQGSDAVPMDRDSWESSRTSYDQARARMSLXXXXITPPPPGYAPFLYQQQGSDAVPMDRDSWESSRTSYDQARARMSLDELDVVGQLNYGAALSMLQQQNAAAAAALAAAQFGGGGASVPPLSPVPEGYPIVTRESDPGAFAGARGDGVERLSAEMQGLDFGPPAPQLVNAFSSSLFSGQTEDLHNKGRDLKREGKEERGMT

SEQ ID NO: 11886 - protein, 246 aa, Chlorella protothecoides
MGGGRHGLAPWGATWWSCGKGTAHRGTPHSFIPFAPLPASWCLPHYPPACHKPAACMSWLSPKTPHLNGGAQEGGRDQCHCMEERRRPDGAPQQDQGPCAARRAQDPLLVPGVPAPTRTWMARGAGAAPAEGTQGSLVLGGRGAEGVCMKMWAGHGLNPGCLHAAVHAVSNTDAHLVSSPPGPWLSCWTVSACGGRRGGRRGRGRGYPLDYRARQLRMLGRRVMPILPSQGAQGTARRCLACGGSA

SEQ ID NO: 11887 - protein, 578 aa, Chlorella protothecoides
  MOD_RES (63)..(66): Any amino acid
  MOD_RES (272)..(275): Any amino acid
  MOD_RES (378)..(380): Any amino acid
MSSSDDEQPLAARPGAARLIRKSLALDTAFRSTRSPRGSLGGRRRSSAHGVTVPGAAPHPPAXXXXRSTRSPRGSPGGRRRSSAQGVTAPGAAPHPPAGDPRAAAMDASQGEVPPHQRADSDPTSQCAAEPAVPITQASLDPSTQASQEPGPSSCPSPGGGAAIPAHLPLLLPDRPPTNKFLLELGPVKGRAGNLRATDLSGDSGAIGRLNAVGPKDEPRLQIDLKGVLYDAGVVACPMTLAVLNVGSADARLECLFQECIQMRGDTAQGTXXXXNHEGQCGCGFVCGCDGRGDKVKGTMSAVPWGSASCGRVGRYRVGISWQAVRRAGRGMETGEVAGTSSLFEDEDGHHAAGGAAPAAGEDPAGGKLPGGEKPAVXXXRGRASCRWGCSPSGRRGPSRRQAARWGEACCVGATFVHFIYCRDAEGNEKYMNYRRACHVVPHRCWIWVQEKQGTWPGIDQAVHFQAQAQAQDKTTEYKGQKTKGISGQAAAVVTDGYISRQCVMKAVDAWGQVAGLCHSKKTFGKNASMSLGSSHGWACSACAAAHSVVGFLFQIHQHLRRDSRGDTSLHKHGRSLC

SEQ ID NO: 11888 - protein, 809 aa, Chlorella protothecoides
  MOD_RES (84)..(87): Any amino acid
  MOD_RES (251)..(254): Any amino acid
  MOD_RES (646)..(649): Any amino acid
MTVHTVGGALAPDPAHPVPLPRARGQHHVDSQGERGVLRDGAGAAPVAAVRPSCSVCVGVFPPRWVRSWTQGRPLRQALPPFPXXXXGVLSPSLDPFVDAGKTPAASSATVPPPSPPLAVVVLHLLQRGGLPEPLPDAPLPRERAVRGPDRGARRAAPPGLPPRRLRLVGAGRPPGLAPAHHAGHAVRRDALQAVAVGPGRVVAPGPGDRPGPGVRRPRDGPGGRQRRGGLRGGGGAAIIAPPSHALLPLXXXXARTICCKPEQHIPSDGDYSRVRLFGAVGWGIWAAAGGGLLGTLGWPSLFLCHALLTCLLAWPSAHLSFDLLRGGPGHVGGALKGSGTGAGRGGDQERGGASAVGTRRQVFVLADVEEAVSLVGKASEGGEGGVDDGGSQCASIACDTQPAGAGQSAPVGQPSPSGRLTGAPDPPSPGQPPAWRLLIHPPILAFLASVAVMGYAMGAIESFLFLALRDLGGPPALAGLTLTVTCVAEPIVFWHARRLQAALGRRGCLHLVFAAFLARLACYATLRGWPSPWLVLPVELLHGFTFGLAWATGTAWAAAEAPPGRKAGMQAAFQGSYMGEGGKGWDDGGERETGWRVKVESGGGGGRPAGWQQAAREGCLGRWALAAWGPAGTTSPSPLQEAHAXXXXGPAGWQQASREGCSREWALEAWGPAATTTPSPLQEAHACIPLNVPASPPSQAPAPAGLGYGLGSLISGAIYSRSGATSVFAWAFAVVACGWGASTVAFTALDAVAARRGGGSVAYRGVELAPREGLGVEDPCGRADTLRTPSPVPIAVERGGRHARHSVR

SEQ ID NO: 11889 - protein, 59 aa, Chlorella protothecoides
MPTTTHSNHHAQCLAAVLGMDAGLAGITLFALANGAPDLLTQVAALLSSNQVDVGLAAR

SEQ ID NO: 11890 - protein, 392 aa, Chlorella protothecoides
  MOD_RES (183)..(186): Any amino acid
  MOD_RES (324)..(327): Any amino acid
MILPPSFPPGPAQAHCGPGHAGIPTLQSPPIPSPAPLPQPQPAYDRLRRFCNSTLPPEGPWRARTPSKGRRRGLRGPALAPSAAMHRSDTSGKKVEATPPVKVVGFHVEGASPSPRNTLLGSESLVHASSLSPVIIPPAFQVRALVCTVSLSLKVLGPATACAASNTNLIWGPAWRQMDRCIXXXXFQVRALVCTGLLSLKVLGPATACAATNANLIRGPAWRQTDRCIVCPCDAHVCICEYAATMCARSVPPPLPCTSVRCSNPCSVPTPCAGPAGDGGHFPTPGHGSGGCRLWHWAGGRARRGGPGRGPHLVPAAPGAHRQXXXXGAAQGVAPTSSSPLRPVRTASDTDALGAPGTPSRRSAALPLTPVASAPASAASTVPSASPFQMAA

SEQ ID NO: 11891 - protein, 343 aa, Chlorella protothecoides
  MOD_RES (292)..(295): Any amino acid
MFKVCTAAGSARRGLAPSQWPYRVACGSTLPTASDVPIYNAVPGVMCAQMPIAPRIPRQAPPSPDPDPSTHDLASWYAMAPHAAHAQGPAGDAGSTRKGNPGPSRKVIDTIKEATGASEEDVVAVLAECGGDANEATSRLIENPFCQVVHKKERRKEVRVGFRLRRVTPGVMQAAALNPAAMRDCLRSRDGAVGALHGEPHCTAEPPLAPCPCQQCRGRRWPRGGARGGMTSGTSGSGTSDAVRAGAEVLAARPDVAAAASLAAEVRGGFGWGWSSWGGDDGGVMAVADAQXXXXRWRQRCVGACDGDEAPGAGKTGVYGCCGCAKLPAAAALYRGMCCDIWN

SEQ ID NO: 11892 - protein, 727 aa, Chlorella protothecoides
  MOD_RES (79)..(82): Any amino acid
  MOD_RES (287)..(290): Any amino acid
  MOD_RES (688)..(725): Any amino acid
MLTSTASRLASRLGRAGQANAAASVGAFRGMAGSSHDLDPAPTPAQQKVRATVAFGSIPRPHGPILMNGIILDVERGSXXXXDPRPAKSACDACVRVHPTSAWTHLDEWELFWMSGAVHVGCHPPRGPHQSVPKSCTPHRWDSTPPAVHCLIHSIIDLENKHGAHNYHPIPVVQTRGEGVFMWDVEGKRYYDFLAGYSAVNQGHCHPKIIRALIDQAQKLTLTSRAFFNDCLGEYEEYITGLLGYDKVLPMNTGVEGGETAVKLARWGLRGWCGCVCQGGCAWCVCXXXXKPPSSWPGGVRKDDVAVYARGGNAWRWGYSVKGVPKNQAKILFARENFWGRTTTAISSSTDPESYEGFGPYMPGFEIIPYNDLGALEAALEADPNIVAFMVEPIQVWVVQGVDRGNRGCIVGDAILKGAGAWGCQRCGEWEAGGAPPPPGHPSLVFSSVGELALAAKGSCSPPTAPSPAPTQPFHLSHPRAGRGRRGCPRPRLPGQGQGPAAEAPRPADRGRGPDGAVPHGQDDGLPARRRPPRHAHPGQGAVGRDHAHLRRPGGRRGDAEHRARAARLHLWRQPPGRQGGRRLAPRAGGRGPGRGLGASGRVLPRPAARHRHPAAGVGARQGPAQRHRHRREQGLLRLGAVPGPGAPRLPHQAHARQHHPPRPPARHLRGAAEGGGRHPARGTARQXXXXXXXXXXXXXXXXXXXXXXXXXXXXXXXXXXXXXXPP

SEQ ID NO: 11893 - protein, 119 aa, Chlorella protothecoides
MVPSGRIEALRVPAHCPPAPHRPGHDLRPSTGGQMELLNMADDGLAQSSLPVFHPLEARAPPLRGTSISRMEELQQYLRQCDDRQCFKMYFKASWGRSNWLCQGDPVDGFTCRWSVQHP

SEQ ID NO: 11894 - protein, 547 aa, Chlorella protothecoides
  MOD_RES (93)..(96): Any amino acid
  MOD_RES (328)..(331): Any amino acid
MLAGANSISAAAVGLVYLAAVGPAIIVKASGPYWFHVVGYPPRMAAAAALMSGSFCLVALSASRPLQLLGVALASFQTHLPPKRLERGQFPRXXXXRPPRPICHPGVWSGGSFLDIQPDPFPRAPALHPGGPGGGLVPRPQRTLRLRPRPHHAVEQRHRFRRGGGVRLGGGAACLGGPQLQDHPPGRQCAGRRLAGHLLPAPAAPAPAASAPAYFRRRGGRRHGGQRRPGADRPREGAPPARGSSRAAAALRQPLGAGRGGRRQPCSNGAGRRRRPRQAKARWTHSSGAEHPGEAAGGGGQGRRDRPRRRGESPALCSGALGPAVLDXXXXGGGQGRRDRPRRRGEPPALCPGALGPAVLDPGALALHGAPLHRLPGRVLHAERCLDRHRWAGCIRGVWNSLLVLFVSLSVCCRRVQGAWTLFAGRMPVEGLASPALRVSRPEAEIRTPCTTHSPPLLPTIRFPCDGRCGPPRLLHLRQLVLPGRRFCEPVQRHGVAAGHGSAVGHAGLAGGPPLLLPARCRGALVVRLDAPPPLLPHRWVCEVCMG

SEQ ID NO: 11895 - protein, 180 aa, Chlorella protothecoides
MLAGRGCQASLRAQAACADPLLLTRTHHAFPPLAYTATSSLRTPPGQLDGATPSSQPPPGQLDGGFAALHPRVHGQDLVIAQQAGDVLLVLAQAVIEEGAGGERQLLGLVDQGTDDLGVAVPLVHRRVACQEVVVALALHVPHENALAAGLHHGDGVVVVGAVLVLQVDDLGREGGGWVG

SEQ ID NO: 11896 - protein, 386 aa, Chlorella protothecoides
AKEGQRRGSTDKPRRRALRLHIFAGHPATGAAQLSTLATKAPVDAGRLLQLLLGDDERGGEADDVAVRGLGEEAAARQVQAQLPGGAALALVDDDGVEQALAAHRLQQRGVDGAQLGAEGLAQTRRGLCQALVHQHAERGDGHLGGQGVAAKGGAVLPSPDAQHHLVVRQDGGDGHGPARQRLAQDEHVGADVVVLVGHHLARAAQPRLDLVRDQQGAVLLQQGLGLGQVAGVGDNHAGLALHAGRQLAYRAENQGWVAWRGRRTSCLPLAAPLASPCPCAFEDRVAHNASPVPPVHPLHHPHLDGLHHEGHDVGVSLQRSLQGTQVVVGDDLKARHVGAEALVALRVGGGGDGSGGAAPEVLARKQDLGLVLGHALHAVPPAPAQ

SEQ ID NO: 11897 - protein, 217 aa, Chlorella protothecoides
MVATYPGHNIAAIVIAIIASCGGGMIVDALDIGAGYSKGPAELATPGFVLRSGAFLAIFHLASVHLLGLLSSRASLGVITTLFVAHTLASAILQAPLDYTRPLGILLHKVGGRHGGVGAQRMSQWTHTQVVVGEGPRAKSSLLRCLLFKPSPPCIYEKVTNIPVPVGGKTKAPPSKPVTRSQAALSKEVDGHQEQYPSTPSSSKQTPRRRTTAGKRE

SEQ ID NO: 11898 - protein, 665 aa, Chlorella protothecoides
  MOD_RES (489)..(492): Any amino acid
MLSVQPMKLDSLRPHTPPHPHASACPIRPRSLFWSLTSWCALLAPRSCSRVRYKAWDVGHFHSLSFALGGFHCHYSNAAVASASHSMSHPRQHASPALSGVPHKPWSDFLDRGWDREKTLEIAQAEPALTLQVHAGLVPCRVSLHHPTQDASEQRPHKISFKVSSGSDAVVQELTAKLKQAGLEVNVIYSAGVDLDLLPAAASKGKALAFLLEEPAANDAPSVPGASTRALGCNPRLPPGMVQWDPSHSSPPPRTRLRQPRAPPPNPMHSFASPECGRWTGALGGRAMACWWRGTPATTSSCLPLPACMGAWWLTPTRSSGPGATPMHRAPSSRCWCRGRVRCVPGGVPGCRSRGPRGRTLSARRVAWYPRGAWGTSGRDPGSQFPRPPVHALHRPPAVLHPHPSAPGTPSCQASEDGPGGIFQALEHFEFVKHAEPRPAGVAVRRAVVGMTTAAAELFCGIAPQPPTDTVARLGEGCSHPAPRLDAPXXXXPECREPSVSSRVKGFLSSRDVLACPCNTFCPGTGHYMVMDMTPSSLPTHTSHAHTPPRAQFLSDDFFYKHEGVECGKQEYLDYLGGPGYGGMAQVAAGRGEWREWLGAIVVREGVANTWKVEAVERVQPFKAGEHERVGEGWRGGEGVPGDEHDGKIWHPVLDGFPPACPFAW

SEQ ID NO: 11899 - protein, 380 aa, Chlorella protothecoides
  MOD_RES (327)..(330): Any amino acid
GAAPAPRRPKEAEEPESEEDEEGKTRFGAGRGEHATYDAGDEDDAALAAQAQRQAAEREGLAEEEEGGEETGPGADEESRGATASADAEAEEGWAAAPSPAVPRSAASVSGAVRRTSASASSRVELEGGVWVDAATSSCGLALHLALDCPKLLLQEVAERVAAAALLRGTPGVSRCYVLEAARGAAACVQTDGINLRAAAASADLVDVDGLAANSPYAMLETYGVEAARATIVREAASVFGAYGIGVDPRHLALIADYMTHLVRVVGVGRGKPRIAGSEVGVHGRWPVGSEQARGTSLERLHSAGTADNRSAFTRPRIIPLRCWSSXXXXPVGSEQARGTPLERLHSEGTADNRSASTQPRIIPLRCWFSRRAVHECTQE

SEQ ID NO: 11900 - protein, 354 aa, Chlorella protothecoides
  MOD_RES (341)..(344): Any amino acid
MPQSTHPPTPVWLDCDPGHDDAIAILLAGYSPQLHLLGISTVAGNQSVEKVTENARRVLYAAGLAGVEVVQGQGRPVMRDPVACAEIHGDSGLDGPSGGPLLPPVPEGAGIGPHSTGPTGARCTDTDISAPAAAGPLQPRGVVVMAERIAAAAAQRAQRVHVVATGALTNVALLLTLFPEIVDRIEIVFMGGALGTGNTGEEGSRVAFQSWRSQCRASRQQRRLCRRWEMCEARHPGTVSAPPLKGARQEPPHAVPPLTHASTLHTTPLRPLHGVQHPGRPRGRRHGYAQRRPHHHGPSGGDAYGTGWPRGGDSGAGSSPRRRHPLPPGHARPAALLCQDXXXXSRQQRRLCRR

SEQ ID NO: 11901 - protein, 315 aa, Chlorella protothecoides
  MOD_RES (27)..(30): Any amino acid
MPATRTLSSWPAHSICDSTGTSPPRPXXXXPASIGASVRMPATRTPSSWPAHSICDSTGTSPPRPLAPSPPLPLAPSLPHHPSPLAPPLPQSTRHRSVPESRSWGWNAPVRVGVQAAGFTVAPLLPKYHTEGESRECLLTMVLKADFGGVVSERSRLARLFGPLAGVGLRGLLEPVVSSVIVLRDKVEQDRFVLRPLSSSDPTAAVGAAEPLALGPAEEAARRRAAVQKRSASTLAYRREPLLLAQRAVAAEQVGEPCCDGLVVGMVVDGGDGNFRSKGWFACDPGTAAVSVVFGEWATSSDAGSSEGRPGAGAL

SEQ ID NO: 11902 - protein, 738 aa, Chlorella protothecoides
MLEPAHPPPPTLTRNINPLRRLSTPLAALSRLSMLPPGAVPGALGSGPSVSGPSSTGAAAPAADAAPAAEAGDAAAAERVEEDAWAIGGTCPRQFWSCPGDAGFKGQRDSRLMGGRMGSGMGSSGERMEKGSPVSVSYCFVSEAQRPKQDGYLCDLSQCLAEISHSMPAIQMPARPIRAWPELPGRQAQGPCRPARLRAGGGGPAGAGGAHAACRAAPALGAQRARAVPLLRPDDGALQAPCGPGGQLGGAGGRAGRGRGRPRRGLRGAQRQADARGRGLPQGPRRVSWAVCVWGGGEVGWVLRSCGRGKVGPGRGVMTAGRIADWEVVAQGAPSHAQPVPILCRAHSNSSSELRSFINGEGPEADRARNKQFKLIPHISKGAWIMQKSVGTTPVILGQKLTTKYFKGSNYFEVDVDIGASSVAASITNMVVGATKSLTLDMGVLLEGQTPATLPEQLLGTIRHVPQQGMTPQWLISTLTCRKTTHLTPLRLAALDMKTAAYFDEGAGRIIQPEQLNQCDDSLADMGLAFGGQVSHSRFPPHDRARQLVRWGDATASGVDDRRRTGRRSAIMVSNPRRHLQILVVSCALPCLLAFARIEDDRTWYSIALSAVVSYAGLVATKALVPIVKAFNLRAGLSGLDINKKGSPAGEKKIPESLGLASGVVFLHRSLSQHAITGVHHIVSAAALLRRRLLRAVVDAWRELVGAEERGGGAGQRRMVGATACCWGSDTDAYLLAG

SEQ ID NO: 11903 - protein, 250 aa, Chlorella protothecoides
  MOD_RES (159)..(162): Any amino acid
MPVSVLPASVSMPVPQISNPRHDPHTLSPDNPPNPFSPHIVSTRQAGGLQRSPRHHLLHALPGLCGRCAGHSLASEAGPALRRQPAPHHRVRRGHRGRGPATPARPLLRPGAPPGAGAALLHLHGGPGHLLCQLHQHPGRGQWAGGWANCGHRLGGAIXXXXYIYMVALVIFCANSINILAGVNGLEVGQTVVIASAVLSHNLMQLAGNIPDEGGNGKRHRVWGGREGGGLMHNGWFMEGKGMGYAMAFA

SEQ ID NO: 11904 - protein, 136 aa, Chlorella protothecoides
  MOD_RES (112)..(115): Any amino acid
MTSVQSESLPGGAPPLHSPHYLTHRTGEASLLFTVHPPNRQVRAMSGEPKWQDVLQLRKVKDHFIFTIESTGAWRPHEIFEYAVKLMMAKCDKVLEGLQKYPPPSDFGAEEXXXXLEGLQKYPPPSDLGAEEWMED

SEQ ID NO: 11905 - protein, 228 aa, Chlorella protothecoides
MFCARATATSSEDPPPPPPPEYRGAIADLAGCQEGCWRVQAILGAATPPRDPCSTSEDEWHPFPGYFLFKLTLQGGPLTRQALPSTSRRAKWPTPTSLSAAGPRASPGSMDSTLAGAGRGQSLGRVLEYLVLLPVAHTMPQCPVPHPAPHRHWASQGPQVTLYVPGPLLHAGDNEIVLLELEDTAERDHAAVSFVDEPDFYGPASQGMAGAGVSIAGAPGRRTAHGPV

SEQ ID NO: 11906 - protein, 195 aa, Chlorella protothecoides
  MOD_RES (172)..(175): Any amino acid
MVRHGAFHGIGMGSRRPPVPFRGRRLVPHALSRPDTAAAAIAQGIELCREKKYDAAQGLFEAALELPGTGTKRFRNKPPQISNSERIAALYNIACCQGQLGNIQNGMIALAGALESGERRGMEQCSGEQRMMHGKDCCGGMVIVWGGKGPVRTCWTPRHLQPVIHNPTPHQXXXXDSQTPSVSDPQPHPPPNRLR

SEQ ID NO: 11907 - protein, 145 aa, Chlorella protothecoides
MQRGVLPGRWLDIASACGHLHPPMPSTFPEGPYNDADTARLDILVEAMGRRNFGCEEGGWDLKGLQSSLVTLNGESAGAKHAPRETGGEGWWQTCILPGPGWGRPRLHLLKRSRNPLGCAPPKRCSSPSNFGLSRSGARSGSFLI

SEQ ID NO: 11908 - protein, 445 aa, Chlorella protothecoides
  MOD_RES (369)..(372): Any amino acid
MAFVGATRSTSVTWWAWPGSILARLQSSSPQFVRVPTSLPFPTRSTPCGLRWNLARERDIHVWSTREGGVGRMSGCFSILHPCMLQGTPAVTITSRHGIIPFPVLRAVDFGPGWFNPEADFAVQKSLNAPGLSPPFNSEFYSGWLTHWGESMANTSSSVLAADTQVLLRWARNTTSLSFYMVHGGSNFGFNQGANVDGSNYQPHITSYDYDAPISEAGDYCQPGIGGECKYHVSGLGPAGRRTRSMSPGRRECRRESLPCGDCAFCTQPTPTARLLPAQGTASMLPLPFRRQSERSLRSTRGSPRLPFRPDLASTPTARCHGGICPAVRASKGGGFAARTLAQSLRLGASHAHIFFHESGAVCFATFPXXXXICPAVRASKGRGFAARTLTQSLCLSASHAHIFFHEPGAVRFVTLPRTLPCVQKWPHPLPAHHPPQAAEQELGA

SEQ ID NO: 11909 - protein, 688 aa, Chlorella protothecoides
  MOD_RES (338)..(341): Any amino acid
  MOD_RES (505)..(508): Any amino acid
MLARAAACCLTMSPPWPPSHPPARRRGEEEPMVINGGSLPDHILEALGLTAESGVSIRLVRNGARGLMVEGLTEDEEDEEAAAGEGDSEESTAASSEEEAVAAVPGLAGVEGDGGEGPLSSQDAAKVKAKRKRVEAAAAAALRRSGPSAAQDGRGGADELLEGGCAGGAVRAPSTSHVAADPRPRRSSVRTPPTAAETSSGDTGAVGSPFDADADALPVLAPSAAEEELRVAAVVEDGASPQPDTPSEQGEGEYLGPTAGCTAVCALVKAGVLTVANAGDSRCVLSRGGVALAMTQDHKPDDPAEYARIINVRRRRRRRGWCRGGRRLLGGSVGGSDXXXXREAAPAAQGVVWGGAADSWEGVWVGLIGSTYLGQDDGGLRCGLAAPKLLPPSILEDPSCTPIPAPDHAPSLHHAGRRLCGRRAGEWVPEPVPRPGRHGVQTEQGDGSGTPGEMAAQAGHRHVERLAARACFMRGRVGRCFAMIACGDGAPDILEAGLLASRGHXXXXGRCFAMTACGDEVRTETLQAGDEFLILACDGIWDVLTVQEVGKGWGRAWKGGSEEWIGVTADRFPRAVDFARERLLSGKTPREVCEAMCDHCLAPDTDNCGKVGRQEAWLHAAGSCIPRREARLMCHYMLMVGNGDCEGAEESLVEESAGVCKPSMTLVDSHLLCSAPTPLCRDLRDATT

SEQ ID NO: 11910 - protein, 301 aa, Chlorella protothecoides
MILILCPLCEHPNCANLGAAAGWMTLAAAMPPTVYFTTGNKNKLAEVRAILGEQGQLPFNVEAVSVDMPELQGEPEEIAKEKCRLAALQVKGPVFVEDTCLCFNAYKGLPGPYVKWFLEKLGHDGLNRMLHGFDDKTGYALCTFAYSDGEPARVEAGLAQSGAELLSAMPSFAPEHPDLLYTCVLALATASGPSTLAGPDAEPHVFMGRTDGTIVPARGPTTFGWDPIFQPSGFDQVTPVCSIKLAFLCPTRATLPGLTPGLALHSMQTYAEMEKAAKNAISHRRRALDKLRHHLVQRYAT

SEQ ID NO: 11911 - protein, 88 aa, Chlorella protothecoides
MWMTARNNDGLQTSTVSSLSQVLQPLSPQVTGTGAGAVVVAAVLANLLESVLGATIQSKTGWLTNDVMNVIQISCAATAAMAFACRLA

SEQ ID NO: 11912 - protein, 303 aa, Chlorella protothecoides
MTVQAGLAVQCVAPGRAYGHPASPSPQRWRDQHGGSCRAQAPTRPPSTTISTVLHTEELSMRARAAVQGNDSAQTTTMGCRAGIAAQGSGWPGACADLLRPSPGLLAGLVVNSLVYLLGIRILRKGLTWVGYSSSWVLGTLSYAAFGYKGYLIVCLYFILGTLVTKVRMKQKEAEGIAEKRSGHRSLGSVCGSGFAGIVCAIGHLLAPQALPWQVRAWALQGMTELPLPAEIRPKTRDRSSAAGGLCGLILQQGSRHSVQRDWQSVWQPGIPCQHLSPGPTRHRGGCELRGLPRGAGSRNWDC

SEQ ID NO: 11913 - protein, 423 aa, Chlorella protothecoides
  MOD_RES (99)..(102): Any amino acid
  MOD_RES (354)..(357): Any amino acid
MTVQPDTVWTCSLTHPHLMSIAAGAVYTLYNGVRLTGRPAPSVRTGLHLMDGFIIRARGDGQIYTLTIATGGSTPLGAHPACCAQIPAHLFVKRPDSLXXXXHHRNRWEHSQGCTPSLLCTNSCTPFQEAPQLLVPPPEAGEEYTAEWVPPPSYKSVRVALTSFKPALESLNVSDITSISIGYNASDQTERSSGRSEFSCSIDWIKCMPGGLEPDFILVSCSGATKVLRLSDAKIGHRSDALCHPGLDETARERVIAAKRRGERALRASGLGYTIVRPGALVEETGGYKALVFDQGTRISQGISCADVADVSLRALHCPEARNKTFAVCWEYAHDNDDGLYELVAHVPDRPSLXXXXVHNAEQFLKMLCLPACKPPLDGPAFVLLSTALFGTLATINDEDHAARVLIGKHYPHVEHGHPPNPE

SEQ ID NO: 11914 - protein, 299 aa, Chlorella protothecoides
MSLMIPTSLSYHATHRRPAVPFNGRKNVGARKSCGIPAQHREGGPQTPREGVGDGNEGRPAESFNIDDLNPISIGRKSREVFDDVWAQLQRISSPTKRGDLPGRYLRPEFETPGAKGTKVLVTGVTGRVGRVLLRKLLLRGYTVTALVRQRGGEERQTLPPSVRLVTGDIGNYEDCREAVKDVDKVICCATARTSIVSDLERVDVEGVSNIVRAWQGRTWGEARLKHRLSRFAKLELVHFKKPYVGDDWKVQAAPERSTSAGGTGLSRVMRTAGPKDVADMEINEEGVMTFSGGAVVIK

SEQ ID NO: 11915 - protein, 243 aa, Chlorella protothecoides
MWVPHGPYSVGVTDLEWEAHPGRPFNDLVRAEHLSARIFYPTAKRSPRPWSWGVSWLPHYNYAKGSPLFPLRLYQKMFVPPAKGTFRPMLRPHIPRHRPRRILLLPPAPLPDQCAGAGGPAGLRPCPGLAAAPVDDPRSAAGARPGRRRPSSRHLQPWAWRLPQHVQRPLRRAGQPGLRRPGRGACRRVQQRRPCGRCQGGTGAGEGGGQVELGPQEDCDPRGVQAVDPMQSICSNTLEQLDT

SEQ ID NO: 11916 - protein, 299 aa, Chlorella protothecoides
MSTVGTPHKRGHARSRSSVAGEETPILQGWLARESGVVSALLNKRFGALYPTALVTYRKETDEASSGGMTPSKVWSLSRDVSLTPVDRHTFKLRHAKTSTLWAVTAKAYDAKDMWGFSVKWPNSGIIGQDHLVLAFEEEREAELWHRALSDVIARLPARTVSGIGDLHSRQASLTSEADAGEGSPPPSPMKSGLGAELGAERGAVATGAEGSAAAAAAAALPATAVPMRHVRAASEDSTARPRPRSWASVMHINGVALFVEDSDADGSGGAIMVSAVVKAPPHDVFRVSGVGGEVCVLE

SEQ ID NO: 11917 - protein, 93 aa, Chlorella protothecoides
MRATERKRCPGPAYPIHCHSKNARVPQEDAHSTVLRVEPSSDAGIFAVFDGHGGKEVAKYAAVHVVGEGLVITHREAQRIGKGVEWGFFKPPQ

SEQ ID NO: 11918 - protein, 168 aa, Chlorella protothecoides
MACACALGPRRGPKASGRADRIVEEGRATAILSLQSDACLEALGIDYSALHARACARGLLAARVAVRDFDHDDQAAMLPEAVRALHTLLAMGHRVYVHCTAGINRATLTTVGYLTFVQGLGLEEALRAVREARPQAHPYVDCWRTVRRRLVEGRGDEVGHAARAIFNT

SEQ ID NO: 11919 - protein, 451 aa, Chlorella protothecoides
MATKAYAAGDLGAAVAEAYLELDQLMDAPAGQEELDQLAAPVQKRARAPLPPPHAPRHPRHCASPPPPWPATPRTPLTLFSDVDTSATSNTSLDSGRVSAPEEEAEEAAPSAPGVDRRLRKMNSSSEFLASHLQRASIVTPRASPEGPSTALAEHGSLGRTDTRREASALAGEEGEEVAEDPASLFGILEGASVPALAAAAPAESTEQRPRAEGAGCTALTALVRGGRLVVANTGDSRAVLSRRGVAVALTLDHKPILFEEARRIIRAGGFVRDNRINGSLNVSRALGDLDFKRNAALGPHEQMAAPRGLGSQAFSPSSLHTSVTPCPWNTHPRRPHHVSLPRPAQVVVTPDIEVVNLSEGDEFMIMACDGIWDVLSNQEAVDYVRRRIKNGTSLQAICESMCDHCLAPDLTGMCRGADNMSVVVVLFKRTARLDGIWGRMWSGLWGSMAK

SEQ ID NO: 11920 - protein, 74 aa, Chlorella protothecoides
MQLALDVLTAMAQGSRLPGRMTLSHGLQASRFLRGSVDLGCVAAAGHSYGGATVAMLAAEDARFKAAIAFDPWW

SEQ ID NO: 11921 - protein, 89 aa, Chlorella protothecoides
MAIAARVRLASRCRPPMWSTCPSRAPHPLQPLSFMQPQLVVESEGYRGGQTALALSQAFLAVDDLLVLPEHREELKALRGGDKEEKQKT

SEQ ID NO: 11922 - protein, 107 aa, Chlorella protothecoides
MTLAVAGILGHFSETLLMFFIPQIINFVYSIPQLFKWVPCPRHRLPRYDTATGLLHPTPNWNLVNAFLSIFGPCTELVLCSRLLAFQGLCCGVAFWARHVLAGVYKE

SEQ ID NO: 11923 - protein, 232 aa, Chlorella protothecoides
MQPGKHTHLLGDLTQALEELLGGLDVPGVTHHRLQDDPSDLALVCLEDGLHRLQAGRRRASRVHTHSPADTCQRGRGSGGHNARRVGEAQGNHPRPSLDQELVGVAVVAPHKLQDLLALGVSAHEAHHRQARLSAGVDEADHLHGRHPVHDHPGQHVLELAWCAKGGALVQLRMQGGGHLVVGGPDNGRAPAADVVNVLVAVHVPAVGTLWLVGREGVTANGGTQKGHSGVP

SEQ ID NO: 11924 - protein, 118 aa, Chlorella protothecoides
MDRAQYVRESRGCMRQLEAATRGLGTSGAQHPVLVAQQHERVAALAYSLERLANVKEFRTPQGARSVARLYVGLIIPIFFGPYWGWGGEGSWDRRGGGHVLARLAECGLLDDELLHAS

SEQ ID NO: 11925 - protein, 166 aa, Chlorella protothecoides
MSEGISMDKQQEKAAVGRGTLAGRSVMLVKPQTFMNRSGQSVGALARYYKVPLERVLVVADDLDTPLGALRLRAKGSNAGHNGMRSVQSAMGGSTAFPRLRLGIGRPAGGRDVADFVLQVGAAGAAGGAGPGGWTRIPVRMLLTLWWGRCFSTTPARYQPPCSHRR

SEQ ID NO: 11926 - protein, 147 aa, Chlorella protothecoides
MSENALDGICLASKGWQESFGVRLAGLARSPNSQDCTALDPPTCILGVSWPGQMGEAAACNPTSSDSPSATEEDLLAQLTYFEARADPQDPEQAAMLDKMREHVRRLRYARGDWNKPSCNRDWNDPTPPSSATAPMAIDSYRCGMFM

SEQ ID NO: 11927 - protein, 718 aa, Chlorella protothecoides
  MOD_RES (701)..(704): Any amino acid
GTGVVELLGGGRGLHTAGQPVPLVAATQDGRLLVHAPGSGVAAPPRQLVGNNDEVTDVRFVERRASGAGAGPSPACVAVATNSPVIRVFSTPRFDCLASLAGHSAAVLALDAALLAAPPGVNDGESNRSALQLLASGSKDCGVRVWDVSAGTCLALGEGHVGAVAGVAFSRRRPAAFLVSGGSDRLLKVWDTSAVVGATAGGAGGDGDGTTSDRPLRLRTVAAVAAHDRDVNAVAVSPDDALVASASQDRTAKLWRAADLVLVATLRGHRRGVWSVAFSPVDRLVATASADASLRIWSAADGACLRALEGHAASALRLCWVSLGAQLVSAGADGLVKLWGARAGEAAATLDAAEDKVWALDARGDGAQLVSGGGDGRLVLWADATAEDRGEAAAAGAAAVAADQAYANALADRDWTAAAKTALERDQPRRLLAVVNNVLEGADEPADAEVGWVLWWRRRRRHLCSGIGPCAHSSSIFRCHKSLILRRGSPRSRIVRRDPSPSCKRHAGDAAPAGGAAAGRGAAAPAGDRARLEYTHAQLPRGCRAAARRAVQPRAGRAVRAAGRGRHRGRPGALHPAPRRAPGPPGALRFPPGPRAGQHEHAGAGGRGRPERTRQARRRAGRLTQEGVSTCGQGETSLSVGIGRVLGYHCDVCRRVKAMAPCDPFKGMLGVAGGPPGRSQCASCRPCNHEMGVCRDDNLHXXXXAWSLPMCFLYALQS

SEQ ID NO: 11928 - protein, 63 aa, Chlorella protothecoides
MLAGRAGDIKRHAWFEGFDWDALEARKMDPPRRPKGQDATKRIQELTADGGGKAGECSLYLRL

SEQ ID NO: 11929 - protein, 116 aa, Chlorella protothecoides
MHPQARGGPTRIPAEVVVRRKQHGSGEWDVVRTRGHADEVEELGGTSVAEAGGERGGGSGGGMSACRSPPAALAPTPSAPHHAGLGAVDRPRRRPAPADPPPPQPMPQARRADSWW

SEQ ID NO: 11930 - protein, 122 aa, Chlorella protothecoides
MTHPNPVHAQPLENGRKTYTFCGTPGYVAPENVLAQGYNFSVDWWGLGVLMYVLLTGRQPFTSPKTDDPMVVMRRIVDEKFRIAFPPYVHPVARVRGSVVLSWGGLLARGSDGRSPCACRHE

SEQ ID NO: 11931 - protein, 63 aa, Chlorella protothecoides
MVLGTGAFSRVCVARDEAKGRTFALKRMRKSGVVQCPEHVFCEQTITRNLTHPFCIRQPSFAA

SEQ ID NO: 11932 - protein, 100 aa, Chlorella protothecoides
MRDIAVHHNHPHSNPRPTQAVEERVSGPGGRPLLLRQLAADHAHVARATRRDNAYLQDVLLDWARWRSPADDFIQVPAPAYTAARPVGSARTRRGREGGA

SEQ ID NO: 11933 - protein, 312 aa, Chlorella protothecoides
GPAAGPLLHSARRYHDPKKGVLGCRHYRRAAQLVAPCCDRAYVCRFCHDEATDHVLDRYAVCEMVCMECSLRQPVAGAVRCGRGERGRRQSGASWKHEKCVTPALGDTMDTSVGHRPQVALSRSVHPALSTHSGSCSGCGTCMSRYYCKVCHLFDDDPGKAIYHCPFCNFCRQVRGSGAVCGLKWIQGAMEEGGCMGSCLRSTTPAGATSLHPGADLNHPSLLVRCSPNCPRLRMDPRPLSPCLPPAGQGPGHRLLPLHVLQRVHEPGAVQQARVQGAEPEAGLPSMLRHAVRIQAPRQGGFAWLLLGVCAS

SEQ ID NO: 11934 - protein, 357 aa, Chlorella protothecoides
  MOD_RES (17)..(36): Any amino acid
MSTGVIGRRVDADALSXXXXXXXXXXXXXXXXXXXXRTARAGGGPGRWRGARAARRGGHHHHRPGQQISGAGGGAGARAHGAPGRHVQGVGHDPPQHGHHAGRGHLRRARGRRRLAPRAGRRLRRLLQPDHRGRRHLHQRHRAGPGQRRGGGGGNRGPQLARGACAGRRADRPSPGPSQVHCLGRGGGDHAAGVHGAGGAERRRRAPRRAQRGRQLPGQERHVRPRPELGAHRRSRREKGAACDCSLARRAPPPSGRGGRQCWQYSGVDYRQEDVRISLGDTELMRGGQPLDFDAAAASAYMKAAAAAHGTVTIEVSIGDGPGVGQAWGCDLSYDYVKINAGEGAWRAWGHGWGSAM

SEQ ID NO: 11935 - protein, 612 aa, Chlorella protothecoides
  MOD_RES (33)..(36): Any amino acid
  MOD_RES (112)..(115): Any amino acid
  MOD_RES (345)..(348): Any amino acid
  MOD_RES (574)..(577): Any amino acid
MCPCTDGGVRGSPNPSDPNLPAARMSMDWRGDXXXXIRSQASRYTDEHGLEGGRCRCSPVHDMSCEDGHAGIVRWVEAARHAQVRGGGAPPFEPRGIGGYVHSPRPGPLPQXXXXTAPEDVASILDESEQDAVIQELAAQSARARRQTQLCVTPLGACLALLYLYFAGQALVDPWSIRHHAELRDVLRPLAIAAGDLGSSIAVAAGTWAVAAYCNQSEHQGRAILRPVVVLATLMAVFWSLGILKMLRLRGFVLDGAWRMFWLPAAPAVWTLITLSVINTVGAVERDLRALRAARYSGPPNPNEDARISVGGLVGPQHILGSLPPCSICLPLFFAWSLPLLILAXXXXGQGPKLRLGPQIPQSGPPNPNEDARIFVGGLVGLQHILGPLLLCSICLPLFSAWSLPLLILASHARGGQDSPLFRGSPFVAFTRTYRPISRGFYRDETHAGVGVRSDPSSQRLWVGDVRGRKIDAMPDRVAGADEWQWWRERVEGDPWTPLPGNTSRQAHGLADLIAERDVQRLAVCLQLGRAVLEGIEHRVRLLVPGDRIGGRGGKGSHSAIQDVRMVWVLHGHXXXXRGGKGSNSDIKDLRMVWVLHGHDEDGEQCIRIASG

SEQ ID NO: 11936 - protein, 561 aa, Chlorella protothecoides
  MOD_RES (271)..(274): Any amino acid
MYLQDGVGVGLPQPGGVGQVVGALDVHNQLGVEKGLYRCCNGSRKGKDHFSFSLPPTWCAASIKRTKARAGAVSFSVHVARGPTGALNEGGNDVAGMCRASVVNELKLESNLKMAVLTRCDLTISALSSSQSFRGGRCSTWPTQRRRIQLQAGRGVWDPWRHVECPYSAEKPSCIAATFGPCPVASAGTVSETPPAASMPQKAQPAPFKIPKSLSEVDNGKILGFGAELAEGHPGFADEAYKQRRVDICKIASKHEMTPACGSMRQLGWWXXXXGCGMMWSEGRLRVLQCASWAGGRGCASHHSIRSMIGCPCMSGSDQCLHRRPHPRHRVHGGGDGGVVLRHERAGGALPRPRLLRVPGLLAGAGLQPPPRAPAAGGLRVPAGPQRLADPARGGPAPPPRLPQRPGLPHLPQHAVHAAWGRPVLDPGAGHRARDDRARADAGAPRLLPAGARHRRGVPGRGRGPDLAPHQVLLVHRGVWRGARRRRGQGLRRGRTVQLRRDEEHGLRPGRPARVRPLPEAAQDELQRRVRRRRGDGGGMGVHERRWGGLQGRMPRWKWGL

SEQ ID NO: 11937 - protein, 334 aa, Chlorella protothecoides
  MOD_RES (142)..(144): Any amino acid
MGGWDFPNPCSSLLPAWMLTIFLPSSMMQVAGAEIQTHHIKNAGENATWDETHTIHSTLPPTPAHSLSFAFNNVAIEDILELSVYDYNKVRKDGIMGTGSLALREAFEEGRIDTRIPLSNKTGSKDAGEVWINIRTEGVIRXXXNRLQGCWGGLDQHPHGGGETWAVLVFPGGEEGDIVAAMRPAPGHPSLNLLPVVLGAVVPGLPSTWSPRRSFLLHCSSRPTVAQAAGLETDFKPLDMDTSREAHSAADRQGVDDASGGQSGAAWQSSQTGQVAGVEGLTKKTEGLGLGDGGNVRKGEEVVLGQDKYTTVRVGSLLNAVHDWHQQQPVKSTQ

SEQ ID NO: 11938 - protein, 146 aa, Chlorella protothecoides
MHYGVAPPLNLFRLGLSRSPCHPLYTYTSTDRGPVGGEGAGGPLPRAPPRGEGVCGGDARHGPRARPGGPTRGGVPGREGADPERGAHPLWQGDQQKHHHEDRAEQVNLEWIGQVRSPYASPLLALRHAGMATVLIALVNPCLHVA

SEQ ID NO: 11939 - protein, 305 aa, Chlorella protothecoides
  MOD_RES (66)..(69): Any amino acid
  MOD_RES (253)..(272): Any amino acid
MMVCCTACHDRATKPWPASSLMATQMGACSDITCTKYISNVASSLDAWSRHDACPIIVRAVHHEGXXXXEPALVFLAQDISPMLHLHSMLGRGMTPAPSLSGRCIMKGCAVSTTAPIHSLAPQRPATRYQLYLNTSHEKLGRSSRAQAADNHRNPAESDPRSRVSWSMADSDGIRSAVVMLGAAALLLGASDASLASEAPHQHPALNMVVGNLADNDAFWPNVLRYISFFFSVLLGTAYVAIQPIIKLLKKPXXXXXXXXXXXXXXXXXXXXRLCPLPAQGDGVSDAGGGDGPGSPSPLKGIPLM

SEQ ID NO: 11940 - protein, 296 aa, Chlorella protothecoides
  MOD_RES (53)..(55): Any amino acid
MVQAGRLLGAYGLAASTFPSMKCSINSTLQAQHCAKCLCHRMRRPTWRTTLTXXXVQHQLHSASSTLRKMPSPQDAEAHLAHHFDSIQDIADTTTMPSLLPALGAAVTRSTGVQPLLERLRAGVSGDGAPLSAADKLGVWEELKVASLAQLLLTTRLLPLLALTVRCQLNVLGRYLYLESALEERGPGAVGVAVPRLSTPSQERFLSFADHLAREGHARLLPAARRAAAAALAGLQLHAGLDGAEVLRRLSAALEAMSASEEDAGEGLFLFVCATAGCCGVWLGEGQGACQPAPES

SEQ ID NO: 11941 - protein, 154 aa, Chlorella protothecoides
MRGHLWYIPPPSPTPAWREMVLPSPAAVAAALTVSAPDDRALLPGSEGLLVDAETVEGMLGEVRRTLDSACFARVAQVCRGPPGAGGEAEALACGWGVVRRRMCFGELVVMDTRRSWFGGWRPQGGAARDVTPVVTLSGPPTARMRGAGRPGAL

SEQ ID NO: 11942 - protein, 147 aa, Chlorella protothecoides
MELRDLASGAKHPAKFRPSESVEVVHLESRRYTCLYREGSLLHAMDAATYEQVAVEASLFDPGSAYLVEGMEVSMAFHDGRPIVGEVPATVTLEVREAAPTMRGETAAPSYKPAVLENGVRITVPPFVVAGDKVVVDTREGTFVKRA

SEQ ID NO: 11943 - protein, 405 aa, Chlorella protothecoides
MDEALTHKAGPSLRPFEGPTTRSRKRRLSQQAVDAEDAARRQVCSGSLGRGANWYVQVLLQPKGVRHPPRQTAGSRRCFSFTIQTRRAPSCCTSGTLPQPGGLEPVPVHPLDDAVRGQQGHAAAPAPDLLHRAAAGPVQVRAGVALVGVWGLRSSRLVWLPGRQQVCDPSAPPAKSHSFFPPHKCSRLIRHAYDGSDLPDFLTSPAFLMCTPLEEFVSVPSALGSTHFRLVLLAQDGWEYTVAERDLSSHPDPAADLMVTVSAVVGHVGGVVGGNSAAHPGCPSSGLSGGAAAQATIPATIPATMQQSSAGRPVRHSVSSCQCPCKGGGAQRPHAAHRSARTPPLPPRLTPAFTPLITQMAEFQSNALDLGDHEVVFNMVSYPTVCVQREVVERMIARCAEDPSA

SEQ ID NO: 11944 - protein, 121 aa, Chlorella protothecoides
MPCSSRPPCSLYVESIDLGEEGGPRTIVSGLVKFVPREELEGRQVVVLANLKPRNMRGIKSAGMLLCASNSEHTEVEPLLPPEGAQVGERVWFGDASEQAEAAQPNQVRMVLAMLARPYRA

SEQ ID NO: 11945 - protein, 666 aa, Chlorella protothecoides
  MOD_RES (58)..(61): Any amino acid
  MOD_RES (329)..(331): Any amino acid
  MOD_RES (599)..(601): Any amino acid
MVSPGTVAGGWPCVRSLPCTRCMKPAPAALGQLQRTLPGSAIPESTPGSTSHSPRHSXXXXGLWREDGNACVACHAHADLYDVVDWMDPSQRPSWSEGASSDPHEDEAGQKGMGRRHRRDSVRASKPASQAAAERLFNQACLEASWWQQICRHCASHVLTPTITLSACCGAAGHDGKVLGPDQAGARPLRNLLWALHVGHIYVGNGLEWAGLRTGLPGCAPETSSPLCTHVPPDPPPAAPPSAHSAMLRIYKHYNFNLTELRPAADRMSFSSYPGELFSDDDFYLLSSGLVMLQVARWDLLGIGVAWRGSGKVRSETWDTTLQDARLLXXXFPMARSDSCHPCEEWEGRRHRTPLCKMLACFQPSPGSPPPGFPALPQTTNKIFNDELFELLSPSTVLSWQRIRAANWLASSGEGRRGATLPDLAVLCSLLPSLMRPAHALQASHPPGVGRPPGPPQQRHLQQPVHGGGPGQVQGRPGPHARPAGGGGADPWPGGKRGRDRHPGGRALGLLQRALLPQSESTVHLSEGALPSLNTIRHFVTTCIPPGHSDLQPVWLPRHGLQGRRPWAALLQGGWGLVKWVAAQLKRVLWGSSCIAAPXXXRRGLVQWVAAQLKRALWGSSCIAAPCCCGHTGHLPRPSTLLQCSPSPRRRATGDAISSDPPQCPP

SEQ ID NO: 11946 - protein, 466 aa, Chlorella protothecoides
MKTGRDIVVAALLGAEEFGFATAPLIALGCIMMRKCHTNTCPVGIATQDPVLRAKFAGQPEHVINFLFMVAEEARTYMADMGFRSVQEMVGRADMLEVDPEVVAANPKLANIDLSRLLLPAASLRPGAAQTCSEKQDHGLEAGLDAELIPLCSAALRPRRDQARHVFLEAAVCNTHRATGTTLSHEVTKRYGAEGLPEGTIHLALSGHGGQSLGAWLCPGITLELEGDSNDYVGKGLSGGIIAVYPPAVSDFEPGENIIVGNVCLYGAVSGEAYFAGMAAERFCVRNSGARAVVEGVGDHGCEYMTGGTVVVLGGTGKNFGAGMSGGVAFVYDPEARLQARCNPDVAGDLFPVEDEEDVAALRSLIQRHVRFTRSAKGRALLADWDAAVQGFVKVFPPDYRRALAEQAKLAAAQRGQEEVLAGASTDDAFESLKRMALEVVRRGAQVVDTTAAPVPARAPAPAGAA

SEQ ID NO: 11947 - protein, 434 aa, Chlorella protothecoides
  MOD_RES (52)..(55): Any amino acid
  MOD_RES (345)..(362): Any amino acid
MKPTRQGLGEDGAPPQGSANGPHLQTWSGHPLTTQHNQYAHQLTRSTVGQHXXXXTAPARVCVACQGEGVSSGSRQGFEGVTLAYMKPTRQDLGEDGAPPQGGANGPHLQTWSGHLPITQHNQYALTRSTVGQHDEVDAGLNGGGGLVADARQGGLQATWPLGDRPGGVHQPRLPAAVGHVLHGLHLQGPQQRLLQLQAVGLGLPGLRQVALRPDHGPGGGDEALAQRVDRRVGHLGEQLLEVLGQQLGALADGGQGRVVAHGAQRLRPRLGHGQQQHLHREDWVPRSGNAHPGKHACTVLAPFFGLPARCKGHKRAERLPTHGIAKGCEGLKQAVDAGDTVGGXXXXXXXXXXXXXXXXXXTLHGWQLQHRWVHRLHDAVQGDHLILQPLAVGARRGVLVLHLQVGSGKERRGPSGTSGWQPIGQEEGRWAQS

SEQ ID NO: 11948 - protein, 689 aa, Chlorella protothecoides
  MOD_RES (25)..(28): Any amino acid
  MOD_RES (460)..(463): Any amino acid
  MOD_RES (662)..(665): Any amino acid
FPPPPPPGSPFEAINCARDYPALEXXXXAPFPPPPPPGSAFEAINCASDYPTLGNKLFATGASPVGEQGYSRALQSIADGIARRLTSAPSKAGTLNPSPLGADRPPQHHAASATTGLSPAVGLAMHAQCAGCGTPAHLHRVPLGARGPKRDRTPLIAAAVNHPVPSPSSPQVVSKHSAIPEAQGLFDPANDRDACGVGFVAELSKKPSRATVEDALEMLVRMTHRGACGCEENTGDGAGILVAIPHPFFAEVMADEACFDLPPPGDYGIGQVFLPRDIEEAKAIRDIIGNVAERLGNHVLGWRRVPTDPAGLGPSALSTEPVVEQFVVSRAAPGAGRRSRGIEQQMYLLRKLIESKLRLQHLGDDDVYICSLSSRTIVYKGQLTPAQVPGYYRDLQDPRFTSYMALVHSRFSTNTFPSWHRAQPMRMLGHNGEINTLRGNVNWMRARQGVMRCEALGLPXXXXGHNGEINTLRGNVNWMRSRQGVMHCEALGLPERTLQKLLPVVPPGQSDSGSFDAVLELLVRSGRDLPEAMLMMVPEAWQNDALMSEEKKDFYRFHSAIMEPWDGPALLSFTDGRYIGATLDRNGLRPGRYYITKSGRVIMASEVGTVDVDPTDVAKKGRLMPGNIFLVDFDRHCVVDDEAVSRRGAGGLGLGGSTLRRXXXXLRRGRRGGELEGGGWFGFGRKHAE

SEQ ID NO: 11949 - protein, 167 aa, Chlorella protothecoides
MEVLLLPMAKSGAEPLGSMGNDSPLAAISQRPKLLSEYFKQLFAQVTNPAIDPLRERLVTSTRAMIGPEGDLTETGQSQAHRLELEQPLLRPLEMQAMKHMTYSGWETRLVDATWPVAEGPGGLEAALARICDEAAAAIEAGVDFIVLSDRAAGECVLVVLGDWEVP

SEQ ID NO: 11950 - protein, 490 aa, Chlorella protothecoides
MRRPFFATSVGSTSTVPTSEAMMTRPLLPVAVKGGPDVAPVGEGEERGAVPRLHDGRVEAVKVLLLLAHQRVVLPGLGHHHEHGLGQVAPRPHQQLQHSVEGAGVGLPRRHHRQQLLQRALRQAQRLAVHDALPRAHPVNIPAQRVDLAVRLAAHDALPRAHPVNVPAQRVDLAIVAQHAHGLRAVPGGEGVGGEAGVHQRHVGGEARVLQVTVVAGNLGRRQLPLVHDDVHVVVAQVLQAQLGLDQLAQEVHLLLDAARAAARAGRGAGHHKLLHHRLGGQRGGAQAGGVGGDAAPAQHVVAQALRHVADDVADGLGLLDVAGQEHLTDAVVAGRGEVEAGLVGHHLGEEGVGNGHQDARAVARVLLAAAGAAVGHAHQHLQRVLHRGTGGLLGQLGHEAHAAGIPVVGGVEQALGLGDGAVLGDHLRGRGGGHRVVDGGGDEGSSVTFRAPCAVNSEKSTPSRPTWSAPPRPTLLGVTRRVGIARPCL

SEQ ID NO: 11951 - protein, 452 aa, Chlorella protothecoides
MPIPLPPGDPSAVEWSPSRSCPKRARSERLLPPRPSGHPAHEEVSAAAVLLGIAVSSDEGGDGAEAEGPNGEAPTPTSSPPKLEPAAEAQPPAPAPATEATPPAPAAAAEATPPAPPAAAEATLPAALVAEEATPPAPPVAAGEENAIPTFEPMEEDAVAVAPPSAPTPALPEESEPGPFAAEASLPPQEEVPALAMPGADLAASPTPEANPAEDGEAGATRGQRRKRESNPPPEDTPPLLDGARPLTSDGYEDEEEEGEKVDCGVSKGHGALGQGRLGAAAARGEGAAPIPPSGGWSAAAAAPPKSELTLLCERFQRKYGRLGPGGEPRVLLLNDVAASLDVPRRRLYDVINVFESIEVMRRVGKLTYEFAGFQHLPALLAQLLDEEMKGEEGGLASRVSLRGGWFGGGLARWRASAGATAAVGGCSLHAMVACLRMHAQGVRGTAPGLGT

SEQ ID NO: 11952 - protein, 166 aa, Chlorella protothecoides
MRQLDADCALLERLNVMDYSLLLGVHFVRWGNERWSPPFGDWGAAEAEPPAPDGHTWGRGCDARSLAAILRSAEEESGLGEAVRSAASMLTRVGRTSVAAWESAVRLSLPKGDGPASAPRPQGSVGRYYSGGALSRGAAPVPVVVKDAGHGVGVLGTRRISLPPEV

SEQ ID NO: 11953 - protein, 130 aa, Chlorella protothecoides
SRVAAQGGGGALGGRRILPGADAPQILLWWPDLTPISPRTAPRPPHLQLVVKGARRHARLATVRAGAAQRLLRHHLPRDRSHHLGPGEEHVGGVADHEGEVGEGGGVHGAASAGAHDERDLCEVGGGGRR

SEQ ID NO: 11954 - protein, 315 aa, Chlorella protothecoides
MLQLVRAASRASRHTKALLPALTGAARWSASLAEFEELPVYTLDNKKWERIVTAKQAAEAGGGQARIAKQHEKGKLTARERIAAFLDPDSFVEAGSLVQHRCTDFDMESQQYYGGLGRWRGDPTAPGRDLTLLISTPLRLGPPFELLPSAACRRRRDHGVWHGVWPPRLRIQPGLHGAWRVPVRVARPQDLPADGQGGGCGRAHRRPERLRRRAHPGGRAVARRLCRGVPAECGRLRGHPTGAILVILSRRVESARLRVPACGFVAFDVRCWILRLAPLVLDRVQSDPPLRVMEGCGNTYRWEMSRLCSPHRHCT

SEQ ID NO: 11955 - protein, 81 aa, Chlorella protothecoides
MVGGKGDEPPREAGYPDKRRRMPTIGAGETRACYKHTCRIQKCLSETNYDNAACSWAIDALKACCEKYGKDSIHCAFPKDA

SEQ ID NO: 11956 - protein, 98 aa, Chlorella protothecoides
MGRLLVAAPHFNYTTDLLQALVPVATSRDPELRFVPGGRFRCLGAARDRLPVSTAVPLHSTGPFQLDPAATCLIHPIRSAQPLPSHPGASWWTPCAPC

SEQ ID NO: 11957 - protein, 719 aa, Chlorella protothecoides
  MOD_RES (535)..(538): Any amino acid
  MOD_RES (573)..(575): Any amino acid
MLSWRAGAAVHAARRFGVGVLALRPFALVPYKAAGRAWQGADDGLCEAAAAWLEARGVQLSDHEFFARALRRARPAAGVDAPPLDLHRVPKVLVSDFIPNVIAALWRDAFACKPSSRFQPLPARAPLRAPGARHPPDWAVMRLGIQGECPHPLPPLRRARDRRGSRYAGDATMPETRAPGAPKYDDGCDRTFHGSMLRRCGLRRAARLGGMHARRQHRCMAWERGMPLLPGGPGQAQGGGQGGGPEDHGQALPDPVGAWRCVVRTWLADRAPWGGPAGRLSWQTWCLLLACSGRAWPHVYDSPTLLSSLRVGPGTQFPLSPPFPQKPSLCACRHSMVEYIRRERAIMDQLSHPGVARLYFTFQDAYSLYMGIEHCPNGELYDQVRLKRALGEDTARVYAAEVVDVLAHLRARGVVHRDLKPENLLLTAEGHLKLIDFGSAKALPGGAVAASGALFAARESGESGRGTPARSVAATPSAGSLATSSSGRLPDLAGVSLSARAPRAPAAGAEAGPGPASSQGSAQRLVSLVGTADYXXXXRWLPAAPCLQRGRAASPGAARPREAWPPRPALARXXXAAGAGRRRGGGAGARLLPGLRAAASQPGGHRRLRVAGGAGQPRRDPGGRPLGTGLRAVPDAGGAAALQIALRDLIRSLLRSEPEERLGGGGMGVGGVGRMRGGQGADALGGRGGSLWWVLEGSEKWRLTSGSDTGVIDPPVHTP

SEQ ID NO: 11958 - protein, 278 aa, Chlorella protothecoides
MDRKWRTNRAAIFTVVPYAEYCSRILQCTAEYDLATPSDLYAVYTVLHIESKTSELHWSESGGFYYFLATWSQAPEPDQVGYDCHQADCTVHSQPCTATNPHPWPPVTTSPSTSSPEPSQTASAAQPVMQAGAPPAQGKEAAPCMSADQGSAGAQAQCAVEVAAHDRSSEANGAGAVGAVASPLTSPDAVLVGSQAADSRPPPAPITRSQIIVPVGSACTSLTPALLQRFFSIRGVAAQQLLLALVDGNGMVSRTCLFNYIQAPLEGPGTADLDLLDD

SEQ ID NO: 11959 - protein, 343 aa, Chlorella protothecoides
  MOD_RES (200)..(203): Any amino acid
MEGGRSSLMETWGEFMGAGERLKGLGVGLVTGCIIPGLGVLGIHSSFSRDSSSHPDARPCQEHTRRAPARCNSRGNGQARESQRTGLNVLELLGKPCSAPRIPSCPGRNRWVVYAKASDYRGQDPANVPAEWHGWLHASVDVNPANVRGCHVECARRDGAASVSNRFCQRCWANSLPRSSPLSGQCAHPFHLSPLAKQPXXXXAGLTLFQGVDACQGSALTLSTFSPLQNNLCSTTSRRRFMRPTSWATPPPQFRGTSPRALGSRSTSATGSSTRRGHPPRLDCADVHIFCKIPTRAEYGYGRAWHAGAASRHSSFGAGLHVCSLKVTLSVKWRCSYVKGELG

SEQ ID NO: 11960 - protein, 336 aa, Chlorella protothecoides
  MOD_RES (59)..(61): Any amino acid
MLLRRALAVCLPTQAPVTTQLGNASMAAELPLSHSAVVSQCRVLNPPRASAACPPAWAXXXPVSRAESPESECGVSTRLGPLAHERQVRPFQEVLGLQGARGPAHASLLRHLQEDPAPHLQRQPVSDTGHVSFSFCVLRGGDTGCGDCGWRVRLTAIFLNEGPAPLCAKDLTPVFLPPLHLDRSPTTFDVDAEKLEARYKALQKALHPDKFSTASPREQAFSDAQASAVNSAYDTLRNPLRRARALLRLQGIEPEESAGVDDPELLAYVMEAREEVEGTRSRAGLETLLRDNREREAAAVARLRAAFAAAEWAAAAEAVNRLRYIERIQEAIREKL

SEQ ID NO: 11961 - protein, 363 aa, Chlorella protothecoides
MTGLDGAGSLVPVAFGNVEGRNDSRLSQRSAMSNNDRDFQVGAAVTPPPPAVPWARFRSTLTPTAPRTRLQALKETALSQLKAKHARRSVVLKDADGQGVKVVDAKRLTKIGSVQLLDQLVPIQKHNAEVDMMEGVHARLTNARGTADPDPPSMAPPVHRVEVYPPTVTIRYHHMSVETNALVGDKELPTLPHSVSHAFLSWTEPKRPLSIVHDASGILRPGRLTLILGPPSSGKTTFMKALVGRYRHSSDLKVRAAGEGENARVHGGRCGPLSRESDLPRLVSCSLSSPPGSQVTGSVTYNGKNFNEFMPERVASYVNQVCGSALLGMDYVYLPAAFIRGTASQTIVLAGWVPGLEGSGSVL

SEQ ID NO: 11962 - protein, 785 aa, Chlorella protothecoides
  MOD_RES (262)..(264): Any amino acid
  MOD_RES (648)..(650): Any amino acid
MGASGAGKTTLMDVLAGRKTGGTVTGEVHVNGYPKVQKTFNRISGYVEQEDIHLPQTTVGEAVRFSAALRLPRGVSAATRAAFVTEMMDLVELDRMDGALVGILGESGLSIQARKRLTIAVELVANPSIIFMDEPTTGLDARAASVVMATVRAVVNTGRTVVCTIHQPSIDIFEAFDELLLLKPGGRCVFAGPVGLESSQLIDYFMATPGGDVCTARPPRQGPLGGDVCMARPPRQGPLGGVPMCHAGDVPHAPRCAPPAAXXXRLACTAGRATGPSEMRVFPCVTRATCSTLRAAHRLLPDTRLRPGSACWPFPFLARAPSQLPSADPHLSPPIPPTRLKNQVQPCQLDAGADQPAQRVVAGRRLQRGVCRLQAGAGEREADRGRARGGPGHARPAVCRHGGVWGLGPAGPPAAPQLRHVLARAGLQHHALRRDPAGGLRLRVAGLGAGRGAGHHLRRAEHCGPALCLHPLHRRQQLHVGAAHRGVAAQRHVPRARGGDVLRRALLRGPGGGGAALPGGPDPVLLRHRLLDGGLHRLRLQVLLLCLHLRPDPRLLHRLRPDGELGWRGRGGWGGMGQGPRVVHRSTRVLATRALPAAGAPQVYVWLWGARPACRSRSRSLEGMVTLPRAATSPPPSSPHLPRSASTXXXNGELGWRGRGGGLGWDGTGAEDRTQIDEGAGDVGADCDGSTASVCVAVGRAPGVPLAQQVPGRDGPPAPRRAVPHSLFPPPAPQCLNLMPELALANVFTSFFFGFWNLMCGFLIPASVRGLGGEGCLGAAAASPG

SEQ ID NO: 11963 - protein, 512 aa, Chlorella protothecoides
  MOD_RES (10)..(13): Any amino acid
MASTTPHIRXXXXLPSLTSPDGASTAPPLPNGFDDPSHPGVRERCEVAGGPGARTQSEAELSPIFSYLHADIPHTTHGGTVVEGLCGVGVPPSAPSPSQQLPHADPTLGCTIATAGHSTHSRFPGVWTREPSFAWVLMDGSAAQMLQPWRRCRTAKAYAPRTHVHRPIFTSLTSLRTPSTTTQLGFALAIAGAVFITVPRGVSIGEVCVRPSRMSWNTTKSTYQLKLLAMVPVYNPNYLKVGAHGLLFVLSRRAGRATPCATDLGVGTCGFDCELEPKISHSPKLLPGQAHIEGELRVLFYNTEAGKQSMGSVKLPARSSPAVGAALREVILSQRGCWRLSVYPRPRLQEDLLHRVGHPSFARRALKLRSSPAIPCRSSTSQSTPRMCHRTTSWPSSPSAPPSQRSSYSSCRATSPLSSQTPAPWCHSQGLGLVGLHKSSPQNRPPLTSSSPNPAPMQARYLFQRQHLTAIDTYFLIDCRNGGGMQPDDGPPSATPAPLALDRLRGLDPGWC

SEQ ID NO: 11964 - protein, 181 aa, Chlorella protothecoides
  MOD_RES (13)..(16): Any amino acid
MTSAPAGGEAHKXXXXCAVTAEGHTSRCCPPNPSPFPTAHPAPSGAEVLGRAEIAPWDPPFPAVLSSQADICQLGMDQRKVNVLAREYADDARPKRMKPVILSHPMMPGLLQGQEKMSKSDPNSAIFMEDSEVEVRTKIKKAYCPPGEVEGNPCLSYIQHIVLPWAKQLAVARAEKNGGNM

SEQ ID NO: 11965 - protein, 209 aa, Chlorella protothecoides
MGGDLKKIQTVGNYMVEIWKAVGMDMDRVEFLHASGQQCIGNLICFFSLDVWGDQAEEARPGVQTCRCRREDWVPSWSHVPRPACVYMLCWTATLCRPRTGWHDSHFPSSTPILFALPILLTLPSRTPEEINKRPDEYWTLVMDIARRNNLKRIVRCSQIMGRAEGDDLSAAQIFYPCMQCADIFFLKASGAETRCRVDGGSVQSLQRG

SEQ ID NO: 11966 - protein, 312 aa, Chlorella protothecoides
  MOD_RES (129)..(131): Any amino acid
  MOD_RES (264)..(266): Any amino acid
MVTHSPPHAASAQLRGALDFVRRSKIRGQASAGLRGGGDHRVCRVRGPGRPPRPCRPVRRQGPGGPGGWSTQPCTAPEVGLQGPALDASPCPITHSALECRLCARNHPPPSPARCPRTTAGCHWTAAAXXXCHALSPRWSAGSSAQRQPLPHHPLGAGMRTVRKEPPATLARQVSEDHCWLSLDGSGRRDAAVELTTSNAALRGLAPGAEAWSGWLYAGGRAHTLTQRQVIASLVVSVDPTVVNGRAKKVSGQLAGLQLLLLRXXXSAGMDERGLAWGVGGGASRSSGLWAGLALAVAPCLRRRDNIGSRAL

SEQ ID NO: 11967 - protein, 407 aa, Chlorella protothecoides
  MOD_RES (30)..(33): Any amino acid
  MOD_RES (243)..(246): Any amino acid
  MOD_RES (300)..(303): Any amino acid
MPQPRRGNNPTICLHPPPHKQERLDSALEXXXXDRAEGTIQPLHPPPHTQERLDSALEKALERGQGVAAFCAQFEREIAMAQSSLEGAIYACAGAPPSSGLGKMRVADQSAELQASDWILEAGDASWNWYPFSCYAEASLGYVEAMAGADGSALQENVPSHFQLGLCALAAGGRVLAKYRHAPTGQPEVVGAFWKVMWKEGHGAIQDGVSWPPADLTVGTRGAARFNMRARPYPLSPPCQTTXXXXAGRPDRGYEGPSTVQHACKALSTLPSVSDDQLYKDIDELLRTVKSAADAAVLHXXXXASALLTPLAVEHLLRFLDGLCLYYSGKPKPATWVATLLKVLASATPETRQTGASRAAAAMQSPTMRASMGMWWELKPRLLKPLFEAGESEGEGARRVKRARVVD

SEQ ID NO: 11968 - protein, 97 aa, Chlorella protothecoides
MPPSGAVRAVLVVGFESFNAALYRAAGERLLHLQPPVQLSVFSDRDLGEWPGRARDYPADAGKAELAAALKDADVFFGSLLFDFDQVGLTFLDGRGS

SEQ ID NO: 11969 - protein, 66 aa, Chlorella protothecoides
MQGQGGAVEEPLSNLRPSRRSLPCPRLQDVVDKVSFLMLGLDLPAAPLFKDALETVIIPQVRTGGG

SEQ ID NO: 11970 - protein, 104 aa, Chlorella protothecoides
MRFSARKGCASRCHASATVLLLPATEFPPTTSRASQGRGPNTHAYTHSLDAGHHMFMKVTDGKVGHFCPAQDNGLHQDSARRTGLLAVILHTTGHRPPLNTPAR

SEQ ID NO: 11971 - protein, 91 aa, Chlorella protothecoides
MYDLLRKYGGSLIVDDIKAGRRKFRLTKPPRFLALHVKRFVKNQFFLEKNPTIVNFPVKNLEVPVSAPGAVPCVGFILRHCGPVRGWFSGN

SEQ ID NO: 11972 - protein, 165 aa, Chlorella protothecoides
MPGLVGLNNMKRNDYANVVIQTLVRIVPISGEPRCSPRTSHPTATPNSRRRDYFLRTQNYEACRSPLVREFGSLVRKMWITRAFKGHVSPHEFMQSVIAASEKRFTIDAQADAIDFFQWLVNRLHLELTGGKRKKASIITECLQARDLGVGSAGWCVVEPFGEGN

SEQ ID NO: 11973 - protein, 106 aa, Chlorella protothecoides
MRGVSIHQIQHTPWPLTSGSNRLHQNSNPTGGGYVFGNVPLVRNNFSLVMLAIVVLSILPAAYEVLTTRGVRQRKLRLAGPGTLTGQFGGLVVSRHPSQTGGTLTA

SEQ ID NO: 11974 - protein, 351 aa, Chlorella protothecoides
  MOD_RES (327)..(330): Any amino acid
MPSTNSVSFTSSNEEVVYRLHSSTWQRPASPRLPSLLISAILLLPYFNCPAQAQDVANSASPEVSSAVVSGLRGLLDYLLHLDVHLGELVAIHGRASYTILFAIVFAETGLVIAPFLPGVGSGIVGEAPYHVSCLNVLRVPAAPAPHCHVPSLAAHRRLPPLCHGRTGSERQTEHLPSTSHLHGSCCAGRLLLLPALMSSRFQLLGAAGKYLGAHVQQSRLVKKEHLVKTQHFFAKHGGRAGEGAGNSPVVLGRFLPIVRTFAPFVAGMSAMPGSAFAYFNVLGAALWPCLCCGAWEGGDLGIAYAAFLIQWWPCGRGLAWSKLPHXXXXGPACAAVRGKVEMWELHTQPS

SEQ ID NO: 11975 - protein, 257 aa, Chlorella protothecoides
  MOD_RES (90)..(93): Any amino acid
MADNTPASIQPGASSVTIPDMTASLNAKVVVSDDQQADPAQLAACYDAMAAKFLQHGLNIEAVQATRQYFDLSQVHQCGPMVYVGHSMRXXXXFSSPSSPPVWSNGCMSSIVCETFKRTQHSPPYTCSPSPSARSNRTPVTGTLPRPLEYARFPSPLPEAAVRLGVLFMQKCNPTLASLAHQAALDIARHIPPGEGGRVHSLIEDPLTWGIRLLGLIRDPGAGSFHGQYVAGIRLPHHLQPPPNTPNIPTQQATCCT

SEQ ID NO: 11976 - protein, 168 aa, Chlorella protothecoides
MTSQPHTLRPDPFDPGWAPPSGDAPPADWAAPAPAALARELRAMAAAAAAEPPPRLRAQRLLLADSGTLLLCSVDVSGGLAALRRRLRRAFPGAPPRQSTIVHCSLGRVLGGEEMGADAAARIAAACDAWTMRLAGAEWTAPGLTHVRETVFTTVEGPAVFMPFASEP

SEQ ID NO: 11977 - protein, 230 aa, Chlorella protothecoides
MGGSRSRPRRAVADMVWQYSDMVSRTMRGCPGLLPPYALSTHMILMACLPCAHRLEPVPALMTSPPLRAPEQDVRDLLVPAPPVRRPDLPPGRLHHLQQVDPLPGIHRRPFPVRGAGEHHPHGCRGLQLLRQPLLDHVEAAHVRVQRRQPGADRGGQLPQGLPRRVHPSGCLRQRPPGADRRVPGPQAPLRQRLPAHRQALRVRRLGPHALWGPPLNEPPPWGNRCRSGP

SEQ ID NO: 11978 - protein, 366 aa, Chlorella protothecoides
  MOD_RES (238)..(240): Any amino acid
  MOD_RES (321)..(324): Any amino acid
MATLWHPPFASEPEDDEEQRSSRGHYGQAGGMVRAAHPPEHAACPLRTAVCERAGGGQGEAGGGGLLCALVCSLQGPLPQGLPRSGWWLGWAQIYRHGLPLPGGLGASSMPIAAMQSAPPTPTLAQVVLLAEANKDVIFLAINFDENKALARGVGVKVLPFFHLYRGAEGRVDAFSASVSKVQRLRCGWGSRPRGVTWDTERGWTPRAEGSGSVGPQMLNPLFTMRRTGMRFGCTIPXXXGGVPGREAHAGGVRRHRGKHPALCWLAAAMVCTLVCLLTGSARRWGLLHPNDVPVPSLNSPVPPHPATCLGTPRTVLTLDXXXXGGVPGREAHARGVRRHRGKHAALCWLAVATVCTLVCLLTRST

SEQ ID NO: 11979 - protein, 159 aa, Chlorella protothecoides
MTTQLEQAAAAGVALVGVLTVIIIRRCVADDFPAVRSGELDLFHVRLTPDLPEAIGVLSFAFYVHPMLLPMLAEMPAGARGVALTARANQLVTSGVALAIYSVIGVFAAARYGLATGGDVLVNEWLGGAWDGALDAGMALYLALSMVPIVLTLRLQLDA

SEQ ID NO: 11980 - protein, 93 aa, Chlorella protothecoides
MAQELASQPTEAGDGRDPAPIKDSWVQCDRCEKWRRIPAAVAERLDEETPWCAVREGRRAHAGALGNASCANLTRLSAFQMQSPPHALAGTAN

SEQ ID NO: 11981 - protein, 637 aa, Chlorella protothecoides
  MOD_RES (18)..(21): Any amino acid
  MOD_RES (326)..(329): Any amino acid
MSRTGSPWPPTRRCPPVXXXXCHTMHACMCREGSGTCHGLALLAAHPPLPTCPRHDLPVQEYCPCGDRCTNQQFTKREYAALDVLRAGAKGFGLFTRDGVRAGQFIVEYVGEVLEEDEYQRRKEYYIASNQRHYYFMNIGNGEVIDACRRVGKVSRGFGGWVGRRLGLKRRPNGGVQTSECPGQRRPNPPLPPPPPPSYLQGGQGRFINHSCDPNCETQKWLVEGELSIGLFAIKDVPPGGELTFDYNFERYGDKVGGQQLLGVGLCTVTGEEAGGHLPSLKGCEILAASRSRSETPFALTHTTRWCAACALRRSSPAPRSPHPTXXXXFRDPCCPDAHDLLVCRLCTTSLIPSTSLTSPHPLVPAHGMPVRLGQLPRRDRRHPGDRRPGPAGGGPRVRGRPRAHHGERGQGHAHPGAPAGPHRGRGQPRRADLGGAEPVSGGGARGCVCGVLRPGPRAWAVAGRAGAPGPHTAAQASSGPQEWPRASHRCRAPTHRALAGPLTPMQSQAAGAAAGHHPGVKLRGRGGGRGGGEAAQGGAGAALAARAPRAPRALGQGERRVRCVALHAHPGGARSSSGSPWMPRLPGRHALTGSRHAPSPQRARRRGWTARRRSRQTPPPASPASPLRARGARGAP

SEQ ID NO: 11982 - protein, 199 aa, Chlorella protothecoides
MGAIRQYLCLSLLKNCASSVPAALPPCASIFLTLLTRFRAALKGEVGVFYPMILLRPIEPVGAGVLAHTTGSVGGAAPVDVAYRGVALACLARLAADGQALMDLYVNYDCDLEGANLFERTVAALVRLAQGSPGLEAAVPAPAEERALRFEALRCLVTMLRSMSTWAAEQQRGAGPGGHGGGAGGDGADADDGDSTGAD

SEQ ID NO: 11983 - protein, 293 aa, Chlorella protothecoides
  MOD_RES (38)..(41): Any amino acid
MHVAVVPGDGFWGLAVRGWEGGQVGPGGTTEAERLQGXXXXARGCGAGGSLFESRWQGMGGGTGGSWRNHRGREAAGSRGRLESVRIERTAGVRQDQRSVPPCMHAEFLAPPPAQCESSCSSQPLIDRCKTDELIKITVAGNAEKGLFPLKMRDEAISAGFAFLKEKGLIPIADSSDDEVNYAEAAGVECSASGSKEVGWGCHDDAGIESLNGYRVQDASKIPVRPWPGPFLLQLLPDRGWPYTVETAQPCSWEIHSHPSTEAERSGMCVAAGEVQTWAVAGPEPLHSKAHLP

SEQ ID NO: 11984 - protein, 1231 aa, Chlorella protothecoides
  MOD_RES (680)..(682): Any amino acid
  MOD_RES (769)..(772): Any amino acid
  MOD_RES (1104)..(1107): Any amino acid
  MOD_RES (1218)..(1221): Any amino acid
DGGIHSLLVSDVLCRQRRLLQLVLEELGLALGLARLLLRGLEVRISESSGIHARDVHLGGGGDDVGLVHTAGWHAVDAERAGDQQQAGGQLLEEHHALSLEAAGQQDENGAGGDGGAQLGGVAHEAAVQRLLGVLRGVEAGGLGHRHLGLLGLGVHGESAAILLLDGPQTTACGGWPQHGALLKRACAAEHGSTMQAAIAISVKNRGARDAHTDRTLATPESSAGCGTAHPPGHPGSARPLASGRSNKTISGHLRERPRPPAGFTASLAIALLYTPPRLGGERGAHCRRLGPFLAGGGRAADVKLARSPLSNENSSAPGVRAVRLANQRQSRRANRRSMTADTYWPIRLIAGYTRRVRTAWGRKCRFRPLPLQPVDPRKSSPLSDWRFPSAKAPLPMRAMPMTIASTPAPFLRIWSPRSRPSLAFVSHRRISTRVASPIGPDLSPEAVTPASHPDPFPTLAKGAPLPEGYGEPPSAPPKHRRSGIILHPTSLPGPYGIGEIGEEAFRFVDWLVASGQQIWQVGPGSASAVTPCLDGFRLHVSDRPCVLSHAPCMDGVLMPGSPDPACHQLGSRRPSHKVSSRILPFQPLHPAFHPPFSRPPQLLPLCPPETEYWSPYSGLDALCGNPLLIPLNGLKDLGLLKETDLPVPSPPGDAGLHAPLPFVTMPGDYCMGVAIEPPXXXATQVCTPRCRLLPCRLRCQDAAAGEGRRGAAGRPGEVCRPAHVRWHWGKRGGWGHARWVRQRMGPVFTLERTFTHRSLVPPPAPPPXXXXWVRQRMGPVFASERASMHGSLVPPPAPPPRPLRHPPPHPRREMAAFRQENAWVEQSALFSALTEVPGLAGLAWWDWPEGVRDRHPAALEAARREHAGRIDAFIALQYLFDRFWKAVKVLAQGRGMDGGGMGVGEGGEAKGGGEGEKQKGGVGVHSRGIFGDAGIDSLTRLPPPPTLVPATVLEAQYAVAVSLHPNPPPAPLVQAYANDRGVLLIGDMPIYVGGQSADVWANRTLFALGPDGAPVEVSGVPPDAFSDSGQLWGSPLYDWQVGLCRGLRSHAAPASLPWSRRRRDAGAGGASPGWASSAGHLSRPGALLPGTIVTPHPLHLRPXXXXPGWASSAGHPSRPGSLLPGTIVTPHPLHLRPPSTHAPGAQRGPVPVVGAALPAQPPAIRRDAGGSLPGLCRVLGRRRPGGDGCAKAGRGDRGPSCGRAGGCLPRSSSGTCXXXXCKGGAGGQGG

SEQ ID NO: 11985 - protein, 127 aa, Chlorella protothecoides
MARGQLNQAMRMLWAHETDRLPDAAIKEGGKKGVDLAGVSAMGGVCFFNLAVETPEGDLDLLQAVIDGSNTEVDESAEERKGGAGDIGERAQLVGSRACRKSPPLAHLRPHARHWPPPRRQDLSLCW

SEQ ID NO: 11986 - protein, 253 aa, Chlorella protothecoides
MNGVWKKGPGIELFEALEAALGHVPILAEDLGVITPDALDCQLDLHKPCPPPLVLQGGHRSAGHGRAAVCLGRRRDQHPPATQHLPEQLRIPRCAASLSGDAVARCTHALRAPAEGTPAKALTSSQPHATSGTHDNQTVLGWYKAGCRPEEARLIARYIGAEAGQDISWAFIREAYKSVARTVVVAMQVHGGAAVRRKGGFLKPWPRLSTMHTPSNPSHIPAFLPGCDAAGRLRQDEHSGQGGGELGVAGGRQ

SEQ ID NO: 11987 - protein, 183 aa, Chlorella protothecoides
YFFPPSCVGETGRQGPAGRREIGHGALAQRALAPAVPPEAEFPYSIRLESTVTESNGSSSMATVCAGCLALLDAAPLSAPPPTTTPPNPPTTTRRAAEGPGGGRGHGPGSGRAGARRLPRAHRHPGRGGRAGRHGLQGGGRCARHLCAPAGRQGRGRHHGRGGGGRAGRGARRAPGGPARHGR

SEQ ID NO: 11988 - protein, 68 aa, Chlorella protothecoides
MPPAALTSSWSAEMPCASPATLKSMSPSASSAPRMSVSTRKPPGACASRTRPMATPATRPFSGTPGGC

SEQ ID NO: 11989 - protein, 277 aa, Chlorella protothecoides
MRSALLICDARESSTVVKIFRNFKEAQTLRLPYSAEGIHGGSLLGVRTPDAITFYDWAGGAVVRRIEAEVRAVHWSEGGAGVALVGPAATHILEYSREAAEAALASGEGVDEDGVESAFELVGEIGEPATSADGVESAFELVGEIGEPATSAVWVGDCLAFTTSSWRIAYAVGGETTTLAHADRPLYLLGYLAAAGRLYAFKTRVLRGDVDGARALLPTVPEAEHAALARFLEARGHLEAAAEVATDPAHRFDLALALGRLDSAAALAAESGSALAW

SEQ ID NO: 11990 - protein, 429 aa, Chlorella protothecoides
  MOD_RES (78)..(81): Any amino acid
  MOD_RES (131)..(161): Any amino acid
  MOD_RES (184)..(186): Any amino acid
MAYTFPCDQGMLGCMWRLTSSTDSCWIRGTQCDMCVTSQVRHDVAEFRGTFLCPGDGPSLTQRFIHEFHTDMVSGAGXXXXGDGPVSWCCHTQVGPCGSLRAACAHRDHHSSSTRQTSMTRSSRGQGRQAXXXXXXXXXXXXXXXXXXXXXXXXXXXXXXXKEGCVRWLVDWDGQCGNDAVFRXXXHWQSLTQRFIDEFHTDMVRRRCCVPEIQPCRPFSLPLLCTEIASDILPGPCKLQEALNCLHPVLEPRVTDNIPAIISMIQSILSMPLLSAVALRLVNLSWQCRTAEMSTPTAWMGMCTLRWRLCPIEEHRPHGRSNMGVVHLRAGGNGQHAIRAVTKPAINLILKEDNRAGERVDVDGRKRGPADFVLWKAAKPGEPAWDSPWGQGRPGWHIECSAMIASHFGEEGIDIHGGGRCAASFGRKY

SEQ ID NO: 11991 - protein, 258 aa, Chlorella protothecoides
  MOD_RES (235)..(238): Any amino acid
MYIRMSTRLCIPSLVRSLSAITHAPMLPVHAPTRMMSVLLGGSPHQQWVSATTHERSQEHSAYISSHSRSLVEDDRAASPATLQATGLAGQRRACSRMGSQGLASYRRNSSHDGSDITGPDLYLYDTATRQKRLFTVRDPDRTQPGVDMYVCGVTVYDFSHIGGFDEMDPVTQHVICGTEGGLGCWLMCAIPTGVWHAEVKAMTTASGLHPSPFRIPNQAPHPAPSPLPPTMSYXXXXSNRSLACRGPGHEHSLGATP

SEQ ID NO: 11992 - protein, 284 aa, Chlorella protothecoides
MASLELAKSGITTALRPLGLPDASVAGAASFVGGGLASFSSHAVMVPLDVVSQRQMIRTGQLRGGGASATPAVGPGGAAMARHILATEGVRGLYRGLGASIATYVPSSAIWWSSYGVWQTLLWDRLDALVGEGGAGAERTQGRTVAVQVRGCGGAGHRVHLGGADQPAGRGEDADPDAAARGGGRWAELGRDGAGPGGARGLGGVLPGPGAAHGQHLRLGHRHGHHLRVPETNMRPAPGKLRQPTSMLVGLAGPPGELASACPKLDSLAPAMRLLLLPCVVARL

SEQ ID NO: 11993 - protein, 187 aa, Chlorella protothecoides
MSKSLGNFFTIRDILGATPAAALRWFLLSTHYRAPLNFTPTALDQAADRVYYVFQTLADAEAAARAHDPEVDMDDGRPPPGEPCALLSAAARAHDPEVDLSDGRPLPGEPCALLSAVRAALADDLNTPAALAALGPPLRELNELAGKRGKGAAGRQAALLALRASLVHALRLLGLLGPAGDAGAPDA

SEQ ID NO: 11994 - protein, 616 aa, Chlorella protothecoides
MPTRDVDLDALLQRAVENFAQHDLGDALHLQLGELAEDDDLVQAVQELGPEVLLQLLVHQRLDAVVGPVLLVGVQLESDLAAALLDDGRPHVGGEDDERVLEVHGAALGVGQAPVLQDLEHHVEDVGVGLLDLVKQDDGVGPAAHRLGQLAALLVAHVAGGRPDELGHGVALHELGHVQAHHGLLGAKVVAGQGLGQLRLAHAGGPREDEGGDGARGVLQPHARAADGARDGGHRLVLADDAAVQHALHVDQSVVLVGRHLLDGDPRPLRHDVGDVGLGDHGPRLAPGLRLRRARVLGRGGDGPDLGLELHLAVAQGARLLKVLPAHRGVARLLGQGGVAQAHARPRLVDQVDGLVGQEAVGDVLAGKLGRAGQRLVRVAQLVVRLVALAQAAQDLHRLLHAGLRDQHRLEAALQRRVLLDVLPVLVQRGGPDALHLAARQRRLQDVGRVDGALRRPRPDQRVHLVDHEDYVVVLLDLLHQLLQPLLKLAAVLGPRHQQAQVQGHHLLALDRLGHIPRRDALGQALRHRGLAHARLPDQARVVLGAAPQDLGHALDLPHPPHARVQLALGCMGMVWRGAECQRGLQPACASTHQTTHTATGSSLPWVHGMGCRGAE

SEQ ID NO: 11995 - protein, 346 aa, Chlorella protothecoides
  MOD_RES (316)..(319): Any amino acid
MRRGLVDEGKATLRSVLGGRVGDGLVWCGLDDCDMQRVTELAPPLPSPPGKGAVVPAAMMRQDHRNDNYNMFDLIAYRIKFTEHPHAGDRWCIYPSYDYTHCLVDALENITHSLCTLEFESRRASYYWLLDVRVVLGWLPPRGPKSRGAWALRGVGGARSGTECRSVQGGLGLVWGWRGAVRVRVSIGTRRAVSDTLLRYWPWPIRTRVTPMAPPPPPAPGPGHLQARGLGVLPPEHHQQRAEQAQAEPAGDRPLRERLGRPPAPDPGWAQTAGRYPQGGRGWRGVKGRGHAGPRVVAAPCCGGSPVQALQLIAPXXXXPGSDHSMLGRGWPPRRAVAARPCKLSI

SEQ ID NO: 11996 - protein, 286 aa, Chlorella protothecoides
MGATGVGTHGMTSIPRRPIGVGARRCHTQDLVDGRSRRWNPRNDKHTSAANWRWGKALPHACPMQAVPGSPVSIDPRATSLPPPGNVLLNLLAGLVADVGVPPLDQLHRQLVQALKVVGGVGDPVGRPPHPRDDLLDVVDILPLLRLGIGVVEAQEAVAAARGGHAKVHEHRLGMPDVQVAIGLGRKARDHAPPRGAQVLRQPLCGVGDAELAPVREGHGGVALVVLLGSGQEGVRVGGAPGLLLRCRGAGLAGRRPALRLGGLLLLRVSWMGGALGESGPVDTGL

SEQ ID NO: 11997 - protein, 504 aa, Chlorella protothecoides
  MOD_RES (186)..(189): Any amino acid
  MOD_RES (347)..(350): Any amino acid
  MOD_RES (381)..(384): Any amino acid
  MOD_RES (410)..(413): Any amino acid
  MOD_RES (450)..(453): Any amino acid
  MOD_RES (472)..(475): Any amino acid
MWWGVKGGGDAERMSFKGGAPGESSKQESRQQSDVMSMRSQAMLVSMPCSSVSMSEPTACQLHQQCLNFRAYSMPAPLGTHPTITPPPSPMHRYLPAARAVAFNELQVLRALTGLPHAHEKFRAASSSLSANPPVVELLGYFLAGHSDSARRLEPAAILAHPENTIWGSSSPLGITRSACRAAQCXXXXGMCLDGGCGWRGPSSSLGIIRSACRAAQCSKCRPPARFTPPTQGGHQVGWLGPAHALPRPAADQRAGAGEALGGGRRRLPHPQAHAEVRLWRGRVGAWCDQRRGYRALATWHTASKNRASAVESRIVSTQMINKHQTFHSPNKHPLLFPPLPHTQGHXXXXGEGGWGPGVIRGVVTEHLQRGTLPQRTEAIXXXXTWASPAASSAPSPTAPAPVMLRACTXXXXLCYCHVRGVVHGSLGSGSVLLSSFDDTHAERLVVKLXXXXAVLLPRARRGARFARLRLXXXXNLGFARRVFCPLPDGASTGEAPCLHRSLL

SEQ ID NO: 11998 - protein, 476 aa, Chlorella protothecoides
MHNDPAIMFPRAPDKVPDLRCTLPVDVNPCSWPPLVIATLSKPTSYASLWITLNRSFFMLRRGLKPKPPEKGVFPLDHFGECKEVKEKYMACLRSNRDETRACQSLAEEYLQCRMDRDLMAKQDLRELGLGHEAKTESAPRPDESASAQRRREARGFVAGESQKERRAAPGQDLPSFKRVGADERAVGKIKQSEPAATHDEAILSTRRVPPCRGMGGAWPRFALDCGRGVVVDYITHFAPKICAFRRGIVVSWNSRVAEFGSPTVAAMHGQDLSTCSPALFRPASLATRRPFPAPPTERCRRLRGRAAGQVRGPGPDDDDDEQASLPSSSSVDIDDLVSKLSAHAGRMRAGAPAEPQGGQGTGRQRAISNMGFLLTPAGDEAHITESSIRASVGPGGFHASDFELLQELGQISIQQDSRAITICKGPPPDARTPLSAPGGDVAGRGGAAAACPAPQHGTQRRRDWLHGCLPLRHAL

SEQ ID NO: 11999 - protein, 374 aa, Chlorella protothecoides
  MOD_RES (65)..(68): Any amino acid
  MOD_RES (158)..(161): Any amino acid
  MOD_RES (366)..(369): Any amino acid
MGVGLTGHAAGQQPEPLWNVSWSKYAVQSGWLMHRAMAWLPPFRTPSDLSHPCHSPFPPSGDQHXXXXGSFNASNPIRDDVNPTCKPLFEKEQEVRIWWVFFSRSGGDVRSGGGGYILCSLARQHPCARQRLASRLCRNCLSMMRIRTSQHAPTPRPXXXXGGDLRSGGVATSCGAWPDSTHVPGNASPAASADLLHDLYDIPARSCDRKVNEFVKRVRAAKIHCLIMGHLRKQMPYFGQKKAQEKLMDNLANEFRQVQREYHLHAGKAGVGWGGVESGLTGGRGGLRSCIWIQHPADAIANVVHPADAGDFPDVNRYRDILSAFDISKFPKLDKSMIKQVSMRRWGGSSDSSRGGRVGVLFERRXXXXAAVIH

SEQ ID NO: 12000 - protein, 281 aa, Chlorella protothecoides
MVDPVRLCVSGLAPGVTPSELEARFHPFGSVLSCEMIAPKVYDSVEFHRGLAYVTLTPKDPAALANCLAVYNGCKWRGGVLRCAPACPDYRERLRMMQSDEVKLFEADVGRGVGSTRMSRSWCSFPGGGVSGARECQGAGAVVQGSSCVEQDFPCWIGPRETLPQLPLYSAQASVDPSGAEELEPESPAVLRLKGQTYGEVVTIASAGNGSHRALEGEDASPGAAELRAASSWAPLPVPAGANYTFEAHLAKVAHLAPLRQAPAPQETEEGEWERWAWVTA

SEQ ID NO: 12001 - protein, 228 aa, Chlorella protothecoides
MTARSRSGPASLHRAKAGSRLGSALGRGVSVLSKVDSAPPCASRETCCAWSTRGQAGDWYTVALMEPPARPGPLTDGPRWQLATTLRGDHSRTIFSVDWSRCAPLIASGGADNSICIHGVGEAASASPPQADANAMPSPPGSDSGPGSGPSLAPGLKVRSLFMPEHGFQAPPVEKLAVTLSHKEAAAHASDTNCVRWHPTIPGLLASAGDDGILKLWQYDQEAEDDAS

SEQ ID NO: 12002 - protein, 119 aa, Chlorella protothecoides
MDAVAECAQEGWGALRGRIGAAALPDLMHRSFEARRRLYGDEAIGRRTLAMVKLARSCRAEASLAGSGGCVALCFREESGYIEHLPALQAACEAADFSLVRLRIGDALHALPAHARDPC

SEQ ID NO: 12003 - protein, 395 aa, Chlorella protothecoides
  MOD_RES (5)..(8): Any amino acid
  MOD_RES (147)..(150): Any amino acid
MPGNXXXXKEACKPPGVDVSRAPDVCLSGTPVRPAWIYFREYRPSPPPMPPLKAPVTHRVHARAGLLGNPSDGFQGAVIAVSVANFWAEVTASPSPRIDILPSPDHDPTSFGSVAQLSHHAAGYGCNGGVRLLMVSCPTSPPPFHPXXXXLARSCASMSIPGGWKQRCPGELPHVTPSLPTREPQAACHQFQQHCDAAGIPLPPITFALSYTTNIPRQAGLSGSSALVLATLRCLIEAHSVEDGISAFDLPSLALAVETSLGIAAGLQDRVVQTFGGCVYMDFSELSSSGQGVYLAIDPGGDALLSGHRGQLAGIRGNDRSADRQHNARQHCVLHGDQAIVKSLTFHPPTLPQRTCRPCSSSSTTIPPGRPADRSMHSSRSAGSQETVQSGAGAL

SEQ ID NO: 12004 - protein, 244 aa, Chlorella protothecoides
MESHWDPFATNASTVHEPTSVSNDELYLSWFQTADTDGDGRLTGPDAVTFFQRSGLQRDALAKVWAAADYSRRGFLDLPAFAKAMELISVAQRTGKVGGEAYTQAKAMGVAPPRMAGLEKKAGPGSHTERGGINPFGGAESSVSRSGRESTPRLASSPPVGVPPFKLAFPPQAEASSHPSTARTTSRRHQSLRRPVMTTKEAVGISEGLKNIYFNKVDAYHARAQCLVIVGTCFSGVVVSYKPA

SEQ ID NO: 12005 - protein, 343 aa, Chlorella protothecoides
MHGVGTAKDWNRCECCRHAASTEAPSPSGHPSRTQVKVKRRDDDSKFLAKVLAIGTECDIALLTVEDPEFWKDVEPVVLGPLPQLQDSVFVVGYPVGGDTISVTSGVVSRIEVTSYAHGATELLGVQIDAAINSGNSGGPVFNEAGECVGVAFQSYAGSEAENIGCAGAWCRGFWMLGSKVPWEPMLPAWGRATSVPKGHLRGGSGQTPSEDGTPGRLCFLPSMGHLRGGSGQDPSVDGNPGRLCFLPSKVLVLHPYLPWHAHQYVPKPLPPAQLRDPHPSDPPLPGGLPTKWHLHRLPSPGHPVAAHGVCDAQACDLGGGEEGVLPRACRLQNHTTCNTASR

SEQ ID NO: 12006 - protein, 247 aa, Chlorella protothecoides
MAVNGCCVEDWPLVHAIAAAHGEMVVANYGLHPWWVGRQPDHWLDLLRQRLLANPGAGLGEVSVFKAQLLLAQELQRPLSVRSLSGSSWHPSSHPPQVHCVRAVGHLREALAEVRPTAPVLLHSWCGAAEDVRAIASAHPSAFFSVSGGISALPPAKAIRTLRAIPADRLLLETDAPDGGLRLGPAWLEALPGFARSAPPCPERQEPAGLRRMLALVAAARGEGEVGLAALTWRNACAVFAGLPAAR

SEQ ID NO: 12007 - protein, 159 aa, Chlorella protothecoides
MPLMPQVTELMLAELLYLQYESVTAPVFMYINSTGVAPWNRLHCQGKCPESVLRNLRKLSSDSAPSAWAIQGPDPVITLTNMTTERCREAGIRGRGFCHLRHHVLHQAASGHDRHRQRLWRGGHAAGGGGARAQGRAALRQHHDPAAHPAIPADAGDRH

SEQ ID NO: 12008 - protein, 208 aa, Chlorella protothecoides
MPPKQPRSTHCTPQGLSQFGNGFLSKFESAQCDNRLLEEISLVDTPGADLGPGHALRQAQYVSREESCCGPACELVGKNLLSEGAQPCLRCMLRMALHLVHAPPHHTSLHAGVLSGEKQRIERTYDFIQVCGWFAARCDLILLLFDPYKLDISDEFKEVCGEEGPWGSPMSRRLGDQREWGSQDTQLANSQSQSGMYHGASTLCTVVC

SEQ ID NO: 12009 - protein, 253 aa, Chlorella protothecoides
MPPRGRPHHGLVPPQADEARLPRASPSLQQGSILLCRGGAGVHQSHRWEAWEGRWGSASTPARSATREARAAGLPARSMPPPSHQPAAEPYLASEFGPDYLREAPVKLLDRLLYTHKDRPGQQVVMLNQVLACEATIGYEDISNSQRILKDVRPFVAVAWQVHTPHTPEPFTWQVAKFNDVKVNSLQHLVELVQENREPFMRFNLESKEVLVLDASLAQACTEEMQVFHSIPHALSKDLREALGIPVVAAQAA

SEQ ID NO: 12010 - protein, 88 aa, Chlorella protothecoides
MAVSLQNPSHRLDPQVGVTAMLIASKYEEIWAPEVRDFVYISDRAYSREQILQMEKVMLNTLRFNLTVPTAHQFLSRYLKIVDAASDT

SEQ ID NO: 12011 - protein, 115 aa, Chlorella protothecoides
MRVVGAFSSGRPPHPPRTASVRVACAQPRDRRQQAGRGASQPVQEVAPAPHVEGIVSKGYHALHDPHLNTAARYLGEVPSMPEGADGLETGCMLRRRGSHLLWRLHRSTLLDGRV

SEQ ID NO: 12012 - protein, 117 aa, Chlorella protothecoides
MSFKLAVSARDGRTILPKGEKYISLADKEDFKGGHCVIHRLHCPPQDATVADLKRGIADSRPELYTARQRLTTVAEKGKKGTVLEDGKKLAEYGLTNGDTVVFKDLGPQVGDSNQAP

SEQ ID NO: 12013 - protein, 347 aa, Chlorella protothecoides
MLSRAVGFHLFPVNCVPSPTTPSSQAQLEARRAVSAHIRSRFLGGFAAVYVVILAYAAWVARAPPATYTYRQHLTCVAPAMYAPPAAWLLYRLLSAILQALDSYSARKVALLDSKLRKMVAELKLPSIALACTGVPLPTRRPLVLPDPTQESSRYERTLALLKKYDPEYKPPLPTPAPRPAAPAGRAPGVQGPRPPPQPQPAAGPKVVPALTQLWTRAADRLIADDPVALRLLQEAQREAAELRAALVASETETLRLQAQNRHLLTELGVDMGSDVTGHQPQPAEAGVVEGHAMPAGGEPAVAAGETALDTVAASGNGKTGAAGSCDPTLKEPVTERPRSPARKRLV

SEQ ID NO: 12014 - protein, 59 aa, Chlorella protothecoides
MAPGQKGVLVREVLPLSEAAGVLQPGDVLMQFDQTQIANDGTVGFRSNERIAYSEQAAG

SEQ ID NO: 12015 - protein, 149 aa, Chlorella protothecoides
MHLSEMARPPRRRPPLLPQSNAQLDAALEFLAQTGSEPLDAGALDEAAGVGVVVTPEQISAAVASTLAQHAQRLQEERYHANTNVLLAEIRAGLKWVDLAAAKAELERQVEALLGPKTEADCVKPERKKKIKVWEGGGRGGEGRLHPEG

SEQ ID NO: 12016 - protein, 312 aa, Chlorella protothecoides
MATGCPATARSASRAPAHAGPAARHAPRPQRVGRPGAPGASKSLRFARTPMAASVDNAQAGVGKLISKVEIPAFIPRQDMMNQLFRWASDLEDNGYALIGSPCKESASQASPSTVTSLASCHTLGSCPTPVALPQITPLMEDEQVRNFTISLLNSGVSVADILIAFDEDVAVKHEWIGMGPGETRRVGVSKGGSPVVELGVSLWLRHGMGASLHAPAPSAAGKVDANPTTARNVRGIPGGPLAPSLAHACPQTSSQCLRATDVHGKHLEVRKTDTNSVSDALRAALHLLCANLAEAVNKYYAFGSCFSEDAT

SEQ ID NO: 12017 - protein, 81 aa, Chlorella protothecoides
MATQTREEQEAEATRLFEAIQLAPGTLAGAIKNVKFRQALVQTVREAGVESGCTKQQGALLYTVASKVMGGVPRDQDRALA

SEQ ID NO: 12018 - protein, 567 aa, Chlorella protothecoides
  MOD_RES (29)..(31): Any amino acid
  MOD_RES (307)..(310): Any amino acid
  MOD_RES (519)..(521): Any amino acid
MVHQISMWPLPWPALQYRMLHAHHQHVTXXXGGRSISSACGHRPGRCCSITCSMHTTNTSHPDARAPIMPLRRHHPSPHHPFPSLNLPTPVDAVNDAHSATVTGRQAAACTAQMERYLAQYRSRLGMQACLALQQLLLVSRAVGRACAARPQGSQTGEAHARSLNAFVLEHGLEGVNIFQLLRAGGPLLGSSMSGVRKGRMMSPPPPSISTTTVPGMEAGKPGGGGGGLGIEAAGQGPLHALLSLLRGLRSADKDGRIIVDPGGADGGSLRFVLVDAGRLFSSHAGPALWVMWCGEGINGSCACAKXXXXPDAALGVSMRARRFGWCGAVRASMGAAPVQSVCHRVDTAPTAVLHQIVSEARSVILASGTLSPLGPLLTLFPGVPMDRLHRFSCGHVVGKERCVVLGFEMHWGALTLPLSLAHGAHLPSWPLKTLFLQAAGPGSGLRVIRHPLGLSILQAGRPGGAEGAGPGAPERLPCDPRGDHCLLPLPPLYGGGGGEVRGVQMLDNWDAGHAVRLXXXTRRRSSIRSLSPCPASRSCAPLRLISILPWVSHALRASDNNCRNGL

SEQ ID NO: 12019 - protein, 710 aa, Chlorella protothecoides
  MOD_RES (208)..(211): Any amino acid
  MOD_RES (230)..(233): Any amino acid
  MOD_RES (258)..(261): Any amino acid
  MOD_RES (628)..(631): Any amino acid
MEHRGRTSFWGCVVEAGCSHTFDPPSHSFSKLHLSQVGVSGVWGETGRGWESGPAVTQSWLWLHSPPRLPRRDHHTIPSPAAALSTDAKPKSKATLEVKTRDSLARAVVTLRAGKVEHASIDLVIDEQVVFLAVGDADIHLTGYHMPEFEGEEGTAGGEGRGTDLGGAAVSARGSGSRASCECGVHTRWVCTLHDPDRPTTALCEARXXXXAGCCCVCTRERIKSLLPDXXXXDEQVVFSAVGDADIHLTGYHMPEFXXXXGEDYSEEDSEMDPYEGDAMGVGLDGEDYSEDSEDYSDEDSDEFSSERGKGGLPASQAGVQPPVLCTGFVSRALTAPQRGPSVLSAISRETAGDDESDLEAAGEVRRPTPEIRELPADAGEDDVEASDDTEADDEELDEDESEEEDESEEEEEQEKAAAPTPGQKRKEAATPVAQPSAKQAKQAQQAKEAKQAKQAKEAQVTNQAKQAQVTKQPAAQTVAKQAAQPVAKAPVRAETAKPAKEAKKRTFPNGFEIEVLKQARPLGWKGLGLPDAKFAKAGKTVSVKYTGRLKSSGKVFDATKGNRAFNFRLGVGEVRRPSGQGYGQALNMLGGGIVRSTVGADSARGVHHSSGGLNGPPLLPAMMQQGXXXXHDLPSIAASNDAAGLNFDPAILGHPQVIKGWDRGVEGMRIGDKRRLIIPPAMAYGTSGAGKAIPPNAWLDFEVELVNVK

SEQ ID NO: 12020 - protein, 224 aa, Chlorella protothecoides
MEEEAIIKYRYLTQTYALAAAAAAPCLRRGAGPEPRGPVCGAPTCLGCPTLLHASDPRPETPRFFQFRTALTSGTAAEARALYDDLLVDLHAIQSALDRQATGARATGARVAEREAALFAAEQRRLEAGIAATRGGIEAARRELAAAQADLRHAREYEALRRSVAQARGLEEAMARRRAALTGLLAVAAGVAAELESEALAEEGALPETETAETVAGPAASLDR

SEQ ID NO: 12021 - protein, 275 aa, Chlorella protothecoides
MKPPPSGPRTHSCTPPPPRRERLRPPAHEAALSSTGSDLHLTVQHRRRRASYFSGDVMEVQQQGGEDGMTPPWARRVSPALAARSDVARWVTRELQAILLQDDVDLLGQHLLGTLRGAAQLGGGARRGTNGGGPSHAVRWSPFWSRVLEVCCAPWRWENGRVALVQCSLAATLKPHSPLCKLQDLCTRLGTAAGPFLHRHATRFAQQLVSFASSGQSLATWDAAAAMAEEVLVAGALAASDGNAATTADGDATFTVVLSGLEDEDGRQPISGGDG

SEQ ID NO: 12022 - protein, 141 aa, Chlorella protothecoides
RTHSQLSQFVGELRRTRFVDSLSLVVLGSRGALCINDAVARLGSPAAVNEACAELQRRPAPRKKAGSGERTGGKGACPYLARGGAHAASLRDMVLAHPIDIEELAKLGELGIGPCQGAGGVAPLNPLGPREGGPSPGRPAD

SEQ ID NO: 12023 - protein, 424 aa, Chlorella protothecoides
  MOD_RES (116)..(119): Any amino acid
MQKLLNPAPAHAVAKRRLNCGADSESEVEGPGTEPGLAGLPRRSRAGTFTEVQVCGLPLLRCPREFADLTLPCQGAGEATAPPPLFLNQLPCHPSPSPGCSQANELRRAFEACNGXXXXPPLFLNQLQCHPSPAPGCSQAKELRRAFEACNGAKDCLSRVVQALGGRFKKVHVSRQLAAMGLAKGKFTPDQDTLLAAYCEEYGGSTPDGRALIAERLNAGFSATQVKRRLQALGLVAGPPTAAGKQARDWQALLGSSSDEDGSEGEAGPGDRGSSPVGDPAVEVRPPGSVASALDAEESGIEGEGGAESGSQASAPPGHLSAAEPPEAAAASPESKRARLEGGEDVEQAAARRKAALQALRQCRLQQQVAAGEPESRASDPEPLLSAREAIQAPDKSSGRRRLKKAGAAPASLLLDAGLMDEDA

SEQ ID NO: 12024 - protein, 628 aa, Chlorella protothecoides
  MOD_RES (464)..(466): Any amino acid
  MOD_RES (580)..(582): Any amino acid
MLAYGSPPDPRGHTRPFFSPRPGPFLQLCGRLDPRQFLLSRLGPRTRWRGAAALPPVPGPGTHHGHGGRQASGCLRRHEPAGGWAAPCLPGHLSPAEHPSTNLPTHPPQVQPGRHPDRHLPALLRRGLRPGDRHLAGAHAAALRPALPPVHLRGLLHPGPHCADARAGGAPGPACRQHHRHLCLVADGGGGLQPGRRGHLQARRPRRFPPGAMRAACTWRSGACSAGRSVPSESAGRSAGVQVHGYPHSLPRAPQGTSTIHPPSSPSRNAQDAVTYLVSAVCAAQVPRALGVPGAPAASTRAREGEAQPLSLELAAMEAVGCDGGARTACGEGSASDSEPEPLASAGRSRALPGMASVGRSGILSSTGSIKQGGMLHSADSAVLRYDFGSQLAAGWRTVTEGCRYLAAPENRDVAAMVTLKGAGSLSWGCMDIMNVRQRQPGGMRRVPGADRRPAGAGSMAHVXXXIPPGRPHRVMGGRDAQGAWRRSHARRCRIHGTCSPVNLAAFLFVERWSASPLVFLQAPCLPAAAIPPDQFPCQPTPSSSPLLPPSSCLPPAVYASAHTLPTPTPSRPGSATYPXXXHPLLPVHPFFLHPPVFPQLSMTPHTHSLPQSLPGPAQRPTRDAAPG

SEQ ID NO: 12025 - protein, 186 aa, Chlorella protothecoides
MDEEVRALEAEVTVAAQQVATLRTSMQTALQEELALRLASTRPSSEASPVEPDADAGSASREPASPAEADADAGSASREPVFPALEPGLQALQDQLEAAAAQIPSLRARLEESISRMSRIATAMQAEEARAREVAPGTVEKVLAGRTPGPGSDGVAPSSPPSSDEEAEEGADLRRALAASLDRPLD

SEQ ID NO: 12026 - protein, 826 aa, Chlorella protothecoides
MSLRIASSASTRPGFSVLHATLRLPSRGGIRSLELSDHSPLAHAAPTTTGITHPTPRQRHVGARAELGGGTDSKLQLAAGVAGVFAAPLVLWSSYTLATTGSGLPPGPSGVLGAAEGLSYLVVTAMVAWSVKTKISSGSGLPAGPYGLVGAAEGLSFLAIAAATWCIHNMPSRTSYIKCTNLCRHHRICCQDGQQLSSPHLDCRACLTDDQRLAKTIPLMLLAKIMLALTVAGLAEVKLSRGRRREHDILSQLGRAMVAVIKSPADKKDYRYIVLDNGLRALLIHDGEIVDTTQEDAEEAEPVSHSGSSSESGSESEVSTAGSWGSDAEGEGDIEAEAPAGGVKKAAAALSVGIGSFSDPWELQGLSHYLEHMLFMGSEKFPDENDFDSFLTAHGGASNACTENVRWKTERRYRPSPLHASSPPCLSPPNVPSSPQEATTFYFDCKPSALQGALQRFSQFFVAPLIKADALEREVQAVDNEFTGVAQSDGCRAQQLRAHTARPGHELSKFGWGNRRSLAQEPAAAGVDVRGGLVRHYTQQYSAERMNLVLLGGETLDELEAWVRDEFRGVPGGRGPRPSYAEAGFPFQVTVVQVLSLFCQWGGGGKEGEALLSPWDVICGQPQNCASRCILGLDDNTIPCIIYPTGRQTLLPSGSTAGASPAAHLPAPMPACRVQAAFKIRGVLHAWSAACLTLCMDYADSVSMIKGLYPPKHHHQKVPAVQIVPLGHDVESPPSLNNTSTPPYTGRRLTTTCPTSSAMKGGGHCCQPSRAGAGLRSCLAASPSRAPHFISLTLSSPSLRQGWRTDQVHGGWKQGQDALVSTSTPD

SEQ ID NO: 12027 - protein, 750 aa, Chlorella protothecoides
MRVGGLEAGGKHGARAWAGCWGTRCAPPTLAPSPSTMHTISCTPAGRCGSGSDCEWGCSGHHAAEQAGHRQLLQIDLLVEHPAPRLVYSRMGQGMTPPTTTLSITPTSHHPSIHPPSCALRSCPSKAPSSSTISLPAIPPSAMPPAATTARHDSSLGLLTRRFLSLLNEAEDGSLDLNQASDILRVQKRRIYDITNVLEGVGLLEKQAKNHVRYCSGPETPCAHREAGRAAASRGGGGGAEGEAAALLAEIAEETAAVWDAMREMSAHALNKQRLYVWDRDVMGLPGVAREDRVFVVLAPHGTTLDHSPCQEPGPGEAAPPHRSVGWVGVGTGAERERHVYVWGVIEGERHVYVWGGIEGERHVYVWGVFEGERCVRGELGQGRPRIALPVRNRGGACLWPAARRALLCHSTVIRRARCRVLCPSAAQTLRVTASSQLLLLPCLPRPPARPCRPLPTGSWCGARRSPSPLSPSPWRARPCSLGGAWAPPSSRRRPAWRPRAGRGRPSSCPGQASRSVRRRPAPWPTPGTAPSPPTAPARPPATGCPWAASWTLGRGAACFPDSTASRAGRLRTHRPFWRAAARMRAVHETRVGPPALAGAGHTSMSLGEGCSPGRLWGPGSSRDRAAPCPCAHGAPTSVHAVQLFRRLSTSRNTFPLFQLHPTLSSARPDVTTSHGLASQPVCVLKLFGAGGSVCECDEYEGGHCQAARLEKGVTGPDVGQSMLCGMDAAAPARRRMHLAAVVGEENWGL

SEQ ID NO: 12028 - protein, 505 aa, Chlorella protothecoides
MEGDKCLRPTSEVGQPSVLGVAAVHVLREFTPVSRTSPGNPLPTCHSHHLQPSPTPQESWRTPGYSLQLLLPAVQALLDAWRDTDALFSSVRSWSAQPIGLRHPFSFYYGHLASFARSRLLPGRPAGHLDLLYSRGIDPCVVDPSRCHDHPPPPPTWPGGEEVRAYAVGVRAEVLADARALPARTHALHMVLEHERMHQETLCYMLAQQRGADAALTQREGVLGALAGRWAGCSYRATEQRRADAAWVHVPATQIQLGLGRAARHGFVWDNELGMPAPQAVPAFRLASHPVSVREYKAFMDEAQVGLPGWILKSGWPRCGLLDLSVSAPKFYAQLHCRALDPRASPPPSPVPFQPYEREGLWSAGDWAHISSSGWKRPAGWILDQEGRLHVGLPEAVYQWEEVADSPVYVSLAEAEAFARWAGGRVMTEEEYAAAVQHKELQGLLSSVAAEADEQATAQCLESGGWEWTSTPFKPFQGEAGWQEVSRGHAMMKGQRKYMILKDGC

SEQ ID NO: 12029 - protein, 259 aa, Chlorella protothecoides
MGHELPGCFCHGLPNLRVSRLQGAADRQSESGRGKEDWSLRGYPSSLLTHSHWLSSQELTSAVWTPGSTPTCSTWARAQPYTFRLPHTLPGSPPDWFNQDGQNWGFPTYNWEEMAKDDYSWWRRRLAQMARYFQACRRDLGGRKEECSPRVCDTYLGGDAMAGHREGRRCPGAPSFLRRRPPLATSHPGTPPLTPCLHTHPQVFRVDHIIGFFRIWEIPGDCWSGMMGHFRPCIPIARAELEAKGIWDFHRHVGHKEAG

SEQ ID NO: 12030 - protein, 709 aa, Chlorella protothecoides
MGLLQVLNECGGQRPEHDASKRHVVTLVILQILCQNAASQHQGCEYPLRHRARTLLRSNACRSYLSHPCKGQGGPAPIRLTKGHPLPFTDPSVLCPSMKSSPAVADGSRHIPAELGGGCVGAPTPLAGSHAEESATQWANLQSQQYTGGPRGRRPHHRGKGPRLPRRCEPFRKRTSWNSLHALPAACPDQGDLIGPPSGVHRVLCPGSGPLSARLLLALDPLQAVEGRFSILDNNATNGTFLNGSPLEPESWHVLEDGDILHFGGPQTVKPKGAFIPNPWAFRFSSGGGPEADSGTGTEVPCPIAHLDSQPRREVYSFSPARSLATSRQREWVGPVFADENTRHAFNLEAEALLQEQADRSPCSNPAGTKKAWKKGPCHAADLLREREAWSVACLLGTPVSRITPELLPHSVSARHSGFSGCQHSSKHLSHRATPAIGRRRGRQLAAHRPCGVQEEGPVFGTDAAAPPRAPSEEVSASLAIPASPAAPQQQGPATFQAEAWHPATALSTATSTSPDKDACAAEPERGSSGSMLPRPASSPSRPRPKRAGEELVGGRPRASVSPEGRAAWAEARRLQLDAITEHLVCAICQAGWRRKGSLQGGPDPPGTCGCGGSLQSLVGLGRRRRSPPRRPVPAPMHLASLPLQENLVATHVLVPCGHLFCGACLGDLYRSFKDPPQCPTCRWVGLRGTWPIAALGKEAVSWGRCVRV

SEQ ID NO: 12031 - protein, 308 aa, Chlorella protothecoides
MRDHGIAHDSAALEQRWLLRMQGLALALGRVPVVWEEAFGRAGAGLDPKTLVHVWKWWGEGREREQGAAALASARRLMAGRMAWEGPGWAAEATTTRSMPLGPGLASPGPEDPRVWAAKLSAVTAAGHGALLSAPWYLNLGTFAEEDWKRYYAADPTAFPARNSTQVRAGRPVAGRGHPGKLVWRRRGGALTRQPGATKSRPGLLPPLLPQGQWQEHPAPSLPHLPCSLPPVQRDLVLGGEACLWGEFIDDTNALQRGWPAAAAVAERLWSPGTITSLAAAGPRLAQFRCWLLRLGIPAAPLGPGSCQ

SEQ ID NO: 12032 - protein, 187 aa, Chlorella protothecoides
MHGLGTPSVSQSPFSTSPTPASPALRIQRMPSGQEEFGDPADYPYMCVASPSSHDTTTTRAWYEEDAPRRQRYYAQVPQGPVGAEGRSRQSEWRRGMHAPASFETDVLGGEGPAPASCTPEIMRAIAQQHVDSPAVLAIFPIQVCWCSRAGVWGLAKRGRPTRAMGSLPPRQSSRIANGSGGALLAL

SEQ ID NO: 12033 - protein, 358 aa, Chlorella protothecoides
MLQPSQPTCRRTHSGPPPFFLRFLVPLLLVHGNLSYYRIARLIKYSFYKNITFAFVLFYYQFYNGFSGGGEPSALHRDAAAWRVAACPPLALLHHQGPPPPEALPRTTHSLDTCAPQSVAITLPPITPFPHLAGQALVDSITAAVFNVVFTSVPILLFAVLDRPVADLKTYIHYPRLYDKSELHTLTTASFWKTGVAQAVVHAAVCFFIPYYSIATSGRHNITDVYSLGKLAFVALLGTVNLEVALVARYWTVLFAVFVALSYFLVYPYMAIFPLIQLGLNIYDPANVGVSENVLASPTFWFVIIICNLTTFGLRFAERTADWSFKPQDTMIMAEHEEEARKQGKVSGCGCGVGGGRR

SEQ ID NO: 12034 - protein, 488 aa, Chlorella protothecoides
KSDPACPRAGAPHTPPWPPPPPQTPRLQGPSPDEVALVEAARQLGFEFVSRSQTGLVLSMLGEEVEYEVLNILEYSSDRGCMSVIARAPDGTIRLFCKGSDAKVMRKVRPGTDPVLLRQTDENLHTFARQVGFWRGARFPSAGARGGARRPDRSWHPGPSAHDRGAGAPVPRPLLLAPQRVAPRLAWARHRPPCAPEHSPLDRPLLAPLQGLRTLVLGTRILEEQWHAAWDARYQEAASSFEDRDGKLDALGDEVERELELVGVTAIEDKLQVGLGGGRSVLGPSVAAPQRGAGARDRRSCMGQGCLCAVGSAWSCPCSLASPPGPFTRWGPAPTTPTPCVQDGVPAAIKTLLTAGIRVWMITGDKMETAVNIAVSCQLVKDPDSIMMLVGGDVSWQANPPASQILSSLRIASLARHNLFQDPPLRMPPHAVTTPHPASNQPCMNPCRPGHRGGPPAGLVHEAHAGDIRAEQRGACGHPGPGPALLAG

SEQ ID NO: 12035 - protein, 79 aa, Chlorella protothecoides
MRGASGRHYPIPHHSPPPLPAPPGVHGPAYLESRILEFLAGFVSTLRGMPEEEFENHRAAVISAKMLKVCVCVGEASVR

SEQ ID NO: 12036 - protein, 164 aa, Chlorella protothecoides
MAVDGHTLNYILVDEALSSKLALLAAHCSGVVVSRSSPSQKAGVVRLMTAYEMERVTGTRRGLRRWYARYKRRLSGKMLSIGDGANDVAMLQTADVGVGIMGKEGRQATNNSDYAITQFRCSPGGGRGGSSRGVAVGRGGASGAEEWVGLGGADVVQGIGMVCV

SEQ ID NO: 12037 - protein, 278 aa, Chlorella protothecoides
MQDAVPRRPTFNLHASVVPHSRFIQHLRLAPEQPPQEHPGTQSDDSIGNATAAGGGLSATSGSGPLPDEVGHHHHRRRRHHHRALQITAVHVTVYLPDQSLGPATNDSYSLAVAAPAIKLHAVSVYGALHGLESLAQLVRRRPCDGLCGAEASSEGPEQEGEADVPNGHRHHSRKRHRRRTPLILGVQETVIHDAPRFPHRGLLIDTARHFLSMDTIKAHLDAMSASKLNVLHWHLVDDQSFGYGSEALPELPAQGAFSKVGLLYEGALAMVTAARLL

SEQ ID NO: 12038 - protein, 192 aa, Chlorella protothecoides
MAQHRSMVEEADGMWEAVTSQKYDFDARAREVEVLQQLTLPEVKVWGQGMSRAGGGLASQSGRWSMHGLVGAMEVVWKISPLPIHQIHVSIVLSLPRNLQSPSPPSKAFYEECIAPSASTLRQLSVHVVGKAHQAELSADAGEGVTLLSDPSSLHQRLPLADLEATDPGAPVGVPDAGPQSDAPAAKRLKGA

SEQ ID NO: 12039 - protein, 149 aa, Chlorella protothecoides
MLPSWPCRHCCRRPAALNRCRGSRAAAPLPAPTPCRGHKLECSHVGSTLVWQTSLRVAHPADLLYKYAVVDARLNVVKWESGSHTLHLPADLVNDAIVTVTDVWEVRCCEAVLVRDSVDCGAGAESLLQGVLQQEGPRGAGAGVILLVT

SEQ ID NO: 12040 - protein, 297 aa, Chlorella protothecoides
MARTSSCLLFSCGKGLEQHPPALLPLPGACLACRPGRCHHAERLTHPPRSEVVLRTLTVPEGMSGLAVSAWPRIHETLLLMRRNVLLLRDPEDPQKLYPVRRALGRPSLGEGCVGVMTCFLWSQAPLLLQRWAALHHLPVQQARTLQPRSQRFDLTKTTSFAALDNVAWAEELAWQHDDYFYRRQVSHSFMEGPGVAVGRASSPGRQAGTVCRTGGPSWFWVQPHLSDCVCPTLITRQLHTLPYLPLVLGTGGAVEGTGSQDAARPPFILRHADVWRGPGVHAGVCPTHHGGAGDPG

SEQ ID NO: 12041 - protein, 83 aa, Chlorella protothecoides
MKQGVEPWFDFQYVEAVIPGDLLERWQGARATEDMSLPPPNHFVPTDFSLCCEEAKLPAEEGPFPAPPALLVDEPGLRCVEDF

SEQ ID NO: 12042 - protein, 212 aa, Chlorella protothecoides
MPGCFLPCLAGEGQSREGAGQSSRPEVPSSPSTPPLPRFLPAPSPRPLHLPCTAPKEGPLPLLVVRNDSFFRHERRWRGAGVAVPVFSLRTEASVGCGDFADLCPLLDFCRNTGADDGHERSEEGFAWGPKRGQSMQRGIVGGRGFLANLHSMLSACHRSDSSHDTRRAVGGAAAPRERHLGQGRLAGLVSILLPLRFCAAPTLPLPGPAAR

SEQ ID NO: 12043 - protein, 101 aa, Chlorella protothecoides
EPELRRRLWRHVGVLSGALGLPSRSPILPVVVGAEARALRLADDLWRAGFHVPAIRPPTVPAGTSRLRISLSAAHSDADVVALVGALQEQGLAGASAAARL

SEQ ID NO: 12044 - protein, 603 aa, Chlorella protothecoides
  MOD_RES (47)..(74): Any amino acid
  MOD_RES (338)..(340): Any amino acid
  MOD_RES (396)..(414): Any amino acid
  MOD_RES (503)..(506): Any amino acid
LAAATRDELAAYVDGLGSARGAPGSNAPGEPGPAHARAAAALFAAGXXXXXXXXXXXXXXXXXXXXXXXXXXXXGDHGRQAADPGADPGLRQGARCCDPGVCSPRAAARPGECGRGDAVSGCVWWGGWGPGRRLHADEERHAVAALRGCSQAAPRLDSRHPACPSSLRLQAHAWTALGKMCLMDEALAKLCVPLFVQQLRSAAAPAVRNNIMVALADLVVQFTALVRKARGGPQGEGGRWCWGHGEGPAGRRSVGQDSQSRIGWLDPTPGVRNERCPGGRPRPGPGGLHHGRQRGRALPVPGAAGQPAAEGAELLPGRGGGTRQWGTGGDSAADHFAXXXGGDGRGGGARQWGIGGDSAADHFAVGRVAHQHCGVFSNGEPSRCPIAGFLQRSGPXXXXXXXXXXXXXXXXXXXARAPVPPLPPGVGGRVPRRRAHGRIPAGRRAFQPGAEVLLGVGVGRDQGEHGPAPWAPCIAAISSRSIPIHSPSHFPSARRPTWRTTTXXXXEVSTGCAMGAMHRSDLIQKCTNPFPLPLSLRQAPNLAYNHFVESFFVLNACREGPGAGAAVAACMDLDAATGASVCGGGGGDAPGRRPATRRLDGAS

SEQ ID NO: 12045 - protein, 171 aa, Chlorella protothecoides
GYGAPAAAAAAPGYGAPAAAAGAGDPYAAAGAYGAYGGAQGYGAAAYGGAMCLFGFCFLRWGGGKVAQGLTPWECDCGCGGFVQVSTRPSLCIARSEDGMAFVGGPHAARGDFSRSCAPGGAQAGGPAAGGLPGASAGGASQWQELHDDQGRAYYYNATTGVTQWERPADL

SEQ ID NO: 12046 - protein, 422 aa, Chlorella protothecoides
  MOD_RES (64)..(67): Any amino acid
MVCSLPGTLLPGRSAWRRTPWHVQMWVPSVHRSFPLTARSQTPSSPPSMLSSAGAGRAGPRPGXXXXHPALKHPLPLHPSFPQLVRDVLDRAQAKGVNVVRAWAQAVTPNYALETAPGQYNEAVFQGLDYLLDEARQRGIRLLLVLLDNWQPGGADTLANWAGSNVHEDFFSNADAKRLYQARAEAIVTRVNAINGRSYSEDPTIFAWDLINEPRCYRCGATTAAWASEMAAYVKSLDGNHLVTIGEEGFYPAGQAASAANPQGLQSWAFEEGQDFYADHNDPNIDFTAIHLWPDNWLVGACVARAPCIRAGGGGWAQRHEPRLAGKHTAAGLQEILYEEPTGGGVAASTPGCKGEKVGGYMASMIFRNTYCARGAPNQRPLMLMPLPLPPMQDKTTDFVERWIAQHIQQAASLGKPMLLEE

SEQ ID NO: 12047 - protein, 645 aa, Chlorella protothecoides
  MOD_RES (232)..(235): Any amino acid
  MOD_RES (410)..(412): Any amino acid
  MOD_RES (487)..(490): Any amino acid
  MOD_RES (526)..(529): Any amino acid
MGGGGDGAGLVEGGLCSATHGPTTPPALAGLACTGQVGPTRCGTSTTSSSMTSSKRCCKGFAGGDWHGTLGKGHRHTHERGTSIRLYSTPTILCSNNFANGDRAKLIAPLTPPPIPLFGPPLPALQPCVTNLPQDAESGGPSGGALFFQYYAPGQQAPSEEGGGITGVFGVVEADNTFPIIDAFTASMAQLTGKSVSQCSATSGVSVTTVRDCSYTQVNGRPGTGRHVRAGXXXXHDCAINRLPTCPGVMYEGPACDVDINECVRGTSGCAITGAACTNSAGGYTCACTLGYAGDGFSCNPTPTLDQLQLNYTTQGAAQLACDEGQDVKYPTGVPGFAYDPTGGLSRADGASDAMVGPRGISFLWGSASLRGAGHVLHAGEVCIGGRLTRSASWGSPCVMLVATRLALSXXXVGGRFDTIGVMGLSLCHASSHKAGPVSSGSSISVQPVDCMAACNEAPGCTAFSYNPSLQKCFLKTGSSYNTCQVXXXXGCTAFSYNPSLQKCFLKSGSSYNTCQSCRSSPQFTXXXXSMTSIIKHKRRCAHLHGGRSIHADSGSRTTERTAGAPRQQCSRPPFPQRPRPILVQEIQNQQVQASHCFSEKSTQQMENPVHPPQSACFSPLGRILPLLVAGNGIPIFFRIPSVEL

SEQ ID NO: 12048 - protein, 558 aa, Chlorella protothecoides
  MOD_RES (214)..(217): Any amino acid
  MOD_RES (357)..(359): Any amino acid
MRASVHFGWICPPTSTGTALKMASSMCMASTPACMPTRTLTEVAAQSIMARRAGAHLSSVSPPDDCTHVQQVQGGMVMWVPHANPSMRPLIDVPKDPCTSIRRFESCPALPNPTAHRYARQVGAQLFEALARLDGKFLGVHPRRIPLSLLSHACTARSCARWVSRLFQSNKAPDQPVDERSRLLSRFPDQTTLSMQCTTVLCYVFPLLRLPALXXXXHCQCNALQFYIMFFLCYVYLPFAWGKGWARWCLRSMGTGKGTAITSVNDELERPGHHDRAPRQPQRPLAGPGRPLHHQPHPADSCLASSSKPACKRARVVGLPRGGPASPAGGRLPRVGHGQVGCCVDALLGRATKDSSXXXDMDRWAAVWTSWLGGQLMIAAEGGHGTAPYFCPAHGMHTARQPSSPARQRWQGLHPGETQCISLKASMHCTAARTMEAETWHQSSMVLHWCCWRSNPEAHLRHLVVRRVFRMVSGRALTSRFESDRSHMRSESGGWSAPPPPWPCFECAARGGGDPLTLEALLRVDADLGPGTKLLEQAASIQLPWEEVCGEAEATLAE

SEQ ID NO: 12049 - protein, 155 aa, Chlorella protothecoides
MPGAKERAPPRAPQLAPAPPAPAPPEGADPAQLLELLLRRGHDILPASPVRPHPGPIAHPSHAKPHAGPAIVSLGQDAGRKRARRSEGSRTCSNCGVTATPFWRKSRASGLPLCNACGLYSAKNGDAHRPPKLWREGQPVPPGVGDDARGSPAAV

SEQ ID NO: 12050 - protein, 775 aa, Chlorella protothecoides
  MOD_RES (235)..(238): Any amino acid
  MOD_RES (704)..(735): Any amino acid
MPPRSSSLTPLLRAYFQQGNSSWSLETFNQIRSSAGASLADSARRGYAATRAALRSALPAQEAEAVERSVPRAPPNKARGSHNQGETGIAWVWASGEWSTTLRVPTHAVLRTPTLPTAQSPPLNHPGSPAAGPSTRHTPGTSTARAQVNGNVQRQPGPQQQPQSGPRSRAAGPHTPPAPRPRHIPRTAPPSPPPQRPGVNHIPAPRPPGGAPRAAASPGKATPGGAARREARHPXXXXAPRAAASPGRATPGGASRREARHPRTPEQQREWLKATGKWVDRSAPGATWKHPRTPEEQREWLRANGMLWEAGAQPRRHPRTPEEQREWLRAQGKLGPDQAPRWGSAGDMQQQQQQQQQRRPRQAHPQPELWGEHADLQDGRGSGTRPKPVRAAPAVQPPVVIPADVTVLRLASLFGEQRRSMAVPGCRGSGCLAGLVGLPHAQGSCPHGSAFLTRVPHSPPPLPTKWHPHPPHRCPLSRLEGILASLGSPPGSEQELVSPEDAELAAMELGVAAVLDPEAAAVASSSSRDAPDAAPRPAVVAVMGHVDHGKTTLLDALRRTALAAREAGGITQHIGAFSFPLPASGTALTFLDTPGHAAFCAMRARGAAVTDIVVLVVAADDGVMPQTREALAHARAAGCPVVVALTKCDVPGAAPARVRAALLSLGLELEEAGGTVQVVEVAAPRGTGLDALEEALLLQAEMMXXXXXXXXXXXXXXXXXXXXXXXXXXXXXXXXWWSRRGWTGGAAPWPRWWCARARCAPATSSWPARSGDASA

SEQ ID NO: 12051 - protein, 350 aa, Chlorella protothecoides
  MOD_RES (213)..(216): Any amino acid
MLCLMAELCVRRRIVMYSSRVAAESAQWQQPDCGWSKARWKHSHPSSGHPRSIRSPNPYKCIVTVRCVDTQTYEPLFVGSLASMAGESVGLDSLGPQELAEVGKQLEGEINGFIQNALTLQQTAGKFAAAGQSVEYLQEQKKGQPLLLPLTESLYVSGTLESVESVLLEIGTGYFVEVGCSGRGGNHGCIPWCVYSTSKQAVFPSLACSVIWXXXXVERDLEGGIDYCRRKVLLVRDKTEQLSQVWMGADASRNGREQAIYTIALLPHTAHQVPANSAGSGERSSRAEGGRSGRPGLRNRMASMDAYGHGCAECRAQQSLFQCRSLKSYSSCLRHQCLPSAHFKACNLSQ

SEQ ID NO: 12052 - protein, 941 aa, Chlorella protothecoides
  MOD_RES (107)..(109): Any amino acid
  MOD_RES (167)..(170): Any amino acid
  MOD_RES (217)..(250): Any amino acid
  MOD_RES (491)..(494): Any amino acid
  MOD_RES (645)..(648): Any amino acid
  MOD_RES (833)..(836): Any amino acid
MHRSTYVCQCSYIVTISSSFFTGCRPQLGRERQSCPKPAANNLRHAGRGSHMACGHLLSRVVEDSSNVMTGLRVCFDGASGRLGCSSIATTPPRHAVPLQHALPDRXXXCRPQLGRERQPCPKPAANKLRHAGACRAGRPPHRPAHLLRRLPGLLSFDFCDLFLHSXXXXGCSSIATTPPGHALPLQHAVPDHGHDPCSGSRGRLLPWRAGRHLQHXXXXXXXXXXXXXXXXXXXXXXXXXXXXXXXXXXPQEQACLHTCPLCLASPWLLIPLPALPHTQAVRNLDDLECMACPPKYRAIQSFYRYYSGEARAPIPTLFIGGNHEAANHLWELHYGGWAAPNILYLGAAGVVGFGGLRIAGLSGTFAAHHYPLGHFERPPYNNSSMRSAYHVRSLEVHRLARLASAPDIMLSHDWPQGIARHGDLDALLRRKSFLRSEVGIRDRILCRSDEGRWGDRWQYRSSPAFLEYHPGVYRARPVDPTPCWARVVAXXXXVRRGQVGIRGRILCAEAMRGRWAGRWQYRSSPAFLQYHPAVPSSGASLLHVVITQLSKGRQHITHTSIYPLPPPLSHPHTVQITDNSLGSPPAAELLHHLRPAYWFSAHLHTKFAALVRHAAEPEQEVPQKHPPKGSSPGTLKPRSSNAAXXXXPPKGSSPGTPEPTSSDAAPHVRGRHPATRFLSLDKCLPRRQFLQVLDFPEASGAHEFTYDAEWAAVLRATHELQNLAPAPTALPRGPPAPVTPAEVASAEAALRAASPTGDLAVPTNFVATAPAHDPGRPGQRGRMPRAAPRNPQTLEYLRRLGLPYDLDLDAVPGPPHGGWAAGGLTPPQATIXXXXPTGDLAVPTIFVATAPAHDPGRPGQRGRMPRGPTPPQATRASEPNPEEIDLDLESEEEVKDNAEAEQNSNLCGSDGRPPLLASLAAVLGPQNPEEVQLDSETEES

SEQ ID NO: 12053 - protein, 558 aa, Chlorella protothecoides
  MOD_RES (8)..(11): Any amino acid
MVTSRFVXXXXGRMHSGAWPAMQGRAHRQSGRHGHLQIRVRRDPRAGTARAILGRARAITSGPGWALSARCGHVRASPSRPPTGASWRASAAGPAPRPQTLPPPATLREAHPLLPLIQSSPWPPGNFPTLDLPPHTPAPRGAVPPGAMIRGRRIATRLLTEIRSLAPATHDPTTLPAQLPGMSRSAHDSPRPASKEGKAMHPDLLNDNILKTQYAVRGELYTRAQELAKSGGEVIYTNIGNPQQLGQEPLVFNRQVLALLLAPFLLDHPSASALFPREAIDRARELLAAFGGRMGAYSDARGAPAIRQQVAAFIEARDGQPANPEDIYLTDGASVGVKYALNALIRDGNDGILCPIPQYPLYSAAIQLFGGKLVPYYLEEDAGWDLNLEALRGAVKKARAEGTVLRALAFINPGNPTGQVLTRETLRELIAFAHDEGLVLLADEVYQPNIYQDEKPFVSAKRVLREMGEPWASSVELASFHTVSKGMLGECGLRGGYVEWVNIHPGAQAELYKVASVNLCPNTVGQATVSLMVAPPTGDSEAARQYAKQYEDSLASLR

SEQ ID NO: 12054 - protein, 50 aa, Chlorella protothecoides
MYIRYRKPGPRARYALEALNILCFLVTVCAIAGSVQLIVADSADYEVFGN

SEQ ID NO: 12055 - protein, 596 aa, Chlorella protothecoides
  MOD_RES (51)..(53): Any amino acid
  MOD_RES (149)..(152): Any amino acid
  MOD_RES (230)..(233): Any amino acid
  MOD_RES (388)..(391): Any amino acid
MNAVRCGPRSWGHPDERPRQACPTGWHRHSSLQPRPRVANTPSPLLRPLSXXXERPRQACPTGWHRHSSLQPCPRVATPLAPPPTPLPALLACAVWEMYHCRSVHSGVREHAVLAGVVQGTLRPIFDPGCPPAYAALARDCWAQESWGXXXXVLVGWRVCDFAFVRGFGGARGGGGGFSRPIREDVDGAGRDGGRRCLQRRACCQPNHHRCHLALHRDRVASRPAYAPPXXXXEQAGTAGGGACSAGHVASQTTVDATRRCTATGVASRPAHAPPAISSARGAPRKRPTFQEVLSRLVAAEMAFRAERHAGRAASGTHAVRQARYGRRAPALPASGHTRTARLEGGTRAWRPRRPSSHQCGGQPRLAFPCRARPFQPAIQSSCLAAGXXXXTARLEGGTRAGQSRKPSSHRCGGHPRLAFPCRAPPFQPAIQKSCLAAGNEADGGASLAQELEARGLRARHEQRAACRHGQAAGELAAVGHAQGGAQPLQPVQAQDGVGGGEGAGFREVQQQQRLLHPWPLSGWPRPVGHSRAWPGTCMGRVVSPLAIHCTRTVAPFRSCAHSDRLFSTRATRMLRARVPMHGSLRQHRSASTGNA

SEQ ID NO: 12056 - protein, 105 aa, Chlorella protothecoides
MTDAFNGLEGASCNFTEGAMYSFPRLHLPAKAIQAAKEAGKDPDTFYCLALLADTGIVTVPGSGFGQVEGTFHLRTTILPQEDVMHEFVDKLRTFHKSFMAKYKD

SEQ ID NO: 12057 - protein, 172 aa, Chlorella protothecoides
MEVTSDLDVRFSKAIWLVRKGPPVPGTTNDTKLAYYAHFKQATEGDVKGNQPWAVQMEARAKYDAWAMLQGMTKDEAKAKYIEMLEKGGLGGARTAQSSRIGGSPTYPIAAHWRWSGRDLRLPVAPIPSLLCSHHPCPPSHIQEMPSGRATPPSRTFRMLDEAQHNLQNPPG

SEQ ID NO: 12058 - protein, 363 aa, Chlorella protothecoides
MFIPSLLAHGTKEQQEAWLPPSLRLEMVGTYAQTELGHGTFVRGLETVAVFDPDSDEFVVHSPTLTSTKWWPGGLGKTATHVILMARLISRGKDHGVHSFVVQIRDMARHTPLPGVTVGDIGPKMGYNGVDNGFLRFDHLRIPRSALLARFARLERDGTYVPPPSANAKASYATMVFVRADIVKNAGDFLGRAVTIATRYTAVRRQTAPGPGARELQVLDYDNVQQVLLPLLARAYALSFMGRAMFGQYKAFDAARARGDFSALPELHALSSGLKAACTDTTSDGIETARRTCGGHGFSQLSALPTLFTSYVQNATWEGDNNVMYLQAARFLVRALITAQRGGRLAPSVQYLADEGAGARRCG

SEQ ID NO: 12059 - protein, 185 aa, Chlorella protothecoides
AGPVAGSGGVLALHLAPRYLLLNSLDAALQYRQQGTGAEAELGPGVSCPLRWADAGLPLRLCVRLQEAGWLWSGGFGLDSPGDTFIKVRHRDRGETMLLRVGVAAAAAGTLAVTLSHQPAGFAPYRLENCSLLTLHARQRRVREQQDVLRPYCSLGYAWDEPARPHQLVLELAGGVRLGTWGLDQ

SEQ ID NO: 12060 - protein, 107 aa, Chlorella protothecoides
MSGSGVPLFLEHARVALGEAFRSQSCPSGSRRDRSPLIPPPLWPRSQALPGQTTPDGVPAFKLVLVGDGGTGAWAQFEFSCPAVEFKITPPIPPATPQGRPPSSSAT

SEQ ID NO: 12061 - protein, 666 aa, Chlorella protothecoides
MTTAFLTTRACPCTPQNFQGATLNHCRTLLTSSGSRRRGNAMAMRVATREVLTGSQRQKMDPSDDTMFYDSPKIVQHVDDGFRAQLTQLYRERLPPGGTMLDLMSSWVSHLPPEVTYAKVVGHGMNAEELSRNPRLDSFFLRNLNVDPTGWALADNSLDAVLCTVSVQYLQQPERVFGEVLRVLKPGGVFIVSFSNRMFFTKAGWKRDSTGKAPSPLRYLSTQVSAAPCAPTSCSQAIAAWRDGTDYSRVRGYLKWQGRELCGLPSEPVTALRFGGECRMDGQAARRPSPVDRSCPCTHPLPDPAGEAVLWCLSGVRAARGDQSRLCARGPLPPGQVLDGGRCLGRRHARPLPCGAGTEEDGGLTWPGQRCQAHRNSIKIWWRAFGFGKCAASSRRRAGGIGSLGRGSPAWQRSHPCLPLLALLSDGVPSMPNPPLCRLSCNRHGQPCCFLIQTWGNTLQTEPGNILQAWQAGWPGQLITPHCTACWRPRSAAARTPAAAAGRSGPRGAPAPPAPQSAGWGPPPACGPGDLLGLDLPVLHVHLVAAEDDGDVLADAAQVAVPGGHVLVGQAGGDVKHDDRTLAVDVVAITQAAKLLLPGRVPAEEAQLAAVGGEVQGVHLHADGRCRGGWVAVHSTIQYQCRQWCCGDQVSADEGLVSDHPQKLLP

SEQ ID NO: 12062 - protein, 334 aa, Chlorella protothecoides
MGPGGFCTAGDLSHLRQSDLRTPSSRQGELPALTPSGEAILAAPGRLALSPDGNGGVYAALRRSGALADMAARGVAALDVWPVDNALAAPLDPAWVGACLAARAELGCRVLQKAAPGERKATPGERVGVLARRGGRLAVLEYSELSEARAAARNPATGALRYAWSNACLHFFSLAWLARATDALEAAPRFHVARKAVPCLGGGTRPGVKLELFIFDTFGLAEGVRLVEVGRAAQFAPVKNGPGAGSDCPETAREAVLALHAGWVRRAGGRVGCGEGVEVSPLLSYAGEGLEDVCGGQDFTRPWDARLQLVGGDKGGPGLGPSGRRGGHPATLNM

SEQ ID NO: 12063 - protein, 204 aa, Chlorella protothecoides
MGGLEAALRTAGQGHLWDHLLTLDGEVRTAFQVQLEAVDFARVQRIFQASMAMTEDSEEGVEPIDGVQTIQDTTEEQRGKWRALGLAAIAGGRVAGLLLAGGQGTRLGSPAPKGCYDIGLPSRKSLFQLHAERLLRLQQLAQREESAPRPCIPWYIMPSPATDVETRAFFQAHAWFGLDAEQVFFFQQVRRGPSSIGVKVVRVM

SEQ ID NO: 12064 - protein, 209 aa, Chlorella protothecoides
MDPPSATDAEGLLAEAREVASTRQVTDAFAATFPERLEYHLRAASEGGPAGADAALSALRDQHLRLAADYDNFRKRSAAERDSARTAARGDTVLELLAVVDSFEQAAAALSPATDGERKVVAAYDAVYRQLVAAFRRLGVEAVPGEGEPFDPAVHEAIMREPAPAGVPDGTVVQEFRKGFRLGDKLLRAGMVKVAFAEDEPTQGGEEEA

SEQ ID NO: 12065 - protein, 200 aa, Chlorella protothecoides
MGPLTPRLHNSRPSQAHHLTSPAATIGVEVHPLDFTTNRGKLRFFCWDTAGQEKFGGLRDGYYIHGQCAIIMFDVTSRLTYKNVPTWHRDLCRVCENIPIVLCGNKVDVKNRQVKPKQVTFHRKKNLQYHEISAKSNYNYEKPFLYLARKLVGDPNLHFVEQVALAPPEVQIDLQQQQEYERQLTEAANMPLPDADDDDM

SEQ ID NO: 12066 - protein, 237 aa, Chlorella protothecoides
MSAAKRLIPLLDRVLVEKVVAPTKSLGGVLLPEVASSKATRHRGRGGFSRDSTAARNDPDIYIAAQINQGTVLAVGPGRRTSTGELIPVGVKAGDKVLLPEYGGTPVKLEDTDGPPRSGFVGCTDTQCFDHAHSALLPLRHGVHLSLDFQVHDLPRRGAPGCAPELICVLGTRCHPPRTRRNPPLLSNFRLHCSRDPPHALPWVRRTVSLTDYLATRSRSFAAVIAVSLVTVTDSMS

SEQ ID NO: 12067 - protein, 85 aa, Chlorella protothecoides
MGPACCGALFHIRPPHARATQALLSTRPRQDVYKTGDQIKAAGVSLLKEPGPLPGLGTKILSLTDPDGYKIVFVDTADFLKELEK

SEQ ID NO: 12068 - protein, 53 aa, Chlorella protothecoides
MSSSYPGGNFGGNQLLDGSISLSPLYPSPKSDLHVSTSTSLHQSFLWLRPAQA

SEQ ID NO: 12069 - protein, 144 aa, Chlorella protothecoides
MNQVEEFLVRPSATFHHRDVRNCQHLACPPCPDLAMYHESGGGISGPPFCHLSPQVYWIDIDPLVVARLALEAGELAFAVLFGELALVDARGDRDQTGACENLLASALGCLGEPDGLYAVTYSPSLEAQVGLNGRATFLCNDEC

SEQ ID NO: 12070 - protein, 235 aa, Chlorella protothecoides
  MOD_RES (20)..(23): Any amino acid
MSASRPPASSPPSPHPAAKXXXXASRPPANPPIPTPCRQRRRSKDAQPASLRSALLAADSPRHCGRLALAAGPRAGGEHEARVGVALAVHRPLLAVGFLVAAAGPRAQRELAHVHPLGGRPLLAGQGGAGGVGGLHVQAAVGLHAVEEDGVPASRLDRQALPRAGRPLGALALGQAVWEHRFAPLLRRGEVHEHGGQAVAAVRGVRVLAVVEVVGVRLVLLPVHVLEHLETLAIL

SEQ ID NO: 12071 - protein, 274 aa, Chlorella protothecoides
MQELWRGRVEQVSWEPRAFVFHNFLSDAECDHLMHKANNTLTPSTVVDSRTGGSMASTVRTSSGTWFSKGADDVIDAIEQRIALVTMIPAENGEGLQVLKYVNGQEYKAHTDYFHDSKNSDAAHGGNRLATMLMYLTTPEEGGETVFPYGLPKREGPEWSACARQGLAVKARRGDAIFFYGMKPDGSLDMKSTHASCPTLAGEKWSATKWMHVSEFTLGAGPGCGDKEPHCEEWAVNGECDANPGFMLTSCARACGKCKPPAVARRVSRKQGAA

SEQ ID NO: 12072 - protein, 137 aa, Chlorella protothecoides
MASRAGVANSLWTEIGERYDQAQGSGAASTTPTEVQRVRDGDTGVEFIVQVAANLQHKARSSSATLSVGRPPPHNPFLPYEEALWVRHLSPTHTLLLNKFNVVPRHVLVVTREFAPQSGLLAEADLAATWEVLQVGA

SEQ ID NO: 12073 - protein, 407 aa, Chlorella protothecoides
  MOD_RES (363)..(377): Any amino acid
FLPRLIPIWCAALWESVPSVREGAAVALGDAAAGPPAVRDVVLPAALARLEESLLMAAQQPRDDAGTGNDTRAGNGVGLRKGAGPRNGADQGDGTSSRDGTAQPQFAWGVLAPALARGADCCVDHGYTNRQAGGGGEGALAMGVVVGVLGRSSTPQGYLQGLGWTEMEPWEASDGAIHLARELARTTPEDIAARLPALAELARMRHFGASASLQQTLWRSLPAIGRDVGKPAFKRELPRFLDPLFAALTCDQPLVAAAAGGCVSALRDWLGPGIWAGRLTPEQQALQRDSPDACTRGALRFKNGMGQGSLDRQAGGHHGCCSMGARMAPQAFQCPSRLLVPVDKVASVASLKNLDPVPIWVGXXXXXXXXXXXXXXXEGNVPAQPEECDGSVDRTAAARGGRYYHTP

SEQ ID NO: 12074 - protein, 527 aa, Chlorella protothecoides
  MOD_RES (156)..(158): Any amino acid
  MOD_RES (441)..(444): Any amino acid
MAQIALSFQKGAIPDTQTAPALRMMYRLAPCTLERVPACSLRPITPTFIVCLVALAPLIRPCTSAAHTQLATRHAGSLPPDSFPNAQARKGLASAFPEEGGGGWRIDEPLPACPCPNPWDGGPATHPPQLTLSLVSHAMQGPLIMQHGHPSTSPPXXXAFHESHAARAQPLSLVVRLDASTVCFTPTDIQALRTVLLDPFQSKHDLLCALRKLDCYRLELADLTASGIGAAVATLTGHPKPDVARFAAALLCKLRAVAERGLFPRLPYDRAEAAAAPDGQPQTPEEAIAIAAQVARAARRARRLAAEADFLDVASSSSSDEDEGPGARGGTSNDGEWRPGGRGCAVAATPPTAPGAGPDPGGVARHVNAARYAPDSAFRKTRAGSRVAPGTEQGADGRLYRQATLASAFCRPAQPAAGHGLAPSAKAELPRTMVVEEELVXXXXCLGGERQGGAAGDDGRGGGAGRGGRAAGGQPRAHGAGALRGCGGRCWAGTATSLVPPFSDHPGTHAATGVKLVHTESIAPEAG

SEQ ID NO: 12075 - protein, 177 aa, Chlorella protothecoides
  MOD_RES (124)..(127): Any amino acid
MIQAPSQFHHRRPEPPVHGKRGVGAGERAADGPAGRPAPARGQLPGRPQPVGRDPGPDPLHQHVGLQGGCRLLPAGRASQRPSPWSAPTSCSATWACATSWWWMSTTASRPGDSKVTFPVRSFXXXXVDEHNCVKGIVTRKDLLGYRLDEAVARARTGSLAGGGHAPGSNGTAYAPA

SEQ ID NO: 12076 - protein, 255 aa, Chlorella protothecoides
  MOD_RES (103)..(106): Any amino acid
  MOD_RES (216)..(219): Any amino acid
MCIPCLDLPRGPRSAHEGGLWVILSTNTAPFPHSPLSAMAAVLGSLDNDGGHRHCGGHHRLPPAPPHPHPGCDQDREHQVWAAGAGADGSRVMCDQAGECLPXXXXAAGAGADGSRVMCDRAGQCLPAHPLSNPPFPPTYPSRWLLTHTHVILSWIFNLSYSLGLVYCSTWLVVNIAPEAAGAGVAEVSAYLNGCNIPKVRSWRGSARRRMVNVQXXXXNIPKVRSWRGGARGRMVNVHTQEKGIAQGLSCRLQG

SEQ ID NO: 12077 - protein, 497 aa, Chlorella protothecoides
  MOD_RES (105)..(108): Any amino acid
  MOD_RES (363)..(366): Any amino acid
  MOD_RES (399)..(401): Any amino acid
MALCCELQSRLVELLVGTAHLFTQTNGPSPPQMSCGTTWRSWGSTRGTGTIRSLGAWTNAWSSSSRNGAAGWRSMDARAKAGCSLKSSRLGFPDTPTTNKCAVRXXXXGWRSMHARAKAGCSLRSSRLGFPDPPTTNKCAVREQVHQCQQGQEWVGRGDDLLNRRWVRCLGWGSWSCEITTPGMHRARQDQPLTTSDHWFDSTKSQAAEAFANVDLRTRATKRGNKAKVHTKESLPIYKSTNDPILWLRFRRRGVARNMSLAAAWVRSPSWSVTGNRPSEDKRGASAGFLASYRHDFKQLEFDVAALSGPALRFLDGETAHNVAIWAAAHGLLPKETRPDPPSLRTTVWDRDFPNPLGVCVCXXXXAKNKAAQWGLTRLPGPVISVHHIAFDTYSIGLXXXRSGWVLASCVCSFGRQAVAKHKAAQGGLRRLPEPVISVHRIAFDTYSIGLAAGFDKSAEGPEALLNLGFGFVEIGEYHPSKQRQGVVRRLPMFEVF

SEQ ID NO: 12078 - protein, 400 aa, Chlorella protothecoides
  MOD_RES (12)..(14): Any amino acid
MHRPARPPGQAXXXARPLAAGDSCPPLQRFRLAPRTGLRALQGRRELQSLVRRVKAERDALAWHGKLSAMADYGAMHAPGRRLPCQGSLQVPRLSAKDRVPPFATPHSHQLMQPAPPLLIKIAPDLTAEDLGDIAAVALSEGVDGLVVSNTTLERPPGVAAHPAGAEAGGLSGAPLFERSTAVLGQLYRLTHGRLPLIGVGGVSTGEQAYRKIRAGASLVQLYTSLALSGPALVRRVKLELAACLARDGFKSVADAACTVCLKIQPCPKLCESLSQESAFTLDLFLASSCEATARRRRKSQSSSEAGPPASWRGPTTWTAAPATAGCPVIGGCVNTLALVIERLEHSDHPTIQPRTSPPPHPQGYTQTTPYLGLLEEALPGLARMLIHLHLLQHTWKGGR

SEQ ID NO: 12079 - protein, 209 aa, Chlorella protothecoides
MVTHEMRVGDRIVLQGTHRGTIRYIGSVPNQAGEWTGVEWDDASRGKHDGCVAGQRLFTCQRPGTPATFVRSRKLVESLLPVMSLLEGLRERYCRDEAPSLDLPSPGQHPKGRGVVVMGRADLLAAASDLTMLAHASVLGMHVAARVSSGQVDCYLRGSAQPTGPGCRRYPARKLARGCHGALEPARAAHAEPGGDTAGGGPRPAAPAA

SEQ ID NO: 12080 - protein, 205 aa, Chlorella protothecoides
MRSPLADAAVPPLPPPCVCSRVVEETLELFTCSRTSHTSQVHGGGGPGDADGPGGKGNITIPSSYNELATLMSVTGEGREWERWTGPGWRDCLCQGGCSGSCPARIKSSHRPTAMRGYKSEMWGSMLPRSERRGRDPAPLLARHTPRVWVCGPGGHAGVVLPGGGLDSRVCDRLGWAGVVGLWLSLAAGGAWRGAPARVDQWVAA

SEQ ID NO: 12081 - protein, 210 aa, Chlorella protothecoides
MSQGHSTTLGCDSGLFRRFQNPKDKRDFVTVGAAVGIAAAFSAPIGGMLYVFEEVASFWQQALSWQIFFANMIAVLTVDTLRSAESALQEGTFGLFDRESSTVFFEVYTQLNNHVMAMVPAALCGLLCGLLAVAFTIMNLKVIRFRGSVINPDRRLRMAEPCILIMLFVTMGMILPLFFPCTPTQVRRIVLEGGGAGGNDPSLGEGGSYS

SEQ ID NO: 12082 - protein, 101 aa, Chlorella protothecoides
MPGTDAQLGEGTESDPDFKGYHNGNEEPKGYGHIGFSVPSVAEACARFEKLGVPFKKKPDAGSMKWVLGRIGPWGLSICSFLKPGSHALACGANILNTEHD

SEQ ID NO: 12083 - protein, 190 aa, Chlorella protothecoides
MAARNGAGSEGCVTGAVLAPAGLLGRGRLMLWASGAGPSPPRPLLVCTPKPCLNPLHICCTPPHPLPRAPPGVFLPPHPMSFIDPGAFALIGAGAFMGGVTRMTIALAVILMEVSNDVRILLPLMVAIMVAKWVADLGSHPLYHGLLEVKCIPFLPKAPVSSASLDLIEVRYVMHWPVTSLRVRRREGGS

SEQ ID NO: 12084 - protein, 940 aa, Chlorella protothecoides
  MOD_RES (194)..(196): Any amino acid
  MOD_RES (922)..(925): Any amino acid
MLPGHSRQSPGPSTLVTCSCPIGCLVDPWPRPAGSCQRTRAGRRACVWLPGPQRRGCPGDYLRAGAVGTACTPAWAGCCRRPGPHTAAGPAGWRGFGERCCCSESCWDVLAPKAGRMWGCSARLHPRQWPSSTSLNSQAWNRAHPLALAQAARRCLFGGLDVPLDLGMWSSSGKGGPRKCCTGIPWSCLLARAXXXGSGKDGPRKCCTRPCTYHVGALHDHTGPLPIAQDFLHGADAALVPTGGDLHLVTLHDFPCVGLKHGLESPPVPAHPERRCAGGRRLLCVRKAGVYLISNESEGSSGPRAISLQFKVWFPKHPATAGALSPGGLGTLGAGSQSTAQHATAPDLMKAHVWIGELIGFPTPCTSILAEHNLLQVHPARCRSAMRAITACAASHSLAQPTSLRPPHASLPAVTLAPGPKPGSIHRLHLLRFALLAPMLSPPAVPGLPGLPVLQAGAAALADPVGAHLPGERPLTAVLLQTLRECQVAIGVYPPFAYDASGGMGRGTVRPRPDGLLDLDFDPRRCAVVVPVPLPCEWELGWSWITCTCSDLVEPLQPLYHPNTLQSRHPQHRLPHDECTGGAPPPAPVHRHPAPVPERHAGPRHGQHGVDPGRGLPVHRRTPLQGAAPARAQSAEHERWKGRGAEGQRERAPGRDRHRAPHPRWGAERLPGPAHGGPGGALYPPHLCLRGGQGLWAHTGFTSPLAPGLSRPESACAGPIPLEVSWVGGGCGAHGGLTSPLAPGLSRPEPACAGRIPLEVSCEAHTANWCSLDVLAGTTAALMCPHAHLGSNALQCPQSAARGRVQALHCTESSLALACQAHIKLLGLRPGGHQVSVVLGCILLPPLLHVLLQPAAGLELLKLGHQLQSLLLRLLEVEGRLARLYCRPLLALSHQWGGRKGALVAARNAAALAAMPERAACXXXXNGVGGRVDWWRHGMQ

SEQ ID NO: 12085 - protein, 220 aa, Chlorella protothecoides
MPCYLHSFQAEEEDDEVPLGQRAAQLADGSTDRSAMRARARATLRAGRQPRENKHRPSEASSKRPVPVLRESIQGPRAQGKDPRFESLAGGAFDERRFKSQYAFLYDEKLPEERKGLRAALKKAKGAEARADLQARLTRVEQALREENARRWKLDFKAKLKVCDGGLVKGGGAVLLYRGGKKPSGRDFGRGTRPLSSARAGLWPWDTAALIGGEGREAVR

SEQ ID NO: 12086 - protein, 69 aa, Chlorella protothecoides
MRQSKERAAVQAGKTPFHLKKSEQKRLELVAKFEELKASGRLEKYMEKRRKKNAAKDHRYLVAPRAQAQ

SEQ ID NO: 12087 - protein, 286 aa, Chlorella protothecoides
MGCYLSHLPTTTLAGGTCPETRQEAGNQIVGILRSHPEQLPGVLGAVSALLRSPNWDTRLAAARCLGSAAMHFVHATPADIAAASGLDAVALEAELDREEPIPDGTVKAEQDGDEGPLTLENLDIQEIVDNCPPLLASGGEVRGERWGGGGGHARCRTCGCLTGTFAAGSGELGLARRLLTCPQTRVRPSLHVAPSPLDTPRPFSRALRAGEYAAQAAEGVAAQRSALRKRLGLGGAAGGFMDDAELFKDEDLLAGAREPEPSAAQPEPAPIQAGRRACASPPRAA

SEQ ID NO: 12088 - protein, 131 aa, Chlorella protothecoides
MSHPGGLDAPTPDGLSPGELQRLAFARLLLRPPALALLDEPTSALGAGAAAEMGRLEEHGSRQRRVSTVALASPIVGARQPFSRPGAHSVAECADELCEDVPHLRAAHAAVLKLVGGDGAWTLEGGDDVAP

SEQ ID NO: 12089 - protein, 219 aa, Chlorella protothecoides
MDIPVAPHGPPLQDMTQPVLTGHGDLNPAHVRASCGCTNRSLLSIISSSLAHPSLIQHRRSRYYNGIPFKLLPLQYHEKGLRHVGACLSSPDHQASSSQLPGHEAFMAKCKRDGGNNLPNAVVKFSCPIRMGLKATSNDQQAWDALSGCSEADSQCVVVDRSQWGRLRLVGPGALPLLQGQSTADVINLRPGQCCETVRCLHVGEFNGCMALEDGGSVL

SEQ ID NO: 12090 - protein, 196 aa, Chlorella protothecoides
  MOD_RES (45)..(47): Any amino acid
  MOD_RES (68)..(70): Any amino acid
  MOD_RES (125)..(128): Any amino acid
MLDPKQHRCACCRNQWLTLRCRPGHFFASSDKAKRELGWKPEHTXXXFQHLQNHRCLIPSSIVALVAXXXVHPGCSRGEDERVPAPGCSRQQCVEGTPVRLSALVQALSAGLLRTRSWWRPTRPXXXXFTQDAAEVRTGECLRQGAARSSAWKVPLCGFQRLCRHSAPVAPRTQLVEAYKASGRRDQEMDFSGGSV

SEQ ID NO: 12091 - protein, 82 aa, Chlorella protothecoides
MTSNRTLSGQPLHAPTRTRRAALARRAAPRAEHVLISNTKSGGHAFLGLHLAQKLLEQGHEVTILNAGSKVPRHVVVEMRVC

SEQ ID NO: 12092 - protein, 159 aa, Chlorella protothecoides
MRGEDVMGAGVPPQQAGCGGQALSWPRAGAVRGQVHLEGAPYGGDGGQPGLHRVRGSPLRSPSHAPCLHPLLPPPPFPTTVLNSEQEALLDFIVLSKSRLFVGFGSSTFSFYLREYRSLQVGTPGPEGGCRAGGRAPVSGHAGAYTRGLSSKPSACCTR

SEQ ID NO: 12093 - protein, 247 aa, Chlorella protothecoides
MLPLTSSGPSRRGSLLHLTNSPGGTPSLGLQPIRDPSNLRFLAGLLAVTTCLLFLGLHPDTYPLSGAFPRRRGLSGLVADSRLLARHAEAAAGADQGPTPRPLPASPAPSPPALPAGLPEDFDAEAYRAYHPHLDLPSARAAAEHYLAHGREEGLVAHRLRVLLRYTACTGLINQHYSHIAAFSLASVLGAEVVLPPAVCRDSFAHYFSVFKEKNEVQWAPVPLDSLLDVPALIAWPGASTCTKRRR

SEQ ID NO: 12094 - protein, 478 aa, Chlorella protothecoides
MLARRRRYSRLRSRQRRWGCTGLHQRCRSKRWSGPSTPCLAASLHPPPNPAGRNPDLKVVLMSATADADLFAAYFEEALGQPTARVVIPGFTHPVTGESLGGTVPATGGPACTRGARDFLAPVPKITWACGPGLAEAGTGPCPKPARGAHGMGTSMEPSSLDCKAAHHPATLLTSVHTPQPTLPSHRVLPGGCPGADAVTRPPSRGSSRDGPGGKKEVKDKAAPIPRGLEEYSEQTRAGLAAIDEATINYELIGSVVEHVIATKFSKGPAQAILIFASGAEEIDKVVRQLRSSRQPLHVLPLHGGLPPAQQSAVFQRPPKGATAQSAVKHRAGHRRVPAGGVTPLSSPLCAPPGPWYMPPLLTSCPRPAGCIKVVVATNVAETSITIDDVVCVIDTGRVKEMAFDPDQGLNRLAETWVSQASAQQRRGRAGRVRPGTCWRLFSRATWRKLEKNTAPEIHRVSLQVDTRGRGGFGAPWD

SEQ ID NO: 12095 - protein, 111 aa, Chlorella protothecoides
MTHGSKSKREHGSIGPGTTPGRVFKGVKMPGQMGNERVKIRKVEVRREAALAPRLECLAPEQRDTLTSPPKQPQVLLVDEENGALVLKGGLPGKAGNVLEICPAKIVGVNV

SEQ ID NO: 12096 - protein, 238 aa, Chlorella protothecoides
  MOD_RES (43)..(46): Any amino acid
MEGVLAGRRQLAGILQALGFVDGGYLARLDAPPSSDPPHALDXXXXLARLDAPPSRDPPHALDAAAASARVVKAALAAGLYPNLLRVDAPPPKFQRVHGGTAQIDADPAELRFHDRSRGRVFLHPSSCNFGAGRFPSGWLVYSDIVRTSKVFVRASSAVPAYAILLFAGELSVDHVAGTLTAGGWARFKAPARIGVLVRDLRAAVASLLAAKIADPGLSLAGSPVVEALHSLLASDGF

SEQ ID NO: 12097 - protein, 207 aa, Chlorella protothecoides
MRAVRAALPAAAQREAVLEGLAGAAVLVVEGATGCGKSTQVPQFLLEDAVARGAGGALDVVVTQPRRISAVGLAARVAAERGEAAGEVVGHAVKLDSKRSARTRLLFCTTGGGFPWGALAALHCRQARPIMRPWVFPARSNLRPAAPQGTLRRGEAPTSQQAPYLPRPPPGLAHPTSPPHFPPSPGPPQAFCCAGCSTTPAWRARPM

SEQ ID NO: 12098 - protein, 102 aa, Chlorella protothecoides
MPGHGRAPPACIDESVTPASWTLQGRKGTQYIFIASAGAYKPDPNQPPLVEGDPRKESAGHVAVEKYIEQEHLPYTVFQPLYIYGPHTSKDCEQWFLDRILR

SEQ ID NO: 12099 - protein, 96 aa, Chlorella protothecoides
MTSIYKDGNMLPVTVVALEPGNIVTQLKSEGREGYNSVQVGYRVVPDRKITKPERNHLAKAGAPPMKFLREFKVRELGEVVPAPKGTPKDLSLVRP

SEQ ID NO: 12100 - protein, 275 aa, Chlorella protothecoides
YLAEPGRRAALLELIVGGGAGALSAARRYRLRGVRWAALEAMRAEARGEAHAETVSALIGEIVLALKEGNAKTRAAAFDLLVGLAHALQDAGASAALSTTPAAGPLAALGGVGTLVTVLLGGLVGASPHMVSASVMGLARLLHEFSAALLHLVPDLLPAVLMLLRSRAREVVKSVLGFVKVVASRLPVEELVPRLPAILEGCLLWAEDSKNKFKLKVRMILERLARRCGYEAVEPAVPAAHKALLTHIRKAHARHERGRQGGDGGDGDGASRADA

SEQ ID NO: 12101 - protein, 216 aa, Chlorella protothecoides
MTPPIPTQQQSGELFDYIVEKGRLMEDEARRFFQQIVSGVEYCHRNMVVHRDLKPENLLLDSRMNVKIADFGLSNVMRDGHFLKTSCGSPNYAAPEVISGRLYAGPEVDVWSCGVILYALLCGSLPFDDENIPNLFKKIKVGMWGGWGPGEGTGSAAPKPPCRGTCWAVVSPGHAPAGAFPVPRTHPHLPRTLPTSPPLSTLGSPLFIPLPALQRP

SEQ ID NO: 12102 - protein, 178 aa, Chlorella protothecoides
MADAAHHQAPPVAYPGVPGANPMAQTGTEFFLSNYRLGKTLGIGSFGKVLPADVIRAHPRVKVAEHILTGHKVAIKILNRKKIRQMDMEDKGKSRVDDGGGWPGVRATLLHATLAQRSRQTCMYSSCLPRPAVRREIKILRLFMHPHIIRLYEVIETAHDIYVVMEYVKVGERSPAWW

SEQ ID NO: 12103 - protein, 812 aa, Chlorella protothecoides
MAEDVIAGVAINRLARIAIASLSASSVVMDLCKTPTWPAYVFRVGLAPCTPLDCWDGSRVPPPNPQSPAPVSTPPLAHAKVAIVGRPNVGKSALFNRLAGRRMALVQNTPDGHVTRDWREAPASLADLRFTVVDTSGMEPELGARAPRSIQARAAALTAGVLARADVTLLLMDGRAGVLPGDVELARWLRRLPPPHRVLLVANKCERRETSAAGLAESPRLGFGPAVAVAAEAGEGMADLYAGLQPLLDAVRGAAWGVVGSAGGPGVGGAEGAGVGGAEGAGVRGAEGADVDSAEGAGMGGAEGAGVGGAEGSGPPGLAAEGMQAPDDAAPAAEGGDAAAERTTERDSATKAQSPGSQASPLLRMAVVGLPNVGKSTLCNALLASERCLTGPEPGLTRDAVTARGIGWAIPNPVGPTHHWMMARGWVCGALEDAERGASHQPDAVSSQHCPQPPPPPPPTPGSNPGADSAAAMHSAQVVVLVVDGVRCPVWRRRDFSCTGTAVFMRPGKGWGTNATLSQAAGVGAWRGADTPRADAGQRRYPARPRAAHRRQQDGRAGAGGEGGCAGPAAAQPRPRPPRRRQRAPAAHVGAARRCGRPAAGGRGVGGWGGWDWAEDDRGGSSSAALPTVALPTCLRCGALHAAWLWTQSPHAGALGGGAAHSCDLHTTFSRLPPAGKFLHDRGREGRGAHQVHAAGQGPAPDLCRLGVGLRVHAVLHPELPHQVPARRVWAGGGAHPAKGQGQGVQEAKVMREAWGGYLSDSARLGGTLPPQTLPNWQCHTHQADSFVVVLSALIVGGFEDWARMGWPEPTG

SEQ ID NO: 12104 - protein, 476 aa, Chlorella protothecoides
MNEPTTPRFRHLCIVFHDEPGIDSICAVLSHGSLPLACRGWPVRLHSTRGRPHGRGGRGVPPQLRDGGGNNAGECMHHILMRPGRVSWCAVVAPAESIPPDLGLHNPCPPPFHPCAAGWAERDLHLHADGASHLPGQRLHPAHRHPTGARAGGRRLGLAPHARPGQPLRWRGPHRDAVPLPPERGTAPADPGARSGKRGAVAPGPGHRAAVGGGGLRQRRARRRLGGRQDAHQDRGLCRAVLPAAGATTRGAIAEGRETGGCMCGPSMPISFRFDSTSSLTCQELQTPHASLCPFAAPTEHFPLSSSQEPAPPPPKARAGAPPPSDSEGPLIRLAEALSPPMLFVVGGRDARCPPERLGALFAPGGPAAGTDARAVVLQGLGPSLESGGAEGADGVQRVVRAVAEFVAALERGGEAGEAATIKGCGLPPAASLAPSRPPAGASMLGVTTQPPASWGSTPAPPLGMVLQHPGLGGAL

SEQ ID NO: 12105 - protein, 171 aa, Chlorella protothecoides
MVESRRRVSIGDPGAGRSPFWGGTGTSYGKREVWIPGEGWSPRAAAARPAGQACRGRCCPGSWLRTRESGQAMPSIPCKRGMRQEVRARRSRPRPPCPLPQMGRVIRGQRKGAGSVFKSHNTHRKGAAKLRTLDASERHGYVKGVVTEVIHDSGRGAPLARVRRGGGEGYG

SEQ ID NO: 12106 - protein, 341 aa, Chlorella protothecoides
MLPDDRYNLKRKVAGLPPVTREWYDARKSQLLGSLDTSVKRTWQDPLTGKKFGSENTYEAFTRSPHTGALKEDLPPLSSAHAARSKKYRDLLSKLEGPAPSAIITIQRTGPAGADAAAASGPPATPQRVLGHVSKPIGKPAPAATEEDEEGSVSDMSDDWETEDDASEAGEGAQQPEDWEEWNVCQSLFDGHVSASLEENLKYMYLNFGFYFPDTEFLVDPEGLMRYLGLVLEIACHTRSIQGLMPRPESLLAHAGCQAAVWRGSAVQVWGGSGGQAVQVPACRAGESAWVGGQGGCIVMGVVGAFALRTRFDRVWGHPRCPGFCPTLALMRWARPCPQLP

SEQ ID NO: 12107 - protein, 632 aa, Chlorella protothecoides
MRALRPQPGRVQRTAPQAGGQGHAEELPPLSSSAQSHPPHPPTPLPAPAHPSHKAVEPARGDAQVPEAIHFVHRRQQACHIGAQRRHGQQAHAGAGGEAAAQHTRPRLPPQRVHLVGGDEQRAAVQDNVVGQHQLAVCQPLAMLRHPAGGQGGWGKECLHLLDKGNRVALTLGPLGRIHPHRRLTQRGVRAPSLARPHEHGCASTAKVPPPPHWAPDAVHDQDHDLRAVHGRRAVCQGALSQYTAGVRVMRVEARAPPPPRRVHQLQDLTLGWEAAAAGVGGSVGKRPRPAGGMLLAPRPLGHHTPSPWPSSSDPRLRPRQASLAGEQGVAERGLAHIGQAHHRHAQQRRGLRAGGLGFGRAVSFSRALRCCVTAFSGRRRVVGRLHTLRCEPRRPGALRAAHTSSLRAAHASSLRAVHVGSLRAANAGSLRAANAGSLRAANARSARAAHDSPCRPPHGIQQGLQACIQVGHALPRLGRHGDGGAETQARALRQPRRTSLAPLALVGHQQDAAAQPARQLHIPGQHPRPSIHEQERDVGARQHACRQRRRACLDGTRRARAQLRLHARGVHHREAQVRKAGGRLAPVARHVAVRGVLHQGHAPPGQAVEQRGLAHIGAAHDRHLCMGKRGG

SEQ ID NO: 12108 - protein, 422 aa, Chlorella protothecoides
MPAKADWVGVTERVSWACSDIAGAASNGTTTRGPHDARTCYQLACRGARDLSIVHRMLPRHAVVPQHVGISSVPGPLCVWSLMSWDYRYTSDDAVDAAHGVADLGGDVAQEVGLEGEPVRGHAVAGGDGAQRHDMGVGALIPLHSHAADGQEHGKGLPDVVVQAPLPDGVHVHLVHLPQRGQRVAGGDVAQHAHRQAGPREGVPRDEALGHLQQAPQRTHLVLEQLAQRLDECEAQVLRQPAHVVVALDGVAVLLPAAGGRTALDHVGVQRALHQEARRVAQARLQPRRVFLEGVDELLADGFALGLRVGDPRQPGQHALRHVDLGDGEVQVLAEGVHHPLRLGVAQQAVVHEDAVQAVAQHAVHKGGRHRGVHAAGERADDVVGGAHRRGHLGHLLLQYVGHVPVALQPRDLKQQVPDLIF

SEQ ID NO: 12109 - protein, 152 aa, Chlorella protothecoides
MVDSGRCTMLYDGNEDEYADFYDYTGDDGEAVSAGGEFWVLALAGEDGAAAATGFELGVPLQSGGTRYLGTREFARYYKQRHRHDRRAALTAAARVLAQYRRMELPMLAFRAPEQVEKRRATKVQNKHWARERLSLGMARNINDKLPKNVPY

SEQ ID NO: 12110 - protein, 81 aa, Chlorella protothecoides
MVDRVTAKSRGFGFVTFAEEDDMKAAIESLHSHEIEGRRISVTKAVPEAKTAPGTPAGALRNGGPLRNGEYRPRDDRRWDS

SEQ ID NO: 12111 - protein, 180 aa, Chlorella protothecoides
MNSGEPRVDKGGEVGSVLGSGPGPLPRPPTPPHAHLNLLEQVWDVLVVKGQGAAEEGVEDDAAAPHVHLWTRVEPAGDDLRRGVVGRAAGGLEEVAVAHDVAQPKVRDLHVHARVQQQVLGLQVAVDHHVAVAVLHPRHDLLEEASRLVLHQPPLLHDVVEELPRLLLCWNRRGHGDGDG

SEQ ID NO: 12112 - protein, 232 aa, Chlorella protothecoides
MQDAIKEVNPRMIILSGGPNSVHAEGAPLLPPEFYTYCQSSGIPLLGICYGMQVSPGLTDGWLCSILKRVTGCPRRRSPPAHQLPFNPRSTLQLLVHQLGGVVQTVMDSGEYGRMPINVERDSVLYAGEEADRQLVWMSHGDSATALPEGFRAVAKSEQVPRCAAAQAFLPPSPSPQGACVAIEDPSRKFFGLQYHPEVVHSERGSAMIKWGSGSVCWGTCVWDLVEAGLGL

SEQ ID NO: 12113 - protein, 273 aa, Chlorella protothecoides
MRLLLVHLEQGSADAPRPAGGDEAHLLAGRRVAARGGGVPNVLVVTTTVGVLHGVHGHTTHLGPGVALHAVLVVGAPRLEQGLLGPPTAGDLADGGAATGGDDLLEAGGQLDARDLGVGVVRHDDGVVAGGARHRAAVAHLLLHVADDGTLGQLAHGLHVADVQGRLLAAVDVLAGVDALRRDEQLLVVHVADGVAEGHLGGLGPGPGGEWAAQDQARPRRGRGPGGELGRAGRSATAAWPRAEVLSQWEKPSQELAPATQKGHQKDPAFECT

SEQ ID NO: 12114 - protein, 172 aa, Chlorella protothecoides
MYEPRPVYNDRSIYEPRPVYDDRPVYEPRPVYDDRPIYEPRPVYDDRPVYEPRPYYARDYSAPVYDAPAYDAPAYDPVAYQPTAYQPAPYEPRGGAEAHAPRGAGAYEPRGGYRPREEEDLYEPRGRYESAPQEYSAEAYKASSEDRSSRGYGRERGHERPLRASGPYDRAR

SEQ ID NO: 12115 - protein, 652 aa, Chlorella protothecoides
  MOD_RES (42)..(45): Any amino acid
  MOD_RES (116)..(119): Any amino acid
  MOD_RES (562)..(565): Any amino acid
MAVHRSHEQYGLETGGIWVCLAWLVSSSVAGRHLCGSKLQLXXXXSCSVAGRQMGMGAVHDISHMPPPDTQKPLPLHRAASAAPNSNFFKGVQWSPDGTFLLTCNDDAVLRPGKLXXXXCNDDAVAKSHANHDPVRTPLESPSTYWQTACVQQRAGLRVFSDVLGTGPDLGEAPPPPLGIPGGEAVYDYAWFPGTAAGDPASCCFASTGRGHPVHLWDACSGALRCSYVIHDAADAPTAARSLSFAPDGGQLAAGLDRGIHLFDTARPGHASRRLPTHARGGEGQPGIVAALAHSPFDPGWLAAGTTGGAAGLYDTRAPEALCLLQGCAGAGVNALRWSADGNFLYVGSRGRGGGVACWDVRGGAVPYFIPRAPAGAAPHQRMQFDVEPAGRHLAAGGCDGAVRWYDLRDGSQADACFVAGDTINGVSIHPALPLLATASGHRRFPLCPSSSSSEEEGEGGDEPGPASDRSLDLAEAPALGLGEQGGQRERSPLGLARCSQGDDPAHGCNVLRVWLLDSQPFDLYSERSGSEHGEAKICDEGATKSRAHKPLKSLIKRQLDXXXXCSGCGCWSRSRLTCTPSDLGASMERQRCNVVTAGEGWSCCLDIPSGRGSLRCDEGATMSRAHKPLKSLIKRQLDSIWRADYPFKNIH

SEQ ID NO: 12116 - protein, 144 aa, Chlorella protothecoides
MALVEPGTLLNRARLGVLQSGQGAPGGVSLPHLSLLPPFLAGPRPHQPRPAPQPSSNSPRQGFLYVLNAVTGGALEGWPVQMGPILGAVVADDINDDGKLELVATDTLGNVAAFDGTGKEVWERHLESAISQVGRDGREVQGGG

SEQ ID NO: 12117 - protein, 263 aa, Chlorella protothecoides
MAPILLVPLAASPSPTHLHLVVLAHDGFLYALHGADGCVEALDLGEVGYAQALADDLDGDGRLELLVASMGGDLYAVATPAPAHPLRAWTAAAQGLNGHTARWGRRGVWASADARAPRDVRGRTLPIRFTLLDGGAAARGRGAAAGGSNASWPVPGPGPWRVAATLTNTPLAHMAAAEAPVIGAADTVAAGGRYALEVPCPVARTTATVRLEARDRFGLLTCDEFSLSFHMHYYKLLKWLVSLPLAFTLAAVVLMGRQLELPM

SEQ ID NO: 12118 - protein, 387 aa, Chlorella protothecoides
MITRWLWVVALFPAALAQVVGSTVHLDADRIAGNKFLQRSATKDSVVHSQQPPGLDVEKDCPAPWSPARPARPHPPLPPPHHRDEVPYSTCSHDLAIKWHARAGSAVYATPLITDLHSDGRRDIIVPAFVNSLEVVEGRGGAKQADFEAFHESTLHTSPLLFDADFDGVQDIVVATYGGEILFFKDNALDADVRPPHPDITLARQGEEASRRLVIPPLEVRRGWFEGLALDHVDHTRPDVTGAEQQTGGQGAGRRLLSQSEGGEAVPVLESTAGQQTVQERVPGDAAPRPEPDQVAPRGRATRLLAEEAGGAGAVGGQGLAVGAATPPGGQNATGSFGTIGSVAAFLCSPLASAVTGHVMYVDNGLNTMGLALDSKVLEREPVDASA

SEQ ID NO: 12119 - protein, 290 aa, Chlorella protothecoides
  MOD_RES (256)..(259): Any amino acid
MRSSSPSSRTPATHTPHSCGAIQSPEHTTTFLLSSLFPPSKNTCTPISPPGDVDAIAGGAGPRHELVEEGDVVAAVAVHAAGHVAHRHRQRHLCVLRHGVVVRGEQAAAAQVACQVLQHRAGDGGAIAGCRATAQLVQGHQAVPGGTRQRGRGLCHLHEEGGLAQEQAVARAHAHEQRVGRGQAQARRRDPGPHLGQHHRQADLAHQRRLAAHVGAWACVGCVRGGGSEGDGRRGGGEVMGRGVPGAQCGSWRGRXXXXRGMGGEGGGGDGSRGSWRPVWVMERPPTGLG

SEQ ID NO: 12120 - protein, 222 aa, Chlorella protothecoides
  MOD_RES (7)..(10): Any amino acid
MSKFMDXXXXPGRRHSRVCHVCGDDCSEPWQSVQKGRLHIPPHTTPCLAQENVALMSKFMDLKRFSHIYVVDLCSSLCRQVGAGLVNVAFQRPFQLQGTPLIANNHRWPTKFSLPSHSQAEQKVAQHGWTNVTVVEGDACTFVPPGDVATLVTFSYSLSSTCRGGKWGESAALFRHRDMLFPCSAERIVENADDLSQLCPYPPELAPHWDLVRTHRFLASAP

SEQ ID NO: 12121 - protein, 426 aa, Chlorella protothecoides
MGRIGTPPWPAPRSSPANVRQSSTAILWCAPARASRRPPRRVWELEGLARPPEQGKSKSDGILLRLGLLPVMVSVSMFSCVTWSPRRSTPGRLPGGPNRTRIYVASSAEHEQFQDPENQLRRYGARYGKPYLLQSIVDTAPRVRVRKARDRARDQLADLAAPDPSPLLHLIPLRPPQVMNERLMHGDDARAAAIRQRLDYLRRRRLAWEMVYDVVIRDDALCTLSVIEEANSRVQRILSEEHRERAGVASLRRQMVELQGEVASARARLDATQEALARNMAAMERLRVEAEALQGLVAGGNLVEAGEPSQATPLLQHGLGEVQGSGAGTPGRPEPPIALPFTSSAAIGLTSEERALARPSSHAAPPMGGHAAAPPPQVKRRRGLKSSLFLEPGLKEHWYGVAFCSQLQPVRMLLDAGHSCGAAIVP

SEQ ID NO: 12122 - protein, 328 aa, Chlorella protothecoides
  MOD_RES (149)..(152): Any amino acid
  MOD_RES (171)..(174): Any amino acid
LSIAGSHGSLRSLAGPGPNPALLSSYSAAPPASDPYASAQSQGGGVALIPMPAPREPSAPFFDPLPARRHGPLGRAVVTCQVVLLVSVWITLYILSVWQAGWSLADLAVNPWAGANPRALLAVGAQSHGYVASRGQGWRVLTSPFVPAXXXXTWPRVARAGVFSPPPLCRXXXXGGGGVGGGGGSPATHHTCTPPSTPYTPTRRHHPAGAKRHAALHLCAVPGADAAAAPRNHPRHLPGGVLVRGGDGCQPERLLRVQRRLGRGRCPAWCVEGGGGVVIGKGRAMGGENSSHWSCVLGESLQVAYPLAYGEARGDVDCLRQDKKGMPV

SEQ ID NO: 12123 - protein, 399 aa, Chlorella protothecoides
MWELRRQDGGDVACVPAGNPASTSRSPGESRGMQECTASLPLYALAPLIPHDASLSTHWPGGVPCTEVDGFVWVWPGSQAPTPPPTASAVPLGFRCHAEIEVEVPVEHGLLLENLLDLAHAPFTHTSTFAKGWPIPDVVKFQATKLLTGNWQPYPITMSFAPPNMVVSLIGLSRPGVVERVSDVGATAAGGWPWRLGLLSRASSPFGVGLGLAVQVRRMRSTPIPPPSSIGNSFLTLMRDHVPRRFPRPRSTPAPSPLQGLSAESCKRHLHQLHVCLPSRPGHTRLLYRMSMDFAGWLRFVPGIAAFWRSIAGQVLGEDLVLVRGQQDRMLRGADTWQTPVSYDKLAVRYRRWRNRLEGGELDREVVAQAAAALAMSAGEMFALSEERCGDDNGTCVAE

SEQ ID NO: 12124 - protein, 172 aa, Chlorella protothecoides
MVLPNFPPQTSVPYLQVEAPPCFPPTFLYTQSWEDPAVDEPILDIQPDDVCLTLTSGGCNTLHLCLAGAAQVHSVDCNPAQSALLELKALAIRRLGYDDVWSLFGEGRHADFPRLYERELSPFLTQTSHAFWRDRLHYFRQGLYYQGGMVSGSFLGVENWFNEERRGAGGGQ

SEQ ID NO: 12125 - protein, 357 aa, Chlorella protothecoides
MIACTLTLVVAGLQTSTAEVEAELMALWSAVEKERTEVTARRERHAAARETRAAPIAQVDVEAEAGSSPSHSKWLPLQGADPAEVDLGHTKLLQEGQESSSFVSPTEDLRCEQAALNPSTAIEVDEGSLVVDADGQPPGFLRVSADMFLDVWLLPRSGQGRGEERGECQGWAPATPHGRTPACPVPHTARALPEGQESSSFVSPTEDLRREQAALNPSTAIEVAEGSLHCTPPFPPSQHLPITDRGPDRRAFHLALCLAFFNQAVASTAIINYAPSLLASAGLAPARATLASAAVSACKLVGVVVGLVLVDRAGRRRLLLTGSVLCTLSLAWLAVADAVGSVGLLLAGMCLFVLSHR

SEQ ID NO: 12126 - protein, 182 aa, Chlorella protothecoides
MAAKSPATSAATATLFATGAASDALFLSLRDWLGPGAFAMYACIAAAGGVYVMAKVPETSGKTLEEIQALLAGGRRDLELTAGTGLAAWAGETDVVCRDPPGVVPVDPVAGGGGGGLATPSPARVVLVGEDGEGEALPFEAEHREEHKDPACTLLSPSTSTSSSAREICRPYVSCVRVGGGA

SEQ ID NO: 12127 - protein, 164 aa, Chlorella protothecoides
METLLPCVDDLGREVEAPGRPQYNVLAMHQPQPSIAREGPLSKAQYSASLAGSSQGAVVWMAQWLFWALGLGGGMKRLVSAPTLEDQVKVWEGLWVVRFLVYAPVWLSSLFVQFFAALLFNRAALIRKDGVRLSTYAARVFDGVVRGYSLRDDNCFYYNCLAGE

SEQ ID NO: 12128 - protein, 144 aa, Chlorella protothecoides
MAVRGFGGSASQRRLQLPRQTSHGPPPTPPPAGRYARNNCPAYLTPHGFANLKQGALDSLQIHTGFFLPTLNKRKYSKVILMDHVDWLSLPQAELHTPGPQEVAAALGRQVVKGGKVIWRSAALSPPYAPLIAKAGFKVSGKLS

SEQ ID NO: 12129 - protein, 227 aa, Chlorella protothecoides
MGGKSTLMRQICLAVVLAQVGAWVPAASLRLTPADSLFVRMGARDRLLLGQSTFFVEMAETSAALARATRHSLVALDELGRGTATSDGAAIAGAVLEHLASDLRCRGLFATHYHAVAEHAQVALPVAVCHMACRVDGDGGDHVTFLYKLVPGACPASYGVNVARLAGLPDAVVRRASSMAASLAQGATIDGEEGAREKLGSILEACRRGPKAVQAAWLSMRRPAISV

SEQ ID NO: 12130 - protein, 101 aa, Chlorella protothecoides
MAGGGRGAFQALSTPLAVDGAGATQRLRLNQLLNTSGKLGRANGNSLGALGLMFAATESFGNYMSDGVVPSEVVTLAAGASAGALYRSECIFWDHSIISMQ

SEQ ID NO: 12131 - protein, 355 aa, Chlorella protothecoides
  MOD_RES (10)..(29): Any amino acid
  MOD_RES (171)..(203): Any amino acid
RPACRRAGGXXXXXXXXXXXXXXXXXXXXGADSEGGGGDGAMPDADASPPPPSAAQLSSPSQVYARYVAAATRARAEALKVRQQEIVLEELCAEVEKRAVLVREQQAEYERLKGAYAGMGAALEGAEAEARAARAEAEALRAQRRRDARELRGLEQQRVDLGAQIVRLLAXXXXXXXXXXXXXXXXXXXXXXXXXXXXXXXXXEAGGAAVGGGDGGQGRAESAPPAGPPTTASQVTDSLLLEFRDLEELQRRNAQLVAVNRELAREAEARREEARAEVRAEFEGVLSGLRADLDALKAAGAAARDLLEKVTRQRDTLRALLAGADGDLAAAREGYAVALRRGGGEGSPDDAADAT

SEQ ID NO: 12132 - protein, 434 aa, Chlorella protothecoides
  MOD_RES (264)..(267): Any amino acid
RRGPPAPRRARRRRRAGPGTGAPPTPARAARPPARRARPRPRRAGPPPHPGRGPWRPPPPAPRGGAPDAPRPPPRAPAPRCRGPGAPSPGAAAAKRRAPENRAPTRRAGPRSRPAGPGWQGSGGGCRAGWRWRGSGRGGWPGMPASSPGPSCCGGAGRAADTLQARTHRWCRRRPCDARRHTAMASIKDEIYTGSAFTQARSLVFTRAGVCLDRCSSPTAPKCIERITSREIHLLTGDGQGRGQEALGAECRSHTQTQDHCHCXXXXRAMAKAGDKKRLEQNADHLRKLKIIVIVANVAWLVVRFLLRRSTVTWTSYAALGLTSLVYAICYPGIATALGEALVVGMPFSGWTRCTENLCSYYMGGVLSYYHDLLYITAFVQLGSTISKWAWLAFIAMMYYLCIYRRWKCSAAHEMQSAYSLCICHDDSPPSPSL

SEQ ID NO: 12133 - protein, 155 aa, Chlorella protothecoides
MGPFGAIERPWKPFNPILGETFEYHKPSTGIKYLVEQVSHHPPIGAGHAESPLWTYDLVSAPKTKFLGNSVEVYPIGRTRIRLKTTDEVFSLVPPTSKANNVILGSTWVDTYGDYKLLNVTTGARAHMVYKECGWFGSGRYEASAVDGWGRVLVV

SEQ ID NO: 12134 - protein, 122 aa, Chlorella protothecoides
MTPLRRIPCPGVHASKHSPRRRGALTAPAPSASTLRCTASQDRKQAFKSYKDYLGKDITSLVILPVWIMQPFTMLQNMAEIMEYTEALDKAAVTEDPYEREDMPHPRLCKRDVAPTYDTPAL

SEQ ID NO: 12135 - protein, 362 aa, Chlorella protothecoides
MCILDGNQYDAKCVDAGEERGDDLEACALLLNNKAQPLLLAGAGGSHSASSRVLVPLTRGAAVLPDLHVSDSSEAMLSGRKPPFRLLVRASGGVVPGVVVRHAVSEGFVVATRRTRTAGKVEIPNVDDHVSKLEHMGKETVKKLQDVRGSGHAAGIDIAVPDNAINKVGEFRRLALLAEADGHLRQKLQQVLKLSKEKWEEARDHAMKAVVADNRMRIWYADKANMEVGLLFTCRLGNVDLDRPVGLLTKKAQDGAQTTMDATLMAQQTPSQRDQVRALQPAAVAAWWQGGHPGWAIYPVDSEQFLATGALDSVALPPTDHIVAPTLPGGGAAGGAAPGGPGGGYPPLGPGYLPGNEALLRA

SEQ ID NO: 12136 - protein, 727 aa, Chlorella protothecoides
  MOD_RES (29)..(32): Any amino acid
  MOD_RES (58)..(60): Any amino acid
  MOD_RES (395)..(398): Any amino acid
  MOD_RES (533)..(536): Any amino acid
MPASVKSVCMKVRAYVKLNLTTLNTVQVXXXXMNHTTQPGYRGLQPPAPRPRCTGPAXXXEVGERRLAWASWGVGRWGAGMQGGPVRAATLAGHWWQPLVAGMKGGAPFLAARGTSRGARWGAGRGSEHHASEWLFGEDRDIQGDSSGGHYQRFKTFPCLALLTHLGSMSVVLGVLFMRVEPQPGHLTPKYQLHIITCIIDFSEGLCAAFCPSGHLLHLGISCTLYSVLTARYIPPEQIDTFPILSSLSAACWARAHETAWIHEHSSFEGEHTTLGRARMKLLGYMGTGLSCDEPFDEKNHVLLVLLTKLVAPAPGLAAVHAHERRGWGSAPCPRQHEPGQHSRCRQARAPVPEAEKVRIWGDVSGSTAGLGIEHSATRTHPCPLQAARGGEGAXXXXSGSNIPPHAHTPARSRLHEAGKVLSLELRASCAPEDVEMQAWSEVNDGDDDGALLEALALDGSEPAAYARAYTAFAAWVDASLDLYKVPGGGSAGERRGAGPVGRPDVGCRPSPHPLCLHGGAKPRCPPPPSPPXXXXCWMPPLTPHPLCLHGGAKARCPPPPSPPPQPELACLLYPVLVHVSLSLVERGAASEAHALLAEHGPRFAAAGSGPAAEHRARELQSLQTLTGREQLAGNAAAAAWRARRAGVRLSAYSHGLLLRALQTPALQLILGVVNGHVRLEVAEGPPAGAAELAAAEELGAGRAGEEDGAAHNRGPIDLQLLQVGHR

SEQ ID NO: 12137 - protein, 164 aa, Chlorella protothecoides
  MOD_RES (44)..(47): Any amino acid
EPGAGVRAHVEGHGLVAVGSARWALGDEGESGAKEGVGAAPRGXXXXEGHGLVAVGSARWALGDGEESGAEEGVGAAPRGVHAGNPSMRSSHSPAPPSPDTGSHAVVHVSLEGGALGTLELADEVRPEARGAVAALRSLGLAVLMVSGDGDGPCAAAAARLGIA

SEQ ID NO: 12138 - protein, 98 aa, Chlorella protothecoides
MSGKALRGNKLVFGDYGLQALECSWITSRQIEAARRAVTRQVRRGGKLWIRLFPDKPVTMRPAETRMGSGKGAPEYWVAVVKPGKVLYELKGVPETSA

SEQ ID NO: 12139 - protein, 462 aa, Chlorella protothecoides
RLGRLRRDLDRFEGLAALPSVPSALADRYRFDAPGEPTADAGGAPLDDKALAKARKEVAKQQKVGWLGVCCVCGKGAWGTVMRSRGLPDRRGAGGVRHRDLPDHPPPPPDPQAAGGRAGEEPRLPRAAARRHCRPGAGRRGARGRCGRRGGVTRGFAMETWTDGCMEESSTEVLSPQDREQVQGGAGVGKDEPKGVCEVVGRGSTPQRRASCRGALQLARGAARLHVLLGEGLGGLRPPAPRPRRPAPLAAVALGAPALLARGQSHGAHGHVHVLHRPPEGHVLDPGQVGAVLHAHAHAQHVLECADVGACGPQQCAHSPLGHGQHAEAGAGHGLDAGRVARVTRDQVHHLRRAGGQRGGTGRGQRHGAEGHEGRAWRARLHRRMASAPRAQGLDGLAAGAHHRPRAVPGDDDAQRQLGRAGARRQALQRTGDGGQAVQQHAQRGRRAGHAGRREDEQALRG

SEQ ID NO: 12140 - protein, 261 aa, Chlorella protothecoides
FCRYNSATTYPTERLLIFASPSVASAAAALRVLLDCLAAVPGALERLAPRPGSPELALRIVIPGHCAGAVMGPGGETIKALGARCGCHAAVEPRPPRAAFVPFRAVALAAPGPAALAAGAAEVMDLVTRDPRYAPGIQAVTSTCFRMLPVAERRVGALLGPAGAHIRALQDVLRVRMGVEDGADLAGVKHVSFWGPVENVDVAMRAVALATGQQRWRPEGDSSEGGGTPGAWRGRAETTEAFTQEYVEARGAARELQGAAA

SEQ ID NO: 12141 - protein, 298 aa, Chlorella protothecoides
  MOD_RES (64)..(67): Any amino acid
  MOD_RES (147)..(150): Any amino acid
MPHPRPPSPSIRPTSRPRTTWATCPRGRRSGAWAPSWWAWAPAWPCCAPWKARTPRPVSCWPGXXXXEEVWGVGAQLVGLGASVALLRALESAHATPGVVLAWAGIQAAHVTLRAAALSRLAFPWPNRKRAAALVAAHICEGRVPAXXXXRKRAAALVAAHIRAGRVPAVREVNRGESALALPPGDVALGCTLGEALAAGAGRDLAALCATYSAEAYLLTRHSGRCWVVLRQRAGAHDALRALWQAAWLEAHPGEGEAAGLRAMQAAFPDFQRQAEAQGWVLGDSLLGQGPTRLHDAE

SEQ ID NO: 12142 - protein, 159 aa, Chlorella protothecoides
MQTGPPSRRAFAGHDLRPEGPTAVHGHKLRFPSLRAGATSSPPTPQSAPSTLSFIEVGPQRIQRLGVGEDGEVREVGEPGLGTGQKEAWSGESAGPLGPARSFLAGLFLPKDWPDSVTPDYLEYQLWTLPTHVTGVMSHALATTSMLQVGSHAGGGPLP

SEQ ID NO: 12143 - protein, 176 aa, Chlorella protothecoides
MRGVLTPRASAACNGRMVTGGEYGAGYASRPGLTARQPLFGAPSDQVQVSVEPSLDWDDEIEQLRAGVGRLKQVSSAIQEENTLTKQVMDGLVSWCYGEGMRRPGSCADICQSAAVFIESAMETSRQSLKQASKRLRRAMVQSQSNHVLYVFLFAIAVFFALYFWNKLYKLLRWIL

SEQ ID NO: 12144 - protein, 290 aa, Chlorella protothecoides
MDIQISKYQGEEGKAQSAREAAGGGAAPGNAAEEARTQETRSGCKSPPSIPHLQAAGIEVRERTRRGGAIDYSKEVPFERRAAAGFFDTRGEDLQRGEPGRPGQGDDAGEVALQPGCRGLALNAGGGSVAGTVQQRRAPAGSSAVPTVAHLFRMNTYGVRTPLPCECVSFSKPNPPPGTPTQEATRTSEMQEDFRPITVDELEGRKRKDIEKELIKADLAKARVAERANAPAALARALAANEASAGPVRRGKLMLPAPAVTDEELEALARGGYAAADRDADVAAGGSAAT

SEQ ID NO: 12145 - protein, 147 aa, Chlorella protothecoides
MKYGLNQWARISSLLTRKSAKQCKARWYEWLDPAIKKTEWTREEDEKLLHLAKLMPTQWRTIAPIVGRTPVQCLERYEKLLDMAAGKETYDPTDDPRRLRPGEIDPNPESKPARPDPIDMDEDEKEMLSEARARCVLGLWPHVACWE

SEQ ID NO: 12146 - protein, 154 aa, Chlorella protothecoides
MRVVPRCPSAPGDHLHPFSLSTLTTVPPSPQAVGIDAGPGGAAGASAAIKWISKDGIGALGRFAVSARFASVFDEDPRRWRLAAEAVTTLGLALEIATQAYPGGWGVRPRLPLIPPNSTGHFVLLAGGGNLATAVGHGLGHPCFRVIQAREVGG

SEQ ID NO: 12147 - protein, 98 aa, Chlorella protothecoides
MSKASRSAPLPMQVLDPSALHPDDYLEAQRAAAAAEEQRRAAQRQATGRIDFVKSASQPNLGASRPSTEEALAAAQARAAAVAARVAAMGPGYAAARR

SEQ ID NO: 12148 - protein, 319 aa, Chlorella protothecoides
MVPVRWWLRPRPPHSPLPTQALVDRPDEIRRVVNFKRLVLTDFKIDIPRLAKKSVLTKALEEADVFAKFSNSSWGRKIAKREAKANLTDFERHTALVAKVTRSKKVSAAAGGRGWRGWAWAVCHGLAYGVRLIEGMILAREICWGSPPTPTPSPLSRLGRRDTPLSPRASLGVVQPCGPLAQEGVPQDPPLRLRLPLEVREGGLHGPQAGGLALPRVRLQPGRLPQRAQRVVRPCALPEHHPAPPRVTGEQVGLCRVGRAEGRQVAPGPRRERLAQRAAQRDVARRQRQRALPSIHLADGGHAPCADGRPGGRGPRRAA

SEQ ID NO: 12149 - protein, 72 aa, Chlorella protothecoides
MPFTRYVEIGRVALINYGPEYGKLVVISDVVDQNRVRWGTRGRRREWTYWRGLRGAQELDCGVERRVAGSWP

SEQ ID NO: 12150 - protein, 561 aa, Chlorella protothecoides
  MOD_RES (23)..(25): Any amino acid
  MOD_RES (473)..(475): Any amino acid
LLSPSERTHAIAASPWTPESLAXXXARHGRQGRGRPGTQPKRPPRAPQLPRQASCRCRSTNMPLQPAPGLREGLACFRPTTPHPPPPPPAHPAGSGGRWRRRPGAAAPAGRPRSRSGGRDGAWRRPAPARPPRPGPLRIGGKVHGPCAAVPRLIQPGVAHGLAGEAGAAGQVGVLLRRQAVLQRAGGLGCQAVRRRAVVRQAHRAGVAAVHARQLLAGRWVQVRDHGHVAVGHAEHRAGGARGQGLVLALLCGGCPRGEREEGGGMELWQGGSSKNWGLAWEPGPEGRPRRLHGAPIPTPRINCTPSFPPPTTPHRAPPLTLVRVLELVVLALHGLDGAREVARDGGPLGGGVAQPRAAVVLLPHQLHQLVLLLGGPGLVGFLGLGVHRGSGHAVVGCGAREVGGKGVKVSRERGLRSWQGDGKRRIASGGPGAPALDPADNPTRSRAPPWQEPGPAGKGAPAVLLVPPWRRXXXQEPGPAGKGATAVLIVPPWRQAHGPSPVPHAHQGPCRPPSSPPAPHQTRCHCVSRVTGLQGPPGHAAGLAGRAPCLAQSHPPGRSG

SEQ ID NO: 12151 - protein, 139 aa, Chlorella protothecoides
MACAGSREMQLSSIATTLPSLWWRQLRTTCTPEAQPRPHSIHPRPSDSRSVHAPNSRRQTLCGTLDYLPPEMVEGRAHDTGVDIWSLGVLAFEFLVGTPPFEAAGHSDTYKRILKVDLRFPDTPVVSAGARRLISKVGE

SEQ ID NO: 12152 - protein, 179 aa, Chlorella protothecoides
MPHGYMSMVSHLHPSASEQLAGMYGGDPGSMGLPYYGAAPHGLTPEAAGALQHGLTPEQYSYLSGGAGFPGQAMGYAGLYEPGDGGAGAMHLPPNFTDVLMSSLQYGVPGTHPGAGGDFAAGLGGGAALGPGGAMPHHDRRFWNEADQQELLRLASDATYRQTLLGEQGEGGGDEGWSV

SEQ ID NO: 12153 - protein, 107 aa, Chlorella protothecoides
MTTATVDSQAKKSDEAWTPQEEDELVKLVGQEDYRRSRLGDTTTKWAPIARHFSRTVKAVKRKYDKLQNPDKGERWCSFILGVGIGAYRRGAGKAPLVPLMRPPRAR

SEQ ID NO: 12154 - protein, 210 aa, Chlorella protothecoides
MATLQVDKENCLPFRPTHLGTKTVAKGLTEQSGARPAVLQPLSVNVASNTAASAAPGKAAQPTGPVKTAAAESRTAERTSSSASARWQLTDFDIGKPLGRGKFGNVYLARERKNKYIVALKVLFKNQLQTSNVEHQLRREIEIQSHLRHPNILRLYGYFYDESSDPDRRTLVPHPSSQTRVYLILEYAARGELYKELQRVGHFDEPRTAT

SEQ ID NO: 12155 - protein, 461 aa, Chlorella protothecoides
MHQEFLANMDALHAFGSGGVLRLLLTQGGSSADRDVVVILRRLSGSLLRSGRHSPAACAPLTQLAMLLEDGASTAWTLDVQRWQATLIRSLAAEAWQRWLRGLCAEPATSLPGRLHASELTRLVGKIAAGTSVAIGAVDARKAQLSGAAQALLRHRVPNSRAMAVSERAALRAVCAATLAAHSDTIPEDLREAFGAAIHDLLSHDQPAAGDVVSLLAHAVNGSSHSGLRQLWLVCFMPIVQLLAHGEEFAGGWWTLGPLTGAGCQPSALGGSMAQYAALRSVLGSAEGLLLCLSDNIGLTTSPQTCWPLEKPGLSWAWAASTSASLLRHVTPQLRCVSGRDAACALSSHVYLPIFDHLPLSNAPAPFQPGEGGGDEGPYLLAAAKSKKDLATSAERLEHLCTPRPLPPQYFEIRSEVCRFCSGIGSTEPVRSLIEVGMLCRGVSAVRQRIIFTADLCMLKE

SEQ ID NO: 12156 - protein, 197 aa, Chlorella protothecoides
MWHTALLSTSLNLAPGVFIQAGATLAVLNLSQQTDASDLLGGFRPVRPTDAALPLFERFQDLVQRQWPAGNNGAFIDRVARLAAKRHAGRLVKAFKVALAKLGVACPPSRAELAESAAPEPSTPARELRRAWLKFSVDVAHAEATLLAAEGGFSFAFMEGTLVQALRQGSWLLLDEINLAPPEVRGPRQGRCLLCSI

SEQ ID NO: 12157 - protein, 258 aa, Chlorella protothecoides
MAAFVRGQRLHIFNCNQHTEASDLLGGFRPNRAPVAEGEAFVPFVWADGPLVQAIFQGDIILIDELNLAEDAVLERLNSVLEPGRTLTLAEKGGSAAEVIVAHPNFRVVATMNPGGDFGKKELSPALSNRFTTIWVPAATTPSELHAILRQRLVPAAQAVTQPLIDFWTFFNQEISASVRQALSMRDLMAWVEFINLTTPGLGAMLAYAHGAELILLDGLGLGVGLPIEVGMRVWSSCIGSWQGSRSTIAVWAGGPHV

SEQ ID NO: 12158 - protein, 130 aa, Chlorella protothecoides
MYATPGVLAVWSPESLSKSRTPPFLPARSDGPLLHAIKTGAWLLLDELNLASQSVLEGLNAVLDHRSEVFIPELDQTFTCPPTFRVFGAQNPLQEGGGRKGLPRSFLNRFARVYVELLGTDDLHFIAGGW

SEQ ID NO: 12159 - protein, 420 aa, Chlorella protothecoides
MQSLGTYDAEAQSQLDVATSLQESCAAWANSLLQRYPSYRDILEPVQTAAGELQYGLNLMVTARQLGGTDSQGVSAQLATLMRYPKPARLHLTPRLVPQLVARGRQTHDPSQEAVGALAARLKLLLFVLEDCSRYLGAVQQSRVPLVNETEWKTVHHVYGALLQVWVDVQNEERRLEEEAALVFKTKAKAVTLSIDEQVGCSMHMPCALTTLGFGMMLGHLQTLNALPPPFPLKIIQEDEDAYNQQFPDHRLAFADLELDHDVADAPNEVSGPEQKAAFALVGTLKGHVLERLAAAYAALFASRREVVAAGRSPAAFLSAYQLGLQIAGGDSTFDSSLDRETFTGHITAVAQEFHTLAKPASHEADVETFDIQSPSSEEALLIRAPVAALQLHLLELLAEWPEHVLLVQVRWGRFATIVH

SEQ ID NO: 12160 - protein, 217 aa, Chlorella protothecoides
MGDGSTKGAKDVSDEIDNEDQLLGTDKDKQDDGDNEDTMDNDAKGSEDENEGDELDRQMGDTGDAGEDVDERAAENQEQNDTVNEKDAGSSPEDARGNTDTVAGLEEGNQSGDDNGADDAREKEEDGGGNEGEDAPSEMEDEGVEDSGMVDDDNHTHAEEEAAPFELDHDMDAMSEGSEDETSASQASDAAGDAASSDEEGEPDGDDDEREGAEKRM

SEQ ID NO: 12161 - protein, 368 aa, Chlorella protothecoides
MAGLLQDPRGSLVLAERGDAEPVTRHPDFRLFAAMNPATDAGKRDLPAPLRNHFTEVWVAEPSQTEDLRAMVTSYLGQTTPRGVVEGVVSFYRAAKADRGLVDGAGACPVFNLRTLCRALEYVRAATARYGPLRALADGFDMAFGTALEARSAARLRYAIQTHLLGGAGYGATTSGAAGAPPGDCHVCVEGYWLERGPAEAVPRERDAQGRVFMETPAVRAHVRNLARALVLRRCPILLQGPTSSGKTSLVGYLAARTGHACVRINNHDSTDLQEYLGRYVSDEHGRLVFAEGALVQAARRGDWVVLDELNLAPSDVLEALNRWEKRVAERVEGWHARGAKGNAWLRGTFLTNVGVCQLKGVLPLVLT

SEQ ID NO: 12162 - protein, 454 aa, Chlorella protothecoides
MISFLARLQAETVARTGFAASGGPWEFNLRDLLRWCELVAADCSGCDAAGSAMADGDGHELQYPRDPCDSAAAHHGHMLFTQRLRTAEDRARVGALLSQTWPGHGGAPAAAPAVHLTPQVLRVGRAEVARSRAPRMGGAASQPLLALLPSKGRDLEGLARAVGAGWMGLVVGPAGAGKTALIRTLAELAGRDLTELSLTEGTDTSDLLGGFEQLEPMRRVQVRIGAAPTEIGHGTINFLKKHRAGSPVQPATSSTIENHASLVVDVQNIGAAVKASLASCGRSLLLLPNVEGAASVLSAVTRCWEASCEALPPGASQDEGEGQEQMGRAASLLLLAVDGLLAQLASHSPSTAALQECMHGLVSHLDLAQQRLGALLAEAEASEHGVAGRFEWVDGPLTRCVLVAKAGRGERPQAFLAHTGHGQPVPDEVPLLHGNPVQTSGTTAQPQPTSSSPG

SEQ ID NO: 12163 - protein, 225 aa, Chlorella protothecoides
MSSGGQLQPYYHPFHRLLDDNRELFVPELQETIKPHPHFMLFATQNPPGLYAGRKALSRAFRSRFLEMQVDDIPPTELVTILEHRCGISNSDAGRIVRVMQALQDGRAAGNVFAGRHGFITPRDLFRWAGRGGHGDELAINGFAVLGERLRNAEERSIVRQSIQTELRVKINLEEAFFTEGEKPLLELQARLRAGELDGAMPGPETQALQKMLRGLVWTRPMQRM

SEQ ID NO: 12164 - protein, 410 aa, Chlorella protothecoides
MAMDPRHGEVSRAMRNRGVELFLPDWTLGEGAARETAELCLVLEQAGIEEQALQSSMCAAHAVATVQAAGHSRRPPGLGALKRWALLARSLVARGWGASEALTASFGQLYGGEEGQSPLAAAHAADSRSTGVTPSHGLVRRAAWPLPRDVAAAAEDATAFSVARRATPAVASLVRLGVELMQPASAGAAPAITPNALASLLNTAPLDAATVRASVVLHAAQGATAELAPWVPGHGSAASLWRRALACTHAAAVWAPGGAQVAPSCLLPSLAQVHAAASALGAPGLQQAVMVAAALIRELERYQGTLLRGWHPMEDGEDGMAEVQVSGAPEAALPCAGAPLLTRIIHGAVEARALLMAAILHVRSAEDAVSPLQFSYWRHAHPQVGAAPGHRAEGLSEYRDDVGLSLGISA

SEQ ID NO: 12165 - protein, 198 aa, Chlorella protothecoides
MVDDEEADKGDQPAAVEEAAGQADYRYLNQEEEVAAGDEQTLGAAADGQIDQELPDAQEQAAPDEGTEKNGERRLGMTDDAQTMAEAPTSAPAPTSPLRVEEADSYEDAAPTTASVTERDEGEMITAMGNMMQEERVRREVAYNEVGELGIIKFGGNHGAEVLHPLEKPFSDADGARVVEQVNAEHLLFNHISWRSGR

SEQ ID NO: 12166 - protein, 464 aa, Chlorella protothecoides
MQQAMAKRSAALVAHFENFISTLAERTAQLRADTARGHISRKRLALKDLFDAISEIGISKSEIAVPAQNRGVFCSFTQAFPEVAGEDGTKISNLVETINEYYYKSILRMKKVDEAMEKSPHADLEPHHALAAQHMTHHIVYMLQQTRESLNACTRASTLIRAAVFTKRPAPDGGLSGSTESLTSQHRSMSVRLLTIKTVLDEACRGLSISLPHQPSAELSGQQRVMRTLLEMGHRVAALQAALSETALPPLFKTGLVHSRASDLMESMQQSLRSMEREVEEICKTHADGFTADVLQAFQATESTAAPDGEEAAASLRQHSSDLPVFAEYLAQLQGELLSLQEADIPEAEPTSLERLDVYLDWLGILKTTVEKVSISLREVLRFSAGHPDLQGSEMDALERTLGILKSVMESISSVGAATSRLAYFITSLFCGLISEGFCRPDDDDGEEGGESFLFCVGTHLRYT

SEQ ID NO: 12167 - protein, 382 aa, Chlorella protothecoides
MHCALPPLSQDSFWNFGDGPSPPPPIKTCQGSEKEVAVGKETGAAAPAPDLLGLDIWPGALALCNYLAMHPSLVGCRRVLELGAGMGLPALLAAKLGCSSALLTDYEPLVRRALGGGCELMLHGWVAWAGEVRGHFFLTSVQVQAAAAAAPSLAHNIALISLLSYTSPFSQSPLPSPPTPFPYIKVLELAAENIRLNGVGDIAATHRLDWEDPQGTLAPGHPHSFHVVLAADVLYISDIVLPFVGMLQTLLHPEGGRERSSGGPGTGSWEAWAGASDDERHGPSARITHPSSPIHPGIALVAHQTRRPLVLDPETGVPGLSRRDEPYEAFQAAVRAAGLVPRQLGALDAGGSAGPLYLSALAWEQAYIATLEPVARLRPLKG

SEQ ID NO: 12168 - protein, 386 aa, Chlorella protothecoides
MRCRPCTGPELDFVLADTPASLKTCLLGSISGAAIQHRETPEYTPVPIAVTIGTMDSVCRRRHAVFIRSYVPSITSLSTTASGGRRKRYVWTASGLSTVDADALVGGKGDSSPRSRVDVLLRHPFEWAKHEIRHAFFPHRDEVYPGEAAGAACLSDGAMAFWSMTFPSHYPPPSLPPAPRLSRLLDLCKVEGCAPLLQQHELGLCDAGWDGTPTPAPRPAPPASSPTFTRSPRLQSLLQAVGIGAQRSLPAAATINWVLKDGLGRLGRLSVATQYGASFDADLKAWRYLYHRNPGLEPIVDPLSTSSLTPTCTASVKRALTPQTRLPSPRLASEIPVWDVHPVLPGAGPGVRHPPRPLRLPALGLPRQRGEERRTGHLCGHPGGRF

SEQ ID NO: 12169 - protein, 446 aa, Chlorella protothecoides
MVECRAIGFSVDSGDTLQEPVPARSTPVLSALLVALTATLVDVVGSAALLTKIEKSGVSLNISVNYLRPGKGGSTVKIVGEVVKIGRTVCSIEVAITEKDSGRLIAKGTHVKVRLPLILDCSVCSFVEQSRRPLDQTQTLCLLVRKMKEANPLLWKGLRISVQFTSEPQPHVQHILEAEPPFPRLDSVAEELTHRRNAVRNKTQKSRLLHWHHPGRMSGVPDYQRFAERFLDLSSNQRDSDGGPSMFDSAAMPGLYDIQAGPGHIKCYMKVGKTHVNFMGNLHGGCTGDLGQAWAAVGSLVDLVGSAALATLGTTPHVSISITTNYLRPAPIGTIIRIESSVSAVAEQDHEFLDTRPVSAYRLEPEPLHDPKTLSHCRYRQGMPGYPVMVSGAHGGRPPCSSVLISSPKIPFHATRIFPEQMMMHKQQMPGEYSAPKNEDTQTSRL

SEQ ID NO: 12170 - protein, 199 aa, Chlorella protothecoides
MWPGRVSTKHIECTPVTPTPTPPTVYGKRADSAGLSQKSERTSVWALAWAAFGLFTLQLVACILDFGNHSKIEGPAGAWQSSHEGTVLDLGARGLVQQEHMHVGGALCCNFHTPSHLLTPSHRPGAQYGSSPPYQGNAQYPAQQYGAAPQYGSAYAYGNATYQPPPQYPPPYQPGGTGTVTGFPQQAPGSAPPQAVRPV

SEQ ID NO: 12171 - protein, 109 aa, Chlorella protothecoides
MAAFVKSIDSNHLLTTGEEGYRVRGDTSCCTNNWLNGGVKGVDFDTNVADRNIDFATVHAYPDNWGIAASDYKWYGPNFLADRASIAHAAGKPIVMEEYGSREGDMPGC

SEQ ID NO: 12172 - protein, 92 aa, Chlorella protothecoides
MPLQAHAAQGVKVIRVFAHSDGYGFPDNIKTPNPIQPRLGVYNENALMRLDLVIAAAASTGIRLVLVFTNFEPFYGGIQVSPRNPPQRACQT

SEQ ID NO: 12173 - protein, 380 aa, Chlorella protothecoides
MYGLVARSAACESLCEVAARLAAARGPLASLLSPGDSAALDAFFGEGLAAAGDALRHVSDAGVRLLLSLGWLAEAVAGTNYALAEPPTRHQPWVDQLLRQLGVFADRVAHVGREELCVGLRGLSARAHASAAGSRAHRIFIAAHPPPCTPCAPPHPAPSHRPLPPPSHTHAFNHHKQASGLSQAGAARAWAGAAAHVEACVLDSVARVRSCSLEGRAAMTLDVQGVAHGLRRLAPLPVGAQAGLARADAYVKAFYIPVGELTQWALAHPEYTREQVGGGLRVVVEGSRQLLWQRGGAVKSCEWRRETPGVDVHAGPLQSASLSLLFDRQRHAHSPPPHLLRQILALTACIADSSGLRRKERAALLAQMEAALHDPGRQGP

SEQ ID NO: 12174 - protein, 114 aa, Chlorella protothecoides
MTFFQTKQLGFSTEYLGQIRLVGALASLAGVGVYNYGLKATPLRTIFLWTALLGTGLGFTQLILITGALVCGCVSVTAHAGNALCHAPACRAMPHQLPQHRTTPSTRHQPAVRD

SEQ ID NO: 12175 - protein, 488 aa, Chlorella protothecoides
MRKDKCTPSQMKACMASQPVIFCPDPADPGASNVHRLHKLYLHVTAMRHTSTAEAATVDLCPATVASRGAWGSVRGLWDRAYLLPPGAGSLAPSLWHAASAAPVLSTFLCPPIPPWERWTRTPFQYPWNGLAIIAPAPTWSSGWLGTTPSTLTREQGDRGGSGSGHTDVPLRVSGWDAYTSGDVMPSYSTAPHITHLHRWLDNAPHRSFDLLLMYYGQDPDFQCEHCVAVYRRSGAKWQLLRKLSESPVWPRVRQAYKFVMIPDDDVLMSTHGAGSLRRPVVQLCWVKGGCVCVKPSHAVSKLLAVASGSTTPSATANRSSPPHRPSSPSSPHHLNWSIVCSDQCGIPCGTPLLAVHGPAICLPAQGLLQLLAQRLPEHFQRPTLHGLCGKHGPHVLHGHPGAACAANSRECQHRLGCARIGAVMGGHGWGLCGNGSDPRVTARGGGGGDIGCHVDGLHNHQLAAATCLTHLSSSLLLQASTSSGPCS

SEQ ID NO: 12176 - protein, 446 aa, Chlorella protothecoides
MRVLVVSQDMDVASGQGADPNTSVFKTLRALLTTSPAMPLPSLQDCWGGVSPHNAPEFSSAQDAGLAHRPKHPAFRIWSSAMSFESQDLCRLSLVLCAPHTSTLPAAHHVPAGLKEYPTSIVFHAEPLPEGGYELKLPAFCPKTFSLPAVIPCRTVFRIWSLVPWTMLGALLLYVVVLRMKSWKARRWPLTATPRRKLSGHRSLPTKETRGFATFSAATLPINRLLTTDNASRDQLLRAPQSQRTCRGDAKSWRLACAEYCQHGWTWDSEYRGSDCSNPPTVATLRLTVEKALMKALGLALVVFFMGNHPCQGRVLHPSPPPEANNSWNVAPSPPSQGLEYIGSPCFRPYLLIAAVGDNSALGSPAWLDDSPGRSFDMLAMYYGNDTAFSCPSCVGTFRHPGAKWKLLHLLASRPEWDRVMQPYQAFMVTDDDLLMAPHGAEAKAG

SEQ ID NO: 12177 - protein, 141 aa, Chlorella protothecoides
MDGDYAPLARLAELRRAHGFLLAVDEAHATLVCGDRCADGGRGVGVVMCVSCGAGAGVVTPAPVGGRRGGGGGRGGQRGPPPGHPVQGRGLLRRLPGLLPRLEGPAGGQGPGPGLLHRHAGAHGGGRQRGTASGPGGGLGC

SEQ ID NO: 12178 - protein, 91 aa, Chlorella protothecoides
MAAVAGSPEVEVFSDELNHASLVDGLRLAKAAGARVYRHNDMAHLESLLQASPAKPSAQGSVAGVGGRACLLVPGCSGGVEGRPTGSCAGP

SEQ ID NO: 12179 - protein, 149 aa, Chlorella protothecoides
MTSRWEAYLDQTLESLRVTRLSRELRATVAGNHAAQVHCAVPAGCRSVGWAVCLTLSMVSTQGPIAAVPLATEAQTVGTGPGRTVRLFSLNDYLGLSTHPQVCAAAASAALAVGSGPRSSALVGGYTTHHRELESDLATLAGQGEAGEQ

SEQ ID NO: 12180 - protein, 321 aa, Chlorella protothecoides
  MOD_RES (12)..(15): Any amino acid
  MOD_RES (72)..(75): Any amino acid
  MOD_RES (134)..(137): Any amino acid
MLCPPTVSKTTXXXXDLCGRIIVGNDAPALHAVTTDCLKDDRPHTRDPAVDQPGWTLGEASKFVLLTSSKGXXXXILPLINQAGQLVKRQNLSWLLQAKAGGLLAWSCLYLPACYPSETHPGWGQGPRTRVWDXXXXRDPHWVGTGPSHPRLGRPHGEWGTCSDGLIVPPLLARPCLLMDLLAIARYYVDRMLTEVSGMKALLLDAETTQSISGVYSQTDIMNQEVYLVEKLEANKTDKLPHLKVCVFVFWGGAKWCQSATLHPALAGCRKGMLDHVIIAPLTAAHVDACAGGVLPAPHPREHCSAAARAPRSPLRRLPPL

SEQ ID NO: 12181 - protein, 419 aa, Chlorella protothecoides
  MOD_RES (30)..(33): Any amino acid
MVIKPTGRCKRRAAHAVDGGGHRRGTARAXXXXGASVELLTLATEGPSPWHGAGRWGASVRLTVGQLGARLGLEAVQALGTPGRVMLFRIAGERNAHHSVQPGVRLCLHHVCMHSTGPPSPSPRSKRFLNPPAFVPPPTHTRACPPPCRHPGDVVSEETWRTCILPEGSYRGVPLGPEDAIELQRGGTGFAEHDKQAQAKKFFHLGPGSGLSDRRGQHGGPVSKVRHGHGAQGWGLTAGSRQCAAAKQGVGRLAKEGRFQGHGWRSSSVFRCPLGPAPCQGNGSDPARRHVAAMLPEMGNDYTRMASQHRPRALRSPEAAGRRRGALAGAPPTTGAGSAAAMAAALRICRCPADREAQNTAASKDSHPDRVTSLPEEGCGVTNTVRLSCRNTSWGLHRRIEALTVSTSIDENTLNSGNN

SEQ ID NO: 12182 - protein, 188 aa, Chlorella protothecoides
MLDLPRARPADQTPHPAMPMHAGPPYMPGPLAAPVRREGRGKGKRIRSTGWRATCKQHGVVPGGLCLHVGGQGFAGKGSARARFHPSKSLPIVCAPLQMCRFCGADLPDWRGCWSTLPKADPVMTVAHDGQTHQVVVRPGLEGRAAFERTIREIFGLSENDTVSLTFGCALPQGVDTGAAGMCWWPGL

SEQ ID NO: 12183 - protein, 406 aa, Chlorella protothecoides
  MOD_RES (188)..(191): Any amino acid
  MOD_RES (283)..(286): Any amino acid
MGILSVRGNHDDRAAGYWHRWSLHGENPSDPEFDWVKDLEPAVGDFLLNLPFTISLEAYNVLVVHGGLLPGVPLACQDLAVMYTIRFVVPARPPPFGSFSWALERRMLAEAVRSGRITVPPAYQLEARERPDWKEGRPWGGQWQGPQHVIFGHASSRCLVGVGGVGRGVVAAWGEVRRRHCALDLGGXXXXLVGGGGGGEGCCRCMGRGALPSLRTGPGWGALGVSLGGTGGANLRMAPRARGPRDYLTPCTRLWPTPSKTNPPLPPRTPPRHRMLQLEPFAXXXXHGRGKLAHGTSRQGALRIPHPDAAAGAVCHRDRHGVCGRRLPLRLHPAGADAGGRDRARHACPAALPVPADHPPAGRRGPECARVHAALPAARVPRRQGCKGPAGVSWARRQPRSAFPAD

SEQ ID NO: 12184 - protein, 768 aa, Chlorella protothecoides
MTRIRIEGLLAAFPKLVGQGKQHTYVETENVRYLYQPLESMYLVLVTNKASNILEDLETLRLCGKVVPEYVHGLEEEAVSEAAFNLIFAFDEIISLGYKENVTVGQVVQNTEMESHEEKLHKMIIASKIAETRETMQRKAGEIEKKKMEAGRGSARGRPGEGPPAYPSAPAASGAGGFGESRPALPRPGLGGSRGEAGLGASRPKKGMQVWMWGGEPFFWGWAGRKQVGYQKGSDGEKMCMSAGGESKPLCLQHLHQPCSPTPWPQLGKGGQAKDLLASLKAEGEAVEDAPSAHAPPSLAGRRRLARVWSSAGVAQNPHPPPRSPHCTHRPKGGCDRQRPRLRLGGGDAVGGAVQGRRYAEPGGPGLHEPAGGRGRRRPPAPGPHRRRRAAGLPVQDAPQHRQGVVRVPERAGPARRRAPLPHRRPPGRAQVALPDRRRGSRAPQHQLLALRVGWVGVKEGSCDARARVPGLAASGASSFHCPAFPAQLACPQQPLPWVTSGGESYVDIEYQSQVPFDLHGVQISIPVPAGGAPQVNQLDGDWRYDARKGHLVWSIELIDASNAAGALEFVVPAADPSAFFPVEVREGDEDVCLNTPVSFTANKTMCDIGIAEVTAVEGDAPVKFGTRSLLTTDEQDCENLVLVRGDACATAGETLTRQDDPWQVLTIMKCSLRRRCALPWCSRNIGALGARWSRVGEFARPGPGTRSAMSQPPREGSRNKKVKRQVHRYFLAHGVADYPAHQGDWTPWTIVPLCCPQSTQGPLPPTQ

SEQ ID NO: 12185 - protein, 405 aa, Chlorella protothecoides
MEGIPGRGLGRGPLESRPGTGLRSCKVCYWRQYWAPLACAAPLMPEAAIPSPCQHGKHLSVPGDSRPAFVCHARCAGEHTSSRLFLRMGPDRRLPLPPSPPPTGQAAFGNMVRGGHMYSPTKTWRRWHRKVAVNQKRYAVVSALAASALPALVLARGHRVENVPEVPLVVSNAAESLTKTKQALALLASVGALEDVKKVEASRNLRRGKGKMRNRRYVSRKGPLVVYANDSGITRAFRNIPGVEVACVDRLNLLQLAPGGHLGRFIVWTQAAFARLDAVFGTTSTASEQKKGYRLPRHVMTNGDLARLINSDEVQSVVAPAKPAGKHAPLKKNPLRNLGSMLKLNPYAAAARRAEFRASAKKAGKKARAPGTKDTAKAFYGNMVTDSDYIGEQYEVFSAWLGAEQ

SEQ ID NO: 12186 - protein, 294 aa, Chlorella protothecoides
MNPISNLPQNKQVDSTFRVSHTDPWIRGDPYHTSRSITVQSTKASVAAIHGKAVGEDVAGPGPGSPRPPQPRPGAQGARCEAGFEPGRGYGVGELAGDTNVGMGRAWNRAGHSVHAAPSAGSTWQAAPAVCPLSASLPLHPGGGDDFHACVLQGTPPTHTHTPPYPLIVSSSLPAAASPTPRPGPSLCRGSAAASSGADPWASAGRAAWAPAGRGPPPGTSARGPWTRTAMAASSPSPGRGRTRWRWAFCGWHTREGRERTFGGGGRRVPGWSWVSEEVEAGDYWRVLLNCQAP

SEQ ID NO: 12187 - protein, 360 aa, Chlorella protothecoides
MSSTLTGTDGVCEKPAESPRSLTKGNGRWVRMHDEVISLCCILSKVAKGALPHQTSVFWSRIRSRAALSHLPPAFPTDALKLPESNNRIGRHGAMQVPNPPMLRVDGWTCNRPRCEYTSAALSRRQGLTAAHWTMRQPRSTHWHKASIAQASTGAVSTSSAPPSSWTRMCEYDIWLPGEKNGCSGAVTGTEGMLVTGGSLPTGVGCMLASGELDECLELLGGEEAAGPGDLQLGALPPSSPGTVSYLSVVCMLRGRVYDAQENFQRGTAWYHAALQADPFNYEAFHTLVGSHRLTPAEEAELLDSLAIPPEHGWLGLLYAARSRQHDAGSRVEAALGALGGIGQYMAQSAGLSLSEDIRS

SEQ ID NO: 12188 - protein, 127 aa, Chlorella protothecoides
  MOD_RES (3)..(5): Any amino acid
MLXXXDPHQLLVHPEQAYFAPYPSQRHAELVAELQQMDGVQLSVLGQTLDGRDLDLLQIGVLFWSRAGSGVLGSCIAELGPCSGPAPSRPPTQARLEKGSGWRGSLRGSTPVKPWQSGQPKVRRGGR

SEQ ID NO: 12189 - protein, 297 aa, Chlorella protothecoides
  MOD_RES (252)..(254): Any amino acid
MQHHIQSPRSEGIREGKILTGRPPCRIQVFRHGAHVRIRVRSRSSVRHPAYSCIQRSSPDPGAEGVLSRCSLALRAEGQHGVRRAHAWGWLQYATLCNSRHSQPHVHLPTHHAMLRPLLPLPGANLASQFDRHVLDKGWTATPRRTPSPLLSPGAVISAQLEALQRNDWPEEGAGVATAFAFTLPASATEAGALDSVRRKLVVLAGAHGLAEWAGAHTLQATLLPQHKACSSLRRHWQSRNRISMATSPQTXXXCMQQLEQALAQQESDLHGHLTADGCCGGLTVERGAKLRAPTCL

SEQ ID NO: 12190 - protein, 216 aa, Chlorella protothecoides
MQRHIIPMHVPGLHVEELAVCSEEAGPAGLHPQAWVPLRLIRSAAAAASPLPTIVLLHYTSGNMTGMAPQAAVLARRGYLVVCIDLRYHGRRNFSRLDDFAAYQAALVAAWHGSGERPFLLDNVWDLMVVADYLVQSRTDVDPSRIAAIGVSLGGMHAWLWAAADARVAAAVPLIAIQSFRCGPGGVRESKGQTNGELWPGDVGWDSRERHDAWWG

SEQ ID NO: 12191 - protein, 434 aa, Chlorella protothecoides
  MOD_RES (2)..(5): Any amino acid
  MOD_RES (364)..(367): Any amino acid
MXXXXVRESKGQTNGELWPGDVGMGQQGETRRVVGLKYAIDENCYHGRVSSIPQVFQVAAKDLGKEAVDAEVVAVVWERLTPGLVDAYDAPASLPIIAPRPLLVVCGQADPRCVIDVSRSLPLSATCSRPQSALCSEGTASDDQQAFVILSTVVPRRASTPPCKQPWRHMPQRVQRMPWTSLWKRGWAMCAPPPCGQRHSIGWMRSCKKHDDGVRSLAESKGSAHSPTSVCARMTQCMCTRASLASAQPTHPPCMCTRSGLAPAQPTHPPARVLNLSAPPYDASDPRSTWMLKAHVRHHAWRLQPPAPKHTLRSCGFRTLLLNAPLVPIKQANLPTAIRPVPACLGGTTLGIPMMTADCLHDAXXXXIKQANLPTPIRPVPACLGGTTLGISLMTADCLHDAMNRHHLGSRGSPLICTRRCEQEIQGQVINTKV

SEQ ID NO: 12192 - protein, 338 aa, Chlorella protothecoides
MFRASRRARMSCSPAIPITAPRRSGAARTVLIDLKIGNTMQWHPSRRFLGPSHLHGSASCVLRCVLCPGSLISGSLLLGEVLEGGLGAGLNGVLALLPVSWAHLTVLVCELEGLEQAQGLVHGAAHGQVVDSDLAEDALGGDDEEAAQGHAGVLALLDEDLVVGGDGLGQGESTLAPTTCSGRRAGVDERGWASGASWKGPWPSCTGKPWAGSSAWLPLLHSMHTTAASRGMPWTRPLRQAQPPATHLHANVAELLDALREGDNLCGAHKGPVHGVEEEDDIPDVGGRGAGAQGRHPVELLAPSEMAHSLSLVVIEAYGLEVAIYNSSGLEGRSCKSW

SEQ ID NO: 12193 - protein, 1032 aa, Chlorella protothecoides
  MOD_RES (20)..(23): Any amino acid
  MOD_RES (740)..(743): Any amino acid
MCSTLLPFPSACAVPFQPHXXXXPYMCSTLLPCPFSLCSPLSTLPRPAQSLISFLHQDPDFCATLAQEIVSQGHSVVVFCGTKKACETVALKLARPSTVFCDFVGLPGQCSSCGPAFASSITSIYYISSIASSPRLLKVPQRARSDCGGMEQRSRTDVAALLGQLSASDTCLAECVRGGVAFHHSALSSEERQAVEGAFRAGSISVLAATSTLAAGVNLPARRVIFKQAYQGAVAWPHLYSEYCPTIPAMQVPSDGGAGGAGGGGRRGRLHPADWDGRHLAQLASPRASPSQSHRQLPHRGQESRGRACALQPLPLWFPFLTHNVPGPGMKRAMLEVVATGVVTEPSDVQQYIRCTLLAHMNSSKASCRAGHPASSISSVGFLDGAVHLVTGRHQERAQLPPVPPRRSCAPGHLHVPAVIHGATVHHKASQNTSHAPACIARRSRLAPKAVSSSAPPSHPLSPGVRASDPPCLGLWLIAMPERPSQWGLVPLPCTAHTFRTHIESLKFQLLLHPPTLPHLLAQADLQRARECIVLTSDLHLTFLCVSPTDNLIPDWRRLLQLINSLQACRRSNLWERLAFGHFVPSLRHLMAWSEPIAAPTGGQSGPSPSWSLPAEAPCTLACRSSTSGQQAQLPIPALRAGRRRKRGLTRRLEPGSHHGTCAWISPGESGWSLGATQASTSSNVTPNPSHPLQRSSGKPEAMTDSERVGRRFWAALILRDVLAEVRGGCACGVCSAKPXXXXLQRSSGKPEEMTDSERVGRRFWAALILRDVLAEYLADGPAALGTFQCDHNRQVDLQEISRKFGAAQGAIQGLQERSSRFASMLAAFCERLQWQDLEMLVSKFQARVLQGVRPELLALTEIPFVRGESTGKGVGAWERRTFLLTSRKQPCSDVSLHNPRITSVDGSTETSMPTTAPSPTLGPPQNYTARKLYSAGLRSPDSIAALEDETLLIEILARGSMGRCTSSVCWLAFNWGESPLYQPQSTQVPTVQRKRTAKQESGTRDPARCQEHRKRQTQRGACSTCGRQSLN

SEQ ID NO: 12194 - protein, 200 aa, Chlorella protothecoides
MDWTFVCPTEIIAFSERIQEFRDIGVEVGGRSGSQAELPAHGFPVHDGHGPFQDAPLAHPRSSTPALLPLQVVGASVDSPFSHLQWINTPRNKGGLGGLNYPLLADLTKSISADYQVLIEEGENAGVALRGLFIISPEGILRQVTVNDLPVGRSVDETLRLLKAFQFTDKHGEVCPANWKEGEDTIKPSPKASLEYFSKQ

SEQ ID NO: 12195 - protein, 796 aa, Chlorella protothecoides
  MOD_RES (158)..(161): Any amino acid
MSASWPAPRYSDRLLCMLSTLASLTASAPPAEVVRDRGADAGPPRSPPSDPSPCISDRRRLGSSGAPAIAISAAWVRGGRGGSGGRRGRQVRLGIVRGPAPPRARGASPTQDSGEPRLRQRPDLPSSHGTLPLPPDTALSSSRNPPPPLLPPHNTHTXXXXRRTRESPGSDSARTIRARTALFPSHQTRHSPPHATPLRPSSPPTTHTHLRLGAGDPLRGAHRLEEGVLEQRARAGPCVARQQAQVDQRGEGARGHLLQTRGPHAQRHLAVDLGRVLALRIGVLQRAQLQQAHAEGVDVHAVVVLLLVQLGGHELWRAQHRLGRGAGAEQRGQAQVADLDHAVGAVDEDVVALEVAVDDGRVVAVQVDQAAQDLPGPALEHLGVGVAVPAPVLAQRAAGEQLGDEVDGAGAGVVPRIAEGHDVLVLQRLEHAHLGEDALPFLPVLRVLVRGMEPFVLPRGSGHAEHRARRRAHSMIAAVPAPSTRPSPIAHPPGCQRPCTPPCRPRAPGPDRTAVCRGGGRPGVLRVEYASPPREPCPHRDTPFPSPAFKVGQPMPCAQPPPPWTTHPAISTAGVHLRERWAVVVAVGGLHPGLGHISGGRVLREAALRHDARPPRRGREDTDHAIPRKRGRHARAGIGGTQKALSLNAPGDGNVVTRQLQQRSQDSAPARGDSNPVQVSSKNCHKPSALADSLPVRAQVRDPPAGRGSLLAKTKESAAPRIQSGWSDARPGSPAMTVLGGLASLLGRGRRVTRTGFTQLTSKNGPRNFYKGKGCLPTGQHTKKGVTPSGGGRWGW

SEQ ID NO: 12196 - protein, 303 aa, Chlorella protothecoides
MAALQQKVNPREQIVGWFSTHAEVSGSDALIQSFYANECASPALLTVDTSLRDGALAVRAHASRALSIQGRELAREFQEVACRITSTDLEQLGTDLLATEETRLGAQEEEEEVVEALHRLRAALSTAAAYVDAVVVGGGMGDQLFACFRGGERETDACRRWPQHPHVSLGPLEDMAQLQRCAPLQSAFLATSTDIPPHRTRLHSIHAPSPSPSSSTRRRARRPTSWAPCSCPSFEGLVWGVCTVGRCGLCRVRRCPGALVHGTMQRHQDEHPSIPGANTPVLDIMLYTITLRARHSSGEFFKE

SEQ ID NO: 12197 - protein, 242 aa, Chlorella protothecoides
MLRWAAARGWLLARAQPSAECAWRAFSTPAAPAAAAATGAHAAIPRPAPTLSRRVRQLMREYRQLSKARLSALVVATSGAGYVGASGAAVDWPGLGWTVAGTALCAASANALNQVYEVATDRLMRRTAARPLPSGRMGRGHALAFAAATGLAGVGLLAAKTNGLTAGLGAGNIVLYAGVYTPLKVVSVANTWVGAAVGAVPPLMGWAAASGGLDVGAAILALGLYFWQLPHFMAIAWLSRCV

SEQ ID NO: 12198 - protein, 223 aa, Chlorella protothecoides
MALKTLVMLGALLQVLVKGAKFSLFKPAEEMVYIGLDDESRSKGDEGSHGSPLLSGSLPSAWQPRATAVQEPQTAALPNLLTAEPGRHGSWLASFTANAPPLCTGKAAIDVVGAQSGKSASSLLQQTLLLLRPHLTAASHTSHRYQRPHSNITTLCSGGQLPKTLPIMALFFATMLRQWIGAVTVLAGYVGSEEAAQADAKQPAGSEKGGVAPSPSAQDLGLA

SEQ ID NO: 12199 - protein, 390 aa, Chlorella protothecoides
MHTPRAGPQACRPLCIPQFDQVLGRGACKVVYKAFDTQEGEQWGRGAWRGLGRRRSWSALAGVPCAPHAQIPGAAQRVPSPSPPPPPKKKITTNAGIELAWNQVRGMEFMNNKDAENREERERIFAEVRVLKALKHKNIMSFSDSWYDPRAGTINFITELFTSGTLRQYRRRHRHTDPEVLKGWAWQILCGLVYLHGHNPPIIHRDLKCDNIFINGSDGVVKIGDLGLATLLRSRTAPQSVLGTPEFMAPELYEEEYDDRVDVYSFGMCLLELSTLEYPYAECKNAAQIYRKVSLGVRPAGLQKVPPGPLSALINLCLLPRDARPRARALLKHPFFESVRAAQGVTGAKSEVCVCCGGGGGAKGGCVRGRVPCLVGGEQCRASSDGPGAV

SEQ ID NO: 12200 - protein, 286 aa, Chlorella protothecoides
  MOD_RES (131)..(134): Any amino acid
MGPASRAGDHSPEPQHNVAFCLEGSGVERARVSATMSDEVVCPKPEEEERCKPRCTKYLLEYEVSLGSMRWECRRVRGTTVVAGPGLSRTDLSHLTHSDRLAASESRMTPLGRRTAQASTLTIGGASTSAXXXXTGQVRVNRAALLSVWGEYFDYWRCVDKCVAARLFDKLNLNVECVDQSRADEGVESWARVAGHLGGDWLTCREHIDAIDTLRQSISNLLVARSEHPGSCKVQMTHIVAKKSLRHSISNLLVARSEHPGGLQAVQHSGSQTMEESRPMEMIRIP

SEQ ID NO: 12201 - protein, 369 aa, Chlorella protothecoides
  MOD_RES (82)..(85): Any amino acid
  MOD_RES (215)..(225): Any amino acid
  MOD_RES (334)..(337): Any amino acid
  MOD_RES (365)..(368): Any amino acid
MAPKPAGPPKAKGGGKTIEGGGVDAKSRIEAIEREIQEQQKLRVHAQLERVRHAALAWHPHCYIKLAKLQIGSLLDHSSAEXXXXQLERDWVQERWEASIKTVAALETALLAKEVEAEALQTQHGLDLKVYRARVRQLLAEVRDGAIQIQGAAAAEAVDREAGAATREASLLQQILRWDGTGGAPWTRWKGIIANMNNIPIQKGRWFPTLSTPLXXXXXXXXXXXGVHREEALHHQQSLDAAVASGTEGARAAWRSAEERTASLCQAFAEELERMYGQLEDCYAQDLVATVSSAQASAASLIASHHKVKRGPQSLLVSRSSHAERADRVLWLTXXXXTAGARAAWTSAEERTASLCQAFAEELEXXXXR

SEQ ID NO: 12202 - protein, 91 aa, Chlorella protothecoides
MYVEIERARLTRRLAQMTEEAGKVSEAADILQEVAVETFGTMAKTEKIAYILEQVRLCLDKEDFARAQVGKALAGQAQACLGQGRDVRPAA

SEQ ID NO: 12203 - protein, 182 aa, Chlorella protothecoides
MLAPAALKPTYSSLTVGCLLPASHHLHQDKCHLQVLFLLPTPQILWWQLFTADFKAELEAADGIFGGSKGAKLREGAAASAGLRLVWLGPCVCGLAARDLVSNAECQPRPGPRFTPLSPADLKLRVVEHNLVVLSTYYSSITMQRLTQLLDLTTDEAEARLSEMVVAKKLEARLDRPAGTIR

SEQ ID NO: 12204 - protein, 141 aa, Chlorella protothecoides
MSVPEDAPISMDQDAPKSTSAPSKKPDIDPVKVEEGIANARALAAQGSREEAINALLSIEQKGRLAEDVAITRSACTAILEDWTGLQDTLLLLSKRRSQLRQVITAIVRQVMGYVDDTPDLQTKTALIKTLQDLTEGKAGA

SEQ ID NO: 12205 - protein, 641 aa, Chlorella protothecoides
  MOD_RES (305)..(308): Any amino acid
  MOD_RES (393)..(396): Any amino acid
MQNAVAMAMAASLSSATYDDLLRDVSCWVRDLRGSCGDVEAALREVAASRAEVDGQLAALGGAGDEEALPRALWLSEQYAAVEGRLAELQHRVAPIQEAVAGLATLHEYIQEAQVLVWVWEEGEAGIAGWGSRLARATRLTLSCTPSSPHVQPAASEAELQRDYIIAHLFEALSQQGLDANHPLGAWGNGERDGSQAGRGCQARVPRVRGGGSPGGPAGWQTLGVSGVHGWMAMHPHGAVASGHGGDLRDIVQQLIEDCRRMPPLPRFVMAEEEEEAGTSQALREQRIESDEDSNDAGFRSEACXXXXFEVLRLPIHKSSEEQLDGGEVFEAKPAAPSVCLHRQLPANVIHHVHLHPWHAGSIEAMPSAPVLLKEEGPSHRPAVPSLNLPPSXXXXPANVIHLVHLYPWHTGSIEAMPSAPVLLEEEGPLHRPAVPSLNLPPSREEEELPAAVPEPATVAAPVSAPASDPDAGLPSDLALHAAPASEPAPVLAPDVSAASLASSASSSSPAIPPADDPAPGVAPPSHSADHAGSGAPTRRATASRAQEEEPPLVPTPPTPGGGRSSPDKGARAGRPLRSPSPLPTPGHHTPRDGLRPSPRDAIVRLPPLVALRHDLQRSAALAGRGVPLPSPRGGGGRAAA

SEQ ID NO: 12206 - protein, 492 aa, Chlorella protothecoides
  MOD_RES (126)..(128): Any amino acid
  MOD_RES (145)..(148): Any amino acid
  MOD_RES (239)..(242): Any amino acid
  MOD_RES (481)..(484): Any amino acid
MGASGDRCFPLFPAGTAGRAIWLRTEWQPPYATHVRTPGREYSRVPLERERFLFMKQGCSFQITEQILQADTLSYERAVFVQFGSMAENRVATPLCNAVRLTRDYIRPSMHSLISQSACEQPSEPXXXNQQHAHHQRQIYHSAPXXXXRTSPFKGTGRMSQTCVTMGQRSILLLAWHTCGRGPASFRADLPFSPMRLEPRTSTHMAECILRLTRVSTIDDGGHCLTTGTNIFHWELPSXXXXQCILQLTRVSTIDDGRHCLTTGINIFHWELPSISGFGRHDQPKFQPRHDQPKVQPRYNLWTVRNAFMMTSWPTQPGAGSAQHGVDSGFRKVLQNPRQSPRHKSAPPAAPPTRIHHLCGWRARPPLATTISVAMEGTMQDDVPLVVTRCLDYAAKYHGSTEVVSRTVEGPIVRTNYKEVHSRAQAFANALLSMGVRCGRVGRGPGEGMPDKARFRGPVSAPDGHGFLLLRQITQEGRPRXXXXGSVVLSQP

SEQ ID NO: 12207 - protein, 566 aa, Chlorella protothecoides
  MOD_RES (461)..(463): Any amino acid
  MOD_RES (559)..(562): Any amino acid
MYTHRSNVLHAMASATPDGLGGGTSDTMLAVVPMFHANSWGIAFSAPMVGMRLVLPAAALDGRSVYELMAAEEVTVTAGVPTVWLALQAHMEADPSRRLERMRVLVIGGSAMPRKLLDFFGDRHGIDVRQMWGMTETSPMGTFGTPVHSGGVEPGPEERAAQRLTQGRPHFLSDLRIVDESGRELPWDGKAFGNLHIRGPVVLQSYFKAGRPAVDADRWFDTGDVATMSPRGFMQITDRAKDVIKSGGEWISSIEIENAAVGHPQVGEAAVIAVPHPKWTERPLLVVVPKPGQVCLWVAVGGGVLGEFASGQCCAQECGGRCARSHHRTGNLPRPLQTGLLRRFPPPAPTHTPHPTLPAAEPQQGGHPGVPGWEGGQVVGPRRRGLPQGDPAHRHGQDLQAGPAQAAGRLRFWSRLQALRAVGWEEGRACKAGSCAERCGRFGGLAIPQSYLRLPAVDPAXXXRAAPKVDRAPPPRGRAQARAGLFVGGCGGRGAGGVCIGPVLCSGMWRRTLRALTSPNRQSALSPPNRSLAPLPAPSPNTDASTHPPRCRTPARRTXXXXVLAC

SEQ ID NO: 12208 - protein, 234 aa, Chlorella protothecoides
MGTTSGPLPGSCSTSGCSMGGPELETGNRPGRWARWGGSLWHVDLALARTDGGIERPHGIPVLSLRAALHGTSSQHLVLSSICSQGGEESLLPVSVEAPPPDAAVGGEAEGHPEEPEALQQEVRRGGRGHSHAVLSACERGLSSATSVTWEGARAILITAPCSPLTQADTEFLAAREKQMEEWREWQATKAEWAAEQAEAKKALLGDRLRDGDFTVQLAEVTVVLEVKEEAVKL

SEQ ID NO: 12209 - protein, 134 aa, Chlorella protothecoides
  MOD_RES (7)..(10): Any amino acid
MVSAAWXXXXEGVGVLDAVAGPGPLQTQNGLMEFWDTEDMSLLSAGEHYMATEVQWDPTAYRLCMGGPGVMRASLPVMEGLVGGGDVLNAGQPVSGQVLPAAPSHTHKVSSPSMLPLSLSLNPNHRESPCQAAT

SEQ ID NO: 12210 - protein, 444 aa, Chlorella protothecoides
MRSRAASSTFLSTALARCKLPQHTPPHSHPQTNLSRLGHNHEEGALGPLGVRHSDHRGLAHLRVPHRRVLDLDAGDPLPPALDHVLGAVRDLHEAARAHGGHVPCVEPAVGVHRGAPRLEVGLQHHGPTNVQVAKGLAVPGQLPPRFIHDAQVGQEVGAALGQALRCALLGAGLHPPRVHGRAKGAHGRGLGHAPHLAHVDAVPVAEEVQQLARHGRPADDQHAHALQAARRVGLHVRLQRQPDRGHAGGDGDLLRRHQLVHAAPIQRGGREHQAHAHHGCGEGDAPGVGVEHGHHRQHGVGGAAAQAVRRSGGHGVQHVGAVSVHHALGCGNGVGEIGGMLPWSLNVQGGRWGSVVGERGRGGGWEATRACSVFSPTHWRAGERRRGSGAEEEVGRLHVHVASSAPHTGVQGYGPPLTRLIRLGMDNASLHGPTLGRPVVPEV

SEQ ID NO: 12211 - protein, 104 aa, Chlorella protothecoides
MDMVVFLSAKSHRKGDRVATMAWNTHRHLECWYAIMGIGAVCHTLNPRLFHADLEYIINDAQDCIILADISFAKSLEELGPKLPSVRRYIFLTDEGWVVDLRVC

SEQ ID NO: 12212 - protein, 185 aa, Chlorella protothecoides
  MOD_RES (100)..(103): Any amino acid
  MOD_RES (124)..(126): Any amino acid
  MOD_RES (149)..(152): Any amino acid
GAGASGAGAAAPDLPRGAVVHTTRGDIALKLFPDECPRTVENFTTHARNGYYDGVLFHRVIKGFMLQTGDPLGDGTGGESIWGGEFEDEISRNLRHDRPXXXXARWRTSPPTHATGTTMASSSXXXGRVHLGWRVRGRNQPQPAARPAXXXXLTETGLGLAQRAARPGHRQPSRLHAPTLPWAVE

SEQ ID NO: 12213 - protein, 128 aa, Chlorella protothecoides
MLRTMVSQLVEHERIETTLPKAKELRRVADQVVTLGKEASQHARRQAMAILRGDAEVHKVFSVLAQRYSQRDGGYTRVLRTQQRGNDAAQMAFIEFVDRPGELRPARPGRPASLLPPAAQLLQQQQQQ

SEQ ID NO: 12214 - protein, 142 aa, Chlorella protothecoides
MQYARILQKLENPVIFKEFKIQNMVGSCDVRFPIRLEGLASSHSVFCSVSGTARYEPELFPGLIYRMVDPKIVLLIFVSGKVVLTGAKRREEIYQAFENIYPVLKEFKKGGLLESVPAPPALPPPQSAPADEAQLGAPAPQL

SEQ ID NO: 12215 - protein, 236 aa, Chlorella protothecoides
MRCGIQGWGSWKGRASRWPGVVACMLRRCHALAAGGHAVRWHEGPACPLYAANTKYGRHSASPTGRPPDFMHREISSQPERPAEDSGLGRTPFEVQAKIEEMMAQAGCQQPNEVLLAAKRLLKEGVLGCVEGARARRGPQPPTPNPRLHLSHPHPPTIHAGLAEGGPISGEDVMRVRGCGLTVLERLRRDAASGDAHGLSSLLSEVESGAGQLPRPRWFTESFKALNQETATIMAR

SEQ ID NO: 12216 - protein, 714 aa, Chlorella protothecoides
  MOD_RES (171)..(173): Any amino acid
  MOD_RES (198)..(200): Any amino acid
  MOD_RES (371)..(374): Any amino acid
MDRPTCKVPGREAYPSGRLLCLTLVLLALPWAWAVPSAPMEALDIEIAAAQLFSSQASARDCTPAEDLPVAGLDLSAEERVLLKYLCIPQRDLLLEDEDIAVVRRGIPPGVNCTEVQWSVKNDGDGALINGTLGTGMLKKDPMPLYHVVSTCQPPAVSKGLRGMKHLHPPXXXLSQSPPPPPTPTPTTQVRRGEPVLXXXSGSCPLHRRKPSFGVPLSSRDPPPPKTHTHTKRRCDGESQCSLVCERGSVVIPDWQVHAIRTQLDAQADVPLCRASLLGSHNSAITLADGYGNLDEYWQGYFRYIKWAIPAGASPRLRTNNHWLSLTDQLRMGVRVLELDAQCVTGKGGDCAGCEGGCFCCSREEGVHGRXXXXCAVRYGEGGNCAGWEGGCFCYSREEGVHGREGKRESRRLCKRGNYWMAEGRGCARGGDGTVYDAGEERLWPGMLAKIAGILGRSSPWTARSGTGPMWLPTHLPHPTLPPLSAPSGHDTLPPPPHRLSLLPLPRSWVGGALRIAHCGGLHVPQLNALVKALNLVAKLLGRRIRWDTETLGCSPSLSSIPALDQRTLLDALGEVAAWMGGEGAAGDALVLFFDDQADLAHWGVVGELLGDVLRAFPRAWVYDRDDHARFVAGVARESEAAGLPPPSPATTWPTPRQLRAAGKRLVLVSGADYGEAMAPLVFPKDDGSVCGWHEPALRAARGAPACDVQGGDA

SEQ ID NO: 12217 - protein, 93 aa, Chlorella protothecoides
MDGKEFDPEGLREAEAYLRGLIDDEVAAGIPEHRIALVGFSQAGRLVLKTFATYEPTLAGVAGLSTWLAPQDLEGSGRVCFPWEEAWGPTRGS

SEQ ID NO: 12218 - protein, 437 aa, Chlorella protothecoides
MSNPPPLLPVQTGFSHGTLHDGGAVGEGSERDGITTSLGPARRTPWAGGWVAEWEARQAGVLRYNCADSLDRTNAATCFATLPVLQDALRTLGVDLCVGPGRDAGGAARSGVEEGGAVRPDAGALGSLPPPLVAGRPASTEQVPPVSLVRARMQCQPAARMAILRPTQPSDRRHLPPNLHVLFLHAIGLSRAVQQPGVPDGQAISVPIPPLLPFPSCSPGVGGAGWEVRWHGGRPLYIDHANRRTQWEAPSWPEGPDAHPAQAASGPAAAPDPGTGGSPARVEVPPPGATAVALAQLSLRQGREDGAPDPAPPPGPAPREDSGHVRPVAGPLGSPGPAPPQGPQPWAFFGLRGMAEVRARLRRPVVADFVEAFRVHGDINSFLYTGSPAMHSHVLGLVLQVPAGSVGSGVGGRESMDAHALPPLHRDRRSVIVGWAS

SEQ ID NO: 12219 - protein, 507 aa, Chlorella protothecoides
MSTAWVAAPHSWHLHLTDPSSPPPLHAIVQLAALSSLHALGYEAEHRGDALLGYVATRCVAGVLLATRTREKGVLPGGHALLTLTESAWLLLPLSQVEGWGPWLCACMCGGGGLGVGRRPGVVRRRGVLSVGRGACVQATCHRGPAEQEFWRLLQQVTLDGAHYFCWTADLSRPFPSPRPAADPAPEFVWNRWLSAPLARAGLPGRCPVLLQGAAEVSLHAGVGAAPPFALALVSRRSRRHPGTRYLARGLNEAAGPGNEIECELVAWTLARGGAGGRASLVAWTLARGAAGGRAGVRWACCVWRRGTVPIWWGVSLASLQKGLAAEVYVRERDPYRGSAAYFRGVQRAWARYEAGQTAAGAGGSVRAGQAVAEEGSASGMQAAGGQGGGGATPANPAASEDAAEEGLHVPVTCVNLLHCNPAKASELMLSSHFQEVGRSMRHVRRILPPGAPIRVVNFDWHGNIGRLGEEKGVEGFWSFMEPFVKQVGPGKGPLVLVCCIWLWTKV

SEQ ID NO: 12220 - protein, 650 aa, Chlorella protothecoides
  MOD_RES (53)..(62): Any amino acid
  MOD_RES (118)..(121): Any amino acid
  MOD_RES (310)..(313): Any amino acid
PVRAVQPRRADSTTASFGSRAGEAEEGGQSAAAGQFVKAESAAHGGAAAAAGXXXXXXXXXXPNPAAQLAAAAWTAGMKRPPGPVDKVRSRVGGAWQSCPGEDCCLPWTWQPNSCAGXXXXFFVCIGGERLGGQGAVGKVRARVGGAWQSCRGEDCCLPRTWQPNSCRPPKDGIYRPERLAAAAAAAAAAAAAAAVIQPKVEGREAPAYQPWLDIPEGEAAGWRSVGLILAGRWVTAWSAGCCPCHRSRVWPGYHVPAILHCPPQHSECNTTKKYAAPPARRPSSFGLLPLFIPLHTHAESPPPPPPPPXXXXECNATKKHAAPSAQRPYSFGLLPPFIPVHTHAESPPPPPSAAGRCHVIRVRWAGERCAVCDADADTDFDQLVSCDGCGLTVHQSCYGVPEAPAQDDLWFCAACEAGDGPDPGRAALPQCCLCPVAGGALRPAAVAPGLWAHLTCMQWIGELSVGDMASMSPVLGVEAIQRERWELTCGVCRQRCGAKIQCRACYAAYHPLCARVAGYSMEVVEAGAGEGVALVSYCARHAPPAPQLAAVKRLDAAEERGDLPDLAAAPPALWNAQPFELAPRCALPRCEAGAARCQAVLRWHRQSHGTGTGVSSTAGFWIPEAPAAPPPGKPGEGPWAPSPRPLSAG

SEQ ID NO: 12221 - protein, 248 aa, Chlorella protothecoides
MVVRDLAEEVVADVGVRDVVEEDVQEGGAHRAIHGGHGPAQPVPVLLVVVGQGGVGVLEQGDGDQPGVDHKVGDDVGLDQPGGAEGAGQQPQARHHRHQRGVGQRHLCALALGEDGRPGVEVVGEAGVGAGGGVEGQVQGPAQEQGHRDVGKAGGGGLLPLKALMGLLALGGHKHLVLVHAPRVGVVPTVAVLPRVVGDQEEGVEHQPNSVIDGLGRGEGLGQKQGGGGRWRTGGVLWLRRAAERMEG

SEQ ID NO: 12222 - protein, 139 aa, Chlorella protothecoides
MAAVKRQSVAKPPFTIGTLRKAIPAHCFERSALHSAAYLMVDVALVAALYVASTYIDPAPLPTWFKYTFLWPTYWFFQVGTCHVSALSRLLRRAARGADPSRPSPVLRLSPSPPGRIGRGRHGHLGDRPRVRPSGAERG

SEQ ID NO: 12223 - protein, 245 aa, Chlorella protothecoides
  MOD_RES (115)..(118): Any amino acid
MKGVWRGSRIAWEAVAGTGAILMQESSMASPATGHAPAAMHFRRGWAPMHMPEMPRCPSRVWPRRHAHDPATTPCQPCAGSPGRGPTPGMRYHIDTPGSGHLAPTPGSYLPTPGXXXXAPAAMHFGSGWAPMHMPEMPRCPSRVWPRRHAHDTATTPRQPCTGSPGRGPTPGMRYHIDTPGSGHLAPTPGSYLPTPGMAPSPFSPAPALTPGLAATPGLSYEAVPAADYGAAPRALGGAAVAAEG

SEQ ID NO: 12224 - protein, 477 aa, Chlorella protothecoides
  MOD_RES (310)..(312): Any amino acid
  MOD_RES (359)..(362): Any amino acid
  MOD_RES (423)..(426): Any amino acid
MSLVMCMRLTGWDSSSRARARTPRDQEVPTRIVCSYRLASAHQEERGVPPSECGVERMGNKVSTRTVRCWCVHSQDPLIKLARRSSQKHPVPSPGQPGPAPSAPEEDSGEAQDGDEGYGLRFESCPIIRSASQASLSDKAVSDYETFMHRQLELNEARRSEILASLGVDFHTPQNRFDNITALVKSIFGVGLSTVSIIEGDMAYFMSRAGDWAPGAPRKMTLCQCLSACNDSKLLVVENVQTDPRWVGEVWRWSGHQCHLPVLREGMQGCSGVHLHAQSTPGTVTECSLRHPVRWVLFSGAIVSGTYMSXXXGPATAPWGLKRTIRNYPRSHGAYLGPAVCSALQADPQRPPIPSPSPXXXXSNSLRLMQRMTESRAYPQRPPIPPLSPQLCLPGRVEQQVAGGCSCRCYMVDARFLGGATSXXXXAGGCSCRCYIVDVRFLGGATSKAGNRGGCTFLSWGTALSPTHCQPSGYGWL

SEQ ID NO: 12225 - protein, 447 aa, Chlorella protothecoides
  MOD_RES (442)..(445): Any amino acid
MHPSPNTQDLADSKRINANIRSAARGAARGERAATVTATMLSALYWPQGSAPAPEEADLRLPPDVGSWLEEYGQAYHALKAPRKLQWRPSQGVVQLEVTVGDQALELTDLGGTACVCPLGQRTVLAVENHPGSVDLSTHGVLIVSSGGNSAVTPAQAITLLSFRERSEWGEAELAEQTGQTPAMARRNASFWVQQGRLWGIVEELHIGVLHEAAQPGGARVYARNRVLQASTGGWSGPPAEDEGAEGGAPALDAGLQAGPAPDPDPKCSAPASMLRSTPALCCSAKLHHPDSDIAHPMPGHGSIRAVHPGNAGEFRQPAPGPHPQHAQDSSTLSEGLTHAPHPLADVCVRSALRQDPGPAVCLSRSPGGPGAPHVRGGHHVQAETLDWDACWPSPTCLPGRLSLYSSHVTRFEDDDIRGEERYGWPGAATLSWTSCVAFQAXXXXKL

SEQ ID NO: 12226 - protein, 166 aa, Chlorella protothecoides
MRPRPPQTFHQELSVEAAVAGTLSHLQAHLEERATRDASAPWLAEALEYTASWPLRLLQQLLPEAGAMPGRGSAIATRSGVTMSNTRLPSSPGFSPPSNLPSQASGWHLWEQRLRYFVYERAGLIFTDSLFDLVVDFPDRYCSSGRPGVAGVPWSFEFLQVGELRA

SEQ ID NO: 12227 - protein, 311 aa, Chlorella protothecoides
MWTPQVGEPLLLGWIDHPRVQPGAALAARIGPQVRPAQHCEYLHLLLPPPSPPTVLRHGPGPGTRGHTGLPAHAAGRHPLHCGPADGRRGGRGQRGAGGAGGRGRGRRRRGGLGHGGGEGREAGVVNGAVELGLPAEQYQAERPLWPLRPRMQVPLTPCFDGPDADLQALAEAERWRPEPGHALSPSWGSKRPQATPSDTNTGLRHCRAVDAVERVTGSDAVSQLVGIWGSKDLLVTEYRSLLADRLLAKQGYDCDRELRTLELLKLRFGDAVLHTAEIMLKVTRLGPGSLLRCSTWVSRGGGEGSGGVGG

SEQ ID NO: 12228 - protein, 84 aa, Chlorella protothecoides
MPQVSQASAIARQAIEAAGGSVTTVYYNALGLRALTQPEWFAKKGRLLPRPARPPPRLEAKFERKGALPPLRDLAAGLEQAATA

SEQ ID NO: 12229 - protein, 89 aa, Chlorella protothecoides
MASTADACELSAHAGPSFPAPTPTPAHPDRRFLCLRRLVKFQRVSVLTIFVADNVGDTESTVIEKLAILGSAGDSFNVAEIKDVSKEQG

SEQ ID NO: 12230 - protein, 120 aa, Chlorella protothecoides
MFKVSAPTLPLPLLPTPKRHVPLTKDTEELDMAAFHDLLSPRTRLVALVHVSNMLGCIAPAAEICEAAHAVGARVLLDCCQSVPNMPVDVGRLGADWIVASAHKMCGPTGIGFLWGRQAG

SEQ ID NO: 12231 - protein, 71 aa, Chlorella protothecoides
MPPWMGGGEMIQDVFLDRSTYAAPPSRFEAGTPAIAEAIGLGAACDYLTTLGMHRVDAYERELGAHLHEQV

SEQ ID NO: 12232 - protein, 111 aa, Chlorella protothecoides
MTVALVGATYGAVPVYRMFCAATGYGGTVQEGASVEAKLRAREENPNAEVETAAAARQLTVSFNADVSDGMPWKFVPTQRSIKVRSCGMLPEPGKGEWSNLSASRERWEAL

SEQ ID NO: 12233 - protein, 285 aa, Chlorella protothecoides
  MOD_RES (28)..(31): Any amino acid
  MOD_RES (275)..(278): Any amino acid
MLSMTRRWSTSSWTGLATSRPTAPPAAXXXXCIVHIRRFQAAHAVNDPETDHPLLDRSGNLPPHGAAGRLAVLGERYTVTYRLVHGVLLALVTLPSASAFLCLEALDAVHRVVAGLLRGSALTPAKVAVRFPEIYAALDDLLSLGLDRLPPGFRHAPLDDRVRLSMPVSTTDAKRQFRRLVKGARGGGASEAGSVAGDEAMHAAEEAAAAAAEGGKRVDSEGYPPLSQFRPYRCWQLRCSRAATASARVDFMQSSSPMTPHHQKPCPSAGSTAGXXXXSCSLPPL

SEQ ID NO: 12234 - protein, 515 aa, Chlorella protothecoides
MARVVALMIWELRAPGTSGPQRTGGRKRNCWAHMLARGRGVVQGLHLQFAHNLGMEERLRAQVPTVAAAFRDSCQLASDSLFEAPGFAMPATPRDGQHPGQYIKYSQVESFLAMAEQALRARDRAVDALRDETAALMSDLDNLRGEKSKSFDGPISSPAASWPHAPNDPLQVEVAESVAVEEAQQLSSLVQQLHAEKAAMQAAMQKLQRESQYLTDENALLRNQLTMAMNGGWVGGRAQGPGVSACCRYGVQFSGRNPPYRARPVPLLPNHAELVDVHTHAMHPRSHHRPHLVITPPPPHPPSRAAEQASGDMDQNVSPLGPHTALIAHLTDTLSVEQDRATQVDNENMLLRARVAALEKAGLVSRGPGGARGERGGAVLARAAQFSTSWRAHQSLRPCTWQAQRSPSANPLLSPAPPSLAIAPAFFQAQQSALVSCIEEGERSLLASGRRASLSPQAVLSPSHWRSENTEEDGAGSEAESSSGGGGGFSTPVARRLGTGLGPLSPRASLQAQAS

SEQ ID NO: 12235 - protein, 198 aa, Chlorella protothecoides
MEVDAATSSRHAASRVDGAATTRATGAPAARPAPTPCALPGHSVEEVFCQSFVVEVAGWGERRAVELKPGGAGIPVTEDSRREFVDAYVDFWLNTSVHAQFEAFARGFLMLCGGPALQLFSATELERLVCGNPCLDFEGLQRSARYEGGYSADHRVVQWLWDVVGELDADERRLFLKFFTGSDRAPIGGLANLRCVIQ

SEQ ID NO: 12236 - protein, 463 aa, Chlorella protothecoides
  MOD_RES (123)..(126): Any amino acid
MGSETPLHIIVTGQAAGGGLAALAGPALALAFPRANVDVITFGMPWTGFNPQFSWAFDQLVSLYYVWPFNSSDIVQIINATQHDPQQSLFDQAAMAGGRLVGGVEEEGFIVGGWGSPGDWTCXXXXAAMAGGRLVGRVEEEGVIVGGCGSPGDWTCLGLGHETEHRPGSTDSHPQPRAAFACQSCAALPHPRPSPQSPPKITQRAPPPLWATSPPRPLAPARPPRPAPPSSASRGKARPPPACCGAPTTPQPSRLFHCHRHALTCMHSHTRNHQPCHPCLTPIHLHPVQGLPRRYLQSGGTGASAAVAWDAASETAYIVFEGTDTEADWVQDLLVSQSSDFRPTGADVFDGVGVHQGFLNQFESLTDAAPSAEENITAVVLDLSGGLIPRRVVAAGEESFLFSGGAGGPNRRSKKAQSCVAVPCFGPLPGPVQSQAALQRRGRSRQGRGHASNSLSLDHHALD

SEQ ID NO: 12237 - protein, 404 aa, Chlorella protothecoides
  MOD_RES (396)..(398): Any amino acid
MITADRNWGALMFAALLVALATLCWGIVLFVSCGEVESFAVPKEARVAGNGISLGSPTAHTGGAAEFQRLPMGAGIGLPDGEIQISGGEGDRLLPSNPLEVDIPFYSCNAHRSAEEGFVFLSEGKWKLATSRMGADYVHPPLHERGPCKADIFDTIGNALGDATRTVGNAVDTAADATTNFAGNAVSTVGGAIGDAANAVGGALSDAANATGDFVDSSLDTVRSGLNTAVGAVSGAGSDIRTFFSGGEVTPLLPSIHVAVMRIGILMSRSNTRMGSMPPDSRVWCQVCRQLIPIFDSSGINASGTQPPSPLNTPTHPPTPGPIVVKTLVALQYAVNLNASDYQDEAVQLALAEDAVVTIRHAGLNQAIVAFQNGACFRSFPCDTMVSHLQASDVVXXXLSVVPL

SEQ ID NO: 12238 - protein, 502 aa, Chlorella protothecoides
  MOD_RES (132)..(135): Any amino acid
  MOD_RES (151)..(153): Any amino acid
  MOD_RES (250)..(252): Any amino acid
MIEPYRVKSELETRCARWSLHSSITRLLHCCTGFRLLPRNPERAEPGAGALQQQLQSGWLSLRILGMDSTIAAQVLDPEISHGGFRAPKLRPPLDNVGVLHEPVQQPCAQRQKQHHSALSGAEMGIDILRSXXXXTTDEFVGSLAPGGPAXXXHCDKEGMSVSDPSHLEAQLASQIVTLWRSQTAPFQAIVDDYAAVLQRAQESHVRAAQLDREANEARAENDTLLRALEAAKRGAVTQEETQSSQQTLXXXNAGGGGHGNSFELELTASCSNGADSVFPANALFAALQAVLTRTETDLTAAYKDKAMLAESSLQVTQQLSVRLPWQSSASTLLHSTNAIPSTYLQVVRDINEQQTREIKEAEAAIRTLRDQVRALRGEVERLEESVAMAGKEAEVGPGFGLMWRSHSVGDPASCTAGTPKADGWLMGRRRYQMLACWAQRNDATVSAARAAALEADNAALARRLVELKEAEIERMNDINRQGEEMVSWECIKALRALWDGG

SEQ ID NO: 12239 - protein, 258 aa, Chlorella protothecoides
  MOD_RES (93)..(96): Any amino acid
  MOD_RES (129)..(135): Any amino acid
MDSCGYAPRGMGAGPEVPHVPCAPYGPRLALAPNPIPAPSPVPPRFPLATVLVDGRAAGEPFRGEAASGSQAKAWVSAADAVAAASRSPADPXXXXHVPFALYGPRLALAPTPSPLRLPPPRFPLATVXXXXXXXGRHPPRPAWPPVARPVWRRRAAGRGGRQCLRGAAGPARPAGPRRRPGGLGRAAVPPGGGRARGRGGGAPSGPGHRRQPRHAAPAAAAGHAGRLPAGCHGPVAGGGGLLDAGRPAGPPPAPRLL

SEQ ID NO: 12240 - protein, 173 aa, Chlorella protothecoides
MSNYLKKRALEPLRYYVPSLLQARDQLSGLGTTRRLSLRQPANGAATPSPTPITLGASPNPTFHCHSPVEDAKEARSRLRTGAFAGLREAVNAVGEYTSRDGKQSTAFLRTLEDLDFSIFQAVKGRDSIGPASLSKVDRAVAALDAVLAAVPGDDLDYGKRIVTQLRAPLPPV

SEQ ID NO: 12241 - protein, 138 aa, Chlorella protothecoides
MALTAGKDNVVRVVDLRALRVQCTLTSRHFSVGGAWSVVALRGEGRGWSGAALQARSRRRAQPRVRTTGADEHHAAAGSADGSVLIWDLTKPGTAPSRLSARQAASPVTALAWSPIGAPIVTGSKAGGVAFWDRAEDD

SEQ ID NO: 12242 - protein, 188 aa, Chlorella protothecoides
MRFKSPRSFVSRCALRFPGRHVGSMGWGLGPRALGRGLMVCAAGRAITLRAVRPETHYKGRWFKDASVVNAHPDGIPNLKKGVEVSRSAGRCSGGLLSPAPPHSQIFPRLAGTLYTGAIHIFCGIVGKLIVLPSCACMLCWTQVLDLRCPDPPAGAGVLALPRSLGWLGWVAGPLLIIAFYFMSLTAA

SEQ ID NO: 12243 - protein, 478 aa, Chlorella protothecoides
  MOD_RES (109)..(125): Any amino acid
  MOD_RES (460)..(462): Any amino acid
MQSWALTVIFGAVQVVSSLVPNLESAWWVSAIGTLTSIFYASVALVLGMIHGENLPEGGLWCLKAAARSADLHSPAVSLCASESESPPTLNPYSLQWPGHHRGHPLQPXXXXXXXXXXXXXXXXXPGRHRLCLLLLQYPRGNPGHARPGKHAWVTSCTCRDVVWNLVPVHIPCHRPAPLTRLPCPFTLCAAAQGCQDHGQGHHFRGDCLICGDVESGDAVDGDAALKPGGPKSLARISRPFLLWPLSAFVVRPQASKPLQPSDEPVQPITHSSFYFLVAIGGYSSLGNGRLLGHYVWVVDEERIRWANHHAAQARSSVHPISWAITPHTMPRNPTDVPSYILGGLEGPDWVIFVANFSAVFAPPSAPCLRPDTSLFPPRSHPQASCCTCGLLTKSMPNPCLTPWSPTSRPSSGCRCAGRWAPPQPSKVCMASTHLILSPHPLHSLGSARQGPRATPSCRXXXHRLLPLPLLVLEGERD

SEQ ID NO: 12244 - protein, 380 aa, Chlorella protothecoides
MMRDIESMRVIRQTGPWAEMWTGLVCTATPRGPARSPGRRSNDPVDVEEWEGLRGAAPPDMVPNLTSSALYHELLRTPICVARKKSCEPRTGVRGVLPGSSATACRLPPEHARPSHRGADQHAGGLSASVHHPTALGVWWAPMAPHGLQAAPQGTPSWVAPGFGVDSPRKMCHANPPCIPLLTLLAHPPPDLHPTDLQKCLARASATLHKPAGSGQYTGAVWPGPSSGDPTTPTPLHGSCTGGAEAEEHALRLQLELHDHFMNEQAGSPQTRSGRARRVMEGAAADLARGGFPWSAEGLLEAYRRCGVVTAEHAKTFYLGTQLMTPEKARAIWAIYVWCRRTDELVDGPNASRINPAVSVVLLLLRWGIPMVTWSGGEDS

SEQ ID NO: 12245 - protein, 624 aa, Chlorella protothecoides
MDEGAEGGRLSHHRGSTDGHALRGGRTKPPLRTPAGVLLGRIRLPHGSSGMLRGNGGEGCDRAPWTRQVSGSRVASCPGHAWPTSAAPGSAWHAQHGPSSGCRHFQAALRLDVHRRNICSAVFCIGLHPSAQEHPVQVNEHPTRCHLPCISGLHHRGDYTAELTESASVQPLCTIPQDALWVPPLFRLLSGFKRTRRQRCASWQSAAWGMKGRSILHGSKGIDGMRDAECQGLPNSSHHSTGAKGAHRPTRRLASLASPHFRAGYNHLRPFSPVSPATYPFWEEYLCLLGFLIPFLCALALWLCAASLAQQLPGLVPGRGRRGPPLRTHSHFNSCASSPADPCVLLVMERECSEARTPLMGRPYRVRRPPGKARKRECLFWHPSRQAVVAHAERPLHSGFPQAAHAIKNLTYKPYFSRIHPFSTRSSKLVLCIRSTSNFSAPGGYSACHQPSLCAALSRTSPGPHQEELTAADYYADSYGHFGIHEEMLKDEVRTKTYMNSILRNGHLFKDKVVLDVGCGTGILSLFAAKAGAKHVYGIDMSAIAEQAKIIVRDNGYAVRSAGDGRGGVQLGSGAVGSSQRTRPALIPYLARTAIDARPFILREGPHHHPPGQGGGGRAASGHG

SEQ ID NO: 12246 - protein, 149 aa, Chlorella protothecoides
MTKEDASFTANFALTTTRKDYVHALVAYFDIVFAACHKPIAFSTGPRSRSTHWKQTVFYLEDTLRVHPKEEITGGEGGPGQSRLVHPHDAHSLSQAPHMRCKEECRQEGGSRDPTRLPDHPPAPKPARYMYVQHPLYPIPHLFHPHQEP

SEQ ID NO: 12247 - protein, 422 aa, Chlorella protothecoides
MGKSDASKEDTSRGGAWYVHPAAHARQYCPGGGTVVHLPPPHPSFADLILPQKTTPALDTSKWPLLLKNYDKLNVRTGHYTPIPSGHTPLKRPLQEYVRYGVINLDKPSNPSSHEVVAWIRRILRVEKTGHSGTLDPKVTGGLIVCVDRATRLVKSQQGAGKEYVCIARFHSAVEGGTARVARAIETLTGALYQRPPLISAVKRQLRIRTIYASRLIEYDEERHLAVFWASCEAGTYMRTLCVHLGLLLGVGGHMQELRRVRSGIMGERDNMVTMHDVLDAQWLYDNHKDEAYLRRVVMPLEVLLTNYKRLVVKDSAINAVCYGAKFMIPGLLRYESGIEVDDEVVLMTTKGEAIAVGIAQMSTSVMATCDHGVVAKIKRVIMERDTYPRRWGLGPMAQKKKALIAEGKLDKHGRPNEATPA

SEQ ID NO: 12248 - protein, 595 aa, Chlorella protothecoides
  MOD_RES (558)..(561): Any amino acid
MGPTGRRGCLCTAAPGLLLPAPLITLHHDHLPLQSLSSSLLRRVYAGRSCSVAAPSRDAAAAAPRRAPVPVYVMLPLDTVWLLERDGGAQPVLIREKAMAVGLEMLSAAGVSGVMVDVWWGIVEHAGPRRYDWSAYRRLFDAVAAKGLRIQAVMSFHAAGGNVGDTCTIPLPRWVVKAGEADPDIFYTDAHGARNRECLSLGCDEAPVLAGRTPVAAYRDFAAAFAAEFRDLLGSGITEITLGLGPAGELRYPSYPEGDGRWRFPGVGEFQCHDAYMLASLAAAAARAGRPEWGRGAPHDAGAYNSRAHETGFFHDVHGRWDTDGGVGGAAPGAAGHRGGPPHPADAPPPASHPATSASHQTTTPLDASASTLLRFRPAAALGVKLAGVHWWYTTRAHAAELTAGVYNTRQRDGYEGIMRVLARHGAAASFTCVEMRDCEHPAEAACSPEGLLGQVLAAAARAGVPLGGENALQRYDRAAFDKIAESAVGRSVLAGRLEDGRHDGGQLGRVQLLPAAADGAAVLRSARPVSSTAGTVELADSNIHHRAPSPKPHPPNXXXXLWSLQAPTSLIAHPPPNPTPQTPPPRCRLPAWTP

SEQ ID NO: 12249 - protein, 290 aa, Chlorella protothecoides
  MOD_RES (270)..(273): Any amino acid
MSQERGLQVVTNPRPVVKDAQLDRLREEREVHRHRQIWTKDAHGGPYKKVMVVSGDPSVQGLAILVRLGIPWLAPPPCSQVNDGKGYDPLLQTPDGKDKEVSGDRDINAWDGLLGFGRQCLHKSREEGRAENSLCTPPRDALPGPSLPPSPVPCPSPPPPQWALGYERVKVGPTTNFVGNHMTQAAIDLVQAHLQPPREPVSDPGALRLTQGAEHGPKLLQVTPPQSEQHAGSPIRALDRYRWQDAAESVDISVELPQNGPWDVTCEVTXXXXRTAWISASSCHRTGPGT

SEQ ID NO: 12250 - protein, 484 aa, Chlorella protothecoides
MADSRAPGLAHPGEDHEAPPPPPPRVEVPGPLLSPTVLGEDSSSLSISLHPASVLQTSHDGRPRHFGLNYDLQMQQRITSLLQQLPRATSWTRAAIALLNLHPSLPQLHEDQGVRDHKWCTQVGQGWPFGWDSDAPCCMQYLGPETHVRVNGLRPGRTYAIRVRVQLVCDDPEVELATPPPSPICTTSTTPTPPQAPAAPGLSSRQRNALKVRGAVVDTALPLRRLRAGIGNTWLRGWARVPSDLSACPAQFKWCDPDETGGRPILEWVLQVAGPGVSEDPQVTAGDFCDVWEGLHGLTQHRSRRPCQVNFGGVCRAFLPYALEGTTKPSRCTALLHLGNGNVSDTGAAHRLPGRRHLVPSEEAGVRDSAISCIGESPWSPTCSVSTPAAVPAAPLAPVVVERDASSVTLTWHAPHNNGSDLTGYLLELDDGGCGEVTGVRWWDWCRASCLCEGHSHLCQAPLAAWGRPWGVHGSRGVLGWHAT

SEQ ID NO: 12251 - protein, 695 aa, Chlorella protothecoides
MEWQWGGLAALPFPPSRPHLGGARSACSGGVLVRAWPLTGSRARWPGGSPGRSPMPSWSGSSHRRRRALLRPTPPPVPPQGCRWRGLPRPTTAALASQGIDWSWSSPAGRRQRRGGSLRKAWGRGRWGVEGCKGEWARGADRTRFLPSARTRARRMPRAAAVLRMRAMQGQGTSPSTPSAPRPWSGPPLSAPPNACAGSEVLACDSSSAVVQALEPGALFTARVCALNAHGSSPHSAPGRGRWRLWGGGWAAGVVLQSPSGQALEASPASRCLAPQGSNARETATMRTTNPSPHPVLPAPLFPPTPAVTLETAPGRPAAPDRPRLLRASGADLTIGWSAPYGRGGGVRSFQLRIAPAAACLRPESLPGEPPRCSAQAYSGPATSCTARSGGGALGCWVAEARQGAAVLHVEKAATHAGPASLPSTRHAVPDLQPATPYRAWVAGENAAGKGEWSAPLECRTQPVGPSPPQALAVEPGAHFSRVARSRWVGCRGAALSWAPPALDNGSPVLGYALQAGPAARRAGWRQVHVSDAAGGSCVARVRDERARCLEGVVNAPEKRVRWPRFLGLMDPSRLMQTPACRENPGRHGCICLLDVEMHSMARNAAPGRLQVDRGPGTRLGRGHGRRSSPWPCHPTCQLKSGGGVWATGQGVLCGAAEHCPTGHARHLRGKEVVESPPCPKAPSGPARQPAGSGW

SEQ ID NO: 12252 - protein, 90 aa, Chlorella protothecoides
MSSVTPLEHTAIGGVAGFTETCIMQPTIAIKNALQEGRPIPRSPMTLYRGLAGRALWKREGSGPRHPCTEDGQARHTALKFTECPNLCGQ

SEQ ID NO: 12253 - protein, 413 aa, Chlorella protothecoides
MKTGTGSTQVARAVWTVGRHPTHVLRLPSQGPPRLNVLIIPGNPGVAEYYEPFMHSLHQGLRGRACITCVSQLGMDGQGLTSGRQACFKADLLLPDVVQPLKQSGRRGQGHAVVDSMRHLAPRHPRAPYPRQVFSLSDQIQHKSDLLRQHFSQEGQPPLALLAHSIGAYMAIKAAAGAADARVRAVVAMYPFLEHDPACPRQRSLAWLSRRWRWVGRLVAPLQLLPHPWLRWEGGKGGGEEGARARGPVGPVRLFKTPRCDGEGTAAGPGAPGAAGRSLFPGRPQQQPPFGTLWAVTRPSIPIILPPALRSAVVRVQSGMQEEHALAATRLVLRPDSVRNALFLASTEFAELEGSLPWDDVRRLPSFTAYLAEGDMWCPAWQQQLLEKVYWGGVKGIPAPREWLSTLRDGTWL

SEQ ID NO: 12254 - protein, 645 aa, Chlorella protothecoides
  MOD_RES (140)..(175): Any amino acid
  MOD_RES (193)..(196): Any amino acid
  MOD_RES (214)..(217): Any amino acid
  MOD_RES (270)..(285): Any amino acid
MAAVAPATTTPAPATPSTEAAPAQPQANPALANSSLYVGDLDRDVAEAQLYEVFAQIGPVASIRVCRDAVTRRSLGYAYVNYNSGVDAGAGASARVFGYHRPPWHAFACKCLSGWIQAQGWASHVLCVSSRGLFDPLPSXXXXXXXXXXXXXXXXXXXXXXXXXXXXXXXXXXXXLARLPVLFPLPDISTPPXXXXLARLPVLFPSPDTSTPPXXXXSRANACLAGCRRKAWPAMSCVSAAGGYLILFPSCGRPCHVLCSPSHNLPVHLXXXXXXXXXXXXXXXXTSAAAERALEQLNYAPLAGRPMRLMWSHRDPSYRKSGVGNIFIKNLDKSIDNKALHDTFSAFGNILSCKVALDAAGESKGYGFVHYEADEAARLAIAKVNGMLLEDKKVYVGPFLRRSERAAESGGRFTNVFVKNLDESVDDEALKAAFAAHGAVSSAVVMRGEDGASRGFGFVSFEEPEAAAAAVEALNGAPLAGKELFVGRAQKKAEREAMLRARFEDVRAERIARYQGMNLYVKNLPDDADDEFLRATFAPYGTITSAKVMVDAASGKPRGFGFVCYASPEEATRAVSELNNHMLRGKPVYVALAQRREVRRAQLEQQHAQRMVLGAPRGPLGGPAPGMPGMFPPGAGAPLYYGAPR

SEQ ID NO: 12255 - protein, 335 aa, Chlorella protothecoides
  MOD_RES (118)..(121): Any amino acid
MSGPASLHAVTWAEKFAPGTVDWLGLKIYARLSTWLEHGTEHEPHQPLDEHGRASSSCAPAVALDNARRAWQYPERGGSLEGRSMDLHTAGHCAGAGRSSNTTTLASIYCIAYLLKLXXXXMDLHTAGTDPTSIKMPLSPPVQWAQRKDRLYLTFDLQDCKDPTIEVKNDEASQSGRVSFKGNAHSHATGPDEHTYSMDLELYGEIDDSDVKQVKTDRTVVLILAKKEEGPHWPRLLKAAGRAPSNVKVDWNRWVDEDEEGTGGLEEDGFDLSALQNLGGGGAGAGGMPDFSSLLGGAGGPGLEGLGAGEFGEEDDESSEDGDLPPLEGDKPAAA

SEQ ID NO: 12256 - protein, 467 aa, Chlorella protothecoides
  MOD_RES (459)..(462): Any amino acid
MVKQGKALLKHDFVFHVWDPIGGAQPCHVPSWVPSAHGHLWTHCAPSRGHGPSLLPAHVRMSWHCLATCRAASDEAGCSGSRPSDGAMPLVQRLRHGAAAALKTGALVATLLSPMAAQAYTPAALFGGSTLTAPREAPSIQENKVGQRIVCIGVQLPMGVTCTGVATIDSGLHCHLGSIALDISIRFFLMYASMQPHSNLSRLTSRPRSSRVFTSSKKTRSPAMSPLGSPRLTAVFAPIVHQHEATVLPTCLHMCAWPGTGRLCLLILQPHAPQAGGGEHSQHRHQARLPLHRPPAPAPGPGVRLPLGRPGPRGDQLPRHPRRFRGPRHAHRPERVQREAGGGRPLAGHCRPPAGRPARQPGRPQGRGSVAVGLPRLEVRGQPNVPSRLWHPCSSCSPPAHRPPRLQGKSSGLAVGQKVYAIGNPFGLDHTLTSGIISGLNRELGAGEAGRKGDSWVVXXXXGAGSG

SEQ ID NO: 12257 - protein, 354 aa, Chlorella protothecoides
  MOD_RES (108)..(111): Any amino acid
  MOD_RES (246)..(249): Any amino acid
  MOD_RES (281)..(312): Any amino acid
MYHSDNATLSIGTSAHSFSPPSAPQLDNPAVFPQRYGAAFPRDFLNTVKTILKRLFRVYAHIYHSHFKYAVAWYTGKGGAFWVARSFAQRSEYDSAHTFSTPGGPISXXXXFKYAVAWYTEKGCAFLVARNFAQRREYDSTHTLSTPGGPIPVLQCSCAGRSDCSPNPPGWDPVPLLLHCLPPCAPCRSGCCSTCHFHSTPPVPAGQSPHRRSGTGAHEGAHRQADKGGAMTASPFCYGGKHPAEXXXXGGIQCLYSFIVSLPVLLSLWMLLGVSFPLYPXXXXXXXXXXXXXXXXXXXXXXXXXXXXXXXXGAHRQADKGGPMTASPFCYGGKHPAELLLTVPGVTSHHHTHL

SEQ ID NO: 12258 - protein, 417 aa, Chlorella protothecoides
  MOD_RES (43)..(46): Any amino acid
  MOD_RES (87)..(90): Any amino acid
  MOD_RES (110)..(113): Any amino acid
  MOD_RES (292)..(295): Any amino acid
  MOD_RES (317)..(320): Any amino acid
MSPRPNDFGRERSRDRSRNGHGDGERHTQGPRRVKGAVEIAPXXXXEWGTFGMDWNGCDLLLDAAPTVPTTAPGPDVLTPTRISLLXXXXPGRSGSHEQFRRETIPKPLXXXXEWGTFGMDWKGCDLLLDAEPNVPTTAPGPDVLTPTPLHEPSAVLEGPGSCDGELLQFLQVLHGLVLILAANVVMHLYSDADLITPQSQEGRHLQLNTRASSQGLTLKQHIEHTLGTGTIEEAVRLPPGELGAPGRRVQRADSRPNLSPCLPPGGLTCSTAMHCIHTLPANSASVVVYLXXXXEGRPAALSLDIRKLMCISHLGXXXXPCLTGWRNRFVADRRNWPHANLLAAGSSDAGCLLWLARIAFFDRDRSHYEYLWADGVRVKHPVKLSAPAYVNTLFDWVEEQVSGRQEKVASCKPPGG

SEQ ID NO: 12259 - protein, 902 aa, Chlorella protothecoides
  MOD_RES (65)..(68): Any amino acid
  MOD_RES (476)..(482): Any amino acid
  MOD_RES (862)..(865): Any amino acid
MVSRTRKVPGLCMVSPVTHTHCTAVSIPCMPAVLVRPKRRPGPDPDIQLHNIPLWGTRHAHTQRXXXXPDIQLHNIPLWGSCRAHAQRYAPTFQLGLGRRVDELGDHKLAVGALGQLLELGLELRQDLSALRIAAVLHAGLHDPGGGVRGSELHQAPLDLGQHLGGQLAPSLGRYVVPAQLLPEGSSILAGGGRVRAVGCLDGVTAAAVLGELSACFSILRASSTAASRSQHPTRHLNEVKVTLDLGLALAQGFLALLARVVDGFRILSSGWDVLQMFLALGSDPSMLRILKASPAFHTDLDCGLLGRDGLAGADLRSLWPPAWDDFGRFASLPGPLAGLLLLLTGLDASLAMSAPEVGESYLSKVAASLGSSRDRVLEQSGLYGFQSNTRSKCDVYILKPDVKSHAHQLELPSPVLCDARQRRDSAGGKQPTSLRQEFSPAGRDRVLEQSGLCVFQSNTRSKFDVDILKPDIKSXXXXXXXAFNIRGIPLGNCEGRDVGHQGAVPTEQSAGVGPGVRATPWISPRSTLQQMVLLPQSFLAQRIDEKNRMKDSVTGHRTGLTERLLKLFAPRPPLESVPVPPPKPKAVPLSGIAQYMDKFAGPGDPEYHGAQEIKEETRLFRSPELQYQARIDVETLPERGAWRRCFPAGRLAWGRYITVGAGEPAARSAGPLGCPPLRLARSVSLPPPRARSSTSPRRTPLPPCRDIRLAAEAQAAAAAAIREGLETWDPTKDPNVQGDPFKTLFVGRLSYDTSERKLRREMEEFGPIRRIRIVHDRNTGKPRGYAFVEFEHKNDMKQAYKLAEGRKVEDRRILVDVERGRAVTGCIEAQRASMLHARPMYRSLTANPAMRPAQNPGRMTXXXXHVEAVDSLLSKDRSLGQLRSPEGLDAACTPNVQEPHR

SEQ ID NO: 12260 - protein, 265 aa, Chlorella protothecoides
MVLGCKAPRAGAVDGNWPAPDSLHAGAPAVAVPADLYAVGCLLAEVASNLLFIIECCPRNSANPTTHTHILLLLCVPGTNNGPSLRNVIQTDAAINPGNSGGPLLDSKGRLIGINTAIADPTGYLYLDCPGSFTCLSFSAHVKPPPPSPQTPATGKGASSGIGFAIPIDACRGLVDQILTYGRVVRPMLGITLAPPQALRQLGLSGVLVLDVPPGGPADAAGVKGTMRDGFGRVVLGDVIVGVNGRKVANEGDLFDALDSCKVGV

SEQ ID NO: 12261 - protein, 89 aa, Chlorella protothecoides
MAPFDPYNTLGVPHGAGEAQIKQAYRSLSLQYHPDKNPDPEATKYFASHITKAYETLTDPVKFANWQEYGHPDGMQDYDERSVPIVLVG

SEQ ID NO: 12262 - protein, 229 aa, Chlorella protothecoides
MAREASKPVKSSKRPASGPGKDAKRPKSSHAGGHSDRKSAPAKPSLPSKPQSRSVWKAGDALRMRNIEGSLPSARNICNTSQPLDSILNPSTTLARSARKPCASASPRSSAPHCSHSAPPCQDATSLWEELRRHDVTPERRSQLTTQVLSKIKGRLVELASSHTASRIVQACVKHGSDAERAEILAELKPKLQELSKSPYGKFVVSKLIDTAPKAQLKGGGIPLGVCAA

SEQ ID NO: 12263 - protein, 192 aa, Chlorella protothecoides
MSGVVKVLRLQNFQILRQLKLEEALLRASNDNWFLVNDGTPDPAIVLGISGGLSWVVEGPEWLGRLGGRGPPQQGMAPREDSLHSFHCRKPEVMVHEVAARKAGVTLIRRFTGGGTVVVDSDTLFTGLIMGVDEVPGLEPFPRPIMKWTEDLFKPVFGKYGDFALREHGEWNVLVCGWWWTEGYSTITKHLT

SEQ ID NO: 12264 - protein, 254 aa, Chlorella protothecoides
MRMCSGPSRCHPSSSHSSPGQGQCGSNGFTCLDCSRAFDRWTVAGHTSCVTEHEKYAQGATKPGGYASKGCFASQAAHQAAAEPSAEGLVGPQFLSERAPWRCSVCSVTCTSRESLEGHASGAKHQRRARAAMAAAAGPLPEGGKPGSGHDGAAPVSEAAAAAVSGKPSLETSGKRPRDGEDLAPTGPPKKIKWKKLAAAELNRKGGSMKLKKLTAAVLAAAGRGEDSAAELLQKLESSGRFSLKENRVALVDE

SEQ ID NO: 12265 - protein, 375 aa, Chlorella protothecoides
MPRWAGALWWGLERAEGSAVRAAALKWLPASSAGHMPTLRGQGLHLIGLFSFYEDGHGECCRVRKVRPLRRQLAGLGAWVTGQRKDQSPGTRQAVPVVQVDPVFEGASGGPGSLIKYNPLSNMTSTEVWNFLRVMGVPTNALHGAGYVSIGCEPCTRPVLPGQHEREGRWWWEDAAAKECGLHSGNVVRSAEEQAAREAAAADLWQSGDVAALSKEQLSAALEDVAGRGEPTLVVLYAPWCPFCQVGGRGGAVSGCAPATRGGGPFVDECVCRSGWERRPLTLSLMPPRVKLQLPARGQDGQASLRPRCHLGAMEPAYAELARQLAGSGVKVAKFQADVEREFAATKFGLETFPTIVLLPQKTPGACTGSGQWLF

SEQ ID NO: 12266 - protein, 531 aa, Chlorella protothecoides
MTAYLSSKLILDLDAQYIGVGRTLGLDVGLRVLARVTHFSNAVHDKLPTACVPGNRPLLEEATGSSFTDRRSYSALEEGSYHRSWQGNHRGASAAPEICEMPVRGVRSDNAQAARHFHALDLAHRMDSLGVEPTHNSHICHDKSARRARPHKISGAMVSLGVASRAVRTFPQPSPISWLVASWCPSVPALPCNPPRGRIEQLSWKPRAYLYHNFLTAADADHLVAIAKPLVRHLTWGWWGGPHFRSFYMCLVECILKTLSEEPFRLTKQWWRLVRRRSALYWQRIAVQGRARATQHLSSLSSTSCRCSAPRWLDWAGSLCWTTCGPPTAPSFAATRWPPGQGPVSESAIGWQESCGPGGCLRGHGGTAASAPPGPDVGPPFPAPAPALQDPVVAAMEERLASWTKLNITHQEDTQILRYGPGQKYGAHYDSLDNDSPRTATVLVYLADTEEGGETAFPTVRGAARGWVVCVSPGQVVGRAQFWRSPGAGVHAHRGAARQGAGAQRVPCCPPPCAHPLELRTARDLAMHERA

SEQ ID NO: 12267 - protein, 208 aa, Chlorella protothecoides
MVISPRHRKRCRTCSPPQVVFKVKKSTKFEKILNAFCQKKAVAISEVRFVFDGTRINPSMTPEDMEMEDGDTVPTPWLLHPSHRCRHPWLSDVSGPSLSCIVGHRLRSASIRVGVGSGGVQIMRGALALRQRIMQAGQGRVDILPGSTSAPPAPPWTRHPQGRGMLMPVLHCPAGHVERIGGASAGLTSGSPPVAWGWGSADVGWQGV

SEQ ID NO: 12268 - protein, 149 aa, Chlorella protothecoides
MHTGCPVVKGTKWTATKWIHTKPFRPEGFPDHTVSAEPGCDRGGWLRLVVPGMARLKSLDDTCLARIAHTSASAGQCPAERLSSHPSSHHHAAPSGNPRAGNLLGQGRAVSRLGRVGAVQQQLRLHGRRHVPVSLGLWDLQWFREEWAR

SEQ ID NO: 12269 - protein, 633 aa, Chlorella protothecoides
  MOD_RES (61)..(64): Any amino acid
  MOD_RES (188)..(191): Any amino acid
  MOD_RES (341)..(390): Any amino acid
  MOD_RES (503)..(506): Any amino acid
  MOD_RES (565)..(568): Any amino acid
MLTTPGVHSSFPSLTRFALPTPDHRTEALGVGSTIECVPAAMQGLTGGSTAKDLETAWPCXXXXIECVPAAMQGPTGGSTAKDPETAWPCDAPGPGQRLAAGFQMDEFVVRDADAGVEVARDFSVLRSAILQPPLHPPLPSADSLRRLAAALLLLGGVGGPHGLHARLRPPDHAAAASAGRGAAAANXXXXMHASGRQITRQRCRPGAAWPLRTLRAAWHGMEANAVRLVAERGVGGTVRRLRCITAGEDGALRTLDFGPGDGANAEPFRGPSARSVDGAAVRALALAPRANLLLAGGAKEALAAWRLAGNAFEAAAPPPAPRRPHRARDGAAALLRADLXXXXXXXXXXXXXXXXXXXXXXXXXXXXXXXXXXXXXXXXXXXXXXXXXXALADGSLRALALATGGDNPRAPRHVADLAGGGGVALCCAGLAPPDAGVRVVAAGASDGSLAFWDLSSLARDLAARGGAADGAEESAALVTLAPALRLEAVHQSGVNSVSLVWXXXXHAGPGAAAGGGAPVWGQLGVPRLAGRCARWVAAGRLLRGLLMFHLGSSPAVDLGIRASXXXXPPAAVTFTPARPAVNHLGRFGPAPGTHGRRRPGAAPPGPPAARRPARPGPTLASRRRPARAQRPR

SEQ ID NO: 12270 - protein, 273 aa, Chlorella protothecoides
  MOD_RES (7)..(9): Any amino acid
  MOD_RES (53)..(56): Any amino acid
  MOD_RES (125)..(128): Any amino acid
MKKLLLXXXLPGMKPRVRFSARGSTSILDCTSGSCCSTQVPETLSEEVLAKLXXXXTSCCSTQVPETLSEEVLAKLHAPPKDVDVPIIDVAKLPEFDGFIFGFPTSLKTAPHPHDDTGLAPPLLXXXXQLDNGTPPTRRHRFGTAPAQFKAFLDATGGHWASGALVGKGASIFTSTGTQVGPRDGRKDIVGKGGWWTTAASCASVHVEKWGAGSLPGTNGPSPSSLHREAAARPRCLPACRSLSTMASSSFPLATPMVAPSSPTTQSAAARLT

SEQ ID NO: 12271 - protein, 201 aa, Chlorella protothecoides
  MOD_RES (78)..(81): Any amino acid
  MOD_RES (197)..(200): Any amino acid
MPLLPQGVSTLAGADGSRQPSELELGYAEHQVQLESTRTEVKKPALRHPIFPHITRANDRSFGIRARSLVAARRAGIXXXXCSSNVLLPGCLTRIHYTRTIISQWEPYLHGTSFESITALTGYLVIIIDGLERRSMFRDSCSVLGRRKASWNRRYGQRDSGRTGNDNNITDDSTASLPTQTDGWNSAWRIESVMTPXXXXQ

SEQ ID NO: 12272 - protein, 425 aa, Chlorella protothecoides
MGNCFSTPEPSAPVAPAPATAAPAARPVEAGPVVAAEDAAPAANGAVTRADSTNGVAPAARIAVIYYSTYGHIATLAKKVLEGANSVPGVKADLFQVLCGGIWGVYVHGAFEFDQLPTGTHRTAWTLAFPFLSLQVAETLPAAVLEKMHAPPKDASVPIIEASQLPEYDGFIFGFPTRVQEEEGQSRRPCVHALHLTPPSSMHSLPQVWHHARSIQGVPGCHRGPLGLWGPGWEGRFHFHFIRNPGGPGNLGGSLTCSAQQSPVSRKVMCLLLGAMPAALDNLVRHAASPPAPLKPQGGGIETTVLTSLPVLVHHGIAYIPTGYSYGASLFSNDAVRGGTAYGVSTLAGADGSRQPTELELGYAVHQVDSDYCVGRHGSTVQEKQCKPLVNPVLPQPVCRANMLRGSSGSWQPDQVVFSSGLPQN

SEQ ID NO: 12273 - protein, 186 aa, Chlorella protothecoides
MTIDVGTALAAIAAANDVDTLEKALQDASFIDATPGDDRQKYRGALGVLARIVRALARLHRPRTGHVVDPTCLHTCIRPGSRTLQSSLLAAGKAKLRKLKTEQAAKGGAASATAKPAEKSPHAKEVREGGRNCFRRIPGMMSWSDNIPSCQSRTELRRLRVREPGGEIREAELAHHLQARRCNGQA

SEQ ID NO: 12274 - protein, 203 aa, Chlorella protothecoides
  MOD_RES (94)..(97): Any amino acid
MTQGKGHELRAPCILAPLIPSVYSRCCRYHMQALQGDNATERPMWAEKGGLDFEGRARWDAWAALKVCGGRVGGCMGVCMPSGMRSCVFSSNLXXXXGVGGWTGVCMPSGTRSCVFSSNLQRFPPISHITIEECPCHLAGHPRGQGQAGVCPTVLRIPGQVVVLRHPCLSPPGLTPYLSVHLNVAGEMHVLPFPQVLAATTLL

SEQ ID NO: 12275 - protein, 163 aa, Chlorella protothecoides
  MOD_RES (88)..(91): Any amino acid
MSPPSTQPPTPLSPRAFRQLPISDKGLRRLSESFKMYRRTLGDAEVAAAFASILAKAKRSAAKGDVKVMLLGRKAHRGLREPALGVPXXXXGEAIRRQGRREGDAAREEGPSGLAGVSFGRAECQAQGICSDLDIGAMSCPSSTPAQMRGSHGTRCLLHSPLP

SEQ ID NO: 12276 - protein, 217 aa, Chlorella protothecoides
  MOD_RES (59)..(62): Any amino acid
  MOD_RES (214)..(217): Any amino acid
MVGGGVIGGFCAANRLTPSKREGGAQIAAARVLFCRAPACLPPCDPPPVLYPLVALHAXXXXADFQSIMQAVSSGGRRGRWRVLCGTSADALEKGRGGAKRCSQSAVLQGARLPASLRRPPVLFPLVVLHARVQLLGYIKKDKQGDALVEKLCQRFAASESLTQWHNVAFCLTQASVGVAVEGLVSVEVPHAVVLLRMSPPSTQSPTPLSPRTXXXX

SEQ ID NO: 12277 - protein, 197 aa, Chlorella protothecoides
MHQPMSPPSCRALLTGDPGLRASALLCLVKLMAVDGAFCSAHLQLLFTLLQNRWASWCWDDGGVSLWGKEGQRKGGLLEYERGASGESEEGDCMSSRCWPETWREGAWCSFPIAPSVSHWARTMPSLPPTTTIANFPDSTPRRGVEPGLRSTLAVALGDLALRFPNMLEGWTERMYRPLQDADTMVGSIAVGDSVQG

SEQ ID NO: 12278 - protein, 373 aa, Chlorella protothecoides
  MOD_RES (214)..(217): Any amino acid
MERVWMTSRDPSHAPQFLRPPHTSTINVQGCAPPAVRADPAFLRRGSGPRGRHKRPAGPAPRRGPGLGRRAGGACGLRLPPRAGPGPGEWASGAAPRRGPGCPHACSALRRRGPTAAVVLRGRAGRGRAVRAAPGAGPGGGRRAARTELACRRRRRPRPGALLLPPGPRGPGTAGEMTWVDRGKGRGGRDGLGGEGARGGDERVPCKEQHGRRXXXXGTAGEMTWVERGKGRGGEMGWGLKGHMGFLGVCIPGCPGSGIVSRYSAWQASPICSPPTPSSLCQVYVDGQAKRARRVLAGVGRPAGQAKGQEADAEDINAELGVGSVAADAELEGQRERAEAEILGPASPLAPHARLVSAGESGVECLQGEGEGM

SEQ ID NO: 12279 - protein, 343 aa, Chlorella protothecoides
MTGRCGYQLDKKCTLATSCVGSSPGDDVGATGTAKSTHPSSPPSLPGITFQLYDRDPLGVVDQAFFDDLVGLVRAFPLLSESRRGLLVDGLASSLTCLTSWTDRALASREQDAAGTAHHRSALRAHVFFLSWLVRQWLSLREGDAASQPAALQAAKPGPRKRTVEGAAAGSEAILPTAVKAAAASLNTDLWALFRPAGPDEQLLLCYSLLVRPATSLLDRPAACRDGVAVGNAGHVLSALALKYGREESVAAGLVELISTREHSPGPVADLLRDSVAKWGSASLVRVGQGEAGEPGWRASAVVGGLAAVDPAEYARQQSATGEKAGVRSVAVFFEELAARLPK

SEQ ID NO: 12280 - protein, 390 aa, Chlorella protothecoides
MLSTECQVRKGTHFPFPNPVLQGHTGRGIWQCAAACEGKVLITGGADGAVHSWLLSDWVHGPRSASWKARHADGPPRQETEVCRLPDPGTSDPGSAWAAPADATPTGPGVADSRGEYVRCLAPAGGGALVVATNRGRVWALLDAAGPGSEWRQLWASPRVSPPIHLQAACSGGLLALTELSGRVVVLRRDGACLRADSGPAQACVLADWAPGPDDAPALGAFWGPPLDAGRRCLFTTDAGGVTVAWAIPVLAATPPPACLARLASPFRQRVTALGSATAQRGAAGSLLTVVAGDKDGAGVAWEVPLGEDRPCEPAPLAARRHLHAGGPMRIARVLPGGRVLTAGNDGCAREWAMGEGGLHVLRRGAGFWGGDCRHVHGQALYSHKVAVIL

SEQ ID NO: 12281 - protein, 113 aa, Chlorella protothecoides
MKSFFDATGGLWVKGSLVGKGASIFTSSGTQGGGLESTVLTSLPNLVHHGIVFIPVGYTFPPQTDLGHVHGGTAYGASTFAGSDGSRQPIDQELDHAEHQGKYVAGVIKKLAA

SEQ ID NO: 12282 - protein, 225 aa, Chlorella protothecoides
MSGGGTGPCPSSHAYVGDITALCAVHATPYLLVASGSTVRVLHMYNGAGISSCIAMPDAIRVQGLRVCPFAVPGADRVVLAHGDRLASLLSLDTQSGCMSLIVPLPRLRHWILAASLWAASPATLHIVLGLANNSLTCFTCSPERDWRPDLAWQVDGQERSLLYSMAIHLDWDREGFGGASDGTRPAPNQVSSCCAGRFVSGPGRTTARGVGCTQEAWGRDVQPP

SEQ ID NO: 12283 - protein, 62 aa, Chlorella protothecoides
MVDPARIAELQKYYQRAGGSPYIHLRGKADRLTSVVIPLGVGAVGAFLLARGYYHMITGTGA

SEQ ID NO: 12284 - protein, 178 aa, Chlorella protothecoides
MSGRRGLWRAFSAMPRRGPPPPPPKFVLPGIKHIVAVASGKGGVGKSTTAGRRFWGVSCQWSFPGMNQHPARGHTPPFPRLPAVNLAVAMSQSLGLRVGLLDADVFGPSVGHMLGLSGKPEIGEGGCACGRGFLTGGQGGSLDRLCIQSKSLPNPSSRPRQQRQAGSWCRAARTACDA

SEQ ID NO: 12285 - protein, 401 aa, Chlorella protothecoides
MPGPAGLALAGRQAEDGMPHPARYPLCMQLLPGQATLYPGDRANPVQTYTSELSSTPPTLLPATAARLRGKQHLLDVLTQRVRDTSSYTRRACLAAWQGLAETRTLPLGHWAAVTDIAVGRLEDKSSLVRREALRLLQCLLLHNPFGPALPVGAFAASLASHRAALEVLAPDHAKDEFQGLKLEGGRDGATEPGQEGEQGGAEAPRIKPEPGTGEVPLPSQPAPSSQRRASASEVAPAAWEGSLEELKALVASLELATGFARTLAHTMPLLAQLLASASVSDVQARETVAFLLTCKQFGVDGVEATTRRALPLVFSRDPAIRTRLVEAADQLFVTGWAGNLFTPAAAARNLMDLASDATLGETVAAGLLNEGEQGVGSGAYSEVKGALGRKRCGQDGRRLG

SEQ ID NO: 12286 - protein, 90 aa, Chlorella protothecoides
MAFLLAQDAPAIWRGPMVMGALETLMSKVLWAPLDVLLLDLPPGTGDAQLTVTQRLHLSGAVIVSTPQARRGGVGGGAGGVCGTQGGRRR

SEQ ID NO: 12287 - protein, 296 aa, Chlorella protothecoides
MHPSAPSLPPVSRHAGFSKVGSLRTSILHIMGLSMSTIRVSNFAILSDRSTEILTAVECLKPGQKACSADSDGNIGSGNRGKNNFGTNNIGNSNIGNFNIGTANWGNNNDGTGNRCFNKTGDRKVSNDCSLLEFRKQAWVLAFPPPTVRKSSPPPKKAPPPAAKQSPPPPSKKSPLPPAKMSPAPPTKKSPPPSAKESPPPPTKKSPPPPAKTFPPPLAKKSPPPHSNPSSPPPTPSPLPTPPLSLSLPPPPSLPPSPSQPSPPPSPPPPSPPSPPPSPPPPSPPSPPPLPPPPSP

SEQ ID NO: 12288 - protein, 626 aa, Chlorella protothecoides
  MOD_RES (354)..(356): Any amino acid
MMGCSRGGPDQGDQSLPLLVYRDRGDVVIGCIQVCLRSFIPALYSRRAPLFLTGIPPHSVLVARAVLRREGFTQLYPRVHLPAPAQRDDVVVRRLQWPAHWQAGGWHREVALGAFKAFVPAQHLSARRSAFLCASRPVTVRAPVTASATMAASQLTIECADGRRGGKLKTRKVSGWSGMQSPLLVSYRTPESLVEFPMSQAAVKRYKVTGSGKVLTRKAGKQHLNEKKRHQHLLRCKCVCLVMRRWQGVMQCCWTGGPGHPPNPAMCTVCRKEQSVSPGDLFKIKRCIPYAGGESTANPSILTAELRYRSSGVASGHSMGYWLPTLDGMARNLCSSFLPLQQGTEASVQILEGXXXQHRCPILDVHGRDGLWAVGLEHPLRQVHAPDAGQGQRVRLGVEHPGVEWKEGGPAWPRAGAVGHGAGVRGIGLHQPEVLERLRQEEALLRVALRRGRRRHVVQAGVVGGVLVAILARTLAPTAVGGVRPRPHPRPALHRAEDGPGLVLVGGVPRDLVQQVERLRRLGAQQAVRVQAGDAELAHAARVVVGDVGNPVPDLGRQARGRVAVPLIAAARQLPCQPQVAHARGVVALRRAGDACVHAVVVAQGQHACGEFECGSGTSGGICVQG

SEQ ID NO: 12289 - protein, 517 aa, Chlorella protothecoides
  MOD_RES (360)..(363): Any amino acid
  MOD_RES (500)..(503): Any amino acid
MRMGQGPRQASHLPVRRLVRHGPDPGGRSVYTEDDGPRLPLPGGAGLGRLGAQPGQRPHGECFRGHHPPHRRPAVGARPGNPGRRRRAHPRPAGAGGRAGRATAAGLRGQPQRHSLHGRQREQRAGLNLPMDAHELPVGSRDADPGVDAPLAILRQVEGGHACGKALLGVGWISPRCTPAGGAGGATGYISKTHRPLHHDIHAGNPVFEKHTDKVYEVLASQTAKYGGLLPYELDPATGELQGDRVTLGEAVCMGARSMVSLSRACLGGAMPRPVVPYGVAPPTRPPMLHNGAGGRADSYYEYLLKRWIQRGKKDKTLLQWYIEVRLPIVERVGCVPELVNKDCAIDAEPPRLRFEALIXXXXPIVERVGCVLELVNQDCAIDAEPPCLTFEALMTGSGHAQRAVQAGPEDGGQPLVCLRAGPDAEPDLAQDGPPCLLLAGCGGGGVGVAGTQQMLDLLCTRSLGSIAPQVGLEGSVAGPAALLSWPDGLHIPLLPGPPXXXXGRLCGWTGCPLVSA

SEQ ID NO: 12290 - protein, 611 aa, Chlorella protothecoides
  MOD_RES (113)..(116): Any amino acid
  MOD_RES (296)..(299): Any amino acid
  MOD_RES (580)..(583): Any amino acid
MVTVAAYLADSGLSSAGIAPNTPFMEAGLDSLDLLKLARCAWCSGIMQNRQVNQRDGPMYSCCCIEHWGFRGHMLLDIPGIWHEKQQCIPSTPERSVVSQEFEATLPTTILFXXXXDCIPSTPKRSVLSQEFQATLPTTILFDFPSVASLSAHLVAAGLGMAKGGGSNSTRPEALHTSAAAHADPKAHASIEAGSFSVIPALRPAPTTIVPSRGAVLMQSGAIQVGDGGDMLAPADWSNAYGLHWSLGAECPRPIPPERWDAEVPGGVVAGPRFGAFLKGELNGETGEEGVLLTLXXXXSERWDAEVPGGVVAGPRFGAFLKEPSPSLACTDVHGFDPGAFGLGSAEAALMDPQQRLMLEAAAWVIGACQATAGWEPSMGGVFVGSTHADFLVASRTPGSATSTFSATGSSLSVIPAVGVVQVDLSGGDTGPCAQPALYSGWHNADPQVASPTHLVWGGSLSSWTPPARAAWWQCTLLPQPSRCTSSVICSGLIPVNSFQQAGSLTWGVAGGVNVMLSPATMASYDAAGGASVACTFWDLGSRLAMAPPIQPSTRGGAIVILITANYKHDVQLLQWPLSXXXXQGGAIVILVTANYKHNVQLLQWPLSLQG

SEQ ID NO: 12291 - protein, 307 aa, Chlorella protothecoides
  MOD_RES (112)..(115): Any amino acid
  MOD_RES (184)..(186): Any amino acid
MSLDAAADGYVRAEAAGLFLLRAVSSMDDTHAGQTSAWWCPGTSILLGTAVNQDGRSSSLTAPNGPSQSALIAAALRSALSDPEQVESHECVPGSIIWQWIVSHCSPAVGPXXXXTALSDPEQVESHECVPGSRIWQWMVSHCSPAVGPGQHVERGGTSCTAPVHQFLMQVDMLQLHGTGTPLXXXNTSCTAPMHQFLMQVDTLQLHGTGTPLGDPIEVGAALSTLAPRHRGAGGAMMIQGALSLPALPGHSLALAAVKASTGHSESAAGLLSLAAASAGAGSAYLAPLRTLRWVVVQGPGNQYARS

SEQ ID NO: 12292 - protein, 125 aa, Chlorella protothecoides
MKPVHDPSLHRPYDRARVYRANFGGGQHPFAGRPRAQQHAEVNSLPPQIRQLLQLAPLLLLLLVTFMSRPSAPVFSLHKTADYPVMLSTVRHEVPYYVPNLKAFEKEYPARSQPRSVTGVAAKVG

SEQ ID NO: 12293 - protein, 91 aa, Chlorella protothecoides
MRRAYRKLALKLHPDKNKARGADEAFKMVSRAYACLSDPQKRAHYDVHGSEDALSQQARPNGGGMYAQGGIDPEDLFNMFFGGNPFMAQQG

SEQ ID NO: 12294 - protein, 142 aa, Chlorella protothecoides
MGDHANKDEGTRCLHIAEQALQAGDLTKATRFAEKAMRLFPNDEVRKFITKLERARSSNGSSSSTGARPAGPVPTARRGAAQPGGMGPQPGLRQRGAPASSGAHVHETPDEDHKVGAWLGILLGLRSLLPGFQTMGSENASL

SEQ ID NO: 12295 - protein, 103 aa, Chlorella protothecoides
MCDFGYSKHELNSLPKTSVGTTCYMAPEVYLGYTTYDAKVADIWSLGIILFAMLFGAFPFKGRDKRYIQAVLLGRYAIPPDVQVCHWDEHAFIGVRGGESGLP

SEQ ID NO: 12296 - protein, 56 aa, Chlorella protothecoides
MDEYPNGTNAVVAVLAYTGYDMEDAMILNKSSIERGFAHASIYKSINVNLRDERGR

SEQ ID NO: 12297 - protein, 296 aa, Chlorella protothecoides
  MOD_RES (293)..(295): Any amino acid
PPTPLPRFVGQIPTDRQEPDLLPVFAPYGAIEKLTLVRGPEGKSRGCAMVQYKRWADAERAAAGVNGTSPLEGGRGRPLVVHFANPRRLVGSAAAEPAITPRKLFVGQIPKTASEAEVAAVFAPYGEVQGVSILKSKGIHAGCAFVQLTTWAACEAAIEGLHEQRVMPGCEHALVVKFADAKRLDGLAGKARAQGLNLLGMLGHPGMLANHSYITGAELGMGPPLPPQLGGMQGEPGWGREVWADGGLGTGDCSVPPVGLWEVVRRGRCGARVISRMWGFELSQEDRPPGATXXXW

SEQ ID NO: 12298 - protein, 878 aa, Chlorella protothecoides
  MOD_RES (219)..(221): Any amino acid
MWIKSLGVFGDLSWGIYYFESRAIWDSWSEKSGCQAHVAWEPARRPSGARLPPPGRYLARLGAPCALGPLPPPRRYPFCPVRTTSRNGDLRAGSSARRCNSRTTPTRCDDSRAMPGRSTMRKSGPSCCVGIYVRRTDRRRTCAPVWASPQLVMSIPSMALFAPSASHPMMGHELVDPACHPPKPPKAPGGLWLGHSLLSVRASPPHSSHLAPSLLLAPXXXTPGGLWLGHSLLSVHASPLTLYTSHPLFFLPQAELDEAVAQIAAFPPLVFAGECRTLQSRVAAAAAGEAFLVQGGDCAEAFSQFNANRIRDLFRLLLQMSVVLMYGGGVPVVKIGRLAGQFAKPRSADLETVDGQSLPSYRGDIINGPEFTPEARVPDPARLVRGYNQSAATLNLLRGFATGGYAALDRVMQWNLDFTRGSEEGRAYRDLASRIEESITFMRACGLDMHSAIMRETDFYVSHEALLLDYEAALTREDSTTGLWYGCSGHFLWCGERTRQLDGAHVEYLRGVGNPLGVKVSDKADPADLVALIAALNPENTPGRLAVIVRMGAAKLRERLPALLAAVGAAGQVVTWICDPMHGNTEAVQGYKTRRFENVRAELEAFFDVHEAAGTVPGGMHLEMTGDDVTECIGGGAAVTELDLSSRYHTHCDPRLNAEQALELAFYVASRLRRRRAARDAEQQRADGAPAAAARNGLLSPVDGAVPSHSPKSLGRHLFALVTWPLRNAATGQTCLSLLLARNVCVQVQEVGAGRQDTMGKGIYGGVIGLDWQAIDRIVDHRPALPEALDGDPELDARTRAPVLVRGNELLQRALAVLHGVQLQVHHHGAGVVAMRCHQPRHDVALVLGQALGRGRARAANLAQHSPQVWRLRAAGRG

SEQ ID NO: 12299 - protein, 129 aa, Chlorella protothecoides
MPAAASPFLGQVSQAPMPSHRAASPPGPQPPAGMGVLGGYDHLALQQFSGMMVGGPPPQLRPIKLGRGVADPAAYAHKLFIGQIPFEVGRGACALQAGSCAWGSLCGLRYATRHTHRDLEVVHDAPTLA

SEQ ID NO: 12300 - protein, 481 aa, Chlorella protothecoides
MVVPGGTLLIFTPSAVVSDHFLVRPKHSQQAVACGRGRRAVGALLLCVARGAPPPQPAGNVEGQLQRLLRVQTWVAVGVVARAEVQLGHRGTAADALGDVVARHLQVHAAGHRPCGLVHIEEGLQLRAHIFEAPRLVPLDRLGVAVHGVADPGDHLPRGTHRGEQRGQALAQLSRAHAHNHRQPPRRVFRVQRGDEGHEVCGVGLVTHLDAQRVAHAPQVLHVRAVQLAPVPEARGGVLARQRGLVVQQQRLVRDVEVGLAHDGGVHVQAAGAHEGDGLLDARRQVAVGAPLLAPAREVQIPLHHAVQRRVAARGKAAQQVQRRRRLVVPAHEAGRVGNARLGGELGPVDDVAAVAGQRLPVHRLQVGGAGLGKLPRQPPDLDHGHAAAVHEHHRHLEQEAEQVADAVGVELGEGLRAVPALHQEGLARRRRGHARLQRAALAGEDQGREGRDLGHSLVQLSLGQEEERVRGVKSEGGGMN

SEQ ID NO: 12301 - protein, 396 aa, Chlorella protothecoides
  MOD_RES (37)..(39): Any amino acid
  MOD_RES (103)..(106): Any amino acid
  MOD_RES (209)..(212): Any amino acid
MRAPGVRKGHRCGDARGRQTAAWAAVSALHAQGTARXXXHLVHVGVALGGGLEEGQLVFVGQRLCLRWHAMGPVAAALAHRHVDGRYHGLQGGGMPGGHTRGXXXXCFPFFFRSLVGASPRPPSPAAAVSSAPSELVRGQHPVPLLSFLVKLASPVNPTEFSPTCSPTLSAVDSQADPSAAQNRKRIPQGISESSQPASRSSGGTGWRXXXXSGKRIPQEISESSRPATRSSGGTGWRGARITTTSSSCSSSGTAGWGRAASCSDSPRTPSPPVSSPPSGEGVWTGAGHEGGGPLGPVAVEVQPCVHRPTLQPPHPPTPSIDFKIKKVLIDGKWVKLQIWDTAGQERFRTITSGALWAPPRLFLFSFWDRSSYLCVQANLRSPASPIACRPTHDWA

SEQ ID NO: 12302 - protein, 83 aa, Chlorella protothecoides
MRRLEFALAVGPSPGPDPLHSIAHDPPFQSRESMPQEAVATISGPLTPPEIALLAEAVAWVGDAKNRWELICKEYLPARQPKV

SEQ ID NO: 12303 - protein, 336 aa, Chlorella protothecoides
MLASAIPGQWALPVVQAACIRAAAAAGACMLRMRDVPFLHLGVHTPTPPLAAEEAASPHHPPTPGILSHLLHPPTPSQEESAATALTNPRTLLGASLGRFIVNRLSLRVRLDERRIAEILEVLRCRGGRGRWAMGGRCHCRASLCRPPRLPCWVERHTACPVLASPETPPLPTHTQTHTRTQITCAHHRAWTRPPWATSLCRRRAGSWVTWGTWSASASAPPPWQRGGRARAARRGPPPTCCRPRAPTSAGYGPRSSPWATRWGTCFRLPEQWGGQGGGGGLGASCKAAPSFLPPGACTSGGPARALAPPGGTLHSTTTLPSPPDHSLASDPLHPC

SEQ ID NO: 12304 - protein, 456 aa, Chlorella protothecoides
  MOD_RES (255)..(257): Any amino acid
  MOD_RES (366)..(395): Any amino acid
MSSCSGLLPPGGCPHLTLLLHPLLTRYELIEDPSTDEIISWNEDGTSFIVWKNAEFARDLLHLHFKHSNFSSFVRQLNTYGFRKVDPDRWEFANELFLRGQRHLLGGIVRRKPAADVGRPGGSAPGRDAGALSAVELGSYGGLAAEVETLQRDKRLLVTEVIRLRQAQAGTEATLHGLQHRLDVTEARQQQMVGFLAKAMHHPALVQQFMGGAPALQRIDDGRTQPWGLGGCEPWVRPGFPCCIRPELGILAPTXXXCDIFWGLWRVWCVCVLACVCPHQPSPGASAAASLGCALGSRAASDPSSQSWPQHPRTPPPHHPPGRKKRRGGRARAAGADSDSEGSVEDSVAGQGAASSTSTAGADSGXXXXXXXXXXXXXXXXXXXXXXXXXXXXXXGGGAPRHDQRMIVHGGVGAGDAPGEPGSLAELAQAFMQLLNTQSQPIGPPPPFAPPAPAGG

SEQ ID NO: 12305 - protein, 333 aa, Chlorella protothecoides
MAGLCLRHGVIGRVVFLGLLCVGAASAYRAAHPERLSMQPISLPMGRPTKGLGVGKEPERYSGYYDLNRTTDGHMFFFYFQAREDPENAPLVLWMTGGPGCSSELAVFFENGPYRLSPNQTVEETTYGWDVSANMIFVDQPLYTGFSYSTSDDDRCFDEKCVSNDMLDFFLALYEVRPELAGKDLFITGESYAGGRGSAVLAGHGRVSRGWSCWHGRVLRGWRCCAPLAYTTRLCPLGPVCYRECHAAAPPAILCQPHSGVVTITGHYVPAVASRLFRASKSGEVATPFPLKGLAIGNGLTNPAIQAGWWRVGNEGRPGRACYGQEGQSPLLQ

SEQ ID NO: 12306 - protein, 534 aa, Chlorella protothecoides
  MOD_RES (249)..(252): Any amino acid
  MOD_RES (462)..(465): Any amino acid
  MOD_RES (494)..(497): Any amino acid
MPCRTKINAQQPLLHPPTQYGAYADYLLANGKIGRTLYSYVSLVRASPPRGGWWVRCDLLVATGTCRCLPPAHLPPPSSPPNSPDQPPVPLVAGRVRPVQVAVGVPAGSQLLPGRHLCSPHGGCVGAEGVPACGWTVGALGVGIACTSWWTCSRDCLARLSGRRMIAVRASNPGMNVYDIRKPCVGPLCYAEFEVLDTYLNLPEVQEGLGVNRNMLQVPCQAWCRSVDNPWPRLVLARPPIRFPTLCRXXXXFVSMLQIPCQAWCGSVDNPWQRLVLARSPIRFPTLCRQTQAKPPCPSLPLNPPLTLLPERWKSCNMRVHAEMMEDWPHDFSHVLPELLAGGVRALIYAGDQDFICNWLGNRRWVDALPWAGAGDWRTARDARWTVDGEQAGVFRAAGPLTFLKVGGAGHMVPMDQPKHGLDMITRFIRDEPFGPQPEEDEDDVVLGQPISRARAVSRRQXXXXGNLVADSLLKQAISSRLHAEPRAEYLNTXXXXFGPQPEEDDDDFVLGQPIPRARAVSRRQGESGLHVVQ

SEQ ID NO: 12307 - protein, 516 aa, Chlorella protothecoides
  MOD_RES (370)..(373): Any amino acid
MYRGIHGLHGRCEVSLQGENPGVSDAKHGSGDFVADSLLEQAISSRLHTEPRAEYLNTLRFISFKAWRGTKPSPGCTAMSSPSHTQSSVASTVFAVGLGVGVAAVAGVAVGAMFGASALSIAAASKQQARPPLTAKDLRRDEEGRILNWRSALRIIQQGVRKPEGSPMCWSRGDMHISRLGGHSQPPGADHAILTPLASIQPPPHQGISPELRGTLWPFLLGVFSPDSTEQARARELVRLRGVYAQLLRVCERLEAEARAAAAAAAAPGHPDSPSKAARAAVAFGEAHRIIVMDGLRTDLRGGAGRGVDPGAGLSVLPISLDGGAPDILLVRREEDEGDAAARGAAGAGEAWDGASECDGGGTAAHAAAXXXXDAEARGAAGAGGAWDGASECDGGGTAAHAAAGPAGSGSPPSAPEPRRWDSRAARDALAAMPEGAAHAPRTLRLIRLLSAYSVHDPETGYCQGMSDLAAVVVMLVPDEALAFACFERVMRHARRNFRHDETGIKCVGGGVGGWG

SEQ ID NO: 12308 - protein, 254 aa, Chlorella protothecoides
MCGLASQKEACRRGSGKEVERGEGNGSVQDDGGGGWDIEQPRRRAAAKVRYSVMKMRNQLGSHEEDGVDAAVVLGVVSDLGVLAPHHLAARGHQAQLRHIHLDDGAARDHAQARVRLAVGVLLDADDGQLEGGLQLGVGHMRLVHAQTGGPDEALVLGRLAREPGWHKGHLERRCLGGGGGRCWVRGADSGGVTWGRGPGCELPSMAGRGKGRRTPLPQPPHTAIRGSARPVILQTSNSHTKIVYPRPPPASPW

SEQ ID NO: 12309 - protein, 146 aa, Chlorella protothecoides
MTKASLTSPTFPTQHAGGWRFSMDDSDPHVLALEVHIGKHLATTEIETEVLPRAVQLLISGRLLSLHLPDEVCPDACRAVRSRATGTLVLTLPREGNGRVAASKQAGISSGRGKSAGNNAAVVGAAQATPAMTAAVVACGDGFPPL

SEQ ID NO: 12310 - protein, 113 aa, Chlorella protothecoides
MRQNFHVPCIAAELSDRVGRVAQTNNVVLGTGDESEWRELDAQVNAYPADRTFKAIGSGGDDFVASMTSCVERVVGVRLPSSRVTHRLSAGGKYVSVTIGPVLVETPDQVREF

SEQ ID NO: 12311 - protein, 223 aa, Chlorella protothecoides
MVLITEALLRQRALPAGDVGFSEVREIALHGLGIERIDLLGHRCRELRVLMLQNNVIPRIENLHRLKVLEYVNLAINNITTIEGLHRCESLQRVDLTLNFIPASALPGLSNLRHLPDLRHLSLLGNPCTRTSPAQRRQRPLQNAHAHSLRHSRQDGVEVTEDERDGAACTAKDLEAALDLWVLQVEGQAGTVQEDAEDTQEHDRLPWSPEQRLQDFRYALQLG

SEQ ID NO: 12312 - protein, 278 aa, Chlorella protothecoides
MPLTRLSTSLRLNLSNPARHRHQLLQLAHILSDTDPPLYARLRALDSGDCMFAYRMVVVMLRRELPLPRVLLVWEAAWAHAAAAGRGDGVPVAAGGWGRGEAPCDGADQSRGLSDVEATDAALGASLLRDGGKVAGGGEARHAADGAISGSQAASVEAAALPAEAPGPPLTAGAGQAADKTTAGGQPPAIAKRTPSQTGSAAAYAGGTSIPPPDFVLQFIAAVVRGQRRQVMSCCHGTDDVLRLFSGVQIDFWLTLAQAQKQYKAYSQGGRVPRAGAQ

SEQ ID NO: 12313 - protein, 179 aa, Chlorella protothecoides
MDTHTDQHTHTPPSINPKRCHTTALTPPVVDALQGGGAPHELLDQGRVVHGLCQEAHHLLLPRLGDVQAVLQAVQRGLGPRLSLAQADDLGDQQALVALQGLHLRGQAARAGVAAGSAAAGTADVSGGLAPDDAAQQVALAAQEELVGKLPAVRVHLAEAVGVQLAHEAGEIAVLEVEV

SEQ ID NO: 12314 - protein, 619 aa, Chlorella protothecoides
MEPDDGASTPRCMLPPGLSRRAGGYRKPSLSQRQILALTSPSGPRSRDLAPDGGEAASLERGGDALGYEGCGDPQTALCWRGLGAWCGMEESPSPCKGMGGKPLPRPSQYPQRCTWPLAAGSGYGGHQGLLQALASTLQRGRAREGGTGGGAGRDQGQVGDRELPQGHFTLSRFRRVSEHPPLATCNPSNRMASTLSPVHGKVVLVLGASGIVGGGAALGLVQLGANVIAPFRSGESKEAFSKEFRHYPSSQQWDAPVVDYSTEQGLQDLAEYIRSERGGVVDHIFACMGGSVAKGPLTVLPAPELESALSHRVFSQVLAAKYLLPLVRPTPDSCYLVTTGRLGACDGAGGLAAGYGTKHANLLCIRADPPHPIHIGESCPAPEWAIYTLVNAAVYGVVTALRSEIKTHRLQEELERNRPFIVSHLIKPAMIASASRQAAADRGGHPSRFGAFSPPVAGSQVTPGQQPGAQHPEDTQRRGSRRHRALDCRGALKHFSLDAGGAASPLSTEVPSAGCIATLARTGVRCETLASHEVGAGGRRRSLAQKDSIPRCGALGYGNMEAQASHDGVRPHPMCKRVAHQDQGLPLPGEYHRDDVMTPPPADASSARPPRHEPFSPH

SEQ ID NO: 12315 - protein, 399 aa, Chlorella protothecoides
MFGRVVVMVGTRHSSTILTTQLCAQCRHPPNAFLTTEFFALNVLPDRTAGGLRLAKVPGWGATIYSHAAAADDHIKVGARMRGGRFAQRHIVTQSLGQCDCEAIGSPACCGGFRERGCWIGHLFAPLGSTVLGPFPGVSPATGFVLLNNHSIHMCNNMPSHPLHQVLLLEDSGDPVAADITDDRLAIRLPNAPDDGDNFVTGLGVDLTAGVQVEVSHPTDPEAGDLGPQPLLWVSDGGWHRAPVRGLGLARWGRLGACLSCKVATSDGMLRAYTFGSTEGRPSVVLSVAHPLERLALPATSGGTRELGQDSGLGLGAPPSAAAAAAVPLGDESDDDDLEEEEEEDSEAAAGSEKEGSGPGEDDQDSGASNSEREVRGPSGAAGCICSALVAATGLRWWD

SEQ ID NO: 12316 - protein, 127 aa, Chlorella protothecoides
MHPPSPHPRRSSGFGAPASPGFGAPASPATPGFGQPGFGAGAGKATAFGQPTGGFGAFSGAGSSPAASGFGGFGAAAAGSAPAASGVGGFGAAAASSFPAASGFGGFGAASPRPPAPSGASLWAPRK

SEQ ID NO: 12317 - protein, 191 aa, Chlorella protothecoides
MQEVDPNPGTNELSELAGPGSFLADISSSIPGIDEAMSFAEVIKQVNSLDYSCIVFDTAPTGHTLRLLQFPTTLEKGLGKLMSLKESFGGMLSQVTALLGAGGEGDIIEQASQKLVALKVGHRRWWRMGEVMGGVGARIGPGGRQACTSIKAAPPCQRHHLPLWGRQACGAHLASHALLPPERPPFPKGLA

SEQ ID NO: 12318 - protein, 179 aa, Chlorella protothecoides
  MOD_RES (79)..(82): Any amino acid
  MOD_RES (102)..(105): Any amino acid
MAECSWGPLESTSSQGPRRGHDSSGLAEVAGSNIHKFPPAIARIEADLTMLVPVCNGKKMEGGCSRGNQWALSDAGTVXXXXSSIAREVEKGGRRALHPGKXXXXLHTQGEEPLVRHNNQPGNIATAAFVLTELGINIMTVAHGGPGADAIMAIGIDGSPDKQLLGAISCIRTAQGPQP

SEQ ID NO: 12319 - protein, 395 aa, Chlorella protothecoides
MLRDACGAAKQKRRRGSPHALHDALCFPRSLQDNTKRQTDIGSAEDKRKTLLAIFHETKDVFVLKNWRGSHPHRETVGCGENWSETRGGPAKHQGCAAGEGAGIVSTNKIHAVRPQATRSSASLPQTLVDDDLVHMEKIGSSNYFCYQVVQDIQTTVWPFTRLHKDHACTARVLNHEPHCAPPRKCCRSFPSEAAVKLQVEITKLETQLEERSQEAKSLGAQLESKKVGNTDTEERSCLVRRLAELDEKLAASSAELRQYAASDPERYEALSEKMAWCLAETREGGAMAAMHCALLLPYAHQLPEQATPVAIDSANRWIDNLHALHDWLRKKFQGMDTQVTNLFKEVRACVQRGAVWVWPALHVHVFMGKVGRLNIGRESPGQGSSNPATTCCSR

SEQ ID NO: 12320 - protein, 207 aa, Chlorella protothecoides
MRTYARAASLVLAFAIAACLLQHAEAHGYLAVPASRNALHNTDYCPQCLNAGGPAAVSAGNTLQWPLSHHGMCGDSYTGERKHEYGGVSATGTITGTYTEGQVVNLTTVITASHKGRFTYRVCVIEDPASELAELTEECLDKHVLPSWEPSTPSNPTPGPCLPRCKPTWPELRTLAAPTGTIGEPVPTPCPTSCPRVSPATVSTRAA

SEQ ID NO: 12321 - protein, 182 aa, Chlorella protothecoides
MFKLWYMADADMLHPSNYYRLQNTGQGLQRVQAAPGVGRAMHAILARCQRRLGGWVGSSVVHLGDHNVPNALLFIDKYTQVPRILGPLVLVLEALPTLCRDRAVRAYVEAVHGSVAGCRGAVLLDFFRHAFDGSGADNFFDAGSCIDGRLTSAWNWCSKLEKKEYAHVFALAGFTSFDGDFK

SEQ ID NO: 12322 - protein, 146 aa, Chlorella protothecoides
  MOD_RES (41)..(44): Any amino acid
MRCMGSTRETFVGGDAWDGNGQCRPGSDIQVVRGLVSTRLXXXXIEIVGADEIACDAWAQNTGDMRRWTAMVSAVQGVIFNCDVPLKEYIRSLDDAASAAEKFIIAELDDQNLFVKVARAEFVEAKVKQFVNALHFTKPEVAPGQA

SEQ ID NO: 12323 - protein, 188 aa, Chlorella protothecoides
  MOD_RES (107)..(110): Any amino acid
MQVHDDIEAFLAFYESLPGPKRLIGYSKFAERHYAQDGLYGPGTWLVFGSETSGLPTMVRAYGDAAFCRKEGCCAAFRQHAVEAVNNDAGNSAMVKIPMQQQHVRSXXXXHALSSKSSCVSLLCSHYHCRTSQAVEAVNKDAGNSAMVKIPMQQQHVRSLNLATSVGIGVYEALRQLDGAVLPDVKNH

SEQ ID NO: 12324 - protein, 771 aa, Chlorella protothecoides
  MOD_RES (170)..(173): Any amino acid
MSSWTSAQRLPLISSSAPLCVCVYRGYPYYVYVEPCSPAKKLQSLSSWYPSPFIRLCKIKYYNNCLFYNVQRNFIAQTGDPTNTGKGGESVYGVLYGEQARFFEDEIRPALKHKKKGMVGMASECRCGGLWVARDTGPDESAGECFSLDAPCRMTGRVTMKYGLFDSHPXXXXICWGVSPLLRFPIPPQKKTHSPLGVGPDANASQFYITTGEELQSLDEKHTIFGEVAEGWEVLEAIDDAPCDDEGRPLQNIRVRHTIVLDDPTPDPPALAVHVPDASPPPQFAEDGRLEDDWEPGEDARPAEEVERAGREAEAHNRAVVLEMIGDLPEADAKPPSNMLFICKLHPVTSEEDLETIFSRFGNITSCDIIRDWKTGDSLSYAFIGFDTEKACEEAYFKMNNVLIDDRRIKASSSLAGGGAVRGVWNEEVVRMGRACILSEAVLQQCGAAPGPAALMACKDLCSQSVHHLWRQFKRFGKKGNAELADAAAGHDRGGRDAGGARGSHCWQASRRVLATVPGETQGPWSGPRRRCCHGALLPGGDSVTHPALPSHAGTSGRLELKEQFRGPTLSHGRGNREGYGLILDHYERLWPDQSGGLPQAQEHDRGSAGNRSSSLWQEAGAGAGRGGTGNPGAGAGRGGTATTGAGAGRRGTVVTTAGVGMGTPSIESALTGAGSPNGRGGGTAAGTGSVAGAAGPWAGAILERWRLRGGLTPIGMLIATNTDFPPLDGNKWSMAVGMRLAEAALKTWATPPIRGSSREQIGGQGVPSVF

SEQ ID NO: 12325 - protein, 170 aa, Chlorella protothecoides
  MOD_RES (136)..(139): Any amino acid
  MOD_RES (161)..(164): Any amino acid
MHARSATAPRGHADHASSRGEGPHQVPCSRSNTSNPTGRREQGFSSAITCTVEAGQTLYLPAGWWHEVTSQGAGDSKDAPGEHMALNHWFHPPDNLDAEAESLHESWTATTDTIPKVSSSHDNPLLIAAPTSGLRXXXXGGMRSPARGSGVQRTLPGSTWXXXXLCSLVM

SEQ ID NO: 12326 - protein, 403 aa, Chlorella protothecoides
  MOD_RES (21)..(24): Any amino acid
  MOD_RES (295)..(298): Any amino acid
MPSTSVAAAAKVGMDRVTQQXXXXQSVHFRGGCCRSGNGPCHPAALTAQVVTAFHANVGEPSESGQLGRGSHQHTSLSRRWGHNAHSPVQGQCATHVCRISARSPVRAGYDNRCVPYCTSLRNMRVQGHRRPAKRVWPRQGALGLWVGHGLGPGQAATSRHLQAYPVLSLRGDWTSEFTWNTKQIFVYANVEFETRQNKRNEMLMWSKLLTSKVGDEGRLDCGVEGALVMSVDPRWAVGSNGITSGMSVPSTTERDGGTRRTFLATQCHSSPLPIAPLQDEATVDLPRLAQEFPXXXXIASGMSVPATTERDGGTRLTFLATRCHSSPLPNSPLQDEATVDLPRLAQEFPYAVTDQGYTLRGTLFNISITWNVMPRVGRLYTRTQAFGPWELPQDYQTLQKEG

SEQ ID NO: 12327 - protein, 579 aa, Chlorella protothecoides
MDGQGSSLPTHTRNPIPRTPQIQAVGSSGTPSTHQDVLVGLQALQPLHQHVEVVVALRHAPRLGERKDDIHLVGQLGVVVAEDRQEGLAQQVIVLLQEGLVDLQGVGGGAILGHGQGGGEAVPPGAEEAHAAEAGGGSGVAGPGVCSNNRCDAGIRVERGRRHPQRPPFEGQTRSEGGLGLSRVGTLAASARVTKVRRRAFLSRIDARRARTGPWLGAVRESRHPPPPNNCDLTRSMFCRNRMSTRTLTCPVGTSAVDAAYDCTNTWLAVLSSAHIRVLRREDPSRSFHPHGVLQLDDSDKHVSSLAWAPPDQGPLLAAGTGAGCLMLWACDPTSPEPCWTRIARLQAGKASLRQLAFDPNPATHACTLAAACEDGFVRFFERNDRDPSHTAWEPCNSLRCSGAAGTPTCLSWHDIGDGAAHGTALPSLLLVGTSRGQAAVWWLRKETASWVKATDLPLAGDGEGTGPAHAGRPIAAAGLESVTSAAWGPALGRAHETVATASGSVVTLCTLRGTIDALEVRRSAVLPHDSPVWQVGWNPLGTWLACSTQRGQVCLWRPDFGGEWQLCNVVAGEAAMQE

SEQ ID NO: 12328 - protein, 1042 aa, Chlorella protothecoides
  MOD_RES (50)..(53): Any amino acid
  MOD_RES (716)..(719): Any amino acid
MRQGLRVWPVSLPAVEPCHALPLGHMPGIAGVMGSSGFQSPVASAFSQLXXXXFPLTLAPRHANHLPPPCPPQVASAFSQLLNLHNLTEEIVTARVEKAARLGEVEQSTRSTNKSLERLVNELGQNPEDIFKALCRQRVDIVFTAHPTQAIRQSLLKKYQKIRSEMDALHNTRMTPYERLECLDEIKSQIQAAWRTDEIRRKKPTPQDESRQGLSYFHDTIFHGLPVFLRRIDTALKNIGQPMLPLDTKLFNFGAWMGGDRDGNPFVTAATTRDVVLGARLSATMLLQSQISRLVYELSVWRASDELTAAAARILEARKDGLYAHTTRESYETEFGSVREPFRVVLSEIRERLNSTSTTLRYLMSHPHLNVKETLDNDPGAYSDAEAIITPLMLCYDSLVATGDSTIAFSELTDVIRQAQTFGLHLCQLDIRQESTKHAEAIDAITTYLGLGSFNAWDEAQRTAFLLKELEERRPLLPADLPMSEEVADVIGTFKMLATLPSDSLGAYIISMAHTASDVLAVLLLQKECGIRETLRVVPLFETLDDLEYAETAMEQLFGNAWYHAHIAGAQECMIGYSDSGKDAGRLAAAWGLYEVQERLAAVAAKYDVHLTLFHGRGGTVGRGGGPAHLAILSQPPKTISGTLRVTVQYAVVSRMEERGRLHAVIRGRELGYWRGRSADPAPLPKPLPPCSYFPTHSGPPPFPPTPPQGEVMEQXXXXRARTEVLAGAIRSPCPPSKPPFPRLILPHPLRAPPPFPPIPPQGEVMEQQFGEKEIAFRTMDLYTSAVLEATLAPMEEPQAVWREAMREMSRTSCEAYRAVVRHDPRFIEYFQTLTPVNELGRMNIGSRPAKRKAHGSIDTLRAIPWIFAWTQIRFHLPVWLGMGQALRAMIDAGKLELLQDMYQNWMFFRVTLDMLEMVFAKADPRVVTMYQRQLVDAGLHALGDELLRTFYEAEELVLKVMKHKGLLSSSSTAFLQQKLQLRAPYVAPLNILQVYCLKTIRDIEAGKEVDESGYKPDPAAVALMSRDPEKTPFVGAVEDTL

SEQ ID NO: 12329 - protein, 478 aa, Chlorella protothecoides
MEEPTWSDNDYPAIDYQAYSYYSAPRQKEKKGSLEEVDPELLATFDKLGIPLAEQKRLANVAVDAVFDSVSIATTFREELGKAGVIFCSISEAVREYPDLIRKHLGSVVRLGSRLGEVSWVGGNRVPTSDNYFAALNSAVFSDGSFVYIPRGVRCPMELSTYFRINAAETGQFERTLIVAEEGSHVSYLEGCTAPAYDTNQLHAAVVELSAAADAEIKYSTVQNWYAGDAAGRGGIYNFVTKRGVCAGARSKISWTQVETGSAITWKYPSVVLAGADSVGEFYSVALTNNRQQADTGTKMIHVGPRTRSRIVSKGISAGQSRNVYRGLVSIGPGADGARNHSQCDSMLIGDEAGANTYPYIQVRNPTARVEHEASTSKIGEDQLFYFQQRGVAVEEAVGMIISGFCREVFNELPLEFAAEGAWDTALPAWRRAGRSGSLRVSPSPPHHEVVAIAEVAAQAILRVYHAKASGGALVAGL

SEQ ID NO: 12330 - protein, 171 aa, Chlorella protothecoides
MQFAPSARATLPVASCRPRLVATRPIARVASLHTAKAAMVPQPLVRLGGLASALVGPGPSSHDVAPRRSISECGRPESVYFFRKFEWPGRMSPCPGSRALPSHPHAPCPQMARPLGLASLPAQQRAKPTSVRVEASSSAAAPAPAPKEGSFLGIPAFTWQKIVPLGIMFFW

SEQ ID NO: 12331 - protein, 185 aa, Chlorella protothecoides
MLNTTPLWPLLLQNYQYCWCVDPLDGTKEFLKRNGQFTVNIALLQGAKPVLGVVHVPVQGKVYWAVAGKGAWARESPASPPRQLHCATFRETDPGLVIVGSASHASQETAEFVGEFRAPQFRAVGSSLKLLMVAEGAAHMYPRLAPTCEWDTAAAHAIVEEAGGRVLQAGRCDSSGNALEGWRVC

SEQ ID NO: 12332 - protein, 506 aa, Chlorella protothecoides
MPLLASLATPPAPSLPPHPQATAVPTDTPAAKKLWGGRFTGATDPLMEKFNESLPFDKRMWAEDIRGSQAYAKALAKAGVLTDEEAATIVEGLARVAGEWEAGTFRIVAGDEDIHTANERRLSELIGALGGKLHTGRSRNDQCVTDTRLWLLGALGRVRASLHALIAAAADRAAAEADVLMPGYTHLQPAQTVRWSHWLLSHAAAWQRDDQRLAGLLPRVATLPLGSGALAGNPFGVDRQFLARELGFHGGVCPNSMDAVSDRDFVAETIFTASLHLVHLSRWAEDLIIYSSGPYRFVQCSDAYATGSQQASHSSPCRFPPGSSLMPQKKNPDALELIRGKGGRSIGGVTSMLAVLKGTPTTYNKDFQESWELMFDAVDTLHDCVRIATGVLSTLRIDPEAMRRGLSADMLATDLAEYLVRRGVPFRETHHISGAAVKMAEDRGCALSDLTPADLRTIHPLFDDDVAEVWDFARSADTRDTEGGASHRSVAEQISKLRAYLEQNAV

SEQ ID NO: 12333 - protein, 181 aa, Chlorella protothecoides
MWHAKGLGTCPDFFPLSTRVRPLRVLRFLFSLRRNQPNVHEQKLLDNPDHWHGAELSLIIAGNWQYYRSKVLKYLQLIAVITPYTQVADLGIAHPGIPLTPESDVHLDRRALPAGTASQPVLFTQFCNPSHAVQFNFKYVAEEEKQSLNIVFARRTDVMAPPPKVMGCRQTHLALHDKSVC

SEQ ID NO: 12334 - protein, 234 aa, Chlorella protothecoides
MAEGPVKVTPAELGLGPSEEVDARLEFDLGNLCAYDPSPVDAEAYARDASGACASTASRIMQALVGRLFALPSEPADVGRIAELPAPTTALPREKPIPRPRPPTKWELFAKKKGITKHKRSKLVLDETSDTFKRRHGYSKANDPAAVPIIDAKDGEDVGDDPFSKQKRDKKARVAKQEKAQLANLKAAAKSGGKGALPPTLRLAAALPEHGRGRPVRHKDYKQEVRALSMVPMN

SEQ ID NO: 12335 - protein, 322 aa, Chlorella protothecoides
MARCLLLAALAALLISGAQAGCKLRRDPNLKPEDRFYNHVPLNSQLPLEALPKNFDWNNKDGRSYLAPSWNQHIPQYCGSCWLHGTASMLQDRLKITKDGAGPDAMLARQVILNCAAFHGFGGGCDGGDVIDVLRYMAAYGLPDESCMPYAATDHTKYGKHAKACPAEGYCMNCMPIKGKDTCWAVKTPIRYYVESYGQITEKGEAPIMNEVLARGPVVCSIATPTVFDYGYHAGIFHDKDNSTDVDHDIEIVGWGEEDGQKYWIVRNSWGTYFGNLGFFKLERGVNSLMIENGDCWCAGGGLWCSGRGRAQGLGPLQRGVA

SEQ ID NO: 12336 - protein, 96 aa, Chlorella protothecoides
MYPIATLQDGGERTSQSKLVDHILRKNADDIVDVGRAIGKFESAAREDRHRMKMKGANKKGRISKGAGAPTGKTKAGGVAKKGGREGSAKGRGKKA

SEQ ID NO: 12337 - protein, 127 aa, Chlorella protothecoides
MAGSPGSGNLPEPLQKGETGDALDGKRRDLEARQAAAQGGRSDKVFYRVTIKDNGAGMAHAQIPDMLGRVLSGTKYGVAQTRGKFGLGAKMALIWSKMSTGLPITIRSARPRSATISYYKLDIDIQK

SEQ ID NO: 12338 - protein, 108 aa, Chlorella protothecoides
MHTQALQGASLLTSSLCPARPFRAGSRPARPSRPQCARVRATATDFVREPATEMSEEKRDLQRMLSKPYKYGFKTFIESDVFPKGLDEDVVRAISLKKEEPEWLLEFR

SEQ ID NO: 12339 - protein, 152 aa, Chlorella protothecoides
MLEVEFSDEGAARKYGQGMKQTMPFRRFLQSIADGEDSRYLTTQDVPTEIDGHPALYGSPLVALEGDFPRLPELAGSLVPASINLWMGLSAQGTSSGLHHDFHDNLYSLLRGRKTFRLWPPSALDSMYPHGRPVKRWPNGRVVYSEQVPRWV

SEQ ID NO: 12340 - protein, 159 aa, Chlorella protothecoides
MQAAVKSALQACCLQLRSKLVKQAAAREQAQRKRALTKYVPNVAAAVYAIVQGIAARPGKRPRLAPPEKDVIDKVASGDVTQKTLATRLMEHIERFDTDMALEYQMQQGITEGQRVDAFLRPQTDRHRYTALLTTGVASIQLLCPSAAAASSAEVIDVT

SEQ ID NO: 12341 - protein, 397 aa, Chlorella protothecoides
MIVNATLLKRIPGVEPCVPRPPILEPMHGVPSACWPFPPDRPFTPVHHTPTPHSILFNYTILRDTKDVLVVTAPGSGAEIIPFLKTWVNLPMAIGFTILYTKLANVLNNEQLFYTCIIPFIAFFSAFAFLLYPLRDVLHPTAWATQALAQYGPRFAGPLAIVRNWTFCLFYVMAELWGSVVVSVLFWGFANQITTVDEAKQFYPLFGLGANVALIFSGRAVKWFSQIRASLPPGVDGWGYSLKGMMGMVSAFGLVIVAVFYYLNRTVVPRVQDAIPKRAKKKKEPMSVGESFAFLAKSAYIRNLATLVVAYGISINLVEVTWKSKIKQQFPNPNEYSAFMGDFSTATGAVTFTMMLVSRWIFSRFGWGMAALITPTVLLITGGWRRVCGGGVEGGVL

SEQ ID NO: 12342 - protein, 262 aa, Chlorella protothecoides
MGMTRARVRSGSRGRYCWITWSLAGARTHPMTLGMLDPSGGGQSHKLSVLSEHGLTIGHGAHRVQMDVPRRLEDAREGLNIRSWLSVYQRDRSGGASHMHADSGSEAGLGNASRSGTWHADRLAPACSPQHLRSYARLSHLALDPGTLLRPLPLGGVNWLDLERVEDRYLLAASSDASVVLYDTQGQEEEAAGQVPPGQGPALPGLAPLLSLTKASPGGHRFSVSSAAWYPLDNGLFVTGASRVGRGRPRALACRPAPATLQ

SEQ ID NO: 12343 - protein, 370 aa, Chlorella protothecoides
  MOD_RES (170)..(173): Any amino acid
  MOD_RES (335)..(338): Any amino acid
RRARVLCQAAGRARVWARRPRRGAARRRRVTRAGRLCAGRALRRPPARPAALRQGRPAGRGAGPDASGAGGAGRRPRRRRRRSEPALQRAAGQVAGPGAGQGGGGPARPLRRRHGRAGLPQVFVWCEEEGGGERDVFDGGRALPADAAPGRPPACASLLAVPHVATGSPXXXXAPGRSPACASLLTVPHVATGSPLLPFLQAHDIVARLLASADPEVRGAACFALGALIQVDPGEEEAEGEGEAAGAQPPASERWKQERAIACSLMEMVYDASPVVRWVPGPVLWRDISVYSWRGHVFVFKVGMWRGGCRGARGIMGRQSTGPLSPEGSQPASDXXXXGRCRGSRGIMELKSTGPLPPEGSQPASDAEAV

SEQ ID NO: 12344 - protein, 619 aa, Chlorella protothecoides
  MOD_RES (129)..(131): Any amino acid
  MOD_RES (284)..(287): Any amino acid
MRAAYSWDPAPLCSLRPVRSKLVFQAFRACPRRSLRSAVSMKACNALVPCDGEFHAGSLWSMLLVGSATGPALSQAPSLSLGTRLVQAGIVPFPWRAPSWAVLSCQPSPNPPSSSRMQPHTSTTPSLRXXXASTHEHHPIPPTVADTKAAFLEGFKRPLPGIYSTVIQELLVQQHLFRWNVTYSYNAITALGVVSIFDQLLEGLPEQDPIFEAFIKALQEDPAQYRGDARRLEEAAGSLGGPENLKPDAAHAASWWVGPARVSSIKCLLNQNAEPSWGCPSACXXXXSSASSIRTLKPYGDARVHAGGGQRDPEDTGTDGRGHQVRQLPVHPLLRRGPLPPAGAGGGQGPQGPLRPDVRPGRAVGARERRPPDLQERAVQAAGRQGDHEGVGSGLEMVWRDWSGGRLVGWSPPNPLGASVAEPARHTTPNPQEFLEREKKKTAQRLAEKQAKQAAQSGESADGKAAELRMYEFKYGKTPRFEFAAILAHFLSVYRVRASLGALTSSPAKHRWVSLCSSARAVRTSSRRPCASRLDPITMGAARTQIPPRHRVRLAGATPTTLRSCPSASPLTPAGIGATASPRDWMKGVVEGTGEAVRFAGTASLRWRLGCGNVGVHGI

SEQ ID NO: 12345 - protein, 337 aa, Chlorella protothecoides
MGGSFGAWRAADVVCHEVAHQWFGNLVTGTNWTQLAFNEGLASFLEYHCLTAVGAPGEVLRYRAPLPQARLPGVHEGPTLRALCTDASPFRPAMVAASDAAIGTGGVEVYSKAATFLRMLEVALGGETLQIGLQASRAVPSHCHSATSQTPWSPSPIQQALLRERALGSADFGDILALLHERALGSANFGDILVAAAAAQGTIISTDPLAGGLPETGTAWATQPLLPLRNASAVAAVGQLPDRAGPFCSTAQLPAAGLGAEEAARQALCLPAAGAAWTLPAGTGGVADQSAWAGSVNATGLFRTLHSAAQLEALAAWATQVVSRGVWKGGNKGDVWR

SEQ ID NO: 12346 - protein, 101 aa, Chlorella protothecoides
MYKETEPLRDLSLSHEREGGAELLEVRRLRLMPCSAAAPLRGHSWQGCHTVIQATLPTPRRPPPQIRVPAHCLTSNNRHVRSRQLWGCDLYTDDSDELGGD

SEQ ID NO: 12347 - protein, 115 aa, Chlorella protothecoides
MGPPLSACRGCSFAVERAWVVLRSGQSVDLASNLDGLPLGAPTFTPSHHERILTRSSAGSGARLRTAQEVTVVFNLANEPWLKYSAAAVADRGLRPHEWTSARMRTATLYLESHT

SEQ ID NO: 12348 - protein, 580 aa, Chlorella protothecoides
MLDCLGREIMVNRDVAQDNDGTHREPDATTIVAGSTVVLTTDTSQAFSASLFPISYPGLPAMVEPGDNLFVGRYLVSGADASSLYMRVEAADETSITCTALSGAVLSGLLTVFHTERSSEGLANKQNDLPLLTAYDREAVASLAADFDVDFLSLSYCRDAEDVESARAFLSSVGSGHTKVLAKCETRQSLFAFKQLVRAADGIIISRGNLGLDVPPEKMAMIQKSMISTCVVLNKPVLITRVVDTMIDTPRPTRAEATDIANAVLDGADGFLLGAETYRGKYALETVRTVCAIAREAEAAFDHAAHFDHLVDEGGRLAAEGEAHASRVDMMRNLSGASLASEAAGWGAGGGGGGGGAPSVPRSQSVLSGGSGGAARLSKLEAIASSAVRAADKVRAAMIIVVTQTGRAAGLVAKYRPAMPIMTLVVPYLKREGLRWRLEGRSSARQALLTSGLMPVLAAPTPSAGESLLEEAVVLAVRQGMLAPEDHVVTVSRTGVGEYMIKIVSVNEFGSGIKHIRPKSLLTILRGQGQNVPDEEEGEEGEQRESGEGVAIGAAPAPGPQYRPELSRWAGWCGRGSGTG

SEQ ID NO: 12349 - protein, 262 aa, Chlorella protothecoides
  MOD_RES (250)..(253): Any amino acid
MSQMAELETQLFRGEEDVAAELLSTGDPQQLPVFQDREPTEEARAPAWHDPQDASLRVNVADVSRARKLRQRNGEKVLDGAAYSERLRAQHAKLNPRVGWARRGARAEAGPDSETAALLQRSGGLLVKGRALPAGQLEASRMRDANAADPAQGVLRALQYHPNGQLLLTASLDKRLRFFAVDGDACPLVQSLFLEDLPVHAAAFAAGGRKVLATGRRKYFYVADLESATMERIPRLFGTQDRSLEGFVAXXXXSLCAGRGNR

SEQ ID NO: 12350 - protein, 366 aa, Chlorella protothecoides
MPGSPLPRAACSTYPGLLIRCDTGALIAGHGCRRFRWTDYMFAHREQWKTDAADWPATPQFTASILFTTWRPSYRFFLKHVRNPSGFGKGHGVDKRFQTGVNESHIRFDREVDTDGIFVRARSVPLKSVELEILPEGRQLSALLGWSLQDRCGEVRIRDRAPRRCGGIAWCGCSQGRDARIARFKPKARCPHHVQAPFHLLRLDGKLNVHLVCHTHDDAGWLKTVDQYYWGRLAATCGYSVCAEPQTVEHSRTYSSFLLSGCRGAVHSGCRGGGPCCQQGPQIHLCRDVFLPALVGSAGGGHAGPGPPPGGLGPAVLCERRLRTARRGGQPLCGHDRPDHKGPQVSLLLWRAWACGAEALDLEHCK

SEQ ID NO: 12351 - protein, 246 aa, Chlorella protothecoides
  MOD_RES (155)..(158): Any amino acid
MAHHLNALKPYNFLLTSSDGFQVMNDWNRVMSTIFNGASNIAQAGGLAALSDKGWAEVQDLVAFYKENASILKWVVWMIDLGCGRPVWWGRTDDGVRDWVKISSPGCIHMEMDLGFTVYGGSDAPYIWIEFPGVEREACVPCNALLLSRPCLRVXXXXAVFTALCESDLVNPIDSVPLTPAPTPPALPGRKSWDVFGEILERCNIVTTPGSGFGAAGEGFVRVSAFGHREDIEEAVSRFKTAYKSA

SEQ ID NO: 12352 - protein, 206 aa, Chlorella protothecoides
MLHRRLLADDGRGVAEALNETACGDANREAPHACGGLVPHACGGLVARGVHRVLVQREGSGEGPAHAAAVRRTAQALVNDPPLVMVGPVQLFEPPPAAPPAPTLLALSLSGGATLPPDVQLLTLAELAGRGIVRVAHLHEAGEGGDAATPATFDLAPLLRSIKFSEARVWFETDGGHVCALPSAAGEESPVRTFELRLDSRSAAAA

SEQ ID NO: 12353 - protein, 264 aa, Chlorella protothecoides
MCSREFGHRVKGISVSRFTPEEAAALEEGGNGVRRREFRVQRRTMEWWGAPAARALRCPPLSDAQAFAAEYLATWQASTLPKPTNRVPAKIKEWIQVVFQEQRFRGPPKKASSPQQRAPSLGQEAKPALFKTPSAGRSPAPLSTSNGNVNGMLASARYKPRAPGARGLIGMGNGALLQLVLQQCPPSLPSLQGHAAAASPDSADRSNGDASHVIERRLSDVLGLSMPKLSVSEVHSPAASPAPATARSDGAGSSRWWPGGSCTR

SEQ ID NO: 12354 - protein, 358 aa, Chlorella protothecoides
MLTVWYLTVAARLGATQTTGSTIHGHHTPTRPPPGEVTTRVERNKNFAKLQAGYLFPEVARRRREHQAANPDAKLLSLGIGDTTEPIPPTIVNAMRDAAIGLGTREGYSGYGSEQGQSKLREAITERLYAHVGRKPNEIFVSDGSKCDIGRLQLMFGADVSIATQCSTPSALRRLTPGDPPISQDPAYPVYVDSSVIMGMTGGHNGEDFDGITYMVCRPETQFFPDLSKVMPVQPTLHSFEHGARPHPTAPPSSTLSQAERTDIIFFCSPNNPTGAAATRSQLTELVAFAKKNGSIIVFDAAYALFISDPDCPRTIYEIPGAEEVALETCSFSKYAGFTGVRLGWTVVPEQLRYAGEH

SEQ ID NO: 12355 - protein, 200 aa, Chlorella protothecoides
MDKLIHYVNADGRVNVLYSTPEAYVDAKHGYNHTWSVKRDDFFPYSDSSHAYWTGVAVHLFLGKVAPALWLACLQASPLLSLTPPGYFSSRPTSKRYIRQATSFLQAARQLELTVGGKSSGGPTTDGLEAAVSLTQHHDSITGTEKQHVANDYHERLSAGLAVGGVGVVKWLREPVASCEHLDCQPVHPCMGSACILGVS

SEQ ID NO: 12356 - protein, 189 aa, Chlorella protothecoides
MLRFCNYANATICEPSVRLSREGRSIRVVVYNPVAWTVRAPLRVAVSTHTSCEWIVQGPNNETLPSHTVSVDATTRRLQHLLHETNASSEAAGDAEVAWVADLQPLGLATFTMLPASVGRAERDVVSGAGPRRRRDEVLDNGILRLGIGIDGAEPIQLTTSLAWYNSSDGLDVPEGKDRGQAGGAYIFR

SEQ ID NO: 12357 - protein, 437 aa, Chlorella protothecoides
  MOD_RES (8)..(11): Any amino acid
MITCYTLXXXXILLMRLDSVESPKTITYHTLTFACKGISCRDQATDKHLYMPHAIQAKAKQEGISTVVIDHILMETIDIQLAVVLWDALGSYVLLELEHPRFPPIPSTVRRGASVPNGPRHPTNPFISCGPVPTTLVPTLVSGPIKVSLHSEMAGSAQPSAVGDAALPQLGEAQQGEVSVPVRLPALADLPRQYSACVLAAGATGERGAEYKAVGSGVTRARGHDLWCTRVVRPSHAPASLAFPGETMTGSRPPEPHDPQTQRKLLIALVIAFLFMIVEVVGGIYAHSLAIITDAAHLLSDVSGFGVSALAAVWAARMSHSHFSYGCEDVGLSWCRHKGRRGRCADGTTVLHPGWWAVAGLAHALATPREAHAAGPCPRSLGPNLLAPAGTTAWRCWAPWPPSSPSGWSPASCWWRPSSASSSQSPSTAKVIDSGMR

SEQ ID NO: 12358 - protein, 261 aa, Chlorella protothecoides
  MOD_RES (163)..(166): Any amino acid
  MOD_RES (249)..(251): Any amino acid
NAGAPLPGAATLDPGLGLTQEALDAAVAAVGAALGAGTNAISALRILKLYMERLGVDLGAGGEDAAAAVGGRALADAHAALESGHLLEVTPSLGAAALLIHARREAGEILWGGRWRGGVWKKRRVGGGRLQWCAAGTLCTPVLSVQLAKGSRKVHAICPQSSXXXXREAGEILWGGGWRSGVWEKRRVGGGRLQWCSAGTLCTPVLYPGGPDGAHAGGPRAAERAGRAARAPLSREHGGGNPHLLNRLXXXGPAEQGARRR

SEQ ID NO: 12359 - protein, 131 aa, Chlorella protothecoides
MMGAVVHVIGDLVQSIGVAVAGLLIWIHQVRPGQSPSSPHDPRRIDLVPHPSFPPHSTPQDDPRWALADPICTFLFAALVLWTTKRVLRDIADVLMERVPRGLNIADIEDDITAVSARGCGVFDQGAVRRE

SEQ ID NO: 12360 - protein, 91 aa, Chlorella protothecoides
MVVLAMHSMPDKHLASLPRTHAQKVSSGLSDRVVFVKIDTDKYPALASQYRIEALPTLVLFKDGRPIDRIEGVLNVGQLQARLQLALGPTK

SEQ ID NO: 12361 - protein, 138 aa, Chlorella protothecoides
MYSRVGGRDGGHPGRGGRGGGGRRGGGRGGRLPPGSRPVTEGDRISIAEQLKEFQHSEETGKAVIRDRLFVCFNVDVGMLPKANRSFPHATSPTAEYKFPPGLSNHDRAVVHAECKKYGFTSKSYGCGGAGSEGLAAA

SEQ ID NO: 12362 - protein, 300 aa, Chlorella protothecoides
MVKEGYTPPLSQTSPPHTEGPSDSWRRQYVFVAATMPVDGKYEVGTKLRRAFPQAVWLAGKRLHQQTRDLQHDWRRAEGEQERARVLQVGPCCDLAAGFRRVGPVHHCLLLCEDDVRVLVSQDGTCIHIPCSGGPSPQALHLEGNHTLPHPTPASTRALAQEVIAGDKTMGPGTTTLVFARDVSSADATLSALRRTCAARGAALLRYHKEVPQAEREDLLRTLAAPGSSAREPIVLVCTDAAARGLDLPSVNHVVQADFAASAVHFLHRVGFGRVGGRSWARTCVGSGHSGSHPGQFLAA

SEQ ID NO: 12363 - protein, 92 aa, Chlorella protothecoides
MSDCCSPIPSLRSQPPFSSQIEGVAGVGDLHVWSLTPGIPLLCAHVATQPGAEGEEVLSRVTAYVRRLGIQHSTLQIVGPEEADKPHVHHQH

SEQ ID NO: 12364 - protein, 173 aa, Chlorella protothecoides
MLSLDIKLRDGSTVTVGENDVRHACDRRFGPGEGLPIDARQAATLCLPHPTLAQLVQGQLQYGIHPSGLPSLRDWATRHVADLHGAPRPTTTIIVGGASQGLSALFSMLFDPGDSMVVEELSYPQVSECLAAPDRINLVPIATNDGGMCPLALTKVRSAMQRGLWFRPLPGPV

SEQ ID NO: 12365 - protein, 348 aa, Chlorella protothecoides
MISDGSIPQAEGVDLTGVKGFATIDGVSLVNVEGTGMVGVPGTASAIFATMRDAGVNVIMISQASSEHSICFAVKAADSARAVAALRARFQEAIAAGRISCVAALDDCCVLAAVGSAMASRRGVAATMFAALAQANINVRAIAQGCSEYNITALIDARESVRALRAVHGRFYMQALTIGLGLIGPGLIGSTFLQQIQDQARRFFGGAAKLRDEYHLDIRVLAIASSKRMLLSDDAIDLAAWRGELEARGEPLDEERFAAHLSDNFIPNVVALDCTAAEGPSERYLEWMRRGIHIITPNKKMNSGSLERYRALKRHQRSSFIHYLYEGTVGAGGWVWGGDGRWRGESWG

SEQ ID NO: 12366 - protein, 237 aa, Chlorella protothecoides
MGSQAGLRSRLLRRSTPHRRHPLLPQAEATQVGSTYANALIEAAQAENSLEDVHSDVDALAGLLRENKGPWILLALLSHAEIPSRPRHVPHLCLMQDIAEFLSNPTIRVEAKKELLKRVGGEVGFKDYTLNFLNLILDRNRMDSLDDIVEAFETEYCKLTDTQLATVRSAVKLEQEQQFLIAKKLQELTGSKNIKLKPVVDESLIGGFIVEYGSSQMDHSGGGRKGRSGMHLPAGPL

SEQ ID NO: 12367 - protein, 579 aa, Chlorella protothecoides
  MOD_RES (42)..(45): Any amino acid
  MOD_RES (353)..(355): Any amino acid
  MOD_RES (455)..(458): Any amino acid
  MOD_RES (531)..(534): Any amino acid
MCVSEVFGNGCYCRHTVVLTATITFRNCLFCFQIPLTSTSPXXXXCPRSLVVAATVATLWYSPPLSRSAAASSDSRYPLQAHPPCLPRHHQAFAGIVTVSVGHCHPEVNKAVIEQTERLQHTTVIYLNNQIAEYAKELTDRMPGNLKARRGGKGGSDLGRFLVYKRWSGQGALWLPCTFRVPGLASALPSPAPGCVTAPTTLTPTSLSFSNHPAAQVAYFVNSGSEANDMAIMMARLYTGQYDMIALRNGYHGLTGATMGLMGLHTWKANIPHVRPGGRVGGRPQSGFALASREVPRACRDEGSMPCKFWEACGCVDPSRRCGWASPHPASAWFSADRQSGMPDTMSPPPAGXXXPRWCGWASPHPASARLSADRRSGRPDTMSPPPAGIRRAPCTEPRPLPAGRGGDEELNLYAACKYVTGVQHTPRPTLGPFFPPRTDVTDIIQSSTPGRVAXXXXPSLGPFFSPRTDVTDIIQSSTPGRVAGFISETIQGVGGAVPLADGYLPEGTEAAAAMWCLIGAMKSVLSQHPXXXXPPRGLQGNGGCRCDVASHWGYEIGAEPASSAVAAPRGCPPRPVSI

SEQ ID NO: 12368 - protein, 178 aa, Chlorella protothecoides
MSIFPSYHPQTVREAGGICIADEVQTGFGRTGSNYWGRMSPAFIWTAAWLCRQLPLPAPMEISSLSSAAQVLAKQPLTRCPAPSIHPAGFPERWGDPRHRDYGQGHRQRAAAGRGSHDSGDRRHPGPAPALQHLRRQPRLLRWRPRGAACDRPGGHPGQGRRRGRPPAEGPAWPGRQA

SEQ ID NO: 12369 - protein, 77 aa, Chlorella protothecoides
MATKFPKFSQALAQDPTTRRLWYGLATAHDFESHDAWQGNFEQWVQDPLHIRPIAHAIWDPHFGQPAVEAFTRGGAS

SEQ ID NO: 12370 - protein, 540 aa, Chlorella protothecoides
  MOD_RES (325)..(328): Any amino acid
  MOD_RES (523)..(525): Any amino acid
MNNNPNPKMKNPTNTPPRYVVGDSRFQRYCKSNPRKMVKMWAEKELRNLARLHAAGVRAPQPLQLRMHVLAMQFLGSGGVAAPRLRDAGLPPARMRQAYGEMVLLIRTMYQKCRLVHADLSEYNVLVHQNELWIIDVSQSVEPDHPRAFDFLREGVGVLWACLGDGEDRGGWEKEGRGCSAASPSVQATPSPAVASDSAQLFPPFPPTPPSPLADCLHVNDYFRRQGVATLTVKELFDFAVDPAVTDDNLDDTMDALMQLAAGMGGPGATRRQQHVLSLLPWVHPVLLLVSHHNEYQRVLVAGKKRGRSVLHPHSPVCFLPPPYXXXXFTCIHPPGRHSIPCKTHPSHPLPHPKLPHPRSRPIDTSSAPDSSVADAVWAQAFIPKKLDEVANHERDHARLQAGEPVEGIYYQALAGMKADMSGARTLPLALEIAEEKVVERHGAASGSEAGSSSSSSSGSGDSSGSDAESGDEAGAGAGWTDGKPAQSKEEIRAARREHKKAVKESNQERRKKKLPKKEKARXXXGARVDRPAAGWGSFG

SEQ ID NO: 12371 - protein, 71 aa, Chlorella protothecoides
MVLFKMLNRGVFAEINGVVSTGKEANVYHATNPAGEELAIKVYKTSILVFKDRDRWGEGLWKDRKGDGQVG

SEQ ID NO: 12372 - protein, 180 aa, Chlorella protothecoides
MVSESLLRALGAAPAINMFGMLRLLSDVGGLRAVVERAGADPEPLAPVCLFAEALVFGRLGPQGVPGIQAPRLLQLLERYREVPRSSGLAGQHSTPSAGKGSPEGRWREGLCVHAGQLPGRRQEPWSDCQMLRPPPEFPCMCSPRHCLDPAAHIPLQRFLSKKSVEDVMKALRSPTKRAK

SEQ ID NO: 12373 - protein, 161 aa, Chlorella protothecoides
  MOD_RES (85)..(94): Any amino acid
RWGAPVLAAAADPAAHAPLLGALGAALRYLREALVEDQVLALAEVEALDVVVGSGSGETGPGVDSAPNGDACTQGPGPAHTSHLXXXXXXXXXXQGPRPAHTSHLAMDAAALENLEVLEGGEGGAGTHAGAGLAGSLLAAVDHCVTPGGRGALRAWLARPL

SEQ ID NO: 12374 - protein, 432 aa, Chlorella protothecoides
MARAVEAPQPPGAQTEALGSAAGGTSPDANGPGARAGAGPASLSPEVSALGSPPPSPNPKTERRRSGGEQAPSASDATPDKGVPPPEQHARRGPVPPAPRFLHVLDRSGRILSSDELDVGPGATLAVFYTESAHRASEAVEKGTGLAPTLVLEALPKGGDSRVAGAGAADAGTASSEPSSDASALPGAPDENASHDSPSDRGSSHPAASANASPAATTVDTASPVHALPTPHPAPPATPPPALSQPYKWWRDGDEPLYFLTSGSGTVVGRPRDGNDRVAWMMERGRIAEALAVAESDATVTRPVREAVGEQYLQYLVDRDEWAATAAAAPRLLQGGTWKIYTPGSSGVANLSLDSRSGPGVGAVGARLRGCAGAAAPGAPPPRLGAAAAHPYLRHGTAGPAGVSQRCVKEAGWSSEYSDDCKDPKWWGECDE

SEQ ID NO: 12375 - protein, 174 aa, Chlorella protothecoides
MHQITPAARLCLLYPVRIPSSRVFRCATVHRKHAFVRRLRAGYARAEASPGPNQTPASEDLNLLHTELHAAVASQDFSRASQLRDRIAATTGTPPPGSWEELGLPPWLADRARQLGFTLPTTTQARAIPALLSGTDACVTAQTGSGKTLAFVLPALAALDASPALYPEDLEASL

SEQ ID NO: 12376 - protein, 290 aa, Chlorella protothecoides
MGVGVAAGASTGGGGGIASHFPPRMQPTCELCCTPLPTPPPCRPSYPNPTTLTHRSAAPPGDIMASVQAARAARVQVSVVGLSAEVYVCREMTRVTGGRYGVALGESHLSDLVLEHAVPPPMAPGSSNYSLVRMGFPRREPQAPGAAVFTGGASIDGRWQAGEGKGAHRCDGMKHECSVAFCILGVIEARGRCKPVVRKSCHHGAHRRACTVSRDRDGMSARTVIQLPSRRSGGCAPVRWVHMSTMRGACGGAALPMPRVWTDTGVRTASLAVLPSPLPSSRFCGDWGRR

SEQ ID NO: 12377 - protein, 100 aa, Chlorella protothecoides
MAQAVDSSDEPRLKYSALSPDASIPGTALLLAVSDKVLALGTSTGAVLVLDYNGNQAFKEHHAAVTDLSFDAEAEYLASCSADGWVVVCLVHGWCACMPT

SEQ ID NO: 12378 - protein, 105 aa, Chlorella protothecoides
MPNLNSLRLHGLPPQGWLGSSETPLFRGRGAVQVARMAGTLLAWVTATGLRVYDTATHTRLAKIPAPKTPAGEAAAPASLLWLGIRELYVGWGRTVLVRWGGKGG

SEQ ID NO: 12379 - protein, 313 aa, Chlorella protothecoides
  MOD_RES (208)..(210): Any amino acid
MRPLHVVQPEGPSFTVKGSAVEWQNWSFQVGFSWREGLVLHGLGYKDGGRVRPVVYRAALAEIIVPYAEPRPPYETKCAYDIMDYGLGFCANSLELGCDCLGHIHYFDASLNDALGRAVTLRKAVCMHEEDAGMAWKHYDYRTDEVEVRRMRRLVLSFIATIANYEYGFYWHLYQDGSIQFEVKLTGIVSTSPLHAEEVLRGPDYGTXXXDGHRVHLPPARRGGSARSRLRQPGGPRGQRRAPSALLHHPPRHGRGRRGRRAGAERGGDGGGAHGAGGRAQPLQARLQGRGARPGDGAGRAARLRRRPLPRLE

SEQ ID NO: 12380 - protein, 795 aa, Chlorella protothecoides
  MOD_RES (312)..(315): Any amino acid
MSPKAGSGDARHAHSPSDCAAASRGTRHLPCPTTVWWVAPVAHRSYGASHARAWHAHVGEGADLGGPRGALHAFGGAGVCERGNNDRSACGQVCELLDNSPLTPQQQHPSAPSESARDAGHGEGRRELLDLGRQRGQVSTLAALRLQVCHEVAQLALARRGGGQVARDADGGVEHVAHALKIGLAQAARGQCGRPDAHAAGDDRGAVAGHAVLVQRDVDGIQHVLRARAVDARRLQVHQEQVVVGHEVCVGREGYLQSGCRAFHHHLQPRFRQAGLNWKTTCSPGCQGPRVGDHLLLVGAELGAGGLLQGHXXXXDGVVVRPALDAWEHGLVDGRLQGLAEEDEAAAWAPQALVAGGGHHVGVVEGRGDHPRGHQARDVGHVGHEVGPRRVGDAAHAGVVKVAGVGRGAGDDQARAEEGGAARQGLVVHQPRGLVQAVGHGLEVDAGGADAALGRPEAVRQVAAVGQVEAHDAVVGLEQGGVHRKVGRGAGVGLHVHTPLCGVQAEGRQRARLAQRLGLVDELVAAVVARAGQTLAVLVGHAGAHRRHDGAGGEVLAGDQLQARHLAPLLLADDGGDLRVHLVQGSVLEKHGAGVHCRAREGGCADAGASCYCMEPCSLGPGPRTCMHARRRKMPGSLPAHCTRQQQPGPGLCARAEHYWERRKFETAPLLPPSLTLIAGRTLALQGGGAACRPAGSLSDQACLVRPGRQALDATLGRRTLWASRAGAGLGEGDALHCCRELGSGGGRCGQDWDRGSRGWTVSWTPNADLPPSNPVPRSRAPVGLVGQKRSGAWT

SEQ ID NO: 12381 - protein, 314 aa, Chlorella protothecoides
AGAGGVAVALRGQLRLQDALHGLEAVLEGVGPVPRPHGHRLHLHHAQPPPAVLVVHGHVEAGDEEVLMVRGVDPGGHQVAVVGTAQNLLGDLLGMQGGGGHDARQLHLELDAAVLVQVPVEAVLVVGDGGDEGEDQAAHAPHLHLVGAVVVVLPGHARVLLVHAHRLAQRDRAPQRVVQRRVKVVDVAQAVAAQLQGVGAEAQAVVHDVVRALGLVRRPRLRVRHDDLRQRGAVHDGAHATAVLVPQSVQDQALAPGEAHLEAPVLPLHGRPLDREGGALGLDHVQRAHAAAEGTGQHVAGEEGSKAGRGGEVG

SEQ ID NO: 12382 - protein, 331 aa, Chlorella protothecoides
MYGAHMCDTDVVHLTLDLATTRRPALTLPPPPVQHKPLRSAAVLEAVYEPDLDLCGPAAAALTEGGDPARQPRILLQKWRGGPAARFLYHELRELRGLVGQGAVLVGVVQPSGSWKAGKRDEWSLTEQGHQVLAGGEESVAELRMRGGLVQATYSARGSLKSNAMAAAAAKALKTLEGLLRPSATAFNPSPHTGRRGKVGGSAAGGSKGEPGPRLPALPRGPQGRVRLRPVCVMAGAWTPGSGENVWQPFLLRSSEQGPASRLRWGLAAGAHWKQHVRPTSPPKLHQTQGIHCPRSEADIAAARERLAFQELFMLQLNLLLQRSLLRWRRL

SEQ ID NO: 12383 - protein, 467 aa, Chlorella protothecoides
MVRRLALPQGLPSGPSGSPTPSITLTLATLRLGPALTLPQPSDSSRKHLAASLQCYLQSWPPNPSIPRPHPFLPLLQSDPQAAFQRWARFYGKTYSPAEESQRLEAFMANAARVAAHQAQNAGASYTLGLNGHADLTTEEFRLRYFGEQPRDMLALRAAATAADNGKKSKYFRDWPYGHTVPPAAVDWTAEGMITPVKDQHVNGSKCGCCFAFSGVAGIEAANALYTGGDLVTLSEQQIVDCDAYDWGCDGGSFVDVMRYTIDNGGLVPDAEWPYAAKETVCHRRRERKRAAVTIDYIVNLPEANETALEQALAHTPTNVAMCCGDFIDAWHLYTGGIFNESAHCTEPIDHALLAVGYGTEPNGDKFFKIKNSWGAHWGEAGYMKVRRGIADPKGSNGVALMPGYAVKTRDNPRPDAALVVSRARGSGEFLVMLGVGGQGMIFSAGSKTGVARSTRASPPGCKLRED

SEQ ID NO: 12384 - protein, 310 aa, Chlorella protothecoides
MRAASALSCYLGLSPPPLPTRYPEQSKVQQHRAQQAQQDCIFFLQGWCSKGSLCPFRHDQACRGVGGGVSAGPYPTMHSVVMAPKSRAGHASHSSAKADALKALNSSTAPSLQQVARAPPAAPSPAAPGPTLASAPAPTRQQVRLAPVPPAPQRTSLAAGLMGGRTSPVPAAASGDARRGGATSASGASASGAATASGLAAPAPGPPRAPPTLAGRLGPRQGARDQGASPLPPRLQQRLGRERSGSGPDAPTGAASSLSDRLGSKVRGLWGGVGRGRWSAGAMGWRSTLWPGHAEHGRSPIYCRGAAMAW

SEQ ID NO: 12385 - protein, 285 aa, Chlorella protothecoides
MFFEDGSLDEVDPEIASIIRQEKRRQVTGLELIASENFTSRAVMAAVGSCMTNKYSEGLPGARYYGGNEFIDQAESLCQSRALAAFGLDPAEWGVNVQPHSGSPANFAVYTALLKPHDRIMGLDLPHGGHLTHGFWTAKRRVSATSVYFESMPYRLDEATGLVDYEALARSAALFRPRLIIAGASAYSRDFDYARMRGIADASGAYLMADMAHISGLVAAGVVASPFHHADVVTTTSHKSLRGPRGGLIFFRKALEAAINQAAASPEFRAYQQQVVANARALAAR

SEQ ID NO: 12386 - protein, 196 aa, Chlorella protothecoides
MSIPQAPTFDTNAVKTRFPGRELTPGRNHHPLDQLTAEEIGAAAAACRERAASLGLPVLRFNSISAKVGMVWVSYPMSHALATATGGRGFRTARPARPYSAPHDHPMTPQEPHKYKVLAYLKGGAKPARQALCVVQAPPRNSVFEALVDLDGTRASILSWQEVRGPVDALYEIHSSFSPLGWAVSGGRKPQMSVAT

SEQ ID NO: 12387 - protein, 93 aa, Chlorella protothecoides
MQGVAFAQPGASAARPQGAPAQRGIQRLASRPHQARLVAQAPSRTACRASTLERKGAPGYEREGWGKQRAQAAWFHAIARCPSIGTPFWNMPV

SEQ ID NO: 12388 - protein, 173 aa, Chlorella protothecoides
MGPHWSLGLAPCMASPSASSPTTVRRHLKEAARSVGEGMSWGKSSTACTNANGILVAAVFPFSSGKGSSHQSQAFTRHARCMGSPRQNTIPSPRPGILFSESALKGAHFVQLCSQRGIPLIFLQVLFGCRPVALHHPHAQAPRPYRPVASPSPPNLSHPLPQNINGFMVGKKY

SEQ ID NO: 12389 - protein, 91 aa, Chlorella protothecoides
MGGEQAAAVLHLLESEKREREGRSWPAEEQEAFKKAIKDRYDAEGEPSFSSARLWDDGVIDPADTRMVFGLSLAAAQNRGPRSSQFGVFRM

SEQ ID NO: 12390 - protein, 72 aa, Chlorella protothecoides
MAENEQHALSLARNIVRNLGPGTRAAVPLPWAEGSWEEPRFPAAELRGGARCGGERGGFAGGVRPAWRGCEA

SEQ ID NO: 12391 - protein, 535 aa, Chlorella protothecoides
ACAPGDLVRGCAGRPPVTQGGASRTPLPRHLQSPAAALGRNTPPPSGPHLGVDPGGGPPGRGLPAVHHPLQDQRLGVGGGEHAHELLHRPVEPAHEEDAQRQAVRHQDQGGVRAEAAGVYVTHQMVLEDSHAVVHVRPRLAVGEAVEEAAEAQALRLLALLPLRVLEVAKVLLPQLHLLLRAHDLPRIEGRRHALKRLLAAQVGRGVEEEARRVRVAGAHLPHALAGGQRLLPAAPGPGMGQRAGKKGLAALHCRGASGALARLGPGHVLPPLGCPYENLVQSTPGTPHQGDPAVGQVGVGNVVHVALALRMPDEDDADGQGAKVAGGRAPTAPGDEGDGGEVGAGGGAVHSAAPCTAEHWCPPCQCWQANSNQRPVMVAPQAFPTTYSTPHNCKASDGQTCSLDQDHTIPQPIRLTRRCCESGSQTCPPPVDPACPTLFAGWYWGWGMRGPLAGGPTGAVGAPPPLAASCSVLPLWPRELAPPRHADAHSDSRRRGDGWDPPWCDGRRPGRPDGRGVPGRAGAQPGPTTCGPGS

SEQ ID NO: 12392 - protein, 496 aa, Chlorella protothecoides
MLSGQAERLLVPAPLSRRGDRAFSRRTMAGPTHPHASGSRNGHLHGVAEPTPLATAAELNSLRREVEELRQLLWAHQQGAHACPTPNTTRQIESGMPDRREEGMFDSRFHSTSSAWCGAVHCSTPCSHLTTISLVPWCRRGATPRDFRTLPIRIVLIRHAESEGNVDNIAYTYLPDSRVPLGLIAPSFRTGTPGAAAHGQARAWPAPRSPLGSAGPPGLSSRLAGPCPARALTAGERVREVSSGDAHPPRLFFYTSPYLRSKQTFEGVAAAFDPGQIMGAQEEVQLREQDFGNFQDAEGKQREKAERLRFGRFFYRFPNGESGADVYDRMTIFEDHLVRDINAGRFGPDATLVLVTHGLALRIFLMRWFHWTVEEFMGVFTPPNAEPLVLERVVHGGEATPGGPAAWIHTKVGPGGGGGVPSQGGSGTLQVARERRPARPSLCDRRPPGAASDQVSGGARTASAVRSRAGIARSCAGIAHLLAGASMRGGRGAQQT

SEQ ID NO: 12393 - protein, 152 aa, Chlorella protothecoides
  MOD_RES (53)..(80): Any amino acid
AAERGASPDRVAAREDAASAAVARTRFRGAISPVFAPYLGAYVAAVERDLAWXXXXXXXXXXXXXXXXXXXXXXXXXXXXACWRGRAGRRWPRARPSSAPPTSWWRLFAASCATAARASAAAPSSATWPAPLPAPTPPTPRASWPACPGWRA

SEQ ID NO: 12394 - protein, 682 aa, Chlorella protothecoides
MKSNSFQSWRMFLLTVWLEVEQGGCIAALACLLLGLAVAWTSRLRGSPGLPQPPIIPGLPLLGSVLALGRRGSKFIAACHAQGARSENDLAPGTRGICPLFHGPRGTNKLWTRCTTEVVLDGGHGNQPLPIGATCWAALCPRARGWPVGLPPLANGCTLAPFPIHGPFPIPTVHGPGLRAPSSALCWQARAHAAHAAVAAGPRHAPKHTPPPSLLPAPGAGGQPPAWPGRVWSSMGGVPCRCAARARRHGHGPADSIPADPPPTTPDGCLAGATLPPVALPPGPIKAGGDVPVSVVALVHRWRKGLPAVASLFEVPEAMTGSQPEPAAGRAGTTSDPSDQLAPLHPRSLQASAAQGQHRQGDGGEEKGMNLGDPKAAMGWELDSIEPRAESQACDANATPTAFWTLAFLLLPENAAYRGRVEAELQATRSSTDPAASLVDLACSRSSALNKCIAETIRLRAPSIDVRIAASDVMLRLPGREGLLLEKVGAGWWDLLGSGPREVRGAADESDRAGAWAGSAWAFGTVCKAPCCCPTLLHLTQCLPCPPRQGSVLATSPFESHSDERLFGPDARHYNPDREGMLLCGKTALHSSILGVGGVAGLAFGGGKYRCPGRYFAEAEVALVVGMILLSCPTLALDDLQQQWEGGVGDPHGCLPAPDFQKLLGIKVPVAPCWVSAKEKGC

SEQ ID NO: 12395 - protein, 394 aa, Chlorella protothecoides
MCRPPQPLRQVVPILRAGLTLLESAATLLPSSQTFHVGYRRDEETLVATPYLNKLPASFTPEDRILVTDPMLATGKAARHGNGIWGERGAHSPPPALNPVCPHPTGGTMRQVIQDLVDRGAAPGMIRIVSAVCAPPALKLLADKFVGLKIYTGEGWRAVRGGTGCAAPGVRRDSIATQGQTMSVPACTGGRHCLIRTPGAALAEGRGADVGQSDADVELCRRQMLNGSLPHRYHRRRSNTGVCDGIAAHKLAPCHICEGHAEGSLPGNTPALRIGSLKNALRLLTLEEIFLTCEGQRFRERHARTSTHRILGCSGIGLHPCWALWRTHHRSPVDAAVCTGNVIPVKNSQPWDMKSGGWDSPLHHLIRPVPPGAQKLPRVGGPSLRRPLRPTPGG

SEQ ID NO: 12396 - protein, 421 aa, Chlorella protothecoides
MQQAIDFWLVSTATRSQSTAKRQLPETHLILKCPSVVIPAPVHARLAQCRIADDLRGHERNRVRLSNWATHCDNHPISTDKVQRTVPVLNTPDRCWGFQEHVKSVIISMDCPPKKLGGPSYSQSTNAQSEPEGAPVPIACRPPPRSHTPWGPVIKIMAQVDATLIHAFTAVGSLTKGVFLCRQAILLEVSHPSHISAGPSGTCHNPVSTLASSPGVQGREGDPRGVVVAAVQLPHRQHVAELGVLVGLGPVKLAAVDHGRGLAHLDPGLQPAEVSQVRLGGDVPCQSVGVAGDGPDDDEAGGGEGRLLGRGLQVLQQQVDQEEVREVVGAHRQLEAVRGGSGLLGGGQVDGRVGHQRVQSPARSAEALHEVAHGVEGGQVQVQDGVGVPWDAQLTGHAGSLGGHEGRERDSGGVSTRHVRE

SEQ ID NO: 12397 - protein, 62 aa, Chlorella protothecoides
MERAVLLRDLRERDVMPADFEASQPAVCRLIRWMLARSPAERPTARQRGRRGAGGPAALAAG

SEQ ID NO: 12398 - protein, 100 aa, Chlorella protothecoides
MSLGPGRTLRDVLDAGPLEDADRWLVLRQILAGLAHIHDQGEIKLGDFGLAKLAGSDPGAEPLEGPPGAAAGPAPGSLGKMEAAEHTTQVGTSYYIRCAT

SEQ ID NO: 12399 - protein, 263 aa, Chlorella protothecoides
MPNSCPPGVVPGIEPVGVLADPTLGAQTNGPHQEECRDGEAGTGLGRWGLPMALGGSEVSHLRIRSLIAAPMPGPGPGGGSGSTSWDLLLRAGFRPASVSTLQQPNGTLTATPSAPGPNRQNSGRRRCPSAWVARQPRARQASWCTTAGERDVELPGTFTWALLWTACARWSGPLAPYSICVPPLPPSHHGPTARLSPVPLPPPTHKIRQVIAQEVVNPAHINITLQDVGGLDHIIEDLVGVPSLGTRMGAVPAEISHSTVGL

SEQ ID NO: 12400 - protein, 148 aa, Chlorella protothecoides
MIPWVSWRGNDRALEAGLPCSPGAGSFQDSERHNPPPNGCSFRCPCPLLKIPPNVPGHNYDLAAGAALCVRPLTPHPLLPCQGVCHRDLKLENTLLDGRQAPRLKICDFGYSKVRGGGFSPFTGRSAYRCRVAQPGLNASVTPSLTLQ

SEQ ID NO: 12401 - protein, 352 aa, Chlorella protothecoides
MGLISGDGFGNQTLQATEPGITTQFQELHDVLVGLCLAEGRLCHTLRSADFEGTCPRREGATTRGRSRRAGRRDPGSRGKPKRPARWSRRHAHPCAAPLLGPALPLYTPPGPGPDPPSPSGARCSRSGHAARGGLGPRRSIPSGCAETSVVYPSPCRTPLQIKDIGSGNFGVAKLMRERSTGELIAIKFIERGEKVSRACRDFGQVSPACDRRGVLIPGIPWPPCTSQIDRNVEREIINHRELSGHPNIIRFRETDLLKGAAEAPPSTPAPLHSSIFGRAPSPSPQVFVTSTHLGIAMEYAAGGELFERIVAAGRFKEDEARYFFQQLISGVSWCHKWVRERAAKGGVRHAA

SEQ ID NO: 12402 - protein, 249 aa, Chlorella protothecoides
  MOD_RES (221)..(224): Any amino acid
MLLIRCQEIQGRDFIIVTVLALHRLTPKEPLSLWWETLMANSTTSATCGCWSVENGAQPQECHRGWKVHSRVCISACDHVFSSLGPFSTIHCHRFKVAGYPSPTSLFIFNGDFVDRGSWGLETLLLLLAWKLAAPQHVHLLRGNHETALCTMVYGFKGELVAKLGRGKWKVRGSLECAAFLPTHGQEAQPWGSGCEVGHRRERPPHGLAPRSVTSIDPSAXXXXRNLGGLVVRLDIVENGHRMALLLVL

SEQ ID NO: 12403 - protein, 72 aa, Chlorella protothecoides
MKALMVESAASAASHSFLLDEDSALPFTQDDVAAFMDDKDLLGEMGIPAALRDQPSFAFLNKRLELALQSAA

SEQ ID NO: 12404 - protein, 262 aa, Chlorella protothecoides
MRRPELFRTSLLRQKRGVLLYGPPGTGKTMLAKALASECNACFINLKASTLLSKWYGDTNKLIAAVWSLAAKIAPTILFIDEVDSLLGHRRAVEHEATTAMKTEFMQLWDGFESASDSNIVVLGATNKRDDLDDAVLRRFSLQYEVRLPQRAQRETILGLLLARHARELGAQYLDPTLMAEVEGRVRGTAGPGVAAAGAGAAAGAGAGGASNPGAANGTAAPTGGSALRALAERTEGYSGSDLTELCSMAAAIPFHDAAPTQ

SEQ ID NO: 12405 - protein, 205 aa, Chlorella protothecoides
MQGPVWRHQQDRRVWVLLQPRRVRWLSRRGGLHPRRGCRRLAPGGRAGVVPMVFGSGSEGGARLGSRPLVVVRRTHPAQNAPLRVGAGPWVPAHALPWMTIDSRRAASEILLPRHLGPQVEAKYPALLFKQQLDAFVQKIFPSLRDNIKKDIMPHLAACIHAPRSGVGRTSRPGRGSSHGVEAPPARSPLGSWLRQCQQECRDPA

SEQ ID NO: 12406 - protein, 508 aa, Chlorella protothecoides
AASPEAVRTATLRSAAGAAVGLGAVVGLGVLSPSPAFSSMLTKFGLASVCGYQTVWGVTPALHSPLMSVTNAISGLTAVGGMAVATGGLVPAGAAGGLAATAVLASAVNIGGGFTITQRMLGMFRRPGDPPEFTGLYGLAGAGALAAYAAGAAAGYAEATPAAYLAASGLCIASIGALASQRTARLGNVLGATGVGLGLAATLGAVVATPGSDALLPVQIVGALGVGAGAGALVARRMAITSLPQMVAGFHSLVGLAAVTTSIASYMAADPAHLDAVHAASTYFGTFIGAVTLTGSAVAFGKLHGVLPSKPLALPGKNVLNLGLLAGNAAAGAAFLTTGDPGVALAALGATTALAGGLGAHMTASIGGADMPVVITLLNSYSGYALCAEGFMLGNDLLTTVGALIGSSGAILSYIMCRAMNRSLANVILGGYATAAAGPAAEVGGTHAEVDAHGAAEVLTSARSVLIVPGYGLAVAGAQYAIADLVKRLRSKNIAVKWGIGGRKGDGA

SEQ ID NO: 12407 - protein, 99 aa, Chlorella protothecoides
MQVMSREMFNPQFSLFAPVPEGGTTFQPNPSSVVQNDEARGTNHLDFFKFVGRVVGKALHDGQFVDAHFTRSFYKHMLGEQLTYHDIEAVDPDFYKNLT

SEQ ID NO: 12408 - protein, 131 aa, Chlorella protothecoides
MFNDHELELLISGLPEIDVADLRKNTEYTGVQGTVPRHVSAWHQVQGPSPALPLKLTHPPRTRLHGCQRGGALVLGDCGRHGQGGPGAAGPVCHGHQQGPPGRLCRAAGRPRPPEVPDPQGVWGRGAAAHR

SEQ ID NO: 12409 - protein, 79 aa, Chlorella protothecoides
MAGPAQRNTPKADEPNWPCPSHPPMPCRWMLENDITDVLDLTFAEETDFFGQKNLVELKPGGSGIKGTEWKHPWESSLA

SEQ ID NO: 12410 - protein, 622 aa, Chlorella protothecoides
  MOD_RES (95)..(98): Any amino acid
  MOD_RES (324)..(327): Any amino acid
  MOD_RES (515)..(518): Any amino acid
MGRTDRYSIRVLQHGRSTLWNFRGSGPGQHVVKFMPSNYLLLSKHCPERYLAAHCSIVAPILVQPIGELSLDGRAGMGSRRGFPAVAILLLLGPXXXXAGMGSRQGFPAVAILLLLGPALSLAARTPDSAQTVLRGEPQAPVWPDSYSVEYTFSLPYTAKIQPHGIRQGTGYGRCDWRAFPACCMAWCLMSSSAGVCLAMYKIPRPAGHGTHRFPEPLLPGTPSSSIATARPSGSAWRHTMAPTSSSPPRRLLASAAGTGVAPPSALPLAPPAAYAPDQDAARPLHGPTPSPLCPTPSPEAPLARPRFLQPQSVQYELLPRIDXXXXRLLASVAWTGVAPPPALPLAPPAAHAPNQDAARPLHWPTPSPLCPTPSPDARLARPRFLQPQSVQYELLPRIDRQQCLVWAEPGLADAQALPDLAGWSYQGAEVLEDGAAVHAWHYLARHQAKSLAYRFYAHPDGAPRRLDMLGTDALSGSHFDRWVLDYASYVPGRPRAELFDQPRLCEGRAPVDGXXXXRARSSSTSRDCARGGRRWMAASAAAHEPGPARAPAPVRCAWRACSRASPTAGTTRGTTPSWTRHTAGSGRTAAWPTTPRGRRPSSATRRASRRTTRATPPTPWP

SEQ ID NO: 12411 - protein, 321 aa, Chlorella protothecoides
  MOD_RES (113)..(116): Any amino acid
MPCDLELRTCRRVSGRTQWRHQNVLHQGYKEREGRHALAPAISTCARAIQVPGRLSSPQPCMALSLGGHWIPTASKYSIEVHSSILWIGLGKQWTLGTRAARHGHDVPGGGVXXXXVPGLARKPCTVVSGINSSQGMMSRGAGSSRTLHQYLPDSSHSTTHMAKKSWGTSDKVQEARERKNSSKKEAAEAEAKQKEEAYWSQHANPKGRKDAKREEQERSREEAAARRAEAKRLAAEEEAALAGPSRKAAPKPKLTHHQLAQQRERDQAAAAAAAAEAAAAAQRAPQRRAICRGLCSMQQLFEQLLCRMQRCGMMLSVKPP

SEQ ID NO: 12412 - protein, 1362 aa, Chlorella protothecoides
  MOD_RES (61)..(64): Any amino acid
  MOD_RES (285)..(288): Any amino acid
  MOD_RES (628)..(631): Any amino acid
  MOD_RES (1087)..(1090): Any amino acid
MPAVPCVCRRWEMHPAVLERPLESLDAGRGWGPGDGRAAGRSSVTACPPTHERAITCVSGXXXXGWRGGMLGCGVTGAPRQAAQRGVPAVPCVCRRWEMHPAVLERPLESLEAGRGWGPGDGRSISSLGTQRIAARSTSTLTPLRARHCDGRSRLDPRALRVLILIHLDMSRRTLTLQQLACFWRQAGAGGGTPSAPATPAMPAGTCAFKHPFHSGSRPDERQESMGSSGPRQPASLRGGLGRRLIRDQRTRPPLPCCRLGPGRCQGHDACRPATTPRFQGLRPXXXXAQTTTHAAQPPRRGFRASAPLLKDYYSVLGVGRTASDSEIKKAYYQLAKKFHPDTNKDDPGAAAKFQEAQQAYDTLRDPQKRTAYDQYGHDAYRNMESGGGPGPGGFGGPFGGGVEVDPEDLFGAFFRGGQGFQVGLGLLQGGRTERGQTVLRPCCGLWGSGFGSRSDNSEGGTLAVPLVLMQAELHPVLCRPLLPLWPRLWQRGRADSPPAARRGPADPPAHQLCGRDEGHHPPDGPVRHGRRRPLPGGGQDPGGRGHGPAPAPGGQRRAGRPRLRGGRPARLPGGGALPRLHPRRLRPVRGGTGGHGGRRAGHHYRVSTRGRPQHGRRWPVAAPAAAXXXXAGDHYRVSTRVAEDAQAALSMDRGGPSRHRLLLLGCKAAAARSPCEARHTMLHPSLPSSRRPCRVPTIDGRAEVTVRPGTQADDKLRMRGYGVPQDAAGLPGKRGDQYVVVRLRVPRTLTPFQRQCLEDYRRGERQAAPQQPSGAATGAKGGSDTASGKASEGKSSGTSARADEPADKKNADKGSGKAGSCKGTSLPGLSETRGNGRRVSIHGWLPVTELSVLLQMPTPFPITICPLPALALPTRCERGEGMEDYKRWGCPAALQFQAALIAGREQLPPAEQMGALAAGRGCLLKWPWPPGPTKKLQEQALRGTLHARAIRETRHGPSPETAAALHLTGSGGGRERGGRGGCHPPDVLCILVDGAVGGEEAVAGGVEDGAPGPLLLIPVQLIDAPLRIHARPRRVDSGLATACVKAIQHEYIPHHPTPLPPPPFGPSTHTHTLHPTPPPPQPPSTXXXXPTCVYTSPSSPSPAPTLWPLHSHTPPQPPPAHPPPAYTNPRPLTLGHVGDGVDQVLKVVGVAKLAVLDCFQRLGVARVIVGEVLALGAQARHILRRLAEDEQVLQPRVLPDLDVGAVHGADDEAAVQRELHVGGARRLSPAGGDVLAQLGGGDDDLRLAHVVVGQEDDLEQVADLRVGIHLCANGAHQLHDLLGHVVGGRGLAAEHRHARDDLDLCAISRVSPGAITASCCGGCPIASMCNGQGNTPGHVHGKPAATGLSTDHGPPGAHSTP

SEQ ID NO: 12413 - protein, 354 aa, Chlorella protothecoides
  MOD_RES (57)..(60): Any amino acid
  MOD_RES (247)..(250): Any amino acid
  MOD_RES (331)..(334): Any amino acid
MPEALEKWPVAVLQKLLPRHMEIIQRINDEWLASIREHVEAKVAKALARPAPAEEGXXXXHVEAKVAKAPARPAPAEEEADEADDESDTSASGKKPAKKAPLDPVEEALKEYSIVQENPWKAGEMLVNMAYLAVVGSKAVNGVAAIHSEIIKTDLFPQFVEVFPSKFQNKTNGVTLRRWLAYCNPALSALITEALGSDAWVKDAGQLAGLEPRAEDPAFRARWREVKTTAKAALAARIAETTGYDVXXXXTAKAALAARIAETTGYEVTTDAMFDIQVKRIHEYKRQLLNAISLIVRYQEIKAMSPEERKKVHGGSGREGARRCGREYLIXXXXRCTGGPGGRGASVWQGRFDR

SEQ ID NO: 12414 - protein, 155 aa, Chlorella protothecoides
MGGDCCGGKPTPAVADQLAGLSLDNLPKSNGSAASERPWAEIAKEKAVYFNKRVELFEKYREREVAALEAARAAAVPVQITLPDGHVRDGVKDVTTPLDIAAALSKSLAKKAVVAEVDGKPWDLFRPLEQDCNLAIHTFDSPEGKDVRCSGCLCL

SEQ ID NO: 12415 - protein, 224 aa, Chlorella protothecoides
MAKKIVKLVGAIGAKVNTDPEIGDLLKVIFLPNYNVSEAEVIIPAAELSQHISTGGTEASGTSNMKFALNGCLIIGTMDGANIEIGENTGLENLFIFGEAAEDVPRLRAERKDFTDYDPRYTKALKAVKDGEFGDADYFEDLVDSITDMTKGNDWFLVANDFATYMDAQRRVDELYGDQEEWTRRSILYTARNGFFSSDRTINEYAKDIWGVTPAPPPALTPTA

SEQ ID NO: 12416 - protein, 98 aa, Chlorella protothecoides
MQQETSRKLCLQAGLVGLRRQFRVWRAGDACHKAPKPHPNAFPRSRRAKAAWEAYYEEQLAVLKEDKPGLRLMQYKSMIFENWQRSPLNPRNQAVSKK

SEQ ID NO: 12417 - protein, 463 aa, Chlorella protothecoides
MARSCVGGHAVTDDRPAALPSPGPHPLPASKLSNGLSSTAGCISHLLHTHGTAGMPRSAACQGAPVTLDPSIPPLHPHPSGLRLARSLAEQGGQGARLPLLPDHAQDVVQLALTVHLVVARAHVDGALLALRGAHHQDVVELGHLRLAHLLLHLAVGQVHLHVEARATHSVPHLQRIVVRRKTTDDNPPEMGTTMTWRGESQSGHRPAKFSDGKHALHGAQHGAVDDDGDLEAAVLGHVLQAEAEGQLEVELHGGALELAPQRVVYGDVDLGAVEGAVALVQLPGVARGVQRVAQRALCRVPLPRRAQEALGPGAEHQGEAEAQLAVDVGQEGQGALDLGRHLVGAAEDVRVILLEAAHPRQALQRAGELVAVQHAEVGEAQGELAVGARAVAEGQAVAGAVHGLQPEFALLNVEAEHVLLVVRGVARSLPQGLENVQRCSETVDQCMQYLDGREGVQGARLV

SEQ ID NO: 12418 - protein, 349 aa, Chlorella protothecoides
MDLWKTSGHAAHYKENMFCFDIEKGEFGLKPMNCPGHCLAFGHRTRSYRELPLRLADFGVLHRNEFSGALQGLTRVRRFQQDDAHIFCRPDQVAAEIERALAFLADVYGQLGLSFSLVLSTRPEGFLGTPGQWDAAEGALRNALDASGHAWELNEGDGAFYGPKIDITVHDALRRKFQCATVQLDFQLPLRFGLQYVAEDGGFQVPVIIHRAVLGSVERMFAILTENFAGRWPLWLSPRQVMVVPISDSSYDYALEVRDAVRGAGFHVEVDLADRKMQKKVREAQVAQFNYILVVGAAEREQRTVNVRTRDNQVHGQRQLDDVLRVIGEEREARSLTSLFGEGPGQAQA

SEQ ID NO: 12419 - protein, 198 aa, Chlorella protothecoides
MEAAWFVATGERVSLSEQAVIDCAWGAAPGHEESAAACDGGDAWAGVAYAVGAGGLPSSLEYQYKGQSGYCEANDTAAVARFAGFSRVPAYDDAALMEAVYSRGPLAVSLDASHDSFTFYSAGVYAEPDCFFKKDQLDHSMMLVGYGTSAEGDYWLIRNSWSDHWGDAGYVKVSRDRHGCGAPADAMYVVADADGLRP

SEQ ID NO: 12420 - protein, 281 aa, Chlorella protothecoides
MSLFPPCSPVYQAFWHSSAHILGQSLELEFGAELTIGPALEEGFYYDCYLGDRTLCEPDRDTIQKRMQQAGAIVTRITGVHWVEGRVVPACMPQELCRRSMRSPISPSPQIFSPPSAHHFLGSLHSLTQIVKAKQAFERVTVSRAEALEMFQENKFKVELIQGLPEDASITCYRCGPMVDLCRGPHVPNTGALRAVAVTNASRAFWRADVTREPLQRVYAIAFPEDKELKEYQHRIEEAKKRDHRLLGAQQELFFFHQLSPGSCFFLPAGTRIYNALVEVL

SEQ ID NO: 12421 - protein, 140 aa, Chlorella protothecoides
  MOD_RES (67)..(70): Any amino acid
MAPAAAAARPRSVCRRGAAASIVLVLGPPPCPPPNPFRSLCLLFTTSYPLSLRRHRAHRPPPPHQAXXXXQTHSDPCVSSSPLITPSPCADTGRIVPRRRTKLSAKLHKHVARQIKTARAMGILRADAAPARPWVQRGSQ

SEQ ID NO: 12422 - protein, 461 aa, Chlorella protothecoides
  MOD_RES (109)..(127): Any amino acid
  MOD_RES (192)..(195): Any amino acid
MESAELVCVALSTEQHGVDYLDAALAMGLRTSIFLQTKLQRIPGVGSSPGEYAPCRTVPLAAVWPVGQPIFARVWVCRGTEWMDAPEYSAPRRGLQLLPVPTHERGGAXXXXXXXXXXXXXXXXXXXWADGQLDDLNKGGCDCMHCVGGRPWPTLVLGGRLWLGRCSSYEHSAPLSGQRLCALPYINPGAAXXXXPWPTLVLGGRPWLGRCSSYEYSAPLSGQRICAPPHINPGAAAEASSSQGGVQASPPSESCLRRDAAPEASVDAASGTSSGEAAADSSGPALRPAGVQQQQTGGRPLDELLPGRGAARHATAKGKGKGPATLDRAGIMEVMAQSRPTPAPGRPEGEFASYGLLAQATDAPRAVFGNKAEEQSPSRVHPFRLFYPGQTYSPELPTPPTPSTNTTGPGSVPGGPPGVWTQRHPPTAGHPCQGRACTSRLQGRGLPLLLHHRQALEWGGD

SEQ ID NO: 12423 - protein, 204 aa, Chlorella protothecoides
MSPSTPYPNSMPVAPDLPLPEPLSAAAAKDADELVQLIGPYASACLLSKTWQLRVAALQARGPEWLLCIGGVQWEEVVTDQEHQRTRQPLGCPGMLLYSLAGTRIPWTMTSAWTVYSPRPTPFRFPSQWLEAGAGRAPGLLADPDNFGLLARTLSAALHDRVAAAYLAALPALLLLAQCQVCLLWRRALWLGGLGWMVWQLPEP

SEQ ID NO: 12424 - protein, 201 aa, Chlorella protothecoides
MLAVARGLDGHAGTHSGGRAQDPRREGARIAGLEARKAAAVAAEDYDLAKEIKAEVDGLRRVSQRGSPARAHGSGQEGEDPRDPGPRPPSPPIPTPVRPDLQQAPPGGLAGLRASLVAAASHMGAEVERMSRERAAETSLGDEGSSGDLGPGSSGARPAPGERGDGEGRTSASTLWAEHPPPPGFPAGEGNWKGGFPPGAA

SEQ ID NO: 12425 - protein, 376 aa, Chlorella protothecoides
  MOD_RES (156)..(159): Any amino acid
MLERCTVPEHTSSSDPKATGIGTHSAQALSHLACAPDLGVVTVFRRNPPPMSYKAQLKARGALRPAWDKLLATVQYVAMFISAGQPGDVKKIQASVAAARKVFRIMRPLESLNPIIQNPTLNSNRPLVLELLAKITPASRLHAIPRSPLPAPQLKXXXXPGPGEGTRLFSGASCDGTCDCSGTYSHPSHDFRPDRAARRRGGGGLPGATGEERCRDHTPPAPPRALPGPGEGTRLFPGASYNGTCDCSGTYSHPSHDSRSEHRMVIFPAPPHVLFAGLAGGGPAGAATLEATHGGHAGDHRLSPQLLHAVPGSPRPSQGQHQVLCQGGMMPGLLRIRIKISDHLLCTSLPVTPSCRTACIQGCYTAQLILWRHEGA

SEQ ID NO: 12426 - protein, 628 aa, Chlorella protothecoides
  MOD_RES (337)..(340): Any amino acid
  MOD_RES (473)..(476): Any amino acid
MGRPLPQGTPPAPGAPGPQHASSSDEEGESDEGWQVYSGSETEDETDNEGAEGATERQQLSDAINRGDAAALLALLEDEAVAACLNDPNREGDTPLHLASLYGQAECVRVLLEAGADAGVRDPDASTPLHDAAAGGYTEVVRLLLASDPCLAASRDDDGDTPLHNAARGSHAACAELLLGAGADPRATNHVGFGGLGGRGAGDPRADDGGGHPVSRGPRGRRGGPAGRHCPDHRVIERVLTRGRVPGPGDPPAADAGPSASGWLCLQGLSPLGGGQPPRPAARSARDCDEMNEGPGPGATEVWLGPRSASPAAWFPPLPPPPAQWGRRPVVSPYRRXXXXSPAAWIPAPPPAPCSVGATAGGVAVQEEGQAHRDGQPQEVRSLVGDGHVGRGRALELGGDEARGQEVDAGVGPAAQQPEDAHEEQRADVAAPGRGGLEGFVAFDRVPKLMTTATWKAMRRAGENPARWAAWDXXXXMLRVFGGEGAGGGVRKGFRRLWPCTKTYEHGYLEGHAPSRQEPCTVGSLGFTTTPWHQGIPTRTHAHAQPPTAMPPAPHAQASLKSATPSRARGEEGVAKRERGARRPAMSAKTRAKKRIFRGGERGLACTHPGILNAWPVGRNQSARGCPV

SEQ ID NO: 12427 - protein, 394 aa, Chlorella protothecoides
  MOD_RES (33)..(36): Any amino acid
  MOD_RES (312)..(332): Any amino acid
MHSMMHPPHPNIPPLPSNLVSPLSPPLAPTASXXXXTSGGRGWRPECGWWSTTAMHWSQLPTPCSLPTEPVPRSTHMHSMVHPPHPNIPPPPSKPCFSSLSTTRPNSVLIITVVALGLFSGLAFSASYQLVSRFANKNVIALGMGCPAAGPLVLALELCAGIGPHASHADMVLLYGAVALIVAAGAAAAASLVARHWAALDAGAGGEPAAGFTSAGAAPEGPRMPLLSPGGPLECGPRSGSGSALMHPLVSYSSLEPYRTYMSTDGEVVADDGSFHGALERAAPDDAWKADCAAHGGAGPGAWNPAAPPTPXXXXXXXXXXXXXXXXXXXXXGGPWVSCAAGGRRPRGPARHPPAADRALCLQHHLAHRLPLLHLCALLGPAGGVLPQGEVAQG

SEQ ID NO: 12428 - protein, 446 aa, Chlorella protothecoides
  MOD_RES (38)..(41): Any amino acid
  MOD_RES (208)..(211): Any amino acid
  MOD_RES (420)..(423): Any amino acid
MAPVVVCGAGVIGASVSYFLAQKGLTPTVVDAVGPACXXXXLNHGARRCVRRGGHWCLSVVLPGTEGPNPHRRRRCGACMFSFRQSWWVQGHARCLNIASPPMPMHRSCSPMTLCCSALLLAGGFLARDWCDGSPTGPLAQASFALHADLADKLNGKERYGYRRMSTYRCGCMQGGSGFHRDLDLDATIEKQSFPFHFSIPVLASVPXXXXDATIEKQSFPSHLSIPVLASVPAAGRREVQRAGSRRPWAGWMLTIWSRTVSSPLQKIAPRMTSMVPWLSLAVAGHPGAPFYRSLDNFGPTPPPSQVNPEQFTRTLLEESGAEVRIATLAGLVVENGAVAGVRLEPRDGGPATTMPADTVIIATGAWTGALRAAIPGLPAITGQKVAATRSPALPKRGRMPRTPESKLPRPTPVSRTAAXXXXCLPQAWANAEDYKKQIARAHTSV

SEQ ID NO: 12429 - protein, 544 aa, Chlorella protothecoides
  MOD_RES (153)..(155): Any amino acid
  MOD_RES (518)..(521): Any amino acid
MYGMAYIRLAIVLAAVCSVTAVAGEEAGEGAGEARTLVKGGRHAPCTGPASMSANHTGPIACREGAASYVAFPETAQRILPPPLQAPAPPASPAPSAACASRMPPAPLAPTTPALRAPTTSPTPPTASPSPTPARWAPASWHPSWRPTPPTSXXXYRRHQRLRRYVLARRRLRFQQRHQVLAPSAEAPAPEAGQAPAPEAGGAIGTGNCDIGFVLNTTSVPVLCSATSCQMSAGALDVYCGDVTCACSGACPAGLIQGLVSSVAGTATMTCQPGGACAIAMEGLPIASIDVQCSVGECLVPVVRPLGNDTLPEGDVAHLSINPFIAAIPLLALVTLLAGVGGYAWAHRRLWAPASGALDAAALAALADGPAALPLRRVATLTFLGLGVSVPMNPRLAAKKRAAMQDAEVPAPRGRAWAPAPPAQSPAVEAAAAEFVASLHDVPGQRGQWAVLGGITGTVHGGEVVGERGVFFFVLVGECVWRDGGYSRGDRVPGKGWLAVTLSSCATSSPGPGGCDLXXXXIFVLFWWVCVCGGMGDIVGGKGF

SEQ ID NO: 12430 - protein, 289 aa, Chlorella protothecoides
  MOD_RES (10)..(13): Any amino acid
  MOD_RES (68)..(71): Any amino acid
MPSPGETLTXXXXVREPTLTHAISRGMPSPGETLTQTCHDASRRHQLYLLTRSSCTPPPCRLPGERIXXXXYGPNSTCSRVPPAHPHHVGFLVNVSSIPAYLRWIHYLSVFFYAFEAMITNEMTGRTFTFMLYLPLTSTPCTLSLHIIVPFPIPTGLGVCPNRRHQRQHLPDDTRVRCRRHNPRHRRARGSLRRLHLAVPGIALDGCTLSLHAVQGGVQQSFNAARDVYSKHPSDRGQTGKDRRRSQQLGVRFANGTLEERRTDAYPAESLSVGSSIVTKVHDRRRSKS

SEQ ID NO: 12431 - protein, 904 aa, Chlorella protothecoides
  MOD_RES (138)..(141): Any amino acid
  MOD_RES (498)..(501): Any amino acid
  MOD_RES (826)..(829): Any amino acid
MHQPMYLWPSKPMKNVFSTMCPPWIPSAEGAAQSLATGRAQSAADSSPTRILRGNYQAYINSSPTRVLRGNYQAYISPRCSFYRDLGPCLIFCGLIICELRKIARTQIDNEMYVSSRLGVKACIHSGCSEQQLFTTDXXXXVSTRRKGLHSFRLLGAAACIVHDTVVTEAPRGDVPLLRTPRPDEEMLLFYEHRDTDAAEAPERVEGAEQRWQDLAASLHALLKVSTGPWPRGTLAHLIPQRTGQGHPGRQGHPGRQFRAPIPVPLLPSQSDPSLHLEAKQWLMNSISDLDMARYGHPSGHSDLLAQFIPQCRADVEASTSDFALAATQAICRADVEASTSDFALAATQAIVETEPATLGPVLSRHPAFLSRCLRRRPSLLEWFAAFHPDGLQRSGMGAQALARYALAQRGSAWAHLVWAGKHAQSPVAVAQRPHYWCELDGAASAAGLAARDPGFLASPEVEGAVAGGTLLSVDPGFFASVWEQRGVWAGQREVCAXXXXRLLRLGMGAARSVGGAKGGVCTLSMETHDVLPHITGHVQDFPAQLQSKFGCLEILSTPLPPSDLNSPPGLSLVVPSTGAARLPGRRPRRPHGQGDPCRIVWRPRSPGPLEGTDPAAPPQLVAGAAPRPRPRPEGLRCWSPRRRPGGPGVPPPSLADAGRGGPGLRAGVLAPQASGGPARERGGCLGPGAGVPGWGCALAVRRALEAVQEETVEGHAFLRQRLTPDATALARHYLLGLFAARAGLLASRDLLAALRAGGLTVGPLGQATRKRGRIDTQGRSKRRRRRRRGDPESDEDSGGGAAAWELSWPSGESLLVRADTAVDQXXXXTQGRSKRRRRRRLGDPESDKDSGGVAAVWELSWPSGESLLVRADTAVDQILDCAAILLARDVRRCRLRAAGAGES

SEQ ID NO: 12432 - protein, 371 aa, Chlorella protothecoides
MALPFAQSLNATATGCMLALSMDPTSHLLFDYHDGSVPVGKREGGPVFITPFRLGLAAAVILVNGLVSVWLRLAMHKKLAIATVRVVLQLSILGYILVPIFTANSAWVTAAYLAFMLLVAGLEALSRPALTYDGMLWQVLASLGLPCSAMLAYGLGAVIRPRPWYDAQYAIPVAGMLLGNACSGVAIGLTSLLDDLSSGRDRVEALLAAGATRWEAAEDGVRRAVRMALTPTLNQMNVAGIVSIPGMMTGQILGGADPTTAARYQIALLLFIAAASGAGAVAAVFLAAGTLLDGAHRLRGDRLSPRGTTGKGVLVWLAWQARRAGGGAARAWKAGVGRVRGGPEPGADPTVVVHRGGEVRDGLDESLLRGR

SEQ ID NO: 12433 - protein, 221 aa, Chlorella protothecoides
MALPAHREFLTPSHTLSCQVVELLGKAAFCRAVQALDTKTGLRNSKDYFDQSLDEIKVLRYVNAADPGDEEGILRLYDYFYYREHLILVTELLRANLFEFQRHNRASGAPPYFTRPRIASIARQVLRSLAFLHSLDLMHADLKPENIVMRSYSRCQVKIIDLGSSCFLTDHLSTYVQVGVGRGGGAGGALRGWARSMLVGEGKCHQITREWRMARQGFRGG

SEQ ID NO: 12434 - protein, 262 aa, Chlorella protothecoides
MVAHYLLPLPLILFALLALPGPKQLRALRDQQQLGIYGSPNQEIALLSKKWRTERNLWCAGLPAECWAAEGDRGLCLCCLGRPGRLLPGDAAPCGSGGRTSRHSPLPFHGARWRRHVGRSPSVTVIIWTVAWGSGGGGAAVHRTEGDAVAGDFTITPPSDSSLWTLYCPSLRPGKDAATKGGAGLTAIPLPKIVSTESGDLGVVEPSRDLAKQLEVQFEDERKELEEGEQRRRQTDALEAEAEAGEGEGGAAGKQPLEKKDD

SEQ ID NO: 12435 - protein, 225 aa, Chlorella protothecoides
MCLGSADPATASRPPRRLPCALTPTLFSCPCPQSRSYRAPEVILGLPYDQKIDLWSLGCILAELSSGKVLLQVSAVAGLVRCRVSRGGLQAALPSPAPRSRATKRFSALGPPAIAPPAPSPPPTERVAGDAACAAGEHPGGRAAAHAAPGQVQPQVLHARRAPVRAQPPHAPPGVPETQAHLPGTAPAGRRRRHGLFSPAPPPGVFRRGRWGPKVGAMPPLLWAG

SEQ ID NO: 12436 - protein, 131 aa, Chlorella protothecoides
MRASKPPLPPPEDPLLCPRLCRHRGAPGPALPLRHALLTSRPARGCALQARLCVRRRDIGALLLVCVLWLLGGWSNTSVNLLAPRLVPPELKGTAAAYMAIAYQTAHFLGLAVAVCLALLLYGDTTGRRPH

SEQ ID NO: 12437 - protein, 219 aa, Chlorella protothecoides
MERHATHPCTEGRPNRRAHATPWPLPTPTLKTPLTQNVGLAVLLDAPDAQATLLNVGLAVLLDAPDAQATLLVPTNSALDAAIAGGSVRDADTLAALLNSAPDLANPLAAYHVVKGLWPSWTLAPGTRLPTSATLDKVNLLQLNVTAGPVIRGVGSSANVLQADLLACGPSIIHIIDQVLLPFNFDQASLDAITATQVPVPPAAPSPAVTPAGRRLMRV

SEQ ID NO: 12438 - protein, 153 aa, Chlorella protothecoides
MPPSTAHCPRWPGTSCRDATNSAAAASTAGLCAGGAGAQARPRGAGTSASSLARVHGHAHAQAQEGERGHPAQRQRGRAVGQRGQRGGVQRAGRRCPEAAVRPGVAAHARQQRDQRQQRDGGDEGVDAQVRHVALRQRVVAQRPHHGHQALPH

SEQ ID NO: 12439 - protein, 63 aa, Chlorella protothecoides
RPFEVITARSTKILVAVECLKAGQKACTADKNGNIGTGNKGKNNFGNNNVGNNNIGEQDVGSS

SEQ ID NO: 12440 - protein, 239 aa, Chlorella protothecoides
  MOD_RES (217)..(220): Any amino acid
MKERAPRVYTKPLRSCELDTVLFEEHSVSELKQGTRGPTPLAMTPLRPHILISNDDGVTAPGLVSLATLLHQENFCDFSVCGPSGERSAQSHSINIHHPLHAFPISVPGAEEAWAVSGTPADSVMLALYGPLLKVCADGQTAKGGPSGQACATHQLSRTPSLPRTTSLTWWSPASTEATTAACTSSTAGQWAPRARPPARACPPSLSRWTTTARVAXXXXGRLQGRALHRALAGQPQRT

SEQ ID NO: 12441 - protein, 444 aa, Chlorella protothecoides
MSPHSLPALLAQSAGMRIDLTAVFDMNSSLLMPHSTPDQRLAERSGTPVARSAGSLHEDREEAARGLLPGSEGETGGLCACLPGADCEFGSAGPGCREQQGSCVHIQLRRQAAIATAGDADAGEGAAMSPEHHGMPDDGQEHMPAGRSVHISTGLKTLHPIESSRLLKQTSVGRLKPAPQYATHCLHACSNDWFQARCELQALIPDLARKSARLLCLSSPSQTRSVATPLPHQPPRASLQLSVEPGDTVRAAIFLSDNTVDCQLARALHSVQSALTAARMRQGMWGRAIAASRRKPRAVHAAHLAMQVTVPCRPLSRAIYAGGAAAADADAARQARRAKQAALVQGVVAIHEQLHKAWLEARIRAQKERLAALRSNDMAAYVGLVAVAGSSQLDKLLCQTDACLRALTARLSSTRAVSSVGKGLEGPGTECSECGCWGFLRNVE

SEQ ID NO: 12442 - protein, 266 aa, Chlorella protothecoides
  MOD_RES (153)..(155): Any amino acid
MPSVNLWGGGGVMIVPPPPALHIRMPHDLSSASLPQSHSPFPGSSTFVFLLSVRAGGVGLNLQSADTVVMVGQGIGVAEPCLVSLGGHIGSPLHCMGRNRPAGPGPSASARPDEKGVKWSGEGDSTWRTGAQGFSGHLRCDCQHPGRMPNSGXXXILVVCAVTISILAACQTQAAPALDHASSPQVLVIRLQTAGSVEERVVDVAQSKRTFVDRSITCGFFDGKTSAAERQRHLLEFIAASADSSGMAGTRDGGAEMTDEEVRSMV

SEQ ID NO: 12443 - protein, 870 aa, Chlorella protothecoides
  MOD_RES (34)..(37): Any amino acid
  MOD_RES (315)..(317): Any amino acid
  MOD_RES (650)..(653): Any amino acid
  MOD_RES (755)..(758): Any amino acid
MARTPSVRLFDLRGRHATRLQRSGASPGCRPAYXXXXQGSKAAMARNPSVRLFDLRADTPHDCSDQGPPQDAALHTPSPKPFLSHTTHPPDALVVLLDAGHHPVCGVQTLAQVVLVCLIQAAPCLWSADSYRTPVYQRQTLSLCPVHDPPTAHPHSPTHPVTTPAQSITYPDHGLVQVGVGQDVVQGRLRVAPQQVQLGPDVGGVGVAQPLLLALELQGLGRALLHQRQHVLHLVQAGVDGVHGLSLAQRRHALLQHAALQEELGQAAVDVHLSHHLADEVEGQEEGQEGGQQVQIAQVGGAGTAAHPTHAARGXXXEGQEGGQQVQVAQVGGAGAAARPTHAARAQHGRAQHQARGLRELVEEEPGEEHDDQAQPSLAHGHQLAGGGPERLAWGRGCRKRGRDEGFEGLTHTTEALERSLFRPKLPPDRSMPLGLECTPALPYMVPDGGASPGTRAGGTLAQNSEGMLRWRVTNSACEQTIHVTRNERKAGRHVNEQRKRGLGHSAEPGPLARFPRYSMVLGGHGHSAEPGPLARFPRYSMVLGGMKVLQKRTTHILPEWKKLRLLNCHLCAGYQTLQAFHRSSSVSPVPQLFIRMTSFNHQETLIPVYGVPNLKKLGILHFSISRVHELAVELLRKSDGVGRTCLRKXXXXCTFRSAGAVLRHRDPLMASGGPDRESGDDARVWREARRSLLAGVALLAVLLLSLVPLTWCLPALSGRLPIIILSAPLKPCFLQRFPIHEHTGRRLGYTEKLXXXXWCLPALSVRLWGTLLPPYRLVVLPVHEAEDLAILKSFPPRTLGTLLEQREVILRYAATSPNIVAVCFCMAYVVMQSLAIPGTLVLSVLAGAIYGHWRGWALVSGEERDGCGI

SEQ ID NO: 12444 - protein, 780 aa, Chlorella protothecoides
  MOD_RES (19)..(22): Any amino acid
  MOD_RES (389)..(401): Any amino acid
  MOD_RES (703)..(706): Any amino acid
MLPISAGMSCLALTNLYRXXXXPGHGKTDPRPEVTSGHAADRTPLACHDSLLPTFIEQIYYCKTTLASQSALMASAEAGSPSSSGAPTCSPARESRVRYDRGMRIWGAEGQDALERASVCLLHAGPTGAEALKNLVLGGIRSFTVVDGERVGPQDLGNNFMIDQDALGRPRAEVVTGCLGPPQGGGRDRHAGPCWGASLKELNEAVGGSYVVDEPAQLISSNPSFFHEYDLVIGAQKCHSRLTATCPQCALFLNPRCQRHPAQTYESPPKLLSQLRSSDAAALDAVCRERGIPLILGRAYGLVGLVQVNRVKWPRAPDPSDAVLGLLVPMGCLEGRSVALVTRNRLSTMLPAYPAWILMPMPGPAAHQVCVAEHCVVESKPDNTIEDLXXXXXXXXXXXXXGGGGGGGGVEGPFCHSFCGEGREACVFQLRTLPSSTTPRFSDRLTEPWPELAEAAAQVDAGLLDDHVRGHVPYALLLIRAAAAWAATHGAPFPRTSAEKADFKEGLRSLQRCIEGVPIEYSQVPKPIHFSDFRAPLYEPLIGVVPHNLCISFSRRTESDTPSQEENITEAIANAHRVWSGSSAPKRPPVSLKCLLAAASMHGFKLSSSAPRDHAWWARLIIPSGHPRRHSTLLHAACSPGAGALVPGRSLPASPRRLLPLLDLRGGPEPLCGLQCSRRPAPGGILCGGVCPNNSRAQFGWYXXXXAPGGILCGGACPNGSRTQFEWYICGRQPGLHGRSCMACERRLALWKSSPTLDIQGPIPRAPILPLSYLAPGKHS

SEQ ID NO: 12445 - protein, 306 aa, Chlorella protothecoides
  MOD_RES (98)..(100): Any amino acid
  MOD_RES (182)..(184): Any amino acid
MPGPLVNHTIPFQNLGLDWDERVLPSIGNEVLKSVVAQYQAEQLLTQRDKVRLGMAMRDCGYQLWNQKWSCLWGRDRTPERRQTDPCAPRATPSSHPXXXVRLGMAMRDCRYQVWNQKCICLCGRDRTPGMRQTDPCAPSSTPISHRFHLPRYPPRCAASSRAAPRSSTSSLTMWPSPTCPXXXVRRPTMSSETQAAAQGTSQCGAGAAAAPPGTRCLRELVLTPPPSNPPNPLQERKAAVVRAEGESEAARLISEATRAAGAGMIELRRIEAARDVAGTLAKSRNVTYLPGGEGGASRMLFQLPG

SEQ ID NO: 12446 - protein, 150 aa, Chlorella protothecoides
  MOD_RES (63)..(66): Any amino acid
MFDRVSGVLETPVSEGTHFRVPYLQTPNVMDIRTRPRSISSVTGTKGEEFCRRLPRGAFAEPXXXXQLRDRDQGSPDGQHHPTCAFQAGCRETGTHVQGGRDMRWFGNGKGTAVSTVLGLQICVSDAESCMGRHVSDGPQAPPFISVVNN

SEQ ID NO: 12447 - protein, 625 aa, Chlorella protothecoides
  MOD_RES (517)..(520): Any amino acid
MHACRGMQGTHTRFTPGEKHQPGQASLTGVQGGLQSAGADSQSHGVACNLGEDVGQGLRGLLLSHGDKLPRTLLGVEPTASQLGPPGAACGRRDDGGFPPGVIHPHDIGSRLGTIKPSERALSCGPHTELGNGPIELPCDTDLAWYVLYWNSFGRLDSVAPSCASLLRAGPDPRQGPTHGVGWGRVPRPGLPFPLRLLPRLPPDLQSPDAHGALFLSLRNASLRHPPGGVRGLGCPPQGAAIKGPSLWTPWTAGTHGGSHVELEGSWDNWSQRHVMQASGKDYTLVKLLTPGIYQVQHRAGCGEEPGVGLGVGVRVTPDQPPLPSHGPTGPVPCPFIPTVQVHRVRAREPGLAERVRAAALAALVLRLPRPRPRGYGQGAAGHAAPAPAQPAQRAPGPGRHRRAAPAPARGAEPPLPPARLHQHQRAGAGRHAPLPRQVCHRRRVQAAAPAAAGGLRRGDGAPRRHGGRCQARARNLGAHGRLLPGRLGRAPGGAGVAPLLRRLLPARPRLQLPGPXXXXLPRACTRGSRHCATPQAATPRTTTPPATRSPASEEEGRRGGGEADRDGNPPTQGCSRAQAAVEVPLCSPGCDLTQALPAGRQARTAFQAARSSAIALSSVVRIVH

SEQ ID NO: 12448 - protein, 678 aa, Chlorella protothecoides
  MOD_RES (248)..(251): Any amino acid
  MOD_RES (482)..(484): Any amino acid
MCMDPCAACPLNTFPIRLPRCFFSTQPAATAGAGLGTGRQGAAWSARHEDYQPGAWGRPADDAPAAAALHPGPGATPVPPGAELHPVQGGCALPGEARAAAVVEPALLPPRPHRHAGGGASHPPPPGRLAEGAAPRRHLLRRLLQPHHPGQPEGRHHGDHGGRGDAALAGILRHPPRLRRLLRRLRHHGGALAPARRLLRRRGPAPGRLCAVRRRALPRARFPPPRGPDRRAGRGDASGPARRAQDGXXXXGLTAALAGATPPGLHGALKMVEHWTFSLFYCAAELWGSVVISILFWSLANEVCTVNEAKAVYPLMGIAANVALVIAGSYLKWVNASVAHGNTQVGGWGGASCDGGASTGSGGPKSRVQVEWSVGWDHGKGEASTQCSPGQAMSWGSALMLNVLVGTVIAMSGVMAVAKFVIDTYVVGPYCSLDERSSPKSDSHLSRMSCRPVKGSHSPWEACLMKCTAHPLPSPTSPPSTXXXVVFWQDGGRCARVCHGGFAMLSRLLLQAPTSPPSTLTRPFPAVLKESPKVRNLAMLVVSYSVSHRLFEFAWKGALRTLHPTPGAYQSVLADVAIATGYATIALMLLSRYVFQYAGWAAAAAATPTVMLVTGGAFFGLSIAAGAGLTLGSLGPLQLAALGVGTGVATQVCGGGTLARTGAGLLADHVQHECLEGC

SEQ ID NO: 12449 - protein, 462 aa, Chlorella protothecoides
  MOD_RES (115)..(118): Any amino acid
  MOD_RES (232)..(235): Any amino acid
  MOD_RES (331)..(334): Any amino acid
  MOD_RES (386)..(389): Any amino acid
MTVITPTGHPYVGVDFAKKLCGVSIIRSGESMEPALRACCKGIKIGKILVHREKTWSAVPRRASAGAGFAHRSSASSPDLGAAGEGSAAVPAGPAGRSSPAAPVAPPSCIAPPSXXXXAQLARRARRVSLLHRPPLPRRPGAAAPLCRQRAWGAGGGGARDRVREAAHRHRRALCAADGPHPSVRVLCPARHPGRASHLPRLPPPQAGDQRDRRGTGGLRRDPGRGQAAAQXXXXQAGDQRDRRGAGGLRRDPRCWRVWRPLLLRLRLGQAPAQNPLKLVLLVAAPGHRDTRMHRIPPSKMPCDDDACESPAHDAPLKGEVREPDVARNHXXXXESPAHDAPLKKDVREPDVARNQITPSGHDTCRPRHPGHPPKQCVWDPIPLRXXXXMQTTTPGPPPEAIRLGPYTIALSSMHSCQHNDEIGSCLGVGAVRSRRRVSCRETSSERKHSVLAKEITPVQAP

SEQ ID NO: 12450 - protein, 220 aa, Chlorella protothecoides
  MOD_RES (174)..(177): Any amino acid
MNYPLQGAIAKLFDPLVARLAPAYQAAVGNELRKVGLRYEDLYDPEFDLVSDQRVWVLGCEEDTQQSQPLYLLHARTGVPVPALVLTILSGIPCDLQDTAEALRRLSPDEVHARNQRLKRGMDMSMKHSELPHEIQEQQTPFNFYLDETLAQVKAENEERKQLGSGRPLVIRDXXXXGVVPGRMRWVTRHVDQRADADWRSEMGRNDGDECTLVLLLEAG

SEQ ID NO: 12451 - protein, 68 aa, Chlorella protothecoides
MEPALRACCKGIKIGKILIHRVGDHVLQQDTIYEKLPADIADRYVLLMDPIVGTGETAVKAVQVGLGA

SEQ ID NO: 12452 - protein, 134 aa, Chlorella protothecoides
MQQMDPLFGALAALPWVVEVDPEKARHVQTTVLDSLEGDGLLQACIMASPPVPCVWLCGHDHMLRPVHQMKPHIIPTTAGWDVRGAVHKIWAGARDYKALRVGVDPGSCDAIKAVLEHTRRYDEQYGHKVYHPQ

SEQ ID NO: 12453 - protein, 130 aa, Chlorella protothecoides
MVYIEMTPEEKSKGKAAVDLLGSQIGKSGGAWITQGLILVSGSITASLPLISAVFLATLTTWLGAVRSLARQIADYEAEKQAREEAGDPSAGTGGEHARTTPPPGPQQPSPPPGNGAHADAPTARRPLAA

SEQ ID NO: 12454 - protein, 197 aa, Chlorella protothecoides
MAALLPCLPRTPYAPAASAPAALHPPPPLPTPHGAPPSSKPILPIPPEDGQDITFEEYNELLSALTDASVFADKHGDGDLVQARAELPNMAGALKRRRDDEYHNLLPGSAHKDLERINARRARSRAEWERQLTQILDAQARAGAGGADMGTQLAEHCVRESRGHAITMAAGLLAVAVQLASAYVALSLSMRLPLKGD

SEQ ID NO: 12455 - protein, 203 aa, Chlorella protothecoides
MPRMWFLGGEIEGSGEEGSRAGDAGVARGQDGGLGVGVQHRIGRQHEHQVQGCHGLIRGLGGQVQRAFDDAHLVGAELAAKGLALVVDVHQRLELRALEQRGAVRAQQAVQHPADGPGQGRAEEHEDVDEGRGGGPGLQPVAGAHRLRDDLAEDEHHRDGDDHGGDGVGQPVQKQCHQQAVRVAQQRHNGRGGGLLGGCPRSP

SEQ ID NO: 12456 - protein, 201 aa, Chlorella protothecoides
MKVVDVPEYDFTRHRRTETPRRVPPADVIIIEGILVLHMEGVRGLLNMKIFVDTDDDVAEAVGGGWEAGGGKLLRKQTCCCWDSPPALLMSAGGQAPQNTLAACRIQRDISCRGRDVAGVLHQYTRFVKPAFQQFVAPSRKHADIIVPWTGCGPAAWALLRVGACFLAAGAAAAASGEGRDRNRAPSTLCRAMPASSIPIA

SEQ ID NO: 12457 - protein, 81 aa, Chlorella protothecoides
MTRNCMMHRGHSARKAPVLLNKGVQEDHILFLSLIAAPEAVHRVCRAFPKLKLITSEIDEGLEAYRVIPGVGEFGDRYFCD

SEQ ID NO: 12458 - protein, 186 aa, Chlorella protothecoides
MSLARVIRCPALHPDGLPVRTEPEKGGTDALRQALASEDATASTAAFSVLVPAADRYYRTHQRFPGSLQGSEVPEGEVSQLHAIAQGLLAESGISGVHLPEDATTELVRWGGVELHCVAAIIGSIASQEAIKLLTGQFVPLAGTLFYSTGRLPGVVGRAGEVSPGSGLQCTQVGLDARAKAGIASA

SEQ ID NO: 12459 - protein, 410 aa, Chlorella protothecoides
PRRGPAAALEHDREALQGALSRHLLDSYAEHLHQRAMLAEEAGRAEEGEALRARAGRVVAPCHDFLPPYPEAVPEVPLADLPPRPDSLPATPSARGRAAAPCETPESALQQRLLGSRAMPSTSGEKWSRGRLEGLLRRRSWPRRPALSKVAAHHVRLQPTEPAHTSPHPLAGRPPVYPASARQPQAVRQRRLSFSLAADAGASALDRLHAEVQGAASAAGGEGSRGAMRPARPDAGALEPLLPGDSDFEPLAGGILAADDFDAALAAAEGRVVSLSTLRRLSRNEDAQRRLSGAEAVAAREASAVLAALPRTFSRLQRVFGTAGPRALTREAVLAKLRGGAGAGTDAELEAGIRALAEHAPDYVQLKPYGACGTPAVWVDRGADARAVMGRLMALAEGRHAAREPLLPQP

SEQ ID NO: 12460 - protein, 298 aa, Chlorella protothecoides
MAPKAREVDDDDPASAALSPGRLAKREAVLSRLEGAPPPLAARLQAVDQGVERVAQGAGAALSSLWGWGAGLARHVEQAVDGEAAGADAGKAEPRQPSAAPSAAGLLGALRATAAQLVAEAVGPGGDSADEGAGVRPRSGGAREALTLDQSLYVYGGSQAREELQELGAECSRLGHRACAAEQDPVRRAALEDALRTLAEALGSLDEGAGAGVGGAEAGGDAGARGSEELARDGAASTQPTESQWAPPPRSAALERGHAVVRDVAEEAVESAESLGSRADVLPAGGFFPSLCQRGKGV

SEQ ID NO: 12461 - protein, 957 aa, Chlorella protothecoides
  MOD_RES (24)..(27): Any amino acid
MVPRSPPASHTLSAPRRSPPPARXXXXRSRWYPAPRLPPTPPPRRAAAPRRQGGGASLGHAHDGGALEHGGAGHHGPAHAGDAARGLAAHGHALLCGAACQRDAGHGVLVDADAGGGAHGLPALAVEGGEEAAVAEALLVQDVEQGPLEGVQAHVPNGRPDPGHDDVAQAADDRGGEGGLGALQRHRALVPEGVVVAGGHGAEDAVLQVGARLLVPVEPKGGDQGGRDLGHEEGHVREQPRARQQRVLHAADDKHQRLPGHRHLWGYERGKLSWGPHRAGLARTSLAHKAWGIVSQDPPVRRREWGPHPHPFPTTTRGPPETKPHPPSAHLEVEEGAHHGAAHVSLLGDALVQDVVLVAAGAQLLGVAGHGAQGGARGGTRGRDGEAGAEVGQRLLGDVQADELGLVLEEVEVGGDVVEHPGGQGEVQAVHDARGEDGGQVPAVGQAGRGHAVLGQRDHGAVVEHGQQDDEDGGEVPVVDDGEQAKGEADAEGHGHGVARVGGHALEDLARADDGAHNGVQPRLGEHDVSRAARRIGGPRHRDAHVGLLQRGRVVHAVARHAAHVLALLQHLDNHELVLGVDLREAVGVLDQVLHRGVALHQADALLRLQQRLGGEHVGAHAQLLGRLLADQQLVTGDHLHVDAHLQAPLDGVLGVVAGGVEQRDQAHHHPGGVALVPLRARDAQRAEAAVGVLHDLVVADRLDLRAVVREADHHLGRALHHAHLLPCLHVRHARDGDLVGGVEGHKLGQLVLAPQRVALGVGLVQHHVDGLLGHDVGRQRAELEHILDAVPGHVVGVHVVHSQLVQGERASLVGAQDVHARHLLHRRHARHDGTLARQLEGAQGQGDRQHGGHSDGDASHDDHQHVGQGGAVACGVGVPGSRVCRQVGAEAGTRSGAGDQVTRDSVGDSDAGHGRMRGTRNMERRVAGGSESTGIRVEEGSTGGAGDCAHHSLQAC

SEQ ID NO: 12462 - protein, 92 aa, Chlorella protothecoides
MTNTDDIKAADMSEERGSEPVKEGDHVAWKWGAGMVEGHVAETSTEKLVKETKPGTNITRNGTEDNPAVYIEREGNNVVKKQSELYKVHDEK

SEQ ID NO: 12463 - protein, 617 aa, Chlorella protothecoides
  MOD_RES (32)..(35): Any amino acid
  MOD_RES (181)..(184): Any amino acid
  MOD_RES (336)..(339): Any amino acid
  MOD_RES (525)..(528): Any amino acid
MDVMVGGHQCLRFLRTAPSVGTRCEHETSCAXXXXHPLRGDLSHGGMGRRAARSILTSGTIGSSAITEPSTSPPSLSYPGVKANGLQLADFEGLRGVQATQPIQSGDTLVNVLGPAAIRVLPEDSCPCTNFVRPDFWKQAPWQVETWLSGTRNIFVTADGLCKIFGLFYVARLTHGCSSPXXXXETWLSGTRNMIVTADGLCRIFGLFCIAQLTHGCSSPRPRPSPAPGMPRLGCSSSRRGQDSCQPPTRHTSASSRSLWTPLSCGLTLSWTCWPTHLCKKRCLLHGLCGESGITCFPGRSTLPCMILQPQHHRCTCSTHWSAPTLPITRPLPLKXXXXGACSMVCAHTLEFPDASHHAPTAAQITPMQIKQQRREWADLYTAFSEAYCGPSPAPDKQTFLWALQCVRSRAFSGPHPGPPIQQRLASGAALCTLGAAYVVWAHVPLESALNAAIAAALFNLLYDVLLSGRRRWYALLPGVDSINHSSHVEVRAFDPGCLVGPCAPAGWALDPKLQAPPHVFQHRXXXXGPCAPAGWAPDPKLQAPAHVFQHRNDHLAPPQSDVAYRVFGDSFELTTGSSFQPGEQVFISYVRGRFGVVEEVGDMLAGHTWPPAVQHS

SEQ ID NO: 12464 - protein, 538 aa, Chlorella protothecoides
MLVIIVGGIPIAMPTVLSVTLALGAFKLAREGAIVSRMSAVEEMAGMDILCSDKTGTLTLNKLTVDHVNTYNMSGHSIEDVLKFGALSANIVTEEPIDMVLHESYPERDTLWSEYKLAKFVPFNPTDKITIASVTDVKTGEKMRVMKGAPQVVVRFAHNRAEIESVCHDKIVEYANRGFRALGIARAEGHEGDPTWVMVGLVPLFDPPRHDTKDTIERCLEMGIHVKMITGDQLLIGKETAKQLGMGTNMFTTEALLKAKQGIGLVEGHASVEDLIENADGFAEVYPEHKFMIVKVLQERKHMCGMTGDGVNDAPALKKADVGIAVAGATDAARGAADIVLTEPGLYTIVGAIIGARKIFQRMTTYSRYTVAMTFRICFTFGLLTVIYDWYFPTILIVLLAVFNDGAMIALSKDRVTPSRLPNRWNLPSIFTSGIVYGLYLTLSSWVLYYVATHLDFFENKTKLVSLNVTEESLTNFCTSFAIPAAGATPGATLCTVPSYAEQLGASCDQYDVLNQCIAEQRYVRGAMMRSLLYLQVG

SEQ ID NO: 12465 - protein, 202 aa, Chlorella protothecoides
MRALVFVVRCVEYSLLSRAGLLTYVAFFVAQVASTLIAAFGFNGYEEPSTNLEDCVFCTMSSGNHNPFWNKRAVPLEGTESAFTASVIGCLGYVIVAWIWSAIWYMGLDPLKWALFYVLNEEGFRNGGFFSTFYGQRGEAMGTSAGVGINKNSMSRVSLARGSAQQRVSMGGKTSGGIPGVGGSMVPGPAMLERASIVRVPK

SEQ ID NO: 12466 - protein, 218 aa, Chlorella protothecoides
GGEPHPGARSHLHPVRDGVQGRAGKIYKGFTLLTDQSACGRGCLWRLCSRPADHPPPSNNSVQFTVLPFSHRLQQAPQYTTTVKIASKDKTLISVSPSSVTFTASNWSTPQYVYLTAVDTIPETESAESFELSLTWPTVSSSGVHGSRTKTITGIVRSDVQGTSFFNPVVVDSLPFAVEESISVRGPGVETRTLHGWGAPVRLGAGRWQCLQRGTVPC

SEQ ID NO: 12467 - protein, 547 aa, Chlorella protothecoides
MAKTKAAVKPAVKAAKAEAENLSKKKQGSKKKVCAGEGNPSGACHLSRAACPSTPHTCPGGACICCISRTPPQPPPAVIPPKVPEPESSSEESSSDEEVAAVVESSSSEESSDEEPAVPAKKAAASKKAPAKVSGVLYEWGISIHGGLCLARRVVALLLKAESSSEEEESSSEEEEEEVKAAPAAAKAESESEEESDEDESEEESEEEKPAAAKAEESSEEESDDEEESSEEEAEAAPAKGTKRASNGKAKAESSDDEEEEEEESDEEESDDEEEAPAAAPTPAPKKQKAADGSAVDASAANGSKTIFIKNLPWAADEDALREFFAEAGPIAEVRIAYDRETGRARGFAHLSFETVEGAAKAITLSGQELAGREVYIESTTEREQRAWRFGRGRGMGVGACPTRGWEGGCFTMNTLSSPPCCGLPCAAWHLPPALVWSSPPVYLTPGLSRSGHRSSHGLRVPAPCSPPSTLLHLLARAPSPPPLLGTPFLPLHHHPCDGVGPRVPRAPPTAISKGCCLPHQHTALQERRTLMGPGRRLSSLPGAPAC

SEQ ID NO: 12468 - protein, 162 aa, Chlorella protothecoides
MDRLSTIFQPTHPPPQHPTCPPFHLFLTGTPGQDRFAASEGQTLFVKGFDSSLGEDDVRAALTEAFGAYGEVTNVRLPTDRETGSMRGIGFVEFSTSEAKNAAIELDGAEVAGGWLKLDLNPSSGGGGRGGRGGDRGGRGGGRGFGGGRGFGGGRGGRDGGR

SEQ ID NO: 12469 - protein, 184 aa, Chlorella protothecoides
MCTCSGEGSPSQPCLLTGGGEGFARVMDPTLSLDLGHGSKCWGEARCGHSFMVHSSLSNATNPMPFTPKIAAVDVESGVQHRRGCNCKKSGCIKKYCECFQAGIACGEHCKCEGCKNCVDNPLRAAAGSQKRGRTSGPARQGAESEPGLSGATLDSGSGVDEGLGQAARPGSTGAAPAAAAGGG

SEQ ID NO: 12470 - protein, 317 aa, Chlorella protothecoides
MPEPSRYETLSIEQKGAYAYPSNHELDTPELPSTPTAPLARPRAVSCRTRTGEAQDVQLHLAWVHSVAGLELGEWKLLDPHRTLTCASQNAARGDSPIHTRFLAVRGRLSVNGVVWQVECDIAPDPLPKTSPTLTPFSQVGDWGRDGKHNQSLVASAMALKAATLQPDFIVSTGDKCVQGGILVQGFYQSGLVWPEDPQFNTSFIDIYSQPSLQLPWYAVLGNHDYGELKDDAQPDDQPPVCSSLDSESCYYSPLHQDVWGSQWHPRRLFCNACCLVSAVSPMHFQHSVRNSLSSSHPLLPLTAEPAAGRQGLAMAV

SEQ ID NO: 12471 - protein, 348 aa, Chlorella protothecoides
MPSHLGSLHAAVAAWRSSFRKVVTSPYGNLQPLTGNPRLPLETILLLPGLAVYSAKNGARSKQQLRTHGVPPPPDLGHHGPMTSSPDGQEAANPLERGRQVSTFYSSVVAGEPPASSAAPATQSHDPLPVQPTGVLHPGDAPKPTAKRGVFRPGGVLTDVFTSPSIDSGAFTPHNPQPRALAAGAAIPSSNIGHRLLKAAGWKEGQGLGAPQTTGRRRVRWSGGGRGRREEGGAPGCPTPAWGPPCRRGPGYQGQTRQAGAWVQGLRCSAVLEAPRMAPAESHGPPSTPAPSLTSPGQVMRAEADAAHRQAIQRYIHRALSATDGGPTGDSNPLVRRNERLSSSNPLL

SEQ ID NO: 12472 - protein, 105 aa, Chlorella protothecoides
MASGTSLESSQIHSVHAGAALPAHDPWSLHSPPPLPHTPRLHSTETALKAPIPGQRNILITSALPYVNNVPHLGNIIGSVLRYVGVCGYRHERSLRTPSLACIPS

SEQ ID NO: 12473 - protein, 86 aa, Chlorella protothecoides
MIQDARGDQCDKCGALLNPTELLNPRCAITKTVPVLRETRHIFLDLPRLSEQVQAYIDATSEVGGWSSNCVQVRGGCASGVELERG

SEQ ID NO: 12474 - protein, 109 aa, Chlorella protothecoides
MLTQNFTSHTTLPLLFPTPTPGANILQSTARGVWDGPAPQGSSAPPTHAEDMAPTPADSQQSTVTLPGGSVMPLLGIGTYKLDSVEALHTALDGRSGNSGILRGGLLCV

SEQ ID NO: 12475 - protein, 298 aa, Chlorella protothecoides
MQGRRAELFITTKIWNDEHSPAEARYHMQLRAGPVHPRHSWRSVLQSISELGSEYADLVLVHWPHAWKAGTQEDDPSVTLQDTWGALERLVDEGLVKSLGVSNFSLGQIEDLLSWARIKPVVNQVELHPFLPQRKLVEGSLAKGVHTVAYSPLGHSKTDLLANPVVIEVAKDVGVSPAQSEGGLLVEAGTGGILDISACPDDHDTLAMSQVLLRWNVDRGVAVIPKAGSLNHVKENLDLFSFSLSPAQQVCKRSLCVASYTPLAVLHVCHYSRAIPLAEEAGRPGERQTLRQHILALI

SEQ ID NO: 12476 - protein, 958 aa, Chlorella protothecoides
MLPAHGPPGPGSCRWMLHRCGGSRLRENSVLIYHSQGANLGFTSPKQTLHPPLPPSRAVTRASSFFRSYVPIPTSGNKAPLESSTVSDALPPAMCEQSMSGSPRVHTSHANLLGQAHGRMPMLACGHEQEQSAPVVMMSKVLQRSDAFESFVDLGLLSASSTEGLAAYLPAAGSMPKTCWNSNSLGDHLRDRRPSLGNMALAPMWHVQYSYVGFAQHSHEIPTNNRELDSNPSANPMPSCGTSMAGFSLSEGTCTGNGQGRGTPILTRITWSSSSHSEPVAVRPGQTHWLQVCSRSPGTEHKVQKLYRGICIAQCHAPSTGTSKHWAGTLFQPLLIMTRRRNGHGGLEAARGQDQDQGQGPIALQWCPQDSRGAGLPPPKWDEEGLPHRHPLPPQGPGLLRSQDVRSRRGGAVQCSPGGQRGVPCRVRQAPAPGERAAVLLQRRHADVLRLPHLSTGWHLPQHQPGALTPAGVGCVAVGELGPREGQACPSPVHWPGCLAARPTVATMTVGRAPVRLAGPHIPNISQPCTLTQFQLFLLLQTPVAGGVHAGVGPGRHPLHGRVARHAARAEQAGGPQRLARGHRGPAGRGAGPGHAGEPPGLAGPRHRPALPGPAHRGRAPAPRPRGGRPAGPEGGGGRPAGPAALHRHGCAGRGNDDHAGLGRVSLEGGIPVESGPTTHLFVWLGNQGLRREGGRCADDARGCVAQRHHQSMPVWITNPGSQQALSPVGPGSCPVKCTPSPTGSSLLPGAKPAPVLPHPYSTPIPTLPPPLPSKGSRRRGTRCWTRGVRGCRCLKPHGKPTTTTSLASFVAHNPLLPVARDETPPQPKPPWTAQELRMQANATLQALQPQALVMSAGGTTAAQSGLYDSALLPGMHRAAEIRQAPGAAAGSEGPSAASGAGAGAESAAGPGSLALPLSPGPLQLPAPPSPRPSSAPSQSTDTTPAPPDPARRCASEL

SEQ ID NO: 12477 - protein, 251 aa, Chlorella protothecoides
MPSGSADGNANTHAPQTCRGALERLVDEGHVRNLGVSNFSLGQIEDLLSWARIKPVVNQVELHPFLPQRKLVGGMLRKPCRPPDVRAHTGTHTAVTSAGLAGHCLLPAGPQQDRPAGSPRGGGAGQGAGCRARPGEWPAVPASCDVGAVPDACNAADRSGPAHATPASTPLSSQVLLRWNVQRGVGVIPKAGSAGHVRENADIFSFSLTYAQKVRGGAAGERRAIPKGHAKLDALENGKRFVNSSWHNWED

SEQ ID NO: 12478 - protein, 442 aa, Chlorella protothecoides
MEAQRMKDSLKSAMLVSKAGNAFFQETEIWVAYKSDRDAAAAYISACGGLVLLLASLLEPFMPAFTAAALSQLGVDKVGEGSCDGRRDADGLHGRDHDQRVPRCQVLPLDNGIVASSRSPATILPAGHALGSEAVPLFRKITEEEAAGLRAGRARPAACLPTHPNPHRPPSSSYRFAGNQAEREASDAAEAAAKLTLGEEKAPAEAPGKKVKAKKAAPADPATNRPVDVSRVDLRVGLIKKAWKHPGADSLYVEEVDLGEETTRTASFPGRGRGRGDEFELQHLRPCRGFERVSIRIGADSPPASLAPPHSPCPLAALEPLFLLLSNTAEMQERLAVFVCNLKPANMRGQRSEGMVLAANAPDDAKVELVTPPPGSKPGDRVGVDGFPGEPDARLNPKHNIFEAVSAELGISEDGVVTYRGKPLGTQNGACTVPTVRSGIIR

SEQ ID NO: 12479 - protein, 135 aa, Chlorella protothecoides
MAPEILLATSGKPYSPPPWYRAASRNAAEWATQIRAEGVELQVYPDEISDLAAVRYAVVLNQPEGFLAQAWLACPNLEAVSGLGHGVEYIAQEADSLPDHVQLFRIVDTKMAERMANWCLWAILNCQVLWKWGGG

SEQ ID NO: 12480 - protein, 450 aa, Chlorella protothecoides
MYPSYAQVTFRTRIYHCNINSNGQICLDILKEQWSPALTVSKVLLSICSLLTDPNPSTCMPGGECFEGGSGGTVCPFPRVHPFLRGTGIYQMEASPSQILNPQPCLSGVDSAVCAGLTASWLAGLQWTPPRHAHAWKHPASARPWAGLLRGPLAVRRALLRADNVGGGGWASRYSAGQGEWWQRRAAETGHPAAGAPAPIAQLDAPRQHRARVPLHLGRRVGVLAPLALRQLAAHVDLRRGRPLRELEPAVAEGVLVDVGLPAPTLRRTPHKRVAGQLIQVPWECEKAQEVCHGSGIISAEYGAQRCAVVMAARARFAEPPPRTFEEPLLLNLSPRTKSTSPPAHTRLRHGLVGEAGVGARLHAGLRVADAPAHGHAVVVGAPLDVHAHGRRQRRRPQLGARLAPPARDGGGEQAGLLHVGILVGGGGAAYPRLMDQLQGCSGTYGDMLG

SEQ ID NO: 12481 - protein, 150 aa, Chlorella protothecoides
MNGSRVVPESSPHAKRSPPIAQAAAIPLPMVKSLLGPYLVFLCSTVNGVVHSARHGLLLGDNSLQKPASTLPGTGAIPCRGASHPLPPLPTPGRQGGGQGALGRGRQRGPHLPRGHPARPNPLRLGRRGGEVAERPAVPGRRRAHPQAAR

SEQ ID NO: 12482 - protein, 650 aa, Chlorella protothecoides
MAAVTKAIERWACGSVCTSWSRTDTIMAQAPTRHSDFRDHRPLPLSEIYELYSEVVNEGRWTNGLLEMWCVGILGSGRIKQPSLPSTYLAGTPSSGIRWPGGGRAWEGEVRGVQYLRPRNSPCQHPSPACMASATRFCQTSEIPKSRGPCAARLRAHTPAPRLQAHALALRESLPDPCHRTCEECYWTGLRQTRWARAVYAANLGREYVFPYQNIGHKSYKSDIKALCWSPETEASLLPEHPANPSSPTTGCTASCRACSAAALARSSPSVGTCCSTLGRSTAATRERKCDGAMCACWNRSRGASGSANSLGPFLAVDGAELSESSSLLLIPVAHAEHYVQFADPGLHSLMPTPLHCRRYKLPSTFGLPPGIDDFLAAARSAREGTHELVACRTYEHPPPTHTQCTFCVSTAPATSALGGVAWCQSAVGGVCPAPACAWPSPYAACGSACPVLGEPLSHDSSVPKIPPLPFSRELRELAVRGVDGPGMHILDVLPNSFAGAEGEGWGGEHCASSQLRAGSRGANEAIREREELVNKMTAHPPKFFKSRVKRNPLVLSTVVEVAKETALRAKQGVTDDAGSTATSATSAAPLGWISYPAGAPSTQTMSRDEVDVEQADLLHGPDGKPDWQALGTELHAALPPLQRAWSVAY

SEQ ID NO: 12483 - protein, 342 aa, Chlorella protothecoides
MVLVKTAEPAAGDTPRPHLHGLYDKLQHPLPSHTVLIDEAGQASEIAALQPLGFGAERCEGPGRVHLVGWEWVGCLIHDQDFHALQCVLKVVLVGDPQQLPATILSELGREMEMERSLFERLQRCGAPVSMLSVQYRMHPAIRQFPSAYFYNNKLEDAASVLERPDEPYYAHPLMKPYVVFDVARGQEQRARAATGSVSNLVRLNQEGPWAAFTAAKLHSCVSQIEAELAAALFHELRAFLITTAKENPGEIRGPTSVGVITPYREQRALLRKVFQDVVGKVAAAERVLVCTKAASNLHLPPAPPPHRLQVMIETVDSFQGKQLDVVIFSCVRAGSGGGLGA

SEQ ID NO: 12484 - protein, 396 aa, Chlorella protothecoides
MLGLVATPLATAGQGCASPRCTPAAIRTWGPPALRARHAHPFTPCRLTKRSPHPLVQANSTSEQTYAKPATASEEYVLDSDFRIERVRLGMGEADCCWDGHWMDLCLSLASLIRYHPEPPGPGSHGVRLLRLLLPPARRRRLQPAAHLWLSPDPSRLRALLRAAAPRALPQRAQRGGCQGITSHRHPETGVESVLSAFGVQRGVKAVESWASAQGFGEEGTCLHPGFRTSDTHLVREDVTRFRYGDEQHLDEALVRIFKIGQPRGLARRLTPKLKGVREEVRGPENAYTLVLEFAAKPQMERSAWEERQEKFQSFFGPGVVALLEPTEEVGLDNAHHMVSSEVQGAAGHEGQHPRETMCLHGHYAVATTYPVSTQALLIATWRCTAGHGRRAGRGW

SEQ ID NO: 12485 - protein, 80 aa, Chlorella protothecoides
MWILGAVGKLRADAAWGALIRDAEARGVVIQDADANSLFPDMEYWQRKAAGTPAPQDQAPTAHPAGPCLPRQFPAIPSRR

SEQ ID NO: 12486 - protein, 395 aa, Chlorella protothecoides
MEGVVEGHGGRTEHGVVWVKHEIQERPAPPAPGPWHPSPTFLGPSSSNLHTQRRHRLPPASPPPTAPNPYLARPGGPAAGTPAGPPLVVAGQLGQAALVVLAQEVHGARAVARSHHLGVRGDAHHARARQRGEVGVLELLAHRPGDEVALWQLPGGQRGARAARRDGALQRHLGHGEDVGQGVRIGGHGAQQDEEVVGRGVGHEQQVVGRVLVVGGHVERHHALQEGLRGGVEGEERVALHVVQLAVVGACRPITRHCLPAITWRLGDVLGGVQAQQAVQPLLHLVARGVADWVAQDDLAEGAAPAAVLGRGRLALHLGALGWEEGAMGETPRGMGWHPSRALVDELEGQRAARAFIPIHGGAEEDQVGAQQRLDHGQRDGRRLCDGWGALGVRG

SEQ ID NO: 12487 - protein, 196 aa, Chlorella protothecoides
MRSLPLVLLSVPPTQPTPFHTGQALSTDLLSGLGAAVVKTRPRILVCTPSNAACDELLARVMAQGFCDGSGGRYSPNVVRVGADVDGVISPAVRGRSIGRLVDQHRTMIQSDWQRRFADASRRRQHAGREIELLEAALTRCADEAERMELAKARTRGGAGGRGQGASGDVLVCGRRMYGRWAGGLGRAKGRVVVGR

SEQ ID NO: 12488 - protein, 204 aa, Chlorella protothecoides
MNERKIIAHRAFLEIDTLHCLVNLGVGIPEGVAVLKASHGRDNPAGATATLTTEAGVFGGIPAGGLRFGSGYNCEALVPTASMIDFYSGGGVDVCVLGMAEVDGAGNVNVHNFGTRAPGCGGFIDISQSSKKCVFVGTFTSGGLKGGKLVILQEGRTRKFIKAVVEKTFAAALSQGRPVLYVTERAVFRPLGVYVSGLCRYWGG

SEQ ID NO: 12489 - protein, 185 aa, Chlorella protothecoides
MSTPEKIAAAIARKEKGNAYFKAGRVGRAVRQWNQAEEIIKYDDAFSAEEKEESRAVKKSVQLNLAAAHLKEGSWTEARKAATSVLDHDSFNLKALFRRAQAYLGTFDFVEAEQDIKKGLGVDPNNADFNALHRKWKVAQAAAGKAEAKLYSKMFAPRPSAARPQAAEAAPAAEVAPAPEPIAAV

SEQ ID NO: 12490 - protein, 191 aa, Chlorella protothecoides
MQIWRSVSRTRAAGGAPGEADRGAVLAEAAARLAAEAGDMLVLAGRRYREVLQADPGDARAFLNWGRCICLRGELAREAGGSLEEAAALFQNAADKFDAALDAEGQTAVVLQHAGAALTDAADALLTLDRAQARALAQDALPYLRQALALDPRNVDAQGRLTQVSGWGAVMLMRDEGAAGRAAPGILDLDS

SEQ ID NO: 12491 - protein, 131 aa, Chlorella protothecoides
MGVCWGLEERAAAWIRRTHGAFKYMGEWEAGEQCGEGKCLYADGGKYDGEWRAGLRHGKGSYSHGAYKYNGHWVEDRQDGAGMCTNEAGDKYIGEPEEWSVEGYLCLALCQACRWASLRGRGVPWGGILVT

SEQ ID NO: 12492 - protein, 271 aa, Chlorella protothecoides
MSDILNDHDMDGDLALEDEFAEAVDEVGKEIDVSKDGGVRKIIKKVGAGYEVPEKGDKEGQQSSTCCLLPKADAPILPPPYKQSATVIIRGDYGYGAAGSPPKIPANATLHFDIELLSWRSDKDLTGDGGVIKTILAEGKGWANPGKDDVITLELKATSLEGTDTVYTSPEGGYQVTLASGGADAPFFCRALEVALPKMKKGERATLVVKPQYGPVQGPGAGEALEIEVTLVDWQKVERLPGGVVKRTLVSTDEWQTPNEGGALRWALQGG

SEQ ID NO: 12493 - protein, 124 aa, Chlorella protothecoides
MFKAGKQHGKGRCVYADGSKYEGDWEDGQRSGKGVCIYANGDKFQGEWLRDARHGRGVCKFADGTRFKGEWEADAWVQSAAAPSRCRVAGAGVTHATAGVEASFVIQVRCGAGVAGGFNEGQWG

SEQ ID NO: 12494 - protein, 800 aa, Chlorella protothecoides
MSLALTHTRPLAPRHTSWAGTAAHVTRIPRYTRPSLCLAGLRGGLRPGPMHRTGLRCARALPPDAGSDTGPNPGWQTFWTTLDVTAWLGTVGSALAFIITGEMMLTAAPVLLPILALYASRQRERLAIQATQASTAAALVSVLREQAERTAQDNAALAAEMRGSGSGVQAALKLVEAKLSTIEASVLSTGSSTQILHQDVTAATGKLGARLSRQLEGLAGEVGRLRGAGSSAAAEDVAGLQSALRSLEARLQETQSSGQEQLSSEIAGLLAAKQQEMQWFFTDKLWKEADQLKALLASQAATGVRGASAAPGADTAGLLDALGAEVREALRQVRQEGEPASPRPLDPEQWAALGRRLRALEDALAPAADALGGLVGRLDALQAAVEAGQAAQGGAEGTARGGAEGTARGSPEPVLAALSLLRADLRAMLAAERSPSKAGATGEASPTTEALPSRSEDALVLDVPAQRVAVPEREAAPGEPVAVRDGSEGVELGWEAARNGREPATREEAYARMQRLVRADTAEEPGATREEAEEGMAQARGGQAAALPSWLQLEGAVAARREDDDEAAILSGGSSGSEEAGTSSRDPAMIDQAGGATQAGVEGSDSWAADGAREGAQTTNRMTESGARWQVDPENRLQADAVERWQADSNDQWRADVGGWSGAAASLRDSGAPTDAAVEDGVFTIPVTANSGDGPPVPSDHHSLFAEAQQDETAHDATQTSSGKRSGGGVAAARAPDRDPEASRLEPLETDGPMAASTGKSPSLIKATYDLGLQRLKAGRILASTPGQRWDVAGRLLLCL

SEQ ID NO: 12495 - protein, 340 aa, Chlorella protothecoides
MQCYEEKPVPGRGLGLVATRDIAAGEAVLTDYPLVLYPQFSLRYEVCLHCLRRLPSDGASSSSWASFCSSACAQAAARDPGSHNPAVAAAEAETRFEGLGEEEASALLLLLRVATLKAAAAAGDTGSTARLQALTSLSPGCPQPEDAAAALRARLPGDGAGLTLEEVRAVLERDGSNAYGIALEPGVADGPIRGSALCATGSRLNHECLPNLARQDAFDEARADGDPGSNTGITFRALHAIPAGGSGGLGGGGSLASGAYWAIGGRASESTALHPPSGEELTQSYFPLWWEYDERQSRCREVYGFSCACPRCKVGGGMRFPCLADRACAHSPRHAALHMV

SEQ ID NO: 12496 - protein, 67 aa, Chlorella protothecoides
MSLLPFLCPSSSSSLSSSSHPPAVGEGRLELVEVAPGVDIARDVLAHMDFEPVVRHVKLMDPRIFQA

SEQ ID NO: 12497 - protein, 500 aa, Chlorella protothecoides
MARFPWVVAFVLPPRGQEEGLTVEVHARMSMHQPRRQPPGSSTVHPSPSMQARDEDGNRRLEGGDDFSAALYSPHAVVTGSVRDLGDGSYAVAYVATVAGVYELHVTAGQEHVAASPYPLRVDSGPPCPRRSAATGEGRGRAVTGRPARFSVLLHDAHGNRCGAGAPATGVPLETELTGPGPAPPAVRVAWDEAAGRYDCEYCLTSPGLYRLHLASGGVPLPGAPFSVRCVVAGEDAEVEESRAGPGAQAQDCAGQGLESAARPVQDLTTRWEEIARAAYLLDGDAAGWDSDGEAAVQRTPEDEYIKTLGVDGREAIPSAAHYGDGGRLKACTGCVEDKRTQALLATTRATCTQRPSHPPAPPCTQAHPDVPVVENLEDIWQVSKLQAERKEKEEREKQARLKNPRAGTPPTHPSPLVTTNLQEIQSKLGETFGEAQRPAPEEIRAAVQEIFAAEARLEAASSTAAQAGGCGPLPPRRPIKLSKAQLHAAAATLDDLDDV

SEQ ID NO: 12498 - protein, 352 aa, Chlorella protothecoides
  MOD_RES (111)..(114): Any amino acid
  MOD_RES (203)..(206): Any amino acid
  MOD_RES (236)..(239): Any amino acid
  MOD_RES (324)..(327): Any amino acid
MAAHASKTQGRVGLGQAQRAVKVGGVAWTGTKVQFDEAGEDGAQTSGAGCHADAACQTQAAGPSTEARPWEALVRWKAVTQEFLLGAKPSGASLKRVGRHVVSHVARALAXXXXVEGGDAGVPARCQTQRRLAEESRAPRGLPRGRALAGQGTRARCHARRGRNRGGAAPEAAGQPPIWNAAFRCRQQTLSTGVHVVESLGTXXXXQASSARGVGDLRGWSFAAFWAGIAQRALAXXXXNAAFRCRQQTLSTGYMSLSPGVHGLPFSPGNSQEEVSEPTAQGRAHGFGRSAARLRPASGRRVPLQKAQERVQAFSPLQRPLHDXXXXLREESPPPEAAGAGSSLRPPAAPAP

SEQ ID NO: 12499 - protein, 340 aa, Chlorella protothecoides
MAGGQLHPCVYTVVSESRKRTDSKRKARPCGTPSGREGATSGRAPQVEGALSSRGADLQGVLRPNLHSESWDWMLVVAAAPGSPCAQQPPRSSDSSCQQIPCHVGAPLPDACGLSPISEAGPAGPTGDILPTAARRAAALRLLQPRKPPHARRPGSPGGDTGAGGRAKLLTGLAGARQLPAPTRSLSLACLAGAAAAAVRRKGRQAPGAGHVRFSKFLKEYEEQFYGSSRSYDRAMEGQTDLAAALARNVYMMDPEKHEAANLMARYVRRTSFVGSSISSHVPPSCREIACLALTPTEAVMEGNIKFSTGFYSHMPAEAASRRTEDLATATTAGAAAAAL

SEQ ID NO: 12500 - protein, 545 aa, Chlorella protothecoides
  MOD_RES (290)..(293): Any amino acid
  MOD_RES (385)..(388): Any amino acid
MFGMHRRAPALHYWSARVGLVPSVHTALQGLPQQPSPSLPSLAESTRSAQEGAVPSPPNQNSSQASTAASASGALSEEYTETMQARMGSASLVYCHEDGMNYTRILDNLIVGSCPQTAEDIERWAAARGRQGLVSIEFEVRRRCLGPVYEEKPDAPGTAFHIGARIDEEVGTILSLQEDSDMAYFGLDLAPILAACSGRIDHVRRPLRDFDAHSLRMGLPAAVAALQGSMQRQGGTAYIHCTAGAMMCGHILGEGGSLVRLWGSGSEAQSAPRSALGWQAVRGPTAAPPXXXXPQALGADLGWTFSGKATALPPIPQSRPGPCSRGGPGLHVVGVRSDTPPCTRTPHSPAPLQPQAGRRASGRAGRAAGQEGAARGPAPGRPRNXXXXGGPGLHVVGVRGAAPPCPRAPHSPAPLQPQAGRRASGRAGRATGQEGAAHGPVPGRPRHLPPCAGRGAGRGLGQPRGADSAGAGLGAAARAAPGRLPLQVCRGGAVDAVARPPHDARRRQHQQRPAHRGLGGHAGGRLLRILVRFRGRGKVGRHGGT

SEQ ID NO: 12501 - protein, 278 aa, Chlorella protothecoides
  MOD_RES (157)..(160): Any amino acid
MLGPSILQPGDTAIDATCGNGHDTLTLSRCVGGGGRVVGFDISAAALQATRRRLEEELAPEAMPELKLVHAGHETMPEHLGHDSAKLICFNLGTKGSSRVNEGKIQCWTWGTISAVLIENRRPCSGTFTLPLQKGCSLTHTCLLVPFTTQLSTRQRXXXXDARVQEPSRFCCIRAVLSHTLASLSPSPHSYLPGSDKTEATRAGSSLAALSHAFDILQPGGLLSVMCYTGHPGGVEETDAIISCLSELEPASWVVTQLKLLNRPSAPLLCTAWKRVRK

SEQ ID NO: 12502 - protein, 294 aa, Chlorella protothecoides
MSDFSTCYHTARLGPSAECLGGHQLRLPVAVGPPRIALAAAWPQGTRGGCQEGGKAALDALTEVLKTQAEGDPPTAKLHKVWDAWRKVGSCGRPLSYDSRRIVESAATSVLRTQVHTPTSQAAAVAASPAPAEKLPAPSVAAAAAALAPPVEDKARLQAEKDAVRAAEKKAREDAKAAALQAKVDLKAAREAERATAAAAAAEARTQARAEREAERERQRAEQEAEKERQRAEREAERERQREEQEVRAKWEWGVGTSGVQIGLDDQAARALPSYKSLHPLVLNFFLDAWSPCA

SEQ ID NO: 12503 - protein, 296 aa, Chlorella protothecoides
MKLPPGHVAGVGVVKPTGYGGYGERMLKTMGWDKGQGLGRTGEGIKEAIQVKKKEDSVGVGGRASWKWDDNWWERAYSESSAAIDAVKKDEDSSSSSSSSESEDDATTCVSRRNRDGTASSASAHELALLDALTQGGSRLAAGRFGGREGKMSRIRAQEAREAAAAAAALGTAVPDGRTSKSKKARSDADARPASQEPAAPRIVVEVHSAEASAAAAAAAALWRPTELEGWWGRGMFSPAGVLEGMRKAQEDAKRGFTEDDQVEGGPFRGMGWHTCLLRTTFPLSCQRQRAARAGL

SEQ ID NO: 12504 - protein, 181 aa, Chlorella protothecoides
MAGTPGAAGPRGLTPNTGGQPAARERGYAELFLKPEGEPGAVPPPARGDSMDAELARGLGEAESERAFGEWLVRARAQRRAATLEPRLGLPPSWARRRGAAEAARERYHRLRDDGVDPAQVRTWRRKLLWFPADSARPAFHGSCSGAPRGGVGPRRPWARDPVLDYEVMSDLDWEEEPEGE

SEQ ID NO: 12505 - protein, 201 aa, Chlorella protothecoides
MGLARWLAAASQKPYVRVGVQCHTLPSPAQMGVGTLVMMAIVSPVSVWSALSLDPVVVSPTSSILLLYWTSALALHIGMSVLQVAAGIMLASPMGALVAAGVSYLIAAINGGSQLESGTKVRGAWARVARLPGPAATPLEASCPDSHPDGCAHALQSGLKCSVRGIPGPTCHTHQECVGWDEERCDQPLPHPGHLRCSWDE

SEQ ID NO: 12506 - protein, 270 aa, Chlorella protothecoides
MGAAGALGTFAWNATASRGGVLFGGLDWPRSRRVGPGPPPFTHSPNRHSGAGGRLWLRRAGPRRRGGALPHGVVNVARLLLCRLQDLEGAHERLVHRHHGPRVVELAAVVGRREDGHQLALGEELVAVLHHLVRAADEVQVMLVQELGDGPQAKGVADAAVVLAPPLHVLVWVGPEQVAEEARVGDVGGAGDALDQLQRLELGGEAAVHAQDLLVDQRRHGQAVEAVGECLPQPDVVPPLALVVEAIDAVDGRALMVAPQQEEVLGVLDL

SEQ ID NO: 12507 - protein, 342 aa, Chlorella protothecoides
  MOD_RES (47)..(50): Any amino acid
MLMTKAAGFLEAAPGHACHTPCFSPTPAIPAIASCSCEGHAKAIHGXXXXHTPCFSPTPAIPVIASCYCEGHAKAIHGFEASEEPPFRGIRSSLGVEVACWCSRHSVKAHGSKLSRERPRPPQLIGGTGAHPRDRRRRENSDPKLVRALHDGEESVVQERAGALPAVARSHRHQGRWRGALGSGSVDPSSFEWGAGTTDQPGPLPPPTPAIIRAVDAGADVNEVEAAGNPPLHSAAYEGWTEGCELLLSLGAKIDASNNAGDRPWHWARNMGHQEVQDFLEQNGASTEQGQVLVQDHVPKVKDFFQKECWAHHPKPHAEYMDWRKKEDEAYEAERAKLIPGM

SEQ ID NO: 12508 - protein, 229 aa, Chlorella protothecoides
  MOD_RES (26)..(28): Any amino acid
MGVLPAASRLRLTSIVQRVHRCTSLXXXGVGADGRSPRRRSLAFDQYGAKSTPLHLPPCLQPLYSQPATPGSPSPIQPFSHYTTTTAPRQAPAIGRQWHTWSPDQDEHFRYEVAPARRCFDSPEEVEALTQEGLLRGGADFVALVAQGQDWYDDSLLRFPVDDSEAARHAIQSLLGVLALAALPGSRALPLGHTVMYRAGLPLQLEFARALRRELTRLAAETGAEVGGW

SEQ ID NO: 12509 - protein, 305 aa, Chlorella protothecoides
MPTSSTHPLLSGDIHGQYSDLLRLFEYGGFPPEANYLFLGDYVDRGKQSLETICLLLSYKVVSSLPGHGPASIPFPSLAHPIKSQIKYPENFFLLRGNHECASINRIYGFYDECKRRYNIRLWKTFTDCFNCLPVAALIDEKILCMHGGLSPELKSLELIKRIPRPTDVPDTGLLCDLLWADPDKDVQGWGENDRGVSYTFGLGTITEFLNKHDLDLICRAHQVVEDGYEFFAKRQLVTIFSAPNYCGEFDNAGAMMSVDETLMCSFQILKPAEKKARYIYNAMGQRPATPPRPGAPQPQPPPGA

SEQ ID NO: 12510 - protein, 712 aa, Chlorella protothecoides
  MOD_RES (42)..(45): Any amino acid
  MOD_RES (279)..(282): Any amino acid
  MOD_RES (490)..(493): Any amino acid
  MOD_RES (673)..(676): Any amino acid
MHHVTVKRESRLRYSEHQRGGSRPGMHGHTAPRKCAAADMQXXXXVGHDLECMDIRRLACSSGHTPWQRGRDCTQPLSRCVGSLGPPASRTSKEPPLQHRSSPSFAPCAEQTPAPPGPGLPKLVVFGGSGFVGTWVLQAGLDRGADVTSVSRKGRPKKVGPGTWGDAVQWTLGDALDPAQPWRKALEGATGVISTLGAFGTTEQMYKVPRVLGVGPESEVLVAVLPSAESSTSSERGAGFHDVWGGQHPADEGGGCGRRAAICVHFGARVQAAERWWQXXXXEGFPGALSPGGMLVPCACDECALERCLPEESWCPVRVTSAHLSVHLSSDASPPQLWILSSWVASAPRLPHLISPRLAAGGWHAQDFLLKGYFQGKRDAEAELAVSFPTGGVALRPGFIHGERDVGSVSLPLSVVGTPWAKVDAMNGQRAAKIASKPPVPGFDLSDIHPRATMTHRVTMRRPPSANHDSFSPHTTPKLSPCPPSSPSLXXXXSDIHPRATMSRRVTMRRPPFANHDSFPPHKPQTLSPPTLLSIPTVAECPAFTVTGGPPHRRRGVRAPRPGRGRGQGSGCGRAGCQRAARHHGCGEWCWGEGSIGGLPSPLPALLPGGLWLLTLQPVVARSGSSRSPPHQASPSQPPSRAVADPEVWRSPRRLARLHLAPRACAKSTPPRXXXXPPAPSAPPSYTLSLCEIDPSLHTSILCISPGPRRTQ

SEQ ID NO: 12511 - protein, 756 aa, Chlorella protothecoides
  MOD_RES (23)..(26): Any amino acid
  MOD_RES (469)..(472): Any amino acid
MSFHSAQRPEVDSPSKPQAWKLXXXXTAHKDRRLILHPNPKHGNYSRFGIAGVTPCDSTAAFWLPVALATADTPTGKPTWTEFSGCQSAAPVLQNAASAGTWVKANAGQYGFFRVQYDEALWARLVAAAPTLPPTDLAGLLEDSWALAEAGELGIDTFLNLVGCAPFQGRAREGGWVCREGDRGWLGCVGKSDESHPRAATVPLPTGALGTCGGFLGEAHSLSSVLQALGVPPLDDPTATPPPFNPPTRPSSSLAARSPEDYEPWAAALPYLERVAQLAPCSTLWQNYLAQTLFNTFLRQDAGGQANTSTAPPPLAFSFDAPAPEGAGVGQRLLRPAILAAAGRYGHLAITAQALELVPNLTASSVDPDARSALLATAVRAGHRDVWEGVHRLYLAADAADERERTLRALAAAPGAAADPLDWSLGPEVRAQVSGSFLWERGWGGTWKTSEVGCGEWEGRSTRGFAFWXXXXENERGGMWRAGGTVHPRRCILCHLAGEPRMVHMCHRRRALALRPCTPALAASWTSPPPLLPRFSSQDMATVIVTAARTRPDTPGLVWAWLGRKWRPVSEKLGGGAGGRERGGTPHGVPAGKRGVPLLQPDRDPGGGGRLRCQQGGSTVGIELHLQGCRGFALLDSVVKDGFPPYRPEKTAEGQPHRATRPMPYISTNANSQPISTSSGRRHGGDLPRAGARDHRDECSMGDRPRIQALRFDQKALVASGGIPSWVIEDPRGPTVARHGGTTFDTGSETPKALQP

SEQ ID NO: 12512 - protein, 208 aa, Chlorella protothecoides
MVVADFLTPLTVGAGDAAREQQYAAVLERVVLLLDGKTLTATSQMHDAPTLLHPITQPSCPPTLASGEDDWIVAMSTVASELHAAFDYFHWTGFYRTTAPGVLKLGPYQGGTACLTIPFSRGVCGAAAREARTQLVPDVHSFPGHIACASSTLSEIVVPVCDRSNGTAIAVLDIDSNLPAAFTASDVAGLEHLTGWLEAQSWNAKYWP

SEQ ID NO: 12513 - protein, 420 aa, Chlorella protothecoides
MHSITLVSRNHRASISLSAWSGVRATLFRRASVTPAHAPQALVESFAAPSCTQSLAVRTYSVGPGMAQTTLVSLSGKGTNPKTTLYVGGLEESVTDAILHAAFIPFGDIKDVSVPIDHASGKHRGFGFVDFETAEDAADAIDNMHNGGSKPDVCGVVPTAHAHQFLTELFGRVLRVNYAQPMKIKGGDKGWASQPVWADADDWFERAEAENQLEELEEREAKAAERAALTAAAGLDAMQAVEAEGAHPHAGQQYNATSGSAKSLGLGRATGGQWALGAGAVGSQTWVFGTAEMLAQRERIPLGWRTPRVCFGNDVTGGGVTSHHLEGILYVATGGEGGGGEGRDRCPTVKPKNLRPLQDEFVLLVSLPGVLSPDIEPPYHLVGHPIVQALSSTPPLGSTCSECRTRYVAPSSAPSPGGVC

SEQ ID NO: 12514 - protein, 179 aa, Chlorella protothecoides
MFLNILHVALHSGASRQAVGAEKAAEPAGFSPRATDAIIPRQDEDVIRFFSDGSISSELRTGIEAVRVVRDRKTTLGKGIAFILYKTRSAARSAVLLDGHELGGRKIRVTRVKASAVGAGASAWQGATAGPKRRGVAAAGVAARSAKGPAKKLKRASEGKRPAVAARKARTLAKAARRA

SEQ ID NO: 12515 - protein, 102 aa, Chlorella protothecoides
MEWWGELWLNEGFASYLEFLGAQAGEVTGRAAACLDCDLRTSGWSDDPLEASSLGAGSSVQASPELDIFLSFYTDVLPDALEEDSLNSSHPLSIPQGMMGVG

SEQ ID NO: 12516 - protein, 140 aa, Chlorella protothecoides
MQAARCVVLHAASGLGIQGVWLGNGTGGAQGELRDRPGHQQLVLQFPSTLQPGEGNSLHFRFAYNLSEGLSGAASLGCRCGKPSERRCLSLVFWRHRITANVPAVLPLPCSKERLAAAWWALRTCTVCQLSNPFSFPFPL

SEQ ID NO: 12517 - protein, 156 aa, Chlorella protothecoides
ARSARLLAAAEALHVLRPLIYAATLRRWGRRAWRPWLASLLVDLASRQLSFRAAATSRQAAYAAAASPAVQGTSMAVLYRLQGIRFTAAESEELLRRRTSLLFYLLRDPVFASHTRPALGRLAGKLERVPLVGWGGGRLLEILDGMQQLYSYTSAS

SEQ ID NO: 12518 - protein, 103 aa, Chlorella protothecoides
MTGTPSQPPHTIAGVNTSERIESLFDSIEYNKGAAVLRMLRAWVNRGAGLGALEVAAGINPAQAYLNLGAYNATTGSELWRALAGPLGLPDLPKVDGLPFMGN

SEQ ID NO: 12519 - protein, 218 aa, Chlorella protothecoides
MHPQASAPPQAGDRPEEAAARSSDGPSPDPALDAPRAWEEALDGEREQLFAGFSGRMEPQVVVAELQRRQQEAETLRTELGTSQAAQAQLHASLSAMALENIRLRDALAAAQRAAEPSVVQLRQVLLDPAVNAELARLKRELERRSGRGPDDPATGRVSRRGLAFGCLLRWGRICRENLDEGRQSGRGTTVHGVWGCQLCQSVCAQIACACSLLPAGW

SEQ ID NO: 12520 - protein, 97 aa, Chlorella protothecoides
MSTYLLAIVIGELAGTSRLAPGATAGADPRNVTVWGTPDRRASLEFAADIASKVLPAYEAAFGVPYSMPKLDLVAIPDFSAGAMENWGASLCPGYCC

SEQ ID NO: 12521 - protein, 205 aa, Chlorella protothecoides
  MOD_RES (17)..(20): Any amino acid
  MOD_RES (88)..(104): Any amino acid
  MOD_RES (126)..(128): Any amino acid
MAQSAATSFGAILPVTXXXXIPNTAQGQHHVAFITRPIRRAVPQGQGFVQRFKQVLFRHRIKQFFRCRTNQRHAMFTRFGQQNGQIDXXXXXXXXXXXXXXXXXTVTVTSRSISLCGFRPPSTALXXXPFAKLQLTFRRITPRNNVIMHHDGHFHRTQNFAFTRARAGFQQIVNQRTTGSVPDDVQSRPPLQTAGCSLPQSPLHA

SEQ ID NO: 12522 - protein, 319 aa, Chlorella protothecoides
MIQWRSSTDDPRILLPTPVIKTTFNPILGECTLPVEQASRPFGRISVAAMHASICLKPTPLSRAFVPRGTAPRSRHCRPFRVMDDGSALLAVGGTAAVAAVSAALLAADPEKRRAVQTQEAGGNELEAVANYFNTQGFERWNRIYGTTDNVNKVAVNRAAGVRRSSKADFLTLQHVRDPSGATGHQGGPCRHCQQGPELAWRGLSAWRHYRRHRVRHGIIGHPPGAQGKQSSWAGEPSKLVDIFTTLCPTCCLQGASVTASDISEAMAKEAEQRYKAASSEPGAKKPRKAPTFQAQDLESCSGCFDTVACIDVMIHYPQ

SEQ ID NO: 12523 - protein, 1200 aa, Chlorella protothecoides
  MOD_RES (445)..(448): Any amino acid
MLSFGACQGRISTLQAYSSAARTPSVTRHGVQVITVRPFKSQHPLLHRRIALPSRHCGLCRATSPGEATEKEALVKRDTEHVDQLTSTTENEHNYANGKENGVAEATADAAAQPANQNLYIAASVAAVFILGIGNRVLYKLALVPLSDYSFFLAQLQTFGYLAVYFSVLAYRFRWEIGRFKPCDPYICKGEAQFTPPTPTQLHLCLHIKQSREDHKLHDRGGWKQEEAPVSDWRRGSRIIRPGILWSFAAPRLGWVGMSYGQRWCESVEGCLSWLRLNWARVPSPSCQHFGSLILINVSPLCRSGIAASRTDGVILAGVLCSHPPEEASEYGAAFINKLLIDNLTPHLCTVVQMLGVALVVLGVSAAAWPSNGSSPLANVRYICLSFACHQYPPDAHLINLLAQVNLMFAAIYCASMIFPALDSILKERLFRSGIGAASSKEHSXXXXKRVWAAPPPVCGMCSWNGVAFEVVELLEPLQRSTLPLKAKSVSLNLWIQDSSLPRASTNREAKETLKGKDLDLFVVNSFGSLAQSACILLLLPLLAPLRGIPLSGLPGYLAEGGGERGREVYCDSLPQNSIWTISGQECMGLKLMAQLITAIHCSFISFLEHVTPSGWSVFWGLAGGATGAPMLPLLYIGANLAFNIAALNLVRSAGNVITSLVRMTACWDVLLSGGIWVIVCVLCHGQHRSFHHLCIHCEWIGGEMGYPHVVQERSLRCRFYQALLPQHLASHLPSPSQFDLPFLPLNPPLGLPFLLGTVVMVAGLALYNGPQWIGPVRGMISNWLNTEEGVRVSRSWREHASLTSSGSCKLIDRRFTIVLNVQLSAMPRSNTVLLSSPCSMIPTETAHRRLPACDIATFLYWWRLISTLNCYTHHPFFGDSVCMVCKRRHTEASARLLVLFGIVWRDCVPEFQPLSALGCLSTGDRHPSISWAVNLLPCPKDSSGFLLFMKQCKQSTMHENSSWTRNLELGKGVAFCEVEKDERGEMVKRLVDTKDPALPPFLPCCVAAVRAAGRFTPHTSAFRNHKWTPLGVGGRCWMHPRPARATDRPTAACCGVNDSIGTSLAAGACPAAESKAGTTQRMEPQTPVAMAGFSTKSCAGQHSALPPARTSAKPVLQSTLTVPLEALERGYLPEMADRIAQFATEREKAEHEEGARDRDMSPIHQQHLINAIGERGALDHWERRIFAAWRSTGRLSDQA

SEQ ID NO: 12524 - protein, 207 aa, Chlorella protothecoides
  MOD_RES (84)..(87): Any amino acid
  MOD_RES (166)..(169): Any amino acid
MSADIWSLGISAIEVGAWSNYFVWGGERARAGRLYCNLDTRWARGRIVLSGAEEGEGLGACTCTCSLDTRYATTPPRPTLQGRXXXXPASELAAPACEQQKYPSNAQMARGEPPRGEVSSFRLLFMIVRDEPPSLEGPFSTEFKDFVWQCLRKARGAGGGGFYWRXXXXPSPQSSRTLSGSASERRVVLGVAGFRGVALPFSDVPSW

SEQ ID NO: 12525 - protein, 62 aa, Chlorella protothecoides
MPYALVSVTLCNEGPDAYRAEELGPRITIERRINSSTGGHIKIRDAQGREVGGKGRGGPREV

SEQ ID NO: 12526 - protein, 146 aa, Chlorella protothecoides
MPHGCRLPSTCNAWVLQPPRPLFLTGSRQAEAPLPSGQARAGQVATITLVNFMCHEHLTMDFGPNVTFISGSNGSGKSAALTALQCCLGARARDTGRCGGRGCGHRLSVHARCGLACCSVGCPALWWRGPGLKPGGVLCLPQRSEE

SEQ ID NO: 12527 - protein, 290 aa, Chlorella protothecoides
LAGYDGGEAHAAHAALADPGSYEALESGLTFLGLAALRDPPRPEVRGAIGACRGAGIRVIVITGDNKATAETICADIGVLGGAGDEEDGSDDGASLPRSLTGTEFCALSEADKARVLARPGGLCISRAEPGHKQDVVRRLRDAGEVTAMTGDGVNDAPALKLADIGIAMGVTGTEGAKEAADMVLADDNFATVVAAVEEGRAIFNNMKAFIRYMISSNIGEVASIFLSAALGLPEGLIPVQLLWVNLVTDGPPATALGFNPPDPDIMSKPPRRGSDHFLTPWLLFRWVVS

SEQ ID NO: 12528 - protein, 324 aa, Chlorella protothecoides
RAAAAAAAALAGLAPPPPPRNSRPVPALENEEPQSCLPRLALHLSPLPTRTFSVPQASNVPAAPPVYPPSTAAPDDVHQKCAQSNRHESGQGAGFEQGTKVIRPRPQNPSCPGGSLHPSVPLFELGLAGGPVGCSGGLVDPGPAHRLEHLVDEDYGEGVGQHQEPFLEGERDDGEDVCQHRDIEDEEVEAEGDGHGQEEPGVPPHGHSDERVVLRQRVGGIEHLDGHQHGQGQGGGLGLAGGEVIAGVGELHRARAGSVVGRGEAGPGGAGLPVAQLGQGDGGVPVARQVDEAQEGGGGVPRRKGAHRGKAHIAAHHLTGGRGC

SEQ ID NO: 12529 - protein, 693 aa, Chlorella protothecoides
  MOD_RES (321)..(324): Any amino acid
  MOD_RES (442)..(445): Any amino acid
  MOD_RES (472)..(475): Any amino acid
  MOD_RES (503)..(505): Any amino acid
MRSLSEFVETGNADVRPQPQISVQGTRNCVGVLQGISGPCWACPARLLGMVSRHFVSITALLACGLVPALALQTWSLGDSATWSLNNSAGSANISDVPVTLPSCALGSLLEDGRLAGDPLYRYNELDYRWVADDTWTWTASFPSPQPAENATHWLLTIGAVDGVGQVALNGKVLAFPRNSHRPVEADVSGLLAEDGNNTLTVTIESAAAVAAAAAAVYPYQVPAVRQVGGLPHYNFIRKAASDFGWDWGPAFAPACILGDVTLTAYSGPYLTGALWSASLWLWDGKAGKGWGSEGELLSPDIQHLENGRHMEPGAGTGGAXXXXGNSSSALTPSMSRTGVAWSWGSKWRAGLALAQEEQSNGSFLITATAFFQAPPGEHGGLLILDMGNQTLSGAWSTEQEVLLSCGGAKESAAVGASASSGPACAAAAALPASCSAVISLXXXXGPGARSRRCCCPVAGLRKARRWEPQHXXXXHRPALPALVALGAGGTRAVRPGGALRAXXXTVDPPFQRWWPWELGSPTLYDLEVRFEPEGAGGALSSLTRAVGLRSVELVTEALVEGGRAVGETFFLRVNGVPMFARGANVIPDDVLESAVTPARLARQVADARAVGMNMLRVWGGGRYAGDAFYAAADEAGLLVWQEVMAACAAYPRDAPFLEEVRVVGVGSGSCVLGHAACWSGLGAPAHRVPCGL

SEQ ID NO: 12530 - protein, 156 aa, Chlorella protothecoides
MGVGGSRVCHSIPPDLAWTAHFQCDPEQLPSANHPTPPPCPLPSTPSDRLEQLKVEIEEQQVKARGKLFPSAFVTFNARLAQVGAVRSLMNEDLSTWRCQAAPRPSEIVWGNLGWRIWERAGRHLLMLAAFIALAFFFMIPVAAVQGLLTTNSLVG

SEQ ID NO: 12531 - protein, 168 aa, Chlorella protothecoides
MLRRAPMPAAMPAYFHERMHVHGLHMQPHAGLSSTQDTRNLLVCGISGAHGQCRQVICAAVCPHPLGCGGMANRRHAFCRWRTVCMRWQSAPEIITLAHTNLLARSQVFKMSEAEVIRCGGMDAAMYVKILEMGEHKADGWQRYIVQQACLQNTSLAAAINLVPRVDT

SEQ ID NO: 12532 - protein, 343 aa, Chlorella protothecoides
MCQEPASQLLYIVVKDIDLVNVKVGEGVGAMWLLVVPALARCPCDKRSSSTKGMALAPPTWSRTRRCLVGLRCPSRSSPRWGFGSAAGGTSLSTIVFLARQYAYKRLTCLCCPLDHQQRPGEPHEMWVPLGTGDFAAAAGCVSTLSRGERGGRGVLVTAMKSDFGSQPLPLRSLSHPILQPPQGSGRGEVHLNITFWPFDQLKGHKSSARGAVIVTLFRWLPWPGLALRAGFEGVSRPVHQVGGWMSTGWRLGQARDTHLHQGSRSSPGAYIRCTSSNCDPHTSPCRCNNLVPMDRPVNQSDPMVVFKLNKESKKSSVVWKNLNPRWIGEHFDWFHVRLAWGS

SEQ ID NO: 12533 - protein, 690 aa, Chlorella protothecoides
  MOD_RES (601)..(604): Any amino acid
  MOD_RES (685)..(688): Any amino acid
MNLECTNGALQAVPLSQALHSLDAVWDGLFEFKVWRQGGKEAGVIFASQKCGPPCVMEVLLGITTHTTLRYMPGRCARTECSISHDSQSLPVSPRVARWRIRLRAWWACQRASSASRPGELVLGLAQMLSRPLKSRALRGRVRPGTLLLIGPEGRPPPSHRQEADWLMCEGTVSAGKATFVLLEALFITFQMVEGPKFKSDLAPCPQCHTQTTSITALRTFSSILPAYISHHGPPRAAPRPGGPPRDHRLVLAPGSQTDATKASARSIDDSYGTATLLTPRGKPPSRPSHRLVTAPPPLRVSMPQELTSVSCPCTTDGQSNGVDTGRVGCGQWLGSQGSAEFVCYIASSSLCLGADPRQSTLFVGAALRACDVATASLPSLAGLLAGTPQALLFVQALRAADIASFPGSQITVFAPTNAAMATYVPAADLTDGPAMRVLVLQSLASGALGRSELLEAGQVRMASGDTFPVTQVAGPDGEAPGTGLGQSGWMWKAGIGVAGCGRLALGVTGMGKPFICSYRKHEWGTSGGQDSRASPDSPQNLTCRQQHAGSWGWGGGAGRLVRIRRGAAPGGGAAEHGPRAAPQSRDWGRRGPRPGPPAGXXXXSPSPATGAGKGPAPAPLPETTPLSDLGPQPEAETSSLGPLAEGVTDRLPGQQVGSGVVPAIQSGNQDTEPPEPEPAAPGAXXXXRV

SEQ ID NO: 12534 - protein, 282 aa, Chlorella protothecoides
MSSTKLRLFNTVPDGNSAARETQSSKSKFIPHANGSSRWGALHALTASWPLELSNLVLQASNPDCTDLILLRFRDHLVPSWRYLSWTVPYFAWHYQNFLEYGLQGGVPGICAYTAARCRWLDDQIRAGVEEGAEQVVILRPGYDTRPYRMRFPHVKVTELRVLPNRNLHPRPAFVSVDWGNLATFIPALTGAGFNPGKRAVFVAEGLLCQLDSEAADTLLSDVSALSAPGSRLAFDFLHEDVLEGLVQPAGYASLAQSLANKGRPFLNGMRPVYSGEWECWV

SEQ ID NO: 12535 - protein, 443 aa, Chlorella protothecoides
MAGAGPVVLGPPEPEPEDEGAPGEGQALVYPTLLPQGPRPAPEAEADSAAAGADLAMDAPGLPPLGEPGLEPFEPILTEQPAAALIAPLPRSSEPQSEPAVPTPSLEPAAEGASSATLVVLPPVVTSRIAGPDAEPVSEPTPEPVSEPVSEQAPEPVPEPSPEPVSEPPLEPVPEPSPEPVSEPPLEPVPEPSPEPVSEPPLEPVPEPSPEPLPTPVLEPVPELVPASTQPLLAPVLNPTPQPALEPGSQPSSAPAPELAPLRPQEAVSPAVAPIAEMTPSSPSQEPNPFLPPSADASRETPAPSPKRVTSPPPGPIPPAEVEIPTPEEVPAPPSPPVVFGGSSVLPTDVGCPECQPDPDTYAPLPVTQVSANALLATNWAGEAGPGCWQQGWFGGRGCAAMPKGEECGFFLFAGSGVLPCFVAGREYTTPGCVRHQFSPLSS

SEQ ID NO: 12536 - protein, 103 aa, Chlorella protothecoides
MEQMPADITPTSAASADAAEASLKQGQLHPNTISVERKTFARVFKDPKTIWQGLFKKVRLQEACFKDVVVLYRKAHPGPAPSELDIINDEETVSRACGLDGLV

SEQ ID NO: 12537 - protein, 67 aa, Chlorella protothecoides
MQQLLHKIPTWLDFADTEKLEVKRWLNDIILKSWPYYDLAISTMVKVCLWAVCGGAGAWPLFRRHVV

SEQ ID NO: 12538 - protein, 600 aa, Chlorella protothecoides
  MOD_RES (342)..(345): Any amino acid
MSRRNDRWTIARHGTPLLALCHAHALRFCSRRNTSSNASSTVTLPITEVPTDPLGTLPQAPDPSHRQKKFELGVKSMLRMLSLESAISERCRAVLTRHVSHQAPRADWVVAGMGSQQLITAVCTVIFDLDQGQKIESLHPPASLSEGDQQRVAYHAFPVRPGDEEGHALLMSWALYNGCTGLDSTAQKQLAPASIRDSSFFFRLPRRGSSLYGFVFCRQRQDEALRRGAEQRSFVVLSPLPLHALWTALACAAGPVCLAYGPHAVVDVSALGVRSRRAAAVDCVPWGQMRGCGAGCKVAASADFRRQTQFVRLVVGPLRRGSVGGLEYPSIVPFPLLPPSRXXXXAWVWGRLQSGCQRGFPLADSVCEAPCQTLASWLCRRPGISVHLPFPAPPSLQVYEAALVFPIALPLADREAQVWIRGQQLTLALPDPATIPGTAATQTLDPGTGLPQALLADSHKLTAGPYSHVRGRDDGEGREVVLGRVYTMSHSPWSGCALGEPWDTISAHHHESVHSSPALQVDVYSALQPVLQHLWTLWELLVLGRRLAVIGASPGAKPAGICRMQMGLGTRGVALQSWLDRVNAGAFPFHSFLGICITSE

SEQ ID NO: 12539 - protein, 491 aa, Chlorella protothecoides
MVCPKPRTLSSKSSETSPPPDISNFMLTRCHGPHGREAVPGARRRQSRWRTGGQQADCTPAGRGELPGPADGLLLEVVAKGPIAQHLEKGVVVHILAHIVQIVVLAAGTDALRRGTGWGGLASGESLNNQALQQTPTSQALNPSRTPPAVHDPQHHKHTTYLLGVCGALELSQVRGGVHGAQENGLVLVHARIGEEQGGVVHRHDRAGGVESVALGLEKVDEGGPHDRSRPVGGGGHGREAGEPRAGAGCALYDDRQARDLAATRSQAQSQCRQHACLDGGRMVGADPSTLGSGEEGEGLRYPSTLARYPPPPFTHEQQGCRAQRRRAMPLGLLLPHSCVVATVLANHSPHFPAPPSLIEEEELGPIDLDPFYVDPTEPDPWASEDGMEGTEGTASTPFSIPESFDSRFVESPRTPVASQDPRITTQYLTKYERARVLGTRALQISLNAPVMVDVGTESGGGSYLMALRSAIICAVCRGLGDHQHPTCRHD

SEQ ID NO: 12540 - protein, 603 aa, Chlorella protothecoides
MSTSPLQVSNAGSKAGSERSPTASSEQASHRDLGTGDSGTPRSRPGAPAGERDTGRWSRRRYEAALAALTGVLQRLGALTPVAAVLRPRLGALTPVAAVLRPVLRDAARRVIGDTGLLDHLLKHQADRVVGPRAQRLRRRHNHEGHMEYWLQSPEAATAEDALLRKEVTALTSELRDVKEVRHALHAVRAEAAQVLHEVSSGSALEEGTGQAAGGGGGNGGGGRGVQGESVGNHSGKGSWVVGADIGVMQRQFAEISKRFANTDSVLERASRAREPGGSAEGGGCWATGGTFRRGPRQCWAQKSIKISVDLTSLPSLSIAALQNVLQDLPRLTAQAAANQAASGSRARDASPHPDYNTSSVKQPRVLRLQPQQGLMPEEQKAGPSLPALGHPNKIKDLSQLTHEALNVWNTLKFQPDTTPIIVGHASRQTGPGAPGNTDGASEEELAQLTPEARAIWDQLRRARTRAPAPPAPAVDPPAAVAPPPPPPPPSTRPEQNVGVRGVPSRQAPEIPPGEQVQDLAMMHRFLTQAPPPGSAAADASDGSPAFADSSAFPRLAPHAAGLPFPSLPQQPAPRRRRDSSPDGSMKHPRRDDSPNPPSDRAP

SEQ ID NO: 12541 - protein, 257 aa, Chlorella protothecoides
MREGGWGVPRQGARVPQAFPLLTRAESAWVGPNHPSPIKARMLATLRLGLAPSRCQISCLPIIVQRAPRPRSRLTCLATMPSPTDWPGSVVRSTFIDFFKSKGHTFNPSSPVVPVNDPTLLFSNAGMNQYKPIFLGTVDPASDLGKLKRATNAQKGLVVQRLTRGKTTPPCTPPQCIRAGGKHNDLDDVGKDVYHHTFFEMLGNWSFGDYFKKEAIGWAWELLTKVYSLPADRLYATYFGGDERQGLPPDHEARDIW

SEQ ID NO: 12542 - protein, 557 aa, Chlorella protothecoides
RRAGGWAGGGLHGAASPRDERRRRRTPTPPNHAGKGARCRSRPTPHPIASGSPPRLPLGDPPRRHSTDLDCRAVGHGLVGVDALVGLLAVEVVLDHGLDLGDAGGAAHQHDLVDVLLLQACVLQRLAHRSHGLLEQVGVQLLEACARQGLCEVVVWAGGPCERGEERGWSRWGEGVGPPWSLAAREPDAGRLLPHGPHSTDAPTRRSIKTLVSSPGCQALDLHADLMLGGKRTLGALRLAPQLLQRAAVPRHVLLVLALDQLDEVLHDALVKVLAAQVGVARCAQHLKHAAVDGQDGHPVRDGSGGGFVNDALHGQTRDHARILGRLALRIVEVGGDGDHGAGDGAAQVPLSRLLHLGQDHGADLLRGEGLGAVRQVHGDVGLGGLVHHIKGHQLGVALHLAVAKPGGVKGGRGKEGGPGVGFQAWTAQKGKHSTGNGLTGTLLPQNMKSTNSLAADQALDVVDGALGVDGGLVLGRISHQALGVGEGDVGGGDAVALVVSDDLHLAVLVHTHTRVGGTQVDTDHGALLLLLLFLLLLCLAQGGAQAQRQHCGVVAG

SEQ ID NO: 12543 - protein, 644 aa, Chlorella protothecoides
  MOD_RES (66)..(68): Any amino acid
MGCGAFRLGERSSGSGTRPTVPSARLKSCDEGRHAVPSQTLLADPGTQRPGTLPVARLPHTLCAGXXXRPRHPAPRYLTRGPTSSHTMLSPPPSPPSSTTSASLSSASLLSGAGESSSSGTWQRGEQGTRAPQSPSTPPHTPHLLGNGFLHLEADGEGDELGVALDQLAQLVRARVLLAGGLEVDVDLRAAAQLRPVFVGRQRVVARGAALPHPLAVVVVLGHHLHVVGDEVNGVEADTKLADEGEVAAALGLLQEGRGARARHGAQVVHQVLARHAHAGVADGQHAPLLVHPDADAQGLGLLGVTQLGLVGQGQEADLVQRVGSVGNELAQEDVLVGVQGVDQDVHQPVHLGLGVSVIFGGVSGGEGWGGDASYGQAPMGGPWRKAAGIFVECMALVSRAAQGVNGGYPNAAPVPPIRLCLICAFTAAPTTCPSKQFAWLALRNNPRLPVLTTHLELHGLGALAEGVHRSGGLGRVAAIVRASVNGSTHLAGVASSSAWHPAMNKSIDVSTLYIAWHTHIASRGTCAPILTLPAGRDRAEKQENGGPPHPPHVRQAQMDLLLLLQLRIRSLQHGVAAHVRFEAGDRCLGALSTVTHSNAAKVPPPALLPVPRVLRLPVRNSRTVLHYSPRLTPRRKPVCESAW

SEQ ID NO: 12544 - protein, 224 aa, Chlorella protothecoides
MPALVAAFQPSRGDDEEEAKEKTKTVTEKVKEWEVLNDAQALWLRAPGDVTDEDYDKFFQVLSKVGDAGAPGALARRRSHLGDLSLPASFHAQFDPAPAPANTSPARPDPQGQSNPLAHTHFRAEGDVEFKAILYVPRTPPPGEAPCCGAGRGRLGGTMGVWGLRQGKGTQGGQRMHGEHACCSMPGQPQGAVLVTTGPSHDHVPTPPPPAQTCTRTTTAASRA

SEQ ID NO: 12545 - protein, 244 aa, Chlorella protothecoides
MEYFIKLIKRKYKKDVSGDSRALQKLRREAERAKRALSSQHQVRVEIESLVDGVDLSGGDPHLARVQQGTRGAVAAQRYWPLNLLCIQPSVQTSAVWASTPPPSVDAHPHPLAPSAPPPLLPSLTWPPCPHHNLAEPLTRARFEELNADLFKKTMGPVRKALEDAGLKKEDIDEIVLVGGSTRIPKVQSMIKDYFNGKEPNKGVNPDEAVAYGAAVQVCRVSSRGVPERETRWGPGCDWVWGRS

SEQ ID NO: 12546 - protein, 287 aa, Chlorella protothecoides
MDILINSLYSNKDIFLRELISNAADALDKIRFLALTDKSQLGDTEESQALGIRIWVDEERRVLSIRDSGVGMTRQDLVNNLGTVARSGTSAFLEQAQRGGDLSLIGQFGVGFYSVYLVADYVEVVTKHNNDSQWVWESRASGDYALSADEDGPQLGRGTQINIHLKPACEEYARPDKLRELVQRYSEFISFPISLQVEKTVTKEVRSVGGGGRGLGAGSGGKLPSTGRARGSDACCGTLASSKRLTPSCLAPHAARCRWMMTPLLLTARTPTTRTPTSWTKVGWVGG

SEQ ID NO: 12547 - protein, 370 aa, Chlorella protothecoides
  MOD_RES (167)..(170): Any amino acid
MPRRHPFCCDRGRVLSPILQTTLRMSHPQRFLLARPPPHPVPLAGSIWAFGPDNSGPNILMDDTLPSEVDKTLLNAVRESIVQVRCGGGFEGTGAGEGARSCCNWPREGLGVCNMRMGGRGTTTEPAIRPLLLHAPLGSLSITSVHCRPSAHPHSPSLTSNPPRSPXXXXEQPQSQQSALGCYLHLLAASPCRLCIAAPRLTPLSILDVQPPKISLPSLPPTHTGLPVGGAGGPAVRRAAAQLQVQDHGRGGGARAATPRRRPGHPHRAPRLLLRLPHGHAAPDGASVRGGDPDPRRLHRCHLQRAGQAAGPRDRRRAAPRHARLPGPRLPPGHRVLWVRDRPALPHPGPGLLPLRLRPLADRSRRPPGP

SEQ ID NO: 12548 - protein, 335 aa, Chlorella protothecoides
  MOD_RES (158)..(161): Any amino acid
  MOD_RES (315)..(318): Any amino acid
MRPACRACKSPACTNTGKADSVRSPIGPQGFRQSMHTATCLTQQPATPPLSPLQDLREMYAEVEVKVADPVVAFCETVVETSSLKCFAETPNKKNKITMIAEPLEKGARGSALSAYPRRWVVAMAWIWACHGHGDEAQRVMSMLCIAADLAWNCLMMXXXXVGVSGDGGWGWRHQRWCRRSSAPSAYPRHCVLATAWIWACHGHGYEAQRVMSMLCITADLAWACLMTLGPPMETLSGSYHYSSLHSSALFRSRPPPSSHLWTGLAEDIERGAVSMDWTRKEISTFFQSKYDWDILAARENGLCEEVWMTPIQRXXXXTGTSWLHVRRGCARRFG

SEQ ID NO: 12549 - protein, 849 aa, Chlorella protothecoides
  MOD_RES (546)..(598): Any amino acid
  MOD_RES (691)..(694): Any amino acid
  MOD_RES (843)..(846): Any amino acid
MSLWNVGESHVWVDQAGFGGLESRARLSVRHGPSARLAPDTGSLPGSGLGEGGTQARPSPTPQQSWRWPRTPASRSLRRPRPLLSSWHCAERGRVHHRGRHGRVALRRVWQLRGPRAVRQRGEQGEEEEEEQVQQQPGAEDMDAQAGSEVEEDGEEEDDGAPSGALVLHEDKKYYPSAEELYGAGTETLVQEEDAQPLEVPIVAPVRRARHEAGGPALAPRFTPEFLGSLLATPELCRNVTLAGHIHAGKTLLMDMLVEQTHVVPDAAALADAPMRYTDTRADEQRRGISIKAAPVSLVVQGLSGKSYVASILDAPGHLDFGDELSVSLRLSDGMLLAVDAAEGAAAGTERAVRAAAAEGLAIALVVTKVDRLITELKLPPADAYHKLRHVVEEVNALVRAHYPAEGAADRVLDPRRGNVAFAAPLYGWSFTLESFAVLQSEVQRLALDPRELARRLWGDLWYHADVRAFRRAPPAGGGDRSFVQFVLEPLYKIYATVLGEDDAAVRELMAELGVALRPAAYGANVRPLLKEACTAVFGSAAGLVXXXXXXXXXXXXXXXXXXXXXXXXXXXXXXXXXXXXXXXXXXXXXXXXXXXXXGPLAVYVTKLFPTADATAFDLFGRVLSGTVKPGDKVERGRGWGEELVMVGRWRPAHLTTSPAAILEPPARACIPPNRILQHTHKRSHPKPSPXXXXVGHGGAVEAHSPDHQPSHDPGTSSACMHPTQLNPSTHAQTLTPQPFTTHPGAGAGRGVHARGRGGRRHGHGDGSVGGPGSCPPAPGPRRGWELGAAGGAGRHGGQDRHPGPGVWRRGGVHLRTTDFWRPGRGENCHRAAEPLRAPKDGXXXXSAS

SEQ ID NO: 12550 - protein, 94 aa, Chlorella protothecoides
MGDDFYVRYYVGHKGKFGHEFLEFEFHPDGKATLHRADLPHHPQLRYANNSNYKNDTMIRKEVYVTDAVLAELKRIISESEVRVVDAVLGKGGQ

SEQ ID NO: 12551 - protein, 113 aa, Chlorella protothecoides
MDGEDAIDTFMALTNAPRHVAQHVLDAHAGDLEAGVSFYLEGGGVGHGVTGPSGSLDPVLYTAALSAQEQPRSSPLTVRSWVDVLSREQLTVARGYPSSPRAHGRRGDHVTFV

SEQ ID NO: 12552 - protein, 422 aa, Chlorella protothecoides
  MOD_RES (30)..(33): Any amino acid
MGSITSPGEGSRKAGQAGTDEPAAQHGRRXXXXSRKAGQAGTGGPAAQRVRRGRARGLAHARRASRPDPAPTAPLRSPAAHGPDADDAVGVARVEGGAIGGPGQGHGLGLLGGLHALQRRVQVVHHRLVLQVPDLDAAVGGGAEPVAVGGEDQGVDDVAGVQGVEVLAHGQVPQHGHAVLAARGAERAVGRDGDGVDVAAVAGQGVAKLAVLQVPHLDRLVPGGRHDERRLGHRGQTHAGHPLGVPRGLGHGELALRQRVPQLDGLVTGAGQDLAVVGRDGDGQHVLGVAQEAAGGGALVQVPQAHGPVPGSGQGVLGIGGQHNVLDVVGVAAQGAAGEAVVLLLAAGQGPHDHRLVAAMERGWGVKVRILRNLDVNQAPEAASRKAGIGGSAGSRRAGRRGASPPDAVNSPLPHRRGHLGA

SEQ ID NO: 12553 - protein, 1091 aa, Chlorella protothecoides
  MOD_RES (177)..(180): Any amino acid
  MOD_RES (439)..(442): Any amino acid
  MOD_RES (912)..(915): Any amino acid
MQGSPASGSVLRALREMAAREGLSSLWRGNGVTIVHRLPYSAANFWVYEQVNEQWKHIIPAQGTLAAADVTRRFVAGGIAGLTACTLVRRGDEGGPGEGWTSQASGPLCSGPGSALTPGARSPPLCRHRFPTRSTIVLSDLPTNPPFPSPPPPRPPTQLPKGVPAGSGAHAAGGAGXXXXSPLSITPPPHPPSQLPKGVPAGPGAHAAGGAGGRPRLLRHRRHAGGHRARGRCARAVPRAGRHAGPGGAQPGHKLRGLRDAALRLAGRGRAGVTGGGALRPRHAGLWVAGGAGVLHRHLPAGPGPTPAAAPGRARRGRRLCLLRRRLPQHRGAGGSARLLRRHPARILQAYWRLEVAPLQPCLSSAPDPPRLGLLLFPRAPPALLTLTHSSEALQPDACGFLCLLNWMPGRGHAASEAPCLQTSFPLVTIIHHNPLTSXXXXCSFRGPLPQDLFPTCRYHSSQPSDLHPALLPAALVSPYARPSREGSLRQLALCHCYFVAPCLPSRGLLGAHAVPSAPESAAASDLPARMGSLVLLVRGLASRVLWYRAPAVGPQVQADARCQPGMRSVKQSQDRNPSTFTPPFHPLASLSPPQIRHTRIPTKHNAGGGILLGAEAVAEQQARQEDGEKLARGHGGGHEQRTVPPDGVRDEELARGGGQGQQRRGAQRARVRCEESERGAQLPLGHQAGQGQERRGSGHVEDLVGQGGGVQRKEPGLEGGGEAVDCQVGGHECQAPGRAGMIGGGRGEASGGGGDGACAIRAHKGGAAECDGGSARGVPRCVPLAQHDSAPEHDGQHFGTLAQRLRCKADVAQGLVLAEGCGDVGKGDRGEAVLGILCDEACEHAERSRHNRVGPGSGRALRGVCAQPAVHGASSPKPFPQPPTRRTRERERATAQATRRLARTSARLWVXXXXALRGVCAHTAVHGASSAKPFPQPPTRHTRERERATAQATRRLARTSARLWVNGSPSNGDCMIRSCVGATDEGRVPPGRAWQGVGHGGGRLISIVTAALPCSSHLSGVGYPEGRPCKFHPQSQPHLQHPVQHQAANDATEAPDDMQSVGAGKARGGVLVWGRHPRVAPSEACALRCD

SEQ ID NO: 12554 - protein, 142 aa, Chlorella protothecoides
MAFHHGPKWTPQDLDAAALTGNEGAEVDMERVLVEDDGARLLERGPGGPGGAGPSRREEAIEVIKLLTSGGLAGAISKTATAPLARLTILYQVTRAGVEWCLAGAAPWSVRGMHHRVLTIRRCAGLRCSSMSSVWRTSTSRR

SEQ ID NO: 12555 - protein, 269 aa, Chlorella protothecoides
MDAKVVAHDSGSTSTASGGAGPKDPLRPAVQASWMLSGDTATQYGKSADAPLPGLGSQPEASVGFQARVHQGMGELPGPSSTANIPVLPDIARLKDSRRDIPLTCQVLGCGQSLVGHADYYQRYRVCKPHLKGPALIVEGLPQRFCQQCGRFHPLDAFDGDKSVDGSAARLLCLTRALEPILGPCAQGSPRPTHSLPTTTRRPPQELPGAVGAAQLPAPQGVHHDSGQPEACWEAGGAPALRWPHQRRLGGGRPPRQLGPLPRCGWCVG

SEQ ID NO: 12556 - protein, 238 aa, Chlorella protothecoides
MLGKRYAARDAARAAAVTLGCAAFVGANRAGAVSPAAAGLSSAATNHASTPWGLTLMAAYLTVDGFTSTFQARLFALHAPTLPNQVLYVAATSALLALAGLVAKGELRPALAFFAAHPRALGAAALLALAATAGQLFITHAIRRHGALLVAAAMTTRQFLSILLSGLLFGHSFSAQQYAAACVVFGALYHKTLDARPRTSRTSEPILAGKSDAAADSGAEGTACAPSRPRDGRHGATK

SEQ ID NO: 12557 - protein, 311 aa, Chlorella protothecoides
MGKRGIDSIRGGGAPPARPAAAGTAPDPCLADKSVIVWTLTRGEKEDYGFARRSLRGHSHYVQDVVLSSDAQYALSGSWDGTMRLWDLNKGTTTRRFLGHTKDVLSVAISADNRQILSGSRDKSIKLWNTLAECKFTVAEPAGHTEWVSCVRLSPVSKPPLIVSASWDKTVKVWNLQDCKLRDTLSGHRGYINSVTVSPDGSLCASGGKDGVAMLWDLSVGKHLYSLDAGNVINALVFSPNRYWLCAATDRGIKIWDLEYKSVVDDLDAPLEGVEAAKQPKPVSLAWSADGATLYSGYTDGVIRVWAVGRR

SEQ ID NO: 12558 - protein, 180 aa, Chlorella protothecoides
MAGALLHTRHVWRAVPPRQLATHTGSPQPSTRAPHNLAGAARPLLTGVSLDLPADSLSVLSGPSGAGKTTLLHVLAGLSEATAGTILLGGAAAPWPASPAPAAAPARLRASGVVFQFPERHFLGSTLVEELTLGWPETGPGRTRLAQRAQQVLAAVGLSSTPLQARLSSLSDGYKRWVWG

SEQ ID NO: 12559 - protein, 833 aa, Chlorella protothecoides
  MOD_RES (800)..(802): Any amino acid
MLDSQRSLTKLNPLMAKLIPVPHVTLQLTFWWSWFENLSASVRSGDALSAYIYLISRRTSTVGIIQGINGISQVCPMMVGGTTCFPIDVVGPMMVGGTPCFPIDVLAAAVPAGYLCDILRRDMVLRSGAVLGLLAAGTLATTMSLAPTIVNLAVCAGLLGIYRGIHSVAMESIFADSVEAGRSPSSQTASRRAAGKGLLPLFALDWELISVATEPLELNALGLKHVIPFWDQQYTCRWIWDRFPPTFPVAAPFSLVIPLPSIPNDEQFTVHQKVYRDRACRRKRATSFFLRLPEAGKPLAHGGLPGRGRGRPAPHAGTPGADALLQRRPCPGPCQRGRDEGFRLYAMNEEGRVSIIRPGQDICKVPCGANSSQSKGSSALLSPGRLPDASGAPTSNAEGCTDGPDPELDMERNTVIDPGSELDFPLLSTPAAQPTSCCPPAVFVTLLLTLSDLLSGLASGMTVKFFAIFFLEQCRLRPATVAAVAAAAPCGVAFAAAAAQRIAARVGRVEGGGEVVLGFIKFMKKAWGLDRGRGLAGERGSNSRKPADSWSKPCPLDPHALGLLVQALPSRPPRTGVKHMILHPPPLPHPNRPPIISQGARHADRAPPTNGTGQQHPAPHAQRAHGSGAQAVPWQGERLREHNHVLLEWLCGPRRVRRGAPTPVPPSQQRADRASGVPGHLPGDRGDQAGCLRPRGRAAGDVGHLAPANQAHACGLQQLVPFDARVPSGTRVCTATIDLRGQEKMLMAGASVQEQAVCVMCADGWEQAVCVVCADGWVQEGAGSGCRNGLKGRWGQDGTXXXWGRRSGGGMWSRLGKERGETHELRRPWAQPR

SEQ ID NO: 12560 - protein, 102 aa, Chlorella protothecoides
MPETTEPGCHGNARLAIAGDDAAVSIISMAEARVTTLLQGHVAAVTDLAANPSQPGALAALSSDGSVALWDLGSERQRGPCSTSHAASLVRTGSWCQVLRDG

SEQ ID NO: 12561 - protein, 92 aa, Chlorella protothecoides
MNQGETQSNRARETEVKLLGGLDAYRRHALANLRLKTVIKVRDGNLVASIGSNHATVYDGTHLADHVSVAVQFVNSATAHTPGGVSCLWLRT

SEQ ID NO: 12562 - protein, 183 aa, Chlorella protothecoides
MHAHLAGAAPDPGPALAALGGAQARGMAPSAAYLLLALCVRSGEGRRRLAAEIVAALTSESEAVAEPSVASGEAGADPSPASEDRRGAPASEDRRGAFVDVPGRTPAHEVRVLCDLAASLLAAPASQYAAPGAAASPAAALVPGEIARAMRDAGMVPALAGVLDRVDLDHPKVGEEPVFPLLF

SEQ ID NO: 12563 - protein, 120 aa, Chlorella protothecoides
MTLPCGTATATGSWDSSQRGARRCYSASWPGPGSEGGYSSEGLITRLCPCKHLYRAARTLSFYAYELNPTLFGWFNDYMKRHPIPKVKKCGWNEVSESGTCHAAPPGCCIERSPVRCPDT

SEQ ID NO: 12564 - protein, 144 aa, Chlorella protothecoides
MSCARDWTPPSSLHNGSARPAPELHLYNSLVDAKVPFVPAAGPGSRHVSWYTCGPTVYDSAHLGHARNYLTFDILRRVLEDHFGYDVRYVMNVTDIDDKIILRARRNHLLEAYRATATDPSQARSGGVCKGGGLGSGAVARPEG

SEQ ID NO: 12565 - protein, 484 aa, Chlorella protothecoides
GAHQLVDAGHARHAAHQQHLVHVLGGDARVLERAVAGLHSAVQERLDQGLELGPRQGQLQVLGARGVGGDEGQVDVGGGGGGQLALGLLRRLAQALHRQLVLGQVVHRHQALLLVCAVAQRRGGGLVDDAEDVQAGDAPRVLGRLALVVVEVGGHGDHRLGDGAAQVPLRGLLHLLQREGADLGGGVALAAGLHPRVAVVGAHDVVGHHLALLLHLGIVEGAANQALGRVHGVGGVGDGLALGGQAHQALAGLGEGRHGGRGALPLRDQRPRSADKWLLGPQPHAAARITACSSKRAVHACMHACLQRAAVQSIGTPWALSAQPCTNPNPHWLRCGARHSQPAPDRSTVQAPHQMIHPLTLPSMTATQELVVPRSMPMTSFPAADRLTVDLRGMGDGVGACHAAQHISAHTPPKVGLLTRSTAGCPSMMWRCIYMQKSAIMMMRQGKDLKAAHEQEDTISTTASPLTDDSGLRRSRLFPSRRPA

SEQ ID NO: 12566 - protein, 654 aa, Chlorella protothecoides
  MOD_RES (173)..(176): Any amino acid
  MOD_RES (600)..(603): Any amino acid
  MOD_RES (623)..(626): Any amino acid
  MOD_RES (652)..(654): Any amino acid
MCRRREGRGCPARARAGRPDLGCSGLGVKHARCACGDGKDVLEWGGCSAKESGTTLADFLLGNEENLKRTRSWQNACPAHNDRLESRGRCSKAHAVAITQDQQLRDTRWPPCASTHHAGAQCPPAGHSVDSDWRPPTSRVGRVSEEGPPPPHAAFQKKHIRLALPAPTPGAVXXXXMSGAGVSEEGPPPPNAGFQKKHNRLTLPAPTPGAVERWLHTLTHLSRNADHEGTTACCGLGASAEVEAVPLVVLDGGPVGPSRWVQAMGLECAEAGTLKRENLRSPPLTWGREDETLGGPPQRARGPRLQGWTRCNDWVVRSGSRAAPGSGSACRCGHALMRVVQGDGSCSTAHMGDAGVDDSPGVPPPLHQQVGFILGRPQPGGKDLLLALIPTPDCEAGPAARLDGKTHITLDADWVVEHALQLSRILIGGEKRGEVPRRTALLASLIPAAPTAPGPAIHVQASTCWVFGAQRWAGLGEGGGGGARRAVEGLGAPADPPHQGIARRWSPARRCPGPLHVARDSPKRSPVPAPLPHRLPCLARAARRRDQRSAHGQGCERARRPEALRPPRLRAGRADGDAADPVGRRRVVCGCGWCACQAGXXXXDSPKRSPVPTPFLTGSHASXXXXSPVTLCWGCSSLHACLARHVPVALRXXX

SEQ ID NO: 12567 - protein, 107 aa, Chlorella protothecoides
MLCGVPVPNTRTCTHAPSPQTPYHPPPPLARPPPPQAPTVALARRHTRGKRGEPPTVHTPSLSVVSGNYLAAKRRGVVGGVDHGATGMVRHVAAASVAAQLAAGSIV

SEQ ID NO: 12568 - protein, 337 aa, Chlorella protothecoides
  MOD_RES (316)..(319): Any amino acid
MGWDFPATNAFTRCLDRCEQCQIWVRSAAIVILTPEHARREIVQMHEATLERGFSLATGFVSPEKAPNPASARLNRSFVAHWLKRMWSTAACMSPTVPTFEHGRQLRLLSGLAGERVFKHSVVGPRYEGPRGMIFGSYLLTCDAGLPASTPSGLKGGTPQLPRTHPCRPHQSRRCNLKRTIHASATTSGSTLVEEEVYMERFNGYRRQGAPSKHPIINADYTPFELIEYTDKAMQHEIVMPVAAGIEKCYSIWSDRLNWLQWFDMIEERRQAIRLFTAAPHSKAYFSMQVGFHEDDPSLVSAFYMYRWGERKDPVXXXXLAVYEMFNEIDNTPSIAA

SEQ ID NO: 12569 - protein, 690 aa, Chlorella protothecoides
  MOD_RES (89)..(92): Any amino acid
  MOD_RES (509)..(512): Any amino acid
  MOD_RES (668)..(671): Any amino acid
MTPLCFPRSEMLPVLRGLRALYSGREGTLRDKARGIVPAGPMEGVAAGEHSGDTDTAADTERPSPALPAVLNKKKLQKLQEQYERRGIXXXXTQLQTQKDPPQLFRRFLIRRSCRRCRNSTSGAALYTSVAFLPTWWVLSQSYDPWDACTLPWKVCALPRSSAGRMHDSCSCGGLVRSNMPPISSSDPRLRRKRKEKGANTGKNFTEGWVEFEDKQNAKDVSWLKAHGARPWTGGYPVSVFAGHTARLPHCLTTCCRLTPPLSQAVQLLNGQPMGGKRRSAYFYDLWCLRYLPKFKWDHLTEEINYQKAIKEQRMAVEVSAAKRERDFYLAQVDASKAQAAMLERRREVRDPGADAGGKVVVERCLAAVSLHVDTSGAQLSHVKSCKQFQMPLDARAHPFAPLPLQRSGAEATPPADPSGGMPAEQPQAADKPAKPVVVRRYGQRKPKADPILDDGVPSLSGGLLKQLAGRKRPRSLGTLPPELAAGGGTRGDAAFQKPTRASAVAGVXXXXPPELAAGGGNRGVMARPCENHSDLCMHQSAECISRTQLSRNPHEHQQLPGLRREAGSGSTFGSPCFNGELAWIASPSVEASGMGVGAALRSPGAPSSAVSWGVCHQWGSGDDAAMKPVTTRPSPAARHVPQPLHVAEAGCSCPWADSIPYPQSGPXXXXWCTRQCRVLGGLQSVGIRR

SEQ ID NO: 12570 - protein, 172 aa, Chlorella protothecoides
MCAQLPYRWRPPSLWRKSSGMRAAAGSARCLSERRVECDDSSQPPVLSRGGQRECRQTGGEQRGARKAQIFKTLGDTLPACPAMQDPGVHTLHPGVQRPCHGLKVGRVLEGPDAAGLSLLAPADQRICLADGVAQLVQSSQQRLFPCGGGTLVFGVHARDRDANTEVPNTEL

SEQ ID NO: 12571 - protein, 226 aa, Chlorella protothecoides
MPSHLKAPSFTMTLPLARCRVTAPAGPVLLHPAPGRLVARGVGPPRPFTHSLQAVRRVCRAGSGPLDISEPFHAIQTTESVATNPVDYDAEAPSPRLLGFTFQDVRCFYGRVRGRGSLPDAEVRLPRHPHFPPVLFLDRRVYYYLNIAYWSLLLLSVLTGNDFLSRIAQFETYTTAMFVASTAFSTFFGLKWWHDARRELRREQTSDWRALLRYSWNALFWLGGRD

SEQ ID NO: 12572 - protein, 416 aa, Chlorella protothecoides
MLRKVSGLLRRGHGQDAAAPRSRLHTEDTDHDASGKGLPQARLPSRIFPDGPRQVSEEETFGEKPGRGEGGDLPIKYQCQASLGSLQGALDRGLLKLTLHCAQLLQVRRDRPYFAVLSIGSQTLTSARIRAPAHEDVCLTWEASSHFVLQRSGPTLARVAIYRGGKYKGALNNFLEVGDMGGRVEDESMRCCSRQLTLPVPPERGEDPCLKPHHTLSLLQCWCQIDLATYFDNEPGARSLPEGGWHDLLSANGSDGSASQHAGRLKVSAAASSPRALESQLWTRLLPLADFDGNGSLNDQEFVMLMQAFGADLEEHDLEGLWRRVADPEGAATPIAQLADRMTRVHSGGDLASLMKRCPVDGAALVPGQDLANLIYMTLVLDEGLAPTTPSATLKVGGEGGGGGVQKGWWGWDGGW

SEQ ID NO: 12573 - protein, 256 aa, Chlorella protothecoides
MAPLSPSSVLPNPTPALLTSSTPARTPYLEFYTTFKRTEAEPNRCILEEPVEGTPLVIAVLFQTVEEARAQASASGTVSNVLEGKEGGTVVTLRISYQLAVVLDEFAGQLAVYADVEEKLKACMVRMAAFIENVDEAALAECRGQDQTLITDGEGNQKGVGGFPEQRARRGEVEAERQAAIAAHEARVESALEYVTQEGQVMQDEATAASEVAAEKAVVAQQAAQAEAAAAAAAAPVEVKKAPTKRGRKPKKKDGN

SEQ ID NO: 12574 - protein, 165 aa, Chlorella protothecoides
MKPSTSTKAITSTAPREFKSQSGSPASPPDDSIRFHGVHHVGLLCSSLSRSLDFYCGVLGLAINPDRPDAKLPYAGAWLWIGPEMIHLMELQNPNPNPTPDGVGDGMTRDRHTCVGVHTVKPLEERLEAHGIPFQRSANRPAIFFKDPDNNCLEVVEIRPWRQGQ

SEQ ID NO: 12575 - protein, 112 aa, Chlorella protothecoides
MLRMTEWLTHPLAGAPSGILRGNKYAVGGLRLGAQAAHILVVDRRSRLVVEEKLGVVLSLAMRNMYQSRMGRVLMREGFFARLKSMSETKGRYMDSPESVKVGGWEREGKGG

SEQ ID NO: 12576 - protein, 192 aa, Chlorella protothecoides
MRPAQNGVVPVHACSSQGPDVGGPHGPYRQSERREIYKEYVDKLVEQGLAYPCFCSDEELERQREEAEAAKQPPIYRGKWAQASKEEVEEQMRAGTPYCYRFRVPKDEVITIQDLIRGEVSWNTDTLGDFVVLRSNGLPVYNFCVAVDDALMKISHVIRAEEHLPNTLRQVCRGGVRDCRLGASPPSAPHPP

SEQ ID NO: 12577 - protein, 120 aa, Chlorella protothecoides
MMQVLVYKALGFPLPQFGHVSLILAADKSKLSKRHGATSVGEFAGQGYLPTAMMNFLALLGWNDGTEREMFDARELSEAFSLDRITKSGAVFDTTKLAWMNGGAGRSGLRILGVETCACS

SEQ ID NO: 12578 - protein, 166 aa, Chlorella protothecoides
MAQMVAEVGAAKGLLARPAVTPFVQAATELTHQSLELVNDAVTQIQWLLQYPLEETLASPDAAPFIEDGFADVARAVVAAHADGSLQAAITGGPDAYKGLGKSMKRKGKRLFMPVRIALTGSQAGPDVGQALRLLTLEDGDLAAGVTVVHLDDRIKALQAWLDARS

SEQ ID NO: 12579 - protein, 535 aa, Chlorella protothecoides
  MOD_RES (17)..(19): Any amino acid
  MOD_RES (219)..(221): Any amino acid
  MOD_RES (256)..(259): Any amino acid
  MOD_RES (282)..(284): Any amino acid
  MOD_RES (391)..(394): Any amino acid
MPPVQDVWRLALPVQPXXXNAQSVHDWISLGRATSETPDISPKTPDITLLQVPGQGRGLFATQAISQNTLVHREAPMLCTPPPSLHQHAACAGCLAPGSPSPTPWICQACQEAGLQGEPWWRLHTRCDWGPLQALCSGSGDKFPLLMARLACMRLRPCGPERGEELGVGALRSPPPARGDPLSDLQHLCHARVPPPPPEPWREQHAALLRGLAAGLAGXXXRGPERGEEPGAGPLRSPPPARGDPLSDLQHLCHAXXXXKRRQWRAGRSTLRGTATACRASXXXPSGGSGVPGARPRVVQRRHVAPPPQRVQVRGMGGVCVVKRQPHSMTVPGGDLGRAKCCTESPAQPPLPAAGTPSADPPPRIRTPDSQGGHDLDARRITPPGRGCQPXXXXLESAPQLAGWTRYRCTARHSSRPRLPAWAGGRWRPWAPAARCTRWPPCSTTPATPAWTRDAAPAEPAPRLRIPVPLRTLCGGGGRICGGLRMQSGARGVHAWRDVGWNLPAEVGGGPVRAARDGMSEGLRSETDAVRGGVT

SEQ ID NO: 12580 - protein, 353 aa, Chlorella protothecoides
  MOD_RES (99)..(102): Any amino acid
  MOD_RES (124)..(133): Any amino acid
  MOD_RES (280)..(283): Any amino acid
MALSSARPGTKAQTLLLALSCTALGALMMCAHDRWTSVGFPLGLCPPMDLLEEKPRPEGWWTDLHQQYVDAMAEADKGEGSNDCSVAQYWSMVDVYSSXXXXVRPWTFWKKSPDPRAGGPTCTXXXXXXXXXXYGEGITEGWQGTFQGSATQPTTLRKPVDRAKDVTVTFNATFATPYGAAAFGIAGDGVDSLAWRLFHGELPTRNPPKVIVLNIGSNDLERARRSSPSPHQVEESIWKAVPHVTMRSGLEGGGEEQQGHESGGERRLEIAFRAVCISKXXXXQRQGHESGGERRLEVAFRAVCISKAQDGGLTFHAHPLWRRIGARHLPLWEALLAGPCHTKHIFEVIHRSG

SEQ ID NO: 12581 - protein, 319 aa, Chlorella protothecoides
MPAIAGPLIRPAHGGPGVRRAPTVAGGKVLMILHMREATKMCSLRSTRTTNLDPARTPGSLGRVGRENEVITHLDMMYRSHPMATGLLVMLATSFLIPVAADQECDWTGPRVDCGYVGITEGECRNKGCCWNPADFQDFPYVDVPWCFTQNAHPAEYEAAKIQEDNGKNECLVLYHSRTHRGMLHGQWHHGFSHVAILPVQHRQVPGRHVLTIAHMCGMSLHLARSPRAQRQPCPAVPRMPGGGSYAELALVKSVQPELGPDVTKLSASVRRVGCDTLRLTLRDADEARWEVPTHLFKSDILAGVMMAGDGTGGVQMGV

SEQ ID NO: 12582 - protein, 298 aa, Chlorella protothecoides
MGIAWPAQYALHARSIRRPCSPPVPERARPAGRLVPAAGVAWTPSAPVFLATPRPTHRRPSLLAQELYLWPEVAEAGRQALSQRYRLLPYLYSTMRAAHDTGAPAMRPLWMTFPEDVAGHRNDRQFMFGDALLVTPVLTQGARSVEGHFPPGTWYSLWNASDVVHARCAALGIQRGSHASGAEALVWRAELRHDDLGMRWRAPPPQLLAIDPAARANGTDVTLDAPLERIPYHVRGGRIIGTAEPRRTTRDTKAGALTLLVALPGEGSGAERSAHGVVYNDDGESVVQASRECMGGGR

SEQ ID NO: 12583 - protein, 132 aa, Chlorella protothecoides
MDFTFDPVDFPVEEMQVCGRLRWQSGHQGVGMGLSRAWVLGAFTLCRHFEGLHNRDQGFSAVPLATTSKYTWQALVEDLHANGQKFVPILDPGIKVEPGYHAYDEALKRDLFVRNVEGDPYLGWVRASWGGL

SEQ ID NO: 12584 - protein, 348 aa, Chlorella protothecoides
  MOD_RES (304)..(307): Any amino acid
PPPPPPPPPLPSGVLASNADSDSGGDSDGGALPSADAIRRAKETRERLRSAHLAPDYVPLAAGMGGGTDLSSKSEALVLRARLTDCASLPTPPRRARDRKLTEEGAAPSGSDAEADDEDRGRMVFGLGTRSDAPGQLGPQEWACRKGLVLRQALVGPAAAPAAQDLDEEEAAWAEEQITKGMGGLTHRAALVPGPAGAAPPAAARSAPRAMRPPGHPGGAEDVGAALAAAGATALASLRAAVDDGRARALAAAKQRDRTAAALRTAVASVETLRADLDRASEKYVDAQRMRAYAADLCAMLQAXXXXSTWTCSACAPTPPTCAPCCRRGGFVSGWGGGVVLTQIEGPG

SEQ ID NO: 12585 - protein, 270 aa, Chlorella protothecoides
MAPRRPPSWTNSGGMRGPGRGRRRSARPRPATPRWSDSLPRCRAPVEAGSTGSPDPELEFHGATSSESEGDVDEYRNTRDKILQAGFGLDFHVFDEDIGELVAADTLFLDAAEPYGTLRAVRAELDGWRRRQPAAYRDAYVAAAAPALFAPWVRLELLAWEPLDARTPFTDLAWGMNRRGRLGRGDEQDGAAGEGGPAATTTSNEDDLTVPRLVSSLVLPAARRALAPGAWSPLSVRQSRGAAALLAALEDHLPGEEAAVAELNAGVRAA

SEQ ID NO: 12586 - protein, 298 aa, Chlorella protothecoides
  MOD_RES (21)..(24): Any amino acid
MEPFNNLSPQPPPLPRQRIGXXXXCKTFAAGNCAWNLLTICPRTPRPSRASALGDSTPKRFRGIPLHAQGPIKLAGQSIRSMAGCPYHTRMGEMTSQLERLVHSPAGAALVVVSVALTLLAMVASSLRTLGGLYRHFIRGGRNLRQYGEWAVVTGATDGIGKAYAEALAKQREPRGVRTVLCLRLVSVSNVLTHTLLKPPAPRSTPGTDLEDRLPAGGGGQGDHGQVWRGGAGRRRRPHLHRSRRLLPHPGGPQAPGRRHPCEQRGHVLPPPRVHARCGRRGHQEHCEFECSVPLQGN

SEQ ID NO: 12587 - protein, 356 aa, Chlorella protothecoides
  MOD_RES (128)..(130): Any amino acid
  MOD_RES (209)..(212): Any amino acid
MRTASSWHSPAQGGSPLPLVPHPCPQLCRIVLGGMKERGRGLIVNVGSGAATAIPSGPLLAVYTASKVEERGCPLVAVGRSLAQRVELAAWPCPATAFPFRTRISNPNLPTQTTPPPPRRTWMLSVGXXXPPPHKPRQPPPPHPRRTWMLSVGRWTTNTASSACACRTRRPSLSPPRCPRSGEQRGVLGGGFVVVCGFIGWVPMVCTRXXXXDGGFVVACGFFGWVPMVCTRRGSPLAITTACKGLACRGRHGHPLPRRRARIDAPTPEVWAAAAVRAMGYETVFFPYWFHALQAAAVKLLPASLVQYQVMQIHRSLRRAAYRKKSKAAAELLRARSGNEAGEAPAPAANGVKKDD

SEQ ID NO: 12588 - protein, 539 aa, Chlorella protothecoides
  MOD_RES (141)..(144): Any amino acid
MALRQRCPALARGIFLHLARREAAGGWAWTAAAAPGPTLPSTCVPACVGAWRTFASGSLPEHTELAMPALSPTMNQGNILEWQKKVGDTIAPGDIYCEVETDKKGRTVLLSARTSSWRGGTTFTPNIAHANNAPDPHPHAXXXXITVWTAQAWKICHRKVALSCCPLAFHHGEGTPPSLPTSRMPAMPRTPILMPTSFQASMEWEAQEEGFLARIVAGNNTKDVPVGQVVAIIVENEEDIPAFKDWAPGASSEPAPAPAKEAPGHKEAAAPAKPAPKPKKGGKKAAKPAGRSWPPHEILTMPALSPTMSQGNILEWKKKAGETVAPGDVWAEVETDKASMEWEAQEEGVVAKLLCADGASGVAVGHPLVVLVEEGADITAFADFTDADAQGGAGGAAGEGEAEEAEGAKEVKPAKEAKEAKPAASAKAAKSAAPGARVVASPYAKKLAEEAGVSLQGVAGSGEGGRITAADVRELVESGGGKPVGGAGDAGAQAAAASWEGEGDDVAHSQIRRITAQRLLESKQTVPHYYLSVRCGGSQ

SEQ ID NO: 12589 - protein, 332 aa, Chlorella protothecoides
MLSPHSPLHVSFPVHREVLDRACTGRLPPYTLYRFLHSRVEVGKTIAPGFDPAPVNRLAVHGAGDAMALHCKDGNVLLSSLGSLRSSSLVLSWGAPAVPCTRLDPGAGPFFMPVWAADDLAIPSLASNRVLLYAGAEGRHSLPHTALALVSQGRNAAVSCLHVPPPGTAPFRLAAGTLDGHVGLWDSRDPGRGQGGALAPDLVLEMVSGRYAPGRHSVAGLSVRDGGNAVVAAYSTGTVRTWDLRGGRTAAACFGARIHSHPELSQVSLPGMLADIPGLEDWVGGRKCLERHSNCRLAQVRGGGRAGKEGRSPALGVGRVHSWARWGTSSAT

SEQ ID NO: 12590 - protein, 109 aa, Chlorella protothecoides
MTPLLPSQALVGIPGLIATEADAHHTGDFFCARLNDRPSLHGALLGCLMFLENPACPPSLSQAQLLSVAKNLTSNVFVQHLPQTERLLAYRALQALVQVGWGTAKTGPV

SEQ ID NO: 12591 - protein, 193 aa, Chlorella protothecoides
MRRPGNANLTGTQYQYLFSQASTPSSLVAQPNSVSSRRAGLAGLVFLGVILLSIGHLYSRLQTHALATPEPLPILPNPQPPPPQIGIYLPDSEHPASGLVRVMVVDGTGDPTGNSANYLDSDGHVNDNEARNTSSPAQSASWGPGSRATLLMQPSPSNSSISLVDVNDGNWHMITVSTHPNNSLGYSLYLDGR

SEQ ID NO: 12592 - protein, 181 aa, Chlorella protothecoides
MQLLPQLTTGIDVNVRFTSIGGFEAIITLQPLPSHLQFTRETGIFDLLNVRLVHGWLVDPQDTVTAQAVGQASYNELILRVVCALDGSYAAGVTSEAPGQAPAASQPLPIPGHGIDAASLTAALASAASGAPAASPSPADHKDSLASAINSMLGDLVKVSAPLRSRDDKGGTGSIYEHCPP

SEQ ID NO: 12593 - protein, 403 aa, Chlorella protothecoides
MTCAGTDAGIPVMGPLKCHPIGPNLLTFPPSIHPPALQGDLLDDCVQRNGTWSCLTNSGAWKACALSGDDQPMEEQGLLHVASRNTVGGDACLLPAVLNGYVFFDCVQYATESSNVEICPIANSSWATCDPLSRAAPTVFDASVTLARTARGRVNQLCHVDPADNANENQGCLEDLVCVPLPQLVRLEWAGAQGIGAPVLPWEGLSLVEPGRGLARPSQALAPVLLGIIACFSCCSFVPPPCTSTSALLSCPNQSPHDSPHPPKEIPSFAPQNTTALDGLGYCHDSPQGGTFDLPAILRGEDMAPLAFYPLTGGGLETLTLPLYNGSSAGPVQLRWANDTNFGSVPDCMRVSSTLVCALVPEGFGGMGKGGKLDLPLHAAMCFGRHDPACCDGATVLAGEHAS

SEQ ID NO: 12594 - protein, 130 aa, Chlorella protothecoides
MRSRHGSRRRHGQMQAATMGPDLTVATGVPGRQAAQGTVAGIDTRQEAAVAAENNARQGSEGAGGTPAPASVAAASGSQREARQVDEEVRQALVIQDFLESCPSQLTYHGLASLIQDLQEGEVAVFFRCG

SEQ ID NO: 12595 - protein, 167 aa, Chlorella protothecoides
MPLTNLVQAVRPVPITICTVAKASSPAARAMASEWRDKLQRYVSVEEVCVKPNPKNVKDPLLAVQHEGERTLAALPNDAYVVLLDERGKALTSPGLAALLTRASSDGSPRLAFLVGGPHGHHASVRARADISIRLSDMVLNHQVAHVVLLEQLYRAWTILKGSPYHH

SEQ ID NO: 12596 - protein, 199 aa, Chlorella protothecoides
MIQQSEACPIKPLHSHHAPQAASPAGDAFPAANAFFTLQDGDLTSSVPLNAYRGSGTNVSWVTDPSFGTRVLQCDASLGSHVSIPGLSYGQAGPWALGVWARWNVTNGTASAYVLSQNKTTNVEASLDPNTVGLYLPELGNPSYGLVRAVVQDSTATHGNTSVPLFLDSNGCIADILCTNQKNFTLVSYSWGRGGGLRV

SEQ ID NO: 12597 - protein, 170 aa, Chlorella protothecoides
MSLLLRRPPGREAFPGDVFYLHSRLLERAAKMSSSVGGGSLTALPVIETQAGDVSAYIPTNVISITDGQIFLETELFYKGIRPAINVGLSVSRVGSAAQVKAMKQVAGTMKLELAQYREVAAFAQFGSDLDASTQYLLNRGARLTEVLKQGQYSPMPIEKQVVVLYAATK

SEQ ID NO: 12598 - protein, 435 aa, Chlorella protothecoides
  MOD_RES (233)..(236): Any amino acid
MRHSALPERAKWGLGGSMGSGGQRAAKASAPSGLMCCVPPVFIQDQVPMGDVRDGGSHDSRARRGFRPGRNESAFHCPGTHLAPSSSSLHTAIKTSSQYAGWANLRSVLCAWPIATNDKKQDEVGKGQSSLNILQIIIFSGGSANISSGEVSPDSRGTSRTCLLAESLQHLGAMAQAVSLEAKELSSISFLKQRPRRSQQGQPAWPTRNNHGPPDVIAAHESTDQTCATSQSXXXXLLMLGASVLNCVWERPGEGHQGGADRANLRGQPETTMHLQMNDRLDLWPFVCAYVAWSGYVLWRLVTIGTEGFYLIQLATYALLAIHVRRAREGTPEAGGRAGTERLSRASGMREGTNGAESRPQITPPKTLIPTGRDLPVRGLERRQPGSPALPAGGVHLAGHACAGRAACICGDTGHCPPGAKGRCGESQGAKRRWD

SEQ ID NO: 12599 - protein, 242 aa, Chlorella protothecoides
MSSDLDARFKKAVWLIRNGPPRPGTTNDTKLAYYAHFKQATEGDVRGDQPWAVQFEARAKYDAWAKLKGMSGDEAKAKYIALLEEGELDGARAGRCARVGEGCWVSHFRALVLCGPAASSRPLSLLPHNNLHKRCPNSHDQGMLHGRTISHSRTTQIRDRAHHHAQLPITAWHPMCPPVGRGGAGSGVRHGRGQSGGTGQETLRGPAGCGSSAGWLLLVSDQLPDRRSSLCVRHSCDRSLWV

SEQ ID NO: 12600 - protein, 136 aa, Chlorella protothecoides
MAKRIIKLVSAVAEKVSMGLRHRQAPPPIRSSPQDAHWRTTDHPVPPPHAPVSQVNNDPEVGDLLKVAFVPDYNVSVAEAIIPGTELSEHISTAGTEASGTGNMKFAMNGALIIGTMDGANIEIAEGVIVLEARSL

SEQ ID NO: 12601 - protein, 573 aa, Chlorella protothecoides
MDTYTSDNVLAIQQAIVHHVEYTLAQTRYKFDDLEAYMATAYSIRDRLIESWNDTQSYFKEVDPKRVYYLSMEFLMGRSLLNALNNLEVRGQYTEALAELGYSLETLVTQERDAALGNGGLGRLAACFLDSMATTNLPAWGYGIRYQYGMFRQVLRDGFQHEQPDYWLNFGNPWELERSASIAYQVSFYGHVSVQDDGGRQAFRWNPGEQVTAVAYDTPIPGFQTNNTNNLRLWAAKPDREFDLQAFNTGDYVQAILAKQRAETLSSVLYPDDRTYEGKELRLKQQHFFVSATVQDVVRRYREQHASWDAFPDKVAFQMNDTHPTLLVPELMRVLMDHEGLGWTRAWELVTETCNFTNHTILPEALERWPVAMMEKLLPRHMQIIYDINWRFLQQMRGRYGDDWDRISRMSIIEETPDADKYVRMAYLAVIAARTVNGVAAIHSNILRDDTFAPFHELFPGKFQNKTNGVTPRRWLAFCNEPLRELLTDTLGSDAWIKDLDRLKVLREHARDPALQKRWQEVKALAKDKALSTIERLSGVALPNREAMLDVQVHTSRAGWDGEEKSIKGRQVS

SEQ ID NO: 12602 - protein, 328 aa, Chlorella protothecoides
MEAKGGRVSPCRPTGRTPNKDACNRPATPPCRHSPFNESSHFSGRFVSDEDRVMLNAIYFSSSSPSADRVRCSAPVAGLGEKAGLVVPPTSSGGEAEAEDVCIPLPTWGMRAGPRETIYFEPSLTRAASEGAGEWGVGGGGATASLAWTACISLGIEVHTNQHPGPLGRYGFQGFYSKKHRPVVLTGRSVEDIHLEGGSILGTSSIAPDYRWGVLVWLGRSLEVVVCSTVCIPCLEPSVALLCVSSPSVTSPKPLSKIVRMIDLMGLDMLFVIGGAGGHMGATQLEALLTQHGVRCVVVGVPKSIDNSILLVGREDMWGEVLWQLRGR

SEQ ID NO: 12603 - protein, 285 aa, Chlorella protothecoides
  MOD_RES (281)..(284): Any amino acid
AARARPRRGGARVRREVGGAARARARAVAPRRAPRLGPGLRDREGRGRLPAGTAGHAADRRLPRHLPRGASAPDPAPLRGAGHQQPHRAHRARAQRAQRARREGRLPAGHQPEGPLPGAVRSRHAGAPGRAAQLRGVHGRLLPRLLLLADQRQGDTGGGGDQCPTRSAALHSGGAQGNQASSSLLPFHLPRCRHNGNILLDDAGHIVHIDFGFMLTNSPGGVNFESGERVHGGNGCEGNDGWADGRCCAPMRSVEGVACTPDWARCHLTLGLGVTPHRPPXXXXK

SEQ ID NO: 12604 - protein, 417 aa, Chlorella protothecoides
  MOD_RES (403)..(406): Any amino acid
MLVIVSAGVQMSEDGCATDDKKGDREYLRQFRSSLLQNGDAASRIPGDPRRRLQWPGSNDACPSTSIHLTNAKSGHPVAPKQGCRMQRKLLSVRKMCKSIQWAQGLLRLTEWRLPAMLPTTVQPNPFGHSVLWQGLRMKSHLPPGKDRRNASADGHRLIAACPEVTAMSSLSQTIVRRPFFCSLNPPRRPSGFHAAVTPSPLRPSKWAVPSLAPSLSDVADASAEANQDRREGSYEQPLVQRQVPRGKGGQGALRRAWPRQGFHGQSWQCHDSRSPTRHRGCSMRGRKHWQCLAPLAPQARKRDDQQDPLSSLLPTPDARVSPDVLVVGAGPAGLALAAELGAQGLRTTLVGDAASIFTNNYGVWADEFQALGLEHTLEHGEGPAWNWVCACVSVSVFGGRRXXXXSPGTGAHPGAW

SEQ ID NO: 12605 - protein, 499 aa, Chlorella protothecoides
  MOD_RES (29)..(56): Any amino acid
  MOD_RES (252)..(255): Any amino acid
MLYSSESLHRARALHTFTLSPPPWSTSGXXXXXXXXXXXXXXXXXXXXXXXXXXXXACTHLLHPPCHLLGKCALALSSTSTPLLHTSYLPIIGLQAYRRQHQHRQWLEVVCLRCRGRADRLLWAPILPLGAGVRARRAQLFLIQVGHPLPVHLPHCSHGDDPFTLSFPPARQTQARRSGVSVPWRSCRPWTPSQSEHPLLLLSGSRGSVAPPASLALQDRDTPLSTAALGPEGSRLQSVGAHDCPAGRSVPXXXXDACAVTSPEKCQQYGRRAGASPGATGWPTVSFWPSGGSAQRSPNQDALRVFPSGQLAAVGDADDLLGGAGARAVGLNLLNHVEALGHGAKHDVLAVQPGGGGGAEEELGAVGVGAGVGHGQDAGAGVRQLEVLVVELGAVDGLAAGAVSWDDGTGDGEDASLGWQLGTHGDGGDPWEMFARPHRALMQRHSWQRTRGEVATLAHESGDDAVEGGALEVQGLARAARALLACRVGGRQHSGHIVA

SEQ ID NO: 12606 - protein, 273 aa, Chlorella protothecoides
  MOD_RES (136)..(143): Any amino acid
MPSRSNGAGAVCQKCLQPGHWTYECKNPAAYSHRPSRTEQLKNPKARPRFMDASELPEELQDKPGKPQKQEGKASKRKRRRSPSSSSSSSSSSSGSDSDSSGTSSSSGTSSSSGSSSSSGSSSSSGTSSSSGTSSXXXXXXXXSSSGTSSSSSGGTSSSSGTDGSSSSDSESGSSGSSSSTSTGRTSASDTASPPPTTVKKRAHRSGATPPAEEPIAARKRSTSPSAAAAADTSATAYYRRPSRSPRRRRRSPDAETAERRRIPKQDDRWQLH

SEQ ID NO: 12607 - protein, 135 aa, Chlorella protothecoides
MVLAPPFLLHHLPVLAAGAALVVLVKGLVVGGVVLVFGYGLEVAAGVGLALAQVGEFVFVLLSLAHGQELLATQVYLLLMGEPGGWCKGGKVGVVMGVRRCMQGRGGHSGPYHWSRAVRGMQRGLGCMGVAGGIP

SEQ ID NO: 12608 - protein, 336 aa, Chlorella protothecoides
MGGGLASDIPPHPLPCLATLPWLQIKEVHEEEWSYIPVGGPLPLADQPITAFGAAASLVHPATGYSLARSLREAKGVAAATAAALGSADSQRSVASRVWDALWSQERRKQVGFVGRGLRLFLEVHEDVRGVRGGFGCRGHAPLACGPSPTAIHQCTCPLIQIQTPTGRVPHLWDGAAVQDGGGANGPVLHHLLQPAHAPVAWLPGLQPHLPPAPRLCRDHLCVGPLAHQGGVHGCLGGDLLEAYGWGRTSSQFPGGSLVPRWICTCLVQPFQHLLFLSPRIAAQPNLQTRLVRHLVQDPAGKYLLRAYTRSSQEGSATEEAPGAATAAPRDSLPAA

SEQ ID NO: 12609 - protein, 160 aa, Chlorella protothecoides
MRRATEDVDEVDDEDSSDFADRAFLIVRRVVADKRPIQGKTTTVTVELYNAGSTSALEVKAVESKWPEPFFSVSGDLSASYESIPAGATVRFTYQVTAQEAGPYQHPPTQVSYQAVEDDEDSVKVGSGRIMGMRCILRCCWEGHLIPGEHAGIVMRARRK

SEQ ID NO: 12610 - protein, 139 aa, Chlorella protothecoides
MLPASHPAGEKGTGRSGKPLHFKGSTFHRVIPGFMCQGGDFTAGNGTGGESIYGAKFNDENFKLTHTGPGILSMANAGPNTNGSQFFLCTAATAWLDGKHVVFGSVTKGLDVVKKIESYGSGSGATKQVIRITDCGQLA

SEQ ID NO: 12611 - protein, 83 aa, Chlorella protothecoides
MQALEGVKTKLAETVTPAESLKGVLQARDKKAALLELAGKNGINAAFIQLLDENIATAGAAQQQKAVEVMTKLRAEASRYLTA

SEQ ID NO: 12612 - protein, 146 aa, Chlorella protothecoides
MHAPSHIPHRLVTLASGAAAGRFLKYESSAPAVAVQTAYGIEVEVAGYDEAFDPSVMLFMDFRRHHVGLGAGGARRLRPGRHPAGGDGVWDATDEVPSFLYAMPLGGQRVFLEETCLVAKPALPFQTLKRRLERRCAALGLEVGWG

SEQ ID NO: 12613 - protein, 413 aa, Chlorella protothecoides
  MOD_RES (400)..(403): Any amino acid
MHSIAINPTPTLFTSRQHRLHLTPSTRSRHVGPRKAVEGSPEPTEESATEGTSNRCETCGAPTDAIPSGCDRMGRIVGGLGSVPGFSWFPLKAYRPCPAAAQAGVQYTSSDPHLLSAGRVRSQTIFSGLQSEKSARPTSTMSSIHAQSSAPMCRYCPPTDALNVTKSYSRKERLPGSAARWVGSVAIMVDTFKIHSSPRSTMANLVHGASGAPLGAQVLHKMEYGAWQLHAMIGSCSLCKGPTMHIPCRTSSCASGQSTPRLHRSLALSPEFSSQGSAKKLCTSTGPYLGGRDPSRRQAIKHAMAAPAAFLLAQLAAPSSSHAFPGFKKDLTSKRRVKIPESEFKAGPEGLKYYDVSPGKGPEAHEGQRVVVHFDAKCVSGGWNWGWWCGSGFLDVASRXXXXAPIPGIVTGI

SEQ ID NO: 12614 - protein, 1178 aa, Chlorella protothecoides
  MOD_RES (178)..(181): Any amino acid
  MOD_RES (340)..(343): Any amino acid
  MOD_RES (486)..(488): Any amino acid
  MOD_RES (697)..(699): Any amino acid
  MOD_RES (899)..(901): Any amino acid
  MOD_RES (931)..(933): Any amino acid
  MOD_RES (997)..(1000): Any amino acid
  MOD_RES (1143)..(1146): Any amino acid
MSHELRTPLNGIIGLSSTLLLDLAGEPLRGRGPAVTHDVAAIRSSGVRLLNLVNDILDASALREGKLAVKLERVDVRRVAEDVLALVRQLAAPGVVILNDIPSDLPAAKADTGRLIQVMYNLIGNACKFTDKASWWWWWWGGGSKGDGAWCLVGRVPWEKGAQEATNLVASSGTCAAXXXXLVGRVPWEKVAQEGTNLVASSGTRTADSCRHPLPARVWQGGQPALDAEEEGCWAPEINIQGMALNHWTDSSAPCVCTDFSPTPIPSTARAASCSPLARREKTWCPSRCRTRASASRQASWTSSSALLPRQEAWFGSGVVSAGAPGRLAGKCERGGWHAXXXXSAGAPGRLAGKGEMGVWHATCSVCNRPCDPAKHACFAPMMSIPHSNKPPPLLQADMSYTRRYSGTGLGLHLARQLLAAQGGTIHATSHQNKGSTFTFTLPVGRTLGGCWRRLACIVSKAWVVSSSGWIIPASIGLFMARMRSXXXLGGCWRRLACLVSKAWVVTSSGWIIPASPGLFMARMPCVHRRRLQGRRRGGRDQPGAHAAQPAAHRRHAGGGGRRAGPGRPARRRGRGRGPAPAAAGAGGPGPRPGPPTSWPRSARRSARRRSSSARRPPPAPSPAPPDRAPAGPGRRATGRRPTPAPAARAAPRATRPCRPSSCPAPARRSLAAPPAAPTAARWCCRCAGAGAPSPAXXXGSDRGPLVLPTRGAGGAESRPDWQRAWQSVEDMRQRGAIRVLSVDDDPLTQTVVQGMLSRSGFQVSKAADGERALDVLEGGILAGRPPHIVLINLMMPKTSGWGVGGRELEAEGRWPCRELSGAAGTCTYLHPATLGIPLTPRLRRFDVIRTIRSRWPGLMLPVIILSASCWEKAVVEGLQASGGAWALDRRAGCRVGTXXXAHPRVHGRGLSPGPAFGGPVLRGREWGQRXXXGRGRGSPGEWRCLGSGWPCRMQGWHMLDALHPVLLITEAHRATQHASAASRRDPWGCTGRPQNXXXXPSMPLRQAGVIPGGALGSHRSTLHQTGAPTLPGRRQRLPAQAVWLLRAHGQDRGPAAHPRVHGRGLPPGPALGGSVLRGREWGQQVSQRQRRLLPRLLQRRELQLSGVELAGANMSASDCGTLGRGARGYYSPFPCASVHSAXXXXYPRAGCPRVPQPPSLCIRTFCCTPKPTKYPPP

SEQ ID NO: 12615 - protein, 777 aa, Chlorella protothecoides
  MOD_RES (20)..(23): Any amino acid
  MOD_RES (644)..(687): Any amino acid
MLWSRWPTVYAQEWSSKSTXXXXRMISETENCVFSSPCRCSGAVGLPFTLRNGPASRQHLVWTPCRAFGRPQGPIRCAERAARCVAHRRWGPRPNLADSYARGDLKLRSRAPSSPFPRQSGCRGMDAWSAANAPHRILVYRTVGWTYVVGGSKDQQAWRILKLSRREVELTVVEDPTTYTREELTSLLRCLRDGERNGCSYLGSEPAFVPPDMPRLGLCSPRPQSPPAPSPPDCLPAGNQAAGGLQFVCRAHGMAGCFRFLQGYYLLLILKKSMQGLIAGGPAWVDGRAPRPPLRPVLCALDIPSTAPPGGHAPPTFPLSPPGHKVYGVASTALLPLLHPEAHAAAFREGGTALPEARYRRIFGGVPLDSSFLFSRTWPLWRSVQSVLAPGAPAAAPPPNPDPFASQWVWNAHISRPLRALGLARWLTPLVHGFWTQRRLSVFGRPFTLTLLARRSRRFAGTRYRKRGLNADGFVANEVELEQVVEAGLDRRTRLPAISSWLQLRGSLPLFWYQAASSAVLKPEIVVQQYDPLYRATAAHFDALRARYGDPVVALDLVRRSGREAALGRAYEAALAQLNRGPPPWTPRASSSWAARPGGGGPAPGPHPTAARAAQGGGTPAPGPRPPPPRLPACGCSPACCAPXXXXXXXXXXXXXXXXXXXXXXXXXXXXXXXXXXXXXXXXXXXXQLAALGLSGSARGLAPDSSAARALMDAYEAAGHAAAQQYGGSEAHASFFQRARGDGAAATTSRDLLTSLRRFYSNAYTDADKQDSINLLL

SEQ ID NO: 12616 - protein, 330 aa, Chlorella protothecoides
  MOD_RES (224)..(227): Any amino acid
MSFVRTPSSCFPRSSPHSPAGRQQRPVARQAETKGPQVVRKLPVSGGAQLLLQLLQAKDPAAYARANVDLYQEEFFQSSWAFIAMAEREGSKEVVQELHKAMRIAMDAKQASLRPELQLMNLLMAAPDGPARAKIWAQFTEGDKAPLDGAFFTRVLARFSKDVASGASGTQKDKNLQDRLRRILIPSPCVLDGGCGGELNHPRYGVVGGAQWLDEGQTLADPNXXXXSAHVYLMEGAEASSITQGPAGSLEEGVTRVFERQQNIGVELADIRRQIAAFNATTSKLATAANKVESTALTFGDVQGFLTAIEAEVATIQAALQKIQGRNNGG

SEQ ID NO: 12617 - protein, 124 aa, Chlorella protothecoides
MPGELGIARTHWSGLHQQTGAILLTKRPSTSPPPVPRGATPRPSTSSMRSTRRSTRSTARLRAKSCHPLPRFPHRHRTVVADLLRAQSRDVHQRAQFIVTTFHPQLVAVADRVYAVSHSNRVSR

SEQ ID NO: 12618 - protein, 122 aa, Chlorella protothecoides
MKRNPRKVKWTKAYRKLAGKDLAEDATFEMERKRNRPEKYDRELVHKAVGALKKVTAIRATREARLHTLRKSAARDAEKAADLRELEQSIHLIKAPGVLAREEEERLRESVEELQQTEAMQE

SEQ ID NO: 12619 - protein, 223 aa, Chlorella protothecoides
MLDYALLTPKIALELARQASLLGDCLLTVAQLADCTFFLRPDRYLPDAAPPLFIDFTSGTATWVEPGSERGTSLAGVAAEVRASVARRAVASGAPCLLTLDCDRWAARGAALPTLAGILLGYPAVYAIGSQEEGAQAARCLSSGGLVLHSLTAGLQAGRDPSPPAILAYSVPASLLPDTEMDERASAWEAEVRVAAAVAQGGGWAWGDVGRSRAAAGPRPVVL

SEQ ID NO: 12620 - protein, 118 aa, Chlorella protothecoides
MQDNDEGERKIRQLISTLDMRKDEALERTFKGVAKNFRDIFATVGGLRRCAGGHPVSDEQAWMPPCRWKAERNLERHGGWAAVGRGLHGCCTLHNRTPPSTAPSIPPNSWCQAGGGRL

SEQ ID NO: 12621 - protein, 101 aa, Chlorella protothecoides
NSNVGTANWGNNNKGTGNRCFNKTGTRKIVNDCSLLEFRKYAWVLSFPPPPAKKSPPPSPTKKSPPPPSKKSPPPPSKKSPPPPSKKSPPPPSKKTPPPPS

SEQ ID NO: 12622 - protein, 269 aa, Chlorella protothecoides
MLAARACHRWAGGQHLKFWRSSLRSARHLSHGRKWQHQGRGAVLNSAASQSRKSVVFFGTPQVAVPVLDGLIQAASQPDSTFDVTGVVSQPARPSGRGSRRNPPPSPVAQAAARAGIPQDRILTPERAGDAGFLDALRSLHPDLLVTAAYGNYLPTRLLGIPRQGTLNIHPSLLPAYRGAAPVQRALMVSRAVKLGALALRYGAAHFVLPRLPLWQDCLEPLPLAHPDILACTPPNPQDGLTQTGVSVLYSVREMDAGPVLAQAAYEVR

SEQ ID NO: 12623 - protein, 175 aa, Chlorella protothecoides
MFPVIFPEECVEGSWRRVLPACRPVYINDTLAGLSPAAEPGAEAARPRSGICLQGKLDQSRRDYTGIFAQLQEQAEELAASNFTLVIQVLGVGVGLRVGTGITVDWWGTRGSGEGIGVCVARQPMRETKLATPWPPAAVDVHATGRRRLQREQPWPAHPHSTRALPHTLRARAQM

SEQ ID NO: 12624 - protein, 443 aa, Chlorella protothecoides
DPGTGGARNPRGRRAAGADAGRCIGATRLERGAGPAQAAPGAEGTLGAAGPGIQGAGTPPVPTQGVAVGLPAWSEWEAGLLAEGVRVWGCGNPCALASMIGTRSCAEVAAEVARRFPGATHGSPTKPPAYHRRKPAWGKRIRPTVTQDRLRRTDPVSGQSLRILGGEEEVLMCTRGGFQSGRGGSAQRSCCARGVASSREEEGAHRWLCPDERPPSSSRVASWLSPCPLHHPTLPPSPKEVHAVLPPRPLQLWAPWRPCSCVGPCVRGTCPCVDSQNFCEKFCACDCRACGNRFPGCKCSARARGGGRCRVRTCSCLAAGRECDPDLCAGCQPSLAAGSEGGDGDCANFRLRRGTKKRVLMGLSDVQGWGAFLQGSARAGDFLGEYVGELVDTAEADRRGISYDRDDNSYLFSLNKASVVDAKTKGTKLRFANHSSDANCEAS

SEQ ID NO: 12625 - protein, 139 aa, Chlorella protothecoides
MVPLLRPFQWASANPFSALSPCLAIISSPLLAWQAAARHTPHPLPPQITHTHTQLPQTYVVMVHNALALEQEAAVRAIRASGAKILTIAPHVQAAAQRRAAAQGVQVGGSRCTDVHPPCAPRPCAPVERSGKPSPLGDF

SEQ ID NO: 12626 - protein, 125 aa, Chlorella protothecoides
  MOD_RES (106)..(109): Any amino acid
MHRVHWVPSIPLPASSLCPFISIFCQGKAEIVQRVLEVQSLPGALPAQLVRPKHGEDCVMRAGTRDEGPRGRHVLCMGGIMQSRFAAVYSEIALVRVSPWAQGPFXXXXPSHGRYYVEPLCCSIF

SEQ ID NO: 12627 - protein, 74 aa, Chlorella protothecoides
MAIDRVGAVVIATRQGGNVVYERFYGPFSEPEKGELREAMHQATAHQPPDSADEALGQYRWGAKGGGIAGQSQC

SEQ ID NO: 12628 - protein, 341 aa, Chlorella protothecoides
MRGAWTVVTATLVSQCIGAAALGQSHVIKEALEYYCGPSGNCPLRLQSGPVVIRRVLEGSGAHRSLVVSVPVTAVHDTKRLLLLQPLPAEIFADVYQLQSAAAVGEVPPTLLHGRVDVENITLWADPTVLAVELQLAAQVGEAALANEGLGEGLAVLAVWQGLLKRDATRCPGVPPNSLALQVSGHTFVPNPASATDCTPTPCHLPQGDCQGGAPRQGPAACTVPSPAQGAALVAQHARRGRAPASPAPAGTPSCSAVAAGFGRGGPGRLDRQRSADLAHAGRQSGGKGTHHLGFGCSRRLGHQLPAVDGRHQLIPTYILTPVVTRSGPGALLPSPLFLSL

SEQ ID NO: 12629 - protein, 342 aa, Chlorella protothecoides
MLSPSYLQKVQAIARRYLDAMRSRVPQSRKNVTHIVDKMLFNSWCTRSSCLEQQNGTSLPCNVQTALLSNISFSNLIRFLAPPGTWASSPCSSPTPASCTWSATPPTPSSPASPSPLNGAASSGLITSPSMAPAWRDSVQPASIGAALPALVPREAGPLAWRLPGPKLCSSLSTSLPPSPLPPLRNAGIVDQHIQTQRVMALWERVLPPGRVYRLRYEDVVRDGEVASRGLLRACGLAWDPAVLGFHASQGRSVATASALQVRQPLHARAVGAWRRFAPWLAPALRPLRHDIAAYEAAAGLPSGAPLLDDEVWGGGAVQNEQADASAARDEQADASAARDEL

SEQ ID NO: 12630 - protein, 401 aa, Chlorella protothecoides
  MOD_RES (145)..(148): Any amino acid
  MOD_RES (326)..(329): Any amino acid
MPPLIRVLEPLNRPPSTPPPPPIPCCSQSDGKALVWGAPPQAIRAQYRTGDGRTKTSLLLVSGWWGLARHFHYLPELVAAAIWSMPAFHVAIMPFVYLAFLTILLLDRAYRWGGAHGSAWRCSLPLSGWEDVLPQHSLSSASMFXXXXSPSCHLYTSRSSPSSCWTGHTGGAGLKGARGAAPHPFQGGKTSCHSIVSPRRPCSGHVGNAAIVPLPVPAAALTPPHWRITSTASSQPISTQSTLPDPHRDDARCSAKYGKYWDQYCQRVSGWEEQAWLVSCVGQEVGRLLTGRLPTGAAQCPRASRQFHCSHLPVPRQVPYRVVPYXXXXYCQRVLLDVQEPLAHPIAPSPCTLPGSIPSSAIPLLEILYLFPARRRGGGQAALHVPSPTTTLLQAAHSRIY

SEQ ID NO: 12631 - protein, 651 aa, Chlorella protothecoides
  MOD_RES (596)..(599): Any amino acid
  MOD_RES (633)..(636): Any amino acid
MQGSPVACPRCNRPIPRPAPGGPLHDLDFRRIIPCIPKVRCNITCTCRLFWSTLGVRLLCKGLLTPPDNNRTYTMDTPICEGSTPAPPPITVHCWSGPRCVSTALINDRSATQVVDEPLYASYLARTGAERPYRDLVMPGVLLWVVLNAQSTSAAEVIQSLNEPHAGKFSFAKHMAKHRLDIPLTAFGPASKHMLLVRHGLGMMRAESRPCRPDILCFYPVAVLCQAPTCHSRWPPHPLHDRHPLAVIRSFSKVLPATLEETCYPALLSLASELRTSSSRLACARDHAWATQGEGQNPWTLLPSRNASPTPHALAPSPPAPSQHTSDSRPRHPPLSASPHRSRHGVPIILSEDLVRDAEGTLSLLCCALGMAPDPAMLDWERGQGAYAAGPDAAAPAGGVPGAVCRAEPARPAASQREARGRPAVAGLWCLPGTPRRNARVCAGQPERRHPRGHARWGHRCDVEFRVGGRGEGKLECNQAVAGGGSRWVDECIPLAASHLCSPDPAPTAPCRQLRPGVAPGRNGLRAGVWLPPGRRGVGGPAPAQRGGAVCGQASGTAVRGSGRDRHVHRAIPSQLLVTLLPFIEHAFKSHTGHGXXXXSVAGLEQSDTLPATGDAPSIHGTRIQTSHRPRGXXXXLKPTVCTWSRADPAG

SEQ ID NO: 12632 - protein, 323 aa, Chlorella protothecoides
  MOD_RES (129)..(131): Any amino acid
  MOD_RES (252)..(255): Any amino acid
MAGSSLSRYTSPPMLLSHPRHHTSRHSHKGVPEEFNDFLPKDCDEYKKLKAAQQSAAESGLEELTLQSLPAGPPAAKQLPGNKGKKKKGKPEAHQLLEWPAWPLKRPAAAWPSTNMQVKPSRRIFVATXXXVTGKGGASINSSGPVWPLKRPAAAWLSTNMQAKPSRRIFVATCCSASAGHANNPPQVVLERNTRNKKKCVTTISGLDLFGVKLAEASKIFGKKFASGASIVKNAEGKEQIDIQGDFVDPAXXXXFASGASIVKNAEGKEQIDIQGDFVDPAVDLILKQFKSIKKSDLALVENKKKAPYFDEEDSEDEDELFD

SEQ ID NO: 12633 - protein, 254 aa, Chlorella protothecoides
  MOD_RES (125)..(128): Any amino acid
MSMMNAIAGLGTQVIMGSGTNLHTSGHAYRCAEVLCTWLGCLYRSACSREPTYALVHGSGLNQPPFPITRPATARDELEEVLRLIKPQHFLPVHGEGKRDAILGWPGPRADVWLVPAANSYRPTXXXXPGPRADVWLVSAANSYRRTTLSSPQSPSLPNPHVRSQLARDNGIQHTLVVRNGQMVGVGDRRNRAEYGTPTSLSVVGQAALTTFYNDGDKVGGWGLGRGGRRGFLAQHTLSGGLVWILIFSRYLAP

SEQ ID NO: 12634 - protein, 242 aa, Chlorella protothecoides
MHAVTTSGMAASEGLARATVVVEAASVAAACTKWATSHGTGDRSTFCAVSGRAGVLVHRAGTWGILTLFPLFAVYAVGPAGPALEASQQYCPAQCGAPPSHRWYINEHCDGSLLGFLGRLEAGGWAFLVEAYPSPSWAAVRYILGFGLLQGVLQVWLPGPVHRGPTTPRGNVPTYTANGVPTLATTLLIFLATWRAGLFDPGAVYDCMGSIVSTSNIMSLILCTLLYLKANDFSFVGGGWQG

SEQ ID NO: 12635 - protein, 227 aa, Chlorella protothecoides
MLDADWFGTCDHLASLASLLPADTPTPGQLNLVDLAGSERLSRSGVEGKGVKETQAINKSLSALGEAGGWSWQEEEEWGSGVPDASWLGGSREQGGTPDPTHTLQPAWCMRLSSMQKGARTPHRAPPSALFNTTHPQKNLTTLHAAGTGDVIAALVNKDTHVPYRNSRLTHLLQGCLGGASGKALMLVHVAPEPGSAQETLCSLRFAAKVGAVEVGTARRQVAAAPT

SEQ ID NO: 12636 - protein, 160 aa, Chlorella protothecoides
MRPRPWMLCACILAALLWQAGCQLDSAAPDGRSRVPRAAELYRAVARATDDDAGRAVVLGNLGALLLGAEDAEGARAALTESQALCRGLLDGGASRPVTLEEQCTGNEFNLAKLLQTLGDAEGAEAVLRSRLLTRAALERTPALYAKVRGGRWACHLLVV

SEQ ID NO: 12637 - protein, 215 aa, Chlorella protothecoides
MNPFPPLSPRQGRLAPSSTDSGTTGSLLYDFYWGMELYPRIGAFDIKVWTNCRMGMMGWSVITLCYAVKQAQLYGAPATSMLLSVALVQVYIFKFFLWETGYWSSMDIAHDRAGFYLCWGCLVWIPAVYTSPAMYLVRRPVNLPLSLTLVLGFLGLAAIYINYDSDRQRQEFRVLEPHLEEGQEHNVYARPPQRGTGERDAVQGLCRCVGLNQEL

SEQ ID NO: 12638 - protein, 167 aa, Chlorella protothecoides
MHPLLTLGPPPIKSSPPGSELQVTHAAASGAVPATHTFSYDRVFGPAARQEAVFQEISQLVQSALDGYNICIFAYGQTGSGKTHTMLGRAGEEGIVPRAMRQLFGDGEALARRGWRFAMAVSVVEIYNEELRDLLGARLPPGKKHTGRDEGHGDEGGVKGGGVNPGD

SEQ ID NO: 12639 - protein, 366 aa, Chlorella protothecoides
  MOD_RES (257)..(260): Any amino acid
MARCRKGASSLAMAVKAPRGGAGHQANRATQVTSSARPARHVPTAEFRCMRARGECRHTLQHAIALQEFMSRPSFKVPRPHCLQSGCGHRLSTSVRHSGREAWLADSLRTIPRRCRGCSSRHWPEQGRGSSARVGATPSGRESCRAESPSPALPGPGGCPRSQSSAHPPSSRQTLPAASVALAYPDALPAKRVGGHAWKVWLVCGDCFLIGTFGTLRRPGCPRDCVLAGCACRFMSRDFPETQLCCVDRHPWAPPPXXXXSRDFPERQLCCVDRHPCPPPPILGLAPVLVHLSKDADGSYGFNPIAVNLLVEVVKTLFALGTLIAYVSSSACLGGGGSVRVFDLVMPQQGCMLRSVGLLKWSGHGK

SEQ ID NO: 12640 - protein, 498 aa, Chlorella protothecoides
  MOD_RES (101)..(104): Any amino acid
  MOD_RES (412)..(415): Any amino acid
MPLRILSALDASGVVRPRHAGRRSGSTQLWGRCHWSSIFQHSLLEYLHIQIRLNDFSCHHGEAKGSHHREGGGSQARNSIRLCAIACTDWSPTGGGGCPEXXXXGDAVGGVLRKDEGQVGPAAVLHADSPLPTSYPCSFNPPARQGHPRAQEPAPLLKGYPNCIVCLVKLMVMLGLNVHPRAQAASRGGNPSQELSGNSRPLVLQHRSSGSQTRGAREHQRGTPTMQKPSRRHQRVSAQVSQPLAPSTSHDPYERLMQDAEAFLWKDLEHLFDDQGIDSSRYEEAVNFSDPISKFSSLRGPRHPPLPAPRHQTMLTATPTPGYLANISFLRIALSPKFHLHDIRRTGPLELTTRWTMDMELSFNRWPAYYYVAWVVTLLPHACIARGASDAPLYSLPPQVQPPQALVRPKAXXXXSFHLPSLRTILLPRSSPYSLMHALHEVPLTLLCTPYLHRFNPLKPWYDPKPVFTGTSIMTVNPDTGEGAKMGLNVSQMGRSSA

SEQ ID NO: 12641 - protein, 415 aa, Chlorella protothecoides
  MOD_RES (108)..(111): Any amino acid
  MOD_RES (325)..(328): Any amino acid
  MOD_RES (382)..(385): Any amino acid
EAAGAGEAAGVSEAAGDAAPPDDVVLFVGVLSKGAEQARRDAIRATWGSHPALHAVRFFLAAPADPATLQQVCVARGACGARQGPGWGGPRRVWSLLLFCEEAQNQNXXXXRCSRCVWHVGAAGHGRARDGEAQGECGLCCCSVKKHKARIFLRPACFPHTLALPSPPPPSLQVEAEAARHGDVTLLRDVAESYFNITHQTLAALRAAAHDRAATHVLKADDDSYVRVAPLLDRIRAAPAERLFLGFVERPGGGPHRDPHSRWHVTPEEWPGDRYPPWAHGAGYVLSADLARGVERLVRPPLFKLEDVAVGEWVERVAADEGGVXXXXGWWEGGGWGVMQKNRWGAVAVCARPGCTRRGLQDLPCMTEAWPHPVPRHSEYTXXXXTWRWGSGWSVSQRTRAELSTTSETRGEGPR

SEQ ID NO: 12642 - protein, 180 aa, Chlorella protothecoides
MGAGLMATCMTRSSGPHILCMPSLTRIPRQGEDGRDLPQASDESIRVTGSPPQIQGVATFSGAANQTLAAAKAAELRNILREDGHTPADATSWQLAQYNSPLVPGFLRRNEVQGVATFSGVANQTLAAAKAAELRNNLRGDGHTPADATSWQLAQYNSPLVPGFLRRNEVLIPLSDYKLW

SEQ ID NO: 12643 - protein, 164 aa, Chlorella protothecoides
MSSCQPPTCPSPSHAGKFVSHIDTWDAVSNQSYLSLEAVRHLASQVGGFPSQPAAPSSLPAPQPPQVLTLRQTPQDLTTPSYLVLKKTPRYEVRQYEGFTGLETRAGEAQGQAFQRLAGYLGGKNSQGRKLAMTTPVLTDDKGGMRFVVGADEAVSGGKEVGTP

SEQ ID NO: 12644 - protein, 181 aa, Chlorella protothecoides
PEAAEPSAADSGEEAAADAPAPDDTPPAPAVSEARDGSEAGAPGAAEAQAFQGRLHRHWQHRLDHGEAAQAAMREEYVEAGVTQFIEDAIVKHEDNKWGNKVGCDTALSAKLFVAREFVEKHIRNKHAHVLQAERERLQDIVYWENFQCVWEEGQGSCPGCPGGWPAVASVGPTWHGGEYS

SEQ ID NO: 12645 - protein, 319 aa, Chlorella protothecoides
MWDHASGRSRGYGFVSFATKAQAEAAIQCHWAPCWLASLEDRLRPRRPFSLEHHAPRKAWPSPQGQHGQTIGSRRVRCGWAQHKVGESAAPVDAAVLDRSDPTNTNVYVGNLDVALTDSEIRRHFSSFGALAEMKLHRKGAYGFVRFRSHADAVRAIVGSNAQPLGSKVLKCSWGRHPSLPPSGLHSHLLLATGAGLNPMLPLALSAPAPGMVSGGLGSGLVNPMLPALPPAMNHSLLPPYQPPVVHYGGLGGLDGEGSTQRMLGLQGEGAGAPGGGMPLGPDPSREGGGGAGQPYAGGGQPGPSLGAPGAYNPMFFYS

SEQ ID NO: 12646 - protein, 118 aa, Chlorella protothecoides
MTTIQAARPAGKLADGHEQPAPVFQPIHFLYTYLHEAIRHELALLSQSLQLLLAGTSTGWPELRRRYIFLRDVYKYHSAAEDEVCALCLDGERAAAPVRHGKRTCVRTTTTRSHDALR

SEQ ID NO: 12647 - protein, 255 aa, Chlorella protothecoides
  MOD_RES (251)..(254): Any amino acid
MDTHKRRVGQSSLLSAVLAAGPELQRVKLARANGISLPDPASRRDAAHGDAALCMQDDPSKALQQGAPGSTLCLPATSFYAKSKLDAVEERILRFLTRVHVRHKQPEAVEAEIWHVFPTQQAAFDCADGLNEQRGSPLERTSLLSSCHCNRVWSMETSGDGKRRFLVSTVTNFYRRYSDMLPHHRHYYEIIREGQPCHIYFGELGSGEEEFESSRNAIDGPLSLPSAPPWQEQSRSQQIPNIPEPFMLLPXXXXH

SEQ ID NO: 12648 - protein, 311 aa, Chlorella protothecoides
MAGEASSCGLVIPAEGRTTGSLALVFKTHPFERIPELVKTKGYPLEEHFVTTSDGYVLGTYRIPHGREGASPGPTPCRPVLLQHGLLDSSATWVLNDPDQSLALILADAGWDVWLGNSRGNAYSRNHTGLAPDTAAFWDFSFDDMAAADLPALTAHVQGVTGCATLAYVGHSQGTTVALAALSTQGALRAALRPVVLLAPAISLRHIQSIPMLTLARLQADQVIVRGGGTLCDGKDHLSANCHFSACDPGALPAQASFPLCTDSHRQCPLPTPLHSSLPCWACLSSCPAGRPPPRCSRSCARQPPRPACRC

SEQ ID NO: 12649 - protein, 132 aa, Chlorella protothecoides
MYDWGGSCVSPLGRPQTCNRRVYGREQPPTYDLARLEGVPLAVVWGGEDKLADPLDVRRLLYVLPQASLKLAVVRWGGVGNLQMFTLASLLPLKPSAPAREPEPTPYIPLAGDTAKDRVYPLVLRMLLEWAE

SEQ ID NO: 12650 - protein, 249 aa, Chlorella protothecoides
  MOD_RES (44)..(47): Any amino acid
MRGSKARSSDRWRCRSAGLVQSCPPTACSRRCCIEMVHHAGDAXXXXDSSNPSREYPQHSDADQMITSILRAQASHLHLPISTRLILPAQAKKQASDADLMALVKQLRAENSALRVQLARAGLLPSGGKRAQDASAPAPPSPQARALASPRRKREDPDPHQSKGKSLPSLAELEAGIVWPQGREDRFWERPPRKAPLSLPGPPGKEGPPATAAEPLTIIHIAAEMAPIAKVGGGAATAIAESVTQGIIQ

SEQ ID NO: 12651 - protein, 286 aa, Chlorella protothecoides
  MOD_RES (190)..(192): Any amino acid
  MOD_RES (222)..(225): Any amino acid
  MOD_RES (245)..(261): Any amino acid
MIIPCVKHAGHPDPGSPRHPSTCTGVQVGGLADVVTGLSKATAARGHSVEVVLPYYAFLEGSPDVRDARSVGVFNVPKEHAGESSVCLAWGGNGLARCEAFTATVEGCRVLLLRPVDQGSLFQGQSVYGGAYNETEAYLHFSRSDKTLGCLAWQCAGKGGAGCQACGMAMLMMPPCVVKRPTTSTPSPPXXXKAGGMAMLMVPRYVGKRPTTSTPSPPPPPXXXXRGGEVPQYSRSDKTLGCLAXXXXXXXXXXXXXXXXXSAHAVLGGLLRDPAPHAPGAHHPQL

SEQ ID NO: 12652 - protein, 387 aa, Chlorella protothecoides
  MOD_RES (245)..(248): Any amino acid
MAPAISLNSPIAILTYSGALPRRVTAGGRERPSPPARECPSSRSHTRYGEKVRLMNSGQPDAYEELFAYACPKFVSRRFVDPANPQCLACPLATGVSSHGSAGLLLWKLVTRANTRMSAAQLPFNLIPFFSLHAPSSSCFPQGNANMEAYKPQLNQFLLGLGERDEARRSLRHGRVAPRKGALTCARKDLLASVLANLEGEKEALGPGPSWSCSHGCTGGLRRGLAAFSSSLCQSHPPPPKLHLXXXXFSSSLCQSHPTPTPTAPYSTSLSHTQSITLSKLASLAELDEASLRAQLALMHASTQVVTWNGGDALAGTPQPAGDLDFALERGEDGQEMVVVQESRAAGASGSAFLVSHIQKLQDIVTELEGIVLAPAPGASAPAVAAN

SEQ ID NO: 12653 - protein, 76 aa, Chlorella protothecoides
MSPSLPFLRVMAHHQRGPGYDQILKKNEQLYALLAISCESWLVHTGGSALVSLKGPVRALHPLKWWSGFVATKNAR

SEQ ID NO: 12654 - protein, 563 aa, Chlorella protothecoides
  MOD_RES (77)..(80): Any amino acid
  MOD_RES (101)..(104): Any amino acid
  MOD_RES (267)..(270): Any amino acid
MDGWDAAILHCHTPSLHGWIGTGSLVPRPAAPAVDLEREEASAGNAAGSKRRPGSHTMADGFDVRYRVGVPVDGNCXXXXEWPMRIGRLNWPLEQEWKGAXXXXADGFDVRYRVRVPVDGSVAHGTRAQDGARLCRLLLPSHQVCSQRLVPDVIHIHTSESLEQRCMICDPSCSIWTTLHDTYVHHCSSLISQTPHPTSLNRERNIREIFVMYSHTFPHLSERFFKGVAWPPVEAVSHLVDNDHVFCMLAPLDADSLSCYSAPPQTXXXXRLPVDIVRPSVRIHSHAIRCTLKRPPLTHRTLAQEMCFRHLHAAAKPTLAHRIASWENYREFFSVILSSHLNVQLPNQWLWDMVDEFVYQYQAFAQYRGNLSGKSIEELDVLAASPKVWDSQTVLQILNDLVSQSDIRGILSKPGDRGACMYALKPLVFPTRVSLNHRMFQVALRRCGAEALYVGEGYDLQSNVQTMLGYFSLVGLLRVHSVLGDYVAGLQVGGRVNTAVWALYHTRRSCHGSPPSIALFGSREPPSMPPNPSAGTGAPQPLQPPAPVHDKDCHVQHHPFLLL

SEQ ID NO: 12655 - protein, 646 aa, Chlorella protothecoides
  MOD_RES (12)..(15): Any amino acid
MVCFQILSGQGXXXXFLPPTPFILPSISLDGLLSNLFRPRSSSPVFSHLTPDGPHHTPPPNPPIPPAPPPPRRQRAVPGAGRGRPHAGHGLCAAAGPPARLPARRRPAPGLALHGHAARGRGRRGRLLAARPAVRLRRPLRRLHLAQRDPGGAGVRGGAQARQAGAPPGGHRCRRGARAAQSPARPDLRQPPAHRALPARPAGGAGAARRHAARRPQPGGARRGAGRLPRGQGPDPGGLRCRGAGAAHPQPALRRQLRLPGEPGAVHPQVARRGEGWCFDWLEGELAIMASRCDARRGKAGSTLSLSTSMGVDRGTKNNTIQSAGLPHPLTLLFEPPHNHQAARYIYPGLFLARCLRIVHPQDRLSRLSASQEPARATGGTPGPAGGRQPPPPGPRGSRSTYYLSSHPFAILAARAQISGALALSAPRLQLCPSPCSSSRVGRTGRLATDGHAFSFFTRELAPLAAPLIELLEAHDADLDPNLLLVAKAYAVVKEKLGEAERPRSEDVLGELGLKARKKKGRREADEVAGGQAGQEAHGGEAVAGQGPVEPAAPAPAYIPAKAFKGARQGYVFGNRASGLGYHLDTAAAPVQGKRSSGPPATSRRPVGGAAPGDAEVPVEAAVMKRKKALPGRLRKKLAASAAPAL

SEQ ID NO: 12656 - protein, 631 aa, Chlorella protothecoides
MRNSVGIGCSIYCLPGRRRCSGRRMSNGSHATCAIYPGPVGQWLRCSDHVGHEPFPPFLQSRLWGLHVLTYACRLSQMVEPLPLRIGVEPEHTHRSEAGMGVDYLARKSAKKDRKRAGKEGKVPRSRSRTGPRRLCRGVCFQEPVLQAADLEEEETGPLAPSASAPPPKHESLESRIATQLTSEPVPAAPRVETPRQAAPKRRKMSTSVALPMRVEHSEAERPLPQAAQGAPTPPSAALAQLPPLFQRYMASKGFAEPTPVQDQTWAPLLAGRDVQAVAEPGAGKTLTFLLPAAALLEKGAAKVPAATATVLVLEPTRELAQQVGLVWKDLARLTGAQAAVIHGGVPKQEHVRGEGLGGVVFVLGALSETEEDEVRCGLVRGGLGGQWWRPFASAGPESPPITALPTPASTPPLLKELLVMHTPVARDESDVYPRFSGTATPPGGCPCRYSSLARPHTFPAPGFCAGSRHQGQAPGGHRHARTLVRPRGQRGTEPERAKQALVGGDICVDLDDRASCHDFSMYFEIPAVPHCPDSLPPTITLKPAQASSTWSSCSGPLCLRSSPFTCSSMTKLASHTFFPLGPYPHLCAPASSAGEENPVYSSYGCLGGGSTEPSPLQANTFPEAEATDVL

SEQ ID NO: 12657 - protein, 117 aa, Chlorella protothecoides
MYNAEKKGKKQVLIRPSSKVVIKFLQVMQKHGYIGEFEFVDNHRSGKIVVELNGRLNKCGVISPRYDFAAGDIEHWVGRLLPSRQFGFFVVTTSQGIFDHEEARRKKVGGKLLGFFY

SEQ ID NO: 12658 - protein, 360 aa, Chlorella protothecoides
  MOD_RES (16)..(19): Any amino acid
MRQPSPAPQPHWMRRXXXXSVIDDGPEGRAKGDEAVEPSSPDSLDEEQDAAGSGDSASDDASEDEAGAAEANGGGAVDAEEDDEADSESAGDSEDLGSEGEESEGSEDRALDIFTPEQAAPLRALRVAATPTAFLQASGELAELARLAARALYAVAVSTSVQAPAGALPELYVDGFDPEQIWLQLDMLGAPALKRVRRLLKKTREDFDLLTPDSAEALDVAGNECCRSCVQSLSHQPFRSTSTGLAELLGLTAGPSDGEDEASDEDGSEGAGPHPSDQLDLAELDYGAMLAGDQPGQTRKAGEGEDARPKGGKSTSHALAAVEDEYLKLDEMEAFLQDAERAAAEEDGERGGMRACACVC

SEQ ID NO: 12659 - protein, 115 aa, Chlorella protothecoides
MTVLPELLPYSLEMARRGLTGVMNYTNPGAISHNEILELYKQYIDPDFTWSNFTVEEQAKVIVAPRSNNLLDTARIESEFPEILPIKESLIKYVFEPNAARKAECLAEVKAMRGR

SEQ ID NO: 12660 - protein, 346 aa, Chlorella protothecoides
MVDFPDAAPPAALRSKEQLDELLARLNRRGPRERVLHGALRKRYAAIVACMAQAEGTAYSLEGYARPVPRDKRMAVRTLPELEEVRNALAEAKERLDNFLTEAVEVGVELEFDAKAMRKTLRACDTPEDLRRAMLELEKVYCTAGEGLPPGATDREIQILMGEAAADEPEAKPGATASAGPTCAEPGVGVEPMQGMEGPGSAGAEPVPAEAQVAKGTDAAAPDSAGHAAAALPGAGVEAAAPVAAPGPSTTPSPATTPPTPAQPTPQASGTGAAGEATGTTCEGEEGEEGETAGTPAPFRPVTRDDDLDDSDAEHAFLREKRMRRPARLWRSARARARRRRPPCAP

SEQ ID NO: 12661 - protein, 121 aa, Chlorella protothecoides
MAAITAVIYTLASVARLDSYASYFLPLPTILVALRHGHTAALRAVLVSVLLLLGARVRGSVGPCQSVSWSESTTQHARDGASCCLSLVSRCTPRTTHYNRLHLSSPHQPIPPHHAPLPSQC

SEQ ID NO: 12662 - protein, 179 aa, Chlorella protothecoides
MCQLNEAGLAYSEGTSLLLAAPRSAPSGCSFPPSSWQPPSHPHTQFVSVASQRAPEEVHAPLEKGGVAPAETELEREDRKRRRAQKKRGAKKHRAAKDAERAAREQSLGGLGPIAGRKSEQAAAAAAAAAAKKVRGAQCGQEVFWPWLGFTMGSDSRHSWWQGFCSTFNTPRLMSIVER

SEQ ID NO: 12663 - protein, 124 aa, Chlorella protothecoides
MNLGMQLRPACASQDEPIRANARALFASLCAKLDTLSHLHFRLVQVLVKGVTFKVSSSMCCLPCIRGLPWLCPACMAWPALAPDAPPLLTQAGPRGRGGRAPAGCSRHPHGGGRATGASGRGGV

SEQ ID NO: 12664 - protein, 228 aa, Chlorella protothecoides
  MOD_RES (213)..(216): Any amino acid
MSLWGRLLLSWLHELALPSSKPWMESCGDPGPAQPSIWAELRIWHFAMLHCDELQSVDFVVRIDVKSAIYRAQGVDLTRCPRGQVRGRAMPYLSKQALSGLKHYHYKPGGYTILDNWHQPLWNCECMRGWGCLQDRNAFLPHLCRATANGREPAAVAACQLQQVLHRFSHLSTPPTLSRMHRCGVLPSHLAGTQCDHPHRLELGDGGQPDLRXXXXACSSEYCIGSHT

SEQ ID NO: 12665 - protein, 376 aa, Chlorella protothecoides
  MOD_RES (62)..(65): Any amino acid
  MOD_RES (272)..(274): Any amino acid
MVTTSRAVPGVAHCCPAEGERSPVSLKLVYQRTADPVLARTCTRFRVRVATLQFTPPHAPPXXXXCPAEGERSPASLKLVYQRTAGPVLARACTRFRVRVAPPQSPPPRAPPQDLELYLTGKIDKSAAIEEGPQDLEPVEGPEAVDPGLPPLGAPSEEAAGAGGVGGKEGDAEEATLRRVLANELQLRDRNSMLLVPGRSFDKVLALLRAVQADGAHAPPTQPKKKVGGGGWGLDMRRGRACQSRSRRGDLMSASALALVPLWPTHTPGLAXXXPVNLEAGGAIQCQPRHLHRCRFGRPIPQASRVLHAKSPPPNNSRSRQRCPWRPPAATSARPRRTPRCARWARSNWASAAWPSRPLARGRRGPATQAPPTARR

SEQ ID NO: 12666 - protein, 420 aa, Chlorella protothecoides
MTKDGLRKPNYYGSLTHAATCRVGNYQGEEVHVPFSSLLPMVHPNDIVVGGWDISSLNLADAMERARVLDFELQKQLVPYMRGTVPLPGIYDPDFIAANQVGRADNLIKGSRAEQVAAVRGHIRDFRAAHSLDSVVVLWTANTERYAEVLEGLNDTAANLLAAVERDEAEIAPSTLYALACVQEGVPFVNGSPQNTFVPGLIELATEAGSLIGGDDFKSGQTKMKSVLVDYLVGAGIKPVSIVSYNHLGNNDGMNLSAPATFRSKEISKSNVVDDMVLSNELLYAPGEHPDHVVVIKYVPYVADSKRALDEYVSEIFMGGRNTIAMHNTCEDSLLAAPIILDLVILAELLTRIRLARDGEELAGLHPVAVLLSYLTKAPLVPQGTPVVNALAKQRAMLENVFRACVGLAPENNMMLEFKA

SEQ ID NO: 12667 - protein, 134 aa, Chlorella protothecoides
MDPLRLLREYVSGGRLEEVTTVGDRVHFGTRFALPRSARTAYKSQAKDGAFYDLGALLFYARNLGPTFKYADYFKKAREAGVGQVTFIDRKVSPWAGACRCGGPCGFDCIFLALWGSEAAGLDASGSTSGTAPW

SEQ ID NO: 12668 - protein, 313 aa, Chlorella protothecoides
  MOD_RES (40)..(43): Any amino acid
  MOD_RES (157)..(160): Any amino acid
  MOD_RES (286)..(289): Any amino acid
MHAWEQVLSARWVERDGTNALPHRGSADIWHMHLVAACHXXXXMHAWEQVLSTRGFGRDGANALPHRDSACMWHMHLVAACHIWSFSPEVEIVKRPDGSPWQLGSGGFGTVYKALRNGVQPVAVKMLSVSFGGHLRSILGAQGLLPDMGSVCAVLGXXXXVRSILGAQGLLPGMGSVCAVLAECRGAQAPTSGASVPFPIFFLKAVSGDVRQAALEDFRKEISILKACRDLNIVQFVVSWRTEGEGEGHVVTAQYLQSWARCRLHEPRTELREFVPLAARPLSLTXXXXPPTELREFVPLAARPLSLTKWPEP

SEQ ID NO: 12669 - protein, 387 aa, Chlorella protothecoides
  MOD_RES (105)..(108): Any amino acid
  MOD_RES (186)..(189): Any amino acid
  MOD_RES (326)..(329): Any amino acid
MYLDPLAVVCSFVQGASLGPDNTMLVTEYCEGGNLCNNIAAGRVTWFRRGRKVGGVVVGGGPGRARRCDTHTGPTLPTNDSPCLSHLPRVHGWGRQLSNDAQERXXXXAHLPRLHVWGHQLSNDAQERRTFPGVPCSFSCTLPILTRHAYQAHPGGFHHPCPVPVSVRVLGGGGGVRWSTECLAFXXXXWPGECSGLGGGGGLCVGAPSVWHSTHSSGASPAPPNDLSSPHDRDGTAKISDVGMAKILNRDYITGAVGTLAWAAPEMLWGERCSEKADIYSYGAAAGMRGTAWVLFIYGLTRCLQAQPNPTPLLHPLAGIVLWEMXXXXMRERGRKEGRETHLVWLCLVVVVHCSVGDVHRGEACTRPAARCRVRWGGCAAAARGRL

SEQ ID NO: 12670 - protein, 659 aa, Chlorella protothecoides
MHQASPMPKQHAVSGSESGTVTMNGLTKWKGRHRSSEGESGRSSCKGTCRGSRRDVGWALQLLGRQGGGDAVQPLLQLLHGGGVGDAEAGRLAKGLSGDNHHVRHLQDVSFCGAGASAGGALPAEHHSRAHHPSLTPRPTQRHASPLPSPAQLGHGGHRPESRGFSARPHQGRGVGKHVKGAVGRIQDDARDGAQARHHVVPPLPEGRHHARHGVAAVRPQAQRGQCGVLRDAAGAGGALALHHARGGGKGWRRRQVAQAPAGHGVGLGEAIDGEGAVRHARQGCEGDVARGGEDHVLVDLVGEDEQARVGGHHFRQRAQRGLGVHRPRGVGGGAQDEEAGGGGERARQAPGREQEALGGGAGQHDRRGARQARHLRVGHPVGRGDQDLVPRAAGGQQGLPHGLLGAVGDHHLGWVHDHVVLGRQLLRDGGAERGGAVVGRVAREAGGDGLDPRRADGGGGGRVGLARRQRHHVHARLPQPDRRVGQLHRGGGPQGGHQRVQGLVHGAGHGTEQGGCTWVWVGVRVCGVEGQILGKGMMVGVTITSPLASHRITQCMAGTPNQMYLWQPSGAWLGGQRARNAGSRRCSGHAPSLGTRACRWLEMWGARGTWDPYRLEDPTQASTRHDAGQRCCGGRKRAFSRPGRSTSGAQACNLNKSR

SEQ ID NO: 12671 - protein, 156 aa, Chlorella protothecoides
  MOD_RES (146)..(149): Any amino acid
MPSDIKRVQYAQLARSLRGRPLAELISRATTEPDLATFGDLLHLTAVQEVRLGDWRPWGCYLHGGTTRLDTDDAIDTSLHSAPPQLSNTEDAAALSLLNLFSYGTWQDYSGNMTAPGRCGCIQRRLGERCPFLGLNPDITNFPLGXXXXKGAPFWV

SEQ ID NO: 12672 - protein, 421 aa, Chlorella protothecoides
MGCWAAEAVAGGRAPGLQKSSHQIFEYSTTILSRVLEHCIVTPRLAVYWWVAVCHCLEQAPTIISYVDKLAYSGGSERGSAPTLEQVIGEFFWKGAQTVLSARLPHATPSDTKGSGKKRAWVSRWCGTIAMTLAPCHPSRLPEPAERLPRRAVQLGAGRGRVGQQGTREMATRCRLATRGGGEGARMGDGASGGMVEGGGGLDPGCCEVLQLSATPLRPHLFHLKVFLRPWGAQEEKVALMSGDTGLGKPCLRASWSSRTRSCCLVWMHSRLPVPVVSACDPELEKKELEGPRPPPHTTVETLLERWVFHHQQLLPDSPSSLSKSALVRLSPSSIYKRLVILLRSVFALLRTLPAHKLCRAGGAGRRSAFSLGYRLHSSLPGGAGEGGPERSGSGGGGSAGGSSSGPAGPGAAQARAPRGL

SEQ ID NO: 12673 - protein, 458 aa, Chlorella protothecoides
MASPVDQSLNPLVASLRPSATVQLTDTAVRLREAGVDVVALAAGEPDAPTPAAVCAAGIEAIASGLTRYTPNNGTAPLRAAIAKKLAAENDVIVDPAQVVVSNGAKQAVWQALLATCGPGDQVLIPAPYWVSYPEMARLAGATPVVLPCPAAEGFLLTPRRLASALTPASRLLILCSPSNPTGAVYPEATLRALAEVVAAHPRLLVLSDEIYEYVVFPPARHVSFASLPGMAHRTLTVNGFSKAYAMTGWRLGYLAAPPTFATAAGVVQSQCTSGASSIAQHAALAALGLGPHGGDPVARMVAAFRERRDYVVARLRAIPGVVLDAPDGAFYVFPDASALVGPGAEAPGFGPVPSVAELCRRSVPHCSRLLRAPEQVHVHLHAHTCTHTYLPRSQPRPAKRYILEVAHVVVVPGEAFGEPACFRISYATSMEQLEKGLDRIAAALAPEKLQRPSDVAA

SEQ ID NO: 12674 - protein, 344 aa, Chlorella protothecoides
MHHAILRVFCICAIAGLLLGLCILQVDPAPPQPHADGQTQLPPPPCTPLEGSGASDAVQWMHAQLGRHCQPSNLTITIPPILHHIYFPDRASFLRGAQGKGSATNPAWSESCLRLHPHWEHVFWGEAEAKAFVAKFWPGFLATFLSYDHPVSRSDALRPLLLHTLGGVYLDLDIECFAPLEPMLAGADVVLQGTGPMEGVTNGAMASVPGHQLWLDVAGELERRAPRADLPIDRQTGPGVLAAAARRALGLPDGAGGFAGLHAPSHAGGALRVWPLGSFLTPCAWDDRRCHRAVAIARGAGAAPPGVVGYHRYSASWHGRGRNRHGVLTPQDVVWAVGGAQLGM

SEQ ID NO: 12675 - protein, 65 aa, Chlorella protothecoides
MEYIQAAEPIKVHGLTVASYGSDDPALGCPVEYITLKGTSREHPAVCKYTGNKYYSDDWVGGGAH

SEQ ID NO: 12676 - protein, 208 aa, Chlorella protothecoides
MPTILVELRASLGTNGAGEPWAVPPISLWALPLRAPSFLPLAIPVPHRRALAAYLRRPGQCMWLLGMLLFVAGNVLNFLSFAFAAQSLLAALAVVQFVANVVFARLINGEVATRRVLCATGVVVVGCVLLVAFGNHESPVMDADDLRHLYTAYVAGAGAGVTSTLSRPVGEFAGFCMLHFAATLRIQTHHPTAHPPTDPHTLATWWGY

SEQ ID NO: 12677 - protein, 475 aa, Chlorella protothecoides
MLLRKSLQGPTQLTHWYTYVALLLFLAFAAFWVVKYSEGERRNEARRWRATRNEPRAPSAASPYPCPSRTTAMRRFPVLTMMPMLMIMWVLISMLSGMVYFQEYRTFTVLSTAMFVLGSATLLGGIYLLATCKEVGPGSGREGLRGAAKALKPHMQQAGCRACSFDRRRPAQHSLPAPSLHIAPGGGPAGVRPAQPPVQHGGLDPAEDLAEALWGDVERSDSAHPSAPAACGPRFGPTAAAGRLVRRTSTGAGPPPAQLEHEPSSPPAVPLAVPVGALQLAQNPMFDMPCSPGPPSCRLGAWRELPALGRASRVPGAVLRPSLALQVDCGGGGEPAPRLARSTSGGSEASSRVAGAAPGVLSPILSIFSMPGGAWDLGAPTPQPCAPAAAAEPEPPAAVDKDAGPAAASKAVLPGTGAQSDGQKQAAVDAAESAEAPRDTIPAGRPGREAGGGRTADEEAEDGQDAEPGEPETRS

SEQ ID NO: 12678 - protein, 307 aa, Chlorella protothecoides
  MOD_RES (42)..(45): Any amino acid
MSGTSGPVIWRAGGDAHSDRFLRGGAGHAGHASLVSAPGAHXXXXRESTQGSACQIVPAGSADGQGCATGRRTRGARFPGVGTRRASQSGERAARGSRRLLVEPDLRLLGPTDLLLQLEQAVHEGLGGGGAAGNIDVHGDDAVAAPHHGVGVVVVAAAIGAAVGGEGVVVVAAAVGAAVGGEGDGTVTRERHRGDSSPQSTLAGVALSAFLQTPLAHSRILPGQVVVSHPHSPSRGPPAHGQHPARLRHLVVHLAQGRRHLVRQGPRHDHAVGLAGGGPEDDAEPVQVVSGSAWARERLEDGQLARA

SEQ ID NO: 12679 - protein, 212 aa, Chlorella protothecoides
PAPVLASLLSSLYSAPDSAETVRGLTVGVSAHQKLERLSALLRTLGYEGLAVFGDCFDEVVLLDPVQYPGAIKVFAREVCRNDLLNFGRMHFFFPDSRLALDLNTDKTLKEARFDRHFVRDLTWSRHQLEELAERRFLAAQLEAQRRAAAGAGHAEARKDGGAGLANADVSSVAGGKTYTFADLFQAVSGFGWAGGAGGEVGKGESRCRGCC

SEQ ID NO: 12680 - protein, 69 aa, Chlorella protothecoides
MIMMVRGRGPEAMGCRLQLARRTLSRHLHCPPRDPLQTEMMGRMEAHPEGGLTAQDMEISVTKALEQAV

SEQ ID NO: 12681 - protein, 214 aa, Chlorella protothecoides
  MOD_RES (124)..(127): Any amino acid
MRHCMAACHVPGKKRLNRGSAMLSPSHPQDDQVCRFTSANHEWFAAAAGVCVTTYTMVAYSGRRSEESENVMNEIMNREWGLIILDEVHVVPAQMFRKVGKGGGGGERGKEQVWGIAGLLLMGXXXXRCSARWGKGGGWKKGGRSRCGRLRASCSCGGGLHLAVLPDLSGGVWVMGTGCCDAGPRPPLRPFLSPHVALPAHLPAPPVPTLSPPC

SEQ ID NO: 12682 - protein, 404 aa, Chlorella protothecoides
  MOD_RES (127)..(130): Any amino acid
MRRRASPAPGTRAPLPWTRPGQAGAPAQRLLRGVALPRRPAPPTARPRHPRGARPARRRRLLRGQCGRARRRGRHPGQDGRGGGGGGGCRGARWRGGGWPRWGRCFGSRTFPRRGSCRAGRPRLPDXXXXAATLAKTDVDAGGEEAEEGGGGGEAAGLDGGGGSAREPSQGEAPAPPAGPAYLIDPVEIDPDRELHAFEIEAAQVGRGAWAGGRPCPAFSVAMGPPPTWPGMGGCDAQLLLLHAAPRHPGWSPSCMHCHTPAPPPLPAHPASSLLPCTRQVEHVKQRCLPGGLNYPMLEEYDFRGDVANPTLSMELRPHVSHRPYQEKSLAKMFGNGRARSGIIVLPCGAGKSLVGVSAAARMKKSCLVLCTNAVSVDQWKYQFQMWTSLRVRGMGYVFRGLRE

SEQ ID NO: 12683 - protein, 467 aa, Chlorella protothecoides
  MOD_RES (292)..(295): Any amino acid
MTQTLTSMIARPVAPGSSITHHSGAWSSRLAPMSTRQPFTTRTRAAVKTVEASASSSTDSEEEELKPQPVDQAKDKLYIGFPKGDYKPRRGRTGRIVVDDPSLYPDRDALGIGGWAGGEVGLRAFLERSGDVARYEDAPLETPLADTPPRPAQDPFAGNDRIYVGRGRWITADARKFPYRDAFSGGFAGGELGVRTFLERGDVPIGPPGPRRPSALTIASTVAAAGTVSALLITDAEEVLPGALRTVAVPLRAGVRGLTTLDDGTKHALQVGRGSFSGRRIEKGMEGCQILXXXXQHTSTLVHATLVHATTSAALHTPDRGSGRGRRPGRRSPVQTGVHADWEAGSGTAARGGHAALQRRLPRRSRVCPGAVLTTSLPVTSTVARKGARGASIRIRCEARGGVEARSTGSIAAPGRQAKDSGLLSVLRPQAPTRRPQSQSHPHHPRPLLVGMMEGWGGRRGRGSSDK

SEQ ID NO: 12684 - protein, 173 aa, Chlorella protothecoides
MLCGGTAWGRAASLRAWMSSMETITSRRVPNLPPITHHTYRYPPLRYPGGIDHSVHPIRGSGSTATGRSTGPVGMGWTVMQDAAVAARVLGCHPSFENTEQHLCTIFAGGSSDSRQSLQAMCNPNAHATAFEARVWLSVKTGGMSVATEAKLSAFRAALEAYFEQLRTSKTVA

SEQ ID NO: 12685 - protein, 658 aa, Chlorella protothecoides
  MOD_RES (162)..(165): Any amino acid
  MOD_RES (376)..(379): Any amino acid
  MOD_RES (441)..(444): Any amino acid
  MOD_RES (470)..(472): Any amino acid
MLAARFGLDGSIMHLSSSPVCIMTRHRGCSVCEQRRAGRPGRHGPITPGNLSTSEMHSVLQSAAPCPGAATRLLIANVTRLCHEKDNPDPLASPGGVPRLAFVSGVTAPPTAWQARPRSAPGQWRAPPLQVHRCATGVMTWCAVVDLGQVGPQPARLAGSTXXXXTCCAVVDLDQVGPQPARLAGSTPFLCHITYAGMQNLVVTLALVFGLGFATDVLNLGWVYDNYLPLFTASLIVSVLGSVALFAASHSPWRERPPLLAAGGDTGYHIYDFFIGRELNPRIGSLDLKEFCELIPGACVSGSTPVVWADRVAGHRSGLRTQAAAGAGVCVRAHGPRLRVPALLCASCRTPGPDLPAPSHSPRPQYLIPTFCHSAXXXXRLSLHRVLQGSMQIHGVYLCEKQASMQHYCVLHAGPQALTSQHPPTAPVHNISFQLSATLQXXXXSSLTPKSPPPMSVLAHRADRVAGHRXXXGLYVWDALYHEPAILTTMDIVSDGFGFMLAFGDTSLVPFTYSLQARLLVSRGPTLGALSIAGLIALKGLGDTTFRGSNSQKDQFRRDPGHASVAHLSSLPTERGTRLLTSGWWGLSRHPNYLGDWLMAWAWCLPTGSAAGLVPYYYVIYFAALLGEGRELWRGDGWGSESSVRGKRVQGECTLSLW

SEQ ID NO: 12686 - protein, 125 aa, Chlorella protothecoides
MTPSSIPIAVHRAMRDDHACRLKYGKDWDKYCKLRSTRSQERQRNWRRSSVIRCKIVEGEPGYIGPGHGGAGYGRTSWGFGVSNCITDRRSNHRMYEENIKALVCPCAAAGCWECVKQVVSRAAG

SEQ ID NO: 12687 - protein, 767 aa, Chlorella protothecoides
  MOD_RES (99)..(101): Any amino acid
MGGAESCSPFLIAPSPPQNQARGEGSGICVQGSTQGQNSAVGSLKRVYLDMNCRLYHSLSCCQTSLLNLCSYTACSHPPPLNPLVQLLIGGKFVDAAGXXXKNSVHAVTPPFNALVQLLIDGKFVDAAGGETFTSVDPRNGNALLEIAMAKPKDVDRAVDAARKAFDEGPWPRMSGRERAGILFKLADLLEVPRDPLCSWLLPDEMACRSAPILENAEELALLETLDNGKTYSQSACHPTSSRQGYPPTHTQQSSTVDIPETIYHFRYFAGFADKIEGATIPVGSAGVTGKGFTAYTLREPIGVVGQILPWNFPALMAAWKLAPALAVGCTVVLKVSQHTPMTGLRIAELALEAGLPPGVLNVLTGKGSDIGDAICNHPGIDKVAFTGSTKIGKIIGGTATGNLKPVTLELGGNSPVIVTDTADLEAAALGAHEALFFNAGQACECGARVFVDERVYDEFCARSIELAKGRKTGDPFDPDVKHGPMISEQQMEKVLELIESGKKQGAKLVAGGERLGEEGYFLQPTVFVDVQDDMDIARDEIFGPVQVCVCVGWGEFCRVQAGYWECLHCVSLLPCTAWHSYSPDSHQPTSLSPPHQIIFKYKTLEEGLRRANDTNYGLASAVWTKDIETMQLASRTLKAGTVWVNTHHVLDAAVPFGGYKESGLGREHGKEVLEHYTQVRVQEVCQGGCEVVEMTSKAETAHLVLDAPCTILADPTDKGSVHSPAQEQPLADHVEQLLWVCCTMYEQRVHQPGSVNPRVPLPKATT

SEQ ID NO: 12688 - protein, 142 aa, Chlorella protothecoides
MEYDEFFALSRRHFIPPNFAELRHILNIAQIHASATSLRLVTFDADGTLYADGAHMQHDNEMIGHVIDLMRAGVHVAIVTAAGYPNEPERFEERFDGLLAALRYQPKAVVNRWVVRGGPLCSLQVGWPGGCSGRIRIADKWE

SEQ ID NO: 12689 - protein, 275 aa, Chlorella protothecoides
MAGLERSLGLRCPAAVLHSNYSRTCSQRWFRKGPQGPPRSRFPSRLAVQSLEREQAELQGDAQPSTSQEGVDSSTSEYWQELISTPDSELFGSRARSASDAAVLRRKGHLKEQDKFINFLQEMHRTHTCLEVCRDWNWRLGVLCRLLAPLHGRHKVLSRQAHNPGRLPIQIDSPHHHRSCRRWSSGLWSTTAAPGPAASNAWSPAWAASSPPSGGSSMVMSRWEQHGVEQVLRRKSRWLGPVQASTSNAETRAQPPTSAQLVSSEHLLRDATATC

SEQ ID NO: 12690 - protein, 490 aa, Chlorella protothecoides
  MOD_RES (21)..(24): Any amino acid
  MOD_RES (357)..(360): Any amino acid
  MOD_RES (397)..(400): Any amino acid
MCKLPMFYSKWPWEPMYAHIXXXXVAKCELPMFYSKGPWEPIGTASRHDRCTRSCVPGDQTAHARLLPGHQPRRPSKTHTPRGCAVQSGPRSAVLPPDHSRAGQQQTGRVLLPVHEPNTRFPPAPRLHGPRLPGRSHPARPLRRSLPARGGDAGAPVQGERRMDHPGTVPGAAGPPGLRLRHRGGGGRGGAPPPAPVAHCFAGGINWLRGGGGGRLLRLHCGVGVPKGPRPQQCSGTTGLCPLPSRQFLSLQVYTSLAKDMKKSDLEEFEVPGGDEILAELKFLTHEQRLPAVRYIQARQMDAQVGMAAKLVLGLAVSGGPCCHQAGIGCCCRRRSCAVVFSEPLCRCLFGFPACHXXXXVHAVTRQELVVVAGEVCGGAAITQHAMQAHPHPSCPXXXXTLVEPFYPPQCAGGQQSHNMQCKPTHTHPAPALQSARVLARAIKEWVRREGDKQGFSNAPADCLAFKYYRDVSALGQDYCGLSRVWAEGM

SEQ ID NO: 12691 - protein, 450 aa, Chlorella protothecoides
MAAQELKTEQEIVNKFQQLLEERNALSTAAIERRSEVAEHELVVKTLEPLDASRKCFKLLGDILVERTVGEVLPTVNENKNNLLSVSWVACSVDAGVKRLLKHGRPASFHHSPNARSWQGLLDWMSDCAARSSAPPCTRVNPFEHLAPLCRGRARIRQLPKPKHQAAGSRESSSATHEALGCPSCVPECTVGVPQQRAGRVPVRWWLRQGGAAHSSEYTSPAQRDRSSDVLAAAPVAMAGGRQRNRIAATWEAPAASSPGLSTERPPGCVALSTNRQPSPAAEAGPTSTTRSPGPAFALPMPACSTLQLATRRPAGVPAWASAGQSGSATQSCALDPAGRATVEKKSPRPWARGQARSVAGAVDSKAPAMGSRRVPRSVGIRWSVLSLGSLAAAASSGVGSFLGSSRPPRAWRAEGVTARSRPDFARAADSTGSRVSMDWEDIGEGEGGE

SEQ ID NO: 12692 - protein, 409 aa, Chlorella protothecoides
  MOD_RES (262)..(265): Any amino acid
MQDRSPNAHSFSISPVQYRIDNINCGRASFSSSKADGGVIVRDAIQHLGNVRGFLIGASSIPHRLGPQHAFRAPRTRLVSVLRAPARSLSAASAQPASPAKDSKRSGPASEQSVTPLSEDFSRWYLDVIREAQLADYGPVRGTMVIRPYGYALWERLQSWLDAALKEHGVQNAYFPQLIPMSFFEREAEHVEGFAPELAIVTREQGAHCSSQSRASIRQRRLLVCPQPIQPAYQCAAVHLDSPFPPPPPASKSRRRQGVGGXXXXCLPAAHPASRPVCSRAPLIPFFRPTPLPRNPGGGKELEEPLALRPTSETIINSMFAKWVQSHRDLPMRLNQWANVHRWEMRTRPFVRTLEFLWQEGHTAHATPEEARAEAMAMLEVGRRWGEWRLVRGQAGTGGLRGPRATLIS

SEQ ID NO: 12693 - protein, 231 aa, Chlorella protothecoides
MPLHAPSHCLVLHPFPANPDPETPTNHPQVYREFAVTQAAMPVIAGRKSRIEQFAGANATFTIEAMMRDGRALQAGTTHDLGDNFSRAFGTQFSDAEGRLRHAHQASFGMSTRMVGGVVMSHGDDTGLRLPPRMAPLQVVLVPVAARGAAAAAVLAAVDAALVALRAKGVRAQADVGTEKSPGWKFSHWEMKGVPLRIEVGRCFGVLSEERRVREGRTGRLWRGSRTASRG

SEQ ID NO: 12694 - protein, 667 aa, Chlorella protothecoides
  MOD_RES (170)..(173): Any amino acid
  MOD_RES (450)..(453): Any amino acid
MGVESYLNPLTTQLSWTRLTQAHADSLACAESTEAFLAAFAALLEAEGIVLPPSSSSQSHAGVYIAHDTRPSSPGLAEAARVGAAALGVPTHDLGLLTTPQLHWAVARTAPGEHFNEDDYYAELAGAYAALVSRAATGSGAEPADGGAESADVSMTGRAAPPSTPSVLHXXXXGEHFNEDDYFAELAGAYAALVSRAATGGGAEPADGGAEPADVSVTGRAPLPSTPTVLHVDCANGVGAPKLLALADRCTAAGLHLTLHNTGEGALNGRCGADFVQKARLLPDGLEGAGPSYPCCSLDGDADRIVFFVPGTGAGLTLLDGDRIAALAALLCADLAAALPRGLSPAIGVVQTAYANGAATRYLTEALRLPVTVTPTGVKHLHAAAHAHDVGIYFEANGHGTVLFAPAYLLRLKEFVQAGVGGGLGEGGCNCHHKEGTDLCWSMEDHIAPXXXXASRSLCRRVSEEGWGRGGWGVAIATTRKERICANGGRRAFHLAAGGGGPAAARLDAGGLGGHLPRPALAPERAQRGGPKRHRHRRRGAEGRPPRSSAARHRRGRGSGAAGCDGLGFKSVGRVANCLCATCRSRRCGPAIQACSFACTPGGCEVNSIHPRTHRPGVCEAVGNRGCGQDLCGSCHPGGCGCPGRRGVGPCGPACRRPVIPAPDEPS

SEQ ID NO: 12695 - protein, 119 aa, Chlorella protothecoides
MARQATVRLPPCCPPPYSGEAIGMSSRCSGLCPAWGPHSVLLSTQHPAPSPPCRCGVLMAVRSLLLDAPTGICITASHNPAPDNGVKLVESTGEMLTRSWEVGGWGPWRREPGMGEGSY

SEQ ID NO: 12696 - protein, 185 aa, Chlorella protothecoides
MPAPCSKDRPRLPAQLEACSHLGQNPPTFTLPPRQIATAAGAKTTAARSIGRTVAKIANDETSGLPWWRVVSSVGALQSNPARQEAQLERLRAEGARPNEGRQCLGALPAPASAPSPSIDLSSAGEGITEWAARVGAKVVGTYALGSLRTVFADYDNDDVTVCDWWCGARPMGELGAWKAWHLRR

SEQ ID NO: 12697 - protein, 577 aa, Chlorella protothecoides
MRSRCCNAVGLSANGQQTISRHALSKDPSPSPKPVQLHGLPPKPPPPPAQLLVMDAVEELQRGEDTRWRWVAYSATDARATWDLYAALRERLEAMTDVALDPGVAAEYAAAGRPIASMWDVYLRFWRPFGELLTEMEALGVGVDRAHLAAAERRAVADQERARAAFRDWAVARVPGAAHMNVGSGTQVAQLLFAGVPNGRDPAKAGVPLSREFKVPNTLGVAEGGKKAKKNIAVTLHGLWGEGVASPLVPTVHTPSGAPACNTAVLKALAGPPGRAAKALAALEHRPGAGLGLGDSLDPVGAWDDASGVEAGAMGDSESTADLDADGGAGAAADASANPAGAVAAEPLDAADLEAKRAAGGHGALFPLFGSELEGLRACAAVDALVDVGAIDTLLSNFIVPLQQDAIAKPAAVDWAARRRGEAGVLGARNLSLAGREGPTMGQGSGGGLQAPAALHDSTVDGPPPAPAAAYRVHCSLNINTETGRLSARRPNLQNQPALEKDRYGVRRAFTADLAAGHTLVVADYGQLELRILAHMANCRSMIEAFEAGGDFHSRTALGMYDHIKAAVASGARVGVG

SEQ ID NO: 12698 - protein, 600 aa, Chlorella protothecoides
MILFSLLPSQVSCLPKIPANLPGSGRALPKRSRTRRGPRGLRRVCECGMHACRNRLGTDLSGASLNDVAGWEGCPRDCHSAPHPCPSHGRRIADQDRGRKNLGQHCQGAEGVRVSVHGLNSGSERGWLAACRPRGVLVEALESAVQTTPLLLLGNATPRMAAARPHPKLSHSKHSVMDASKEASALGRKAGGEGAGQGSEALRILPAPVTASLNDVEGATMESWRVVTDAPAVLTGADARQALADWLALLARTHPSLLRSPGCDPSLPRTRTLNRLCRCQAGAAAISTQLDTLWPGDQERPLPGLLQLDMCPGSEFKHPRCRFLRHWGIEVTLHPLSPSQPTTPATSTGVPDLWIGCGGQGRWLHMRPVAAAPHHLRPHRRRPARRRQLACGRARLRAPLLPLQRVQRPLRQDGHRRGGGACGQPAGCRAVAVAGTQPGQPAPGGGGGRRRGAAPRAVAHQSALHALQGGGQRPHGGLGGGGGVRLPHDLLWCTGRGADPADQLPVGAAGEGGSGKWMGRRCPHLPRGGCGAGCGDKGGGAVLAREGQSLLSTGPGCAGPGPRGKAESAAPESLMPPDSYLCRLFIAVFPHPICIESSVK

SEQ ID NO: 12699 - protein, 173 aa, Chlorella protothecoides
MAASRWFERQTDGSDRERREVDLGGKEFEPDLIPPEWNQWLRRTRVEPPSEEDIAKCVVFGELGFRGRCHSCGCACRGKAFRQQVQSRAAFHAAEDMRRAARARSSVEEEYDSTDFIHQLTAQSTDAPPKHIPHGEEDVLQSRASGFPEQGLTVGAVRKRGACRGGSSASSGG

SEQ ID NO: 12700 - protein, 380 aa, Chlorella protothecoides
  MOD_RES (298)..(342): Any amino acid
MVATTEVNGTAGPIIPVGSAQSSLPAPDLAGLDTQTRKIGLIYPPPDIRAIADKTALYVFKNGPDFERRVRANEAENTKFSFLKPGDPYHAYYQHKLAEHAAPAAEEEAPAAASAAAAAPAAAPAAAPAPTPAAPSVLAPTQPLAAPAEEVYTVHVPEGLTPLDLDVIKLTAAAVARNGKKFLTELASREHASPQFNFLKPTHSLFAFFTALCDAYSAVLMPPKGLAAELAADAGSRARVLERALRRLEWERARDSAARAAGDAEEAERAAMQSIDWHDFVVVETIDFFEDETGALPXXXXXXXXXXXXXXXXXXXXXXXXXXXXXXXXXXXXXXXXXXXXXAEAAQAEAAAAGGAAAVDEQALPMDAEERALVAQAAGA

SEQ ID NO: 12701 - protein, 195 aa, Chlorella protothecoides
MPILHSPSLAPQRWFVAEDAAARVRTLCCRGVSWTHPSHDSLGLAKALLAAWPAPAPGVPGLSLHSGVAGLAQDLAAQDLAAQVGPWLDSAPASIRLVGHSLGGSLVQALLAQRGAGWAARGVELVTFGSPPVLALNAAPPAEDGAGGEHAMLSMLGLPSARHYVLGKDPVPGLLLSAKPLLTSLGVGRLGGALG

SEQ ID NO: 12702 - protein, 116 aa, Chlorella protothecoides
MALHSHPRCRLLGREGPGRRFADRALNSWLARTFHAVHAAAPQPVALGPHGLHHAHLFRAHAAGQGLGLLFHAAEYPAYCEQGFPVHLGYCQAGSTLQYSPDTMAWRNFVWWAGGK

SEQ ID NO: 12703 - protein, 330 aa, Chlorella protothecoides
MAVLCQVDSAVADLKSIKATEGQQTEMRAILERLHASRLEDAASHSSGEEEGEEEIREGELSEATIRRILARAEAGGELEVVEEDLTPAELAAFHAALESEEVGRMVQPWVPWWTLEAARDPLLPLSALTKNPPSPLLPCILPQLLYAYCYTLRRHNGEPDVDALGAGETLLMLWPGTKDPPPPSPVHALRQTLADAVGSGRGGAPHAFFVAVVGDAVQLLRLGRSAVLLALVDAARMASRARSAAEDLEDDAVPERMRQGRKAFVRQLAAVEKKLVFFLAWANELDDGTLESLGDGLALFLEEETANIKAQNEARQRPPATPVPVITEL

SEQ ID NO: 12704 - protein, 118 aa, Chlorella protothecoides
MTAQYREWGCAAEPTASLLTFKVRKSPVPCPPCLPRYGGSLAALDTGPSSPLNQRLVYPGLEALGTVYEGSFGDWLADVYYISWWAERRRQQRILVSLPGIPHAPARRRRPELGRQGG

SEQ ID NO: 12705 - protein, 251 aa, Chlorella protothecoides
MTTPVGTTAELATPPAEPEAAGPKVLGMSEVAGAGFLAAQREFHERCPNTPPPHVLVVNTLAGAQAAAARLLSPELRGRVFACDTEVSAIDVTSQSPCCHGDLICFSIHCGPDVDFGGGASPSVQSTLWVDTYLDGDASRKEEAAEILSLFAPFFSSPDHPKVWHNFSFDRHIVERAGVKHAGFEADTMHMARLWDSSRSGKLTYSLESLSSDVALMGSSAVPKIGMKDLFARPNKRADGTNGKGFWRADG

SEQ ID NO: 12706 - protein, 149 aa, Chlorella protothecoides
MVAAAALHSHTRVTLLNPSTLTPQIGPRDVASGTCAIARRDRPGKEGKEFGVPLAPELLVQEVLKRLDEVQAELLERATRFRDEHILDVSSHSQFLEVIEQGSDEQEVALKEESGATLRCFPLEQPDGGGTCFLTGKPADQVALFAKAY

SEQ ID NO: 12707 - protein, 276 aa, Chlorella protothecoides
MGGECNYLLRVDRGRLAFVPDSEWKSEFMASWREDDIHELLETAERLLLEGAERLRLPVSVVRKERAVGVVPSAPTIYEVLEELALTVHAGLLAGPTPNLPFCAFNGGNDVFVDVGNKSIGLEALMRYVGVGPDQALHAGDRFTDSGNDVATRDCCSIIWVANPEETDFFIKILLADIEKREGRWGNGGPPASAQGMYTAFVCGISEDGAGGVKNEVCCLCFAGHLNDFTPPLANLLNPHLGVMLQHLLAVFTPQARLLVATKGHRRIQNMVCVHL

SEQ ID NO: 12708 - protein, 218 aa, Chlorella protothecoides
MHGVHSNNKEDCSHISCPNIIRSLFLQSISSYHRHTGVRTSSVMADASKRPLSDGEEAGPSGALVEIKRQRLDEGAVVPAGPASSLATKPQVSRGPVLLCPVPLSPHTSVGNTQGPSRTSALLAPTMLLTGHADQVFTLKFNPDGDVLASGSYDKTILLYRTYGECENFLQIKGGVPGCSWERRWGRGKGSGRWWERLIGAAAPSPTAHAPSRTTHIE

SEQ ID NO: 12709 - protein, 614 aa, Chlorella protothecoides
  MOD_RES (333)..(336): Any amino acid
  MOD_RES (489)..(492): Any amino acid
MPLLEHPTLNRAQERDPGAALDARRPEPGLLLSRPHCAGLGRQHRAAGEEDERARRHRQLLLPPEARQPAACVGLRRRHRQGEPVVGVVLVMGEREGWGRGGLTGVGTTLARLLKCPGSPTTVPPPPAIRQVWDLRSKRSVATFTEKYQVLAVAWSEAGDAVYTGGIENVVRAWDLRRGAPSLTLAGHADTVTGLATSPDGAHLLSNSMDGTLRVWDVRPYAAQDRCQRVVTGHVHNFERNLLRCAWSPDGERVTAGSADRMVYVWRSADGAVQYALPGHGGSVNEVVFHPTEPIVASASSDKTVYMGELAAAGLSSPEPSGGSALAVGGSGXXXXGAQSRSLLVRAYGRQCAGRGREWQGTGKLDSPQRCPPVATLWCLPSLCCLLLDAWRLLSPLMHSPPLLQTSSSPPQAHTACNDLTSHHCLQARAPSKGVKHGAARDNAMRGGGGARTANLRARCSNPIPTTSGMRQSAAPPPAAPPRELLGIXXXXHGAARTTQCAGSEVLGRRFPGRVAATRFPPPPERVSRPRRPQPLPQENCWASHAGPGPGTGAAAQDPAGLEASPEGWGWRARRWRPLPSPALRERHRAAASTPGSLGVGIQRKGGIWRQGWC

SEQ ID NO: 12710 - protein, 178 aa, Chlorella protothecoides
RGDRARAAAGLADGSVALAVGTHALLSEGTAFARLGLVVIDEQHRFGVAQRGRLAGKARPPPHVLSMSATPIPRSLALLMHGDLSHVVIREQPPGRGPVATRVLDSRDEAARRQVCLPAHPGGGGGGGPGVHHLPPGGGKRGAGLRRSQGRDGGAREADAGGGAAGAPVRPPARPNDR

SEQ ID NO: 12711 - protein, 86 aa, Chlorella protothecoides
MSPMDIGEAGVCTAREGWGACSLPRDAALLEQARAAAATFLHANPNPLDWPPDLLGPVLRHQFLDLDLHEMPSSSLGGAAGGGAAD

SEQ ID NO: 12712 - protein, 122 aa, Chlorella protothecoides
MYRLINGDYYGFRDEDDGVLLKVEAEAEAQLRAQASLRAIQEWEQQEAQRQSSAAAARGTSATVQVDPAESAPQFVAYVPLPDAQEIEARVLEGKKAALLSKYASEALQAEQAQARQLLNRG

SEQ ID NO: 12713 - protein, 165 aa, Chlorella protothecoides
MESSLCPSASPFDHTLSHTPHACRIRDLNDEINKLMREKVHWERRIVELGGPDYSKTGPRVTDSEGRVMAETSGRGAGYRYFGAAKNLPGVKELFEKEAPRQVGRWVVARGRAMGALQLGMQEIGLELVQVKQVSFMQARAERCCCRASCIGRIQVYSLLPADAS

SEQ ID NO: 12714 - protein, 1388 aa, Chlorella protothecoides
MVSAPPPPFSLLKPFSPIDAESTNQFPADASDEGEVFYEALSRSQRRSSAGTSAAASRYFSAGGSVDSEGASTLQLDPGPAWVEEGGAESPLGPSPRIASPPPLAVTAPQLLWRLGGGGGGGVPNGETRCTAALHARLARDILIGGEVNLVVPVLAFHASADVGAWEEAAACVLNHVGLMGGALPDLRALVTAEENSAGGDAGDPVGTSEPGDTGPSTAYPLRWHVRCACLRATLVCNAEESGPGSAPPSPFHSVRMADRHSGEVQSWRGPILALTLQASLEAEARVGADVGLAAVTKTEAGAIADAAPEAAWWLQLRVPGLLLSAGLGSAVSDAEEREHGAAPSLSLGAGLAGIAGFELRCVGPVAPRPDGPDRQALPVLDAEPIAKEEEGQAPGAALLTSIVSSAQSAEPPGPTPQSPEEPPGSSAHAVQVDLALARGSVWLSQETAGVALALTQALTLLAHRLQAQAAEAMPHGGAARRAVRDKGDDAKALTAWELRAQAGILAVLVGVGGVDGVGRGRCPLLQAAAHDLKACAGSGTATAQLGCRLEVRSWAPQLAGWEPVVEPWQVRLALRGALESAGPGPTPPLSLSLESDDLLELTASEGGVAAAARALQSYAFLSTLTLAGAGEAVRAAQAAAGEPALAGGWTLVNATGASVELWMGGLVGGGAAEAGPGGWSGTSGRRDMTALERPHLTVIPGERVDLPVWPGSDDTLADLAAGCAGYPDPMLGVRPAGWRGDMTGCSPDPSDPPCPPRHTRVYFRGSGGTAGCVPLAAPGTHTYGGPWPGAGGQVPGSRGDGAPRPRVLASVARGPDPWAGTSVVLHSGLRLVNRGGVALEVRLHTPLGFVAEASPRASLGALQPGQGLWLPVQHALLSALSFRPLAVGGCHGAGHDGHHQGGTHGGTVSRTGSGVLFSQAGPGAALARHPPLHPPVVAAGSTTGGPPPAPALLARRSLDRARSFGASGPLEWSESVPVSQLVGGARAGAAAAGTFQLTCRQAPGSPGLDAPLALSVGSQRLAGEFEETPPRDERTWPLPAPSDPSGALAIVVGAPLVLLNSLPVPVEVGVGGQQLTLGPLQRRALHGLEEARAQRLRLRPAGYAPVEAALLSPAMLGALGAEAAERQEEIEVVVSWRGSGRRVHRGESVSGRLADDRPPWKFSNHCILPCALINKELPPHPSSSGPTGLGAQQAVRWVRDTPLQLVEVGQSGHSVGVVLRHGLDPGSGARVLRLTCTLWIFNCTGQPLALRQAHEDAGHFTEAERAAAAEDRACGEMGEEHALAGEEGGKFREAAQRKPGKAMQHELYAWLAPLALPPELLRPRGPPSVTASAAGAPARSPMLLSPARGEAASSMRLNSATSSLAPLSRAASSVDVGVAGGARGSVV

SEQ ID NO: 12715 - protein, 139 aa, Chlorella protothecoides
ARLVGLARDVTLPPLATATGASLTGHGLRETVAELPGRVPGDACAIRWGGRRWWWGEESTVWVLAWRYEGGGDDQPLCCSTLHPLGEGTGTYPWLYAAPDTPPLPSNHIPIGTWRAHRRTAPGPPTPTPPPRPPRALPW

SEQ ID NO: 12716 - protein, 245 aa, Chlorella protothecoides
MHRVAGVSALCSGCLSRESVGGRRPLFERSSIAKTRSEVWREEIGSTGAGTLWPGHTTMALLTNFTLHELFVTLNRAVVYGSVLHAPHQSFCARCNLDAQPPALCHITGGTRGRAAVCDTYMLEDTVLCPLSQIDPRAPMSEPALEAGAQSARAGVQAFTDVLAEPRVDMARLRALAAQGVPEVKGLRSTVWKLCLGYLPVVKAARARHLDRKRAEYEHFIKVAVRGNGKDVEWQAGEPKFQHDG

SEQ ID NO: 12717 - protein, 152 aa, Chlorella protothecoides
MHGPPPTHLLRDALTGAADEEERGRAEADAFFCFMELVSGCRDHFCQQLDDSAAGIKATLARLADRLRALDAELAEHLLDRNGVAPHYFAFRWITLMLTQEFPFPDSLRLWDGLLAGGSRGGEDLLRFCLAMLVIVRQDILQVTRRWGGPWE

SEQ ID NO: 12718 - protein, 116 aa, Chlorella protothecoides
MDPLEASTSFLTTRLQRPRSPEAATLALRPALQAVVADLAACLEGTASLGHAASLLLVGPRQSGKTLAVERALRTLCARHNRGEGAEPSVGVVRLAGWAHAEERTAFRDTARQLCE

SEQ ID NO: 12719 - protein, 170 aa, Chlorella protothecoides
MAGVWQVPRQLSHPSRLRTPPRLARHAEPVLPPTRRSPAVRRPRQPVAAAFPGRRDAGSDRSRCLAHPPRPPLLQRRGRGRHAASQGKGCEADSAGCRGRRPLSELQQDHDLMPTIKQAKHYPQAMSRALFIYAKLNPGIKYVQGMNELLAPLYYVFYTGGHRVGTGGRV

SEQ ID NO: 12720 - protein, 99 aa, Chlorella protothecoides
MPNRWMGYSKAGSARSSTLTDLGLSVDAIKMRPFEVITARSSKILVAVECLKAGQKACTADKDGNIGTGNKGKNNFGNKNVGDNNIGEHDGTVRSAANE

SEQ ID NO: 12721 - protein, 274 aa, Chlorella protothecoides
MTSLGSQTPTDKLAAGRRKLEEFKRKKQAALAAKAAGGGVLAMGGGAPLAAPAASPQPPAGEPRPPAPAPQQTGVVRSLTFQHPTEAVPPRQLSADTAGLRQLEPAPGPTAAAAAPPAMAAAESVDAPFASAGPHEILHPEKQREQQGPASTDLASTSAPPPSSQALPAQSQTSPAPTHPDAHEAEARIAALQASNAALARQLESMEAAMREGQEALERRLQDSDRNLDKVLRELEATDAERACLQREKADLVGEQKGKEGRCVLLMRAWTVLL

SEQ ID NO: 12722 - protein, 114 aa, Chlorella protothecoides
MDGFLKSVGGAWSSLTEKYPQLTQLEERVVTLLPRLSPEHVIQLGPKRYRVIRTLGEGGYSTVYLVRELSERSGDLGTAPAEPPGPDLALKQVWNTVASQDEKRQEVQCTPRST

SEQ ID NO: 12723 - protein, 128 aa, Chlorella protothecoides
MCLACSTLSEQAPRCTLLEKIPPASPNLTAPTGSPTTQHGSAWDAVHRAAAPPPLRTVLSIFIQLCAALEAVHAAGLSHRDVKPQNLLMEARPGATPRTVLMDLGSAGPAAVPVRDRGHALELQEEAE

SEQ ID NO: 12724 - protein, 379 aa, Chlorella protothecoides
  MOD_RES (54)..(57): Any amino acid
  MOD_RES (75)..(78): Any amino acid
  MOD_RES (227)..(274): Any amino acid
MFDDPLKHDRAFCSTMQTMLRKRVHESSPGHTEGEQAMQRPGSVSTGAQRSQAXXXXANNAAQAVRSIVTEKHHXXXXSSCILKGIRSFTLLSAGQHMQGLLAATNRYSFSQQFCVSTSVIMQYSKAMAMAVLAVALLAAPVGAVKAITDWEDAFFGFLGLTVGYKSPVQPRSITHYGGSPDGMDPSSPSFGTSEVIIQRCSCVRPAPCRSLAGPMMSPCRPLGSWXXXXXXXXXXXXXXXXXXXXXXXXXXXXXXXXXXXXXXXXXXXXXXXXAYPYFSVAAFSPSNHYYQSDALKACGQCFQIQCEEGRNGKTGVCKTDAQGEPLSILVMISDVCPECEANHIDVQSLAFGKVCALCLGVVNRLFLSNGMPCSACPP

SEQ ID NO: 12725 - protein, 135 aa, Chlorella protothecoides
MQCLKECGDLLSSGASVLFFPEGTRSKDGKLHAFKKGAFSVAAKRKVPVVPITLQGTGELMPVGAEGRLFSGTIKLFQPNAPTVPPAYTLTAQVRVHPAVPPSQAVAMMAAAQAAVASGLPRDKLGPDVLRAVQS

SEQ ID NO: 12726 - protein, 99 aa, Chlorella protothecoides
MLTEYAQGPNCIMHCLPSGSYDPQKHTSWEACARAELSEEAHLEGGTWHCLLPAGHVGVPETKWCANRFTPFLCIGPRPAMQPRPRDAEESTIQVLAGS

SEQ ID NO: 12727 - protein, 301 aa, Chlorella protothecoides
MSEAKKSPINPVWAAIKPFVNGGLSGMGATCIIQPVDMVKVRLQLGDKGSPLTIAKNLAKSQGVGALYRGLSAGLVRQATYTTARLGLYNYIFEAAKGLNEGRPLPLWQKAVCGLSAGGLGALVGSPADLTLIRMQADTTLPAEQRRNYKGVGDAFLRIAREEGASGLFTGAGPTVVRAMALNMGMLASNDQAKELLEEWGFAKGGSVVTLGGATIAGFFASACSLPFDYVKTQLQKQKPDASGKLPYSGAADCALKTLKEGGVLKFYTGFPTYFIRIAPHVVLTLSFLSALPKLQAKYGL

SEQ ID NO: 12728 - protein, 68 aa, Chlorella protothecoides
MLQGGNGYVFQGMDGGAVQAAVGRAMADYRERPGEWQGLVLRVLDDGDAWSWDGPTEEYLDIYSKVLA

SEQ ID NO: 12729 - protein, 176 aa, Chlorella protothecoides
MYLGVGAPRGEDGVHRPLRAVLHEEGGWVQAQAQVLAAVGVPQPRHDAGLLRKGWGLQAPRRVRTRVGSDGGFTDLRSSCPSSDAMHTPPEGASQARSRRGSLRPAVPAPGRTRCAPTPHLGPSDAHRPSQRHLPPCMPTLGCTLPPAMTSPTDTLPPPSREATSTITAPSAAGPA

SEQ ID NO: 12730 - protein, 95 aa, Chlorella protothecoides
MLYLHTRQPAIIHRDLKSANLLVDSQWHVKQPEGLACIPPLALGRRLLQPLSFFPSAEPPNPDPTATPLQIADFNLSRAMESEVMMSTICITNPR

SEQ ID NO: 12731 - protein, 203 aa, Chlorella protothecoides
MGLGQMASMCQGCRLLSEQRTRIVTACLDQSSGASLAVPEPSAMPAGSFRGYEPYVALMTRCWEIEPAARPEMAEVAARLRDILRSELLAARSRRLRSGQLPGGGVPEPQQRYARVRSAAPSPFSQGPSSAEGSLVSEGGLSPGIGFTSGTASGTPPGTASTTLSGSLEVGRGPAGAPAPAAPAAVDDAELAERLGSNEPAFL

SEQ ID NO: 12732 - protein, 168 aa, Chlorella protothecoides
MVQAEDAGAPMGAPLPKGLRMTFRLDDGTTIRSSGEGKATVLKARESYAAGLLSETHLLRVQALLCEVHAKLPDEGPLKTLSLSSKRSAETDVEVGTGILLPCWLGALGAPHIPFSPWDVVDARPSQHCPAHVSIHNMKKIIVDAIDSTITRTLYRLWTSSLPSGRIP

SEQ ID NO: 12733 - protein, 128 aa, Chlorella protothecoides
MMTKQEAKAARKKAARKEKLALEGRAAAGLPPPPKAPQHGGGARIEAIPLPPRKDKQKAIPLPPRKDKQKVAKNMGYGQFERHTTGIGSKLLSKWGFAGEGAGLGKDGVGLTEPLLVSQRARQRGLGA

SEQ ID NO: 12734 - protein, 77 aa, Chlorella protothecoides
MVDKVITALGGPKDAAALGFTVAVDAKLVPDYYTIVRNPIHLGEIRGRLRKSAYADPSGFYQVGGEMVGRMKGEGRG

SEQ ID NO: 12735 - protein, 785 aa, Chlorella protothecoides
  MOD_RES (119)..(122): Any amino acid
  MOD_RES (752)..(755): Any amino acid
MVPQAAWEAGESGAGQWIACCIRHSCPHWTAHTCRQPSPPTTNPACRPTWLAQQFSEYQGQHGRGGARLLRHHLRAGHAGGHWHPRRGRRCVGEWLQGEVVGRHAWGYSAGLGTSKLAXXXXEWLQGEVVGSHAWGFSAGLGTWKLAEEGPALTSLSSLPFGSGEPWRGRPGGCGVCWPYRHYRMLLADVGGLFNVPHSNAHAPLPQVVMSFHACGGNVGDNALVPLPPWVHKVGDSDPDIFFTDRPRESSPGQRNREYISWFAETEPGLLRGRSVMECYIDFMRGFGNFSGVPCGVLSAALVSIAPFQRCCLMFGKEEAGRKNKGVGQPSSQRLPSPLSKGIPGRVHGRAGLAHRGGSCRVRSVWRAAIPSLPRDKRLALSFKEEAGRLIEGVSWESIAGVAVYQPPDSRPLHPSSQGIGEFQCYDRRALASLARAAGAAGHPEWGNSGPSNAGSYNSHPEVRVSQRAGVQTRMRGGDSVGHSAPRPAALKPWAWVVVLLREGGIAVPGLASNVPACQGSKPDPVLLFLPTSSACPHYNAGDGLFPDLEWGLAVPAGRVFPGLVLGRPPRAWGAHAHGRDFRVQLPRELKQRDCRGLTTLMLSRADPVVPGSGSTYSSDTMVGSPHTSVGVGGTVSPAPSSSPNPRTRGRGPPSQNPGGGPVATWQGDGPPPAPPSHSFHLPQPPPANGTPDGMMAAVSFAGMASPGGAGGFNGPFGSASLLPPAARPDQESAAQRLLPPAARPGPDSAAXXXXGPTRSRRRSACWPPPRGPARTPPRSGCPGT

SEQ ID NO: 12736 - protein, 692 aa, Chlorella protothecoides
  MOD_RES (135)..(137): Any amino acid
  MOD_RES (496)..(499): Any amino acid
  MOD_RES (543)..(546): Any amino acid
  MOD_RES (583)..(586): Any amino acid
  MOD_RES (649)..(652): Any amino acid
MDVLQGFNSLSPATFESGRASGRNRAGIPELWFRQEDQPSYSDNELEHAQALNTTVESPHCKFLQQWSFVHHAIPWRRAGWDGEYACTGVPYYVPLEYIYIWSEGRSGGEAWLSPRPSYMADALSNGTCTGSVVXXXVGRCSSYIADASSNGTCTGSVVDDRRVTLGSTCPSPTAGPPSPCPMQVCPGGHPALCGCGAPSACPQPPAHPPPPAGIHLLQAAGWPTQTRRRWCVNQAGEEFLGRGEGARDGLAYRRHSLAAWRTPHRVPLACALPLPEATGLMRKLNKALAPEKDSMKPDWRLGDLLATFYRDLWRSPALPSVSLLCTLNTPKPLHDSRPNFENFLYPYCPPHIERPKEVRSLYLVHLPEKCFFSRRTLQTDVREWVRHTSILLSLSHPACLHWSHKVPQNQKLLAVPLFEIYDHMSRYGPLISAVPQLLSRYALRLIRPDGGVAAAPGAVTTQPPRAAPEAASGGPTRGTDNGSVDASGPLGNGEXXXXPCKPTSGSGSGTPVSCSRSHILPCLHWIVCTRGGWSMVIEQSRXXXXPRRGEGCLRSSHQPRPLNSWIVYTRGSWSMVIEQSRXXXXLPRAAPEVANGGPTRGTDHGSGLRRLLAASSRERDIAGVGGCLKWRTEGLGVGGKEGEAGGPXXXXDGISLAQMVASNGEPRGWGVGGKEGEVGVHQKLWDEVQSQ

SEQ ID NO: 12737 - protein, 195 aa, Chlorella protothecoides
MDSALLTCSQTVVTGCKGPGVDLSDRASATLVGGAVQENVGGVWLWDQARAQLSGVRLEGGPSHAIMVFEEGAELVAEVGRVAVWGAEHPAGRVLGVSRGQGSCNGALEPRISVCPLPCQADHVGCATGAGMSEHPSSHILHVQDCAICGTLHGPEGVLHAVPATNTVTPPGRHTGWPLEDGPFQFVPNRFTRKQ

SEQ ID NO: 12738 - protein, 67 aa, Chlorella protothecoides
MVKCSGDDAVNVCQGAAPLFVDCELTARKSGVRAFDSAAPRLLRCTIEKCGEAGVKLLESAKCDLTE

SEQ ID NO: 12739 - protein, 301 aa, Chlorella protothecoides
MLRPSTQAEEEEVEGTLHWDAGSHRHAPDPPCAHWGHRPSDAHRAAGNAALAAGDCAAALRHYALGLAEPSASPRDTAVLHCNMAAAHLRLGAAAKAAAACERAHRLRPDWHKPLFRLARARQALGQWAAAAAAARRGTQLAGPADVPSFQALQDEVAVSAFVAGSLAGFGGARLEVRSAGDEAWLGGPAPHDPHLDGPEATEPGEVVKYLPAGTGACLQPPAAGIESASLEAKARSGGALVPAEASGLALKITGASQDLAEWRAPSGPRRTSFRSLKEAVAAAEDGDTIVLLAGVHNGMG

SEQ ID NO: 12740 - protein, 211 aa, Chlorella protothecoides
MALLAVTGPIVDTAFVQEIAAAHALAVSSLKLVTQATKLEDKALPASAFDTVVSVASTSGEHSLAYLGRLALCLRPGGALVVSEPGASPAGLQKNLTLAGLGTASAGPLDSVVSSKPAWETGARAAISLRKKPAAVQAAPAWKLSVDDEDDDIIDDEQLLTAEDLVRPAPAGEVGLHPGFVRLALSVRSLTPIHPCHSILCNPQRQVAAPQ

SEQ ID NO: 12741 - protein, 609 aa, Chlorella protothecoides
  MOD_RES (350)..(353): Any amino acid
  MOD_RES (546)..(548): Any amino acid
  MOD_RES (584)..(590): Any amino acid
MLGALHPAELQICHISRFSWFKRAPAGRARAAGRRWQVPRAEHQEAPAKAGRDALAGLDAGALCLEIEPGTNNSRCIYASTDVPAPKETLWRLLTDYQHLNDFIPGALLWEPLARPALGPVASLAVNQELESFPDGCKLLQVGQQELALGFKFTARCVLNIREHPDGIPGRLLGPNGGSGAGNGDRGRSAPLDGSSFPAPRSQMGVDAPHADIVFESVQGDFQELETFPDGCKLLQVGQQELALGFKFTARCVLDIREHPDGIPGRLLRPNGGSGAGNGDRGRSAPLDGSSFPAPRSQMGTAAPHADIVFESVQGDFQVLVGLGEGGAGLLPGVAVVSPLRTVWLYMDSXXXXYQERLLPGTPRAPTCPTPFSSGRSAGSPCNWCSPASSRRSGPTCLPSAGTPPAATRRRAGASRTPPDVVNSFHLAQGRALMPCTSTVSMPSLPPEVEVDVQDAAVEDGLEAFLVIVLPACVRVRVLCAAVVWRSLLLRSRLPRRCPLLGPVDPCGIPTHQGTPPHPPEKHPKNAHQSLLTIRKAMSSYGGPAXXXIEDGLETFLVIVLPACVCVRALCAAGVWRSLLLRSXXXXXXXPPRRWGPSRSYTPATWTCR

SEQ ID NO: 12742 - protein, 149 aa, Chlorella protothecoides
  MOD_RES (138)..(141): Any amino acid
MRSGREPGASGAGDTAEEARLRAAAGAAMGDLGTSGDAPFGGEVALESQAYWWHEKYRPRRPKYFNRVHTGYEWNKYNQTHYDGDNPPPKSVQVGEGCCCGWGALIIFLRRVCSFMARHVVSVGDASHRLGWGTERQXXXXGVAAGGVL

SEQ ID NO: 12743 - protein, 520 aa, Chlorella protothecoides
MHVAELRQQVRLLQTLGYGESAGAEGLDGVTAALAERSRRLEHELTLARLAATQAQSHPNSSGASDAAEAQAASLASELEAAQQLAGRLEEDLVLAQRQVAASGSGPAEQGPNGGPGAGPDPGAAAGGGREDEAPSMLAVMSGQRDRFRARVRELEEHLLVQTQQLARVGACGAARAWFDWMHAGGGAVLPADWLGRIECTEHARQRFTDSIPGDPERSWRCTDSTPGDPERSRVQELGPGAPGLSRLPCPPPLLIMMRTHPQCQAGNDLEAARADNLALAERLKYVQVRRASTSGGAFAGHSEGVWAGARPPPGGKGGGGGHLLQGITAPKMKQPCPRATAAPGLQSYGRSYGRVQAGGDVESGADAVGRYMKQYEDGVNPFNGGSAAGGPRCRPERRCPGAAHDPAACLLHPKPVMPAAPRRPLLIRQPFLFSPSPPSVPSQGEDGGDAGHAADRARRVPHRGGGGEVAYCQVGADGLRPGPPLRHLPRPGQVGCRCSKWERLMRGLGSRNACGGRRV

SEQ ID NO: 12744 - protein, 155 aa, Chlorella protothecoides
MYAGGWETKTPGCASMVYPDSSRGILANILQWKAFREKLEGNLMQRGHVMATLDEIFGEEQAQDDGLPEEFKTMSADDIQRRTRLLETELRVLREENNRLNHDKAGLAERIKDNHEKIKLNNQLPYLVGNIVEVLDVDPDEEEEEDGEAWEHGGG

SEQ ID NO: 12745 - protein, 130 aa, Chlorella protothecoides
MLELLNQLDGFSSQDDVKIIAATNRPDILDPALMRSGRLDRKIEFPHPNEEARSKILRIHSRKMNVSPDVNFDELGRSTDDFNAAQLKAVCVEAGMLALRRDATEIKHEDFNDAIIEVQAKKKTSLQYYA

SEQ ID NO: 12746 - protein, 59 aa, Chlorella protothecoides
MKRTVERFVFRIKLLLAETDQADAFWLGALKHKNLQGQEASSQVDCRPGVPLLSWVPAW

SEQ ID NO: 12747 - protein, 270 aa, Chlorella protothecoides
MRSFKPPPPPHIHKFVGANAYQDASKKGKCVVLKTSTRQTVFLPVAGLVDPATLKPGDLVGVNKDSYLILDTLPAEYDSRVKAMEVDEKPSEDYTDIGGLDKQVGESEGERECACVRRLQCPACRLLLPGVCIALSGCSARCCPLASHSPCTLPAQHSQIQELREAIVLPITHKDRFKSLGIRPPKGVLLHGPPGTGKTLIARACAAQTNATFLKLAGPALVQMFIGDGAKIVRDAFALAREKSPAIIFIDEIDAIGARRWCPSPWGGGC

SEQ ID NO: 12748 - protein, 321 aa, Chlorella protothecoides
  MOD_RES (129)..(132): Any amino acid
  MOD_RES (275)..(278): Any amino acid
MSGDSPGTSRVSLGDLTEYDTLILPTGDSPSPARSEPPPPPLTSQDVSAAAAATMLAFAEMPYSATGQSLHEAGTAGTLAGVKRPNPEPDSGAGAWTPRSPTAPAPDPGGPAAASSAGGVPSGAGGTGXXXXDPGGPAAASSAGGVPSGAGGTGMGSAALEHSGTAGSVESGEQGGRKARLVWTQELHNRFINALSHLVRLLGGWGMGRGLGRGWGKGGGHRRCRGGHPWSRPGCCPRSGMQGTGGLAWDPVVGWACENTRALAPHHLPSPPISXXXXEGWGAAGARGLDAVVAGAGIRGLDLDAVPGVGCKAQEGWPGTL

SEQ ID NO: 12749 - protein, 344 aa, Chlorella protothecoides
  MOD_RES (141)..(143): Any amino acid
AAPPRAPRAEPELQDRVSFRRIRAPRGDALAGVYLGQFGPHGPEVVQLARSRRDGDEWVHATKITGDRNVPAGELSFKARVGREHRLPTAVEGYPPELGVTARYAGRGRVAEPVSETRLGGPRSLRARDCCWGHGLPWSVXXXPPVRCGPGLLLGSRLALECPGVGQERQGAHPSTGLRDRLSAGTLGPALHPILETLVPIYHSPPFDVRATTPLPPTSGVQEPAVGECRAAPVCVGQPHDPRRGAGHRLQRLPHPALPHPLQPRGLGVPGGGRFLPGALMFSATRLRGRPLPWIFWEPRRSPPFSLPFPWVAKPVSPVTRVAPAPGAACTLILSTYTHRRECV

SEQ ID NO: 12750 - protein, 249 aa, Chlorella protothecoides
  MOD_RES (219)..(222): Any amino acid
MGPSSRQGDAGIAGGQKGSDSGREPRLWHDGSTHPANTHRRSLEKELKELEERIEVASARRGLGVGMEDINKKNRNINFQVGLEGAEGMFVCIKEALSPQHAECYGSRLARYPWGMAPLPPCSMPVPWHPSPTQDVTSSPRLPLAQNALNNVSNKVLEGPGGATKAEGSKTLDPFSRRVTRPQNYWSTKGEEAGTAAEAASGAWMVLAMGGGGPSHAQXXXXDGCRSGLRCVDGPRNGRGWAVACATRS

SEQ ID NO: 12751 - protein, 214 aa, Chlorella protothecoides
MGKAVARLLLQAIRVANKFWAALHSSEPVPVCQGLSQPLHALPPGAAGTLGSPGAAPTPSGRTRRRRAPGCGWRAASASAACPWPWSPTRLSARPNSRPGSAPAAQTAGPSWGARRLPRLPAASRTPRRELQAVGFPRQAQAEDALWQRPCADALPSRPKHAHRYTYTAADVAAVLERKRAKGEGARNAALERARLERERDAAAEAGDVVRHAE

SEQ ID NO: 12752 - protein, 338 aa, Chlorella protothecoides
MPALALALAGSSPTLPSIHPGVSALPLSPPTNLPDLAGSFSLGLVGQVITAILVVLLIVIMCCWRRVILFRRAAATPRESRGWPLVRAVLSARWAPQAALPPSPRMSSVGEPGGLPRLGPVRAAPIKPPIVVVMPDGTTLCTASVVDGPSDAEEDEDGRSRQDKSEEGSGAAPAPLPGADPAPLPGAALAGDAWHGSPGALAARQASSLEMAERGARHRHGRRSRRHGRRGVPAIPMFSMEVDDDDSGGEPAVPAPVPVPGDFPAVPAPGDLPAIPAPGDLPAVPAPGSLSASPAPADSPAVPTSNALPAGHTGGSLPAADLGGPDRAGAARPASPGP

SEQ ID NO: 12753 - protein, 220 aa, Chlorella protothecoides
MSGLTGVWDQLVDAVCRPPRDDSYTDEDLVGGQRASFRLGKARYYRQDLEVGVCQRAGGEHARPVAQPPWPGPVVLDACIVYTALRFVQRLIACHLHLHFQEDPCTDTRLKLPRQITSLPDLPPQLHNERGERLLCSHFRPCIVASKDGRLPVVVYCHCNSGSRRDAEEIIYHFLPRHVTVFSLDFSVRWVGDTLSVGCILGLGHRRGGGCRGNKEGLPA

SEQ ID NO: 12754 - protein, 310 aa, Chlorella protothecoides
MPPPLFTHPQGSGRSQGEWVTLGAREVDDVATAVRYLRDEGSALTIGLWGRSMGSVASMLYARADPSIAGLVLDSPFARLRDLMLELGSSDDSLRMPRAIAKVALAVLKRSVRRRAGFSIDDVAPVEAVPAVQCPALFGHGAEDTFVSAEHSRRLVRAYGGEARLRLFDGDHNSGPDWSGSKGQLGDGQGHRSGRPGITGHGDLGHPLPILAVRPDDFYEEAVGFMLSALRVEELLGFDVFLMDPAAAGAALSSGAGAPRARRLGRGGAAGGGGPTAAAAELAADEEDDALAAALALSMQERRAGRCVLL

SEQ ID NO: 12755 - protein, 361 aa, Chlorella protothecoides
MTELEREFELAERAERRQQEVQRRKLLKQTGKAAQEAAHGPVPAGPTVAGTRSRGETLAGEGAGRSMRSGREEREEAAKKTAMQELVAARKARTEGRGPAADEEAERDESLSRSPSPRRARLPSDDEDEALSGMHGGAAGLEAGSGGCRLPLDDTKECQLTEHHATLSSPPSDLEEDGAAGGWKPRQEDEEEEDEAAFEDVCSVIVPRYKLEKWLGEPFFAATMPGCMVRSEEGGASYFPGLGHLGCMTFSSRGRRESSRDPPSPRCAVTVAPPFPHPRPAWSQAPPLLPLPLLLSCSGPRLSGYTYMLRRHRAAPLHAGAGCGRRGARPGSLQVSAVGGGGAIGNHRGAAGGEVAWDREL

SEQ ID NO: 12756 - protein, 54 aa, Chlorella protothecoides
MVGGVTPKKGGTTHLGLPVFDTVAEARAATGATATAIYVPPPFAAAAIMEALEA

SEQ ID NO: 12757 - protein, 455 aa, Chlorella protothecoides
  MOD_RES (141)..(143): Any amino acid
  MOD_RES (251)..(253): Any amino acid
  MOD_RES (305)..(307): Any amino acid
  MOD_RES (372)..(375): Any amino acid
MVSTLSSVVRQRLPAWLICCPDGMEIVVEGHVHAFERTFPVYNYTLNDCGPVHLTLGDGGNIEKPSQLLCSTPATHEQARYPSNYEASGSSNALWYSVNVGPAHIAFITSYADYDQDSAQVGLAFRAPISRLASGTLTFAXXXEDSAQVGLAFRAPILRLASGTLTFASDPVASHHGILCKGEWSAQDGDALAHGGLPCPLVRASRVCERECLRSNASYHWGQEGDQNAEPHGSQPALAITPVHRGSRFPXXXDAEPRGSQPPLATTPVHRGSRFPTMQEQRGCVVSASRLLTTPCLAETSPHPXXXICEAAPHRALSCRDIPSPSSSPNAHPLLSSGHVHAYERTFPVYNYTSRKELSGHDSLPFFSIATXXXXSSPNAHPLLPSGHVHAYERTFPIYNYTVSGRAVGAEHWIQIFSRIFARRVNNRWVGIGTDLIILSLPAMDVWCKCDKPDH

SEQ ID NO: 12758 - protein, 150 aa, Chlorella protothecoides
  MOD_RES (54)..(98): Any amino acid
GGGARRRGGRGARGRGAAQGAGARAARDRAHPARDGGAGAGGAEDLPGVQGAQXXXXXXXXXXXXXXXXXXXXXXXXXXXXXXXXXXXXXXXXXXXXXAAKAAAELARRLARLAKSLDHAERARREEEAPLLERAWAARAAEDADLAAEL

SEQ ID NO: 12759 - protein, 651 aa, Chlorella protothecoides
  MOD_RES (65)..(68): Any amino acid
  MOD_RES (263)..(266): Any amino acid
  MOD_RES (351)..(354): Any amino acid
  MOD_RES (429)..(431): Any amino acid
  MOD_RES (491)..(494): Any amino acid
  MOD_RES (518)..(532): Any amino acid
  MOD_RES (622)..(630): Any amino acid
MGRKTWESIPAKFRPLPGRLNVILTRSASGENTSILGNGEHAGLHCTGLWAGALRWGCCVVLPSXXXXLHWAVGRCLAVGELHGPPLPCTRRGRAGLPSRPLLPPSSTPPGGQPGAPAPPACEALQQPSLSAALSLLASPAYAPRLESVFVIGGGEVYAEALRSPALDAVHLTRVEVDTPCDTHLPPLPADEWRLWSAGAPRRDAGTRYAFLCYTRRGAAAPPRLPPALAAPHEEQQYLGLVRRVLAHGARRGDRTGTGTLAXXXXRPTRSSSTWAWCDACWRTARAAPTAPAREPWRCSGRACASTCATPSPCSPPSASSGGVRGAPAPRAARRCFRLCFVVFCCGGGWXXXXQARLLEGCAGRRAARGAALFSALFCCCFLLRERGAEERVCRAVGGKGRRCQRRGPTSSSPAEAWMRRGSGEWIVXXXGPTSSSPAEARMRRGPGEWMARLSGRSPPRPAPHHPQAQGRQQHAATRCTRPSGAPGPCXXXXHPQAQGRQQHAATRCIRPSGAPAXXXXXXXXXXXXXXXPPPKTGVAEELLWFVSGATNARLLADRGVHIWDGNGSREFLDARGLGHREEGDLGPVYGFQWRHFGAAYAGMHADYRGGWVPGLWGKGAXXXXXXXXXADMHADYRGGWLPGLWGKGAG

SEQ ID NO: 12760 - protein, 524 aa, Chlorella protothecoides
MADQLSKLVEVIHGEIVTLCLPRQLACRPGKLLCFPPTGGSAFQQEPGGARIPPEECEGATASCVEHVSELISVRPGSFPRHPVDSLVIATIFLAAAVLYNRPEYIGLEGRCGRLVAGGGGTPCRASHDTPKALEASNTPANAAAASEDAKSASQDTESEPTLVEDAGTESEEGELGKEKAEATSETTLESKEESTAVEDATTQASVDANLKELKKEAAKTNEEAAAAVREAEAEAVEEQATTEEATEGEAATAQSETTTAEADTSAATAETTAAEADTSAAMAETIAAEAEASDATVEGTATEDESTAAEAETTPAATDPTDAEAETTPAETDPTDAEATTTSAEATTTSAAAGESGAGTEQAGGEAGDTAVGAEQSTSTVEAEAAAAAATEAASAATETAAEATTTAQEAGKSAGEAAEDAAGVSQKAAKDATGVAELAADAQKAAGKKKDQRPDSMSGPFGCTGHPELRLSKPLRSHNIPAPTCSDDARSQRNADVELQTACLCWGPCHARDCSEYSRPPP

SEQ ID NO: 12761 - protein, 291 aa, Chlorella protothecoides
MEPTHATSQSFVSYRVTYRPASGPGSSVHPAGVIRRFSDFDWLKKQLRANHREQLHMCGALQGNARFGGFPSPRHGPTLALLRGCLPVLWLLIAALRPLSLACGPLPLIGPGCIVPPLPEKNVVEKYKLTDEFIEQRRAALAVFMNRLAAHPVLRHSPAFQLFLDADEAGFAREVARTAGEAGGAGVLAAAASGSPAAAVASAVSLLRSLGASASGLVSRQLAPPSEEEEDGEYLRVRGYLHRLERHVAEVHGQAARLARHQAALADALTGFGEAVADLGADREKEGEPGV

SEQ ID NO: 12762 - protein, 245 aa, Chlorella protothecoides
MAAVVPCRRPLAVASSSPSTAHGLRGATLPPCRPSHCAPTPSRQRAHPRPRPCSGFRATSSPEAEAAAVTAAPPEGLASGAVGASLAALPASDLETPTPGFASIAAALAAIAAGELVLVLDSEDRENEGDLIGAADRITTRATAFLVRHTSGVVCVGMRGADLDRLRLPLMVHSAENEEGLYTAFTVTVDARHGITTGISAEERGITLRALGNPATRAQDLRRPGHIFPLRARPVGFWGRVSCVS

SEQ ID NO: 12763 - protein, 255 aa, Chlorella protothecoides
MTSLPSPLSACPDPKVADLVLAVRACPESAGAWWALLACLEARPLPGLDLLQVYTQATRAVPRQGNQGSDAYVRLWLGFARQQWCVGVSVREGMSSDRGPTAPTAPAVLLSVMPGHRDRDDARDTLKTLRRQAIGSSSPLLFLEWAALEWDSGARDRASAVLAKGLRDGAEPPAALEAALADVAAGVWRPVPLWQQSAAPAGPHTAALTCPASTYEAFVTPGAEAERPARASHTHTLVSAALLGPGFPFHGCGRG

SEQ ID NO: 12764 - protein, 238 aa, Chlorella protothecoides
MKGKEQSMVEDGMIQAGPQIPPCQSSTPVGSSRGASSSLLSPHPSTPPLMHLPTPRPASSGQARLAQHPLRQGLGAESGGAAVLVAEHGRGGVQVHPGHALGVHELVEEEGSVDAAPRPPAHVLVVRDGALQRVGVRLLKRHAPHLLARAPCGGGHRLGRRVAGAIQASYGGAQRDHARAGQRRDVHHRVQLALVLNVQQRVRQGQTPLCVVGCLRGVGGWVQQHCTVNAGLLVQDRC

SEQ ID NO: 12765 - protein, 659 aa, Chlorella protothecoides
  MOD_RES (130)..(133): Any amino acid
MTEGQYIMGGHSVTCRAQYTMRDSISAALSTPASRDLDVHSLKAGLLHALPKFGLGTGQPLLVVNATTGLLSLCFVSGGVTLCQKLRDPFFGTYNRGGRMSQKMPLRASFRLSDQIASRFSQDRPECILXXXXAGVTLCQKLHDPFFGNYNRSGRMSQEMPLRASFRLSDHITSRVSQGGPECILLAFYRALLLDSPTPRRRSPSQGMAPPGGYAAGTLTMAALLTALTSSQGLLTTASKTGGSYAYNFATVPFLAEALKLGISYNLLRRQRKEDPKAAQCTTNPRTVALFLVPSIIYMLHNNVQPKGVQAGTIEVLAEQARACNETEDSSACTDIPTQHVQPDSPRPPPHNTVLPAAVCGPSHLPDPGQPEDRHHGHPLPHLPAAPTQPAAVDRALPAGHRGHHQPDQHGLQPGQHQVPHVGAPRVCSPSLPTPPAPGLCLWRAERHALRRGGRVHGVGDEAQQRQPVLAEHAALRLWRGVQRPGSGARQRRLGLGRGRPRRPPARLHPRHLAGGCQPGLQRPPCFLGHEVCRQGKWDAGEGEGHRACMLSLGMQSPGFATTLCSVTTLAPPSWGTETHTLHPFPPCLPDSIVKVYATSLAMLLTTGVSIAFFGLDPSLQLGLGLAVACVSVVLYYVSPEKLALPPGGSAASRALLPK

SEQ ID NO: 12766 - protein, 74 aa, Chlorella protothecoides
MQAPGGAFETPAPVAVVYICGDCGAENTIRAVDVIRCRECGYRILYKKRTKRVVQYEARCVRVVCRMLPEVTVA

SEQ ID NO: 12767 - protein, 316 aa, Chlorella protothecoides
MYPLCPGPSRAMSSLTPARNRTAGPGARGRGPEAAPGADTGPGGAHEQPVRRKTGQEAGPARLAPLQGARGRHCGPWRPLHVPPGEPRTRSTLQELLGRHEPCAITPSPESGHREGACPVPAPPPLLHPASPPQDGTVKMSKSAESDASRINLLDPPDLIRKKVQRAKTDAQDGLRWGDPDRPEAANLLTIYQTITGRPQVGLEGSLFGNHGAASVRTSAYYAGQCAMLDAFSAPLAPRQPSGGGGGGGGGHALGHVQAAAGRGAGGALGPHPAALRRHHGRPADSGRHPGEGKRAGERGMQPARSASAYVWSSCA

SEQ ID NO: 12768 - protein, 248 aa, Chlorella protothecoides
MIEMMKIDMGGSGAVLGAAKTLALLKPEGIEVHFVIAACENMVAGGGMRPGDILVASNGKTVEINNTDAAPILHEEASIDGAMLLHPPTHPPQTPDHAEGRLTLADALLYVQNQGQLDAVVDIATLTGACMIALGPAIAGLYGSSDAAAEAVAAAARRAGEKVWRMPLEKAYADALKSPIADYKNVGGRAGGSIHAALFLNEFVDTERVAWVHLDAAAPVFSDKDGSATGFGAQTLAQWVLGEAGLAG

SEQ ID NO: 12769 - protein, 240 aa, Chlorella protothecoides
MVRGPTAYFLFADAVRADVQEELQARQPAGKISVAILGKAIGERWQALSEEEKQVFKDQAAAKAAAMAWLCSTLSRTAANTFPATELAASEDPQGAGDPESSDPSPSTAPASLPTSLVKKIMTMDSDVSRVSAEGLRAVGAATEAFLGLLAAGALARAAGDKRKNFRFGDVLALALKDRRLIDMGLAEVLQQDPQFREACEAVDASAKPKSARAAAVGDIEDVGMRKLTAFFQGPTLVAS

SEQ ID NO: 12770 - protein, 63 aa, Chlorella protothecoides
MHLMCHFLEAAKAEGHSQAPALAGLGRYFLEVEHSPEQASRCFKRALALDPTLELPGGAVVEE

SEQ ID NO: 12771 - protein, 95 aa, Chlorella protothecoides
MSSCGAWLHRLASGTRCGAQASRYSRRHHGERALHAGLRPQASSAAGTAKPSSTETKPRWAEFDAETPTGTLHLGNYLGAIRGWTALQHEYGASL

SEQ ID NO: 12772 - protein, 162 aa, Chlorella protothecoides
MGAGVAGAGEGTAPGVPPRAAADEKQASNSGAPLDRWSHVSATSRTAPSETPLPASALLRPWSRAKEAQAARERAGFHEQMPRGVFEADEGLQERRVLEYLALGDLQAAVGFLLASPPDRSARYYRDALCTLAMAFAVGDDAGTRERGGAGAGDGGPPEGTP

SEQ ID NO: 12773 - protein, 278 aa, Chlorella protothecoides
  MOD_RES (139)..(142): Any amino acid
MPAHWRLKLLRISSSQRLPRRHVFGASTEARRNLVRVDDQTLGWTFGNTLVLADVETSTQRLSSAFAHGITALESLPGRQLLAVAEGGAHPCVSLIEVSTLRRRKQLTPPPASCRVRRGILMCCCDRECVTNPPAYQNXXXXRPPRHAGCGGVFCCVAVTESAFPIHLLIRAPESCPTAEHTLCGGHREWKICRRSRVGGSQPPSLGPCVGLGAFARGCDPHSAEPERRRASAGTGPCLQRTWWEKRERGLDVRGAWTAWPIPPMQMAAPCAKQRLAG

SEQ ID NO: 12774 - protein, 91 aa, Chlorella protothecoides
MQEADTSRRTELLPWANEVLVGREELSSLRGTVEELQDQVKDITGQHDYQLHMREVEAAEKLAALRAEHAAELQAGLDKCARDGAGARYLI

SEQ ID NO: 12775 - protein, 112 aa, Chlorella protothecoides
MEELSDPVHPSLTRESTLTQHGTLCGRPEPAEAWRGFLPPFQSPPRPAHPQALWALAAVSKSGVASRRSAANSIVQAAKKAVSGDSERRLFSEMGSFCEQLIRLCFHQARQK

SEQ ID NO: 12776 - protein, 80 aa, Chlorella protothecoides
MEAAGVLNRLFLEDPRARRRGLSLRRFAVLPLTEDCGLVEWVPHTVGLRHCVQDVYAAEGLFSRETTNGKIKAMYDAAAQ

SEQ ID NO: 12777 - protein, 257 aa, Chlorella protothecoides
MASVNVLEPPSNTANLHASPPPSPHQLHPLNLQVPGWSGREAGPGDGGVGAGHAGRHHRGRRNPCHPSPNQAPHPYQPAGLFQRGISLQPGREDVYFRYAVFLDKMLLDARARQRGETRAAAGKHMDRLHGRSKLKLGEDRPYLEILLEVLRMYGRGLVLGSRHVYQALPRLLTLWFEHGGGGQGGPAAAAPSAKDRECAAAVAALMQELARSVPLHVWLTALPQLTSRICHPDAEVAGVTRGIITRVTQVYPHQVR

SEQ ID NO: 12778 - protein, 203 aa, Chlorella protothecoides
MAPEILGSHKYDAKADLWSVGAILFEMVGGRPPFTGANQLQLLRSIQRAPARLPEGAAAALSAPCRALIAALLRPNPVERISFEEFFRHPFLSLAPLGAPGARDPGPPPSTWAATTSRADFASTPPYVLHSGIAGRGAQPMPRSRSAAGFGQQVVGFDGPGLTAPGTNAAAVHAAVPLGALSHALRSRASLDAAREGAVVAAR

SEQ ID NO: 12779 - protein, 73 aa, Chlorella protothecoides
MARKRAQREARATEEAIAAGMLSVRSLAKKRRRESSAARPRDQGLQEDGGSFRAGVMRVSRPPPPSAKRGGRR

SEQ ID NO: 12780 - protein, 287 aa, Chlorella protothecoides
MEGMGVVALKPMKGYKEVWDELAGTQAKGRKVSTNVDCVGLPDTWLQPAIARGLLQPIPAARRHRWWVSPLENPGRGKAAAVPCTEHQFLVLPCGGLFSITTIDTQLQSLLSADWRRLVTRDDAGLQSPYGEVYACPSSWGTLLMASHGPRLRRKGLQPPRDWVDLLNPALGGRIALDDSPRVLLAAALGTLGLDPGATATDVARCGVRAGDLRARVRRLRAATRVFGKDGAHVRALEGGDVDVAVGWGDALVGTAQRCTGVVLSAPASGTLLWADLWAVPRGAQGG

SEQ ID NO: 12781 - protein, 97 aa, Chlorella protothecoides
MRPSPSPPPIPTSKQTRSRLYLVMEFCAGGDLSQFLRHGRVLPEATARHFLRQLAAGLREMWAHHLVHVLPLACGLCMKGAAPARIRSVWMLPPHSP

SEQ ID NO: 12782 - protein, 83 aa, Chlorella protothecoides
MEISGPRLVGDWEVGAHVGSGSFAIVWRGRHRLTGQDAAIKEINLSRLNAKLRSSLESEVTILRRIKHANIVRLLDVIEVGGV

SEQ ID NO: 12783 - protein, 182 aa, Chlorella protothecoides
KRAQTSYWTQEEKDAFYAAFQGWGRDWAALRRAVPAKTLTQIKNYYQNYRSKLGLDRLGQVPDDGAGVGPVAGPVRKRKGGRGGGVEWVRGAGSAVWLADCWARAPTDLGQPLVPVPCRVAHGLDATTATHLSLPTTRFTSPPCCSWQGGIGARPRPRGHGPGGRRRRERQRSRARGEGPRP

SEQ ID NO: 12784 - protein, 527 aa, Chlorella protothecoides
MPGSRQAIRKVHANVMGRAMPHKFRNGNRPSANCASAMAGERAVRAPSNGHSMDAETTSPVLLALAKRLRNQRKKLRGIDEIQAKADVGKALNADQEAALASKASIVAAVEELERLTKLLKEPLAEEVAAARQEGEAAAAARAPPSPTKSDAEWLAEREDAVAKAVGPLRQQLSEAKTNAAADAKAAKLAAAAREAAAKKEGEALGRKACVDSSGHEETALTPGWVPPPVTETLGLPPRPPRLHPFPVAYPLAGAGPLCAAARRLALRAPRLPHVRPAGGHSPDPRRHHQRGRVCAHGLQSRVQHPAQPCREWMWGGMTGVVCSVTFTGQLFASSWLLRVPMMWRRRRDSAHTPKNPRIISRRSPTPLPPSPSPRPTGGPGPEQGPGPQGSAPPQRAAAGRRHDGRRPGRGGEEHPGPGLRGAGAQPAGRGWGRGPGAPPRPRARGPRRGPTPPVGRPRRGRPRGRVRGRPPLPGRARCRVRCCGGDGGRRGSDPRGCGRRLGREPGRPLFRAGVFPPRLAPGRGTR

SEQ ID NO: 12785 - protein, 198 aa, Chlorella protothecoides
MLNFPISLAPQDGDRFWRMPEAYVRGNTIKYLRVPDEVHSGVAHGIPRLVLHQVIDKAKEETLRRDGELRCGDAFLIGGAGITCHGREDRQLHSSVVPCPDVSRVVPSGACWLHCRHSFHKPILHPPSTAAEKRPSVGSRGRGRGPGRGGRDGGGGRGGRDGGGGRGGRDGGGGRGGRGAPNGGRGGGGGRGPPADLQ

SEQ ID NO: 12786 - protein, 724 aa, Chlorella protothecoides
  MOD_RES (117)..(120): Any amino acid
  MOD_RES (167)..(170): Any amino acid
  MOD_RES (346)..(349): Any amino acid
MRSCPHPPARRSSFTIMQRDEEEAARVYEEFVKDFGGGRPSGTGFVRGGVIQPGSRGDASASGSRQEKKLYMPSLHGPGIAGVFGDSKEEADDEPAVGGVLPTSVFTCDDSSMQEAXXXXFVSHGGGARAAKGQQAQANRSLPGEHEEVRGWQGKRLMICKSSCGEXXXXEEVRGWQGKRLMICKSSCGETGVQTAAGLPGSPLSDGHLGPKEQMQRELRKELNLPPADDDFAERGSHDVNDPASTNLYVGNMAPTVDEQILLREFGRFGPIGSVKVMWPRDEEQRRRGRNTGFVLFMVGGDRLCLGKGWVGRPSWVGETFALGPLPSHPPTSPPHPPCNHPLIPXXXXVGIAFVWARGRAGRACWVGETFALAPLPTHPPTSPPHPPCNLPLIPRQLRDDADRAREALDGAFLHEMPLNIGWGKAMPLPTAPIWPPPGGLAVEEGAPLYPAPPAPGPDGRWTWREAVPVVPHGARDDAAQGPLGRGPRIVVHPPADERTRFVIDAVAYYVIRDGCSFEQVVMERELGNPEFAFLLDTTSAEHAYYRWRLFSLASGDSLRRWQGGGGGGGGFWKWMSVKAAGRFPDQEPLGWRVEPFLMVEESNAWVPPPMTVGAAGIAKTAAQGGGGRRRPEEARPLSEAQRDRFEDCLRRLTMAREDICAAMMFALEMADSGAARRWLGIGGGGGVPPCKGCFLGPQGMALPSRRMPRVLPRLCDTCAPSHT

SEQ ID NO: 12787 - protein, 105 aa, Chlorella protothecoides
MGHIFYRQEKWSLAEYHFRRATAIHPTSSVLRCYLGMALRRLERLEEALLELHRAIAADPKNPLARFEAANVLLACERPRDALHELQALHVGAWVVIWAPRCVER

SEQ ID NO: 12788 - protein, 385 aa, Chlorella protothecoides
MLVLSYHLQAATMCEFSREEFEGGLARLACDSLSKLRAALPGLRAQLDDASRFPEIYKYAYLFSRGSGWGSKRTGWVGCKGGAACQREACCPFDLIPSSRARDSPDKTRSDPMEVTLRPLISMCNPLAPIPPHPRNPQPHASNNHNREKGQKCVQQDVAIAMWQLLLPAHRWRYTQDWCDFLQAKHNRAISRDTWNQLLDFILSVSPDFSDYDDAGAWPYLIDEFVEHMREKQQQQGSERSVTHVLEGQSWDHRGRRSRGSRDQRRGLPGSPSRASRDQLQTTRKPTLRPAGSAPRPPANPSHLLVQPVLGDAQPLDGALDELAVGRRRLQVQRRAEAAHRLVHLPEPLVHLAHLEVGADLLRRDVLQGGFRKGDVWVGRDGARL

SEQ ID NO: 12789 - protein, 101 aa, Chlorella protothecoides
MASRVTKPQREKLAQVVGVTGASTRTALECLTATGWSLEAAVDYYYSSGAYPAARGGRGPKTDKCVAGRWFGFHLQGGKHDQPAHCPASLSATGAWNSGRC

SEQ ID NO: 12790 - protein, 172 aa, Chlorella protothecoides
  MOD_RES (23)..(26): Any amino acid
MEPAPAFLGPQHPGMASIGGAPXXXXPLLEHRAADPCDALTSRGPSTSTTRASPPTSSGCTSSRYGPHGMLKRWGTGTLIDLHGGFAPGPRLIGLHVEEWQAVTPPITACSTQIKRCPRARPHDWTGCPFAHPDTLQLGGVERGPRFGCHAPCAGWSATGWMPWLKTVTHVF

SEQ ID NO: 12791 - protein, 116 aa, Chlorella protothecoides
MHQAMDRAHRLGQRRSVNVYRLILAGTLEEEIMSLQRFKLDVAGAVVNADNASLEGMDAGRVLDLLGDAAKASEARDGGEAAKKKKGGLAGMLAELPDVEEAVDQYAAEFSRPETD

SEQ ID NO: 12792 - protein, 119 aa, Chlorella protothecoides
MHLKPGDGTHPDLFFWSQEPAGSQAGAALLALMRPLPSPPPPAEPPVADAAVPIGASALAAALGNLGAAAGNGSSGARAGPAGGPSLASVLRPATLVPLLARRPELVAAMAPHLPKAHR

SEQ ID NO: 12793 - protein, 165 aa, Chlorella protothecoides
MPQRVQQPATRAPRQPPSSEHDGPPGMPPAPPLPRRRTPEAIAHLVTTPQFRHTLDVLTQALNSGQLHPSHFGVPAEVGGRAVLVPEGAGADEAGGWMWNPSALLPGTKCSLLTSVTQRWCSGVRDRRMIQKHMLSLHPTMLQGFGTLALLQGLQRQADQQKPKD

SEQ ID NO: 12794 - protein, 1062 aa, Chlorella protothecoides
  MOD_RES (32)..(35): Any amino acid
  MOD_RES (103)..(106): Any amino acid
  MOD_RES (488)..(491): Any amino acid
  MOD_RES (724)..(727): Any amino acid
  MOD_RES (1015)..(1035): Any amino acid
MALPLPQAHAGAPRPHTLPRSAQTRSPWPCPXXXXRCLRLMQGPLIHTLFHTAPRHAHHGLALVDAHPSLHPPSEHGVGRRWPGRCSGEGGRPDRSVWGVHRXXXXGLGDAQGKGGGLIGPCGACTAGVNPFAGPLTCRACTSLHKLPAVKPKQSPTDNVGHRGFEFSSPPSLRRVPRYPDPSTGGGDGAQTRPPAQHMTGAGRAIDRPPFIALLHRGRLISAVSYHLHFPRPEVKLAPSASWCRHRLPAAMEEIMKKRQKALDEAYEAQWDGGRGSHHPDYDPEATGEGVVKASRETEELYNAIVKNDIKTVYKKIEEGADVNFLFGRAYKCPEGYTPLMVAAHRGRLECAKALLRAGADPNFVNNGGDLTLFWALDGGECMGHAAGCCSWSSAGKGDLQCDETGVSGGGWHEPRRPHASQPAPTPIVQAWRSPSCCMTMARIWMPCRPRIGPLSRTQRPKESTAPPRRRASTPSTSSQHAFFATIXXXXSIIGMQENPPWHVTRHFFPTRLLRYDAGCAEVLWGYEVWLWATSSGRSIASGVVQPPWRGLPAREGQLPDPPGAPLSLLQRDWRCCACCAGRISPRMRNCPRANVQTMGLDSPTTETGTALPDHIGMQLRLLGNRAQSEASGRGPLGAWGSAPSSSKGCTLCGDRSTCRGSCRKQGGAGTGHMDPPPYNGCPVSGSTGSQSAARRQESGAGGHCHSLWVVMYSGKTRHQQICXXXXGPLPLLVGRDLFRKDGASPDLSSRSTDRHPHAHVSVWRMCSSLQGACKEQPAAGGQWARAAAVHVRVTQPGQPAPAQAGLQLRAGGGEVAGPGLRRGRRRCVRHSTGKFVAWCTAVAVVVQGFQGFRLRNRQAGEDEARSQDWPPAPPRAAGTNVLTASGWAGTARRRVAECSASPRPPAWPWAASAPPAPPTRPWTSWASCWRSRARCPPAPPASSPTVARGRARAWPPPSPACAPPWPAPSPPRSAGSACADATPSWPAPPAPSASRPRETGLCPRTRPARPPCPXXXXXXXXXXXXXXXXXXXXXFIVAATRTAASCLAALRQAFSTSSMRG

SEQ ID NO: 12795 - protein, 452 aa, Chlorella protothecoides
MPSSAVYLNVYDLIEHNDWTYWCGVGIFHSGVEVYGVEYAYGGHEYDAPGALQGMQGPPGCKARDVALLCLSGYAQGPRGSARTGRRLPSGAPPSFRLSTGVFATNPRQAPGTVTFREPVLVGETDMTPREVYAMVQELGQIFRGNAYHLLQQNCNTFSDELCYRLTGQRAPPWVGQPSGQLCGVPALPPAPGLGSPTPTPNRRPGRGAAAARARFSRPGLLHAVAALTAALFGLGPAARSVMHLGKPLAPSPNSRHHAHGGLAARLGQTAPFAPGHPSCQTHACTMPPSRATLCPAPHLFPACHCSSASHSVPPTGLCACNAARFADAAARFADAVGGCIQGPVLLHSALYTTRCTPDRAPPKVQAFWANMRPKELRSLAAPSLLARASAARTSSTPAAGQPPLARSASARSASARPYWCRPTLALARRSRARALSGSRARTLSQNSTARP

SEQ ID NO: 12796 - protein, 137 aa, Chlorella protothecoides
AWRKAAKHDAAVRAAYEGTAQFHEAWKLKAREVLANSEWRRRKLNRRIEEETERAKAEHKQEKAEAKRARDHERRWEKTREGRVGTWRDFASKKPKKSKGGSVALGGLKPPKAKQEDEEKRYIQRPVGEQFRPNQKR

SEQ ID NO: 12797 - protein, 453 aa, Chlorella protothecoides
MSLRQRQRHYSDSSVSAPASPRDLRPSPPTTPETKTQEASFKEFLARPENAAVVEKQQRKEVRQALSAQERAQLEGLRSAVLGADFEAQRGVAPFLRTPCLRRVVQSFANDPRGDFSAWAANPRVLEMLAAAQALLDSGSMTEAEMEHVMLAQLRDPSHEAHAEFQRKARRVARLPTDALVGALNEHGVAGAGKEGGGVLLLHTDAERTPAPDQGIGSRLTPSQPPDSPLSTNAPPVCHSITQLTERRKGNELYRARRYEAALAAYTRAAAVVEFVEGLGSADQAEVVLNRVAVYNNIAAVHLEQKGGACRTRSFAAIVHLGGREGTLPPLSRPMQAPCARGGADIHRNRPARRPTAGTPPPRSQDYGLAVEFCDKVLALDPDNARARLRRAKANVGRHQYGLADADLADADRASGGWPAAGVEEVRAALARARREGAASERNSFGRMFAQKA

SEQ ID NO: 12798 - protein, 222 aa, Chlorella protothecoides
  MOD_RES (12)..(15): Any amino acid
  MOD_RES (143)..(146): Any amino acid
MGIVMMEASVPXXXXGQYEDYEGAIGMCGPGLVILAPTHCLLETHPVPPPRRITKGDELVTGDVFYFDYGVIVCWGLSQAAERDVIRSLAGPALVDPLSTQEVGFGLDFLMEERHRVALEGTSQVLSHCPTVAPPIPPPRSRXXXXDPLSTQEVGFSLDFLIEERHRVAVEGISQVLSHCPTVSPPIPPPRSRLMSSTFITPCTRSPTSRTTPSRVSGWLGW

SEQ ID NO: 12799 - protein, 368 aa, Chlorella protothecoides
  MOD_RES (191)..(194): Any amino acid
  MOD_RES (290)..(293): Any amino acid
MRSRDRVAGRCRARGKGARRCSCLVDCSVPRVERLNMNPSRACWAKTPTSFGGLLRDRFSHHCSSREAHPRLPARAGASMKKNAPALGYQPIPNRPASPLDRPGAAAAPALNRRPAPPQPAASGAEPRRPQRLANVGSIKPIAPGQPAPPGRSRERFISLPEELQTPDDLSRSLPAEHPTIFELFSQNLCXXXXQTPDDLSRSLPAEHPTIFEVSGRDCGGPKWRWGPGASRNELQPLLWDRLSSAVDHVDMLLSTCPYSSLYRTCALSPTCKLPFDPAASLPKPTLFCXXXXHASSPSTLRLASPNPPSFNLRAGSARRGWAARHARTHHHLLYCRVPGQEIAGAAAEGAWGCGSAAHLSRRLIWPV

SEQ ID NO: 12800 - protein, 509 aa, Chlorella protothecoides
MEHPDQESVDPNEAGRPRPAAAKRRMSAIDGTPTRLQPKRKAKDRRRVSFAPSLTSVQFFNKVRAGSQIFEPPPPPPPDATALTSNCPLASEMTSNPPPQDEDNSGELAPGRSRFGVPDIPQGPWEDQEPSATVTAEVPPPSPMDVSMELTEPWQRETQPADEVTASVPSLGDLLSSEPDATESITAAVPGLSSLVDESREEVALTQAPEAGPVPDGADMDVTLLDGELAGCRRAGGIFAGLDLLVGAPACLHHHLVHPACNCRDLGMRPLLLTGSHCPFPGLAGGSGAQGQEEESVQPSPGLSEDGNEQGPALASKWGFNPGCEDTMDLNLELHGRMIMGDHTYGRLYGDVTGSAASLEEGEAGAEEEDGEEEEERLGEQDGGARLGEQGGLSPERNTGLPAPDRDLDAGAGRAEESDLDSIEPACSPPPEHPRSLEVSPTAEERRALGPMQDDQVPASEPVWTAPAFLPPYMMASGSQVRRTGGMQALGLVWKCGWGTSHSSSDVHP

SEQ ID NO: 12801 - protein, 362 aa, Chlorella protothecoides
  MOD_RES (344)..(346): Any amino acid
MMASDFEKMASGPSHKAPERGAGMSSIERVRGHGDPVADLCPGMRRVRCTTPLHTRTAALCSLSTLAPCSSAGHRDDDFLERSFWSSVTINPPLYGADVAVSFFDERLDFGWNLRRLGCLLSQYDVPEIPGVTSPMAYFGTWKSFFGWHKEDIDLYSINYNHAGAAKIWYCVSPRDGHTFDRMARGLFPELHAACPAFVRHKDIMISPRLLRAAGVPFVQARQEPGEFIVLNAAAYHSGFNLGFNIAEAVNFALPEWLPVGRAALNCECSAMSDGVCLDMGIFFPDLRREDSSSGEEEEGEEEEGSEEEDEEASGEDEEAGAGAASSSEEESAAASSSQDRDRXXXRRRVPGHGHLLLGPAP

SEQ ID NO: 12802 - protein, 78 aa, Chlorella protothecoides
MQRAKCSEEERASLAQFHPLDELQLRPDAFPAFLCDTLGFRLVRRLQPGEAASGFHRIYRPSYMISGQMQGVEHYEDG

SEQ ID NO: 12803 - protein, 360 aa, Chlorella protothecoides
MPGQRIPSASMPHEMQAEGVRQLEMQAHCMSCFIPSRCGCCAGGHESLGQSGMIAPKLSHPGVCNPLQAGIVSPMANLFTNLPKPCPWQLCTDALRAMLAGDERAAEREAAKCRDLAVRVAGAGRQPSGHQYQQTVAFLSVLEQMLQHNMPSTHALDEQHARSLDRLLNQVGLSLCICFPGGVELSGGQDSAVLEQGTHSAHPLKISGSEWKVGDGDQAAQEPQFSTWEEALGGGPHPGAAGPRRDPPPGASRSQPGRHTALYNDLGVTGGATRADIRAAFRKGALTWHPDVNAAPEAPARFARLAEAYGGLGDAGRTPARLAVEGGACFEGDVARAAHTAPALRTHRRGAVRRGAAQEL

SEQ ID NO: 12804 - protein, 183 aa, Chlorella protothecoides
MGQAPSVKEAQVVADEIFSDFVSQEVDKVEIIYTKFVSLIASEPVVQTLLPLSPIGEVCDVDGNCVDAAEDEVFKLTTREGQLVVESEKTAKTDPSDFEAGLIFEQDPVQIVDALLPLYLNSTLLRSLQEALASELAARMNAMSSASDNAAELRKGLNQVYNRKRQAKITTELSEIVAGASSV

SEQ ID NO: 12805 - protein, 189 aa, Chlorella protothecoides
  MOD_RES (169)..(172): Any amino acid
AACAPGAAPGGDARTLCALQALAGPGAGDDDAAVIDAQHLFSVYVHAPPGVQDSSLPPLFQGRLVSRRIDAAWGSHGLVEAARNLLWEAYKEPTNQRFMLVSESDIPLYDPMTMYQQVGVPGGRWGGAVVECGHMGIGNCAPASHLGGMGPQRTPVLDVNLLDSGVDRXXXXRPCFPPGWYGAPAHSCP

SEQ ID NO: 12806 - protein, 678 aa, Chlorella protothecoides
  MOD_RES (238)..(240): Any amino acid
  MOD_RES (430)..(433): Any amino acid
  MOD_RES (540)..(543): Any amino acid
  MOD_RES (588)..(590): Any amino acid
MLNLKPHAHVSTLYRHHPPRSRSNALPLSPPHPAACQRGGLTRQWLRPQPHRPKTLDVADEGEKEGIRMFGPMEVMSHGIQAVSPNPAWPLMGETASPASCIPQRKPEGVPLAEEHTVVSGLAGHHEERVHDPPFHVALGHRFMLTRPHAELVLGDTEVYRRSLQEVRRVEGVKGGTNRAGCGKCLQMKTIAWLVTEAWKLGLVCKHCSSGLTLRILCTMARVCIKNGTLCRASGALXXXELGLVCEHCSSGLTLRILRTMARVCIKTGTLCRASGALFPPRPSQITALSHLGRFEEHCWYGWDNDYRRWRDCFSDEVGTVVLTLVSGSLHWSAVEGGNPLGPPSSLPCSTTCRPYLPCTRSKLTRTAARWAWPPQIGVAVPTPGLTGWCVRVCVGALRFECCSRVHSGIQRSKSHQRSKSLILAACLSXXXXQMLLRGTFWDTTIQVSSKVRVADSCSLPEYVYAHPSPQSLTFSPQPRGRHARAPDRGTEVAAGRLRCPVCVGGGPEDVCQGGRGLQQVWGGWWWGMGGEGKSLRKKXXXXKVDEAFNSRGSLVVVLLPQVYPGLLHTETPRKTTSHTTQRPVQGXXXPCLKSIPAFCILRHRPKQNPTPRSGLCKVPLPEYESHLTSLCKVTARKFPVEVVQQTATLFTDCNNGLHLLAPGVCAAHAEQGGESLS

SEQ ID NO: 12807 - protein, 721 aa, Chlorella protothecoides
MVTTSTFPRTDCASCTAQRGPDTYHRQVKHRAFLDDHGRQIHCADDREALEAVASASATFSLHSRTSSWATSVVGGIKHGTRWALAEAIGGKTSPDPGSSTDWRVPAPSGRCQTMKKVVVKPQATGTIRALLGERKLVIGLLESCPCMAFMVTFENCQADRWCTDGPGLQAPISCIGSSNLLSSFENETIHTAPPQVSPLYLEFPTNSTLSDTDASGAPAEPEQAPKPPENAAKEALEAEPALLEDPVTEEQSRDDCAQTLSASLASHLSSKTLCACRHAPQALGVPKVALLFLAKENIWLHESWRLWFQSASGVLPLRSLQKHGCSRSTVTLPEACRGRGVLASTEVAEEDIIAQQSLFSVFVHVPPEASPVTPVVARSPQVHPHNLPQRPRSRPCSATTCFRGAQWQSGGACGSSMRPACSCTRRSRTLPTKGARGCAVKGGTLHGQLARHAAPHATASFGTWAALGGADPPPASRPASRFLLVSESDLPLFDPVTMHYQVRAYLAISESLSRISACPSSSVDRYRWNKRLKVGSFVLCECLAEGRPASESPAAYVRGHITSFPTCGVQCNAEGPFRLNTHAVGSAEDESLAKGLPVVRGSLWCKVYGCTSTTCTIALISTLKTRLHLLNSPLPRTALIVLPRPDWGSLCAIMDLPGMAPGQAVKQSTQNALHLRSDTGSKSTATRGTTPLCTGRGAAMATRWALDDGGMEGHRGHCWN

SEQ ID NO: 12808 - protein, 500 aa, Chlorella protothecoides
  MOD_RES (114)..(116): Any amino acid
  MOD_RES (460)..(462): Any amino acid
MPAISMQGRLRSGQLRGPGCHRTARAHAVPYPPWAPTHGILPTQDTSFSRQASLGIPPTPSLDDDRSRDAKQLQNSIAGNAVTHSLIVGADIGEKVCIMQGAKCWMSGWEFAVXXXTVPYPPCAPTHGILPTQDTSFSRQASLVTRYGLVAQSAPSPPPVHPASPLAVLKPASSWDERGNTCNMALELDRVALLFLTKGDLFHHQTWSAWSAQGMLPVSNVEEAVCNNFTTAEALRSFCDMTGTDSEGQRALDPDEVVLDRQYLFSVYVHAPPNIAGRQGWILSGGRVNDMMVSVTHSIPLPTYLHLAEKDMRPLFKGRLIKDRIYTGWGSHQLVEAERNLLWHAYQDPANTSVLHAKYVCRGPLPNMQTTTFQPMAHLDCQQPGAVTVKELCWELLPPGCKATPVCPGRCTTKASSQLTAVVFHPHAFTHHIQVMAENLSRVNACKSANQDHRRWSWRXXXFKLTMQGQLEPCLRLFFSRDVKLHWCVLGATLPRLLLN

SEQ ID NO: 12809 - protein, 791 aa, Chlorella protothecoides
  MOD_RES (58)..(67): Any amino acid
  MOD_RES (441)..(443): Any amino acid
  MOD_RES (542)..(545): Any amino acid
  MOD_RES (745)..(748): Any amino acid
MRVASNASESPDHAVLADALMYAQMPLLAEKGPEELALAEELSMYSAGEFWNAAGLSXXXXXXXXXXLPYAFHSTALRPTAGGGTIRTTDEIGIASVMRWVEVQSVSAWGMQSFMCGVGGLSSSHYDAPSPDVHALLPKVIAIRLTAIPLSVATPAALPFHPTSIAWRSDRGELRSVWHHLHGMGLRGLASAPAFLRVSWPVALPGCDLLVHPMCMQSCLSLPNDRPREVNAPLIRRLRGSADSCKPETLIAEAMAGFVHVASIAPYRQVIHWVGGWAKLALICRRLPCSLDGEIELPWAPHHREYLTKHQSHAHSGPECEGSRDAGPILSSGTALPSTCYVLARKFPKITARLVYRVMTNCSSGLDLLAPGQCLEGGEMWMRNTQLMHNYSSIIVICELDIMAGAGVKADSGRAWYGRAQDNTASGNNFASNLLRPKYTXXXNRTVQQVGTAPHPTSCDPNILSQHARTRYFVSWSRPGVRKSERHATLGTSMSPPMTLLLYAMLSGAFYRVHQAPHPSSGPIERARAPNKPPPAHIMHLXXXXKSTLYLFPVHPGPCRCLEIGSGSGYVICSAVRLLHALGVHPAHVMATDCSAAALEATAGTLQAHQASTCPHNAPASCDLSQPELFDHANPLQQIEGADLVQTDLVAGLGDRLQGCVDLLLFNPPYVPTPDGEVTLGTTITAAWAGGWKGRRVIDRLLPQVPGLLSCTGHFLMVSVAANEPEGMQGPLLRSPHCYAYKERXXXXTVAANEPEGECPLPSDAGREGLRVSAWTLGTSKLCHRHAGSIA

SEQ ID NO: 12810 - protein, 218 aa, Chlorella protothecoides
MLLDQRSRQGFPIKLLVACAIFISGLEVLSHHDYLPTIPWASLVSSGASLRPARDPPFTATGPGVEDHVWGLPPADHDISNPALLEAPQVLVSSPDTCAQEPSPCPPYDQALAVPKVALLFLTQGVMHHAEAWALWFASAAGHIPLANLRQAGCDAWHRSILGPLGACDSSVGPKEAAELDPEDIIGAQHLFSVYLHVPLDRDGEKIEWVLQAPCVFE

SEQ ID NO: 12811 - protein, 430 aa, Chlorella protothecoides
  MOD_RES (82)..(85): Any amino acid
  MOD_RES (417)..(423): Any amino acid
MTQACRPLSEPQEPALYTGSEVRIRDPDQANLHFALAYKGASWADPDSVPLMVIQTLLPSTPAHPPTHSSSADAAGRVGEEXXXXSCVVGGWGDSMLSRLYLSGGARARVPRHSFPRPPPTHPPTHHAQTLLGAWEKNSGAGSEAASPLVQPLAVNGLANSFMAFNTNYHDTGLFGVYAVADNDADHEDLAWTILHKITGLTYGVSQTDVDRAKNQLKASILFSGDGTTGTWDLVRCSEDEGELGGRRGEEGGSSCDGLAPRWPPSPVVLTLPFTNQPPGMAEDIGRNLLVYGRRIPKAELFARIDAVDAAAVKDVAYRFFNDQVGGRDREVEELRGARKVDEDGSARRRWVRMGLQGAGASCTKPTTAEVNETAPHAAPHHLQNNTPQDVAVAALGDTQFLPDYTWLRRRTYWLRXXXXXXXSSWLTPH

SEQ ID NO: 12812 - protein, 237 aa, Chlorella protothecoides
  MOD_RES (212)..(215): Any amino acid
MHAVELALQGYDDPQPHLLARVREHLAECQDDAAVCLVCLETIASAGRDAGVVTACSPGEPSMPYKSAWRHASHPPHSSPEAVWYCRGGCYVMTHLGCAQSWARQQLDAADAKTIHSLGQIERDPGQAPPTWACPKCRHEYAASAIPRDYSCFCGKVAEPAADPWLLAHRCDLGVGGLEGSLHDGVVTGVQAVHAAVPVGPDHAWSELAEQXXXXLTCQWGLTMLGQSLQSRLPSCT

SEQ ID NO: 12813 - protein, 70 aa, Chlorella protothecoides
MLQELGQPPLYGGWVQKFNEAGISVVTLDNQGCGRSDGARNLRYFVESFQDYVNDVLLLRRWVSRCTKPR

SEQ ID NO: 12814 - protein, 125 aa, Chlorella protothecoides
MSACHQAQSIGLVEVLTDVLAKGVPCAARRDAPPAPVVGVGPEQVAHGPLVGDFLHPVQAADVVQGVQGGAQPTMEAENLFRGGVGVGQGYRRLMESRGCSASQEDRGWRKPKEGFMDAKSQTSR

SEQ ID NO: 12815 - protein, 156 aa, Chlorella protothecoides
MGCRRWLAIGASSCPWRGEPIHHLGLGGVHCHRNIFFRHSPIALCMGSTTQVRYRDRITILRGNHESRQITQVYGFYDECLRKYGTANVWKYFTDLFDYLPLTALVENQVQLLLRSWNAGGLEGQEWFSWGPAFRAGTPGGHSPVSQSQTTERSAI

SEQ ID NO: 12816 - protein, 301 aa, Chlorella protothecoides
MSRPVTIQAPNEDLGLGASPSLRHLSVWNTLLRGDWRRCSACYAPSIHSEPLPAGAVEDPTGNTETLMGRVTLRKRGARAQHVRLFDTRHRAALGGRYLVAGDCRHPPDLASANRGVLRRSWLPSFVSNIWPRRPPTMATPPLDHYKDIDAQIDQLLQCKPLSEAEVQALCVKAQGIFVEESNVQPVKCPVTVRIIRQLLFSDGKRTLGDDMPRDAQVTRTFLHLRSLTLAGCVVACPALSHGNHRRNVRPSHPRFAATFMASSRTWWSCSGSVGTAQILTTSSWATMWTAAITLWRRPRS

SEQ ID NO: 12817 - protein, 175 aa, Chlorella protothecoides
MHPCTTTPTTKFPNPLSRVDVQHLTEGDGDQAGLPRAGLRLGDHVPARDDGQDGTLLDGGRLLEAVGVDAAQEVLLQVHGVKGGHHPHALARLELQAGIALDHAAARAGTVCVCVGRAEGGRGSGRCQGRGLPDAGDSAPLRPSSACAGWYNGCKYSSSYKHMTGNVPTGLPAWR

SEQ ID NO: 12818 - protein, 634 aa, Chlorella protothecoides
  MOD_RES (264)..(267): Any amino acid
  MOD_RES (516)..(519): Any amino acid
MCTHSPLHTHIKHTFKPPTRSSLQGAGAGGVANTRAGHTDGEEHPGHRRLHECAGTRLHRGQVRGRGHPAAGGGGAHRVWHPGPRVRHDQATQPAHARHPHAGAGRGGRDAVQGVQGADLRRVPLPAPRDPGGAGVGHTAARGAGDDAQVHDRPGAHPGQARRADAGGHQAVLRGRGAGGVEVRHPLRPLRHPHHHPGRHFLQHQAQGVGGWVFPAVAAAPGPATSLGRLGTVYPPCPCSSLPGLALLTLTLHHMTAPNALKSXXXXTVYPPFPCSSLPCLALLTLSLHNMTAPNALKSPPFPPKVDWLTDKMRQNNFTVSAMHGDMPQKERDAIMDEFRSGATRVLITTDVWARGLDVQQVSLVINYDLPNNRELYIHRIGRSGRFGRKGVAINFVKNDDIKILRDIEQYYATQVDEMPMNGQGPYRAGKARQGFKGCKQCGLGMIQLARITGQDRGGPVKGALRGAGALERAPDGIARRGWGIPHEGVRGSTLSCGHRGSAASLIEGRGIKGVXXXXCEGRVHWSGHPAASHGEAGAFFLKGPPVWALLGSRSGAAAAGHSKLWCTLYLVFQGLATLPKGLAAPPQRVGLVCTGGLVCTGHQLCRELSPGGTMRVLVGMPRRQPPIPSLPLR

SEQ ID NO: 12819 - protein, 339 aa, Chlorella protothecoides
MQSPLLTFLRRLEAQNIWRVTYNALPQQQYSSTAVQDQAEGGGRAWGVGGAGRGCYSGLDVLASHLPSRRHWPGLVGPWPVVSLTVNRHPSPGHAPHFLSQDPPPPPPPSPSSEPSRSTTEWYNDESLSAQDALKLLVARIQASGPVKQHHLQELYQRCRTGDELDRALKLTRLNYLARGALEQHAPFSHRTSKALVSQAMQLGVPEVAARALEHSAEFGLPADSAKEATPLLIYYSKQGDLLAMFELYEVMKRRGRHPGPDVCYVLVKGCVDWGRPDLARTVVQEFRDAGVRIREGTLAYMERRPTMGLEAALPSTAEFSGAIMGGAGGALAARAAPR

SEQ ID NO: 12820 - protein, 175 aa, Chlorella protothecoides
MEEEAGVLAPVVPAGARTGRTEGRAVARVWQSSSLAPAAPSPTLCPPNTHTHSPRSGGGVIQGDASLEFETSKGVRVVSTFDAMNLKQDLLRGVYTYGFEKPSAIQQRAILPIISGRDVIAQAQSGTGKTSLIAITLCQMLDINTREWVGELGCGGGCAWLELGRAWGLGGEGGE

SEQ ID NO: 12821 - protein, 179 aa, Chlorella protothecoides
MTAWVMVAEGVELPLLPLHGHEELLDALQRQLVALDQDAHRVCHELVRHLQHLVRQCGRHQHHLGLGGQVAVHVVDLLLEPLGQHLVRLVQHQRADGARAQAASLDHVVHAARGARHDVHPRLQPPDVLAHGLAPDAGVCLHIHEVADGQDVLLRLCGQLACWRHHQRLHPAGRSVWGA

SEQ ID NO: 12822 - protein, 150 aa, Chlorella protothecoides
MLRQDLIRDIHFIWNADRREFHTIIALGLDVAGHPRITHGGFSAAVLDETTGGLVFEGKKDGSLGPGRAFTARLEVDYRKPMPVDTEIVCTARLLNTEGRKIWTEAELRDRPGGTLYAVAKALYVTVRAEAEPRGEERAAEDGAAEEGRA

SEQ ID NO: 12823 - protein, 505 aa, Chlorella protothecoides
  MOD_RES (273)..(276): Any amino acid
MACSPSCSSKGTNPRTTNPQRNAGRKAPRRAPAPVIRAPPRQLAPWAARTQVFRRAVGAPPSPGRTSSTTSLGSHDLPDALAASVAVTPSEPSQSAFSRALHAYTTALRDHPTATKAVTSFLGFGIGDAIAQSIGAPFDITRNIRMSLYGLILDGPLGHKWYQILDSKVYPEDPTCTKAVLIKTAADQLIWAPIMTAVFFAFLKTMEAVAPMDLAHVCRNQFPFPVSPHTHPIPSLCPRPPRAHFAHHPRQAGAGGAGQLYALAHGTHHQLQXXXXVLANYMLWPMAHIINFKFVPSQHRVLFNNVVSVSALDDGAGEGGDDANWVPSAEAPSQCSSLRGLPPLPDLRLLAGCGGAAADQAAVRQAPRCAGLAACGRPCAANGSPGAAAGGLGHPGRLCPRHKYLFSTLVDQVPMVQVRHCCASPHALFIISHYPTHAGTAEPRCGQRPAWAVCRPEAAAGPESVWAAILSTSAGHFLSSLRDALAPQGRKQPEFLSYPSLACSE

SEQ ID NO: 12824 - protein, 80 aa, Chlorella protothecoides
MRWQGVVELEQGTAPMSRGPGCEDLIVRPAHKRAPPCSAPQEIAAEIRAEQSPRRLHTVRGKVYELLVNCIPPEVGAVPV

SEQ ID NO: 12825 - protein, 144 aa, Chlorella protothecoides
  MOD_RES (77)..(97): Any amino acid
MPRGSGCSWGVAPGLAPGLHSHRLDLHSVFLPIPPTHPLALFVPVRYVVQEIIQEMAKNRPVGVSSERMFKVRGRMXXXXXXXXXXXXXXXXXXXXXGGALRCEHVCTLQQACEGQRLGACREFQLWEYTSPAVPPPPSDADPE

SEQ ID NO: 12826 - protein, 146 aa, Chlorella protothecoides
MQRGGAVCALALPSEVWIEVLSRLNGQDLARALCTCKAFSRLQQPVWQAACFKRWNKWSSYLDPASHWRRQYELLCLRELAEQTVADVGQIRNAQQFVSDRHRAVLVEWMCEVRGSAGRSEGAMPTGVDIAACRCSVPDPPRPCAP

SEQ ID NO: 12827 - protein, 132 aa, Chlorella protothecoides
MESSFSNRGDREEDARPALPQRAYLQIALYASGNALAALIGLLLWNLYAVLADYRDAAVYALLCSVALRGPKTWLVDYLGRELAHRSILQSLFNLACLPLTTLVEAWMEGRVLMLRWQQLAVERHRQVRLMP

SEQ ID NO: 12828 - protein, 124 aa, Chlorella protothecoides
MPEGERSLDSDQTPRAPQISQNDCPHALFYGPPGAGKKTLILALLREVYGPGVEKVRPESPCQARCSRRTHAPAAPLVTPTQLKVECKPWKIELPTRTLEVEFTTLASAYHVELNPSDVGNNDR

SEQ ID NO: 12829 - protein, 130 aa, Chlorella protothecoides
MEGSGRPEVDAPPPPSVAVQRTLEALRLRVKEYDMARAKDRLTIAVVRGACAGLAVRGGLHAVSYLAGRLMRRRRREQPPSGPTPVERLVETLRYGAFLGTFGGVYVSADELIAMLLGRSRYGWQRVVEL

SEQ ID NO: 12830 - protein, 61 aa, Chlorella protothecoides
MRRLALELMQKLDDELRQSVAEQAAFFEHRLQEGSKAIFHIEAFVARFMADYKNFLLAAMA

SEQ ID NO: 12831 - protein, 165 aa, Chlorella protothecoides
MFKGGQKKDNALDLSKLVDKTVRVKLAGGREGVRGVEGVLKGFDQLLNLVLDESTEFLRGRWCPGAPCTGWPAAAQWGRDTDTGPGGVSWDECDAGGANCRHRGDRQPLHPARGGGMSACAKAYHLVLPRKHEHALQLLAHMEEAGGAPLNELCLPGMRACSIDS

SEQ ID NO: 12832 - protein, 676 aa, Chlorella protothecoides
MVFEGWVVDHLSAWLGHFFDLQRDQLRISLWRGEMELQALNWAYEPACRPALGITGVTLENIPIRLDALEYLQLPFRLTAGNIGRLQLQIPWQALRSPLILEVADARLEACLRGPEELWQEPAEARAWAGKEARLAGVEASALAGPEGAQESATAVPAPSQGSTGLLWGALSSLASFLVNRLQIRFTNVSLVLMDPGTGLGVEVRLPSVHTCSPSVALRMLGAALDEALGQEGDDPGMVHKDVALAAVSVWLLQGEPGVGTDANGWGEVGATSLGIDPTQAPLGSLPLLPPCDGVLHLGTTAALSNGTLRADCTLTLPSLRLSLSDATLAGVVCLADAAERVSRQNRAALFCPASWRLKSGGREGFARRMWVFALNGVLRSDARWDAGVTAWVPAHKRAERRKRYIRLYRAVLERPVQPAAGVGAAKGSGGGGDAVEEPCCSMLEAAERKLCLPDITLCRAVAARMAAASLAKAAAAAKRKKTGPKAVPSPGQLLLAAAGPASDEKGLIGVDLAPAGLRGAAMPEEGAPPTRDDTRTEEGLSVPPADAMTAASALATAAAGSVPEAALRPGNPGSELPRPGAEGDGVPVSEGTPEQGLALSTRPVSPHAAARRGVVSRGVSAMAGFFGALPRRAGYAQHHPNPPDPSLPPAAAAPGAPRRGGGRPPAGGHGGRHRG

SEQ ID NO: 12833 - protein, 108 aa, Chlorella protothecoides
MVLRVLGDGRRYIASIRTENWIIGEASSHDVYQAFLFAREGEWTEVEIPLARFLLTYKGRLVETHVQMNRSRIVSFGLALAAGDYQQEGPYSLGLDWIKVIDSRRLDR

SEQ ID NO: 12834 - protein, 148 aa, Chlorella protothecoides
MAFARLLRSTQRYLEREGDSAPTDSPGALHHAVREPIPTFEQRLFDFSTPASLARWATFSDTELGGRSTASLIASTSHPATNDFDQISPCSSHLQGTAVFQGTFSRETGADADERLKRSGFVGMNTREYDGGCVAAQRKMHSAALAGL

SEQ ID NO: 12835 - protein, 207 aa, Chlorella protothecoides
MQEGYDLGGVDLEALDGEAIVSALRQAAEGLRVARGPAGMRDLEAGLPAGVSISAAEVPPSELKRMLEFPADWGPSEWGERDAAGQQSAPSFASPSPAQPRAGPGPIPFLPDRDTLVRRMEKHWGPLDSYRGIASSSAGGLVITGVQIGKVWIGIQPMLGIEGDPMRLLFDRDLTPHPQYAAFYLWLQVPWMGEVLWTGVVIVLQEG

SEQ ID NO: 12836 - protein, 160 aa, Chlorella protothecoides
MPDLTPQPPTLTWQLLEGRLFSSGLHVLGKPPSREESLEYLAAYFGDRVPREALERVAAGESVQNVHVGGAAHPEAPSLLEEAQSIASLLGQNGEELRGLTRALSGQWVQPAPGGDLLRDGPGVLPTGRNIFALDPYRMPSPAALLRGSRAAESILAAHR

SEQ ID NO: 12837 - protein, 155 aa, Chlorella protothecoides
MHGTAEWLPGSPLGSSALSWPDVLHGDMPNIYLYAANNPSESLVAKRRGFATVISHNVPPYGRAGLYKQLAELRELLADYREAPGSSKDMRGTIVSLVVASGLEEDVVLEQDGVTFDADIVGDLSLEAFNSFTFRLTQYLQAGTRLGGSWSHSMP

SEQ ID NO: 12838 - protein, 339 aa, Chlorella protothecoides
AAAAEPEAGAEEEEAEAAPARGAPGSGLQLADLSNPLVMAPDSDGGLDRLPPPPVALALTLSVANTGEEAFTFTTGLRTRLATEDARTHGQYIKAVGLHGAGCGVGVGRSGYIPGRIPWGGGEAGASLRHALGMSGVPCSVAMPAEHPSGVALLGCQMYIGGLVPVPPTGKHTLRRESNPARPRIRVENEQAVSFGGRQLDRVYVDCGAREFIAVCPGHAAHVEVKNLRGFDDVALDHPALSYPEEARWSVGIAPARVARPVRRVCGEREGGESGRGPLPEQQRGPGHGEGGCAGSLTAQYLFPPSLAGWSRGRRGRGRPISSRGRSTGTRRRGRGRRG

SEQ ID NO: 12839 - protein, 114 aa, Chlorella protothecoides
MAHCTITSKNVSSPRALEIGWGEDRELKDDNYTVALPHHFDTLAVAHRKLSVIDLIRERWGWLLIFFGGLVLAALVVEAFEDVLKHNVELSYFVPLLIGHGGNTGSQSNATVIR

SEQ ID NO: 12840 - protein, 234 aa, Chlorella protothecoides
MSGWRPSVETPVARELDASRPSWEAGHAGDLWIMPYFPSSLSPGKPSLGPESQGAGPGPRQAQRLPARNGQGGRGRDLHGRHAGPHDPGLQLPLGQHLHPGRPCGRHLPAGERGWSDGGGAPGGRRLLARSTHHARAFREWAGSGSECGAGAPMPPSRRGQALRSGAPASTLLRFLHTPQLVSLWANVLGGVFPLLSARFGFNPAVTSAPLMTTVVDSSGLIIYFYIAKIVMKM

SEQ ID NO: 12841 - protein, 519 aa, Chlorella protothecoides
  MOD_RES (104)..(107): Any amino acid
MISSAVGMEVSPLQEMPNDAPNQLFNGRLEGARASRPASPLRPSITPPSSPPSPPTTADIDFGALPRNLRSTDPAARGRFDLEHKEALASLRVALARLAPNLRXXXXHKEALASLRAALARLAPNLRAAAQFEAVRAREREHLEELEAARRAERAAAAAFAAVRAARHDAFTAAFEHVAACIDPIYKVEVSPGAQPITGSEHPGQPHLASARSATEPLLVPPSPGTGADEQRGAPLWRPGLPGAGQCGRALLRRGQVQRHAPDQALPGHGGAERGREDRGGPGPPLRRPQVCRVGSGGRGEGVSCPGLGPSVGPGFARLAASFRGPHLAPSASPPHPTPPHTSPASFRPCPFFVMDEVDAALDAANVVRVANYLRHMTRRSTNGSFQVRDRGRREPGACHPDPAQSMGPACRLSTHLPRLLDTAAPAFTVPETGAHLRRHPPVQHPILHAGHRDQPEGQLLRQGRCAGGGVPPPGHQRLRHLHPGPERLRGCGGPVRGDPCAQRCCDKTRARPDGQAAF

SEQ ID NO: 12842 - protein, 642 aa, Chlorella protothecoides
  MOD_RES (36)..(39): Any amino acid
  MOD_RES (78)..(81): Any amino acid
  MOD_RES (524)..(526): Any amino acid
MRPLELTAMFEQISGSAAYKEVTVMCPWSRIQGVKXXXXSRGLLLTKRPQVESLIEPSFKHMTMLTRRHVVHSMSCMXXXXRPQEYERADQERAAAEARLSVIHAAKKSIAHGEELWLGWVWGRQLTAWQDIPFMNSSSVTPLLRTNYIFHIPAEKKQKKEEKEEADRAIALQKEIDERRATHFLWSLFHLRQDELAARQEADAKREGIAQIQKDIKVCLEGWAPLFFMCWHLSYIFIDGTCLPPCRSDCGGVDAFSAQDQCPGTACGVMPPTLHPQPPLQANKALLESQRRQQASLAKKRLLLETRIRKMTAELDRGSPDLIRVREELSRGAKRLASLQKQLEEGRHGVEEQRARHAALERQLESLNDGGWAGKCVPGCSAGVCSAGQDGCEVVTRMQRLTSHTASLPHLTPALAQLDADVAAASSDELAMSETLLAEYARLKAEVGAQVSALELDRAALSSTHQAEQEAQRLAQASLEAVDARIAGLGGWRCVGGKQALAVGHTLTSADFGIAYETLCPPLXXXPGWVEMCRGEQALAVGHALTSADFGIAHETLCPPPRSIATETERVEAEERLAAAKERVQELAGRLATLQAEREGASGERRRVDSRVGGVGPWGSSARALLQALARCMRCCTTLLCW

SEQ ID NO: 12843 - protein, 150 aa, Chlorella protothecoides
MGVGGKAIPPNVDKVQRGRDMEAPPWDSLSCARPVQPTSRLGGDEGPGALGRQPRPQCLDIKEPSLSPKTRQVTAIQSDAKFILLVEKDAAFMRLAEDRFYNTYPCIIITAKGQPDVATRWGSQVAVPGRLYDLELAVPVCFVALVPRVV

SEQ ID NO: 12844 - protein, 628 aa, Chlorella protothecoides
  MOD_RES (538)..(540): Any amino acid
MNMSYDSSNLTTPDIKWLGVRPSDLDRFSIPEQEGKGVLAAVTTNKTLRRRCAPPHGTHGGSCPTLHAAGGGLCQSKPRLGAGAAANGTRCRGARDWRIGLPVLIRDARKQHLIAIETSHKFGCADSRRVSQQRPPSYVIKSNVRFDNKSRILPDPRRAGCVHGVRNQGHHQQLATLFAHKSISSKTYLTAVWATCGSCVKQVFCPRPTPPFSRIQAAEPAIAHLWTSSLPHMCRISTINPALRRQDTKEVTVKDVQKIHAMTEQCLLHGLTKAETQAALAGFRVHPKITEIGTDAALAVGLGCSFLEGAQPPPTSPDSAPVPRLSMWHRLELENPEYFAAYYAALRAKVWWERGRERECGRRAAAILRMEAPHPLPLDYQHRMNSLPDHPPLCQLRSEARKDLTGPLPIVREPRHSQLPLCCTLFDMSSNFVPTRSWPLPPRNGGQISAHLVTRPPDSFHSNLNLTAHSTPHFSVSNLNGMHSALPLGIIVFLTVALPAVLSTLPAMDPNLKRESHPLCSVMQACAHRTALQIRQVXXXAALQRHASLCTPNRTADSPSVFLFSMRQGVDSFHQCPAPMRCPLRLTQWQAGAQDVRRISPMSEGWILSPKSQQELVLPRHLGADVGD

SEQ ID NO: 12845 - protein, 418 aa, Chlorella protothecoides
  MOD_RES (228)..(231): Any amino acid
MLYSSEIYADEVEKHRLKCPAHLQIQAQRAAPYYQLDINAGAALDVDPIPGACLPGHSVAERRAAYAATLGPDGLDDLIERVCQAAERVSHTRDVCWRGRGAWPLMAGLSGGQNPRRACCGNRRRPMMPAHAAAAAAPPAPAPGVTTPPYSAKHAAQQASIVGHLERHGLLRCVADDVIVELGAGRGYLGAAVAGHCASLTCLVLVDCRGFKLKADRRGQGADGGQEXXXXPASAEPWGALATIPVYPVAVAFRQRSLPPPSPPNCRALRHLDLHRLRCDLKDFSLAGCPGLDRPGPSGGAPPRSWVGVAKHLCGAASDFALRAAVEQAPRRCRGLGLATCCHHRCSWRAYVGKEWFAERGFAPAEFELVSWMSGGVMCCRMERAGEGLEDIRMGNVLAGPTTSPSREGSNVDEGCSA

SEQ ID NO: 12846 - protein, 1183 aa, Chlorella protothecoides
  MOD_RES (334)..(337): Any amino acid
  MOD_RES (666)..(669): Any amino acid
  MOD_RES (921)..(924): Any amino acid
  MOD_RES (966)..(969): Any amino acid
  MOD_RES (1099)..(1101): Any amino acid
  MOD_RES (1174)..(1177): Any amino acid
MAVAQHAQRVQEPRGRREEAALPQDGLDQDGRSVRRRGVHLQHPLQCLQRAAAAGAAGVVGADAGHVGGQAVAQAAGGGARLAVQAVGVGRGQHARRQRAKGLPVDRLGGGGGHGAVGPAVEGAVKGDDVLAARGRARDLDRVVHRLAPAADEEVLGQAGGHDVAEALHQVDHGAGGGEDVLLGHDHAPRLLLNGRHHAGVAVARGQHADAGGHVQVLAPVGAPDVGTLAVVGHQVLKGCPPTPPPRLLTPNLETAGDRFSSTESSVGPALGAVVVCRDRYRPRVALRPASAEGFMAASVPDSPPRQPKATHFELAMQSEQPRFSQQALQFDKXXXXGRCRGLPGSPGAWQATRAQPPLKPCSRQHLRAHLLDGLHRLVDVLVRHDERRHQAHDVSGARGDDEQAPLARCGHHGPRRLVQLDAHDEAHAAHLTDVGVPVQRGAQAGAQGLALARHLGQEARLADDVEGGDRRLADQRVPGKGGPVVARGHGVRHALTQQHRPDGQPARQRLGQGEQVGRDPGALVRPQRAGASQAHLHLVEDQQRAGLVAGAAQAAQEVGAGVVDAALALDGLHEHRGHAATGKRGAHRVQVAVGHQAAAGGERREGRAVLRLVGQAQRAQRAPVEAALEGQQVGGRGGRGLGIVWVHAGCGRCRWEGGEGRHDSXXXXIVWVHAGCGQCRWKGGEGRDDSIDFRHTMCYGQHDTGKVSGSLSVATCPTDSMHSWVSIHHYDGLVFIHYHDGLVGPLPQHHPSPFSPSSAVRPTSPPSTPTYTSPTPDLGIFARKLDGRLVGLGAGVGEEGAVREAVLHQGLGQGHLGHGVEKVAGVRQQRGLLAHAIHPGWVGVAKRVDGDARGEVQVLLALQVVQAGALPMRQHDIGPGVGLQDVPVGSCSEGAEETVQGKGIVTGHITLGLSHTLPHXXXXVMHLGGLVQGGGRCGPRGHRLQARGEMGGLAWRGVQYPTTPXXXXGPRGHRLQAQGDMGGLAWRGVQHPTTPPRPMQGIPMRRLHSPCDRDAPSCRSCHGVLEPPAWRSGRTQGLPSLQSSRTGPALQTPRAAVLVMGMRIAYRIGWASAANCPADDVLQHVCSTEGRGGTWHVXXXRIAYRIGWASSANCPADDALQHVCLTEGQGGHVARGVLTHTKDERWFPKGRWLGCRALQRQSVMRIEIEIVRXXXXAVVPKG

SEQ ID NO: 12847 - protein, 174 aa, Chlorella protothecoides
MTLPERAEDYVHRVGRVGRADALGLAVSLVSALPEKVWYASGKGQRPWLAPSRQNTATNDRPGGQTVWLDEPGLLRDVEERLGAAVPRLPADMALPADIVARLGRGPQAYGGGGADADLAAQEALGRRLAAVQPALAALAKLERDAQASFFDLKRKWAEVEAVRGRMQTVPLGE

SEQ ID NO: 12848 - protein, 195 aa, Chlorella protothecoides
MPIIGLDTWSWSPGMGHRGAAFIGGAPFPRPPLHDLSHHAHHSQSVLRPVYTALLVPLAARPLFPTPHRSWGRALTSGCCTGPIASVIAAMSPAGDAVALAGRDGRLAIHAYPTGACIGGFKGCACVINPRLSPLDPRQSYYGGLTCVAWSADGNLVAAGGEDDLITVYSLVSKAVAAVCQGHSSWITGVAFDPW

SEQ ID NO: 12849 - protein, 612 aa, Chlorella protothecoides
MNVVMVGAECAPWSKTGGLGDVMHALPKALAQRGHRVAVVAPRYAQYPDAWETGVRLRLRVFHAEQEVGFFHAFQDGVDFIFVDHPAFHAHAGDIYGGSRHDVLFRCALLSKAALEVPWHVPCGGVPYGEDNLLFLANDWHTALLPVYLQAHYRDHGQLTYARSVLVLHNVAHQGRGPLADLALLEVPGDYAESFRLDDPLGGEHANVMKAGVAAAHRLVAVSRGYAWECQTQDGGWGLDAVFREAAWKLAGVVNGIDPREWDPATDRHLQHDGYRNYSLQDMAGKAACKAALQKVCSRGGVPGPARSPRRASGRTECGLGRGPCATCRCTDGSCALGHEHAHTHPPPHQTQKELGLPVDVRRPLLGFIGRLDYQKGVDLIRDNYEWLMGEGVQLVMLGSGREDLEASLRWASEGAGLGDGRDVRRPAGRCVAGDLPPGFCAGMGPTCGLSGSLTTSPLLHLPKPHLPTHPSRDMESRNHDKCRGWVGFSAAMAHRITAGADILLMPSRFEPCGLNQLYAMAYGTVPVVHAVGGLRDTVQAYDPYANAGTGFVFEWSDAGAFRNALGDALYTLREYPDSFAGIQRRGMEQDLTWDHAAAQYEDVLLQAKYQW

SEQ ID NO: 12850 - protein, 300 aa, Chlorella protothecoides
MPSLTTFPSTTSTAGVDPYDAEASASAPSDLLAFEGSFHGRTLGALSLTYKSQYRTPFAPLTPGSSLVPYGDLDAVRAALSSGRVAAVFVEPIQGEGGIHDPGADFLRGLRSACDEAGALLVFDEVQVGLGRTGSLWAHERAGVTPDLLTLAKPLAGGLPIGAVLLSQRVADAMAPGDHGSTFAGNPLVCQAAVTTFDIIRQPRFLAEVARKGEALRAGLRAALDGNPHVREVRGVGLIVGIQLDQAAGAVVAAARERGLLIITAGAGDIVRLVPPLIVSDEDIDEAVQTIQKVCAEVLT

SEQ ID NO: 12851 - protein, 351 aa, Chlorella protothecoides
MAAAETGSGKTGAFALPVLQVVQEVRAGLMRAGAPTAGRGAATDPAPAAAVWNAADRDDALAIQPDGLVCQSRSEAAWSGVRASLGADPASGPRYFEVAVCDEGLCRVGWAAPASSLELGTEKGSWGYGGTGRRSHAGAFEPYGRPYGLGDVVGAALDWQARRLSFFLNGKDLGVAYDLPKPSITCVKSCAQQRLGSRRLHACVLTLSRRPSNSPTQPLQHLATPLFPAVTLKNAELAANFGAEAWKFPPPPGYQGFLPGGSIGEGLVSWEVASAPAQAGSNAARRPLALILEPTRELAEQTHDNLGLFSKFLPVPGVRTALCVGGTNPKAAERALAEGADIVTGTPGESC

SEQ ID NO: 12852 - protein, 176 aa, Chlorella protothecoides
MATLASCLSARPVARVHHGMTDRKGHRGRRAVAPRAAAAPSLHESTQTGADLTAEIIADEKKWDWGRTYSRPDIVLTHGEGSRLYDLEGKEYLDFTSGIAVNALGHAHPAWVDSVSEQAALLAHTSNLFHTVPQVALAKALVENSFADRAFFANSGTEANEAAIKFARKYAKIRGG

SEQ ID NO: 12853 - protein, 676 aa, Chlorella protothecoides
MQSACSTPSRPCMGQRRSVITCVATPSRPPTAHGPKRSKVEIIKEKSDFLRHPLMQELVTKETNISEEAVQLMKFHGSYQQDDREKRAFGSGKLYQFMMRTKQPSGLVSNKLYLVMDELADLHGMRHGPGHTCVHSSPFHMGTVTSHTHTPKHKILPQYGNGTLRLTTRQTFQLHGVLKGDLKTVFSSVIKAMGSTLGACGDVNRNVCSPPAPFTDRPDYAAVAKVSEDVAALLAPQSGAYYDVWLDGEKFFSLAREDPAVTAARLDTSHGASFPGSPEPIYGDLFLPRKFKVAVTVPGDNSVDVLTNDLVIVVLSDPATRATTGYHLMVGGGMGRSHGKASTFPHLAADLGTVAPADLLAAVKAVVAVQRDYGRRDDRKQARLKYLIVEWGMDKFRSVAEQYLGKRFGPPAALPPWEFRPYLGWMEQGDGRLAYGVYVRNGRVRGEAKKALRALVERHDLPLTITANQNLILRDVRPELRDEVEATLTAAGLPGHETLDPLDALSMACPAMPLCGLAIGEAERASPDIVRRLRGVLESLGFPAAERFVVRRFVVRVTGCPNGCARPYMAELGLVGDGATSYQVWLGGTHGATQLAQLYAERVKLDDFEKFFTPLFALFKEQRLGPEESFGEFASRVGFPALHARQLADGAVEEPKAKGPRGGRKPAGSARVAASN

SEQ ID NO: 12854 - protein, 155 aa, Chlorella protothecoides
MEPSSYGRVVRLEVQDFKSYRGITVIGPFHDFTTIIGPNGSGKSNVMDAISFVLGVRTAHLRGSLSELLYFNSDSQSPEDRPKTGRVTLVFQPGDPGAEEVHFTRAIVASGDGSTHTSQYRINGKQVTLEAYNPRLEGFGVLVKARTFLVFQVGS

SEQ ID NO: 12855 - protein, 106 aa, Chlorella protothecoides
MAEGVCPTSPCLTSPQPPKPCLVPDRLLDTGNQEAIRKLFRRFPKAGAGVARLQVLLFSATLHSEEVRALARELCQDPILVDLRGKNHLPDTGEAGGGSVPGWPWE

SEQ ID NO: 12856 - protein, 82 aa, Chlorella protothecoides
MEERRAALAAFKAGEVRFLVATDVAARGIDIQVEWVGRERGKGHPAHMVSPALDPATVRIAEPALFVQRDGSSMLHIRVAAP

SEQ ID NO: 12857 - protein, 343 aa, Chlorella protothecoides
MKARAKDIERLTASIHQITDRVFASFSRKVGVKSIREWEQDHLMRTERASRERLQLTTQAPSHACTSPSPQISKLTSQLEYDRRADISGTVAGLERDLAAEQAAQGELNEAEAKLVESSKGGQERLAAAQEESAGLRAAIDELDASVRELKGVALNQAAEGAAGAREGEVAVKMIGDQRDAHKGLTQAGTGQKNAWLIIVKIQEHPSRSSWRRNPKTILRPTALATVAAAERALKAASSNAAALAARQVEVAQEAEREQVPLPRTGRAATPLSALEEDGEEAADSPAAGGVGEAEREQVPLPRMGRAATPLSAMEEDGEEAADSPAAGDGGVVSWLVSPSRTG

SEQ ID NO: 12858 - protein, 330 aa, Chlorella protothecoides
MATREARTAQDVLAKVEALRKAAAGSKGPVRTLSDLGLPHACREVVDKAEVSVLSEIEQSILQIAVSILEGAGFQYAIPNRSKGNQLYEEPPLPEFPLCIHPSYPNIHASGVALTRRPPHPLAELDRIVLKSSTSQRAFASTATCRKAAITTRILQLVHELCTKRIHVTKRDLFYTDVKLFEVGLGCPLMRRDWIWGLTSGRAAGLGGASPGVGMSHGVTCMHTRWFGERRSWTVCSPHPLPSRAPPKPTDPTQDQGHSDAVLDDVACLLGCTRSSLNGEGLSRIESTGFPVPVGNPWSRVGVDQHGNRSLPPRQPLQSSRRRREWWLGD

SEQ ID NO: 12859 - protein, 441 aa, Chlorella protothecoides
  MOD_RES (113)..(116): Any amino acid
  MOD_RES (148)..(151): Any amino acid
PGGRAPTLLEALAGRHGLPAALQAARSAGRLTLDDAQADYVAALLPRAWVVESKAPGDGGGASESTAAPPDLSAALTAAVCSVFEMLPEYGPGYLAACIERAGGSAEAAVAAXXXXWAGLPGRLHQAGGGQRRGRPVAAAVGRGGAAXXXXLLDGSEGVAGLDRGADWAAYAAWKARSQPARPEAVAATVERGGAATPAPASTSSSSGAAKGRPPQAVVARYLNVREERYHKQLQTAAMESQWEYEDEYDDSLDELAPGAGDGGSEADAGRARNDAGPERGGPAPRFADGAGARGGRGNAPPPRRWVLDGRVYNYRKEGATPVASEEHLRQVLAQAAAGRREIHGLGPGGNKPLAAPRPDLAPRMAAAAASGGQAAGQEQGRQGPDGAQGGRGGPGPRRGGGGDPASDRDRKKKDQHKAAVGNHHRKDRAAQKQNRGMAAP

SEQ ID NO: 12860 - protein, 187 aa, Chlorella protothecoides
MGDTTPKGTPPTPPRSIPLSPLGEAARQLHGGNELWLALALTHAALQDLAPEHLAGALAALAAGDALSRPGLRVAYPAAPAAAAALEALEGARLELERAQAGAGVEVPVTLDARVAGLAQAWAAGASWAQLAADSSLDDGDVARLLMRTVDLARQAAHCEQLLPELRAAARKVVRAMDRSPISDLVH

SEQ ID NO: 12861 - protein, 73 aa, Chlorella protothecoides
MSQAVFSSRTPSVRRLNSKDVTLRWSHRQGDFIVEPSFNLGTESAAITARYNLDLNNRVTAHLDLVRRGVGAR

SEQ ID NO: 12862 - protein, 244 aa, Chlorella protothecoides
MPRLPPCQNPSFKCSATHLSARVRLPTPQPPLTPSQRNRGHVINMSSIAGHEAYVGGSGYCATKHAVDAMTKAARHDLNGTDIRVTSISPGMLLAGLVCGSHCWHREPHVQKSATSNLTAGMGPPLGSHLGPAPVQFAPQRAGCAMPSPVYRRHPLPSSSSHHSTPALGHPAPLPSRRGANGVQRGADQGRPGRRGRRLRRHRPPARRRHRRQRALRGDAPAPRPGGRHRGAGQLPELGTQPGT

SEQ ID NO: 12863 - protein, 961 aa, Chlorella protothecoides
  MOD_RES (512)..(515): Any amino acid
MPTPPHAPPHLHHARDEGSTESKNGENVGVDHRGDVLQQVFVDGVGAQSQAGIVDQNIHCLEVLRQPIWQGGDGIDALYIQGLNVDGHLGCEGATYKSSPPTHANLAFLSQLVFQGLKALQAACDQDEAAPCLSKAPSTGLPNARACPCTPYARVEAYEIPRSKDLYSADAMSSPRTKNGEGLSEDLYSADAISTPRTKNGEGSSEVWITSGDGDGWQELASRAGTCSWVYCRSCPPTRPPLDLAGTTTGQRGGCLAAMTVSTSCTALGRSITSLARFQLDSAACWSLQQVAHYAKASGGSGGGGHAQRTNRLLKVLEPQQTTAVARSLEELEDARQRCEGFGLRLCVSLAPRLGEGQGHCCGPCQSSDARPFSLPQVTGVQPSQDAAALRLAGRPVRQAEAEAGRAGGPARPPAGGGRGPRPLPLPPQPQRVEGDPPRRGQGGQGRGAHLADAQHRHQAPGLGGVESVEQGLGRTDGVLLEVTLLACTCGVRPSRQEGPHIAAARTACTQXXXXDVLLEVTLWACTCGVRPARQEGPVTSQQRGLPAPKGSPWRPELAPSPPPLETNKSTTHSGDDGGLVAPRQRGQVRQLQRGGDDARQHVLRVAVEVGGIVAVGLHVHANGGPSAASARQPEDDARAVPEDDADALALCHRAVDGVGVGKVVGRLQHAAAQLRAGLHVVDHALGQVRHDLLCTLALHALVVVAGVEVAAVGAPVLGDHVADGDQRRALPPPLVLGRQDAEPGQHRPEPVLLAHVVGPRAEALLATDGALPRVHQVAEELPARGRLVEGQVQALGHPVQGAGGGHGACHALQARREVGDGGLGVGRDHRHRVRGGDEEGAAQDHVAVAVAVGGGAKVGGVGAEQPLHQLVGVGQVGVGVPAAEILLGHAVEQGVGGGAQLVDKQPAGVGASDGMQRVIHKAEAGVGEEAAQLGKVKHLLRKWGGMVSWGREDGWGMCGC

SEQ ID NO: 12864 - protein, 287 aa, Chlorella protothecoides
MVVLSHSTGLSDQPFTLEHCTKGDEEGRRHRAGKSSASWGPRTACSGTPAGQGGLGTGDAGRHTKRLPMGTGPGKIRPGASKVGIGSGTGPPLATRHKTRPPLHLALAHRHTRTVPEALRHLGGLVIVVPAGAQGGAVVGLVLRQPLDDHSGHRLVRTEVGAGAVRAKGGNVPAARGWASHAGGRTSASPPGSSPAWHRSPLWWSTVRREWDTVRRATDHAGLGMSLHEAQGCSPGSDWAAAALMPWVRGALRCERKACPTFTGQGFSEQGLFVPKLATFMMQKFSL

SEQ ID NO: 12865 - protein, 169 aa, Chlorella protothecoides
MHGPRHTPSAGSQPVDIRFAIPFKCHFGQHLAVIGGPRQLGQWEAAAALPMTWQQGDVWAASLAWCAGCMGQTARQGFDEANSFSLGSAMLVANPMREVVADDGGTLEYKYVVRNDDLTVAGWKPGPNCELQLPTGSPLRAVRVWDTWDGGCQTVEVCCVRVWVVVVVG

SEQ ID NO: 12866 - protein, 131 aa, Chlorella protothecoides
MNPRRWCVPLRRRLIPKYLGSSRKLTLGLLTPLASQVPIYVESLDVQSINAITSLPDRLPEDFKAVDILVNNAGLALGSNAIHENLLEDVATMVNTNILSVLAFCRTFIPGMVKVRRCMWGCRHAIERTEA

SEQ ID NO: 12867 - protein, 68 aa, Chlorella protothecoides
MASALYKSYSVRDQTVLISGASSGIGEACAWRFAEAGCRLILVARRLERLQALKDKLTQECKVCVCWR

SEQ ID NO: 12868 - protein, 109 aa, Chlorella protothecoides
MLEGFNCTIFAYGQTGTGKTYTMTGGDLAQGSAEMTDSAGVIPRAIHQVFSYLESLGAQEFTVKASYLELYNEEVTDLLALGSEPPKVEKKGGGGGTGVMAHIGLLYGV

SEQ ID NO: 12869 - protein, 209 aa, Chlorella protothecoides
MLRLSSLVPRATRCAAHPLTLQESILAPSQVGLVPEMRAFAARSRAALAVSLHATTDEVRNWLVPINRRHPLRELVAALEELFPAEAQRAGRHVLVQYVLLRGVNDGEADAHRLADLLARVRCKVNLIGFNPHPGTRFAPSGERATQAFLAVLRQRGCVVMLRASRGGEEMAACGQLGGLAGGRGAGDGALPRILPPPRRFEEVLAARS

SEQ ID NO: 12870 - protein, 148 aa, Chlorella protothecoides
MPSSESDSQPSGSAAQGKKESKWHKRFVQQRLRGWSPILHARNAELYFLAVGVFCLALGIPILVASLNVVEYKARYDLAGVFADLDSNNQQELLWGAGDEGVLVMVEIEVTKRMTAPVRGRAGIAWSGEGGTLKMQREAIPAAMAQSH

SEQ ID NO: 12871 - protein, 85 aa, Chlorella protothecoides
MASRKATPRAGPGAGGPAGSEDGVNIQVILRCRPPTKEEVAGRAPQVVKCNEALREITLNQTLGGKQLGRTYHFDRVSLLEDGNG

SEQ ID NO: 12872 - protein, 139 aa, Chlorella protothecoides
MIVTVLVYNRYNTYGFQGAKSLILTTNSWVGGKNVFLGSVYIVIGGLAWLAAASLFITYNLGVFGLERRREGGPRLRHGTCARIPFPQPNPIRPVLEEGVRRSVPPVLGGEWEGGEADGADRLSSPRYTLSGGIPWRGA

SEQ ID NO: 12873 - protein, 337 aa, Chlorella protothecoides
  MOD_RES (246)..(249): Any amino acid
MRGLRAATLALPPYMGMNPTVNVSYLKPYHGDSDHRPPPVFINDSGAPAYLVEAILRHKRVGRGYQYLVKWQGYPDDEATWEPRANLAHLDAYKAYRAAQAEGVPANRAGEDVGLTRPHNRVCCGGWLDSTTRRRGHGTGHKRRWKGWKAPVRVPPQTLTSLYCRPTKGLRCPVGFVGVEVRQVGAGLPGGLVVRVALPLHQVLVAAADALVPEDGLDEVGRHAAVVVENRGWAMVIVAVVGLEVXXXXTVGFIPMEGARASVAAPVLRMAVMVKGPTKGAASLRPLSATSLTCALLSKTGSPALKVWAWLVRLACEAMRALLLWGRAGPHNVDCCI

SEQ ID NO: 12874 - protein, 712 aa, Chlorella protothecoides
  MOD_RES (387)..(389): Any amino acid
  MOD_RES (575)..(577): Any amino acid
MVCASVRKSLCIEHRKPPAWNVNPAQRCRPASPSTDPHTHAGRRVLRATLQWCTTRATWQGQGWPRRSVPSTTGACSKVPPSLCLVEALDRQCPMAVLRLHNDAVPASSPFGCISEHLRRHLRRVSASMLNTPSAGLHEPIHPTVPENIREEVYGVQHLTALGNHTKEWKHQPCSCPHKSLSCCANQSSAHHHWSQDPVRGWVRQERQPHLRQGVGSDVPPVPPEDPGAANPLLRVPVPPREQAGCVGCHLVLPRHHNVCSDSHAAPHHSPVLHMHGALTTPFCPLSTMQGVFCGDCLFMRYGENVEEALQDSEWKCPGCRDLCNCSFHRSRRGWAPTGTLYRRAVAEGGAAEVFYAACAGRGDLLWSSGMWLAHCACTTSPPSHLXXXGRQRCSMRPVMAGWISSGRAACGSRTTRAQPPPLPPAGFVSVAHYLVLNNLAPEARSAALPLMPKELADATRAELEREAAGCDRRSASPAGPATPCASGEAAQDRAAQRPQAPGEEEASASPSPARPSGEEAGEAPTGRRRGARRQSTLRSDVLGAVVKTGGMIAAGKPGAGKRAGATGKAAPAAXXXHDCGGQARRGEESGGHREGRAGRRARRPRSAHQLQARRGPSLSLGAESGRAAQCVLRLAIAMGGRTLCQSLVHPGIRPRRQSGMCFGGPSSQRAPPPTKASTRQPAPRPEPQHRPAPHPENTTRPPPLSAPPLTD

SEQ ID NO: 12875 - protein, 256 aa, Chlorella protothecoides
MHVRWPPAESAPVIERPALGTGGARFCKAKPSNASCVQKYPRTFPPQARVNIPDERFTWLVDLYKPKATFPAFLEIVDIAGLVKGAAQGEGLGNAFLSHIMVREDVGFLRFSDGDGGWGESRAGPGGYAVACVPTSALPSQRVVGSACPLGSGPKIPPRHPPRPSTASSMCAAPLMTRTLCMWKTAWTPWRVSGHGNWCGIPSMHACQVMQQQPAPWTPPGADGYRDAVATFLPLPQTLRSCTASCVPRTLSVSRA

SEQ ID NO: 12876 - protein, 443 aa, Chlorella protothecoides
  MOD_RES (219)..(222): Any amino acid
  MOD_RES (268)..(271): Any amino acid
  MOD_RES (410)..(413): Any amino acid
MYEGCLFGEEIRGPFAKAGCLLQEPELAREDALPMLRRTARLLAGDQDCSTALSHHTPYQFHPLSRGLTKEQKEEMAAAEKVLAWVQEGKDIRSGDWTAIEVEFLNNHQFISAKPVIYLVNLSEKDYIRKKNKWLPKLFEWIQAHGGAQLIPFSGALEAKLFDMPDDEKEAYCKEVRRLGRGGEIAREGDSPCIGDTFGFVQRRPLCGAPAARPSAAPXXXXGFVQRGPIRGAPAARPSAAPPPDATPAPAFLPSLASSPPPPPPPPXXXXHSMGAPRPCPRSSSLASRRFTSSTSSRVAPARCDAGKSGRTPRRRRLETHKLDDGCAARAALRGVWSTARGPAAGRRHTGTLQTHKLDDGCDACAALRGDWSVARGPPSGRRHTGAGGKVGSPEHDLLQSLNPAYPRPXXXXTLKQSPTCQTPHTHKHLPDTTGGGSNPQRL

SEQ ID NO: 12877 - protein, 166 aa, Chlorella protothecoides
MNMSAWRTRPARMHVPRPTHFLALPLNHVPGLQAAVRAIQTDLVGCVPSLAPTLVDPASLHITLGVLSLQGEEACREVADVAHAVLHAATPPAPSITLTGLSDFNHRVRSWGAHFGRQAEPGQAGRLAGARACAAGPDAAISAALHSSSHPGQGATSIAPIEAGTG

SEQ ID NO: 12878 - protein, 238 aa, Chlorella protothecoides
  MOD_RES (35)..(38): Any amino acid
MSARRYRGVANDPKNVGRNTSAPKVDFNPRPPPWXXXXTGVVASKSITSAICTLRPCIVHVGIYRPKSGIDFLQGQKHKCPKSGLQSTPSAMADSDVDEYQKRWEASWNAGLKPGEVSVCDSCLHHPLCSLCCGLDLMRCCTVRPPPSFDQYFAPQRFDACQSSPALLDLLKRGTVAVEGKRVFVPGCGRGYDPVTFIKAGAKEAIGLELAPSAVSDSRVQCEPCAVLAECAVDAETH

SEQ ID NO: 12879 - protein, 244 aa, Chlorella protothecoides
MWQHHRQLLEAGPAGAEALAARLMAGRPGPGGLLPRQGRRRGAGTCTDQHHPLPAGLGPGAPAAGSSRRPVVVPGTNLFLALDADQDRLALLVDLVLDLRTATGEDCGAAPGATAARLGMLALPVPPCKRDKAGLLRRLPAVLDAVCPALRGGRRVGMLGDAGGDALAGAAVAVLAALYSIDAAGGLRPREGGPGTGTPAVSKTDVQRYLGVVAAASPAARPTRGMLKQVFAYFHAEQARAAAG

SEQ ID NO: 12880 - protein, 90 aa, Chlorella protothecoides
MLAISKAFSRALGGRGIETLGVRAYAKALGDQSTLPLSTGRPRLVILGTGWGGARLARDIDPKKFDITVIDVETGDLGDPGAPCAEGMWA

SEQ ID NO: 12881 - protein, 200 aa, Chlorella protothecoides
MIQEERAAAGQPTGRPIPCIFGLGDVAATQETPLPALAQVAEQQGRYLARALNEAAGQPGGLAGGLEGAPPFQYHHLGSMASVGGTSAVIELGGSGQQHVRWSGFTSWIAWRSAYLTRLGTMKHRLYVMSDWTMSLIFGRAGSRASMVGGWISVAGTQSTVRDGRRQGAAPALLEPGYLACNPNLAGPRSLQGCVQVVSV

SEQ ID NO: 12882 - protein, 99 aa, Chlorella protothecoides
MQSTGSGLTGYLALTGALSGAVEALTAAPLLLYPAKALIAWPLLYHYGGGVRHLYWDEYKYGIQVDKTSPLEVPAVTASSRGLLYGSIAASVLLAAVSL

SEQ ID NO: 12883 - protein, 366 aa, Chlorella protothecoides
  MOD_RES (161)..(163): Any amino acid
  MOD_RES (228)..(231): Any amino acid
MVGRGLRARSSVNYSDKAPDVGNTPAWLRTTKSFTSPESAGSDKENAKDLNSAAPAVVAKTKAARGRPSGLSKKALAATSPKDGPPSDAAARVDLVTQDVDGPDAKQDVKRSRPKSAGAPLAPVEATKAGQDTTVSPTDLTADVPEDPPRASQEPARTKAXXXKAGQDTTVSPADLTVDVPEDPPRSIQEPARTKVIAISEPPTQPDPAPRSSAPAPPPPGPSGDSDXXXXPDPAPRSSARAPPPPSPGGDSDLLQDLRRGVTLQAEYDALQRQYEELKEAKINEEVQALLERHNQHVSEVERAAEGLVARWQDRAEAMRALADEALAADAVGALQAELAEAQDQLAEARLALLEREKELVALRAR

SEQ ID NO: 12884 - protein, 666 aa, Chlorella protothecoides
  MOD_RES (142)..(145): Any amino acid
  MOD_RES (243)..(246): Any amino acid
MGGGAGGVHDDQGQALIPRRGEARVDGKAEDVRQAKLLHNLLPCDLGVEGGSVEESTESVAPLCGSSKCEPEAAAPGLQALRSCSPTCALAKGTVPDAVHLEVGHVFHHSHAGHLSSCITSTQPHAHTAGIDASLTASRANXXXXATRTHSCHPRFTHREPRKHAYALGDIDEGQALGCGNDDSGRQRTGLTQGELNVARPGREVDDEVIQVAPLCGRQQLLDETWKGCHGVRGKGDLPWPCXXXXPWKGWRGVQGKGDLPWPCQDSPKQSERGRAPRIAAPIVPQRDEPNNKKCNLPTPATSVFAAGKGQELLQDGQGIGGRTENLMLGDGLAASAALSAPLQHWSVFAAGKGQDQLQDGQGSGGRTENLMLGDRLTASAALSALSSTSAMAALYSPLSPGPWQAPWTLGRSWWAGLGRRPRTGQSSEAAAAASKGPMGSRGHTAPCPGHRRPLHPPPLQDDTAMMWRTPRRPPGFPAASAPWPGTCAGGEAVMATSAVLTQSSARTASSACRLNSSFTGQAGVVRFRRRLTAPLARSMARSWTKPQSTMFLPRSGSMMTDRACSTPSSAEPWVSGGLEGRSTWEWGAGRGAQGKGEAWGGSGPEPGHAGSLVPACSRSCKPRHGPGSDTCETSSDAIDMRATPGLPSCLRDENVGAGAALRGAG

SEQ ID NO: 12885 - protein, 167 aa, Chlorella protothecoides
  MOD_RES (114)..(116): Any amino acid
MGTRWFSLGDQTCWGPSFQAVLQLGFKVGVEGGWNPQFFPRLEGIMAIFSRPDTALSVWLHVLATSLFSAQNLCRQGENGAHGFLQGYDQGILCGTMRSCAEYCAAGTQENSSXXXVLQGYDQGILCGTMHSCAECCAAGTQENSSPCSLHAAVLVQPPAPGVNPPS

SEQ ID NO: 12886 - protein, 344 aa, Chlorella protothecoides
  MOD_RES (209)..(212): Any amino acid
MSSPDCAHSASITTMPLPFPLHLARYGTGLSLGSGVTLGHLRESRPGKFGTWFRAQANSADPDVDAAAAGKGAEVFFALNASAVELPDIERYATDSLDASKPLITWNLALDTLRADLGRLAAGDAQCSAFNDMPPSLNVMHTDTRSLPTPAGLLGFPSKALHDRFLSFFKPVLYVRPRDYSKHCGDALMNAAMRLQLTTLFHFPLAPSXXXXPEITPSDASSTDDTLPLSSRPLPTEHCLASIHLQLQRNPVPGVPGGVEGHAAATKWLLHCRGRCVSSCWVQWSCTLSTYVSRPTRYTLGEFKDVLMRAAGLDTDAQGSLLSFLRKGYKVGSGHDGKGSYVLD

SEQ ID NO: 12887 - protein, 411 aa, Chlorella protothecoides
  MOD_RES (144)..(147): Any amino acid
MRVALRPAVGMLHRAPGTKGMCGGICNLGASRLCIFPDQPTQEHGVDYVVLAGYLKLIPPQLVRAFPRAMLNIHPGLLPAFGGSGLYGLRVHSAVIASGARLSGPTVHFVDEGYDTGACFLSLPVGKVGLLNAWVGFTRPGSPXXXXGRGLRHWCVLSFSSCWEGGATERRGWFYEAPVPQWCCGTREEGRGTACLELAARLPPPLLIPLIPFPRSHPCASQRCRIPPGQPPAAGGTSAGRGMYLAAGVESVPGSHGYEKEPVNRHACTPAQPNTHLLDPTGAQAVPSLRSSPLRGQDLLEGGWHPHHVDRCLRGGLNCRTQLLNQIPALPHVGSKLDADRRDVNPGAQIGSCGRKGNPLHRARQGTLSLSPGGRELLVLPLLPPSLGLRNEHAARVRVHACTSCNSIQHI

SEQ ID NO: 12888 - protein, 277 aa, Chlorella protothecoides
  MOD_RES (200)..(202): Any amino acid
  MOD_RES (243)..(246): Any amino acid
MITPTGHHPERPGISMSCRIGKTYCCLQLPSGPCKRCSAIPMALGRRPGASCLRRRDPTGRPSFPPFRASSAERENSRPVAPKYVAGEGEFPSSSNEQHGDEEAPEIQLLLAACGVGLAAGASIVGFNLCIHAVQSLISHEFLGNAEPWILLVLPPALGGVAVGLLGVAVGGYDDPPTPGSKEALPGPQGEPEEQAASVXXXLAPRYVAGEGEFPSSSNEQHGDEEAPEIQLLLAACGVGLAXXXXSSLPWHHAACQHVVWCRHQPGVQPAGWNHSL

SEQ ID NO: 12889 - protein, 517 aa, Chlorella protothecoides
  MOD_RES (7)..(9): Any amino acid
  MOD_RES (458)..(461): Any amino acid
MGRTLAXXXPGWRLPGLGQGRASARPRRRGGGPARAAGRGGGGGRGRGLQRPPLRRALRAGERAAARPGRAESAPGAQPDPGHGAAGSRAGGSRVPGGAGLLPGLPSAGLPVSGWGVWKAVVVMPRARLSSCLCAARCTAPPCSQANAVQSLTQRSTPIPSVLPPPQTGVVRRAAPLPRAGHAVRPGGHLLHVLRRRGRGRFQGPDAGGAGGGRPQRRRRRRPPIHRGLRLACPHAGGRRPHDGGAELGPPRDPVPRLRQRERHPLRLQPPVGLGPVGAGGAQDHRHLHEPRQRSAGTAGVWVGRGLGHAVFGRAELRRLNRKCLTAVLWHMGWCPGGGSQHICGLKGKGPPGTRPSASPELDHSASSRHPSKCLLHSLKGGLYAPSIFIGAALGSAYGLALQGTLGTLGVPLSAPEAYALVGVAAVLASACGVPLTAALLVFELTRDYLILLPTLGXXXXRPTHRSAAGVRADARLPHPAAHAGRGGAQLLGGRAHGAGRAARGPRADGAAAARAR

SEQ ID NO: 12890 - protein, 63 aa, Chlorella protothecoides
MSTLDRCPEYIYMLAGFKDSADQFLDANIQLAIAAGRVIHKETGKKVHLLLPDGTEYRRAMGL

SEQ ID NO: 12891 - protein, 196 aa, Chlorella protothecoides
MTGSTPGPATQHGLAQAPIRPMLPPCPELPAPHPTPSPPLTHGSAEEGVLQALSVIMDPDLGKNIVDCGFVHDLAIDLASGAVSLRLNLTTPACPVKDEFKRQAEEAVRALDWVRTAEVAITASPPAQVPGQGAEAAGKPGGLRGVRHIIAVSSCKGGGCRGRRCPGHGAVWPLLPMGPLLAAAAASLLCPVRGRP

SEQ ID NO: 12892 - protein, 105 aa, Chlorella protothecoides
MASFPGLIQQLLTTTEWGDLDYLVIDFPPGTGDIQLTLCQTCALSAAVIVTTPQRLAFIDVAKGIRMFARLAVPCVAVVENMSYFEVDGVRHRPFGQGAGGRAGA

SEQ ID NO: 12893 - protein, 220 aa, Chlorella protothecoides
MPLREYTKEPHKTNKDADSLPGSAQVRTLIHCIGATECSSMLCMAGPAERSHAKEPAQSPSDACTGMSRCAAAWAGCVAHRPGVCASTASAHAGVRIAASRRIRLHCAKQPPYSRRPRHLHSLTASVVGAQQVRGAPAVAPANLAVFVSGGGSNFRAIQEACAAGAIKGRVAVVVTNAPQCGGAQYAERLGIPVLVYPSSKSAKGCTPDELVAALREVGA

SEQ ID NO: 12894 - protein, 261 aa, Chlorella protothecoides
MVGRAGGRPASELDPASPGAGPEGGDPASSGPAASGPGSEPPPASPPGFRPGRPFLGRASAAECRSVDLYEKLNHISEGTYGVVYRARNSETGEICALKRVKLDKERDGFPLTALREINILLSLRHPNIVNVSEVVVGSSLDSVFMVMEYGDHDLAGVMRRRLRQPFSPAEAKTLMTALLAGVAYLHDNWVLHRDLKTSNILYTNQGVLKVCDFGLARQYGSPLKPYTHMVVTLWYRAPELLLGVCRGGLFVCVCQGGWGS

SEQ ID NO: 12895 - protein, 457 aa, Chlorella protothecoides
  MOD_RES (400)..(403): Any amino acid
MSAAALRCILSVPWIRTGQHRSIVRSSSRISEASPGGPHRQLQQQAIGAALSGTGTGSRNATLSSIVHAREGRCASSSPGLHNDTFTSQVPAPRPLVLVVSGPSGVGKDAVLNTFQKANPDLHFIVTATTRSDALARGCAEGRMAQFETWIKEGQLLEHALVYGDYKGIPRPQARPSGRLFSRCPGADLRMKFTYNARIALQCQVEAAIAAGKDVILRIDVQGAATVRSMLPGVGIACFVARWSCNLWAHFDYLTSTPLSHVLTTQLQVAETEKSLVQRLIARKTDKLRPGPSFQLPFLPTHPTNPTSLQESLVKRVQTAKAELERAQEFDYVVVNADGAMERTVAHIQAILEAEKAKLQAHSCHLRLPWGLMVDHSVAQRCRPLQPVPEAADVARQSCXXXXVAQRCRPLQPLPEAANVARQSCAWQAMFASSPLTATPSGDAFSRCNRVDQANTI

SEQ ID NO: 12896 - protein, 136 aa, Chlorella protothecoides
MQRSTCLRVVAVLAEPSKAEVYQPAKPHAPAPYHRKVRGARGRPPELWVSGAKLGHAPHRMNNKGERRPTDLELYNGLWLGQTVLGRVVVSTRKGARVEILEAHNTPTDNLRHRHGCAERLGVLGWGDEVDAGGLG

SEQ ID NO: 12897 - protein, 97 aa, Chlorella protothecoides
MVRRIDRNGVFIGIKDTMETGLLHISNVSRKHVPDVSEVFSVGEMVWVMVMGFEPGFGKVSFSTAELEVEDGDIMTNKELCWENRGEWLGWEMMSME

SEQ ID NO: 12898 - protein, 159 aa, Chlorella protothecoides
MPITDGPLAVRDTAEVRECQGLSRPLVPVGLIRPFQVKALPTPEAVTGNPNNTAGPLLSAFLHDRRTMWHRGWQLQSCNREDRENVMMRVEGVNGGGLVSRVCGLPIFVPYSQLHKDRDLRYSEEVWTSAEGRREQVSESNRMEEPAASKALAAASRGV

SEQ ID NO: 12899 - protein, 192 aa, Chlorella protothecoides
MAELLTREPLFPGKGEIDQLGKIFGLLGTPTEETWPGLDRLPNFRKFNFRQERKNTLRAAFPPPGPVFDGRPTLSEAGFDLLSSLLSLCPICMRHGPVSASMAESGGFPLPLHRALSPSIPTTTTTPAGEADICRRGAAASLVQGASPAQGHGAHAHLPIHRGRPQQPALTLTALPCLTLECSAPSPQPSLK

SEQ ID NO: 12900 - protein, 774 aa, Chlorella protothecoides
MSHRCVPCVAWDTTSWWCRGAQRAGNLSLGGALLYGVEQCALGKYHGRTLKLNDSQRVRGVPEWSSDNPYPNSFSNQIPLPSWGTLDSSCSHREFAAGVAASAILSAILSFCPDAVLGVDWHALRPYQAMKAAWEATHAAALRDAPGCRAPPLVYMNYRLHGRTDPACQALEVEALGASALSLLLCRADRRAALDMLGTSDGLRPGPDLRVLLPPLRSDLAGIGAPAAAALAPCRTFLTCAVRVAPEKAPDRFVELVEELAHRGALGNLTPLICGSGWGGAWGTSLAARLLAAAPQAVVHTRFLGPAGLAEIFAATLLNVHPCEHDAYGMTIVEAASQGGGREEGLSGVWKCWRCGCHGARGAAAAQVPLDITPPLGHRTSSRSVGNKNNGAIACERSFDVEPTTASLSFPAGRGPQPGHPGTGGRGGAAGGRPPSPAASRGKGSGEGAVLGGGGQCPPARYLGRSGGASARSSTGTRIIVVTPEVEGPCARALGRLTGNYVAVPMHIKLTEISSAPLSLDRPFVTGTSQRGHPPQYYSRPIQLNYRGLMGSDAFWMARPSRIDMHVPLWAREPGFNGLRPPLHPRPGVGSNSLMPLRGPASTAQHLTDPRPAQAQVGFHVPRHQALELPRRAQPTAVLDEGLCRRGLLRQQAPEVGHSVLVDPVVVDAERRRGIEHFMVPAAGHEDRVPGLLDDFSRRLPGLSQPRPPLAGRSMQRAGQLLCPRAVHVLGVGGGDQGPVLDPSDVHRPAVTHQHVVVQGGGGPLASFWGRGVQ

SEQ ID NO: 12901 - protein, 175 aa, Chlorella protothecoides
  MOD_RES (93)..(96): Any amino acid
MMSTSHPEPAAPVATPVVDARELTYEGFVNDYMAVGEPVIVRGLTDDWAAVREWVTPEGLPDLDFLVRKFGHSRICVSDCSQASEYGAQPAEXXXXDAGRPPRSGLSGPQIWAQPNLRVRLLPGIRVRRAARRDHVPGGVRVLVEASRPGGSSIPQGLALCRRASRVPGGKGLHP

SEQ ID NO: 12902 - protein, 485 aa, Chlorella protothecoides
RRVAAAGGDAAAALFPALLAAGGGGVLLESAQRVASREDDEGEEEEEEEEEDAAEAAAGASSEAGSDSRRPALLDNDEDAEDGDAPPLTADQDANDEEEGAATPAAALRGDPCACIETMRAVLASVSSKRLLTAAQECDLGEMVQARLGLLEVRAQLRAARGEGGGGLDPQATSSGPAAGDDGHATHGAAPARSCPAASASHGDPAASITTARAPPAVSPREWAAAAGLTPAELQMRLHLGLQAREMMVACNARLVAAAAHRYTGRGLSHSDLVSEGMQGLRTGVERFDPRRGFRLSTYVTWWIRQALGRATQAQGRLVSLPVSVVDRFRRLVRAEVVLCDQLGRPPTQDELAAAAGMSAKRLVQVQAAIRKPAVLNEAEGDRDEEGGLQPSAAFVIDSTEDPMLRAMQALKRVELDDVLRGLPRREVSVIKNRFGLEDGRERTLGQCGTSHEVHVRRGQGGKGAGGGRKGRAGAWHRGAHQQTQ

SEQ ID NO: 12903 - protein, 92 aa, Chlorella protothecoides
MVELDAFEAPDFDPVTYVNDYCQKKSQDAPMDRYLTELELRLQLASEDIVGKLADASSRASLRVPSALKELLNIQARRQSSRVKHAEGIRVS

SEQ ID NO: 12904 - protein, 443 aa, Chlorella protothecoides
MSRGSWTCSTAPSDHLCGSSGRRRQPGGRPHPPLRSQTPDPRLLPHSLPSATHYIRVPGRSKHSTMPSATSTKVTTGGSNQSPGPKSRPLKDTGDEGGAAWATGDFGNSLATPQKSEAKESKRSAPDSTSKEPVEENEDMPKAQEAGEAKAPRIKGLETFDGKLVPFAAGGARGTMEGGGARVRARSLPSMGPGCVTGPSHARVWASTSRTSTILRPPHAIAGFENMVRTAPVYRSHRLHAINPTAAVSDDVSYLYTLVGWGASFRGSLDGSHKSDCSSVSACIVQKFSTTSKSAAFPQKCLIASCPMLPCRILGASPPPLPLPTPTTMPSSSATPPRPARAVFSRACCSPSSRCRQPEYDPPTPEHTASMIRMKRTGLAVWVGLGPHPTLRAALDIDPSPLKMYGPCAFACSLTMLSSGFRMKTGCAGGPRSMIVAALAAGR

SEQ ID NO: 12905 - protein, 414 aa, Chlorella protothecoides
  MOD_RES (29)..(31): Any amino acid
MEHLTIILPCPIQCLPSDSPAAAFPFTSXXXRRLELRARVSSHCVNGIPYHHPALRGRQREGEEGAGEGDPRGVRLASVSYRDSHGPGLPARHTPSRTTLRLLGTGGHHLAEHDGGVSIQERNAGQALAVLEGVHHQGLAGLEHDLGHLVGLQGVGLLQLLATGLLAHLPVDLGDAAGGAATPHEADGGVPRLDLAGDVQGLDLGGEVLHGLHGGVRLQHHHVAGAGQVVLVQALDVHAHVVAGARLVHALVVHLHGEHLAGAGVGGGVGGHEHHLVTGLHDALLHTARQHIAHALDLVGAGDGQAQGRVGLALGDVHHVVQGVQQRVHMHLALDDVHVHASPPGHVGGLGDQVVAHPPGDGDDGDGLLDEVGLPAHADEHVAHLVGNLLVAVLLWQGRVLGRGGEPGLTEMCD

SEQ ID NO: 12906 - protein, 521 aa, Chlorella protothecoides
  MOD_RES (260)..(263): Any amino acid
  MOD_RES (304)..(307): Any amino acid
MLPSMLDPRQCTTTSIEVALSTDYLASRSPCHTKVRGESHEYEQTLVGDSPRSGSEPPGKILKNSTQSLHLLTSTSQRVEGDWSPAGPGPGTMKRIFGRKEKVPPPSLDQATDKLNTRGDTIDEKIRKLDAELVKHRENIKRTRPGPAQEAAKRRALTVLKQKKLYESQRDQLYNQQYNIEQTSFAIQSMQDSVHTVQAMAVRRVVARGVMTWRGAASGVGQKLGTPSFYLWPQGHTSRIQLPWRVVQPPHKPLHGQAAXXXXIACSLAGRLRGTMHLRNATSKSRRRMLCRGNPSSCVCSGPXXXXASGVGQKLGTSSFYLWPQGHTSRIHLPWRGVQPPHKPLHGQAAGKELKQTMKHKDLRIENIESMQDSMQDLLDMQHEITEALGANYATPDDIDESELMGELDALEDELTMESEAGGSVPAYLQEPDLPAAPTAQAAGAEGTDSFGLPAVPAMPQRTSLKLKLSTRLLVCSTRRGRHSMWRNLGWHSVSLNGEATANYSSFSHNVPRLCPSADAL

SEQ ID NO: 12907 - protein, 255 aa, Chlorella protothecoides
MVPLAAELQWAPARQGLVQSAFLWGYMATQLLGGWAADKYGENGRMDSFEPGIAALTSHTLPSKCPHSMLQAGPLIVSCLACDPPPQAYLPLIQPFTPLSSSIRRQDGAGLGHRLVLPFQPAPPLAGGHPPHPLPGPCPPRRTPHPLPGGPGGGRGHACHDQPGGPTRQPRPLQRRAGRRLYRLPLRKPAGPGAVALAHRARWLARALPRLWRGGAAPAGGLGHRRAGEGGRGRAARTAGGGSRARPPLGGPAGQ

SEQ ID NO: 12908 - protein, 180 aa, Chlorella protothecoides
  MOD_RES (164)..(167): Any amino acid
MGDPSTTSPVDVDEEFGGALGLTSPPKLNPGLPTVQVDPDLLNDDLYGDLVDERGTGGTLLGLQLAQERARIKQTTDELEAQKAENSRLGEALSAMTQERDALLHNISVLYKTAKLEITRKDAEIKELRSRLGMWFVYEGCSMAADTIPFCFCEVGRWAFSKTXXXXQGAQIQVRDVLRV

SEQ ID NO: 12909 - protein, 171 aa, Chlorella protothecoides
MSQLLQRQRPSCIPPPRLNCPGFIVPGNPHDDVQLQFDLSLIEAARALVGLAALEGLAPAARAALEALGLAGAPGSSAAVAVRRARAGVQGPCDARLLAGLRAVSAQPAELEGLTLRALGDWASPLSLVSEVGGGPLWPDDEFWWLAQGRHGMRLILSYKLIDLTASRIVS

SEQ ID NO: 12910 - protein, 126 aa, Chlorella protothecoides
MPCPLPATNEQAKALRTLTGLCAISLSHFPTTAEEDAEVLRKGGMSGPMALAVQFRLEKKRILDAGIKACAARIRGEPLTHPSHPPDPGTTRLTKLQAWSSPACPKILYNNLLQHSSCGILDRKLG

SEQ ID NO: 12911 - protein, 420 aa, Chlorella protothecoides
MCGRTNTTLRRDEIVRVAGTSRWTGESAFNPSYNAAPGATRSPVVRVVQGMGREICTMRWGLVPSYTKPDELPDFWRMFNARSETLAEKPTFQRLLSRQRCLVPVAGFYEWKKEVGAVWTMSARVTGLGGVRMFGQGLQSHTCDHSLHHSSTNTWQTRVPGWGGCTTACQSSSTPRILKTSGCSMGPATPKLGGWVDGCAGWGPVGGFFEVILQAESRAGISPSYPPMPWLSLSAMIPLLPNLPCRTWSAVCGPYIGEDLVWHPVTPEMGSPKLQGPECCAELKRPTITQFFEKKSGAKRKTDSTLEDTPGGKLARNSDEVGETRGSQQISQMGSQPATAAPAIKKESPQPSDAVGAAGDAKGQGDRQDPIEKEEVVEEPTPKSSPQPKSKPSPAGKGAFSSPDPSEKQASITQFFSKKS

SEQ ID NO: 12912 - protein, 375 aa, Chlorella protothecoides
  MOD_RES (64)..(67): Any amino acid
EQAGSGGAGLLLGAPLRAASASSGTLVSLTALRWLHGLLLQERASLAAAAAAEDSTGPNGAASXXXXLRWLHGLLLRERASLAAAAAAEDGTGPNGAASPGRPPAQHPLHQQYPVILEAVLLSLGSANPEILAAARALNQLLLEAVGRETPAAPTRTRRRGASVGGDAALSSSAGSPAGAPPPPSLPSADGDPGAPTPPPAIDTPALLASTVGALESSSEAVKLAALQWLPALLRRSFHEVFGALPALLRALVESLGASSAAVAVQALAVLGDVALRPGHSHDVLAGVADAFRGPAGAKLLQRRGVLIVQTLAERLGGLQVLLKLSSLAAEDPDPAFGAALVQVVGFGGGEGRGGRKCKCEKGRGAAWEGHGGGG

SEQ ID NO: 12913 - protein, 150 aa, Chlorella protothecoides
MPAPSTSPGALLSSWVMLRGGSVHSALHVRTSPTAGLGLGVSSAVSPGTILVRLPLAAQLGAGGAADSDLQTLLDRVPAELWGARLGLHALRERAVGEGAGAFWPYIAALPSAFPGVPLFFPREAVEALQYPPIVQQVLGGPLGGVGVGS

SEQ ID NO: 12914 - protein, 162 aa, Chlorella protothecoides
MRRGPLDRCVAWLRDSLPPTPHPTPPRPGGEAQQLAGMLEGAGDGASLERLYCAAVLPPLRATWEQVDPARAPFVSALPQFFEQVLGLLRGEAGWLAEAMPCRAPALLHALVTALFEAVEAEHGARLAAALAAPRGSPVPLERLAAARAAALDFVHGAAEAI

SEQ ID NO: 12915 - protein, 170 aa, Chlorella protothecoides
MAEVQERVNASAVGPGAQAVDTLRQLERVKGRMQTAADTLEVGAGAGGEGHARETDSASHGPRPCTMDVAPPSRPCIVTLLPFIEASGLASLFHRMDSLFADEDLPAIAAALAGMQRGLRVVGDSVPGFADGPARLATFQARLRDLVRAPLVAALQNRQGGPAWEQGAGS

SEQ ID NO: 12916 - protein, 388 aa, Chlorella protothecoides
MHRASALVRTLKTPKGRSAFSGSRGAGVVARSVLPTDMVVQTRQDRREELGFEAVVANLCSAVANAGACQPRCSCTRGGCPTPRAGPCLPCKGPNSCLAGPRPTYVSATPAAAPQVSARHAAVLVPLFEDPATRRTHVVLTQRAAGLRSHGGEVCFPGGKREEGDADDVATAVREAQEELGLDPNSVRVLGCLGPVLSKHLLSVTPVLATIPARHAFHPNPDEVQAVFAPPLHTFLEASDLHSSREATFAPGMPYRCALCKGCSFWPGACRQDWTLGKSTLCRAQRREDGQGPPWVQDQPSVGLATGGDQDVVGVAARVLRPALTWPVAVALALRAADREWYSVWGLTAAMLIDIASKGFGRDPDFEALPPGYVPMHAGMFDDQTQTG

SEQ ID NO: 12917 - protein, 413 aa, Chlorella protothecoides
  MOD_RES (26)..(29): Any amino acid
MVERWMGKSESRCIATLQQTGAQQGXXXXTHPWLQECGREGVGAPTDELALEVPPIHPPARAVPGPRHHVGACSCLLGNEVRQVLGVVAQVSVHDDDKVARGVLQTMHICGVAASWGQLLHHVLSSIGAVVVHDDDLETDLTVSSGTLGSAETLVKNEKDMNKCNTINSHNVLRNIISLELKSFDQEVDDDGDVLALIVGGEEHGVFGRRVYSPDHHDLDVGSPDRRSHALCNFAHRGAGRGDGQVTAWKGRPREEQGTRVHPTRSTQPPHVPLSRFNRWKVDCHIRREAVARMLPVKSVDRSATICFDPTGSFLAAGSVAGAIDLSFSTSSTLEVRGGHHCRRAVILRGLVQGQPQYGSEARRWSGACSRAFLTPHVGQGARSRQVPRTFGSLGGVQRKIFTLIGAGSGKLQ

SEQ ID NO: 12918 - protein, 178 aa, Chlorella protothecoides
MSAPALRVCGVSRPQGLCAARVIGTSRTQVPLFVARPGRSARSGSLCSEKPAGHASCNIMTRWVAVVQICRGNPAEPRLAPAQTRRDDTASAEATAEQADTIAPHGGSLVDLMLPSSQRETAISSCNKTVELSDRSAVLVTSMRNGVLHLAKLGCLVFMRRALGNWDLLCCARVCPQV

SEQ ID NO: 12919 - protein, 226 aa, Chlorella protothecoides
MRTWSPEATPYFTPEFNCRRCCGHGTWHPHQTPSLSIHKDRGSGRAQAGPAPQRGGSLHWRGSHHGRQRHRKICCGASGAPCRALSCGMMMCCHAMVAASMWHSPKTHSVMQSQVRALVDVLPEIQVVKDDPFNSSPTDNRYWNTKGSAACTPESPPSLSLHPPSRPRPDGARAPGRTQGGHPTGDRAQAHPARGAAPGSHGGPHLRHHRRREGAVRGDQGGCACG

SEQ ID NO: 12920 - protein, 347 aa, Chlorella protothecoides
MTEEEYTSVVENMTLPDGTLFGLPVVMDTSEEGIIVGDKLLLTYKGEVGPGRGHQSGGKGHLPGDQHACTPCSHARPRLLGGAPGPHSLATFTVSSKWRPNKALEARQCYGTTALDHPAVSMIAGERGRYYLGGGVEGLGLPTREFPCATPAEVRSTLPGGVDVLAFQCRNPIHRAHYELFIRALDADNVSPGAVCLVHPTCGPTQDDDIPGIVRYRTYEVLAAEVANPALRWAYLPYSMHMAGPREAIQHMIIRKNYGCTHFIIGRDMAGCKSSLTGEDFYGALGDPSAGEGKDCLPLLLGGSAWVGVRVQQTRGWECREGPGISGRIPKDQERPHSHRLCLSSLS

SEQ ID NO: 12921 - protein, 186 aa, Chlorella protothecoides
MGKPSAPSLYPAMKNGVEEVASEIGFLAWNPSIHHVLATCTGKSGVVGWDLKKQRPIFQLAEGGARRRHVSVAAWNPAIATQVLVASDDDGQPGLLLWDLRSPAAPLRELTGHSRGVLGLSWSTQDAGLILSSGKDNRTLVWDVAGCGAPHAELGAAGPATNWNFEVAWAPGRNAGLFAAATFEGR

SEQ ID NO: 12922 - protein, 74 aa, Chlorella protothecoides
MNPLMGWTSTADPLENVHRPLYFDSKEAAVAFAEKNGIPRTCPFTLPDGDNFSVKRKGLPSGGLRSELGGKKKK

SEQ ID NO: 12923 - protein, 68 aa, Chlorella protothecoides
MARCATGWRSFSTQIGDDLPSHGTDLQVAGGAPPMAAQRKVIIFSPSRVAGQHGLAQTIDGGAWGMSW

SEQ ID NO: 12924 - protein, 48 aa, Chlorella protothecoides
MVEFASGVKGMALNLENDNVGVVLFGSDSTISEGDLVKRTGTIVDVPS

SEQ ID NO: 12925 - protein, 585 aa, Chlorella protothecoides
  MOD_RES (145)..(148): Any amino acid
ALARPPRRAGWRARAAPRRRRARRATRTRAGGCRRTRRRSPARSAAQVGSGARGGARRPPAGKGAVRREGVGAGVVGWVGGQPLNMKQAPNGHALALTSRASSPRSRTLGKLRGAGAAPARPICSEAWECSQGVVHATTTELGHXXXXGVQPGGLTCNHHRTRAPSHAHTPCTAHLGGRFPQPWSLGSWARAPHGLGVGPRVDTRENSHAPARPHSLSTAYCTFRESVEDVWRAEEPAINPQHKAVEPTSGVSNALIALSRAVIPDLAYSGQGGRMATAALERHANQSTLDADDTMTPNDAENPHNEAAMDKSAGQDLQSLFAEGIACIATQKYDLGAECALSVESNRSVYARIMNVAKNDNLFQDLETRTLTTREQDIISQRVGENGLALLPCLWGGCAELHLAPDLAPGGCTITTSSQVALQRRLFEEYEKREMVRKIQELREVCPQISEAAAARALELCNGRCGKSGQDHGTSSCGINSDGCHHRPHPLCSPSFPPSLTHPPSLRSEDEAAAELVGNPAFRSRVMGPAHGNSAPSTAGQKSQQPWAAKPDPAVRPKLVDPGSLNHSVGGAWWRKTIRRTQAC

SEQ ID NO: 12926 - protein, 191 aa, Chlorella protothecoides
MASSRMLTFKLSPSTRLFIQRADLTTFRGDAIVNAANERMLGGGGVDGAIHRAAGPDLLRACRAVAEVRPGVRCPTGECRLTDAGALPARHVIHTVGPVYDGPATSAPLLASAYRACLCTARDAGLASIAFPAISCGVYGYPLREAARIALNTCREEAGAVREVHFFLFSEPTLEAWTAGAKELGLEEEGG

SEQ ID NO: 12927 - protein, 505 aa, Chlorella protothecoides
MLQYEREQCREDSFLQAALKLDVVLSGPQLAVFEGNGAVLRNPRTIPGAFSSPNPNTPIEILPALYNWRDGEARTQDESPGFICPRAQLVALALAMPTTGPEVAAALGRRARYVLLRAREVAAVVAGAAARQARVEELRREYLLAGGRAHKNQVGPEDVARAGPENVAGVESESREPEDAASNADPEPATPGPAPTATLEPAAGSAKRALRPRGIKRPLVLGSTGKGLGAALIASAAQEGAAAPARGGPVRLSGAGTSARACAAAGSGGPLPEEASVEDDAAAIASVAGSQSGEHAKDGAEELQASAKEPQHQEQAAAVVKAKDAPPAPSTLQRESEAGPVAAVPLAGPDPCKPRAGAKRVPAVRMAGAFGGALPVPAGAGAVPRALAAIRASLTLPFAKQPAGVADGEAAEAPSAHAPEEAKATEGDALDQAEPTTAAEVRSAMEAMRGVAAPAGPRGPRDDLADYLPLSLNERAGKKARQYEAGRRHAAARLAASGGCDAEGG

SEQ ID NO: 12928 - protein, 118 aa, Chlorella protothecoides
MRQLWSTGWIHHRGRVVCASFLVKNLLLPWQWGLKHFWDTLIDADLESDSLGWQYCAGCLRDGHALSHMVDLAEEAARYDPGGAHVRRWIPTLARLPNSHIHSPWTASPDLLAAAGGR

SEQ ID NO: 12929 - protein, 104 aa, Chlorella protothecoides
MVLTCITYTISAATSMKAVAEIACAWRGSTQCFDTIWQMVLIFGALQLFLSQVPSLESAWWVSAMGVFTAIFYSCIALSLGLKYCEWGLGSLQGGPSMLATPVG

SEQ ID NO: 12930 - protein, 419 aa, Chlorella protothecoides
MGMGVSRSHPRPAHTFPVPLSPTPHPSDTHRLPPPDVFPIAEMSVRLHDGTVVDVPDLGVAQQYNLTLHGLPALRAWAEREVAARQRPACATETMISNGANHALEMMCNVFLDAGDALVLEEYHYPVVTEGHTLPRGVEALGVAIDAQGIVPASLEAVLEARAAAGRPAPKLLYTNPVAQNPTGAVVTRERMAAVYRLCRRYGLLILEDDPYYYLQYPAGPEHVPGTDLAPGYLSLDLDGRVVRVDTFAKMMAPGLRLGWITGPPPVVAKLLSCISYSTAGPSTISSAIALAVLRAWGPTGYETHIRAIQRHYAAKAAAVHAAAQRHLAGLADWEQPRAGMFLWITLRGIPDSARIWEAMREAKVVAVPGGALNVRAGTPGFASPAMRISFSYNTPEQVEEGLRRLAAVIRSEMGGAPA

SEQ ID NO: 12931 - protein, 234 aa, Chlorella protothecoides
MTWGIALGAGGQEWLGRPLTVTNTCRGASHSQGSGKETSAPVELEDDEFTDAVTERLELVYDALDDALTASALDAAGAKKEGRMTTRPGQEGPGRAAQPVSGALAPSPTSHGRWTPDGTGPKSQLAFEDGVDNANARVMPKYDGLSAVPTFDGGGQAAAAAAALAADQQPPHPLQAVLSTLRYQPWQTEAAPPQLPLGFDTTPYTFVDTPQGLREMGELVGWLKVGLASFVCTY

SEQ ID NO: 12932 - protein, 95 aa, Chlorella protothecoides
MKPASIISISASFAFYFTVAVANYSAFGNDVPGFIFDAYPGPKWLVLIGFICERCQGGALERGLGIDPAALPPSPLAGTATRAAPPPRNAPSPPP

SEQ ID NO: 12933 - protein, 160 aa, Chlorella protothecoides
MRACQTTSPRRPGPAHPESPANTTRVQLARTWAPWAASQHHARAAGARLGSVGGIVTNPADKAFGVLGSLGAIAFAYSFAVILLEIQDTLRQVGRGGSQEEGCSAGRLAASPQPRWPGLDVGGAPGRPLPLRRAPPTPHEAHPPTPLSTLPSLPPSPPRL

SEQ ID NO: 12934 - protein, 423 aa, Chlorella protothecoides
MVSLEAYTPPSWAAHLPNPPTQRLRLAVTPSLLHPWPLPGLPPGLELFIKRDDLTGMQLSGNKVRSRAWIGRGGAWRKRAGAVQRRLRSSFLIPSLAAPGPKARVPAGQGQGGGPRLCHHHRRHPGLTGQEGGAVQGWCRVTAHGRCDCCACPAGGRDVICPHGREQPCTGHGGGGALLRSGLPPHSAHLPPGGGLRPGAGGEPAGGAAGGRPHPHRDQGGVRGRRLPRPDRPAGAPAAGAGHEPLCHPGGRVKRPGHLGLPVLCGGAEGPGGGPGPHRHRAGGPWWEFVFSMGVEGGGKGMPSAGGWRLRIRREWPAVPCSTADRGVPGEGRALAITRPACGSGSTAAGIALGSHLAGLGVRVHGYAVCDSEDYFYAFIDDLLDQVAPAEARGGAGARDLIRCLLGWFGGVGVWGVGREREQ

SEQ ID NO: 12935 - protein, 272 aa, Chlorella protothecoides
  MOD_RES (220)..(223): Any amino acid
MLAELDAYRQMNQDPAATRRNALAPPPFRVGLVLFSLATLTNQKIWPKQYLSLSSGSVILSSSQVVESASCSIYVLDPARDLGMPACDYSDTAIWPHALKKTGLGGSTVPLQHWEYQYAVHLWLEEAVIDNGARTDRLSRADLVGGCGGGTGIRCRAIQVHRICSGCKGAVSFYQYRQLKLPGMSRLLPQSPLIEQGAHPTLYPSSCPLHPRYSSTCIAXXXXFNTSLAGRGYYQQWGPDRQAVPGRSGGWVWRRDWDQVQGYPGAQDFFRV

SEQ ID NO: 12936 - protein, 234 aa, Chlorella protothecoides
MRSSRYCLVLAGDKASSRRGTEAALSGCIPVIVGPPWHTLVLADEIDHAASSVFISVRHVTWVVANTSLARSDNHPSVLTAWYLDTDLPPGQMLHVDTLDEVVDVLRALPPKVLAAKQAALAREAYKQFDNRPGVLTDWYLDTELRPGEMLHVDTLAEVLGVLRGMPPEVLAAKQAALAREAYKQYWLPAPGETKSQLGEIVVKKLCDHAQTLKDRGIILPHPTPLQGRKLLAE

SEQ ID NO: 12937 - protein, 228 aa, Chlorella protothecoides
MARHKSMAAWTFLMFEGSSSLNPPTSLLLHRGERRDCQPPAEHRDHAGQGQDGAGSPGPVPGPSDLPAVRCRGPGPPLARVKNLEGDRQLVAMLCQVAVSQLLSISPAPLHDDLRPPFHTQLTQSRQRHSQTREDVARLAARHGAELAPELVCLLGILLRDVAGVDEARAALSDLVRELRRVDVGLGGGLTALADVLTLYARTRTWFAPERGYVVSDMGLRGLAQREK

SEQ ID NO: 12938 - protein, 435 aa, Chlorella protothecoides
  MOD_RES (56)..(59): Any amino acid
  MOD_RES (271)..(274): Any amino acid
  MOD_RES (375)..(378): Any amino acid
MSHSCTPNCQATVMACDGRLTIAMHTLRQIAEGEAAPGHGSEHVTVQEEGKDDCGXXXXRRRGSKFISIHIPSCHSMAQGMLAQKQVLAGQMIAATPSPRRAGKPSGRYSRVGYTECASAAAPCGALCMAKHAALRHVPDKPLLHFIATIRGSYLYYTGSRAFQTVMAAKHNFLHRQVCLLRAASQPLTPDDAARLRVRGLFLVVGESTMPGIWSERMALCRKHPRARPREVGLAPCATRLHGRWQFHHSLPVLHARPRLAVASRTGVKRXXXXSITPCLSSTRAPASPQRHGLGSSALGCAVQGQRVPAWLEKWAALVCEYLEQEQASLCSELLKHPLGIYTEATASAGMLPVWEGKGEMAAHWQAGREAHEFXXXXRWASTQRPQRALVCCLFWGGKGGDGCSLAGRAGGASWVQLLRELFGVGEDLIEAGPC

SEQ ID NO: 12939 - protein, 619 aa, Chlorella protothecoides
  MOD_RES (30)..(39): Any amino acid
  MOD_RES (108)..(111): Any amino acid
  MOD_RES (528)..(530): Any amino acid
MARTAPPLMAWAATGRLRDGRTVGERDMPXXXXXXXXXXPLPCSACSEAWSTTASGLAVRAWPPTQSATTLAAVLLKVGQQLVGRNDEGQSWEGHAGPQRGFVCIGVXXXXGAGVECWVSLLKECLGARCSWAVTVGRCVQTLDLRQGQRGLHPSTLKTSPPTPPSRVLESSDISEADTTAWGGCGRKGRLGHGLLHAPQHPRCMIFVEMTVDAKRGSFCTQKTINCCHLHVHSPYYLGWCSGTYVLDPPPPTQSPLIPAVLESKAFGQAKSPAQLPHPDLSQDGAEGGGKPFGSSSTTKAAAAAVVAATAGGHAAGLALATSPAGGEIEAEGVGSDAAGVLSRVHAWIEGVLLPAITKQGQHGWDIALALNHIRERDQKAVPASARAAKAVLDRLAKGGNVSIHNNSREMHARGTPHCMALIPQPHTLALPHATRWGTITSGCTPRAWGWCVKGQPAYPPSPLLRSIWGRSTPPGDGLRSRCSGIGRGGPCLLLSGMCLAICSVLPSKGKRGGPLGGGCTGHCEERXXXCLLLSGMCLAACSVLPSKGKSGEPLSGGCTGHCDELPDFYNIVLERPKDDEQGYDVLFIDAASKVEHSCSTAVQRLTHVDVAPRAALAA

SEQ ID NO: 12940 - protein, 533 aa, Chlorella protothecoides
  MOD_RES (3)..(6): Any amino acid
  MOD_RES (413)..(416): Any amino acid
MAXXXXAPLRGAGMSMVWGNVCFMSARLPSIPLPLQPTDTSAPDPHGSHRRGSCLQDGAEGGRYQVRLWCGKSVASCTGRACSLGGLHIGRSAKEWFPAAQHSPTLQRRLKGLSTEDHLLYQCIARAGNVDSPGPTPFPPPLPEGIWTKDMKRRTNLSQPRINKIVKFLEEKGMIKFVKSVQNASRKVGILGTGCVVQLEGRKGHMAGTGREEQGGRQSRLTWGAHPVGVGMKRKLVSWRSLRHAAYSHFPSSPSQMYMLSELEPAKEITGGPWYGDDGKLDASFIVEMQGGVLPGPGDAAHCPLQHVLWQFQNPCSPWNGLQPVQAVMSFIRHQRVCTAIEVLEFVEENKICTLSTPLQPDDMALLLNNLVYDGQLESKEDEEGALLYRPVRPRQGWGKKVGVLRTCRAAIXXXXTGAAPAGVGIESGVLRTCRAATGAQWNACIKSCPRGLELSPCAPAPHRRCITAWNRPPSPPAPAASAPSSMTVWRRAPSLPAPATTTENGWTFECRAIVAGRYLSCSGNCLLELEDK

SEQ ID NO: 12941 - protein, 311 aa, Chlorella protothecoides
MPRANGCRDDLVLAVSARGPGCAFHDQREPSMQCLLRVCVASLRSQTAGGLQGRHPSLGRCTDGNKTVVTQGRGWQALIDAPVDCTSAHPHAFLPQAVIGTGAGGLVTLRELLKEGHQATAFEQAEDVGGVWVYTEETETDPLGRDTGVCAQEAGTTLAAPARVSSRGLSHTAQQTPRHRPASPQFTPQEGGRCTAACTQDCEPTCRVRSWALATTPSPPHSQGRRTLGSFPPMMRRYLAAYAAEFGLEPHIRFDSRVTQVRQEEASNGEAGAPPRWRVSTASSKSQAGAGVGKQEERQETFDAVVVCSGG

SEQ ID NO: 12942 - protein, 263 aa, Chlorella protothecoides
MCNLCYRGFLLLDIKVRYSYTYPFLEPGHVTVDDVRVRPLYKHLFPPADAPRLSFVGLCFKIAPFIQSELQARWIARSLSGRARTLPSVEVKIYCQGGKAEVTAKACILRCRYAPQSEVHAQPSPNICLPSCQEMERDVQAFDAALEAEGIPPRFTHRCQGALGKSAERPQSSVTLCRGLLFLHSKAAHQICHPASPFTSRSGPIVGSWREEVFNATGKLRTDFPETYRNVGVGGGDKWALAAAVEAQALSEWEEGGRKPLGE

SEQ ID NO: 12943 - protein, 719 aa, Chlorella protothecoides
  MOD_RES (100)..(102): Any amino acid
  MOD_RES (134)..(137): Any amino acid
  MOD_RES (165)..(185): Any amino acid
MAVQVGQYCMQGSPAGWRGCILLHYTSKVLIDFGLSQNSSLPEDKGVDLYVLERAFLSAHAEKGPELVSIADGVREGDVGGSVYGRSMVPAPDNHPEATXXXNRFAEGEGGGGGCECVWPVKGPCPRRSPGGQXXXXQHFPGDGRPASCRRMLFMSQPFWSATLXXXXXXXXXXXXXXXXXXXXXGTILPPPPHSPREGPQAGHGGLACAERSTSKAPAKSSLRRRAAVWFTRTLQLLPAPMPRSGLHGRQPTRSRTWEGVPVPASCRCTNYHMRRILAVILAFPSQCPCAGVRRTSAQAFALAQENAMEPGWLRRTRIGVLAALCICSLFGHARAALEDGLGPSDPCPAFATSPAPAHAIPAPWQDDPCTAFPVTLNVSDYEMGWGGELMLNLTSPVWHPRGPMAESLHTLSPPQAGPDLLKHAQIWVRTSVNTSDQASLLPVVRSAVISICLCLTSMACNIVGGSGLETCSGQDPRCPSRLISHHLTSPTTLTPTISHLPIPQIKPQVAADHAWRRLLGRTDRRWHLPFPPPAPLDVILYRTACPPIFAAAAILGPGSGAVLDQAPRAGLATSSQAGRQRVDLAQAAASPEQGAADPPSEVALLLPPPSPTASEQSPALASPEGGGSEGQSPPTPAAATAAGAPASDPGTNQTLYIALGAGIGGALVLGTGEWGGVKGWAFGQVAPSHASVQPGGTRPWIAPLLYVVTSLRPRPSQL

SEQ ID NO: 12944 - protein, 196 aa, Chlorella protothecoides
MPKGKRQRKFEAKHLQGTIKRRKHLQSVNRKRDLPASAAGATSLELGHGPDPKPAEEKNVEELDIDEFLSGDFLPEGRAEEMSEGDSSSSGSEAGDLNAAASESDEEEEKVAPAATAALEEADESSSDEEADDGTGLAASSAKLTNAVASHKAELEALREKDPEFYKYLQVTGGWVFLAASPGPRPTMEGRRGFKA

SEQ ID NO: 12945 - protein, 704 aa, Chlorella protothecoides
MLAYILRRARASVVFLAPYEKIRRRSLKAALGLFGSADAAARVQAVLFVRGAALALGGSTLDACLKGVARAFAANAKFVNASSLPAIDFMGAAVVELYSIDPGDLAIRRIRSPPSRRRSVARDSMPHPTIFPPPMPHLSLQHSPAAASYQHAFEAIRALAVLLRGALSTKSKDAYREVYCWQTVNCIELWARVLAAAATRAAQGKGGAGANDLAALSYPVAQLALGVAGLLPTPSYFPLRLRCVRALCALSAASGAFVPVAPLLLEILAWPELARPAGRGGDSGFDPALVLRAPKTLLRDAAFQEEIVAQTLELLTQHLAQWACHVSFPELAHLTTVSLRRFVKNCPVDRFRLGGLGDLGRPVEPPYECASTGKTGPGSIGFIQCNGQPSSHSPSALQTQRATPHHLLAPLITHTRRRSGKQLIDAIDRNVAFVGRARDAVEFSPKDITQVAAFLSTEAAAKSAPLQQYARVLAAKAAERAALRRSDDVVIGRRKGGDGSDEDDDGPAAEEEAEVAVPRGSLLPTPAKPRSDEEDEEEAAATNAGASNGVDDLVHEYALSSDDEEEEGAGRRSRPSAQAADCGAEEEEEESASDEESGSEDGRAAASDDDSEASDGEEHALASGGRGRGRGRGDGRGRGRGEGRGGGRGEGRGRGRGERSDGGRGRGGRGGFGRGSPGGRRGGGGGRRGGGGGRRGGGGRRGRF

SEQ ID NO: 12946 - protein, 126 aa, Chlorella protothecoides
MRHLAQAYRAACHYGDSDEAGEAGLQIASSALFNRIMLFMLVRARRAWEEGGRQPYHHNRSPAPPIPRRPIPIMLLQKEADGVFRRLLGVDATSTLRPASLTKLPRWKKVEPLIKSYLGNTLHLLG

SEQ ID NO: 12947 - protein, 231 aa, Chlorella protothecoides
MDRQQVYLQETASRRPDLAEDLTTLGELYHKKLWHELSVKLEELINTPRLQEDGVLIALYQNFIASFAPHINLLKLALFAVAASKQIKNPDVRTVGVLGRVSRSLAWGEAGHEEGCWCFHPRKVSLYQAIPSYGAPSPPHHCHVPQEGVAFLQDVITGLENLKLAAAVQPILYLKMHVAQYDQAAGRWEEANKALEAGEKQLQGLQERQNLEAKPTAFLCANHQSLLAWLR

SEQ ID NO: 12948 - protein, 136 aa, Chlorella protothecoides
MTASASRGTYLAEVRQAITQALCLMDYPSPHVEGHNKPVIEVEGPGHALIAAPIVLTRGAQEGCLVEHSINSSRISLRFKAQDEVERCIIDTHLKFLMHRATMGSTANLVNSRARAHSVPRHCFSESCKACSKIAI

SEQ ID NO: 12949 - protein, 180 aa, Chlorella protothecoides
MSHHKAQQQYGDFYKAALLYLAHVRQETLPADTRLALAVDVSLAALLGKTVYSFGELLLHPIHERQLREKITILSLTEMVSSLPAEDRTLTLEAIGQRTKLPLDGVEFLLMKALSLHLLEGVIDQVAGTVQVSWVQPRVLTMDQVQRLKGRLDAWVGQVAGVQLSLQEAAVGLVPATVDA

SEQ ID NO: 12950 - protein, 531 aa, Chlorella protothecoides
MLRIWSRLAMPGDRPPCTQNTELSMSAARLRGRQGAVGRGRGVGSVVGRRYEYAATPEAARVSRPQEPDGKEGPVPCLAPVKDWPDSFRQCAALARERAAPEVVEDVCAVPPDVGGAVLAQTLVIEAVDLCDLPALVVSPNQEHAVRIPHLWRRGHVCTRVCGVGCATCRGGACAGGCRHSQGWRLASSPPPRRASPMNPHPSTHLEGQQEEKGLYAVESPVHEIAHEEVVCLRGGGRGRSPTALSLRGTGNEVDSMRGTGMDGQALAVSTPTTDLVTLGVPPTFARLTYRDWGLYGLASFQLHDPGIQVHSVSGLGSEQTPLEVCEYAPQGAAIASRPRASPLKPTCVTEPRHLPITGGRQDEGATSWARNFHSILVCAPGPNHELFRSGSARICRSDGPHCPPIFECPINPYLQSTSMNAFKLTWESIRANAASNADLTCRLISISRLRVLLQSEIRTYKKNIADRIIASRSTALLFYSLELNRCAPGPNHEVFGSGSTRICRSGGPHCPPIFESPINPYRQSTSMNAF

SEQ ID NO: 12951 - protein, 189 aa, Chlorella protothecoides
  MOD_RES (58)..(61): Any amino acid
MYAAGPGHGGGCEMGRCARGSGHVRAWASASQAGAPADTPSPLPTAHPSPRWTSSPEXXXXNVCCGFRAWGGMRDGAVRALERACARLGHCIPGWSSCRRSLPPPHRACIPQVDLIARAHQLVMEGYKTMFDSKLVTVWSAPNYCFRCGNVAAILSFDEALEQEFRVFEAAEGEARGVPGKQAAPDYFL

SEQ ID NO: 12952 - protein, 355 aa, Chlorella protothecoides
MNSPCTARGGQRDGRSVGALRSPGQAAEGAECFMHDFSSRCSGTEGDPSGRRKGVDRLLWSAVFYKPIEEFRRRLTCGAQDDVTEKVQVAGEAFLDEAYVFYVLLASKIQRVYGSVGLVQSLGPEDEALVELAGAPRGEHSASPHADVEAAVCHCHVAMGDLLRYKSTMRTAGEVDWEAIERAYQTAASIHAASGAPFNQLAVLATCRPAPRDPLGAMYNYLRWVRQLAGDTAHFRGPPPRYAHGGPHRCGRRCALRRAMGATRPFPQSRANLVSLLRQLRRETDLSACPDVVSRAKLRWEGNPFSKHGVGWWGAQALRTPVATMLGHGTPLQAAMHPRGHAAAAAPAMQLGCLL

SEQ ID NO: 12953 - protein, 194 aa, Chlorella protothecoides
  MOD_RES (179)..(181): Any amino acid
MVRQANPFGPGLDSFFGTRTRGRGRAGSSARIMQLGLLLYHQIAMLENKPPVTMALVALQVLLHLRPDGFEGLPSIASACLQPHAMLFNVRLLPGDLCAAWSLACVLKGVVGLPMSLTMSTSSSGRMEPAIMGSLAPCRRGTPVLQHVLLHLEGAPVRGDGAALLGCMELWARVRMRSXXXTCPPSSGRCTREG

SEQ ID NO: 12954 - protein, 746 aa, Chlorella protothecoides
  MOD_RES (114)..(116): Any amino acid
  MOD_RES (426)..(429): Any amino acid
  MOD_RES (549)..(552): Any amino acid
  MOD_RES (668)..(670): Any amino acid
MTLFYSLPSGSRPGPQLAVRASKGDTPDDIPEYFRTEQATKPVTQEQQYQSVSSTYRPAPGPQSSAGSQIPPLVWVGVGELVVRGVEQQHARMLGVAAILPSRSNPQASWWPPXXXAGTLPSSPAVLLTTCIASRAPAGCSGNLVLPLKPTGVVVATLVKPVLNFFTGGPAKLQQLAMEQAMKQMMKQAGNGQGASPFGPAGSPFGAGPASPFGAGAGGMPAGFPSFPTMPPTPAPAAPKTVDTTATTSQTASTATPPAPATSDAPAPKRAAFVDVTPSAAAGREVDSSEISDLRPGAETGAVPSGSAGAEAGVAAGQGPSSSAGAGPSGESVVDMLRNPEMQKTLYPYLPEHMRNPQTFEFMLSNPESRAQLEQMMSQQVGVVIGESQASVLALTGALGDMVASSRVPWYVRPDYPLPHTPHHTXXXXHGGTRCLGGQLTSPLMEVAGTPEMKDMMASMDSEKMSKQFDALGMTPEQMMQKVMSDPELATMMTKPNVMTALMEMNKNPMAMFKYQSDPEVRRRACGGGGSRQACRPARGRCAVSSVLXXXXGGVGGGRPFALRGVDARSPVSCRGHMDGTGPTFASRPCLETLAQGTESFHQALTHCPEPVPSLTDGSDPVDSGWVRGAHENSSGLVISGYAAPSLCIGMPGRVGSNKLSTGHLPGXXXISGWVRGAHENSSSLVISKYAAPSLCSSISGRVGTNKLSTGHLPGADDILKNNLGAVGDGGGHVTSRPASKAQRGK

SEQ ID NO: 12955 - protein, 244 aa, Chlorella protothecoides
MPHPSTSSSAVEDKQLFILALCDEFTGTALRPATESDLAGIDSPASSPPPMPRHSAAQHRSMSLQEILASRAAFGGPSCSHCGVTGGCPGAGSGGVGMVSSRATKPHTRPTPQFAESPQWRRGPAHKPLLCNACGTRYRWDLLVQPCVEWMPAACAGSLLHRCWHVFHIGHLLLYPTQADQSVPAPPRHAGVTQAGHQRPTDMRARERPGGQGAHGLQAAAVDCQHGLRRIPLSVPHLPCSGAV

SEQ ID NO: 12956 - protein, 651 aa, Chlorella protothecoides
  MOD_RES (152)..(155): Any amino acid
  MOD_RES (487)..(490): Any amino acid
MPPPSPPLSQEWDATVLELHQLRTSLHKTRQELSHALYQHDAATRVIARLLQERDGYRAAAEAAAATRAAAPADANGKRGAEADGGEDGGDAKKAKGGVTARVVEALTAASDELSRGRKKRVVPPSTATPEERRPGGHRGRRRLRAGVRRGXXXXGSGDLAATAGADGCVQVYDVTGARSVAELAGHSKRVNDVRFLGSADLLASASADRTVRLWRRGEAEGDYAAAATLADQAGEVVALVVHPSNDYLVAAAADGTWAFYDVAQALCLTKVADEGAAYSAAALHPDGLILSTGTEGAAVKIWETRTQKVQYWRFVGWGPGSGSGCAGWGPEGGQGGKHDDAIPGAAWGLSRVERGWMRSDCCCGAERLMRRCAAGSHWECGQLRGAHWPHQLAVFLRERLLHGIRRHRRRPDLGPPQAQDHQVGGCVGGPGGGRPEGGEGACRNLSRNAACVGIPHPPHHAHALARTLNLFSEGTPTTAVAFDYSXXXXRNLSRNAACAGLPHPPHHAHTLARTLNLFSEGTPTTAVAFDYSGLFLGVGGSDVRVVGAKQDWAELATLTGFPKKVCGAGWSRVGEGLGTLLSLRPECNAGGGPLPCTDSQPHLALPCRCPIKPLYRPSQPAQGVSSLRFGTDAKRLLVGASDHNLRVFDV

SEQ ID NO: 12957 - protein, 729 aa, Chlorella protothecoides
  MOD_RES (363)..(385): Any amino acid
  MOD_RES (468)..(470): Any amino acid
  MOD_RES (645)..(670): Any amino acid
MDPQRACGSAARRIARDQMAQAMARLPEPGSWWGLHQGASCPSPPQTSPWRHSSREKEHEMPPSIGLDLSGDLPGRGDLVMGIGYSGYGITGSRHVDSILQGDLAVPFHHRARKTFAHPWPLTHPGGLWRELGIDLGAPAASLLSTWRHFTSVQPQDLAPLVCPASEGQRAYTHVTSPAALARHLVGGADEVVDEVLAVAGLAALDEVQALVGEPALGRRQLEGPEEVVRLLEGRAHGEDLVNQVLHADDVVLAEHALHHGVVGERDAVAVDLAMSALVDQLAHRLQVGVAEGDIGLHALQHAQRGLVHLQEDGVVDLAQAQELQDLLGLGRDVVHTADAYHQQQLGLGLDVEAGLGLGLALXXXXXXXXXXXXXXXXXXXXXXXRATGDLINPEGQMHTSLMETCPIVGAAQGKPPDHVLGTILAPDGHACSPARCHGSRCTLSNRCGSSASIHTTGQLPAIPGSRXXXGHACSPARCHRSRFTLSNRCGSFASIHTTGRLPAIHGSHPSQSSPANATPSCSYLGAVLLDILLGALEDLRAVSTGLLLSLWWDFGRRRGSSEVSTPRTATGTARWRAPSLTATVAAAFFSAHCSSLFLFFLHAVFGGESNQYHRRDGQRPGIARGGRLRHSQDGLGHWCGRHGXXXXXXXXXXXXXXXXXXXXXXXXXXASASPLTGVPAAAVSGGMGILTLFPQNPSRQASAEQIAGEGRCRYQGPGFRRTPSCNPL

SEQ ID NO: 12958 - protein, 544 aa, Chlorella protothecoides
MPPWGGLGRAGTRCALVQAPPGTRLWQSGHGLRHLVARNAPSGRSTRTLRIHASENGGDPILPPVGKGAPGLVRVVLKGALKYAHAWIYPRTTGDLPGLHRMFPTSWSPALGPILALHAPSHPPTSESRILGSVVLFSSLVLGSAPYLLSTKFGLETALFAANVAMPATLSVDGVSAGWGRPLSIHGIVLSEEWRSAGPRQDRQAGEETGLAPPGAQRPLLQIERVTSSAPLHSLLTSRAPLTLTVHRPVADATLGPDGTLRLLGLLERCGLLRSPAPLQAVAPAELLCGAGEGKATRATADLKERVVLARALGGAPAAQADSAGDQAHQHDPEAAEDSAGDQAQQHDPEAAEVKAAAFGWREATRRFRLPALEEESSAGRGSERRPLILVRPEGAAAPAPHAWEEEPANKPLSLRELAVRLWRGREGRAQREARARRSRGAVPPALQRADAAVAFSGELVTPWVHCLTADGALNLPLAFKEAAGEHVHMEVLQGLAALEEAGKDGVGEDLAWAQRRPQMVLPLAAGGGGGGAAGGRGVERGSL

SEQ ID NO: 12959 - protein, 117 aa, Chlorella protothecoides
MLQRVEPYVAFGYPNLKSVRELIYKRGHGKVNGNRIPLTDNSVVEGVLGKHNIICVEDLIHEIFTVGPAFKQANNFLWPFKLSAAKGGLSHKRLHFIEGGQAGNREHFINNLVRASN

SEQ ID NO: 12960 - protein, 205 aa, Chlorella protothecoides
  MOD_RES (42)..(44): Any amino acid
  MOD_RES (120)..(123): Any amino acid
  MOD_RES (142)..(145): Any amino acid
  MOD_RES (164)..(167): Any amino acid
MWATTTSVSGMREVAGRYWGFECCLRWTKRNVTPVSLCPSSXXXEGRISNKGNLNWGNNNNGINQRCNNAVGTRKGPNMCSLKELHKSIVKELRQPPPPPKKKSSPPPSKKKPPPPKKAXXXXQPPPPPKKKSPPPPPKKKXXXXSRRHHPRRSRRRHHPRRRXXXXHRRRPRRRPRPPRRRHPRRPQRRRPHHLPRRRLRPPTR

SEQ ID NO: 12961 - protein, 438 aa, Chlorella protothecoides
  MOD_RES (71)..(74): Any amino acid
  MOD_RES (105)..(115): Any amino acid
  MOD_RES (219)..(222): Any amino acid
MNAFLNAESVVMVPQPLIAAGFYVSACLLLGGAPPGARWFVSLSSDPQRDTIRRRVLLVLPNWSCPVPTGXXXXNGPTASDCCMILRIGWPAARRCATGARWFVXXXXXXXXXXXRGDCTHWNMHVATALLPGRLWTLKSSFCLFRSDQAVDRRERLRRLALETIDLAKDPYYFRNHLGQVRLTCCTSRCITALDEHAAQEVVGAGGSNVKLCKDVLGXXXXEVVGAGGSNEKLCMALTLLPPSLVPTLLQIECRLCHTLHTNEGNYLAHTQGKRHQQNLAKRAAREAAEQEIAPAPQRRVAIRKTVKIGRPGYRVTKEFDPELGRSGYSCIPRYHEQGFLQPRSVSACPALSSPSPHLYHIACYTPQIEYPEIEEGFKPRHRFMSSYEQRKEPWDKHYQYLLFAAEPYEVIAFKVPTLEVDRHQTDRLFSHWYEERS

SEQ ID NO: 12962 - protein, 216 aa, Chlorella protothecoides
MPCGPATLWLPRLHPPAAVKAVLAEYRIHNADVHLKGDYDVDDLVDVIEGNRIYVPCIYVINKIDQVCRIGGDGLMPGGSPPESVPRSGISIVSRVSPSQITLEELNVLDRLPHYCPVCAYHEWNLDGLVEMIWEYLDLLRIYTKPKGKLPDYNDPVILPAAHSSVEHFCNRLHKAIIKQFKYSLVWGSSVKHRPQKVGKEHILQDEDIVQIVKRV

SEQ ID NO: 12963 - protein, 186 aa, Chlorella protothecoides
MDVWFHVDSLSSAHVYLRLPEGVAIQDIPPDTLEDCLQLVKANSIQGNKQNNLHVVYTPASNLRKTAGMDVGQVGFHHQSAVIRVPILKRINEIVNRLNRTKEERHVDLEAERAAYDREQRGKEKARLQEEESREKALKKQQQEEKARRSYDAIMLEENMKTSKDMAQTYENVEDYEVRMVEWSCR

SEQ ID NO: 12964 - protein, 349 aa, Chlorella protothecoides
MTAPCDVLICSLGSPFAIWPSPYPASISTTHVGQVVRLAVGRLLLSPNTRANVLCAGAKAEAPGRASLGSLGLGLASEPWRLLLSRIGDTLMLYLLLHCSMWSRVPNGTVVQLTGPPMARIARASVFGRRPEAARAPGAPASAKLEPGQQFEHPLGTGQATAPCQAAAPQQAAAPQQAPAPQQASAPQQTMAASQDSTTYLLGPTGIEQVCGRRPAAPSRRPSSWRRRREAIRRAAAASTGSFDVPPTQEVLPAECQEGPEGPCGPQLGFAGSRPQHAQQARASPFQPAQRLAAMQLPRQLIFYSATFSGRAGLPSQRTSRVVVFLWVQDDKWLRRVSFHPYQCRAPIR

SEQ ID NO: 12965 - protein, 95 aa, Chlorella protothecoides
MSVLQKIKDIEDEMAKTQKNKATAGHLGMLKAKLAKLRRELLEPSSGAGGGGKGDGFDVNKVGDARVGLVGFPSVGKSTLLNKLTGTFSEVRETD

SEQ ID NO: 12966 - protein, 381 aa, Chlorella protothecoides
MNDTYCRLQPVLRRWRAARVQAGALAAAEPVPRAFLATMDVSRAFDNMNAEAVVRLVAGLLTSQRYSMVQYTEITPRAGGSLTVRSRRCALPADDPTGPGPGPGAGHTHVLWSGLGAGRGVQTGGVVGTVTRQSVLALLSQHLQCNLVRLRRRWHAQARGVPQGSTLSTLLCCMYLAHAEAAALEEAAAARGRLTLLARAARCEGGPASQAAEASIGSRLGEAVPAGVGVSGCQGEATSVSGCQGEATSVPGSCTDRGTPVPARRPGDNTPPAPLPPPGNRDPTTPAPPERPLLLLLRQMDDFLLLSSEGAVAEAFVERLAVGFPDLGIAVNSLKTRTSWGGGERLVRSRCGAAFLPWCGLLLNVTSLGVQGDYTRYHGDQ

SEQ ID NO: 12967 - protein, 368 aa, Chlorella protothecoides
  MOD_RES (352)..(355): Any amino acid
MRSPAGRPCSPVMQVCPLTLQGVLAPDDARAAIRAGSDGIVVSNHGGRQLDGTPSALDVLPHVAAAVAGRVPILMDGGVRRGTDVLKVEGAGLVGGAPRGGGLGHLRGPTQPCAWERVRCRRRPCTEALPCAKILLPRAGGQRRADWAARAVGLDPGGGGGGPCRPEHHARRAGAQHGAAGGGERAGAEPRLPRPAHGRGAGAASGTHVRWQCGLEECVRIKECWPRQRLEGIHHCIHLLVVMGHRCCFNTSYQYPVPVACAEFESACVSLLFKELSSMGSPVPCMASHRWVVHAGAQGTAAKATCDRPSRPGHHSSDQKAPAGQLHGISNALVLAHESSHNTLRSILTTGXXXXVTIQAIRRLWPGN

SEQ ID NO: 12968 - protein, 295 aa, Chlorella protothecoides
  MOD_RES (12)..(15): Any amino acid
MLYLTAWALVRXXXXWHVCRPYPALSSMLYLTAWPLVRLAALGTRRGCHANLGVPHQRVGPGDRFSVQIPAREVRPGREESTQEAVSTSYLRKGAISICFRVIVHRGLQIQRTGRTRALAGWSPLASSPGMSRRKHITQNSLQEEVTAPAENESIVRAVGSRGSNIMEVEFPCGRRTLCLIPARFHKKLWIKNGNFLIVEEVEAIDAAVSGQIVKVLYADHVKQLQRIPGVWPEEFRAAGSPAVPDNPSMEQEKREAREPGCLDGSSSEDDGLPPLERINNRRVVEYLVSESDSE

SEQ ID NO: 12969 - protein, 145 aa, Chlorella protothecoides
MAERWLAMHASTNSRFTRASQDTHASLPPEAEEPHRTPPSVRRPVGRSSHLDGISMEMSPGRSERAFRTGNERLYEAYNDLHALAQDFEKPFDAPAILVVGHQTDGKSGGCWRGMGAVSEVIWVQGSTVNAIKNLLTIGSMRRVL

SEQ ID NO: 12970 - protein, 138 aa, Chlorella protothecoides
MLRGEEEGASVLPPPRPSPPPPKPPNTHTGKRDIDDKLHFDIPPHLSLANLKALQEEAGRPASGHSQGSGFAAYFTSLIDPSLTWDCIAWLKSVTRLPILVKVGRGPGRSTPAANCVDDRTAEGLSSSRLSSVARSGV

SEQ ID NO: 12971 - protein, 99 aa, Chlorella protothecoides
MELRRRIDQVMVWGNTQPILPLRRAIWIVTGGIWLCAAYCVAAVGMLLTIVFAPFALQVLRISLFALDGGITLEPYIKTLSFSVQVCTAGGTAGQVLIL

SEQ ID NO: 12972 - protein, 339 aa, Chlorella protothecoides
MFLRPPSRLLEPTMLGGSPFFTSVPSGRVGNSKDAIFRSNEHFRQAVAEREALDVAGNCRDSPSHPRITSPPLPHPPPKRLHTELESRLGRRLGPGERSRIGVGQLRRFAEHLLQRRYLENVPTIVPVLEREYRCAARKLEETQAELNDLHPERLKEKGRVFRESFIAKLALLLRGTVAAPPERFGETLADEHVRGGAFLDPLTNKAIAVEGSLPNAHMRLFGGAQYHRAMAEFRAGELMVLVEFHSCGDGSSGAHGGSACRPWVSLRVVQPHPPHPHPPTCHPPSKGIGEMTCPDISREEIVNACGIDDFHDGVNYTRTACVIAVSKARDLFEPFLHQ

SEQ ID NO: 12973 - protein, 125 aa, Chlorella protothecoides
MAHRSSRSAALLPRSSVRTRGKAGKGEVSNASPRVEDAVQGPGVSAGPEDVEDSEDEEGSETFYGSLDGSGLRIGIVVARFNELVTRPLLAGARETLSRHWVDVDNDVDVRRGKLWWIWPRWLGD

SEQ ID NO: 12974 - protein, 127 aa, Chlorella protothecoides
MAKSGKYDAVIAIGVVDTGVAPTCRASHPSVPSPAGAHCVLSTPQVKGATAHYDAVVGATTSGVLNAAIDTGVPVVFNVLTCDSMDQALDRAGGKVGNKGSEAAATAVEMANLLASMREVGSAAPAW

SEQ ID NO: 12975 - protein, 91 aa, Chlorella protothecoides
MPFPLPQALGANFSGVTSAILSFFPDTARSLRLDTIYPIQGFQRWRDEAAGFELVFPSAWSADLSVRRRLAEDASWQRPSPGLPPLGLAPR

SEQ ID NO: 12976 - protein, 149 aa, Chlorella protothecoides
MRAPRETNTSAPADAMPVEIVQFCHEYTLKRLQALPEVAGAEAKLRMDGGKPYVTDNHNFIVDLYFQEPLKEPHAGVTVGTGLLAGRGLWLLQRCPANVPHSPRPPTFRAAAKAIAAVEGVVEHGLFLDMVDVCIIAGANGVEVRDRKA

SEQ ID NO: 12977 - protein, 131 aa, Chlorella protothecoides
  MOD_RES (103)..(106): Any amino acid
MLPPPWSLTRCSLAPPLQMVEQASAKFVCIVDDSKLVEGLGGSKGAREGCLGHCVWGRGSTILFVLLKRPAAWEVGGSLMLGASKQALPLLLPFLWDRLERCXXXXAAKVRVRVVSVIVCGAVGPGSCLSR

SEQ ID NO: 12978 - protein, 173 aa, Chlorella protothecoides
MQASLSSQAASRSFFTTRPVLRRATQARRALVTRALNMDELKKQAAWKAVEYVKSGDVVGLGTGSTAAFAVDRIGDLLSSGELKDIVGVPTSVRTYEQAKGGRSAVSSSAAPSILCPYPRSTRCPGRGIPLATLSEQPKLDVAIDGADEVDPNLDVVKGRGGALLREKVRRGG

SEQ ID NO: 12979 - protein, 304 aa, Chlorella protothecoides
MGGNCVPLPPRDQDDGPPPGGTRGPGSPLLQQRVFGRHGMLGRDHDSTHIHPLGSHITSTLQCVVGIGCLRRLCRLWCKEQGLAGAATKLKATTRALEPTRTLHSAAYTAGEDMSQARLREALSAGGPTTKDRGPPVSDGTLTVTPDTPEAVEWRARRSIIDSIASCSTYLDDDDDGERGQGCDGECVRTCVIAPARAAGGDEWWREDPVLPCPTLTFPPPHSIHQPRGSVRLLWARFGEEEMTANCRQPEIPHGPPNGGLVAPTNACKAHAPARGPTLGPSLPIGSAHFPLSLQVYPGVPTRL

SEQ ID NO: 12980 - protein, 505 aa, Chlorella protothecoides
  MOD_RES (436)..(439): Any amino acid
MWAAVRVGELCLWRWGGAQRCCGHAGTRAHSRVAWAMAWEALPPPLPLSHPLYTTPRSHTSPPPNMKSQHIPGWSHFAQFTIAVVNRDPKASKYSDTLHRFCKKEHDWGWKKFMELGKVGEGFTVQDSLVIKAQVQILRDRPHRPFRCLDAQYRRELVRVYLSNVEGIARRFVEERRAWLARLLAPPASAGAGEGFRGFWAGLAPPARFELSCDAAGPLLKAAVKRFFNEKEVTSTLVMDGLVAGCKALEAAGRAFLAGGRYETPSGVLIDAVRGVFFFAGDVVAVLEALLGDALPPAPAPDRAAGDAAAGTRAAGEPDDVSRDSVERDERRLADLGRWIMETFAAAEIARLRLEGLGSLSRVHQGVGGLGRGARQHKRLAGDAVGAAERLMAGGRRAWGRLDRGGDHQAPGRADQRGGAAEPGGAAEGRPALRGXXXXEVGAGGGAGGVSVSEVALGVSARASLRWDTDWRMAFLSGDVDCRGFGGLPGTGHGVVHGAVLALLR

SEQ ID NO: 12981 - protein, 343 aa, Chlorella protothecoides
MPLLGVLPGDARFLAAPAARGVTLFTSQDPAPLEGFLAEWEPLLPPPLLQHVLTHLVLPALERALAAWDPLRDTVAPHTWLHPWLPSLGPALEGQWPGVRHRLASALAGWHPSDGSALALLAPWARAWGAGEWEAFLARAVLPRLAAALGAMPVDPGAQDLAPWDWAMAWHGAAPPDALARVLDVAFWPRWHALLALPRVRAHMASALDAMNAAADGRRPGPTAGAGAAAAGAGSAPPGSRSSAAPAPPPPARPPPRGRQPSELSLRELLAAHAEEVGVAFLPRPGRRHLGLQVYLYGAISCAVDAVGGLIHAHMGERGWVPISMQGLDEENERRLAARAAKK

SEQ ID NO: 12982 - protein, 922 aa, Chlorella protothecoides
MLGSRRRLPRFAQCVQYDAYIHFLQRRAAGDVASRKLRPSNTLSGDRPSSAHRSLLHMLAVGNDEEQHSNVTTQTSRLLRSSSQLPEEAASWGTCARCSGPLTGALWTSGLLCVLLSGILFSASSVLVKAIGRHVPVMQIIFVRSSLSMAAGFTAGRLRNVKPLFGERRSWALLSLRGALGSGRLSLGHVIPGSLPTPPPPHATPQHVVSVRGADPAPHGRQREHRVHLPNHHCHPGHTGAERARRPAHAGGLRAEPAGRGCRRPTAHAPRRLGGGGRALDARAGPRRGLCAGRRGDGVGVPGHHPAHRTARAAPHRLHVVPRHQPGVGRGAASGRLPRGTRPAQPPGGGRDGGGGGHLLPRPDPDGQGHPADACGQSGFPQPPPVARPVPLSLQFPEYQQARSRSSQTTQWRPLQVVYANVAGAVLFGEPTTALKLSGGVLIGLGILERRDLGSSWGSVMGPLAADLLGREAATDIRKKPGCVTNSQPDYLTPTSSTVTVPDPFENVTLSQTLPPRGAGWEVARRCMAFPRREGQCSSILDSRMRRGNFDDALGSIGPCIASSRPSIVLPCILYWQIAVGHWHVMCGLLGLVLQRLFRSPQEPRPCLDGGSSMASCSYEASWEQLGESCCGTDAHWAGSRVPMVFEEYFGGVLRALLPTNCWSQLSFSPASSCMHHPLQSSPSTFRPSASSLPTQHCNRQSNSGVPGGAGPATSGQHQHPLPGPGPDRSAGVAGAGRARGPAHPGGLHHLPAGCVHRGAAALPGRHADRAARALDARAAAGRGGRAGRGLPDGGGLCRDSPCRQTNRPAHNVGLVLFCQLLHHPAGCCPVVSRPTLAALPAPSFDPGGHRLDLLPGPAADGPGPAAHACSKVCQCQPHAGMCQCWFWGWDRALAWNCWDTGSVSVALVVLSLVYKEKRQWE

SEQ ID NO: 12983 - protein, 366 aa, Chlorella protothecoides
MYTDPSVVAAPGTAQPSAAAPAPFAAPQHAAHPASAYGAPPATGPAPAYGAPPPTGSASAYGAPPSAGAAPAYGAPPASAAPAYGAPPASAAPAYGAPPQHAGTPYGVPAPVPSAYGAPPQGTGPAAAASYAVPPSAGQQGPYGAPQSAGAYGVPPAATGPYGGHSGAAQYGAAVGGGPKAAYGASAYQQQGPKAEPANPYGGGGGGIPAAYPPTTKAYGNPSGPPQYRGQGAVARDAGPASIMPINSLNSYQNRWTIKARVTHKSDIRRYTNARGEGRFFSFDLLDAQGGEIRAVGWNDQCDKWYEAVETGKVYLVSKASLRNKRGVRCKAWEEGFVGSEPLGGGDGHALIGSRSHCVFLLSSVV

SEQ ID NO: 12984 - protein, 444 aa, Chlorella protothecoides
MAQPADEADFLELLIASERVEEWLEVVQNATLSDTRLIRALKDMLEAVIAKEAYVEEVGTLKAVLEPACRPSFAAPIRRAPHSLGLYQLLLSSSPCCSTPLQARHSRVASRLTAMLKRIGPDQEEAADLAADIIAACSGSAAASGGVRGGPEEVMPLSYWLAEHGDHILHHPIRAGLDLAARYAGGVSITLMEGALGDGVGARLWVAAHILNRSLWTSPWPIPPLGRSGICALPIRPRTAFSAGTLPPPPPTSAPRNPMHRLLAAHPDMVAGRSVLELGAGCGACGLAAARLGAARVVLTDYLDAVLLCLVTSMHLTLGEGPGEGAPQKRRALTAAEAATEGWEAGCAAVRFLDWNAARGPVRAASSEPPPPSVAPPMGPADERFEVILGTDILYEGWMAASVAAVLEERLAEGGGALICCAVREQVGADGGSREQCLASRHAG

SEQ ID NO: 12985 - protein, 224 aa, Chlorella protothecoides
MSTPPPARPVFDLDLTRTRALTGPGLEARAAAPEMPDAKARDASDAGQRLVHRNHASQRGGAQPAPAGAATQPAAQRGDVPDHGQGGRGDRHCRCDCGTHRVPDGPGWPEWSVGMPSHRSPTTLRLHASPACGVGLGYHLSVRGSLAGDVILPLDPPSLRDYTRQITAHRQREWSCRYSRVSGLTYEEAVTSEYGVQSLIDQVCIGVFVGTSVGLPGSSLPAAA

SEQ ID NO: 12986 - protein, 108 aa, Chlorella protothecoides
MQLSRGAIAGILSDGPPQVYTVQCAGERGETMGHRKGHDSVKKVMNPNGQPRYRLMLSDGEFQYVCMLASQLSDLVVNQLQEGCILQITEYICQFVQTKKYVQQIVVV

SEQ ID NO: 12987 - protein, 254 aa, Chlorella protothecoides
MSPPASFSPSPRPPCPLHSLHDGLSRAAKVFRSLDVPPTGEISLDQLRAGARRLGYAVDDDVLESAFVSADLDRSSTINVDEFVVILAILHLLKGPRDEEDVDAATLKAFELATQAFLSFDSSRHGFISRVGVRVRWNEGGQGVARNAGPQDWTRNAHHALARLAGLGSHPRAAHLPIPCRTCQDELESALLEPHLENMPHSPHASATNTIVPLVQQRFLELDRDGNGRITFPDFLACITHWVDEAGEEEAEPA

SEQ ID NO: 12988 - protein, 124 aa, Chlorella protothecoides
MLGQASCGVHAHLQPYLVSTAFRSNARAPKLRRTLCRGLVSAPRAELGEGATVKVTAPITVFHSPKYKDGLLVQDYTGTIVADVSQFQGKTLSANKPWKVSLDAKDPEGKPLKLIIHLVSEGGG

SEQ ID NO: 12989 - protein, 188 aa, Chlorella protothecoides
MPAFPVISTPFHPTPQPPESHPTAHHLHLLLVVAVVGHRGVVGEDIEGILEGEDVLGDRLAVQHLPRLQLQLLHGGLTRAAGRLVGGHHHALDPGQPVQGGHRHQGDDGGAVGVGNDAAAARAVAGHGLRVDLGDDQRDALRHAEGAGVVHHCRAGGGGHGGVLLADGAAGGEEGDVHALEAGIWEGR

SEQ ID NO: 12990 - protein, 726 aa, Chlorella protothecoides
  MOD_RES (580)..(583): Any amino acid
MPTPTGTTLLTGRPTRAPSPCWPRRGGRCRSAACPCCGSPTPRPAWAAWRPRFTVRAREFFVDGGGPCCASRRGCWKATQLGAIGPGWSGQSPAGFPVPDPLSLTYGGCSCHVWQPGPAILGGCTCVRVAGLGPGPDRALAHRAWHPPVCAGNPSRSLKTVAFVGTHGKTTAAWLTRGLLEETGALTGMIGVCGQGVPEACAHIARRHVLPWAPATQGPKQLCLCPAQPARLSRLLLPPPPSPGTIEYAIAEDRLDEEGALWAPEEDDPSADRESSSPFHILPYEGKYGFWGGKAHLVQSLGRVVDRPKRFALFAAGPPPLFTSHAIPGTCRGQAKTVCIVCSWTTTPLVHLHVHLSDAPPPWNLRTPPSVVHAQVPRDHTGPPTPPESAGWGQGPGRHPRRGGAVAPEPHTGRVGAGTGREGGDHGGGIAGRWPSVTPQTDSFQLTILNPVPEIAPDVLVFTCLLDDDLPVGLTPAACCQAIQQAFARLAPGSTAVINVAGKGGGLARDLRGGVCVFLCRHAPGADAARVLCALNPQTNSCLVHTIHSRGGTIHRLPPPHVSPLNHPPVQVITQTPLEXXXXSTLFPFESPPFPSHHADAFGAELAASVAAAGRARVLRMSTAPTPPGSPPADVFAERTKHSIWESEVVVTTPAGRLQVILPLLGAAHVGNALAAVAAGCALAIPLPAVVAGMEGVDVIPGRSEVIDEGQGFSVAVDAARSPAGV

SEQ ID NO: 12991 - protein, 109 aa, Chlorella protothecoides
MSPPLLHTGGVRASGPLGPGALPRHGTGLSPALRTPPATSTSRDSRSGASRAGAAPGSDPSLLVVGPGVLGQHLAKLWMDAHGPGTVAGLTQTDSNHARCVYTLVHARV

SEQ ID NO: 12992 - protein, 239 aa, Chlorella protothecoides
MVQEASHATVVPALLGLMGDFQNPRVQAHACNAIVNFTETCDQDVISPYLDELATRLMALLQGSGRNVQEAALTALASLADCAQEYFIKYYDSCMPLLLHILTHANDRSHHLLRAKSLECISLVGMAVGRERFRAHAHEVMKYMQDAQAAGLEADDPLASYMTQAGARICKTLGQEFIPYLQVVMPALIASVELKPDVTVAAGDDSDVEDEDEDVSWVLKGRRGLDAIGQVPSLLPGAC

SEQ ID NO: 12993 - protein, 110 aa, Chlorella protothecoides
MPNLARSRKCFLPGAGNQSTLYSSMDPAAFAALLQGLLSSENEVRSQAEQAFTELKKYPDTCVPGLVQGLRSNPDPASRSLCAVLLRKVGVVSTVVAVTAAGCCGCASPS

SEQ ID NO: 12994 - protein, 132 aa, Chlorella protothecoides
MQDVPEWHTAEDEKEENAGEGELFEFGQECLDRISFALGGKTLVPVAGTTLTAYMADTGSWEKRHAALICLAQIAEGCVKVMVDEVEKLVALCLLGARDGTPKVRWAACQALGQLCTDLGPDLQVWRGGEEG

SEQ ID NO: 12995 - protein, 98 aa, Chlorella protothecoides
MESALSMFAQLASHIMSVLLQYLGTLHGILAAALAHASTDVRLAAMKATCAFIQELESPAEREKFQALVPALVQTIGHAIQAGDEPAAQVGLRRRAWC

SEQ ID NO: 12996 - protein, 451 aa, Chlorella protothecoides
MTRLGVNHYNSRTLLHRPSMHLRLAIAHAVRGARWEVAGPLLLRFAASCDAAGASSSQAKAYLGAVVVWLSAARPKEAWAVYQDALAVSAFCTSNEAFAAEALFDAYRTAFPAAVAAAVSGNQAFLHLDNQVCGVSGGTVAAVGLSWLRDHGLHCPSNMIPAHSVPGPLRHHSQLARLAKKLGEGPVAEIEAALPGSAVDICSLPASAVAVLYQAARCDSAQRPLKSDSLPRVQSIACIPWQECCATLPVPARTTPKQAKRRALATQLPHSSSTPSSVQSMAASALPSGLSASPGPASPSSSSLPLSKEPSLDAGDRLPKNSRSRSFRPSRSGGGVAEACLARFLGRPGLNLGPAGLEFEAGAGPVSQAVVPASGLEAAGAGRESPWSRGAAAGWGCSAAHAGSHARGPTPARAVLMEAPSSDSSVASDGPVSSDSSSSSRLCSSSSASLS

SEQ ID NO: 12997 - protein, 271 aa, Chlorella protothecoides
MSKSGGLAEADRLFSEGTKLINPSVLALRFKAQWSTATPLFERAGLLYRQHGELAQARTAFERAAKGQERQNSGWHAAKNWEKAGARELEGGGRRGLAAAVLTEIHHSPPHTCLRSRHSSGAVRCSRYRVLQPGCCRTVLWGGPPASSSRRSSQGCQGPRDACTRGMSVTLPVTWHRLAGCMSWSSCGVGVDSCPGSRGVSGVVILAALEQGERPTQAINATQMQLSGWKILGRMAHQETRTGGTRARVTVLQDACPVAVQSVHAHTGTLA

SEQ ID NO: 12998 - protein, 700 aa, Chlorella protothecoides
MGKQLPRIWGSCGAGLSLRSRVLSDPDKTKHHCAQGAHARPERHPTQHAPKRKSQEASYRQGHLCRCFARVWAIRAPAQRLCTHHPDRFRELERASGTVRIVVARRRLTRSVHVSQHVFDTLHDHPSRRLSSIHGAHAVPPSLAFHSSYTRPIQAFNASWLFYEAQISGPKPPWSRIKYRGDAHLDDAVPGGWYDAGDHLKLNFPLGQAVSFLAWAALDFPEAFAAASPANNPVENIRLAAQYLMDCHVGKHEYVGQIGDPDIDHDYWGRPEEQRGSRPTFRWTLATPASDLLGSVAAALAASHLLLKGRDEKMAAELLRHAEELYAWAKEVQGERGRRGGLGLGGVCARRMEVEQRLGVEACRLTACHASHPAQAQPLRHPAAPIETSGCPVAPMQASTTRPTRAQHTSTSPAASWTSSCMRRPGYSGRPGKDGTLMMRWPTGEPPAAAATSSRAGTRSPSQPSTCCWAWRRRERRCLERTNMKPGSRTIFCPPGLTPEAVSWVGGGGERGDDGDWLLETQCSGSVPSSQGATRESHWDMKKSPKGLIVPGFADFGNLRYACNTAFMMALRASYSPSEESKALAWCRQQLDYVLWSTGRSFVVGVGSGYPLRPHHRAASIPAAAAGQGRVWQYHNSPDPNPHVLTGALVGGPVRGDDGYEDARPNFRANEVAVDFNAGYTGALAGVLAMESRSLQISTN

SEQ ID NO: 12999 - protein, 61 aa, Chlorella protothecoides
RLDSDPTPDSSRTFPTQDVHWATVVVDEAHRMKSSGSATRAVLEALPRHWLLLLTGEGGGA

SEQ ID NO: 13000 - protein, 86 aa, Chlorella protothecoides
MTWPKRRRLGLQEWGLPTAIIAAFALKGMHMMYPWQSAALEEGWHGDNLVYSAPTSGGKSLVADLLLIKALGQLRLVRSSRRLRAM

SEQ ID NO: 13001 - protein, 104 aa, Chlorella protothecoides
MPARGLVILPYLSIVQEKADHLSFILGALGCSVKGYTGGLDEHTPLGVGPRRPHRRAVADHRGERVAICSMEKAHVVLDRLTLECRLGMSDGVGSCKPAPLSGP

SEQ ID NO: 13002 - protein, 105 aa, Chlorella protothecoides
MAWNPDQTYPITLGDSILGLEAPEHWTLRYDFKPASAAESGQGRLSVDHATQRASFQRPSSVEGCPSLQFHGKYEPSKDGMDCVAIYDGQGFRLELVQAAVKNLR

SEQ ID NO: 13003 - protein, 372 aa, Chlorella protothecoides
  MOD_RES (18)..(20): Any amino acid
MVAITLWSSIRLHAVLRXXXLMSWGNRTSVRKLERCMADPRRNASGLPMEGMLISALITPPQRDKEQHTTSCCPPDLQINMNSRDPPPARDFPWRLADSGVRCHSITDPAAARPPVFGFGDGFLRSKTHVDPNDGAKDLEGAYYLAPTFSNQCRGHLRPYSSMGEPDEDHFEAAAEQLTLAIAAGNSIPDDELLALYGLYKQGSVGPCTTCKPGFLDIKGRKKWGAWHALSELDTATARDRYVIKVRELLGGPAEGEQAATYIDASPSVSVPTNEVQLPEDDEQWTLRNTLPHMQEGGPLHTALCEADSVVLQRLLEAGEHCINARDGQGCTPLHLAADAGSLQVLCWAWPWQSNACCTCARVGGSLHDCRW

SEQ ID NO: 13004 - protein, 612 aa, Chlorella protothecoides
  MOD_RES (398)..(401): Any amino acid
MRLSPSGLQFSAGHRLAVTTLVKPFRPRRAITTTTMSGSDAPQKLDKSTPDSVWKQVLSPTQYRILRQKGTEPPGSGEYNSITPGGIFHCAACDAPLYSSETKFSSGCGWPAFYDELPGTVERHEDVSMGMRRVEITCKNCGGHLGHVFEKEPTRRAHPQNTRYARVSKRPRTRGIASTLSHSSSGQAKEPLVAGGVPWGGACCVLTRHRRRDTTRMVKLTLIARVRDGQLLAEGLDGEKEEGMYAYKTQAKVRSMAREHDLALPPAMLRCGSCTTVRVWSNPAATNPPLQSLFKQFSTSKPPPRQSVASGDMVFHTLIDEYGVCYLTLTDKAYPKKLAYQYLEELQSEFSRMHGPQVDTVNRPYAFIKFGEEPCAGLPAETSMALDDKLCVVPGSMXXXXSHALSCLQKHLWLLTTSSVWCQGRWTGPCVLTHGRLSMAILPRYTDTFIQKTKKLYLDTRTQRNIAKLNQDIAEVHQIMTRNINDVLAQGERLDSELRWGVLFAAGLCWAWALCFTLYSPKSAHAYCGLLVGRQEERPSPLPTPPLKPLNPPPCHCLTEMQEMSTLLSNDARQFAVKAKDLYHQALLRKYLPWFVTGGIVLLVLVLRLWLY

SEQ ID NO: 13005 - protein, 350 aa, Chlorella protothecoides
  MOD_RES (119)..(122): Any amino acid
MHAVLRIANRVIDAFSRLVMAEAMATVHCSPFPVDNGDLSILEIDSKFKHGQHLWRPLSPSISSGRRLPEGWGPESGALANGHVEVLAQLSQVGNVDEAAWQERFQVLSSQQDVYKIMXXXXPWRCIALEYSHIHPIAVAERFQVLSSQQDVYKIMVIEGELRSRALHLARIRSCTNITNRTVTKGVDFVSHPLPACADTTTERIVATATLLIELKFLRSSGKCGHIEDVVVDNSCRGYGLGLRVTEDAVGWNNWQHCQLSGLALHLLQVDTAAGRSGRGGRLLQGHPGLCRKQCCVLCQGWPCSQGGADGEWEGWECASVMTLMQWLNLKELRNAELITFSCPTQAKYF

SEQ ID NO: 13006 - protein, 351 aa, Chlorella protothecoides
MLDASSSCMAANPACSRGLRRGKGGMRAMPPGPSSTGDAKKGEDVKLEATYAHSTTPRSPALARRHDVANSAAAYAMESVALPAPACDFVTGGGGGGWHWNLCHQAAVMRPPFGIPTPATPANPVPRHQTCLGLDDLCAGVLDACRQRLCFGLRQPGLGHGGGEEGQDGDPGMPPNHGHGDGLRRGARGLGDKGLGADDVQRGHAEEAGGVVDPGGLQHLGRDGHGGVHGVGDDGQPGGGAVPRHARHQRPHDAGVDVEQVVARHAGLARHAGGDHHQVRAEQRRAQRLGAGVRGHTGAGGDVGQVRGHAGCVGNVVQPQLLDVGGPGGLRGVERRETDLGMKSKTSKSTC

SEQ ID NO: 13007 - protein, 128 aa, Chlorella protothecoides
MLGDAWLRRLALATISHHSSKRRVGRIRTSPAPAARAVYRQQQLSFEVFKFGCAADFGHLPKSRSLTHTPDPTASTMAPSAIEVNAVLRPLLLKDLRNQCRARGLTPAGSRESLMDRLQEHMLSTGDM

SEQ ID NO: 13008 - protein, 159 aa, Chlorella protothecoides
MYVRVKRQKTTVFLQVNPTDTVATLKSAIGDLIQQVGDPCTPGRRPAHQGLEAHPHPRLTSALYDAQEPSTQQLYRGSTALTDTQTLAELGVHDDDELGLALKKEGMCGGIVRCGRPLHATALTGTWSHVTLPIFLAPDGTWEALEIMRHEAPSDGVAE

SEQ ID NO: 13009 - protein, 185 aa, Chlorella protothecoides
MAVRLQQVLRRSLRLTSLQGTGPCLGGCIPSPLHIEQLLSARPLQHPAATPEPLPTHTARFLDGRAAAADWHAELARESAHILKVAGRRPGLGVVLVGDRPDSKLYVTRKREACEKVGISERLVQLPDDCSIGDVQRVVGELCADPGIDGVLVQLPLPPDISEERVMESFDPSKDIDGFHPLNMG

SEQ ID NO: 13010 - protein, 231 aa, Chlorella protothecoides
MRGRSTGFVPATALGTLRLLAAGGVELRGASVVVVGDSNTVGTPLAALMRDAGAASVTVVHRTSYSALFADALSPRLAAARVAAAACAPRVPPGPSQAARAADVREEALEHLAGLPGITRTADVLVVAVGYPRLVRASWVKPGAAVVDVGINVEGGRVVGDVDEAGVAGVAGVMTPVPGGVGPMTIAATLHNVVASARDRLLGPREVPQVEPLGGLLRRGDLHYAFPDSRT

SEQ ID NO: 13011 - protein, 289 aa, Chlorella protothecoides
MRWLEEAPDAESLVTEHVGLMGVFFNGAFVAAFLGFFFAQAAKMFTHYYSERKWELERLWGSGGMPSSHTSCVRVECSWTWCMPVRCLRFAQGFWVPQCMGLEWLPPGVAAALCWGQSQNPMTHPLSSFGPQVMGLTSAVGVLQGTSSSYFAMCVVFSLVGKGVMGWHRCVTGRASHGLGPLQGLASHAVVECKQPSSTIAHPAQFTLPTPSPSSSSSLQVMYDATGVRLHAGKQASVLNMIIMELPPDHPVASNVEQLKDQLGHTPLQVAVGAVVGVVTGYITGILYR

SEQ ID NO: 13012 - protein, 87 aa, Chlorella protothecoides
MWTFEQAQTFAGFRTSTNIRMTVIKLLSGVLWVHAPIAPTAECIRLMRELGFPVGYIVLTTYAYEHKVFVGPFSRKFPRAKVYVPPR

SEQ ID NO: 13013 - protein, 226 aa, Chlorella protothecoides
MEEEFGSTSPLRRGAGLRGICIHQRFRFRRLHSRTTAPSPPPHPKLIKTPRPATTRGIDVVRTKIKNFAQQRVSLPPGRHKIVVLDEADSMTGGAQQALRRTMEVHSATTRFALACNTSSKIIEPIQSRCAVVRYARLADAEVLARLLHVAAAEGVAHTPDGLEAVVFVADGDMRGALNALQATARGPGLVDQAGVFRVGGRREGEGGGGERLLGPGRAACDEAVF

SEQ ID NO: 13014 - protein, 183 aa, Chlorella protothecoides
  MOD_RES (124)..(127): Any amino acid
EAARAAAGRAEDRAALSEAEVARLTAALEERRRDAARAERRVALLLRERSGLQAVLSSYDEEYLGGARGEAGIAPQQARLAELEATVEGLHAHVADLEAELERRGAGGGGDVGGKDDVSHAASXXXXRRSWSGAGLEAVVTRVERMTQATRPRRGSWPRRRRAPTRPRRWRSGCAPRARRWLR

SEQ ID NO: 13015 - protein, 357 aa, Chlorella protothecoides
MLALPGPQHVFQYTGDFTCNGVPIVLRQEGGMGRGTGWAVWDASVTLAHWLQHISVEQRLQLLPPGKAFLELGSGTGIAGLSAAACLDQGYAHLSDLPSGAEGERAGWVEGKEAPHPTHNHGGVVTCPPWRAVSCHTRSGTQVSSRVSVVPCDWESVGREALPAAPYALVIAADCVWLEALVQPFINALLTATGPKSKVRPGMVLLAHQCRSQRVDDAFFPRLAAAFKVESVSQRPGEPERGAIDLYIWASVQQHFTVIALASFKRSRSVALTSPALPVGLADGEARLRTPPTADPSLEQGPERGIEQGMHPAVDGVHDVGDGGQPHRGGQRLGQQGQQRLLGRVQRRGEQRCQAVA

SEQ ID NO: 13016 - protein, 246 aa, Chlorella protothecoides
MPYPPTAAAAPAPAAAAPGNEYCALFVALIGEGEAPQGVLSTGEGRVVRAFHRFTLVDQTGRGGDVSKGRRRDQGAVKISCSRADPQARNCHGYRKFVKRSVLEDPGRGLLVGDTIVIRYHIQLVVSTGGALARAGAAPRRGVVVPPPSLGPELACLLDSGEGADVSFEVEGQTMAAHKILLQARSPVFKALLTGPMLEGQGLRPRVDVQGVKLPVFKVLLHFVYADDLPEELQGARRGRGGGVQS

SEQ ID NO: 13017 - protein, 183 aa, Chlorella protothecoides
MLALLPAPVHRPPSCRRAVGRCRSTQGGDNGRPTLPHTPPPRAPPSSSGPEKRGDGIDIDLFEPAGTEEDTTGRRDPSIPTPNLHPLARLLESVDWSEPGTFDGIPKTEYDPLRDGPLRYLGYANEVGEAFGAWLFSGGVPLSYAIAISYVLFDTVDKWQATYRDARAKLSGESVPSSVDVPL

SEQ ID NO: 13018 - protein, 87 aa, Chlorella protothecoides
MAQHLLVAADRFQLIRLRGICEQRLCVSIEEETVATTLALAEQNNALELKRVCLEYVALHLKKVLHSVFSGVAVGLLVGGDGSAPGI

SEQ ID NO: 13019 - protein, 292 aa, Chlorella protothecoides
MLAATRGLLNGRVAPCPMSCVFCHSHDGILLPIRTSNRSCPRPPPPFPGRRGRLRRVRRSTDTPGCASLHVVSHLVPMDTFLARFVPLPGAANIQSWEQTASAVFIAGRWGCLGSLYFESPPPCPCPCKCRLRPRAPALPGALATERGSWGTGWARWGEHRGPQGGVHGVQGGQGGVRTGVGHAPAPRLKKEERKNAATGVRPRARVPAAASRAPSTPRARPRPPPPPACHRPGRGWPARGRAGSAAPPPPARSPPHGTAGSARAPRCPRRSCCRAARAGWGCRAPPRTRTA

SEQ ID NO: 13020 - protein, 599 aa, Chlorella protothecoides
  MOD_RES (26)..(39): Any amino acid
MRRRRVRGTPTPRRPATTAAAAAAAXXXXXXXXXXXXXXAAIVGIAVPLGIIFIIAKTGCMYYCFIWLKKHRAAQAAAQKMDGDWEIDEKRIEIVHRPDGEPWQLGEGSYGKVFKAVKDGVQVVAVKTLRCEEDPLRDQFVREIAMMRFVSRDANITQFYGAVVGAKSLMLVAEYMEGGDLRKAITADVRKRLVWGAGGKGVALDITRGLHFLHTSRVSHRDIKSSNVLLTRDGRAKLGDVGLARILEDQHQSDGFVGTFAWAAPELLMGQRCDERVDIWSLGTVLWEIVTQEMPMRGMLRPPLVPEECPQEVVAIIHACMQHDPKDRPSARAVYNMLLAAPPLAGFEDAASITESSPTSQSPADSMRSSSPDSRPTSPVAVVPGTAGERSGAMSWPAQAFDSAVLGAQGAMRAVSPKLHSVVAQIQKRLRHHEAVAAGGTDRSSPGDSGAEGSVAQEGERQDKSPRSPFEKQDLAGHGMVRGGGALWQGHARGEEAVPAHTTPPQPPAYLPSPRLRYHKVAVNTPFVAVINPFAADAAAGRPAQQNPLPTPNPSAALRPPFHVSSHAPPMHPPGQWRAPNWRSSAASGAIAAGPWPAL

SEQ ID NO: 13021 - protein, 382 aa, Chlorella protothecoides
MRATPHVRRSGWHPPPRLPVETATCANASHSWPLFVSAGASCIAPEPLCTKFYLLPASPFPAISPSHGNEGVHFASHVLGALLGLCDAMTEDMGRSRQAGDVGGEDGHENPFERAPRDVVGSMAMRIHSSAPQAISQCTALLVGWPEHPLTAPYGILNIWSSSTSRIACFRSPLSKSHMSSISIPCTCIRGGVRSGERRGVSATVQASADPALGAPPTVGSGGASRSMKTVGVLGGGQLGMMMAEAGVSRWHDLEGGAEVGGWRHQYVRTLSWHHIGLRLSTWQMYLSLNAAVFVNRIPHHSLLSQATIDLALKVLDPTPSCPASSVAEQVLGSFTDPAAIKEFAKSVDLLTVEIEHVDANALEVRAGYGSGCIASRGKGPS

SEQ ID NO: 13022 - protein, 101 aa, Chlorella protothecoides
TLRAAAPSLTAQYEYAAARGIPTLLVLHGSSYGADNAVHVRCRLCRAEESVPAGEVPRYLRAHARASHGQGGGRPGEAAAEDGPAGWRERERRRRERARGA

SEQ ID NO: 13023 - protein, 105 aa, Chlorella protothecoides
MTEPEPSGRGVRLCLERGLAAAGVAPEEVTYVNAHGTSTPAGDVAEFRAIRAVLGHDGLRINSSKGAIGHLLGAAGAVEAVATIQALRTGWLHPNLNLDEPDEGV

SEQ ID NO: 13024 - protein, 319 aa, Chlorella protothecoides
MIMESSFCWDALTPQADGTPNNGAWESPARAAPGLPIQPTPASQGHENSRIGSKPATCSSMSLERYLEHYSLLTHDTGRVKILNPLEQSMLRMQDLKQVLSINGISQGNKPTRREILDRLPGSALVMPGKGQGDAASPLSSSMLALDAGVVAALPWVGTPTPALLAALSSGACSCCPLPLQRITVRLPAETVGQTPGGSGDIPASVKCTADPPVSAAGAGSPPARAAASLAAAGLWAQVTGNPPSTSPCAPQTAPQAHAPLPATHRPRLWLERGLAELARHSCISAHACDGALLGRKVGGQRSRSPERARLPSCESPTI

SEQ ID NO: 13025 - protein, 329 aa, Chlorella protothecoides
MTPHRHLGLSYRSGTYQRSLNRSFCKAAVEARHAFLIMDAPNLRLADFREAWSGAQAAGYEVWVASLPQRSPQVPGAGVRQGPDAGMPRGAQAAPIVMLRRCAHRGTRRRLSWQLHSPCFRQPVAPDPTPASLAQVCAKHSTHGRSLEELEQLAAGWEELPPGFQPISLQRFMFGGGEVAEVEMESDEGPDHAAARGDAGAGARWTRGGGEAGQMRESVEGAAGGTVASPEAGVGLEPAAQKAAPPGILKKAGALPRRNRHVVWADHAASLLDEDSGFQMPGSRPQVGVKRRWLSGSCRRNWGGEFYADGLPLHRAACHPRKFLLQITL

SEQ ID NO: 13026 - protein, 137 aa, Chlorella protothecoides
MRDRAARPGRCALILRGLPGSGKSAVARLIREAEKAAGTDPPRILSLDDYFLTVGLGADKPRGRLPWARVVETGTADDCISSSAGARHVCGRLTSECVLHGRRCRLPQSQAGLIEFVLARRSRRRWRAARGARGAGR

SEQ ID NO: 13027 - protein, 214 aa, Chlorella protothecoides
MTRARVCVSKQVNRPAGPRSDGRKVLLALGGVHGLLARLPAGGADLVGVVLDVLQGLQHTQCLVHIPAKGQVVDGGVLDDALPVDDEEAAQSHAVGGQHAELGGDLALEVGDQGVLEVAHAALLALCWIGGSGEEGGNGVGPQSPCSSLLIPGRRYPAGKPCSGWQSPRRMLNTVNRNKTTAHPSGSRPGGRTGSPQTHPGSKEARDLRGSVGR

SEQ ID NO: 13028 - protein, 734 aa, Chlorella protothecoides
MVHLVRLQASLSWHVPVGNLSMAPCADRPGDSRQRRHHKGRCPVDPGPGAFVRVSQRACGHCTLADAPGGQLQHTSTHLWPGAFDVYDLPWPWAGQLQHTSTHLWPGAFDGTENTTDVSSSAHFSWVACSSPNSQASAVEMLARPGEGRASSPLLWSQERLDELLQGSPVRDMVVERKQALIAEWADISKLISEHDPAAFPPGGPWSGVRKGFVAMMVATASLGPLSMWRDQVHRSHGGDAAQCLLPPERRVLCAAATASRLGPVWGEGGGRGLRLPFLVGNSTGRHRHQVRRLAPVERVARFASMNRKGMALRHVYTLRTSLTTPSQEGSGPGPEGRATLLRAHVCAGRGHRRAGCRLPRGAGLAGHHRPPVWLEEGDPGLRGAGRSLPVIRLRGGPPSRSCCTMDPILRRRHRAVCQGEEFQRLLETSHEGMAGTTCCRGCQRGHQHQTKTCLVNFERDVIISVENEYEILQLLMSDLRARVQGYSGGIEEDISILQRGDAAPEEKAAAKQRIAERKILLTNMDGVRQRLAPIRGIPTKVGLGQCREAGWVHEAIQYITPLQSSGRRMHAQCWIATPLEHLQAGMQDPNSDIKEIFDAMESIPALPSKLFNRLRDWATGKDDPTWKKILKHLYHSGTTQESSIQGIPGRSSGIGALILEWKAQHRRRGWVHAEYQGVEVSTSLKGKHACSVSSMGWALNTFVTLSCQIHPTRFAQLGMPSKEEAAASQSSSG

SEQ ID NO: 13029 - protein, 343 aa, Chlorella protothecoides
MWQTTGDLAHRHCSTNKPSPPPLSPLLNPCRCPGRRAGTTSGWLATSAWDESGRARAWAARLGGASTVGWWTRGARPLRSTTPTTAPSPSWVPSAFYRGRGKGRASRGRKEQWQLAAAGVCAGTCFSGVPLSARKFQTSCSPTSSCRLVSVLDRVQGGFIGQTLSKFGIAGLYTVSRPRPRMLLPSSVPARALEDHASQPGFLLTPRPMPLFTPSTYTHTHTQQFSLAQVFVYGIGRFLRLSMTNIRMRIPYEDLPNTRRLVALCQVSAAAGTGCAATGGPRPQGLIPASFNLNLVLCPTVLTVPPPSMSTGHLHCKGGGGARPGGGTVLGAHQHLPPAVSDV

SEQ ID NO: 13030 - protein, 460 aa, Chlorella protothecoides
  MOD_RES (443)..(446): Any amino acid
MEVIGIHASSVACIPLFVVYLVTLMHSYTLTTRHGLSPSILGGPVDGRGSVGATEQAPPPPVCVVSRAEGKAPHTSTDLEAGGTAGARGEIPAQAPDTSTPGQSPSAWGRLRLAATSAAACLAEFALQACTVCERPPHHVIVQLRVPRALRVGREESESADDAAGEAACAFLQSVLDARRAEEVCGSAAGRSVPAAAGSGTPRLRLAHVNEEEQPAEVPADAPLLAAMGPLSFCAVTKSLTKCPHHCRGTLHSRHPSPPQNTSFTQPQVCGCAQHAGRHATGPAGGADGGRAPAQYAQRGREDVAPACTVPGRRRDGRAGPGGGARLWQGGRGGGDPGRSGRRAPQPAVAGLVRHHGRHRFRGLHLRGPLLQQGRGLRPQPLRYGMEVRGGQGPLGNALARTSPSAVCLRFPADLHDPVLRWRRLRAASSPPCTPLRRAEITXXXXIAVCRVPSFLCGSA

SEQ ID NO: 13031 - protein, 505 aa, Chlorella protothecoides
  MOD_RES (214)..(217): Any amino acid
MVVVAEEEKRHQQTLSDEEAAWKLRQAAAAVEASRQRAARAQRVARLKARRKEVDLRSWSWNTCCSGLRWHLLGSNAPRTTVSTSPAKEGVGSSFASFGVGVSPTSLDFAFLEGETQEEEVKEDEEEEGEAWPPAEEPVEETTAGDQVAAEPTEDRVEGAASPPTSVAAGAARRADSALTIPDSDYVSAGSSGEEGVPAGRASGGGEGVRAAVXXXXSALAAAARRPASASEEESTARRGSEARDSPPPAASPPQQLPGPALGSRPAHTPATDYERELSAVEEEEARACGMAVDRRGSPGAGQGTASESASGTAAAASQPVSLLHRALQHLRHRLRRLDRESVVAYLAYVAVFVADYSLLALFFPLSMFVYALCSVKPTPRYWRVSLPPFFLFGGGVCVCEEAGRTAGQVLWQSKCHMPAAILCSEDNIWKKRPHNPTPCAGDTGVQRAPHHRAVCLPDSHPPGLLLCDPAAPVHVSLAGSASGPCAAVCARIACRWWAGKSLEV

SEQ ID NO: 13032 - protein, 155 aa, Chlorella protothecoides
MGVEHAPGALPPAAWLACWIPAPRDEERRARTLRPNPIPTFLPTTANPTERKEGGVGDLKYPLVSDLKREISTKFGVLSADGVALRGLFIIDREGIIQHSTINNLAFGRNVDEALRVLQALQYVQDNPDEVCPAGWKPGEKTMNPTKSKEYFAAI

SEQ ID NO: 13033 - protein, 116 aa, Chlorella protothecoides
MAREGAASRDVPPLSDHGGPLCVGSTSVTLAESSRQGLLALLRDGPSDPVPLLRSNDPGAGEGPGASAALYPRFWHMRGDVCSSQPLASNVDGVGASWCALCGVDGGMRWEGEGGG

SEQ ID NO: 13034 - protein, 243 aa, Chlorella protothecoides
MGRHTFVFMRRINIYSSAAFQVFVALPFVYELRQLLDWSCTPTTLTTACGSADDNGPALAHVSLPSAHCTSVSFMDWLKLEDINMSLYFVTVLRRSRAAKPPGQRQPRYSKFFQGTLLFVGLLLLLWVPLLVFSSGNPTYQVPAVVGFGVNVTLVGKPVPGANAKHRTSTRSFPLFAAGDRRVAGEWGGDQAMLGPGMTDYEASQFQLLCASPVGAREFLGLPVMSACWHDPGGAVVTRRWPL

SEQ ID NO: 13035 - protein, 556 aa, Chlorella protothecoides
MPPPSSCSLDSLTDQLEQGLIDLHSLRAWVAWLGLEAGDPSQHDTGHLQRLLTWKVLVLVTVAAKRRSLKYAGAGRDWCRGGRDLMHLSGCLARLEISASLTRILGSFLRWKSQLPAAVRSSRVAGAACPLFWPPTPEDSLRPGLDPREAPRLSRRAAGLLSPRAFLAEGTAVSSLAGSARAAAAEARATLRRWARSALDALDWPRPAPLEASAGPAVPRRHTIAGTPTRGRSVDARPFAPLTSTRGSSPPGPSATGLSSPAPPPPLPVAGQWRAFRFALQDWLESSWQRWNMDLCLLLLLLTAFQATTALALVHVALLGLVMALAPARRTQACRWVLVPALGVMLAGQYSVLVGLPPPLPVLKGANDARHDLLVGQACSHSCFLPGFEVVCSGGRRALSSRRSFGEDRHPSRGCASRHEAARHCRQHGILSPHARAITHHRYNTQVWLGLKDVSRSALWLLFLAYSTAVLQMRYAEWLALADRSSTQRAQREGRAAAAAQAAEASWLLMGNPGDVQQDALPGSLLWQPLTLAAQPAWRWADWARFWMYRCEPRLW

SEQ ID NO: 13036 - protein, 539 aa, Chlorella protothecoides
  MOD_RES (2)..(5): Any amino acid
  MOD_RES (76)..(79): Any amino acid
  MOD_RES (124)..(127): Any amino acid
  MOD_RES (306)..(309): Any amino acid
  MOD_RES (386)..(389): Any amino acid
  MOD_RES (529)..(532): Any amino acid
MXXXXCRCGGPKSIRFWLCSRNRATGVCWGAGGRQGTGTGQRGGPTLADAKYARHPTHLIGTAVHGRGRGRCAGDXXXXVVAEARKALDSGFAVVIGLQVCAGGPVEGREQGLGREEDPLSQTXXXXTWWRPRQDCRDEMLASGPDRCVCGLRVVSLGMEEGMPDSSVDCSDKMLASGMSSTTHMLLHAIALSTRAAHSSHTIYIVPATGEEVARHPDMPSPSLVPGSAKLGAGDEEPESSRTRARLQQAWDSADLPPNFLDQLIDELGGAAGVAEMTGGCWQGACWAGCTGVQSYGGRVEGGTAXXXXVGLGVLESKGMEGGWRVALRWRILAPGFGQSAGESPVLSPKRGYKLPETCCSQHAPGGAKTQGTCGAGRKGHADLHXXXXGRKARVVRDARGTLTYSLRAKPDSAELDSLNIREKAAFMERHLNRHSPQAPPNRSSCTLACTGLQAGGHRVGCRLHRHLPARLGGREEPAAPRAPDHRAALVRRQGHPAAGQEPPRQPGGAQSWAGRSEEGPRPSSNGSXXXXRWGAELG

SEQ ID NO: 13037 - protein, 340 aa, Chlorella protothecoides
  MOD_RES (87)..(90): Any amino acid
MRSWDLSSDALRTSGNKQQGALPCTVTFLFANLEIICAEKPRCRRPSIEKIVEVSDREGQFCRVSPAAAVRHGGLHGASALLHLAPXXXXICAEKPRCRQPWIEKDVEVSDREGQFCRPEDAEWDDGGGEALSSTVFQAYQCCSVAEGQPHPGDIAEPASLAAIPLPPNDYPLDALPAELISSGKLSSLQLEGMRYASGGHALRLRAPPQLAVFGGTCVGTGRGRDRVGMGDRMPNMSGVPTPRPITHPSHTCMPPGQGFFLGDGAGVGKGRQISAIILDNYARGRGKHVWLSTSTDLYQDAVRDLKDLGCHIPVIQNVQVECRRGFGVSSSLFYYVGVL

SEQ ID NO: 13038 - protein, 109 aa, Chlorella protothecoides
MSHATGAYALIDQGELDWKVIVISQADPLAERLNDIEDVERELPGELERIRVWFRDSKLLDGKPANTFGFDDQPVDRAQTLGVINQTHGFWLDLVSGARENTESKSVFG

SEQ ID NO: 13039 - protein, 140 aa, Chlorella protothecoides
MIPGPPLSLQGDNDPVDVVEIGSASAETGGVYKVKVLGVYAMIDDGELDWKVIAIRADDPKADSVNDIEDVEREFPGELQKVYEWFRDYKIPDGKPANAFGFDNKAQNRAFALDVIEETHRFWLDLVSGKRENTEDLSLF

SEQ ID NO: 13040 - protein, 184 aa, Chlorella protothecoides
MAALTTSVFAGVGKAAIAQPRAPTSVRVCWRRGWLEPGVCCGDVEYQTTAIYHAQALGRSFGLRCQVRAPRLYATCVRSSLETEKKVGARLESTLDHEAQALLFGVVLMPEMPGDPTTPDYRVFFNHKSTTVSPWHNIPLHAGDGLYNFVAEIPKQTSAKFEVATVRDDPGGLWCADYIVVCLP

SEQ ID NO: 13041 - protein, 358 aa, Chlorella protothecoides
MAGNLVSAVRSLLPGSRPPAPALSSARPAARLAALEKADAARRAQEARDAERERRRLELERARAERLAAKQAADAEEARERAEAALRKQQEAAARRKQQLEAGKGGAGPKRKEVALAFGAALPPATADAVPRHASQAAAQQARPALHKPDRVRGGCRGVGDCLRWVLLAVGRWDRVRGPCPAWVGRPFPRGWVIVCEGASWRWDAGTVHEPPALPGRAGHSPVHHSVPSLKLHTCTRSTAQENEGPNPSTTALPGAAPTAGAAAVPGAAKPLKKILYNGQQVHGEAGPAKLRLAPAALPQGAQPHGVGLTAGANLQSQGLAPAASRPLLQVWRRVGSDEPNQECMPGCRPGLGQVLVS

SEQ ID NO: 13042 - protein, 121 aa, Chlorella protothecoides
MEMKGQGLYLSRGLSFREAEFAELACPLTPAQIAQYDAAVALWQDTRAALVEALAATGSTRDVWKPYYGAVQRFFKILLVSMKVDGGEDQTDGRGRCQAALGSSGAGLLVEFIQTHAAASV

SEQ ID NO: 13043 - protein, 229 aa, Chlorella protothecoides
MRNAITCPTDRLDTPSLRVHLIECPGIQLQSPWQASRDTDRRRRCPKTLAAPRTLVPQAGRPRAPDEGAVRRPACNGNVGSGRANKVRSGPAAGSQHMGLHRCHGIGLGGNDSRGRQAPRHGCHRNGAEMGSWAGVWVGEVAARPATLAEELRGLALSTPRGRACGRTGGRAPQPSPYKCPITPQGATQCEDDQCDGTVGYGGSPDEAGETTLDAMIMDGDTMDMGAVG

SEQ ID NO: 13044 - protein, 443 aa, Chlorella protothecoides
  MOD_RES (51)..(54): Any amino acid
  MOD_RES (281)..(284): Any amino acid
MHVSRGHRGHEVPSSLGLPTSGQGCPEFAGLCPGAHAGSSHHLIQAHVLHXXXXSALGHMQGAASIFSKPMCYTYNVSAECPAHWTRSTVRALAQAGPGPDVSRPFVRPSPASGACPRRHNPRCSVVNRSLGGGLGGRTPRPPLGGKGWRGSRQPLPSPSSTGQGDAPAAPPGTTREDVVLLDVDGMHCAGCVSRVRKLLEDQPAVRGASVSLATETALARVRLATPSHSSTGSKADELEKSGGEALNGGGGALEALGASLAQVGFSLACVSGFIVLPGPXXXXPGRQPGTGRVSLVCVSGFIVLSGPRAARNAGGVSLGALVGMALALCGFCAGCKEVLPRPASMTGQVDWHPASKQAGPLPSFLGLRPGPRCHAPCSNKVVSPSASFLPSGSSVTNPNPPTPSSDPDGGGIPRDAARGAIPRRPRAPGRHGARAGVEARGA

SEQ ID NO: 13045 - protein, 773 aa, Chlorella protothecoides
  MOD_RES (407)..(410): Any amino acid
  MOD_RES (533)..(535): Any amino acid
  MOD_RES (758)..(761): Any amino acid
MRGMRTRRHQNPKPKLAFLPFLPTGSRSSPLTLAAAQHPRVQLVSGMDERSLAFWALGHGRSGAAPAGGQAFEDFGGSGLRMCSREGWLLRVHSRAVQPSILTPGHLSDTFISSHPTPTSLSFIPPSHPNDVWDGGGKPAPGRGRGLAVRHPADHPHGRQAGGGAGLRGQPDHPPARHLLLLRLLAGGPGAPQLGHAAAAPAGVAGSGGCCGGGGPSAPQCPVARATGPGARTLGKHGVAGGELCWYFGMGLGVTVSVQYLQGRGPLEGLGDWATSSRPWSVQLEAAACASRLPHSLLAALSTATRGLLVAGELRAPEDRAAALAVSRALRWPLLADVLSGLRVGATGVPEGLIACGDNILAAQDPGMCTALRPDVVLQLGGRLTSKRISAFLAASSARGSSAGNDXXXXGGRLTSKRISAFLAASSGRGSSAGNDGAAWWVVDASPHSFDEHGCLAGRVRLPLGALERLLREAGVLVEGAAAAPFTSPYLELWRTMDREVGFLVRQRLNSAPYGEAHIAVCLASCLPRGGRXXXARRTARPTSPRAWPPACPEVGTGGGSPGGKLGGGTVLELQTRNSSHSRHIARVDASADAPGPQPRSPHPGHALYIGNSMPIRDMDMFADGLASSGLIHRTPPPPAFPSPISAQPGVPGGRQPRRQRHRRRAVLGGGVCQWTGHAHHPGRGRPFFSARHQRPHAAAIRQGDLGQGLMDMSWSRPTLGCMLDPSATQTQPRVEHKVLAVKTHPRPRATLAHRQMXXXXLLRSGKETWARA

SEQ ID NO: 13046 - protein, 1005 aa, Chlorella protothecoides
  MOD_RES (553)..(555): Any amino acid
  MOD_RES (935)..(938): Any amino acid
MQELRSLRGGAGWSSPGPAGFSPARGLQPGHTRLAEGPDAHLLHHNARRCRRSHRSAQYRAPCRPITSQASPASSSLYEAVAPHPSRGPPSSDPAEAPQPMPAPSPPPPPVHVHCQTLPPCKDLAAGKEQVEKALDAAVAARAGLPAALIRCEAQVPRTHSALAWLQAQRAGTSGAAAPSRPAPTLYFSPRLSPGPDSAGAAAAACEEGAGAVAGVGAAALWRGAPGEALDAARLHGMQRFTSAAAPRVRGRGGLLSFCFVKPGCLWYFWHLGGWGAGRDPVPAPSVDPAAPSSRSVEVTDVGGALLLACTACWDSKAAPGAGPSATDAGAALATALTTLRDVRSAAAPPSLAAFAGGRGAVSHSPRRAEWEAAVTLAQELLDEESAEGEAAPCTPSLLDPGTALENYIAGGQQGLDDLLEALEGTPALGAPATGGDCGTRDPDCGAAALSKVVLARRSELRLSGGADPLALLASLQARNPRAYALFLELEGGEAFLSCTPERLYSRSGRSVASEAVAGTRARGGGELDLAGWSGAGEGDSLCRPHPFRCQGXXXGLGGRGRHEGPWRGFQVTALACRTLLPGVASPRCITPLLSALPSSPPPGSVENDFWLALDLLQSKKEHAEFTIVRDWVYEVGPVCFGGGRGGDWASTARGVRNTLGRNAINRIPTHGIAGLARHLRHCACGREEDGAEAGVAAAPVRPAVGHPAAGCHGCRLARRPPPHPSRVWKVGGLLQACRERALPWLTFLSLKQQVALRFCTIGRLVHSPHSCSSMDAPLPPPMRRPREASRDMLSSLEPFDRGFYSGPFGWLGGQGAEFAVAIRSALFVPEVQAPEFPGVQALGPTAMRVALYAGVGIVPGSKASLEWAELDLKVAALDRLLTPVPALQQARKRGSQWGIRTSESAPTPPCPYLLASTSSLLLRHTSGAQPECGXXXXQARKRGSQWGVRTSESAPTPPCPYLLALTSSLLLRQTSGAQPECGIRQDLGGGALQAGMLHILYRSG

SEQ ID NO: 13047 - protein, 778 aa, Chlorella protothecoides
  MOD_RES (78)..(81): Any amino acid
  MOD_RES (190)..(192): Any amino acid
  MOD_RES (575)..(578): Any amino acid
  MOD_RES (606)..(609): Any amino acid
  MOD_RES (643)..(645): Any amino acid
  MOD_RES (677)..(680): Any amino acid
MGRGAGGRWCRKLNNEQQSKLTARRGVQACSQTSQHSATGKLSTSPSTSPDMLFLNTYAGRGCKGGEVSAHNWRVWPXXXXPFSQFQMAALEEDTITLFRKRVYDMAGVLGKTVKVCVVEAQAVVLEAGMGGNRHAKGQADPSQTLDHPSRCRADTNPTFPAGVLQWQDAACQGLLRLRGHGALWAYMLXXXGVLGKTVKVCLVEAQSAVLEAGMSGNRHAKGQADPFQTLNHPRCSLGIYACRAYANSTPVIAHIFLAPPCPWSGRLQEEGPPRFYERINNRWEVVIAQSDGQFQQVSFVNSICTTKGGTHVNAVEAQVTKHLLELMAKKHKQATVKGHMVKSYLWVFVNCLIENPAFDSQATVKGHMVKSYLWVFVNCLIENPAFDSQHIHIPLSSAQAKETMTLLASGFGSSCHLSDGILKKVATSGVVDQILRLASFKADKELKKGDGAKRSRLTGSRGLEDPMSSNVWIRPQFIGCWGGWHDITTAQQGRGSHRLTSTFPAPGIPKLDDANDAGGRNSAACTLILTEGDSAKTLAISGLSVVGRDKYGVFPLRGKLLNVRDAGTAQITGXXXXGRSKCTADLQVFWPYPLLTINGKVSGHXXXXMSSNVWIRPQFIGCWGGRDDITTAQQGRGSHTSXXXCRDPKHQADPGAAARKGMYSKWRRGVGWVNCXXXXGVEPNQSVGRDQPLLSLQRFSSLPGCHPQITSHPNLPCDATDLLVAPLASTIACLHDELFRENVGQLGAISIAATRHLNDGNEGGWFGVLAGSEWRHP

SEQ ID NO: 13048 - protein, 290 aa, Chlorella protothecoides
MGGPEATFKLARTAARLGLQVALSSCMETREGLALLRELARAVDVQVFPDMLGLHGLGTDDYVGEALAEPGSRPGGDLPSSARSPEGDRRPRATGSDLQGCAGLAIHCPRVLRHGCESEGGAAGTLVLLHGFLGAAEDWTPVAASLGTRRAVLAPDLPGHGSAGLLTGPVPPSLEQAAADVAGWCATLQQPVTLVGYSLGARLALTLALRHPGACSRLVLVSGSPGIQGQEHAQDGWKGMTWLKQRNRMANPLHAQRRDRPPQCPRRCPGSRTACKPGCCPGGDDEAGAH

SEQ ID NO: 13049 - protein, 479 aa, Chlorella protothecoides
MTSVLHAHAASRASCPLVNGRTSTAPGQCKGPRRHGQTSWRLDAVKYPFAPLIQQLKGTKESQSVQDEHYPETTGRPQPDCPIISCCGGGIFFFCEPARGLGKGCICMHCGGTGYRKQAAPLCIVGGHRCCSGHRCLLAIQFRTPRPLGELGVLLYLQKQFDLGGVQVRGASAGALLSTLVACDVDLEKALASATVRIRRVEAMERKLGLVGLAGQLVGDWLADLLPEDAAQRAHRRGLHIVVTEVPSFRLTTVKRFDSKQDLVQANRTWAGWLAGWTVGGFMTPGPGLRCSNGAAAAPKGARAKIWGCDRPPHTCAQPPSTPAHLPTVASTHIPFFTDGAPSYDYKGQPCIDGSLWDFVFADNSDYLKAEGRAVLVDYVLDSAVQSPFLFSGHQESLKPSPPSTALQFKDDQLSTNRLDFIRLASPDEILSLVGFGYRYASRADEAGEFELALGRLRRSPLSRLVSGGFLPGFLFGSG

SEQ ID NO: 13050 - protein, 339 aa, Chlorella protothecoides
MEAGYSENTSLNVSSAAGPSKATATSKASKKKTIEQTYQKLTQLEHVLLRPDTYIGSTQRQQQQLWVHDGERLVNRAIQVSPGLYKIFDEILVNAADNKIRDPTMSTLRVDVDEGQELPCRSGQCRDPALLVTALRHRPAGSHLWHLPPPCQLNGSIKVYNDGAGVPVEVHKEHGVHVPELIFGHLLTSSNYDDKEKKVTGGRNGYGAKLANIFSKEFIVETCDGARKRRYKQTPTPQQSAPLTPIPSMPLPEGEDAILVSADNTEPRDGQGFGRISLGQDEGARRRIAPTSVVGVVQLGNAWCRKCGCQSVGTSSLLSSRDVMPSSPAANKLWSDPDV

SEQ ID NO: 13051 - protein, 131 aa, Chlorella protothecoides
MWGTLRRHPRQSGIVARRASAQSDHAALADVLEAWSPGRASHAWDELPALSRRVPILLITGEEDEKFVGLQQAMLQRCQPAGTSGIGVQAATILSAGHAVHLERPLELAGAIEAWLKGLECTQQTLRPLEG

SEQ ID NO: 13052 - protein, 222 aa, Chlorella protothecoides
VEAVHLLPLLHKCIVLGDALQRQLLHQIDDVGLAQEAVLEGLDRDGEGGGVEADLALGGHETQQRLDHGLELRGEQLVSLVHDHHARGAQSRHALAGQVQDAAGGGHHHVHRGAQAHDVLAQVGTARGHHDLHTHVPPQLLAHLAGLQGQLTRGYQQQGLDLVARCVDPLQHRDAEGRSLTRAVLGAGQDVAPRQRHGNGLLLDGGGGLETLLIDAHQQLPG

SEQ ID NO: 13053 - protein, 212 aa, Chlorella protothecoides
MGIYEKGFEAPSPIQEESIPVALAGRDILARAKNGTGKTAAFCIPVLERIDTSRNEIQALLLVPTRELALQTSQVCKELGRHMGVEVMVATGGTNLREDIMRLGATVHVVVATPGRILDLASKGVARLGAAGVVVMDEADKLLSPEFQPVIESLLGFMPPQRQVCLYSATFPVTVKAFKDRFLRKPYIINLMEELTLKGITQYYAFVEERQK

SEQ ID NO: 13054 - protein, 559 aa, Chlorella protothecoides
  MOD_RES (350)..(366): Any amino acid
RARAPRARAPPGASGRGVARRRPERRRRRRGQQRRGPTLPPGAGRSAGCAGRRRRGQQHQGRRALRPAPLLPRAGGDGRALAAGPVRARGAQPRRAQPDRARARAEPHVGRAAWGGGRAGAGRSPGGRGATGLPPQAAGAGGEDRLVCHAHRVWVRLAGGRRLHQAAPQGEPGVARHQVLPAVHLPAGPPEPAHPRGVPRPVLPALAAPTGPTHPLAGSAVWAQRPGIAADPGARWVERPLRGVCSLRHAGVRHQGACRGLLSWPGRAHWGTANLAARAKATDEGCARLWTVTAQRDRSRGLAVAPFRRSAGPVPAACARDPARSPPSPSRTARCPMHARDSPWSCLCLXXXXXXXXXXXXXXXXXPPPPPPPQHKTPKQSVTPGHGVHAAFHGTSWDGDVVACLLTGLGAGIECSPAGAPILRFTIRSESQAVMDQLAGQEGELLEVLSGGLAVPVADDLALAGASVAPPAIVKTAAPATTPAAAPTQPESSTYSFLRGVTARTFAVEESEPAQAVDGAAALDLEPAAALALARRLDDAAVAAWRRLRETRRLQAAKA

SEQ ID NO: 13055 - protein, 96 aa, Chlorella protothecoides
MERAWLYYACPLIPLPCRTEAREQLRRQVGTLRFDVRAVAESLPKAEKKEAFAAGKQFLKQTEALDLALRKKDETKALGLLDSTKSALDTVLAKLG

SEQ ID NO: 13056 - protein, 143 aa, Chlorella protothecoides
MYAGAGPAKVVRPAALEGRRAVLGSLLAGVAALSLAGTPRAQAVELEDYRKARETGFDLIYEARDLNLTQAERDGLTQARTDLGATRKRLQQSEKSIDKDLEQWIRKNYWCVVHWKWEGPVVCVVGVVRWKGFGAAMWQRPHW

SEQ ID NO: 13057 - protein, 196 aa, Chlorella protothecoides
MTSTAPFQVGGAGNGPGNEQLINQPSERLPTAFAPQATSKTESDPHPPGIINGGIISTLFDCHGNWTAAIALMDLHATPKPPLTLTYELLVSGEGGDGVGIHASDVLMLWVGGYRQILHRRVTAWCEIAVAWCLPAGQNLLQSHQVTFKEPTPPGVPLVVKSHVTRVQDVQEAGQKAGVQVCRWGHGMSAVRQAWA

SEQ ID NO: 13058 - protein, 40 aa, Chlorella protothecoides
MPSKRKSSACVDYVPALCTHRPSLLPIECAGEVFGLAARS

SEQ ID NO: 13059 - protein, 352 aa, Chlorella protothecoides
MIRIWNAEPMLASMQDMLGSRSFPVGPTRHFLFQPCRGNPGKFMTPTCLGADALPHPWQTNAVHVRHCRCCSRYGRGPLAVQTSPDGAGMGGEGVCHAHGRPSGAPDLHGGPILLCRGPQVRGWSQGGQGRAAPGTATHGMKDALKPGWLMLMPMPHEPGDLLFTCCHPGGQPLHLFQAYSLCIAASSSPEPPTHPNPRRPLSIRYTYSETLGRWGTADLLIGLTYLCRKNPPEHVTTDIARAGQPYGRGADTAAAAASLRELREIRRVFQYCVGMRERRPGPQREYFATALGIGPEAILAQETRAGVLKPSFILARDDHLRAIVLIIRGTHSFKDMFTSLTGAVTGVWVGG

SEQ ID NO: 13060 - protein, 409 aa, Chlorella protothecoides
MGWPRRVKQGPPHARTPMRRCARIHHLHCPPAGQGGPQPEVGVEQRAGPSGPVRPPGGPPRPQHGEHVRATEGMCVGGEEEVTHCPHSYSVAPYRPSHSPLSLSPPQTHTHTCTQAVPDASAHELHCHRHFLLRGLPLLLQAAVEPGGGRQRPARPGPPQVLDRPPPAPQRCSHAAGRRTRPGPAGRRGRAGRDPGLLRAGPAGRHAGRGGGRLGAGAAVAAQRGLGLHLPDGGHERGLLPLLHRVPGAQRPGLLQCAPQGPRQGLGWGHRDAGRKEGGRPRPAPAVDDEIFGEGAALCLNHAEPDGHAALHAVPLAAECGAAARHDVEAEHSAAAPTVSQAYWQLLRVINLPAVKRLAVVLIVCRLGMLPAEAAAALKLLEKGVSKEALAALVGGGAAKRCCQWEGCV

SEQ ID NO: 13061 - protein, 286 aa, Chlorella protothecoides
  MOD_RES (28)..(30): Any amino acid
MLQLSVASVPPCAPVPPTKQRRHQSGTXXXSVASVPPCAPFPTNKAEATSDRDDSQVPSYAQNVPASYTVVDIGGHQMIVEKGRWYEVNRLEDWTWGLASGPVQRPVLQYCVVHASYRLGELLTLCFTGLLLAYGGLDLGAGKHVSSGVTPHSHSTTQAAPGSTIRLGRVLAHKANGDIRFGTPYLEDVAVHAKARWRRAGVHPWLLASQVSDCPNVSLSALLHASSRAQITVFKYKPKKHYRRTNGHRQQLTRFMVTEVLEGQEAGEAPVAVVDENPAAATEEAA

SEQ ID NO: 13062 - protein, 1443 aa, Chlorella protothecoides
  MOD_RES (109)..(112): Any amino acid
  MOD_RES (235)..(238): Any amino acid
  MOD_RES (1170)..(1173): Any amino acid
MHLPHLISPPSPLTLPPEHASAPFSPDRQGREAGHQQGTPGRMAERVTHGYPVGIDVRHWGGGAPECPPSHPEDTQQPQLRTTTRPALRLCGTPVQKRCRGRSTLAREXXXXDFIQALIYRSDFPPPTPCRLMLYVKTSATSHPSCIVSSTASLMQMIVGRHLQLRLSDAIREDKRNVTPFVRCKLNCKLDANDCGKTFAGACKCRPHIGQASSVDQTHLRHEGHGGSSSGHADXXXXDSLPLSEGAVLFGGDRHVLPTPPHEAVPPCHKPPCQPSTRLRRNILLDLIPLKTAWLRRHIYVMRVMAALLAVMLMAAAPVFAQPPGSNAGLPPSATATGLAAQKLTAEIGSALMAEMKYTDVDLLSFLVNTECLEAEFNSFAAFGVGMHPKLFGLDSPSPMGGKKANLSWDIQLWSEEVARDEIGHVRILHEALGADAPFCPQLDIDGGFQQVRETGWVGFRQDCMVLNGLPLIAWYTMDYHPLHHADSSQQKFHTPYTKLPTSCHPQLFNDALGTTNVEWDPYKDDVHFVLSTFALEEIGATGDKGVTGLVAINGNGTVVDLVGGLAQSAGYQAAADRYILWTHRNDTLPEFGKTVNEVMEELTSYRQALTGDVQIDQGLTYRGGINVVPTDGNGVTLSRTPQQVLHILTLGSSNGIGGFFPDGVNGRINTPDPLSPPSSIPSELIAMANAPYTIVSSYKDVEDPFAPSPPGNEGANRHSGRVCTLRSRSPRQPLSPGVAPPPGPTPRPLRTAVPAPHAGRALAGAAASALETAAAAARPAAAAARSPATGGSRAAAAPGRARGGPAGHGAAPPAEPAVPAVPAAPACGPAACPAAGGTGWTGPAGARPGGSGAWGSPAGWPGAGHRPVGNDGPEAPPAADALHWDAWGRPGAALAAGRPAAEGGAPAAGPRIGPIVGAAAHRAAQARCPDVRRPGDRQRRPVHPPAPRHLPTAWGCPARRARGCTPGRDAAGAGPDLGAVCAPGGCARAGPTEGAGMVAAATAAATPARSEVRAEGPSSRLGDPRTRGGHPPAELRGRPGEGVLQGLPGSAAPLHTGCGVGGGGRGTMSGVVGVEEGCIGGGREPGDAGTARGRRASRAWTGELQTNVSQSSLHVGLLARTSTQAGPQGCHKHGPDRLPSERHLPHTPLCKALHSPGMQTPVPNPTSAXXXXCIGGGREPGDAGTARGRRASRAWTGELQTNVSQSSLNVGLLARTSTPAGPQGWHKHGPDRLPSERHLPHTPLCKARHSPGIQTPVPNPTSANHPQNPPVSTTSGTRPAMTRAAPDPHRCLTAASTLSTWPGSGKSAVSAPPFPAPSVLTAGLTCCPAMTPDRRPARAPPTAVRPRASDARCRSRAAKSATTTAAAAACDGPTVLAGVSLPAAAPSPGKRPSPLGMGPPGPRPPPRFLRARAQSRAGAGGPGTAPGGEVIDAGAGPISPAT

SEQ ID NO: 13063 - protein, 72 aa, Chlorella protothecoides
MTWHRLLRPQTPFLLKGTLREYQHIGLDWLVTLYQKRLNGSQMVCQWWGDAPGARNSRDVPLGVRLTSSGAR

SEQ ID NO: 13064 - protein, 79 aa, Chlorella protothecoides
MEAAEEEREAEIDEDEEQTLVADWDTGMATEAYRAQVEAAQAEAREREEAEAAWIQVEEFGKGGGGYTTSGTAMVVLRW

SEQ ID NO: 13065 - protein, 95 aa, Chlorella protothecoides
MDAQAQDRCHRIGQTREGEASLVLSTVQLQAHEEEPAMNNSVALDRPKSFCLNPPSGIHPACSQHTIEENILKKSDQKRQLDFLAIQVGCRILGR

SEQ ID NO: 13066 - protein, 137 aa, Chlorella protothecoides
MNRAIVERLHAVLRPFLLRRLKRDVEKQLPAKHEHVVYCRLSKRQRQLYEEYMASSGTRATLATGNFLGIINCLMQLRKVGGCVGWCGQAAPGLGFMYTSASRAPAASCCSSWHVECRPPHPPPAPPCPGVQSPRPV

SEQ ID NO: 13067 - protein, 888 aa, Chlorella protothecoides
  MOD_RES (738)..(741): Any amino acid
MLGVGLGTSVQPHGGRTCLVRSARPCARPTPRVLAAKCIVAEHRTKETGLGHRVAGMVSTDYVCWCESARQSSAMTLDTTGTLSTMPIVAAGAALSLVASPVCLPAAASEADLVGDGTPTEYIIDDAKVLNRTTRSELGSRLKSLEGTDHEVSRSQEATGYRLEVATVRKLEVEPDAFALGDKLLGKWYGQPDKQGILLIVTTGKDGALTGGPAFVKRSAPDPHPPPLQAVGEDLVDSVVGENIPILTEQEKYNATVLSSVERIAARLEGKEVPAAPQRADTERRRTYKTKAETEQKKPVTSTIVLTLLAISFVMLLHPIQRCLSSHAYCVCVAKDRSRGATLETREVRSWPGRGAGESTGKGTPQHRGAGHNSNTFVTEQIYYNFAYLLSLSPSVSNAETQGYPISSLRAVGPHAACVNALARRNDGGGDACTQESSMVDKACCWTMHGMKTYTCGACARRRRSTGPLPSTTFEQNGEAETPSPSEMIARFQAILAEEKARRERNVITRAYSRVKRVYEHMIFGLGIYMLEPWEMAMVWISLLVMFCLVCSAILHILQNLGAVTLDTPAPWTLLKRALHLVPVTSHSHKGRCILWCGGRGTEGVRVIVRPRPQGITACRVTSTPGISRLGALGQVPITGPAPGWQAPRPRGRGSRPHPLPGTPASQPPDSHAPCGREKVRCGLRAQSQTARPLGPSWHRELIAVTWTPRSDRKSGRRAKRRLHATEAPTTLSASQVXXXXSGRRAKRRLRATVAPATLSASRVEWRTWRGPRWPDPCRPRLQASTRPASSAPLQPGLGTPPRGPPAARRPAGAALHALRPGGTGSGPVKSGGGGVVGPHVVPLLSDLLESGRGQRTAGSARRHSLTAGTIATSRPGDQGACLPVAPG

SEQ ID NO: 13068 - protein, 92 aa, Chlorella protothecoides
MESEPTKRQRPVQGRVGAKSKQALAEIIALRKSGARRVDTFEVKEEEPVYDVVDEDQYAQIVKKRRDEGGAPPEGKTRVLRSVRLPGGDSVN

SEQ ID NO: 13069 - protein, 83 aa, Chlorella protothecoides
MSIERERLEAAAAEEAEGEGDAPAVKKSGKGPQYAGGLVLEPRVGLYDRYVLVLDFNSLYPSIIQEYNICFTTVVRPKVGAVA

SEQ ID NO: 13070 - protein, 269 aa, Chlorella protothecoides
MVMKPVLRRYAFENRGVRPGRQWVLKVRYPATCPALPPGLTGAAFAAVFGANQGLLEALTLKRRLMGPGWLALAAPRAVAPSAQLSWCALEVEVAGHKAVAAAPAGVRPAPPLTLASLHVQTALVTGGAAAEIVAASVVYLPEVDVEAAQQDGWRSARDLRHFSAVCRLGGAPFPVGFEAQVKAVNASEVGRRNGGAVLSCQASERSLLAMLVARLRALDVDVLMGHNIAGFALPILLHRLQHHKDYGTWVEVWKGGAWPRCTNAIARG

SEQ ID NO: 13071 - protein, 291 aa, Chlorella protothecoides
MQAPGMLEALERRRRPGAAPALRGAGGAAQGTADPGAAPAHGQGPAEVGAGRGESCRGHRGSGRGVPIWGHRGRWNRRANVRLVRGWRSVGAHERPYATSTVTVPHPCQHHPCQHRPCPPNPYFLQVRRAQLDIRQQALKLTANSMYGCLGFTHSRFYARPLAELVTAQGREVLQSTVDLVQGALGAEVIYGDTDSIMIHTASTDLEAVTRMGHAIKKEVNKRYRLLEIDVDGVYKRMLLLKKKKYAAIKVEQARGDQAPTEDACCNLSDMLFLVASHAERGAKGAGHRSA

SEQ ID NO: 13072 - protein, 844 aa, Chlorella protothecoides
MTSGGTESILTAVKASRDYMAATRGITSPEMIVAVSAHAAFIKAAEYFGIRLIRVCGVEGRVGGVVVMVRGHRGWLQKREGRDGTSPFTPWHTPQIGFDSTQSPPTHTPTHTQLPVGKDYRLGGRAVRRAISRNTVLVVASAPGFPHGVMDHVTEIAAAAAARGVPCHVDCCLGGFVLPFAARLGRRVPPFDFSVPGVTSISADTHKFGQGHKGTSVVLYRSKDIRCGWFGGGVDWWGRGVPGGKSCKGGTGSAGIAAPARVPCPARHRDTLQLGLRADLTRPCPLSSTPAAHIPQLLPVFSQKVPVHLHHRLDGGPVYLAWVCGVSLRSPHRHGLGLPGAPGGGRLPGSYLRHPRGRRRVPGGGPRHPWDGGPGQPGRQCGGGAQHQQVDREGEGVPDFDGSKISGKDSERPRPEAHTVAGERPDDAARLAPQPAAEPPSGAHLLHRRAHRARHRAAAGGRPGGVHGRGGGRAGDKGRRRDGAHVWRGGGHAGSQRGRALPGRVSGPPAGLLLRPGGGLGAELTPCRCGHSKQAVEAGRARHGSCAAAARPMTDCVLLINTSLTGILVGLQGKRVMRQGPLRCHRDEFCEGRLGKMRGVVGAGCQPGCSTLHLDCHGGGQPRSAHERRNGLAGIRQRGYGQYRRGGESRAPGTQHRHRMYGDCRRLQAFCRATEQHLSCRAGSFVNTDSSVAGVEGVVASEGDQDLLARLRAAGRGNAALRPAPHNVLQVRHIPCSKQRKVVRLMSPLWSLLAYVLRKSREFTFTHPLSNPDTRILRVKISSVMFIRHPCDSLMVQRIISLESHPQGHPHTPLPATMYMGVLAQERFSEPSGDGYTVPRPVST

SEQ ID NO: 13073 - protein, 336 aa, Chlorella protothecoides
MGGKGVTTCARTVCCRAKDASTHATHTTIKTSMAVKSAACTENYNCKDITSWFGVLSTSVRVSTAGKTQIIGSVGGTIVRLGAWSGVQKNSAGTEIRLRVEPWVGKHTSFGGATTAGLKGSQSKRRGESPGERKCGARKPVETCCWVHHAITAGQERPITWVTSGAASEPQSPGRRQLAARLQEPHLLTYLIQSFGGPEGRGSQHDGPLGERHSPPHEGHRCGAYQPRRPPQDPLANPHGDRMAMVLSADSARLPHLNVCSSCFHRLSSTSYTDLSNCTVCSGLSHVAVPHRERVDDGVEFILHLVPSSLIGAGDQRVKVPCTRLFRWGSRFSDNK

SEQ ID NO: 13074 - protein, 526 aa, Chlorella protothecoides
MRPAQGMGQGGNLSRQGCSAERPQEEHLAIRAWCGRPSAPDWTWMSKVQMLGPHHSPVIDAAQEAGELSVRGLRNLHNTCYLNAVLQCAQRDDWVAPFPCWYTSSRMEPGDPDSPPLPQPRQSLASCPGLCSWIVHIIQRLHLPDSSISALVAALVSQLAPAPPHGGRPRPADPSPLLATLRATPSATASFPSGTESDAGEAWSALMSLLESGARQAWAAAPQRPLLHLLGGGPDAGLVPTWALPAYMKDWALASRPPCRGVLTWTSRCLRCGHAWAAPHQPFHLLLLPVPRLPGTGLDGNARCRTSLRECFAQLADVAPGARCGACDARDRGSEGGAPGSATHDPVRRPAPGAVRRPCLVSAPTTLCLQLQRTLWTHRGAVKIAGHVAFPRLFDLQADTGIGTWGHGPEASPECLRQTALKEESRSWSGPQPAVVYDEGAAGDTTPTKRESTCSPGPPAYRLVAVACHSGFARSGHWTAFRRLPGGGASGVWVAAGDERVLRADLQREVLPAEATLLFYEQLIGA

SEQ ID NO: 13075 - protein, 736 aa, Chlorella protothecoides
  MOD_RES (558)..(574): Any amino acid
MSKLTLSCQAACQVHALRWLLLWFCHCNFRACGQQSNRLAASYASGSRFGACPPSLTGSGTSPDFNTGVFVSVFALLMAGESSSFFGGRVFAGERLPRIAAIDRSMLVGRALDPHGAACQEQCVLGRAGAVLAHRVASGPCRAGLVDWGGGAGPSPPPFTPPARFSPTSDQVIDVAGQLLNHGVVELLDVLQQALVVLRHEVDSHALAPEAPAAPDPVQVVLGVVGQIEVDDQGDLLHVDAAGQQVGGDEHAGGAGAELAHDDIARVLIHVSVGGGDGVVTLPHLVGQPVHLAARVGEDDRLGDGQGLVQVAQRVQLVVLHAHVHVELLDALQRQLVALDQDAHRLVHELARQLQCLGGQGGGEHAHLDLGRQELEDVVDLVLEAAGQHLVRLVQHEHADGVGAQRAAPQHVVHAAGGAHDDVHAALQDAGVFAHRGPANAGMALDPEVVAQRAHDLLDLLCQLARGGQHQGLALHQRVVQVLQDARAEGGGLPRSRLGLLDHVQALAEGHDALLLDGGGLLEPVREDAAQQVLVQPHLVEGVEGLGPLRVELGVAGXXXXXXXXXXXXXXXXXGGGGGGGGCKGHQGNTDDGAGEVWRPTAEFEATRPPPAQHPGPVPTHTSAIFSSKALASRPAPVTRADGLGQGPATHLWGGGETNGRARDGWHAVEHRAKETEQAGGGQVSSRHLALQHMQGGDPGTNSDWNSVPLSSKYVHAPWPADLGERDCLVAMCAVD

SEQ ID NO: 13076 - protein, 304 aa, Chlorella protothecoides
MADLRCVPDYRRGARAGQPDPVSLQPGCCRSPFAGSLHTPLFPTLGDWAPIPHTRPGRGAIRNPLAQPAPPASQGVSATLRDFPVPRVALMFLVRGPMPHEGVWADFLRPATVTSSPAAVTDLPWRHFFSLYTHPSPNWTYPATSLFAGTEVPGREQVAWGQHSLIVAERRLLAAALGDPRNARFLLASESCVPLWPRESLYLAAMGHERSFINACRNLRSAKQARQQMVDRYQPGMAIANVTEADWRKSAQVGAGVGTVCSSSGCGGPPRAPPNQICATRHQSPHSQSAVVHADEAPRLHHRD

SEQ ID NO: 13077 - protein, 142 aa, Chlorella protothecoides
PIEIEALLQEDSTVVKRRSAAQTAAKELELAQDEVRRAQERRATGTSPRVEKAAVSARALLLAGAFPLVPANLVPRGTNPAKLYGEHTPMALSPGGTLVMFERRWEGRRGWVVDCGGGWHVSGVEGAPNASATTGDGTGCAC

SEQ ID NO: 13078 - protein, 276 aa, Chlorella protothecoides
MPPPSSTADKGAFVPLKDTQDGYSLLYPFGWQEVTVRGQDQVFKDVIEPLESVAVAVVPTDKQTVSDFGSPAEVAVTLADRVLSAPGQEVRLIKAEKVGGAGVRVAGNRGGGVPGMGSGWGPVRSRVPCGVLARGSPEAPYRTTVLANGTAMACHTCAMDSSCASEQGVQFPGSAPPVHTQRLDTYWKRTPWNLSMNIQPTPSPQSTRDEREYYRFEFVAKGKTFQRHALVAVAVGNGNFYTLVTGSNERRWNKMQDKLNTIIDSFTVGNSYMAET

SEQ ID NO: 13079 - protein, 264 aa, Chlorella protothecoides
MNTTHSGAESLLAVFDVLASSDVSDVLLAMQARDPIPVVAAKLHGHAGWLVGSQAPVLRCRAGRRGQPGGAHRRPARPHSVPGATDHGRHVRRDLRYLGCQTLDPRVPRTCVPPSPERPSNTLSPRTPRARCRMHHCHHISDASLGALALMAPPLHVLDLGWSARVTAWGLKQVIDRCGGTLTTLCVSSTSNTLSLLNVDDGVAHQLCMLCPLLTTLQMVSGGAGGVGDWGWGEWGLRRGACALQDAEAERGPPLLETAVSVDA

SEQ ID NO: 13080 - protein, 369 aa, Chlorella protothecoides
MGLHENLLRGIFAYGFEKPSAIQQKGIVPFGKGLDVIQQAQSGTGKTATFCAGILQNLDYALVECQALVLAPTRELAQQIEKVMRALGDYLGVKCHACVGGTSVREDTRILQGGVHVIVGTPGRVYDMLRRRALRADAIRMFVLDEADEMLSRGFKDQIYDIFQLLPPKIQVGVFSATLPPEALELTRKFMNKPVRILVKRDELTLEGIKQFYVDVGMEDYKLDTLCDLYETLAITQSVIFANTRRKVDWLTDKMRERDHTVSATHGDMDQNTRDVIMREFRSGSSRVLITTDLLARGIDVQQISLVINFDLPNNPENYLHRIGRSGRFGRKGVAINFVSKDDERLLQDIQKFYNTVIEELPSNINDLI

SEQ ID NO: 13081 - protein, 320 aa, Chlorella protothecoides
MSSSSSQNVPVQEASRVPGKSRYQVWRTTFEIDESYVPIKAVGKGAYGVVCSAKHTPTGEKVAIKKITNAFENLVDARRTLREMKLLRYLRHARWRWGLARAWLSGACTLEAGAVLWRAPFNDVYIVYELMDTDLHQIIRSSQPLTDEHFQYFMYQTLRGLKYVHSAGVLHRDLKPSNLLLNASCDLKIADFGLARTSTESNAFMTEYVVTRWYRAPELLLSCDSYSAGIDVWSGVGSPSEELRRAAGESTAAALSRGCVGCILAELLARKPLFPGKDYIDQLKLIIRTLGTPSDEELGFITAPKARTYIRGLAAVQVGD

SEQ ID NO: 13082 - protein, 215 aa, Chlorella protothecoides
MSLCTQCAIVTDTPLPPLSPLSRLLTPQNDTSIGNLGLAAISIKMPHLQCLGLDGSHAWDEQGMACLAVGCQGLISFSAAASRLADMDLCRLLASCRAVEAVRVSNCSAITLKGIQECADVASDSLLLLEFQGVGGAASPTARATFSSWARSSRWELSPKGDALASPGASPSWVYFGDLGRKSRVLDEACSRHSSDVCSSVGSPPPSLAPAATGD

SEQ ID NO: 13083 - protein, 105 aa, Chlorella protothecoides
MQVAQQICSSRGRGRSQGIEDQGARQEDIVLEYTTRLLGRAVDSAAARGRVKPGSKSSVPVAIGPEDILFLVRKDSKKFARVRELLVMQEEIKKAKSVSWMDQGP

SEQ ID NO: 13084 - protein, 571 aa, Chlorella protothecoides
  MOD_RES (125)..(128): Any amino acid
  MOD_RES (323)..(326): Any amino acid
  MOD_RES (368)..(371): Any amino acid
  MOD_RES (504)..(506): Any amino acid
MAGGPAAERRLLAGARAGPGPPGPNHDPRGRVRACVPGMSHWREGVEWAWVFRLLHPHLWVMGRGPGALQPAHPSFAPTPATGPESAGWNLGKRGRSRRHSDASSSSSSSSSSDSSLGDDEDVAXXXXEMLLEPYFMQLDNTYNKLQTLYEYIDDTEVRPWDHGGGWGVVSDASAGPLPGTSVLCHCSACHECDAHSTPCVAHHSLLVACTPTLPGFHQPGTGLQTQSDHQGEAWQGAWCECPWRVERTMHHGGHTASRNGTLQACAAAVHSQPPRPPPADPPTLGHMQMQLVLTSFNASVALVTAFTSLFAMNLEMKPADEXXXXSGRGRCGGVRGPCVCVWRVCAGAGPRATPRAGLSCAEAARPXXXXGAAGCGDPTCVFGGSVRALGTGPPPARDCPVPKQRAPFMRIRRGSGDPPASNLTRACTLWQHQPQTLIPPTQKTTTTGSLRLVPQHLAGLRPGRHLLLRRRPGVRAVQEDPVSQVALGWGPSPPVALAPVFLXXXVSQVALGWGPLPSRRACTRLSGWQQHVTQAWDQGGEDGRARARASAWGSEKSKPGEGVRHRLRTG

SEQ ID NO: 13085 - protein, 255 aa, Chlorella protothecoides
  MOD_RES (64)..(67): Any amino acid
  MOD_RES (200)..(202): Any amino acid
MMLGPCKTIGAVEDPSWPPVADPAALPCTVWSRRLMHTRSGDRRAALLPSCFTHKHTNLLSLSXXXXSRGAALHCVVPPPDAHSLWGLACCIAPIMLYTQAHKPALALSRTQELLDKCNPLGVFDAIATLAVAQNMRDLYRLVLVDTPLAPYFSGALDEGVGYLAGSCGVHARRLTQKVSSKTLMAPSALDASIPTGYVXXXTPLAPYFSGAVDEGVGWLAGSCGSHARRLTRKVSSKPLMAPSALDAAIPTEYA

SEQ ID NO: 13086 - protein, 165 aa, Chlorella protothecoides
MEARHHIRAQQLCCTNLVRCRSALTGRPRDAFPSPDFPWPQPASPYHVLLVTLGSSLLASLCESWDRRKDPNLRRTVKTYRARLPSLYCQRRSNPSSYLSSARHGAFTHCSLPLAEGVVRGYKLGLLTAADYNNLSQCENLEDIKLYLVSRSWLQRVCREEDTAM

SEQ ID NO: 13087 - protein, 325 aa, Chlorella protothecoides
MKHLTLSSRLFTSSLVARSTEHNERRWFVLPQSRCRAAKSKRSPGHLQVMHTLPPPPTIVHRRAPARRLLLQMTDRSTRIGGKNSLTAKWRATMVLSRCEFRGGWCPGSTILNPQQRLPARPLGAGPEKGADSALSHRPEQHSSITAWRDGGRGRCHGEGASGPDQAQLGRASIRETEGGQRAARQAARTFDGWGLKDCHSEFHVPATATSCSVHHASQAYDQHLNMILGDVEEVVTSVDIDEETFEEIVRRSLRNAPLSQRLADEQTNAALPLPQRGWRHLGVTAAQIIGSEGIRAPMPPHLMLSCADQLSRLAVMPAALLWGQ

SEQ ID NO: 13088 - protein, 372 aa, Chlorella protothecoides
  MOD_RES (157)..(160): Any amino acid
  MOD_RES (316)..(318): Any amino acid
MLALMTLGSSSIDTTLDVIYHLKGVIWRGDSVISGIPETLDHLRSLVRAGRGGKQLYFVTNNSTKSRAGYLSKFTSLGLNISADEIYSSSYAAASYLESINFPKDKKIYVIGQEGILVRRRQHTKPVCAQTVRHAQRGMSLLAAWGLKRGAGTQGLXXXXTKRNDLACSLGLEESWVEELELKGFKYLGGPADADHRVELKPGFRLDQDPDVVIGLAQVPSAPARNPPAQSPNWLLTLPSTPPLLPPAQVGAVVVGFDRFVNYYKIQIATLCLRENPGCLFIATNLDAVTHLTDAQEWAGAGSMVGALRVAGDRGXXXSCIKPSADMASARSCALSHHPCCLQKSSSKTLDHMLQQTLHSQLLNHTSSTSKL

SEQ ID NO: 13089 - protein, 444 aa, Chlorella protothecoides
MSNLNTPGMNAATNLTPHRCACIFPHPVYGSKVNLPVMAADRGSRQHSHAGRRSGPRTPTAVASPERAALQPHMAGHTDLINGLGYVGSVPTSLMPWLLRLSHIRSSISGSDTADALQDAACGLLIWQVSCTDLLVAWAFGDIMNYSRKNSMHPSFPTPFKAHHITQAALQEGLVPDDETLMAMAENPGFVGGDRKLEDLRWPDEPLRAALLSEPLGIGEMPVGSSMVYIASGIRLCFIGAHACLRECGRLMVSSPSSSLQQTGSWFSPLHAHTTGGVTVLGVGRFAKKYPAVLQALLKSLVQVVCQYQKTGKHDAGTPSYTSLNPLAFPVSGLIEEEGRARDASGNVYKTIAELQAEEAARRAEGGKQGIRNPNVVAADGKPGSPVPGQPQPGNSEVEEEEPDSTEPKTKEEEAAQKLVAALVKMWREPLTTLSRAGRAFEVC

SEQ ID NO: 13090 - protein, 383 aa, Chlorella protothecoides
MPPMKRRADTQDEDECPSTSAPKTIGQMVEHIGNKQVRSTRFRELKRKEDRRKKAERKKRQAAAEKAEKAGAEPVPKPVPKTIENTRELDETIVAPDDEEVAAEETQDEFAGEKGRILRRGKGRGRWRLNRGALVLGRVFGWRVQLRHTLNHDGTLSRLRYTLNHDGTLSGLPPSTRSPFRGRVLADHFKRVRPPHVLITTCFKPSGIMYKFIAELLEVMMSAYSMHLHGVQWQHEGGVALISPQGRLRDADSPPVIRVSSPPTPLFHTGFPQCHILQAPGFPAEKDRAVCEEPRLLRRGGHQRGQEDDQRHAGDPPARGPHRPVQAIKSEAVDGDLGMWCGALTGMKQACFAWTQDMHRAWLRPWMPCTHIPDTAWLHADTV

SEQ ID NO: 13091 - protein, 105 aa, Chlorella protothecoides
MNIEVLRNTLYKAYLDDFAGLCGRLGGATHQVMGDLLAFEADRRALNITLNSIGTELTRDDRRRLYANFGLLYPNGKGRRVFLRVGARRNQCVSGGTVAGVSLVG

SEQ ID NO: 13092 - protein, 215 aa, Chlorella protothecoides
MRGPRETVAKALALECMRAAKAQDRACYVFAFAGLQEVRELELNMDMKSIHNLLDFLEKTFNGGSDFNSPIKLCLSRLTDAKWANSDILLVSDGELRQPGVEIMRKLAGAKDKLSLRVLVHEFADWASVKKDRSLTFDWDDALGNAARREAGLRLEKMRNAEMKRRRLAERQKGGSGLKGEATKILRMPSKDASSFDEKGPKGKSNQRKAITFDR

SEQ ID NO: 13093 - protein, 123 aa, Chlorella protothecoides
MEKCPPYQAIFSKVCGCQWLRGQGGSEAREGPRAGQEGGDEACLAQVDTRTTLTFNNTLQHFMPCLTPASHAFPTPAQLGAGESVMLDKVLYEEEAKRAMQTFEQQFHYGVFYSYMRLRCVVC

SEQ ID NO: 13094 - protein, 98 aa, Chlorella protothecoides
MCSINVLHHAGGLQFDPETVTISKGDSVTWQNNAGFPHNIVFDEDGVPSGVNVSSLNHEDYLNAPGQSVTSKFDVAGEYNYYCEPHQGAGMQGKVIVN

SEQ ID NO: 13095 - protein, 118 aa, Chlorella protothecoides
MAFPIVSNSDPNSHRGGGWGPLRRAPTQYLDDRGRPGLLRTVLEAQETRGLTRGDDLSRMLPSEVRDWGSICQCRCAGQLPCNLRHVGGPACKGQDGAPGAPALLCQAGRAGAAVLRA

SEQ ID NO: 13096 - protein, 234 aa, Chlorella protothecoides
MEAEAAPLIQALGLVQDTPRVIPEPAPCVSFSGSHAGAHVHVVVNGKCGKHGVDNVGTVPAALTAYLALQAFDPDLVISTGTAGGFGAQGAAIGDVFLSTATVNHDRRIPIPGHESSLRVSEDTETSPACAALRWQGIPVSAQGTAEPVLTRMLVRLGVLLGGFDQYGLGLHAALPTPQLQAALGLKAGLVSSGNSLDYVERDMEIMREHDTSVKVGGEKGRLGGVGGGAKRVC

SEQ ID NO: 13097 - protein, 521 aa, Chlorella protothecoides
MQVSSTALSHRQAPFGAAAGKAKVQFRLPKRVSFGQTISIVTSRSGWEPIPDLHMDWSEGDEWKVSAEVAPGLGSNDSLTPHLLASYLYRDELEYKYVVLGPSGIVEWQTGSNRRLAVDVPGGAAVTVVDEWHGPTQQVSVELPEALQGGRRAWAHGHSCACLHGNIRGLPYSCASTDAGGRTTAATSPSYDAAPESKRAPIGFFGKHRLPASLQRSFAGTQAAKAESASKDLSKKQLKSLLEVGSFGGKGSSAGCTGQFPPTQHTLMCCCCLCSPSTEEGTVHRRPEDRLAGAAAQRCLTSANPDAARTPLCRQTSCPCPSKIAQQYAATVRPSNVCETPFSAVPCHDFRVPCPRPQASAQAWVPSNLIGQNLLAQVRHQGAHEMDVVDGQECAHQRLICLLEMVQVGESEGERVDREYGERSACRTRGRGATPCTTSRGGRVHDGRHADVEEEIKGHYSTQPPAGPMRRPSAGASALHPHTSQNPAPGSKLPRQTLAPLTTRTFPIGVSMVPCRPARVG

SEQ ID NO: 13098 - protein, 494 aa, Chlorella protothecoides
  MOD_RES (173)..(176): Any amino acid
MLKHTRPQAFAGTRRDTDTLQLHVHGIQCDIVRGDETALALEDDGNLLRCWGLPSTLVDRFDARQARSEFSGRGDATDILRFSESIDANTMWLLLDSPLGDSAPVHERTLSDIELDGERYADTLAARADFASSSDTSPSPGQRALGYGTASGSTNVPSIPQPGRHAQPCLHSXXXXSQWKHECPKRTTAWQACSAMLAQQCCGTSRCWSVLRIAVLHNCSADLMAPCQHPISTGAAVPFEYGATLSDSSRVEEPQAPSAPEPGNDDPAFQPTGRVPGNLRLAGVAPTTLRHLKVCPARCRMMGKGSAQVYSSVMTLPLALPTVRLLLDVPARPCDPGPSIQVMLQAARAVRGGGPQLEILMRVRHARQPLFGFLQPEDARHAFFKWLTGLPEEDTGVEALHVAQDLSPGPDTASSLLRVMQRLAASVQVSGRTDAVFVHPFTGVEMRIMRSIWVCVWYACSDGWQRSRWCRHCCTLCSWEWKPPFSYESQIPDP

SEQ ID NO: 13099 - protein, 106 aa, Chlorella protothecoides
MLLTPESSVEAQKAFGADIILPLDELPPYHIADADLEASLGRSHRWMARSLRTHLADPRRQAMYGIVHGGMSIDLRRRSVEYLSALPFDGFAVGGSMGKDRCNGRL

SEQ ID NO: 13100 - protein, 190 aa, Chlorella protothecoides
MRSAQSTTLAEFRRDQVASMVGQQQAKQDGAPPAINRVHSAPRLSQGEDVLPKIVVGICAMDKKARSKQMANIMKRLSRYGEFEVVVFGDDTILNAPVEDWPVVGCLLAWHSEGFPLKKVAWRDDGRGMRDETRPSAGMQRPAGSRPRHRTSHSTGPAVCGPAPALPRERRVCPGPAARPPTGLSQAGGG

SEQ ID NO: 13101 - protein, 207 aa, Chlorella protothecoides
MPGTQHRRTHGAWPCEPHAVALASPPRDPAPAPSAQPPPRSKKSAARVGRIHTPHGVIDTPGFVAVGTNAALKAVDGAWADAEGLQLMFCNTYHLLLHPGPEVVAGAGGLHAFMGRRDRPLITDSGGFQVFSLAYGTVHEEVNELKRSQGPSKHKTGNLMKGVTEEGVRFCSYRWEGGRKGGVWGRLLEPHCLVYLDRNCSLASTLP

SEQ ID NO: 13102 - protein, 212 aa, Chlorella protothecoides
MPTHTRIIVGYGGATLCLATILLVTLAPGNDASLAGTLAATGVCSIFDAVSHPAMYAEAALRPPQYTRVLVLGASLAGVVNNILRIITMAAFDSEADGLANGARIFLALAALWTGACTVLYPLLRRRGLLVEAGPGARLEAGEGEQDPDAEPVEKEGQEGPKPGKEDHAALAVAPGEALQGRAAVLQVICDTWRLCVALILIYMCVGQSWEC

SEQ ID NO: 13103 - protein, 737 aa, Chlorella protothecoides
MRQAIDGKSCMGDWRSDHAQMSCSAIRGVGHRFEAGLVAPQEETSTASAQQPTEKVLALFRRQLAVPHAHSGATLAEWEHAGGAEDPRRKEVLAAHEAAMRSAGEREPFEAAIGEEGAAADTQLLGSYMSYLEFEKKKGDLARCQGLSQWMTSVRPCVAWRACGPRASEQEACRSLFDAVLFPVSHPPDSSPPLPYITAMLPRPQCLYERVLAVFPVTHFLWLQYCSFLESRLLRQQDVNRLITSAYARATRNCPWVGQLWERRIRALHRAGAAEGELAAVYSEALAAHVPVCYLGPREGWEGVMGHRNWDGDRAGGRRAGGAGLRPLFEVQEGAQPAPVAAHRGREAPGDEISGRAGPQLSVGCSWSGGEGERRKTIADPLPAGNLTPETFTPWPELGKLKAVRYVFLITGGPDVSVGFSGVLLRALRDYARLSHPIPTGRSTPAQHRGGRCGRQCCDRHWGGGAGPGPPQSPSSCDMAGRRKPASCTSGATGVSSRTGARPGSSRTGWSSRAFLARHSGHDLKRLRVHSALATLVDHPGSHYHTSSAQSYAEACTQADPILSELASAAAARAQADAEAAHASGAAAPRSARTAKPAAGKAPPILDPEEQKARRQAADPNFKPREKRAPSEAAAGDETKPPHPKRPRQAEQGNAEGGIAVDVASAKEDIQFDSRTAGKEAPLAEKATEPAPTFTAFVKHLAPVVGREQLEELFSGCGGIAEIRFGINPSTKKSKVV

SEQ ID NO: 13104 - protein, 297 aa, Chlorella protothecoides
MGFCTQLDTSWCSDVPCLALDATTPFRLRALRIWIAWCSTGRAKQRGAPDNQLPTRLSRKCAVSSAMPNDEPMAEASSSQSDSEESDGGEIDISEQDASAIMTAEAALESNPYDYEGHANVSTCLAVLKWGLKKGMQNEHRTRFVASCTPCSPSLRSPLCVINTALTLTLTSTPLLLQYISHVRRCGLQAKLKDAREAMHSLFPLGEGIWLEWLKDEVAAFESGSATREDVTRLHELAVQDYLSVNIWLAYLAFISSGVQSGDSAAISEVRDLFERALTATSLHFSQGARVWAAYRQ

SEQ ID NO: 13105 - protein, 253 aa, Chlorella protothecoides
  MOD_RES (82)..(85): Any amino acid
MSLSNEQLEAFERDGYLVIPDFTSREEVAAMRSRALELVAGFQPPKAVSVFDTKDQVPEELGGTSWDSARGMPSTPPTSTTXXXXLCSTPRTRCLRSWGEPVGTRPEECHPHRQPPLPPRQTSKVDQYFLDSAGAISFFFEAGAFDSQGAQVKPKELAINKIGHALHDLDPIFQAWSYSPRVCALAQSLGLRRPLPMQSMYIFKQPGIGGEVVPHQDSTFLFTDPPSVVGLWLALEDATLQNGCLWAIPGSHK

SEQ ID NO: 13106 - protein, 191 aa, Chlorella protothecoides
MMTLFNLGDLAGKGGPTLVPALRWSRQGGILGAVCLRALFIPAFHLAGERHWPGDRLVSQRSSERGSSRGDSAPLGAVGMEGGAHRAEGQGMLIPASCALPPREPADASWSPLSHPLPPLAPPNFAVSAPAGLALCTLGLGFTNGVLTSSAMATAPAHIAPSQAGLAGSIMVLSLDVGLVLGAALSFLWLL

SEQ ID NO: 13107 - protein, 359 aa, Chlorella protothecoides
MKTATGPDTWGTFLTYTGLGSGTLAAWNSFILGADYFESRFPASGCVAGCALDLDSSCTREQLWWRMAALFTGESQALHTQHAPPLPHHSRFPPKHTRTRHAQGQHANRLFTVFYLPVNLSVVAGLTYWHTLLSTRTRIRIGLAGSALGLALVPLLGALPPSGLTLAATLGLLCCVGVTDGLTQPALFAEAAQGPPLLTHALVTGTALAGLAACALRVATKALLPPTPRGLAASAAAFFWVATAWVAGCLALYLTRAQRPREGVEETTPGARTPTPASPPPRVELSPSVHGASEEDAEASLLPRGPAPEAVLRSPYLVPLGTAKAGVGEVRATLRTIWRLSLATCLIYTCEFWRDSEAF

SEQ ID NO: 13108 - protein, 60 aa, Chlorella protothecoides
MAVLTFLLGFSNGLFTSHAMAAGPSHVHPTLSDMAGSVMVLALIVGLNIGAGLSFLWLLE

SEQ ID NO: 13109 - protein, 82 aa, Chlorella protothecoides
MPSHKMCGRPTPHSTQGFAYVEFKTEAGLKAACALDRTDFHGKHIFIAPSNKPKPSAGHDVPDKAPPGDWGDLRGSVRYTGL

SEQ ID NO: 13110 - protein, 272 aa, Chlorella protothecoides
MASRGRAPGGVGHTLFPEMLPSSSSSPGAAEELLRFVGDGEYRRLKLGSEELDWQALEAHFRRSQNALRKKYWMLSKAPMPGTMEATPKQRAERKNWTEEETAELKRLVAAQSGADGESVDWEKLAAHFGTSVQTVKRKHRHAQEHLSLASGTPASTEKGAWRLCRAFLLGEPVWWRGPEGTGVRMRSCVPGRCFDGGEACLPGAHVVDQPPPLRGAVVLCRQPPMSVLAVFGALQPCLTLRHPGPSPALPQNPPLQQASASTTARMCRTDG

SEQ ID NO: 13111 - protein, 69 aa, Chlorella protothecoides
MELLKVGKDKRALKLCKRKVSRTTDGSAREGGGSLVPHTSPSTPLQLGTHLRAKRKREEMSTLLRKVKK

SEQ ID NO: 13112 - protein, 315 aa, Chlorella protothecoides
  MOD_RES (117)..(120): Any amino acid
MCRGGACKFVRIRSFQHLQECSGALSSLCTNLGDKDFHILAKGLSYLGQGCVGHDALARADTSLEHVAPSAELWRALNGRSDGRSLLSFAFLRKGGGRATLAMSGDLLWGRVRPYSXXXXRWALSVFVRLPQKGGGRATLAMSGDRLTRAFPLSGCLHDEVLRPSVCHVSRGRLLMAPYCRLFVRKARNVWRLGMASECTSTPVNCPYSLATTPALPPANHHRFMGYSKSGYIKETSLDILGLSVSAISMEPFEINKDRSTRILLAVECLKAGQKACPADKDGNIGTGNKGKNNFGDYNVGDWNIGEQEMGRRWG

SEQ ID NO: 13113 - protein, 104 aa, Chlorella protothecoides
MADITAVDETIKRLASYKGVRGILVATADGVPVRTTLEQDAAQQYAALATTLASKARSMVREIASDDELQFLRVRSRRGEIMIAPGADKERQYCLVVVQNPVSE

SEQ ID NO: 13114 - protein, 305 aa, Chlorella protothecoides
MRGTRSLALVAPTSILQALHITLASVHTQTPYPPIPHLPSQFLATQVDEDAARVTVAAGVPQRMLLDYLSKYTAYKQPAGWTLPAFSWFIDQTIGGAVATGTHGSSMTWGSLSSQTHALKLVVANGTEVTLTRESHPHLWRAAGVSVGRLGVITELTLAIVPQQAVTRSLETTQFANFTAQMLEVQEDYVAARESGNEDAIKAALFAVDETQLFWFLPNRVIWRTDYSYSDKEPSDVIPNIDPADAATPEVSAQSGPSDDIVFDQAYTDPVRPNAAIRYGTDGWTRFYTIATQNYVRPGTFERRK

SEQ ID NO: 13115 - protein, 178 aa, Chlorella protothecoides
MHTTRTCNVDYIPGIRCPSQVLAPDPANDDACAAPPSPSVLMRKFPQMPQEPINPSLPPQANFQGFFQCDDSTKVGRPADIDELKQLVQSYEHIKAVGVGHSWNKEQFCANTSADSSLNLVMTELLTTVNFIENPSDPTEWGANGPPPNFPIQASQGVGFRGFPWRLVLGSCTCVGPG

SEQ ID NO: 13116 - protein, 706 aa, Chlorella protothecoides
MPLTHSFRHTHAPTHHPHHPTPCTEVLAHASRDTLAVMVGAVFSRLGSLPADLGSQLSSPFAAAAHAAAGGHHLVVEDEVELQGAGAGNAESDAALTAGGNRTEAGDAGSAPAEAVEPAQHSIVSLLPPPSAGGAVAPVTNPVPTDAGSMPTISTTPRGASQDGGASPSTAGRRPGVVGYGPDCVREILAFVIGLIRAKGGGGPAAAPGASAPAASASQDLPLQGLRLLLVVLDAAGPALTRHADLAALLAADLPRAMFEAGADAPPTRLAALCCATLALHARLGARAIVQVEALVRLLLLPLAEGRGGAGPERQRVALEGLLDLCRQPGFAAELYLAADCRVERADLLQDICALLSKTAQPGGGGGGEAWAGGDSAQTLALEGLLALLASLDDVAEGGGASDIDPGVPRLLDSPGHYVDVWTPLAAGLAPPTDQFLDWGGVGSVGPEEGGEGRGEGDSDESRDGGVRTGVAIEGGAGPARAATPTTPRPRATSPADRARAEKRLKSLLASAAEHYNRDPKKGLQYAQAARLLPPTLDPATLARFLRCCPGLNEAAVGEALGERDDFSAGVRAAYLQTFDLAGLDFDVALRLFLDAFRLPGEGQRIDRIMEAFGGAYHAACPGSGLASPDAAYVLAFSVIMLNTDLHKQRTDRQPRMTLEGFRRMNDATNDGEPMPAALLQHLFSVISADPLAITADAAAADQLPS

SEQ ID NO: 13117 - protein, 303 aa, Chlorella protothecoides
  MOD_RES (128)..(131): Any amino acid
MLSRFRSSGHRAPTIDQNTRLGLSLAWGDIGGCSSDDGGRRPGPPAEQRGGHSPRCPARMGRCVHAIHGMHQAIMTPTLISASLAVPLRRQGAIRAPNLAPPCPRRTTRCPRACLLVLRMATRTSPSXXXXGTPSVLCLAPGSSSAPAVVGAGLGDVEPLHLLHPFFEVIRTPETSGPVTGAALGSLRRLIQAGFLAAFPAGVGEAVAALADAVTSCKFEATVPGSDECVLFRILEVLAALVASPWGAALPHDTLLNALQAAYRIGHYQTEKGRATSGERALVSWGSRLAPSAWSVSTSPPRL

SEQ ID NO: 13118 - protein, 327 aa, Chlorella protothecoides
MEGRDPTVRIAVVGDPGVGKTSLITAAATETFPDHPPPVLPPAILPAETVPECVPVVITDTSSRPEDAAALELAVQEASVVVLCFAMDRPNTLARVSRHWIPELRRMAGGAHVPVLLVGCKADARPADHTLQAAVVPILQNNPAVETCMECSAKKLQYVGEVFYLALRAVVHPTAPLFDAQAQTLRPLCSRALKRIFMLCDKDKVGLHGAGVHAEAGASGQNGGGVGCWNARLCSSMSPEECRAPSAPALAPQPFCRPILQDGILNEAELNAFQIHCFNAPLQTEELIGVKQVVAERVPEVLLGAEVIALCCRKTQSFWGKIEGKPV

SEQ ID NO: 13119 - protein, 64 aa, Chlorella protothecoides
MPAVTQLAFPLLVTLIPWSTPAYDGVLVETSKRGLLSLRGFLAKWAYTTATEPEVTLAYALYFG

SEQ ID NO: 13120 - protein, 352 aa, Chlorella protothecoides
MPPWCPPRCSRSWPPTSAWPRWVGVARGDALPHSRMWDVRCRRSVIMGGVRCRCLWCPASRLQMPWACAWQGPACSFPHSGLAIRPLFAEPGPCCRAAGGRPRVLRGAHHVPQVSMMGGAQQYHCAEDQGGVRDDAVVMWRTGDNALVTSPDCEPMWGLKFASQPPRRSAGLSAPPGQRRAWDPAANHHFPASSDPGTRMMLGWSPAAQAPGRDNDTWNVEHSCLHPPLLPHMRPCRAVPPSPPRLECTSAQPLAQVNIVNADLLAKKRGVRIVETVVPSEGAAVLNSLEVAIVSRASRFSSAVNGRGQISVSGAVKSGKPFLTQIGDFDVDLATEVGSPGVERGNRALSLR

SEQ ID NO: 13121 - protein, 132 aa, Chlorella protothecoides
MKRHRASSPGTAARPACRVTGQCGPCCDAAVPEDCPTHASPADTPSSSISLHTQGEVLLVRQNDQPGIIATVASELAKKEINISFMSVGRTGRGADAIMAIGIDGSPDKELLGAISSVRGVQETAALSNLRA

SEQ ID NO: 13122 - protein, 483 aa, Chlorella protothecoides
  MOD_RES (232)..(234): Any amino acid
  MOD_RES (263)..(266): Any amino acid
MGRAVGQRICVMSICTHRAAPVKFEMMLLRGAPVPAGFHSPSRTKYASVPNAVAYSMPRSSCCRKPVTELTGYSTSFGPYHTDPKRSHGRKRVLLGLLHQGESAVDVVASLGQRLGHPSDEVPKGLVLVHYQVSAPHGGTKGCGITGMIGDRFPTAIAAGSGVPSRQGDVILPGAATKWLGTSGGILSSARRREGPPLRQQEQSNIDLVSISERNAASPHDYANKTFTTFRXXXGRRQGNPATDGQDDMGLQRMSIAFGIVTXXXXQEQSNLDLVYRPSPQGRCGKAHEIIREMGGPGAQSSQFIADVPSGAWPTTPLVVRRPGRGGQPPPQPPLRPQVLMGWVGASDRALGKYARVLADWGYPSVRSVVPTAYVLCGQAGACNAWAQSMLDFMHDQGLVQGRPLVLYAFSNGGAAIVASMARICRSEDRCANHVCGVPSAPAVKEGMLGLWKPSASVAPLMDAQHGHTPSPASGTNRCGPGW

SEQ ID NO: 13123 - protein, 828 aa, Chlorella protothecoides
  MOD_RES (38)..(41): Any amino acid
  MOD_RES (153)..(156): Any amino acid
  MOD_RES (177)..(180): Any amino acid
  MOD_RES (248)..(251): Any amino acid
  MOD_RES (269)..(272): Any amino acid
  MOD_RES (800)..(802): Any amino acid
MFWGASSQRYLLMSETSKPPAEAMQASMPMQYTVAAAXXXXSGRDLGSCVSEEVECHELWPGRTESCLQGPPLAPALRPTCEYSFLHPLLSLIPNPSRPVGRRRAVPSRHGEKEGDAARRDHGPRRRHGVLHWHRGLHCLCGRLRCLAHQQVXXXXTRSWQPLSAIGKGEDSQGGYXXXXSTARRGAVSGTHTLLGAFLRRGVPKLEMRNSGGAAPSESLSRTCSRIEIRQLRIIQHVRPTRFDQLRXXXXRNCPIGVPCLSHDTSLYXXXXRRREEGPCQEVQLLQRASRGYAGGLKFANCLLFNTDTMLKLEVVAPGNMNAIVYWFDLHLDDVETLSNGVFVVLCHGTLWVPTPGKEHLVCTRLNTTLPSPSSFTAPPGVLDKAGSESVQPTEPRSGEDQPPSDFEPAPTFQGRRPGWIYGTAKMGTGYYRERDSVATTEERDDGGAASSSQAAAPAESRACAEAAPKDAAADPEASAAEPPHYWGQAMQTLDFCVAVRPGKTVSVVVRREPSRLNFALRQGVGEEVARPPWKEQWGGGASVENPHVQRVHYCELLWLDRDSCRTRACHSGHLLVRRVAFSDLHSALGRCGVALLCDCPTLPPCPPPPPLPPNKVRDFLMRVKSRRFPPIEEDMRMVLAHCGSLILDTAALQQVPGGMGDEGNGRATCRDKGRRCRQTAELKLHGVTGLPRARGAGEDQPDPRVLAGGHSGGHHEACPGVGLSAPVSKWAHCLQPDIAAIWYTTLSARTRIRRSTSRPNSFGHACSHAQLVGVAQSPLAAMSITSLSAARHAERRAAXXXLAGGHSGGHHQACPGVGLRWAYLKRS

SEQ ID NO: 13124 - protein, 206 aa, Chlorella protothecoides
  MOD_RES (186)..(188): Any amino acid
MRFDVEDAAYAATARRDAAFPPRHLAMLADGGKYEAYARALRRAAARLAARDGEVHALDAGTGAGALAILAAKVGATSVVAVDLHEPLADLARQAWHTDGAIPGGMAGLIQSPPGGVCAACASAPSTHPDHLHAFQLQTVAANCVSDRVSVVQRDIACLQRGRDVRALGVNLVVADLFDAGGQGGXXXTRAGRAGAGGEPGGRRPL

SEQ ID NO: 13125 - protein, 669 aa, Chlorella protothecoides
  MOD_RES (159)..(162): Any amino acid
  MOD_RES (451)..(453): Any amino acid
MGVQIPSNMPHPEHSRDVAVKAESGWAGDGEPTFENEEQELSTPVTPSSTCSPPQVRRAILAAQAQAAADPLIMSLKLQDINSRAAAARKAGETPRALGIWLALFAKARAGNLTHPEMHTVHGNASGAALDLELWDLALEHARRGRSLAEASLRRFGWXXXXFWRAGSSQRTNADISQPRAPGSPPEHHDFSAKRRALEPPRYLRPTPCRNGKASDAYIRSFAREGRALLGLGRSREAVTAFEAGLRADPLDPGLRAGLQSAQQRLAEEALAGVCAGGCAGPGLHVLRLGPLYFSGGYPDLIRVCNAPEHLHIWGSAMPLSTSTFGVPLRSQGHSRVLQDIPATNLPRAHPTQTLTAGGGQVLKALTYPEPKQRIAYHPASAPLHRIKTDDMLPLRLLTPFQAENDHAIKDTVNYVTVQVERVKEGLAWGRPTASCTGEASCRGAHHATPXXXGVSPGGPPHAGLVGARRGAGTSSENHSVLHWWSFMQGCSSRNPPMHAPQTDIRMPRRHIKLLEDSYCLSRLQAGVRSAVEAISAGGERDVRVIDLAAGAGVLAATALAAGARHVTAVERWLYLALTAKEILDANGVSRGFGGAPHLQNGAPASLAQPGLLPPHASMCMWPSQPSHRTAPAVPRGPSESGVQAADGPAAGQGCARLRKPDPGPPPAG

SEQ ID NO: 13126 - protein, 416 aa, Chlorella protothecoides
  MOD_RES (327)..(330): Any amino acid
MVGWKARSNTLFSRCVRACVVAWCLGWGGRGGELKIDGPPFPARRGHWGVGPRRSLMPALAALAGNKTDLETLGVAVDVGDTKFVATSGNQFQWVDAWCNNKYLLHTAGFSYSAGGEPAGVSLVVEGAVRRGVHSPHRHSAVSHVTPCILHHASEPGPCRAPSSSLLILSHPESQAPTRHPPFPPVPALKYRLACESLVFKVQSKWVEFYEPGLLPGVHYVALPPYEHEGGDAEKYIKEMGIDPEAPGTKLHSARHDQAPAVGAARHRKAVQESEGKAEAPAVAKAGKEWILKNLQEEVWGWCPDGMRRRGVGHVAHGGTKILTSTXXXXPQESARGGVGLVSGWRASQGCGSCCTWRDQDFDIHQGLRDCQLLSASLYHHFVEQLPALPHRRASHVTGSRPSSDTRSYTFTSSLT

SEQ ID NO: 13127 - protein, 122 aa, Chlorella protothecoides
MPSLGVARASSGGLATRKPLLCSPAHGPMRPGFLAPPARRPRLLAPPPPAALKYRLACGALVFKVPSKWVEFYEPGLEAGVHYVELPPYEHEGGDAKRYVQEAGGAESGWGDEGVHVVAWGH

SEQ ID NO: 13128 - protein, 79 aa, Chlorella protothecoides
MPLLYLYSADDPLTDATKLDALLAQKRALGHDVTARRWASSPHVMHFKNHPEEYLARLSAFLQRVAPARGGTVRIVARL

SEQ ID NO: 13129 - protein, 334 aa, Chlorella protothecoides
MNNFPTLTLPPKPHSALDRLQPRAVSHEEQITALREQLALVYERRELWSQAAQALAGIDLDSGVRLLDGEYRLEKNVRIARLYLEDDDPVAAETYIKKASSLVAAIKVRRWGVRVWGRGHAGRSSYSSQSLLGSIRRTPPDPTSIQNEALELQYRTCYARILDSKRRFLEAGTRYYELSLAGGGGPSRPRNEALELQYRTCYARILDSKRRFLEAGTRYYELSLAGAGGPSRPRVSEEDLGQALSAAITCAILAAAGSQRSRLLATLIKDERTVPSPLRPILEKVYMERILGAEEVVYILRGEWMSGWSWVCFSAARGESNLPAEDTYMQGRAT

SEQ ID NO: 13130 - protein, 834 aa, Chlorella protothecoides
  MOD_RES (310)..(313): Any amino acid
  MOD_RES (494)..(497): Any amino acid
  MOD_RES (618)..(621): Any amino acid
  MOD_RES (719)..(721): Any amino acid
MMVGTVGGGKSLCLRGAGVAWTRSAHPEASHPRHPPPLAGTLTPIVSNPEAATMSESTRGVVRRLAELFPSAIVSGRSRLKVQSFVQLAELFYAGSHGMDITGPAPGATAGAATWEDQVAFQPAAAFQPVMATLCEELEEGEFKGKRGQEQARRRRHHEMGAGRAAPPVPRSRETLSRGCGGEQHLLPQRALPQLRCPLLSANPGPGGGGGGLPLRPAAHDPGPQGPRNQAKGGGTGGEARGGWASLALSSREGHGSSSLGPARISIPCPASAHPGSTAAVCALLHTFMCVHLDSTTAHPLLMQLEWDKXXXXTGGEAQSAWASLALQSWEGHGPSSLGPAHISIPCPASAHPASTAAVGAFLHTSMYVPLESTAAHPLLMQLEWDKGTALIHLLGCMDLADAEQVFALYIGDDRTDEDAFKGKLAWEGEEGGPWTLREPTFNRGPPLRVPFGHQVLAPAATLMRTSWHSTGTPCPPGQKPVVATPSLQDAQLXXXXAPTRTRSRVSWHGRGGKGGPGHCGSQPSPVGRPSECHLGIRSLPQLPHSCGRAGTAPEPLPAWAETCGRDSQPAGRAASFDPASNSHPLLRSARGARPGLRHPAGDVGAERRQRVAVQALXXXXSDVVAFLEKLVTWGRSGANAWQSKRSCKGWHIAARPTAAAATPGLPPRTPTAPTPVARTPTQGHAALRSPAAVLGCCLLELGRVGFRDPAAPPHAASXXXRTSLLPSSHHAPALCALTAERYVPMFSSIPAVPSADLSPWHAALRSPAAVLGCCLVELGRVGFLDPAAPPHAASSMLSNRLRCVQGAGGVVGLEHVPQALMPCMNPLPGGPVA

SEQ ID NO: 13131 - protein, 252 aa, Chlorella protothecoides
  MOD_RES (14)..(17): Any amino acid
  MOD_RES (55)..(58): Any amino acid
MPTPNPPITHPHAXXXXLDPGRGEGRRRGPKHADTRQGPPASQAPVQVDLDVSTXXXXWVGRGSQTSRPAVVSWFCGLGAVVGSGRPRRSGHVQTSRQALTRTAGWSREIRRAIHTPALSPPMPHPYPIHTHRDLWLECARRAFSGLDTDKDGRVDADALLSVLRSKLPAAEVDYAVEHAMVEAGHAGACARFGRGVEEDGLSCGSMWRGLRAGALDPGRGEGRKRGPKHADTRQGPPASPAPVQVDLDAST

SEQ ID NO: 13132 - protein, 376 aa, Chlorella protothecoides
  MOD_RES (54)..(57): Any amino acid
  MOD_RES (186)..(189): Any amino acid
MPTPVYASTSAPKEKGNVFYHPEPTCGFCALYIMGLHAVHWAHSRLPGSIAPPXXXXRATSWAFMLYIGHIAVCRDPLRLRHLHEGGIAAERTAVMTVGVHGYHTTFQDPHGVRRDFSRAPRPSCRPSCRTWKPRVYALAKGKADSSKKASICPASLRRSTASGHLTGSGSSCLHGTCSPLSSSLXXXXGSGSSCLHGTCSPLSSSLLNAQEDERGAPHDKPHQGGLTASLLFNVPIHQRTGRLLEGSAGPDSLHHMSGKGPGAMPPVQGMVQWVGLGVTLQWGMCLDATEHVLIQHHLSVPPFPVQGTGVGPRSRQPTNPIQHAANKISSLVSGGKADDVEWRTSNRCSRCQGRGVCRCEECGGTGRRGPSEEES

SEQ ID NO: 13133 - protein, 140 aa, Chlorella protothecoides
MCVQEIISSQQWHRAVAGYARHGYHSNPVQLPLAGSQHGKTKALEYLHTHPRSEEEIGEQRKAARLALDTSTHGGSDYDRLLRRLEEESKRPDKVGSECGSEWENSFPAECQPRRILEQQGREGQAAVFDSARSRRKGAS

SEQ ID NO: 13134 - protein, 99 aa, Chlorella protothecoides
MRVDIWDVKPKEDLEALDAGLPKNFDSLFELGATLGKGGFGLVRYWGGWGPALLLLHPLSPLASSATPPQQQPMPGDDAGWPPRRQLVRSMLARACASG

SEQ ID NO: 13135 - protein, 295 aa, Chlorella protothecoides
MRGSRSTSSLASLHKQERKERQKRPAPTDPPAAAGPGSPAGRRGAPGVPVWPGSAGASLPASIPEEPESEQGGRRRGGSAALAALGRPSPPARPQGGGEEDVGHARRVTFNAELPSYHAGGEAGPGAGDRRAGSSESDAAPAPESGAAAPGPAASASPVSSWPAGTQSPGAAPPASVDPGAVTVTTPAELSRLMRKMRFRPGEALSAEALCEALHRLGYDLEPSEVSMLLRELDRDADGAIHPSEFVASQLDWGAMQQSNRYGGLCSFWGGSAVHIGWGEARRPLNQRVCGGPVV

SEQ ID NO: 13136 - protein, 245 aa, Chlorella protothecoides
MKSHAPPDLKGPKTPTHPVPRHRCPHLWPDFEDLAAPGHAQLVGAGGHRRLHQAQDWRKGVGIAVAEVHAEAEGVVLHHSPGKGSHGCAARGELGDEDAKRSPPSLPGETCPACTHFMVSPPPGLLLPPFPLELTLLQLFAERGHDGLKSGGGLEGDLVLPGRRPRRGPWRGSCDVHAVAASVEELCQLDKGLDLQSAAPRHDGRGEQLSQPPHDATGRLRHGRRFGVGHDGRQRPCEGGWMTRM

SEQ ID NO: 13137 - protein, 869 aa, Chlorella protothecoides
MGAACIRQSGKDTVNMAARIFWRREGSTCHTDLEQPARPSPSHRCFSSDIMTWTGGENEAWRSACAFVLGTGWDDVDPLEHISNKTHLGISSIPSRACTGCTAYSREISLTQSVAPMANRCEGRGGEGGICRGRGSPKAVGRAFVRAPLRVPQLCPLLHVVADLLVLVVMQDSVTAAAQFGSPVLFNHHHPAHPPQAPQKSYPGPRRAPRMMPPEDHEYPLPDSLSGHRIGIVVARKLGSRERCDHHFIAQDRTRLDHCARSIHWRCFGIFAHPFYRVHRHMISLILTWFLSYSGQNKFALRSLLGREAQKLRIIMSQFSLMDNAMSSQESSPARERQRPLASPSRSSYSAALRQKSCSERIIMPSILVVLIFGVVALMFGPVVGTLRTGRYQPAASAPLTGTALASAEPADAIETREFHAPSHSDRIEGVPAVVDRLVSNSPECRCLGLSLASILSTISSIWHNRDLVEPLADDGHIAVTFANHNHLDFATNWAYHIRKTGCTSYIVGAMDEKILKELVKLNIPTFYMASNLTTNDFGRFTKEFIEMVGSEEGLWLGRAGFMPWPVVAMAVPACFTQAWACRQPWRSFPGQASAICVNKPPGEFCSNSRMLLRLYKGGSSVSFSHRLHYPISLRVARKQPWCRVFWTSASAHSYLTWMRCGCATLSLSSERCEVTSRFTDADMLVSSDLIQTTSIAEGLEDLSGARHGLNIGVMFLRPRALSLVQVREEWVLGEQAVAWSKRLVNSWNTPHNVPHPYHQEWIANMRSDPKGWDQAELTHLFRSNLTVAPNRSDGLLSIYNGKLLGGALPTSLFCSGQSYKEGTSWEGGLRPYSFHASGIASATSGKRSRLREWGFWHVSAWLKGEYAG

SEQ ID NO: 13138 - protein, 227 aa, Chlorella protothecoides
MVEPLADSGNIAVTFVNYNHLDFAKNWAYHMEKTGCTAYIMGAMDEETLKELVKLNIPTFYMASNLTTNDFGRFTKDFLDMGRKKAAMVESFLALGFDTLVSDVDAGRRVFHCAPVMCRQQCQEPLPPHVPCSIFNGKLVGGVLPNSLFCNGNSYMEETSWDGGLRPYSIHASGIHSATSGKRSRLREWGFWHDEPERFTHPVGFLSYDNHVPLELLKEVRDVSWQG

SEQ ID NO: 13139 - protein, 140 aa, Chlorella protothecoides
MNALRLHTPPQFNNRSWTVPGVLPHFKLVNAQLSQLRVALVAAKELGGAAAVLPHLWFGKEFNAWPGFGYLHEPRLKKPFAAPADYTMDLVRMDHEIPNEYREFSFLGKPEATSLLAARVVVTICQVGYMWGQDRWPMRA

SEQ ID NO: 13140 - protein, 259 aa, Chlorella protothecoides
MHPETPPLPPKSPLPPSPPYTHTLAIRASLEQLVLTPSKQLDWERLENLVENGSRAAEFDPGQVWLLADWVCSPAGTGLRASLTAEVTALLDAVAARAARADLAARLRNPGLAARLVPEGRGEAASAARAELLWRLARETSHATTSPLAGVFGTLADLQGERHAPWRSAEAAAGAAAQRPARAQGRLSASRGSRDGGRRAAGADAAGRCSGGAGAGVALGQQRPGNGRGQGGSARILIAEWCPRPWHLCASSGTLKVLC

SEQ ID NO: 13141 - protein, 647 aa, Chlorella protothecoides
  MOD_RES (42)..(45): Any amino acid
  MOD_RES (223)..(226): Any amino acid
  MOD_RES (392)..(395): Any amino acid
  MOD_RES (594)..(597): Any amino acid
MLPLMRCRAAKACGDEQPGQVPPPLVQQWKHRLPVLRRLHQXXXXSLHCPRAPPLYVSQGNTDSLCSGGFTKAADLNPEGGPIFSLIEDERSFDGLTNQIFLGKQARQIVAWVPPRLSLDDKVCGSSVGARGCNLVCFSVRVEGKFPPQSKCCRRGTLGMVWSSIHPSASVGCVGFSHCVLAANSQGPCVHWLSCCVTLNFTKPPQFPPFQVVLGDHKGWVRXXXXLIVVLRHPQLHQPSTIPPFPGSAWGPQGLGEGAGHLQDALALLRLLHPAAGVGPGPRRPPLRGHRQRRPRRHRVPRCQRRRGVCRHRRRLNLVGHEEVSLFLQGGVEGDRAQRRCSGVWDVLVSFSECSGSHLHHCEVEVGSTHFHNPTPTHPSTGRMWSVGKKGXXXXSGGARGGVTLSAGGSGGGQRTAKVFWRVGCFGVILWVQWIPLAPVRGGGGFDTLPQPDPHTSLDRQDVERGQEGRAQVPEDLARRARRSGDCPRAARGDALLRQLRRQHQGLVCRGPGPAHPPGGRALRPAHQLHDGWAGRPPVQRRRRQGVLARGAAGRGGSTVSGCAGAAEGWASSPMRKAGRGDRLQRGHPPCVRXXXXCSWGCGEWGRTVSGCAGPAEGWASSPMWKARRGDWLQRGHPPCVRSLARL

SEQ ID NO: 13142 - protein, 1055 aa, Chlorella protothecoides
  MOD_RES (428)..(435): Any amino acid
  MOD_RES (462)..(465): Any amino acid
MPSFFKAETIDVTILRQRGCGVVWEERGRGRPGMGQGAPAPSWPLGPGLPLRPLLPEHGCCSLVRLGRSLLGLGLEVCGHGVKRGAVLEPGDLVVVEGLVDGELVGRAVGARPGHGQLLARGKGLQAADGDLVKGPHLVVVGRVGKGEGQQALLLQVGLVDPGKGLDQHRGRAQVARLQGGVLARRPLAVVLVAHHDPAHARGLVGAGHVRHAAVLARQLVLHAVHLAVLRVHRADQHVVADVVQVPAVLEPGPRHGDVVGGALAARLDQHQRALHVLPVPGLEGLQQLQAAGLRVNHHLHVGPGGGLVRLLPRVVAAGGQVVARGRLQQDLLPVLAHQRVLLRVEGQVARDGEGSHNLGRHDKGMGGGVAVVPRRKVAVVGGDDGVGYALGHLRPLPLPNAGAAGVGENGATHLDGFRGGGGGGGPXXXXXXXXELISTEGRTGKHGWGSDSDPSSGAPLXXXXGGEELTSTEGRTGKQWWGSGSDPSSGAPLYPSHTHPPPPPKATNPSHLLEHLDQAVALDGGPDLLGTRGDGEGHLGLQARLDGLARDGRGALHVLVGGVGAGADQPGADLGGPARGARGVTQLADAVGQVRGEGPVDLWLQRGQVDLDHLIILGPGVGLQVVAEGVGQVGDLAPVGGHQEVVLAAVEGEHGGGGPDLRAHVADGGLPGAGQRLHAGAKVLHDGPRPALDGQDARHPADDVLGAGPGRGLANQPHPDHLGRLQLPGQARHDIHRVGAAHADGRRAQAAAVGRVGVGADHEAAGEGVVLQNDLVDDAGAGLPEADAVLGPGGRQEVVHLLVGDVGVLEVRHAAILVLALALGSSGPLDQVVAVDGGGHRRLGQARGDELEHRHLGGGVLHRHAVWRQGGGGGGGESMCMISGASVYNAMHGVSCDHFPQWAQAQVADAALDLLALGLVKVTVDHFLGKGQGPVQAAAHDLEAGGEAQGSNPVGETRENPRTLGAAAASNPKYAAPRTFNSPQASSRWRRNGRSRTRQARHGSWAPAATEAAGWNATSTATIQYERAYISTTHLCGHAGAHGEAAIQLAGPSL

SEQ ID NO: 13143 - protein, 104 aa, Chlorella protothecoides
MESVLVGMGTDYDPQRLSASFRDRRLGLTSRSIAVFSKLSVFAAKVALDVAQGKFLERADVRAPELRDLLASLGPAFIKVGQALSCEAGDLVTEGQLSTDWSQA

SEQ ID NO: 13144 - protein, 200 aa, Chlorella protothecoides
MPQGARYAVIAHIVHLVNRDYRAMTRDYYALDFIDPSIDTSPIAPALAAFFDDVLTASVSSLNFKALVDGLGEVLFRYPFRVPPYYALILRSLTVLEGLALSSDPDYKLLAQAYPYVARRLLTDPAPELRCFGGVILGKVGVEGKKGGVDGGNAVLMSARQVGEWQVGSGVHAQGEAAAAVHQSTVAPCSDHWPPLACLM

SEQ ID NO: 13145 - protein, 179 aa, Chlorella protothecoides
MFLSKDLPSPTRHYIVVAARPDLLPPEYLAALATLQDRLPPFPSDTARQLIEAELGRLISQVYSELTPEPVAAASLGQVYRGRLRSTGEEVAVKVQRPGILEQIAQDMVLLRRVISAVDKQPSKLSLFSQPLTPLVDEFAARLFGELDYMQEGRNAERFQALYGTMPQVPETAQACGRS

SEQ ID NO: 13146 - protein, 680 aa, Chlorella protothecoides
MQDATAQMAVLQFISSGLPKTAVPSTIHCDHLIEGTTAPQSERENKYGGVADLKYANITNKEVYDFLASAGSKYGIGFWKPGSGIIHQIVLENYAFPGCLMIGTDSHTPNGGGLGAAAIGVGGADAVDVMAGLPWELKAPKVIGVRLVGKPSAWTSPKDVICRVAGILSVKGGTGAIVEYFGPGVEALSCTGQATICNMGAEIGATTSMFPFNSRQYDFLVATNRREIADLADSFRDNLKADSGAEYDQVIEIDLSTLEPQVNGPFTPDLAHGISELGDAARAAGWPTEISAGLIGSCTNSSYEDMQRAASIARQAIKAGLKAKVPFTITPGSEQIRATIERDGLIEVFEKWKRTEVAKGVANTIVTSYNRNFAARNDGNPATHAFVMSPEIVTAFTIAGDLTFNPEKDTLVGKNGEEILLEPPTGDDLPPRGYDPGEETYQAPAGSNVEVVVDPQSSRLQLLEPFKAWDGEDVEGALVLIKARGKCTTDHISMAGPWLKYRGHLDNISNNMLIGAVNAENGEVNSVKNQLTGEYGGVPDVARAYKAAGVRWVVVGDENYGEGSSREHAALEPRHLGAAAVLVKSFARIHETNLKKQGLLPLTFADPADYDKVGPFDKISIRGLKTFAPGKQLTVAGTRPDGSTYEFPVNQTFNDNQITWFKHGSALNAMAANLKSQAEK

SEQ ID NO: 13147 - protein, 286 aa, Chlorella protothecoides
MPARASAALPCLGGEGEALVRSELGDLATIFKVAPVTGTEDRVFNQLARLIKAYPALPLVAGGALRLQPVWVRDVAQAVFNSMQEEGAAGKTYALAGPEVLTLSQLADLTYHTIREPHNVLPVPESEWGDTFIDGQGEGAPGLLCLAWWCPGAADTAGRRRPAIVHSGTGQRAADRAANLERGWPAEQNLAELASRPLGWLGTKTPFRANPFFSSDSVAELARGDFTLAAATADQPLLTIEDLGVAPRRVTEGHPIEFLRYYRSGGYDMGAVAEVDSAPTPARWER

SEQ ID NO: 13148 - protein, 93 aa, Chlorella protothecoides
MEWIEGVKLTDKAAMARSGLSVVQFVDVGIECSLRQLLEHGFFHADPHPGDWLFRGRSIANGCLISGCGVCLHALPRCHAAQPVVGNCAATGS

SEQ ID NO: 13149 - protein, 106 aa, Chlorella protothecoides
MARAPLHPLPGSHTPSSPFPPLRKGHAAAVLGSTWYIVGGGNNAAGCADMYALDLGGLGRGEPLVWTLVGNTPPSSAIASEGLRWGGDWGGTGGEEGVMTRWRAGV

SEQ ID NO: 13150 - protein, 71 aa, Chlorella protothecoides
MAGCLVSFGGYNGKYHNSVHVYRPEGYVLVKAASAEARGAERGALPAGEGAWLLGCAMCPWGCLVTPVGMA

SEQ ID NO: 13151 - protein, 103 aa, Chlorella protothecoides
AALLCAIHGATVENTLFEDGDGANTFLTGLWTSAFGVVGLALNLRAYDFVSQEIRAAEDPEFETFYTKNILLNEGIRAWMAAQDQPHEKLVFPEEVLPRGNAL

SEQ ID NO: 13152 - protein, 186 aa, Chlorella protothecoides
MAAASALVSPPMDGMVTVTQRGFVVKAGGAAAPPALKSTSAGSLAEPSLLSLGSFGRRTVSPLLTPPASGSLESAAAGGDAGELHLAQCAKLTPGAKRLIKGVVRGLRAWQEPEAAAEGFGGTYFFRDEDGARCGIMKPCDEEPLAPNNPKGFVGRQLGDPGLKPTVRVGEAATREGIWDEGSGTR

SEQ ID NO: 13153 - protein, 576 aa, Chlorella protothecoides
  MOD_RES (274)..(277): Any amino acid
  MOD_RES (377)..(380): Any amino acid
MLRSEQCASAIVPRLQLLISPGPAEEADLAMGSLSRPIVCQEHQLLPWRNSSDDCARNTQLLPWRSSSDDVCSTRIGITALHRHNCRMRCAQIVLLLCVAAATVPGGWGFTHPDECTCGGISAMLRPPECHFEPLQTPHARVDQRLGQVQDRRTPLGGGPVVMDSEWRSRRGGLLPCAAMWMIILQHHAHLSSPCPHSAPHRRTTARGATAIPVERAGGGIALPSPPPRKELGAHILSQHQHPLPDPAWNIDRLTHRPLVPFPPGDDHVPGDGXXXXGSDPAWNIDMLAHRPLVPFPPGDDHVPGDGYVTNVHFSLTGVEGTPPREICDFVHVKEWDFKVCNLEGNLPTYLGGNLSCLPVLEEWDFSRNHMTGGSQXXXXHMTGALARLAAWGGVFKAGVAFTRPDQGGHTAHPGVHRHHPTPGSAEDAGQPPDGKHAGVDGGPQGLGVDQDLCWSICLEPGNTASPIFPPPDNELEGSFPDSYKNVNGRMTQLAIGGNKFEGELDLQHRHGIGCGPWKVWCIRGALVIAAHSIRCSSDRGMRGRSVSPQTYDVPPCVHHGVSRHAVLTHSVLLCS

SEQ ID NO: 13154 - protein, 428 aa, Chlorella protothecoides
  MOD_RES (39)..(42): Any amino acid
  MOD_RES (98)..(101): Any amino acid
  MOD_RES (362)..(365): Any amino acid
MHSAAVSRGMRVAMPSAASALKIVLLAALLGVSSAAVVXXXXAGQLYMLEACNDFQINAEFSTPRSGVSSAAVVVNTHNGETFAYLKPHQTVPPSAKXXXXCSDADPRSDDTLLVTYDCYHQALYGNCNATFMKDYLEELVQNDGGRGDLKTGLHIGTEMEVGDGDGRSYCQISCGRCKCCSAPWDVIQKTGSSRFLQVCTTWMGIMGGCPMFQRARNASPHHVMHWLHPAHLRCACSQSHERGGLFQQPSATPGLLLAFDNAVAATNSSLEATLKRPGYTGTILVPSDAAFEAALAKYPGLLQDPAVLLQVLKFHILPPEPRTRGLWTSPFMAVGGTIFSLYDGTASIKSAKTALPAGLTXXXXLLPLRRRRQHQVSQDRAARGPDCAGWRDRDQADGARQRRDRGAERPARLQDRGHHARQPALAL

SEQ ID NO: 13155 - protein, 62 aa, Chlorella protothecoides
MPGGEKAWLEGWREQEGLGLLSLMYDTMPAQFVSMVITEVGAIPPTSVPVILREQRADGNMA

SEQ ID NO: 13156 - protein, 43 aa, Chlorella protothecoides
MGLMSAWHDASRLQPETVDRYRFPQLIRGWETGFCRFLAARFA

SEQ ID NO: 13157 - protein, 240 aa, Chlorella protothecoides
MVVAKTNYRIESSLEVFYTGGPAALFPDGDRLACACGDETKVLGWQGVCACRSKTCVDTHDEYFQPWQIIDLETGAVLRSLPGVGCALGQGSGTRERTHALAACMLSTLHSSDSEPVTALAISPDGRTIFSASRALLLRAWSAETGKVVQTYVGHKAPVAGIAVDPTGSLLATVSADHSTRGVVGAGLFGPGRPPKPQQTARPLRSASVSGVPAPHSSLMGDERWRLGSAHHCNGVPLES

SEQ ID NO: 13158 - protein, 123 aa, Chlorella protothecoides
MLLVTASDDTEIRVWDLVAKSCRRGQPIPRAPPVHHPSRTLLAHTAAVHAVLKGHFSAVTCLGLSADGWTLVSGSRDGVCIAWNLRSGAKLSTTPVLEAVEALAVLDPGSALAAGAAPAAPAA

SEQ ID NO: 13159 - protein, 297 aa, Chlorella protothecoides
  MOD_RES (9)..(12): Any amino acid
  MOD_RES (39)..(42): Any amino acid
MGWRGQVHXXXXLPGWEGDAGMSGLGQGRCPMPCMLGRXXXXRSAPACSHPPCHSIQPRYKPEPFKIFTESVMNLKFDEEPMYAALISLFEPLLGSPSAARPIQVENAVRVGQKRGREQMEEFRDDAVRRKKVRLGYPASQWISVYNKHAPMKQRYHYNVSNHRLDVHVAKGYADGLYISCVCAAGELWAIIMDAGTGFGDQVYRVAPAAFLPKDWIMEQWDRGYYITAIAGSSSLSSLVVMSKGTKFTQQSYKISDSFPFEWIKKKWREAFHVTAMATSGSQVGGCEGEERACGRG

SEQ ID NO: 13160 - protein, 279 aa, Chlorella protothecoides
  MOD_RES (73)..(76): Any amino acid
MDLLGSSLWDVWNQEGQQLSAQFVACVAVEAITILEALHQKGLETGGQNQGGPTGTLQAWHPCLEVRPASRLXXXXGFEVLWTDETWPAGLRLEARTRAGSQAPCPKRAALPGSLESLYAALPAAHQPHPTITPMQLCARRCEARELPDGPARHTRVQPAVPSGLWAGAALARPQDAHPRQVRPAPRRLPRHHPVRQRARAPGPHAQPARRPRVPGLHPALPAQRPPALAGVPGREQGLPGGQEEDGHQRRGAVQVCMCGGESGRECSGHGDGVEGAGL

SEQ ID NO: 13161 - protein, 136 aa, Chlorella protothecoides
MLRVFGGKAPVQIACARIARSLCSGSRPDAARCRRRGGEGGARMPDQGASLQLAGVCYGTTSGQGRIRAGVPGESGEQGPDSQGDPTLGGKLLRLTGGCLPVCVPLFHAQVALKFEHKTSKGCAPNGAPFEWGVYK

SEQ ID NO: 13162 - protein, 445 aa, Chlorella protothecoides
MTWARGAPGKARNTLEPPPTGLAPVASSLFPRTGCRWRSWLPQSANQGALGQHQDVHRSIHVAIDNVGLAGRVDTVLHAPQFRPRLHATADPVVPVGVQGGVPGAAQFGSPVLVNHHHPAHPPQETDSGPPQSPPHDAPPGQPPSLMGNDPRIPQQRHLCAGCLMGQVPVAREVEEMGVEHAALAVQEVLHALRRNDCLRHRLIVVGTVDCGLGGHYVGCGEGALRGLSACSFSHNSIPTPRRYHPRGSDQLPADPALTQPLRNLGMSTALPGLALGATCPRPTNKPRRTVPSVGASSAAAGPCSTSDPSIQNNVVPTQAPAPAEQLTVISARRRELESQARAALDADSRWWQEGNHPNLITVLTSAQYKAALSSAASGQLVLINYFAPHCNGCRRLYPKFQQMVTCNPGVLFIKVRPAFKSGNLALGGRLQVANGALVMQLPIR

SEQ ID NO: 13163 - protein, 198 aa, Chlorella protothecoides
MLEAIRYSRGSLELLEQRDLPTTTRYISVRGSEDAWRAIRDMTVRGAPAIAIAAVLSLAVELVVQGEGSQFSGAAQASQYIQDRLEYLVSRWVVVGVSGHHGGGGVPAMVGGGGVALAAVVKRGWRYPRDCRPTAVNLAEAAARLGAAAAEAAAAPAATPSSVVETAVAGAEAMLRDDVAANRELGALGADAVARAAG

SEQ ID NO: 13164 - protein, 623 aa, Chlorella protothecoides
MPVRCFWGLGRCLSRPVGQKVGSSPCATIIRTKLVEDRVPGLRGSPRPLPVPSSTRAFHHTPQGPFQEVTDVSTLQSSQSSSEQYGSGEAPATVVGEEACPGVRPSPFSTLSMRSLSASYTSPRLPSAGGTPRGPQPSDSKGLWPVAPADASPGPGCLRNGTTHSQEEPSLEEQASDADGPAMDTDPGEDAVESGNPTRHFWIGNLSTHISRAVLKTVFDKCVLRMGGEKGPVLGVAWCCLGWDGLRLAYAGLAAPPPSLQPPLSSCHPALQVWGRGRCGDLPRQDVCVCQLQDHGRGCSGDGHAAGAGGEAGVEEEGGGSLCDAQAPGAKLFLGVSTEPRRFLMAAACRPIQTPSPRPPPSQIPELTGDRQLLLKYRPVNKAGAKLRALGLGEEGVLSDNLDDRCVVLGFTVEGGSGWFVPRGARGASPLGAQQRCPPSSTRMFPRGALSPRDCPDLGLLPGPPEGLGTAQPRPRTSCLVCEDQAVPAGGVCEACRWSGADKAGSQEPSPRIWLGNITSATTSKALQGVLARFGPLLDAAVFPARIGPLGYAFVKFERLADAVAAFNALNNTVRAWEGPEGAACRGLVLLPAMMMTRRAMPQKGLGGPSVPRAGQWRGCGGE

SEQ ID NO: 13165 - protein, 296 aa, Chlorella protothecoides
MVHRPFIRKAINFVFYRFVFETERHNGIAATCCGRPFSLSPQGPAASRSKPPHPHPPPLELLEILGSIINGFALPLKEEHKGFLTRALMPLHKPKSLPQYHQQLSYCITQVGWKDAGSGQRGEGPEDQIGCPIPLGNGHGLGEGCRGAALPCVPTRWVLAARCALHCKGPPPKILAPSASSQFVEKDSRLAVPVIQGLLKFWPITNSHKEVLFLGELEEVLEWTQAPEFAEVMEPLFRRIARCLTSSHFQVAERSLFLWNNDVIVSQVAQHKEVVLPLVLAALEDNAAHHWNSTGV

SEQ ID NO: 13166 - protein, 357 aa, Chlorella protothecoides
MSSGLLRSMKLKLAGGTPKSGKPDSGAGVGVSGTAPGPVGASTAPPPPGQAPRHAVGPVASTSGRGGVPETDPGHGFPALTEEEMQRRYAGECRPPIGAWIGAQNWEPGAWCGKAVSQGRWGCRPIRLRVIGPQWLPPSPSPAEPLPSFRDVSPGERQALFVAKLHLCSFTFDFSDPASHVHEKEVKRATLLELVDHVNSGSGKFKDALAPDIVGMLAANLFRALPPAREHGPDAFDVEEEEPNLEPAWPHLQIVYEFLLRYVVSGDTDAKTAKRYIDQQFVVRLLDLFDSGARGGGAWREGGKGGCWLCSRGGYTATGGPDACAPRRSIAKGDPAAVHGRTASGPPSVLAMRRCGW

SEQ ID NO: 13167 - protein, 274 aa, Chlorella protothecoides
  MOD_RES (140)..(143): Any amino acid
MALRSLARFALSRRVADACFQQATKLQVAVQGPPALTSLLWRRTASSLLQEASASTSTPAFGTEADLVVPLLNQRGRQVGTYTLGGDVFNTEVRRDILHRVVRWQLAARQQVGEGLGGLGRHCRSLQVSEHAAAVCEPAXXXXWVGTVAACRCLNMPLLYVSQQSSRVHAWTQRCTLKQHCSLTPLCHRAHTRPRRGRRCGAAGGSPGPRRAAAFPARVRSARHSGEAAASRMALSHEVTPSSCSNASGGWASAPPCRCAEGGGALQASLSCTA

SEQ ID NO: 13168 - protein, 96 aa, Chlorella protothecoides
MATPRIPTRHIAEPLPLSRLAPGNFPQGNLAEARKMTADVPQASRPLLLPALHASLWLDRLAAVGHDVFDPALQISPVSPLGYQLRLKWAMLRHRF

SEQ ID NO: 13169 - protein, 115 aa, Chlorella protothecoides
MSTQPPARQRASPLTPPPHTHTPHTQRVLSSTLEGLLAGAPRRSVLLSDLSAEGPDGGEGLRRACANLPWVDLLPSIGLNVYSILRRDYLVLTRQSVEAVQERLRKPIRPQRSTA

SEQ ID NO: 13170 - protein, 206 aa, Chlorella protothecoides
MPIKRHAYPILGLPTVASARPLRACPPCPLPAPVTQWWQSAVNDLYKGHAPDHPVMTALAEVLQQAQLTRYRLQRIVASREEVSGLGQQPESLAELLAQLDSSLGQLSQLQLEAAHDASPTSAEAAQKVARGVGLARVLRGTPRDASRGRTRLPEESTGRHGVSLSGLAQGRPSPELCAVAAELAGVAKVGGDRGEGLRWRECRLR

SEQ ID NO: 13171 - protein, 214 aa, Chlorella protothecoides
MPVVHPWRSVMRGGGGVQMHTPPLPFPTSQDHPSLGAWLLTLVDTAARDSPGEPMQAGALVGELARAVPGFRDEWAGLAEGSVCSARFQRKAQALVAALAARFGAGDPRFAFRGSDGLALDSGPDTIAALLAAGVLRTGAPLADALKERRDLGGSRWEAALRAGALEAGRRARALAAGSDGPVPSAARVLAKVLREQGAAEEGGRLIAAESVAY

SEQ ID NO: 13172 - protein, 282 aa, Chlorella protothecoides
MLASASTRVLSTSGPQRFGSIISRRTGVMVCVAAQPSAPEALEESPFPRLGRNAALYKEVGGGKKFRQHVNPLKKELATPPPPPDWAAVYADPGLPLTVDVGAGYGRFLLGLAQTGAVGGLRNHLGFEIRGSVVARAQDWAAALGVARSVHFVLANATLSLGPVLRSYPGRLDLVTIQFPDPQFKRRHRKRRIVQRGLVDSVAELMPRGGRVFLQSDVLEVRGGGLKGGEHLHGFQWTVPEPLSGSRTVCGRRPCAPADIPLGWRQTMHRDNTLNEQGDSWP

SEQ ID NO: 13173 - protein, 270 aa, Chlorella protothecoides
MAPCPFLILPAPKTSITRTRQEEAALAPSPLSTLHAHRAVLGVIGILHCGHTRDLAKACRAFQQRCHAFKGAFTVRLFGFDPTDAQVGGGLLALPGLDTFPPGATPEHLQHHAEVVMHDYAACMLGELERWMLSASPAMLDLGSLVDAPEFTGAGPLEAVQTRLYSDEEVKTKKRYGRLQKAMGDHCLLAGSPRDALDHFNVAADLCRVVGDWVFQAGALEGQASAKVRGLDGRKGGEGRMGCVCFWPVRDASSRGQIAASRPICLVLID

SEQ ID NO: 13174 - protein, 96 aa, Chlorella protothecoides
MQGACCGVPVTSGEYYPQQQYSQGYPPQNYQAGYPPQGYPPQGYGQPGYGQPGYGGEPAWWSLPALRRLHRSAWAEGGSQGHTDARAACSPRKRDL

SEQ ID NO: 13175 - protein, 128 aa, Chlorella protothecoides
MACLYLGGKLEDTPKSARDVITACCMRRYGPEVAGLSLRNHDFLTAARERLFLAERAVLYALRFDVAIEHPFGTMLAALRRPALTRVWQEWGQAHPGSVSFQQMCINLLNDRYWCWVRVEAWAPGGGL

SEQ ID NO: 13176 - protein, 134 aa, Chlorella protothecoides
MAEAKAALRRKGVLPLQAEADLKLARFLAGLHHKACRQLCGHWALKSPPSSSLIPQPSIQGEAARAEVSDLVTGVLSLVEGMPLPEDRMLAFVEGAGALGLVGSLRKRMLLLWQAVELSKYLGFPNLRSLEVAR

SEQ ID NO: 13177 - protein, 153 aa, Chlorella protothecoides
MCAWDGKALLRVEGGFWWNVVWGAVVEHVARCESVVNDRPRCPPPKPSLSIKCSARKALEPPDRHMDPVGLEEPWSTPRSALHRESPSLWPQVRAGCLEAILGLAIYAKQHAEVWEAAAVLLRDHPAELSPHRQQSLLENMLAAAAQMAPAER

SEQ ID NO: 13178 - protein, 381 aa, Chlorella protothecoides
  MOD_RES (44)..(47): Any amino acid
  MOD_RES (258)..(261): Any amino acid
MATEAVPTVFSGGPQETVKLPLEVALLPKKLLAPGFKSRNASTXXXXETPSGGCVVGQEAFSSWFEVSQRVDSVTTCRAVRGVSGSVYTVRSCTYDIVERHWRGFQTTNLAYLGARVVALFPRRSRSCGATRPSMGDGPESFPVRSRSLKISIQSEPADVFVSRYTDRVLVVISQLASFGTVLSTQREQVLGRGSTFKVDTLLGDRANPMPELCARQLAQSAADAGCDLPLLICLGLRPSAATLAGMRASPAPLPTTXXXXRACVSSWTLSPSTTSGSRFQHCPASGASPAPLPTTSTALHFYCPPRPPTLPASLPTASTPLPSASPSHTHGCMRTAWAGVIERGACRGAPGSLRCPARSAAGPWLTWRSPCCGRRTPAGA

SEQ ID NO: 13179 - protein, 124 aa, Chlorella protothecoides
MVPPHPTCLLPLQGGTNINDFQAKTFARIQLSKSQEYYPGTQDRTLLISGRLKQVVAALALILDKLVGEGVAPLSPRSRLHQEPDRAPRLLLKMLVPQPLCGIIIGKAGATIRSFSNDTQTTIR

SEQ ID NO: 13180 - protein, 736 aa, Chlorella protothecoides
  MOD_RES (187)..(190): Any amino acid
HIFACVAYVATECGSSLGWLISRRSQLPTPLTPWGAEETPTLTRTEEKVPFRSPPCDAGGVRLPSRARQILEYGRGHRPRHQLLICTFLSTEKYRDRTPRPASAGPGDSASGGVPTHRAPGAQGQARLLRAPVLPRGPRPVRGSRMCRPESRIAARGGHHTRDQLRGLPVPRLLLSGAGVPDALPPXXXXVINCVGFLYPAYFSPELEYRTLYLQDTPAEDITCIMYDVFDFIQAAVGHGADPAGRVLLHCSQGVSRSVSLTIAYLMWREGRPYEEVFASVKAARGIANPNIGFVCQVREVQGMSLTDCSQELHALPSIPSGLCAATPTYQHSSAWSPPCHRSCCNGRKGAPLAPGPSACTDWLPSRPQPRSTWYHGLQRFLGPPASTHGAPLYCTPARRCSSGWCTQQKETQGYPCPCAHSSTPVCAWQGKACPEGFAAAATTFAAQLERYEAAPAPALLQRDGKESEEFWTALKAMLSSSTGEDGPEASGSWRAAAVCEMPAYDKDYEVGGCGGDQTKIWLWGCTRYFHPAVYGPEQTLSPSPACLKHCLHQQSCRACPEGDAYNQASSLRSPWTAHLFSHIPSSPLTCISSRKILPHTCFPSHNSFPHCTQLFARSQTARSSTADDSDASPRSARKTPRDERSEEDPSPNERQRKHARGTPPTVPRDAASADGRAQSSANGAVAAAASPRRHASRLPPVPPLDMTRRGDPSVNSRSRVPRINLSPVATVVSDD

SEQ ID NO: 13181 - protein, 447 aa, Chlorella protothecoides
  MOD_RES (310)..(312): Any amino acid
MQGARVLDVGCGTGILSMFAARAGASRVVGEGPLSLCVGGCWSCGQEGGARLVSARNMLLLAMLGRSPPNGAPPTHPNPHQSSASSSKGGGLPVYILTKPPYTYSGVDGSSRIAEEGGALLVSARNLLLLVMLGRSPPHKAPPTHPNPHQSPASSSKGGGLPVYILSNPPHTYSGVDGSARIAEVARQNILANGLGDRVSIVSGRVEAVEELDVPGSKVDVLVSEWMANGWVRVYLGVEAQSGRGWAACSLFHTAPGRVKPRSGEPMYFDPMLGQRVLNPPGQCLLHAQSCQWCFGILCLESAQHPHLSXXXCTLTPCWDKGRWIPLANVCCTCNPADGVFEFCAQSPPQTHTCFTGYALLFESMLDSVLAARDRFLVPGGAILPDQASIYVAGGGPAAGGLSFWDEVYGFSMAPVKGTLQAAGGVGSEAGGKVALGCWLGDLPHGL

SEQ ID NO: 13182 - protein, 277 aa, Chlorella protothecoides
  MOD_RES (79)..(81): Any amino acid
  MOD_RES (198)..(201): Any amino acid
  MOD_RES (261)..(271): Any amino acid
MSVSEASDGPEEWSDWEESEEGPVKSLFSDTWLPTVEEVIEHDSEVHGFDLSLFRKQVRGVCSAFVKGPVASTLALYPXXXQVRGVCSAFVWGPVASTLALYLAPRPPRMRRTQSPILQENLDTYGTLQLINYIRSCAREGAEAVLPTLATRPWADEAFFLPTLAGDGMLSHDWDEAGAWSSSPAEASGSGANASQAXXXXGMLSHDWDEEGAWSASPAEASGCGANACQAQEENAVAMRAAVLALQAALLDEPSTSVPSXXXXXXXXXXXRVLQLL

SEQ ID NO: 13183 - protein, 149 aa, Chlorella protothecoides
MGRGPLDAGNPPPPGSPGGASPLRSLRLLYKTLLQNIMNEAVVAEQAAHLQSPGHDSPTHPPSNLTQVFTQPTAALAALVTRVFEQRVQSAVDQALSWRGVPDPPSASDLRAHLRQLAEAVTMTRGLASDAQVGVVCDEKHGNAVWGQC

SEQ ID NO: 13184 - protein, 451 aa, Chlorella protothecoides
MPWKLAYTSRVGGQILPGKCRSEHCTGVMRPAQKAPRGVLHSSDLRARMSDLASAQRNLQQLESAVQSGSVDQANKLLSKLKAGMRSYHLHRLWSRDAVSHADIAPFTFPPSPLSSRPVTPCSWTSSPYPPWQPTPSPAPPRPTSSFLHVRSRTAPRQLGPLPTAAGGVYEQAVLLGTLRSDLVVFQRSWSQLAPYYIPGDLSRSLTPSPRQAFLTALNLLRLLSQAAVAEFHAELELLSDEVRGGRDSRVDAAMAHPGMLGKSVLLAGLLTARAEASERCVTPHGDCACTHSPPSCAAPDQGFPRGDQDHGGGGVADGGGLQPGAGGAGRPFHLALHCHLPPAPHRHRQVGGLGWQDGVCRVLRRWAYPLHGLKMGESGALETVSLMRLALSVIPRHCLALHPLPRAPPTTPHPRQSHQGGGGGLLRALVCLPELGRGPQAVQAGKRGTA

SEQ ID NO: 13185 - protein, 620 aa, Chlorella protothecoides
MPGSQAACRGHGSICKSTGAHSRGRGCAPHANNRSLNPCTTILTSATRVLTERRSSMPSERDSTPGLPILKDRGPGLKDTLARMSTTNTPSSSALSLGALQLACEWDRMQARVPLRYGRGQSRGVHGIMYVMILKRNTAALVWILAALTICQTAHVGGLRSRGRALRTSYCVVSSREGDHGMTGSAVSFKCGTLRFIIIVLPAPNRSYRGEIMLVDNHRKFSSWSPSNSGACHDHFVLVHIPHRLKGFRDGFYQNNIYLTKDMFPDFNIRVLNLGDGATCDPRQRQCEFVRFVECVPEGAYQCSDDFTWIVGMGTGNAGSWNFGDFNVGDSNIGNRNIGWNNVGSNNTGENIICHNLSGNDRCRLSDLLTGETYFLDAPPYPPPRPPRPFDPPSPSPPSPPLPPPSPPPPGQTCDSGTRFIALPTIECAGWYNGVLYLTSPSSPDAYCRLKGFAGSGSMRILPITLSTPFSKFSISTLDPGTLEMCTPTEATSCQSIAVIECLPEGIPKCTPDASGNIGNGNIGSNNLGHNNNGNNNVGKGACNPNPRPGLLKSLSSSFGCPPHSAGNHNHGSNTTGSENWGDNLVCNNIQDGGQDTCTVTDLRTTDTIVLKVHAPSHTP

SEQ ID NO: 13186 - protein, 240 aa, Chlorella protothecoides
MVNDKETDFYCRYVHALFGRAGSSIYTDMSLTLFIIHLSTLVRMRCCVELRCASLALLRLKGYNGGGIVMQSLDLKNDGPFKDFTIGTVNPASFTTCTPSATVVCKAIALVQCLPNGVPGCVEDQDHNIGTGNTGKNNIGDNNVGDRNHGTSHARRVDAGGGNDGKFVRLLECTPMYESVRRLHRHTSTGNHNIGSDNIGTGLTGQRMLCNFAKTDRCPLLWLATNETIKLFAPPPPHPP

SEQ ID NO: 13187 - protein, 158 aa, Chlorella protothecoides
MSFSASRHGIQPGPCLTPCVPHRGGHGERVLAAYTLFMTIPPCLACAGTGKTLLAKAIASNIDANFLKVVASGVVDKYIGESARVIREMFGYAKEHQPCIIFMDEIDAIGGKRFSEGGWVGRWRAPECRCCAPDGRECGFRPGPSGLPVAGLTHGPVV

SEQ ID NO: 13188 - protein, 241 aa, Chlorella protothecoides
MELLSQLDGFESLGKVKLVAATNRPDVLDPALMRPGRLDRKIEIPLPNEQARTEILKIHASKITKHGEIDYESVVKLGDAFNGADLRNVCTEAGMFAIRCGKGEGGGGVVGKADSGGTGGGKGSNRMVVEVEGLTHARHNPGRHECVAPPSAALHARALAALPPSPPRMPGSGPGCAATFPPRMPGSRSTCACDQCPTLHRCRDERDYVVQEDFMKAVRKLAEAKKLESPSPFSSDFGDKK

SEQ ID NO: 13189 - protein, 337 aa, Chlorella protothecoides
MASQVEALKYIPGTSLNVDGFRFLRPGARHFFLTHFHGDHTTGLTKGFDAGTIYCSPVTARLLIRDMGLRAGVVCPLSPHVTVEVGGVAVTPLPANHCPGAVMFLFVIPGDGGGRPPRTVLHTGDMRWDDGAMMAYPALRALGTLDTLVLDTTYCAPRWTFPPQEQVIQAAAEFVRREAARSAGRVLAVANSYHIGKERFYFGLALRLGSRVFCTPQKARVLSWLDLPPAWLGLLTQRPLEADVHLLGPGEALAPAALEARLCAPAAPWACVVGFRATGWSYKKAPRAEALSVWREGRAAVVGAPYSEHSSWADLRACVASLRPRRIIPSVNAAGWG

SEQ ID NO: 13190 - protein, 288 aa, Chlorella protothecoides
  MOD_RES (125)..(128): Any amino acid
MVGQWEGGCKRRGSTGPDTAMPQRVLANKSYGECRHHPPLTRRARAAAGGRLLQLEPPRLQRVCARLRKVRQDAAVRHCAGGGREDRSRGGVHAAAARASQCSHPQTNSVLIRFLPPASASLFLXXXXMVSRSSEWTQGDGHPHRYSCPPTPWSFCRDHHPLLPNNQTPRKTQVREYAATFWSRVGELNDADRILKNIERGEQRIQRQADIMTAIATKLEKYRNPWQEVRIAYGPAKGKAYTEEEDRFLVCKVHELGYGAWDELKAEIRGNWRFRFDWFFKSRTPQVG

SEQ ID NO: 13191 - protein, 485 aa, Chlorella protothecoides
MQPATPTAELPARLSPPSTPMRLTPTSCPLPPLQAARGRKRLDFLLRQAEVFQHFAPAAAAGASATKARKKKGRHGAALTEEMEDEELLRDEESAEPGAVGHRLQVQPSVITGGTMREYQLQGLNWLIHLYDNGINGILADEMGLGKTLQTISLLGYLREFRGITGPHMVIVPKSTLHNWLNEFRRWCPAIKAVKFHGNQEQRAAQKEEACQPGRFDVVVTSYEMVIKEKNHWKRFHWRYIIIDEAHRIKNENSILSKVVRTLTTNYRMLITGTPLQNNLHELWALLNFLLPEVFSSAEKFDEWFQIGAGREAEAEVVQQLHKVLRPFLLRRLKSDVEKSLPPKKETILKIGMSDMQRKYYAALLQKDMDAVTGGADRSRLLNIVMQLRKCCNHPYLFQGAEPGPPYITGEHLVENSGKMVLLDKLLPKLQSRGSRVLIFSQMTRVLDILEDYCLYRGYQYCRIDGNTSGEDRESQIDDYNRVSM

SEQ ID NO: 13192 - protein, 414 aa, Chlorella protothecoides
MDRAHRIGQKKEVQVFRFCVENAIEEKVIEKAYKKLRLDALVIQQGRLVEGTKGVNKDDLLQMVRYGAEMVFSSEAANITDQDIDLIIQKGESSTKELNDKLQPPASSRNTPWTPPDLTPRAPTPRTFIHPQNFSDDAMKFTMDGGLSAYDFADEDKEPENTDQLDQLKQLMGGSGARGGGRRARGVACQEVCPPPAARRPHLDVWHDTGCAARTQRTHRACSPYTPHEHAPGCIPTASLPSRRPPPPPPSVPGANWVDPPERKRKRVVSYAENEFFRQAQGKEARPRGGGPRLPKMPALQDFQFFDTARLTELYDAEQSYELHKHALAQKEAAARAQGASEEVIAKEIAPGEDDPQPLTPEELAGVWVTVCGGSASVAGGRHGGAVGGWMEAKRLHGAGHCHATARPGKQQLW

SEQ ID NO: 13193 - protein, 57 aa, Chlorella protothecoides
MGGVESLIEQPTIVSYWDQGPEERARLGIRDSLVRFSCGVEAAEDIWADLAQALEAV

SEQ ID NO: 13194 - protein, 338 aa, Chlorella protothecoides
  MOD_RES (237)..(240): Any amino acid
  MOD_RES (289)..(292): Any amino acid
MRQPLNPAQLDGPFVYPAAPSAFCLVWYSFEIRGALGYIALEISSIMLARRALPVVTLCRLPRGEHHPVCKPTQLFPSIRVLEQAPCAPPSIYYTPCNCAAFASLSTEVATGVNILKNGTDPALKSDEELPAWLWELAQPEKPLTELQRHEFTELQSEEVGGGVAWVGFEKSSLCGGRKWSASTAAWRAHLSPALPSPPSNGGGSSWRRAPGSRPTTSSSLPDGAWCLLESFCPLIXXXXPAICMLLLAGVHALIPCLRIGTRSQGMKGSEACGPPCQASGRQARASEXXXXGTRSQGMKGREVCAPRGMGLGGGERRMRTRRPVVRRAREQEAGQGE

SEQ ID NO: 13195 - protein, 225 aa, Chlorella protothecoides
  MOD_RES (93)..(96): Any amino acid
AAAANAGAGAAPGAARLSKVVQLTGFSDPIYAEAYVTVHQYDIVLDVAVINRTQDTLQVRVMGGKEGGKGGQGEPRAADPRGGRRGLPASHAXXXXGKEGGKGGQGNPARPARVAGGVACQPPTPPTADPHPWERPALPATPSTFPCTERVAGAGHHGRPEAGGAAGQPHAGAGGAAPHPRQHQGVQHRDGGHLRQPGLRGHGLQRPQVRRVAGGVWGGVGQTAK

SEQ ID NO: 13196 - protein, 256 aa, Chlorella protothecoides
MRSGGGLRALVQAGGGRGLYAGLVGNLVGVAPASAIFMAVYEPVKQRVLKAVDADRAWLAPLAGGVAAGLASSVVRVPTEVVKTRMQTGEFSNALRALRTIAAREGRRGVFAGYSSFLLRDLPFDAIEFLTYEQLKKGYASAVLGGRRELNPAEHSVAGAIAGAVTGLATTPLDVLKTRMMIDGGRGQYAGVADCARQILRDEGPAALLRGWQPRVIWIGVGGSIFFTVLEAAKKLYAPKAAATGVLAGEPHPAPK

SEQ ID NO: 13197 - protein, 409 aa, Chlorella protothecoides
  MOD_RES (167)..(169): Any amino acid
  MOD_RES (193)..(204): Any amino acid
MACGAAHTVAFTMQDVITWGANDRGQCGHGERAEPDWVKPRSIKMLHDLMITQVVCGAAHTLCVTGTSQVYAWGANSRGQLGLGDVADRRTPTLVDGLWALPVLQLGAGEVEWRGECVFVEACVWVVWLRGAEREWGERGDGSRRVPMHPTQCPPPKNKNSHQATAXXXVRWSGGGSASALKDVSGWCGCEAXXXXXXXXXXXXFTWGANCQGQLGLPAAAEVAAAAAMHRSASERRRVNRRVNQRFLTAMLEMEIPQDRAELALHETGNVGVEVAAEWLFSVPDDVLETHLAADPGTPVEELGEAHPDRDVLVPKRVALSGVHGVACGAAHTVAHTADEVYAWGAGGAGQLGLGPHVLSSTLPVAVASLAGAGVCCVAAGAAHTLFVTADGGVLGCGDASYGALPLAD

SEQ ID NO: 13198 - protein, 508 aa, Chlorella protothecoides
  MOD_RES (150)..(153): Any amino acid
  MOD_RES (258)..(261): Any amino acid
MGPPSRSQGESRARDGREGEAGFSGRLPKDEVQYYEEIDKQLSQLEDGEEQRLLADNAFEQAGTQMIEATGDGVVSRVLEKLMPHASTQALIDMLTALTSGENLVAVCTGCVWVDVGGLRMRRVGPPCDLHATRMGSRRAPFPSHVAEKXXXXTNWGSWSAISLLSVLCVLKDPSDHVLRQGTLPLPRALLIQIRHQLDDALYSTTESVCGDLQAVITTRHGSFLSRRLLSVLVGRDVTSGPSAKAAPGPSVAGGGSXXXXPDPATEPGSRRGSPRTDRAAKASPGPSVAGGGSDAAAPEVEEEKGEEAAPKRRKTVGGLASKLERGSDTSAAASAGEVDHPEALQGLLASLLTDDFAVEAAALCRNTFAAPFLQSLLWACKDNECVCLGYGFGRGCSGVHIYPPRVGAMCGGCRDRGTGVGTGAPSCSKTRTVTETTAPLVVFKANASPAPQATNHSLSTGHPPPARLPPQGSHHAASQLSAGRHDAQRDPRPAAADDAGQGGQPRD

SEQ ID NO: 13199 - protein, 181 aa, Chlorella protothecoides
  MOD_RES (14)..(16): Any amino acid
  MOD_RES (77)..(80): Any amino acid
  MOD_RES (113)..(116): Any amino acid
MCCACTLTGGYDPXXXGMYLGAWVGLTTDVLYLLLRVCCLGSNAMPAPLPEVMILHRNSPTDSHSTVYSVTICRQPXXXXGVPEVGPSSRADPAAEEQDEGNASLAEEFAVLXXXXLCKHILFVMLRVLGLKSSDPLVWQRALLTDEVRLATLKGRRVRDFRLAESEEILCCHSHYECPDR

SEQ ID NO: 13200 - protein, 150 aa, Chlorella protothecoides
MLSTGAAWADSDVGGGPPVPPPPFPPAVTQQRPSPATPLDQATGLTPEQPSAPPLVDPPSASGSKAETAGTSAAAPPEAATPTPAEETPKPSKKRRRSRLGELQEIRQQLAQRELELLSKERSLSARDQDISVLQEEVSSWKTFSQTAPR

SEQ ID NO: 13201 - protein, 123 aa, Chlorella protothecoides
MVTGRRTRSMPQAALKLESSLPGGVGQGLHPPVVQEPATVEGHLLDVALDAHLSQLPADQRGRTDVAAVRELCADVRCEGRDGCQGVPLRVVDHLQDMRAGVVTDVAGWKTCSAQRSPPSWRL

SEQ ID NO: 13202 - protein, 164 aa, Chlorella protothecoides
  MOD_RES (81)..(107): Any amino acid
MQQAQPRLAGFQGLVSCRHMSLASVQPAATFCSAGDGRFIRCFVQVSVSTAKDHPDRCPVSPYPAVLPARFAVEAKAKTRXXXXXXXXXXXXXXXXXXXXXXXXXXXQARLHAGPHSPVAQYDQVTPWSPPHMPVHPILMQVEGTTERPRLAVFRSLNHIYAQV

SEQ ID NO: 13203 - protein, 140 aa, Chlorella protothecoides
MPSEILHCTPPEDLCRAPEKVASWHALPVVPRNPVPTLQALFEELHAAFEAEASQGIIIDNSQPAASFARLNARVQALLTRYTQEGSSDWRRYAAFNSHHYIRHLIEESPHFEILPPRPVWHGPPALKPGLVGNAANFAD

SEQ ID NO: 13204 - protein, 255 aa, Chlorella protothecoides
MSLSPLDSPSPQQVLAASVVEDEVSKARGLVILDNEACRRQRAALRTPAAQGLAERVMDLVAAVTRGQGYTAGTVQLLGELRGTTRRLRAGLHAALAGAGADELNYVLTAVNAPALLEVVAPETVTVLVRGRVAALTTVSRSVLVDAFQKLGLRHRTSRQAAVRDVLLATRGLDLTRLKAYIDDGGDYHSCYKLMYNDLQVDWWGGRRGVGERRGLGRGGPGLTFYGFGGLASMHGLGSWKLVDGHALGRHADRA

SEQ ID NO: 13205 - protein, 122 aa, Chlorella protothecoides
MRTVKGILNKLTPEKFERLLGQFIPLISNYEVLQATIIQVFESAVHQPTFVAMYADLCRELDAVLPEFNEPDTGRPTNFKKMLANTCQEEYESTESARASRVMDLAVEHRAHRSSTHHRPGQ

SEQ ID NO: 13206 - protein, 70 aa, Chlorella protothecoides
MALGGAESSCLIDKAPATRPRRSLLVSRTARRVFWYLLSCALGLWLVRWLQTLEGMSMLWVFLSAVRLLS

SEQ ID NO: 13207 - protein, 174 aa, Chlorella protothecoides
MMRGCFGLVEHGERTGRGGRGSTPRPTACLTGGTGRCITGQHLWFGWKRILADACMLRSTASREGPPTPLPLPATTPQPHPPHAPPKGITRLAVHPSEPLVFTACMDGAVRAWDARSGRCNACFRGHEAPVQDLAVSPDGKLVLAGAEDGAARVFSLEEGIARMVAEQGQRPEP

SEQ ID NO: 13208 - protein, 280 aa, Chlorella protothecoides
MKEDHRPCTPLLPPTSTGGRQGERARARGGGAPGQAAAAGQHPADRGAVQEGHGERPHHAAHPDGPVGHRRGRPRPTRGVHRGGPDPPAESIEAVCELLSTAGAALEAGAKSRPRLDAAFATLSKLANARGYPSRIRFVIRDVIELRTQHWVPRREAFTAKKLEDVRAEAAAELGLDVNIPGLDGTGAGGALGALTSLAPKRPEELELFPAFRSDDAGWAAAARGAGGAAGEGRFSAFLGEYVAVQSGGAGAEAKPAAAAAGAVRGCGGGGCLCGGGGGL

SEQ ID NO: 13209 - protein, 235 aa, Chlorella protothecoides
MPGSASFRRSPSPFSPSSPSSRTPIDVTPERRESLAKSIFTDFLADGSFGEALAAAQDLAVPGFMRRLAEIGLARAYDARTEEEWRAVVDLLVRLGAAGQVPGADLGAAVAGLAPRLEDDAMDFRFAPAVLGTLLGRAAAGKQLGLDVLAAAAGALGLDALDAAAGAVESAAPRRGLVAAALCALRDEVGAERLVPAVAEAGLDLAALLASDPEFDDELLEPAAFLAAQGLDGLL

SEQ ID NO: 13210 - protein, 126 aa, Chlorella protothecoides
MTDQKVQRAIVFRRVGDPSVLEDVRDWPVPVPSKGQILVAVKAAGVNPVDTYVRGGKDIPKFIIKTPQVSGGDFAGTVAAIPEGTVTDLKVGDRVYGLADGWAPWSRDGTYAQYTVVTAANAARIP

SEQ ID NO: 13211 - protein, 327 aa, Chlorella protothecoides
AGSGKRVFISSGAGGVGTFAVQLAKLRGLHVTTSASPANADFLKVGLGGRCMGSGACARGPQVVCKLGKSSLQYSPPSHHLSHRNWERMRCPRHRRPRAPERLDQRLPPPAGKEQWELRRVLKRQGALVDIMNNGYLRDYGRAGRLVQGYSYLRQCVGCLCRGPEAAVRVCVVVRGGETSRRSMEADRGCPPGPFHHAFLCQGAWAGPDPARRLGGGGEGEGRHRPHAPSWRGCSSPRLHDQGARQGQGCAPGGGGQLKGGSHTECTRGTCICKPARALPPNLYIHGSISGAQVMIGMVPVTRIGAQHSRIASRLDSSFPRPSVYHD

SEQ ID NO: 13212 - protein, 1172 aa, Chlorella protothecoides
  MOD_RES (470)..(473): Any amino acid
  MOD_RES (893)..(895): Any amino acid
  MOD_RES (1014)..(1017): Any amino acid
MRLLLIQGVVECWCGSGASLVQGAPSSRSLIQKRCTRGTACTRIVQGCIAAQNLPCMRVHHLNLPPSTCQNGGGAPSDGLPASCAGPGDGPDQGPLLPTGTARGAGTHALHHPFHFPRHEAPSHCHLPRGRSRGRGEEGVLCTVFAGVQAAVQRPMPRTVRGDARPRVPPPLPYPVQNPFTQPRPVQGLPATLFGLPVAGVYALGAALAAALGFGGWSLAARLLPGALMQERSTRGSCLEAGRRRWGRWDHAPLFIRTLGPSLRSVGRLVAAAIGAALAAAVTSRLLTLRRSAAVAQLHNLLVSLPRASDLTRDQVAALEAQAGAPLAAIDPEAVKSLYGTFIEATIPAGDAPLRGDEHTRISAFKQTLGLDDEAAGPVHVDVGRRILRGRLEAGSRREDVEARKVGCDGVEWRREGWVGMAWRIMGWAHGTRWGRVAQMTSYSVLAILSGRSAACRLDGIESEGSVNAXXXXKVGCDGWTGIGRGGWAWRGTRQHRVRGVSERRATPLPLHPLTPLPVEHNHASIPTPPIHPHQNKQAFQKLIYVSYLVFAERSYLTPWARAFGLTDAQVYVARRDNARALFQAALAARGGVLVPTQEALTSLREVKESVRLADEEAEGVVREAARATLQGFFDRALSVVKRRARQRDLAEAVAELRGAVEFNRALARLAGAPGVVPGVGPTSVAGSEWAAAEGRGRDLRDLFRTFVEEGLARDGAYGAAETRDAADLRSALGLGPKEAAGVEEEVKERVYRRRLREEVTSGRLDAAPSPAAVLGDLVERVGFDPSAAAALHAGLYRQKLAALLEKRALSDADAGELDRLQRLLCVPAADRDALHAELAGGIYSQTLDKALAAGAEGFGLRERGAVREARRDLRLDLSVARRLLAAGRRPPXXXRAPRPAPGPVHRAAAAGGGRAPPPAPVHHQRAQDQEPRGRGQGAQAHGAFQLGGAGAAGGRPALAGGAHRGARGGGARAPRAGDGGQDAARQGGGGQAPGRCWWGGEDGRGGRRGRGGXXXXAAGGEKKAEEGVVDVEAAEVKTPGDEPEKAADAGMEEAVAAEKAEPVVAEATESTADGAPSSLKKAQAAADSRKAGEKVGDQIVYAQKDITLADDLDLRDRCLYLGVCPGGGSVPDSTGPRVCRQTTRNCLGPCIARVVSHTARPLMRFPTLGPP

SEQ ID NO: 13213 - protein, 374 aa, Chlorella protothecoides
MVIGEWIKCGCLLSTSGGYSCIPAPRQRRCAVRTSPQTGRATQRDESEFARLAQLGDVLGLTQVEVATVHSDLAEQAFKSQVQQVMGEGALTPDRLAGLEAVRQRMGLPKETADKVLKGFQNQKLIAGMQVGSPGGRAVGGWLGAAKAQGQLTLPFLLELKEAGVDVASLTSADLRLQLYRQEAIARLTDGTGEFATDRIVEELPAALGIEVGKARKLVQELARDRRRTTLVQQYRDDQHAFAMWRNRLARAPRPLSLLFLAFSLTRHTHHHTLNPQAVSFLRQKKYDDTVKALNNLLAVEKAAPSDAPLSWSPAEELADLYSLYVSKESAEEKRAGVQACLGLADGDAAGLRAVVEAGNFKLGQETESEAAFF

SEQ ID NO: 13214 - protein, 173 aa, Chlorella protothecoides
MWALYYLERGRTPEALFAYAHAFPPGPPTSEPQAQLVALLERAARDLPTVYASLVVRVDPGAPGPSLRPLSGGDDEQGAGERTDVALGFALPTPALPGAGRRLLAMGPRLRDCPLVCLPERVARGGEGEEGAGEDRLPVWPDLTQLSAKLVGAGKEGGGREDGGRAPMRIPVP

SEQ ID NO: 13215 - protein, 153 aa, Chlorella protothecoides
MALGMDHGGPVNDLGKAWPNLRTPPFHLTTPPGKELEERLAADREENGRMPTLLTVSWSRDAPPALALDGWARVPSVPSVSRSCALRRPEAAAMADDAAALVRRWASVQPPGGMGGRECVLGGWDGGGVARGDGGMSSRNRSMCGLHALALRP

SEQ ID NO: 13216 - protein, 120 aa, Chlorella protothecoides
MLGGKYGASLTDALGVTTAGQLAALPRSRLEAVAGEKDAAWLVGLCRGVDGEEVVERRLPKSQSCGKTFRGRRSALADLNAVRHWLGELGGLRREEGQGGAGECGELASRRPVWKADAGL

SEQ ID NO: 13217 - protein, 121 aa, Chlorella protothecoides
MQEVLRKRMDAEVPRNHLDLRHRLDAQGNRYGKVIDYKYVGGASLLPVRGIGHACLLQEGIRGLTAQQQLIPFPLPSPRISELRSIELLDDLCDDLKKDYDYNSTSGAWESTSGKPASGDG

SEQ ID NO: 13218 - protein, 118 aa, Chlorella protothecoides
MESSFAMAGTHREDRDDELLARLKVGLDLDRQLLSLVGALGQGQVVLEVAVLLHQRHEAVVGDIQQGVVCAGDVGHVAVVGGGGQVLHLLAGEDVDAHEHALSVTMLAGLGGGHIGDL

SEQ ID NO: 13219 - protein, 180 aa, Chlorella protothecoides
MDPEKLVRLRPSFRPEGPDAAPGTITAGNASPLTDGAAALVLASGAAVARLGLRPLAQLLGSADAAREPREYTTAPSASLPKALARAGVAAADVDAWEINEAFSVVDLVNRRLLGLDPERVNALGGAVALGHPIGCSGARIVVTLINALRSRGGTLGAAGICNGGGGSTAIVLRLMPQAE

SEQ ID NO: 13220 - protein, 82 aa, Chlorella protothecoides
MQQWRGLGGGKGRCCPPGRGEVGRLGSTHLRRLSSCQSHPMDHASAPLVVGLTGGIGMGKSTVSRMLEQRNVPVLDADQVRV

SEQ ID NO: 13221 - protein, 176 aa, Chlorella protothecoides
MVHELYAAGGLAVEPIGAAFPTAVTGGAVDRTALSACVVGNPAALRQLEDIVHPLVKAQRSLGLRRAAEWGAEAVVLDIPLLFETGAEADCDLTVAVSAPPHIQRRRVLSRKGMSPEKLASLLARQLPDAERCRKANVVIDTGCSLKETEKSIDELVSTFPSRTRKAYSKVSTDAG

SEQ ID NO: 13222 - protein, 368 aa, Chlorella protothecoides
VDNNDSYEELVRFVHTVSTGSPVTHFIVHARKAHLKGLNPHQNRTGLNPHQNRTVPPLRYQWVWALARDFPHLSFSLNGGVAGLDGVVTALRADPGPLAGVMVGRGAYHAPWDVLADADRRVFGGSNAALSRRVVLDTYAAYADAMVGRWGSKPDGWRAPSLRTLFKPVLGMFAGEPRARQWRAAVDAAFKQGAGSVRGVLDATLHVLLPESLDAAPREEGDGGVAGPAHEALRTVQHWEPELPPTPEWLAVERELGRGAAEREGGMPAAEEGKAGSASQDSALTAADKSEAANLRSGAQPGGTGSETSTSGNLAQGPAPAGGAATPGDQQQQQEESGAACKDDGASHDESWVLVEKQTSVPLQGAAS

SEQ ID NO: 13223 - protein, 355 aa, Chlorella protothecoides
  MOD_RES (223)..(225): Any amino acid
  MOD_RES (295)..(297): Any amino acid
MGFSLVIVPHPGQAAVNTVSLRLIVRRVSGPSPHGVLGEVGTECTGAASCLRTAPASFPFLVPCPADRWPPLHTPSYPTAYPDGAVELRLKDAQGLEPHHLQALTKTLLSLARERASEGAIAGFDLIQAAQEMLQGLSKSGVGTGEELDSESGRGPSPGPAPPVQEPGLAAASEPAASSPQHPFELFDWADGDLFSTSLFDGLWEGAAAAQVPLHPPAPSPPXXXPLRAVRLGGRGPLLHLALRWALGGSGRSPDPPATTGAQPPAPRARSPEPSSATVCLGCSPYLCPSAPDLXXXWVQPLLVSSVLLESWVGRARGPKVGMCGRTVGTCAMNSLCARPCHSPYTQPASLITAL

SEQ ID NO: 13224 - protein, 351 aa, Chlorella protothecoides
MVNLPAFSATTYEHRRVGQLIKVKHPVSSLAQPPVTRFSLPLQALPSRTMETPRRVPRGPFIMPDGTSLAAFMRAEEPVTRPKRSKPQAPSREWVSDWLTTSGSQPPSIPELDALQRIGQRRQRRWLNNRLLLALAGRLTAADIEGLFKPVPFGAPRPPTVWETLAEERYGALRESLRSLDPDTQADLLASLAEAGAARDDGEAGEPRLSVQGAGQRAWCRVARRGRAALRQPVAAAVVADMEDSIGGFLAQPGAGDELVFEGLDSFGRLLCHSLAEFHGLSSTSRADGLGAKAVVLRREGRGDHPAPSCTALLLMMQGGPGGSGTPDSQGFAANAEAGRSLVYRPAVLAA

SEQ ID NO: 13225 - protein, 296 aa, Chlorella protothecoides
  MOD_RES (31)..(33): Any amino acid
  MOD_RES (51)..(54): Any amino acid
  MOD_RES (71)..(74): Any amino acid
  MOD_RES (132)..(142): Any amino acid
MSGEESRSSPRALPIPSCTFPTRRAHMRSTXXXGLGILGACARVADRHHGXXXXPGIPRGLCTGGRSPSWXXXXWVRYVGRRKAEFSQGPPDPVMHLPHPPRTHALNTLSSSWRIDRFKLRSGCEYQVIRIXXXXXXXXXXXLPCRCDQILYQVKGGLRGKDFVMVCSDTNAAQSIVTMKSDEDKLVPIDSHKLFAISGEAGDRVNFSEFVIANVRLYALRNGIPLSTKAVANFTRGELATALRKVGHPGGVRIPPVCGSCWSTGACCLTRTLCRHHGVHQGLPGAMVHAPGSHGA

SEQ ID NO: 13226 - protein, 206 aa, Chlorella protothecoides
  MOD_RES (146)..(148): Any amino acid
MERLGLPRDAITYSATISSLAKGKQWHAALQVFNHMRDAGVPADVVTCCSLINALERGGQWQLAEALFLQMCCVAKDAEVGVVAPRKDGKEEGKAGEVSPSSVFDLLRVLPPPGEDAPGGGEEVRDAGAPAGEGVPGGEPSDGTAXXXGGAGCRRARGGGRAGGGAVRRDGGPAAGRRGGAGLPPAQLPEPGRRRACDAGRAGGWA

SEQ ID NO: 13227 - protein, 247 aa, Chlorella protothecoides
MALKREAEARRFAAMGEDASGRGAQTVYRDATGTRVTREEFVEGQQKARRKAEYEEEGSLAWGGGLKQRQEAEERARAMREEASKPFARRCAAAQRDGAGSQQASLIAPENDCLRRHRAGVSQSSRTTPCRPLSRDDAELDGAARAALRWGDPMAHLVKRGAADLEALAPALDAALQGSGFLVPQEVPPHSWLRRGLGPPPNRYGIRPGRHWDGVDRSNGFEVDMFKRRNELKRRGQEAFQWAQEDM

SEQ ID NO: 13228 - protein, 281 aa, Chlorella protothecoides
MPGPQASGAPCCSRCNRDGSLLLNLLAGSVPWMYSREFTAAALPPHQGPHNTAFPHHARHKGVFHHTPENDVGTLSLYYDLPWLSMRGMLYHPIKTGAVKKSDVMMVRQGGALECSPTSQRSGHTRGDSLHLINKGHRAVADLVIHFLRMEAARAALGRQHVTLGGDDGALPAPMLPNLVELPAEYCAQGERFRRDVARNATGGFWWKGKGDEMRAVTQNPNATLDIHVDASVTAPGSNRTAVLLFTAKSHDKIGNAGVRVVRGRIEGEEGHCVKFVGGTD

SEQ ID NO: 13229 - protein, 167 aa, Chlorella protothecoides
MLIAHPNTCAQRYEAHVWSEGKQVYLGGYGLEVQVGHLSDVVFSAWHPLGTLGLPAGQDAQTNFDIFRYSAELEDHTASQEEVVQHLRAQSKAMNCVAKDTNLTMEEWELEISGTVLITKFPTCGPAASRVHWSPGRRPVVLSPRSHACMALLRACSVSTSSHCIDA

SEQ ID NO: 13230 - protein, 230 aa, Chlorella protothecoides
MAYSPRHYCQPLSTPVTRKRSRESSGEDEAMPSRRSSLHELMGMSRSAPGTPMEAVPEYKGVTLHVRTKRHEAHIWEGQPGRQFYLGGFGSAAEAALAYDIVALRLGRRETNYHLSYYEPWLDLLEAQPLEDLVSGLRRQSKGASQQTSFFRGVTRHAKGRWESRIGQAAGRRYLYLGLHDTEVQAARAYDRAAIAQKGIDAQTNFALCEYLEELGPEAAARAAARGLLG

SEQ ID NO: 13231 - protein, 602 aa, Chlorella protothecoides
  MOD_RES (88)..(91): Any amino acid
  MOD_RES (341)..(343): Any amino acid
MGSLSAMCIQAMRPDSASAVGAQVRMGPGNEDALDLWQHGIRCNGEITLLVSADNPCRSCQCSGATPSHPAPYLPTPLRALHQEGGGXXXXCRSCQCSGANPSHPAPCLSAPLRALHQEGGGLGPLERELDAAILREDYGQAAVLRDKLRPQSSGINCGEGHGGDCEEFTHSLACRTPPCKGVKSPAYHPPHCREQREGNLSGVLQANAAFYKAFGDADLPAMEAVWGKSESVQVIHPAAGCIAGRDQGRCHRHVGCARGFLVIGFRASQWVRIESWARNVAGLSSHTFKILSEVLLAIPRHPIPTLHSIGWVTCLEATKAGSRTGRVLATNIFQREGSGXXXRRLRSWVPGDRFSCFSMGALRKLGKGSCAPPWQHYLTSPGEEHRLVRADVALLCIEQEQSLIAVLVRTSRCQPGPASYMLHHPLAVVKAPGIGSHICKRHGATMACYAKETAMWIIYHPPRANTLGRHPCPRADAQASVKALNSGGIQCAFSSLGKSPAIHHAIPGIADHTAPSSPPNRGQDRASRDSLLAASSDISQAQLSIAYLELRCRAHGVPAPPAIGGRGACGHVHQSWCRGGGVPCKRLTAPDAEGEVCPASD

SEQ ID NO: 13232 - protein, 193 aa, Chlorella protothecoides
  MOD_RES (177)..(180): Any amino acid
MECKCSGTAPLESRQALEDLLLCLCGSKPTPVHTLEITLQGPNSSTVVLSRGMNEAATSNPQWTAQLFGLPLRGKQAVGLEASVRSVATSSCQGPEVPAFWTALGMEIEYTVERRGCAVTLHAPRSGLEVQARRNHTVLFPSVQVVVSQLYRAGADEEGGDGHAPIVPNHVLVEARXXXXAVMGKRQLSPIMC

SEQ ID NO: 13233 - protein, 700 aa, Chlorella protothecoides
  MOD_RES (144)..(146): Any amino acid
  MOD_RES (429)..(432): Any amino acid
  MOD_RES (462)..(465): Any amino acid
MATALPACHPLFEPLLPGPLLTGGGRALSLRVRGVGAAGSAGRHPGGRDGAGQDPAGPDPALDPAAPEPTGAWSGSRVGWLSLVQAWGWLAGAAGAAAAWLETLGHGTARLRRWVHQLRCAPVVPGPPPSHPLSAPHSCSSQPXXXLRCAPVVPGPSPSHLLSATHSCSSQNTRPLDPARCPPLSPPLLDSPPSSGLQTPGDQGHRGGAHHPGAQLGGGGPALAGPRAPAPALAGGRAGPGRAGAGVRARGGARAAHHQLRAGAAARGRAGGCRAAAGVRRGAPPEGGGGEQDHLRAGCAGLPRPRPADGDARAERAARVLRHGRLRAAGGAGGPPRLRARVWRAHRPRPGPGGDGGGQGAGQGEGQVRVPGGWEGGRCMAWDRAVWWAGQTGQARLAGLPGGAPPSPSAPHPSHHQPLMHAPKRPHTXXXXKSTLRAGVPPRRAPQRLQGWRTRHRWPRAXXXXPIPPTISPSYPPPNGATLDQGAGVAHLGLHAATHGGGERALPAPALRLHRVLPPQRAPAAGVPPRAPVRRSPHPALQRAGGPGIVVRTLAKARMEDAAQALAVLSSLRKICNHPYLAPDPDRDAGPTPDTSPRPADSGKLAALDAMLAAALADPGERAVVVSQSTAALDLIGALCTTRGWPCQRLDGATDPARRVDMVDAFNRHGVGRVFLLSTTAGGAGLNLVGAARLFLFDSH

SEQ ID NO: 13234 - protein, 436 aa, Chlorella protothecoides
  MOD_RES (208)..(211): Any amino acid
MDVRRAAHAVSTRITAGQVRDPAHVMMRIVFRDSTLLGSMSISNENQALPASVPTLGLKRKAFKAPLAVRPAVSNIPPAAREDAGPKPVSASEEHYYFNVTAAHASWGTIMLQVHPRLPCPRLYTKHNPGKLRKNKSWADGVLEMRAGGRTTLFDPSGKSVTQTVARGYDPPSMGEGSSVLLGGWELEVQNRMEAAEFREALPSLVCXXXXAAEFSSAIPRVTWSPNIVQVACMASQERDSIHRPISWCCSTTAQGGQHNDILHGSQGKGGFSASGTGRGCCAACCSAQGPCMAARPHGGNCHRAEQVGPEGALRLSNLSQCVSTCVAQGLVIHRSRGSAHVFASYEDSGLCMHPRSAGLSSSGSQNPPSRSLVPREQWMGSQESGASGVRPVVVDPYLACHLRPHQVLQKGHATRACRGLTELTRYGQTSSVHDS

SEQ ID NO: 13235 - protein, 143 aa, Chlorella protothecoides
MSPLPAVLHAAGCDLVPLTLEVGDYVLSASCCVERKAIPDLRASLASGRLFAQAEAMARHYATPVLLIEFEGDRAFALQAAGEPHGALGAAHAAPPAPAPGLVALPACHRRDLCRAEGQPGGARPGGRRHGRRALGGGGGRHG

SEQ ID NO: 13236 - protein, 84 aa, Chlorella protothecoides
MEGAQAKDGIDTLILHLLMDLGAEDEAAAFAAVPNAVVLPEVEPRLLSLGWEDTLGTLCATTGEVPRALAVYQRAAARRGAGAE

SEQ ID NO: 13237 - protein, 413 aa, Chlorella protothecoides
MQAIVGLHYLSSVSRLVALQEGGSLTLLDAGSLRSQPLPLKGIALATCANEEPGRAPRLAIFHRLRVSSGSFVRPVAHHAMPLIVLPPLCITVGRLTVLLLFPAESGKLGQVAAEMELPGIASPTCPAWVGAQVVCAAGMRYCFAAPLAGGSLRQLFDVPPELAYVPPRAVGLPSLAQAVVLLGKGVVALGAHMQSLRRSWQLSPKQHLRLGVAHGLCFFPNEPQTTLESSTPASIHSQHSPTPPVPLPTFPNAQGETGIRINPAGHPVGDALSLEGYGALRALSGVGRHLLVWTPERLCVLEADTGACVQTLGLAAADPGGAAAGQAVSACNDAGAVLVAPRAAPGSTAARSAGATVFLAQPVPAWDQVRDALAHGEAEAALRLSSRGEARGEAWAQAGLALVGLALLRGKR

SEQ ID NO: 13238 - protein, 220 aa, Chlorella protothecoides
MVAGVMSEDPAAQLEATTQFRKLLSIERNPPIEEVISAGVIPRFVAFLQRGDAPQLQFEAAWALTNVASGTSDHTRVVIDAGAVPIFVALLASPVDDVREQAVWALGNIAGDSPRCRDLVLACDALGPLLGQLREDAKLSMLRNATWTLSNFCRGKPPPEFEAVRAALGALARLIHSPDEEVLTDASWALSYLSDGTNDKIQHVIDTGVVRRLVELLLWV

SEQ ID NO: 13239 - protein, 168 aa, Chlorella protothecoides
MSNASQSGKAAAPAPEAAAADGSSGSEAATAVTTISPQAIKELRAETGAGIMACKAALREANGDAQAASEALRKKGLASAEKKAGRAAAEGVIGAYIHSGNRPPRPYVSQLVASGSVQYVSVADIPEEVRRREAEIEAAKEDLASKPEAIRLVLGCKGEHRMPSANCI

SEQ ID NO: 13240 - protein, 575 aa, Chlorella protothecoides
MIAEGAKPKPSHSPRRDPSAGGGARPGSDGGAARGAGGRQGSSSSYSGRGPTGAAPGGSGAAATVARKSSAGRDSGAPARRKLNVKVGDVLMGKIANVATFGAFVDVGDGTTGLLHYSEMKLPEGVTDVTSAFKPGQEVEVRGEGVPSSDELNPTPCLLASTHQVLITSLKPDKRGNRGSKIGLTMRSKTEVELDRKLKSGGLRTEGAGGAPEDAEEFHAMGQALKMAGLNLSLYPKVGWGCRGEGVGRVAKDERGHAWEAQSTTQQRALPEVGHGTALIALHTLPSRDLLLPLAFSHSTPLLTSQQASSVSVGGGSEVPAADQLVSDDVLISDSGPAEESQSAASSPEAVSSPLVDSAPVVDDSPLTTKEEETVEELATAEVDAPSVVDNLDTSSLATDAIGSPAKDKPLDVAAAETAAPEEGPAAEEVPDGSPEGAHVPAAVEEEAAPPVSEAAAPEAASVGLASADSLVADMAEQAESAEQVSPLRAVQAAAQPEEASAPKVALSTGAGQENEGANPAATEAATPGAASLDAIKRLRGETGAGIMDCKQALQKNGGDEESAREVGGGSGVSG

SEQ ID NO: 13241 - protein, 254 aa, Chlorella protothecoides
MRLWLAEHRLPHPTPRADSLCARLQACLLTATVRIPSSERGPSRPPPLPVHRVISRSTPTWRRCRPAATASFSAEAPTESSPADVSGGAAAPTAASPATSSPPQSARRYNQGYPSRGPKVQGPARTLAVTDLEVGKTYTGTVVGGRHWCWLIVLVGAAVAYLAAARAMAIIKIGAFINVGAKTDGLLHISQISTEYVSSVTDRLQVGQEVEVRVLTIEPDGLKFARERSLMCWVWMWWLHFVSEGDSRSHALDG

SEQ ID NO: 13242 - protein, 239 aa, Chlorella protothecoides
MGSGDSTPPPPPPNQSTRRHQVPSVLVPALRTVGNIVTGDDSQTQTVINSGALSCLLVLLTSSQKKSIKKEACWTISNITAGTREQIQAVMDAGIIPPLINLLANAEFDIKKEAAWAVSNATSGGSHDQIRALVAAGAIKPLCDLLICSDVRIVTVALEGLDNILRVGEGLREMAGSGGVNPFATLVDEAEGVDHIEQLQNHSNEDVYEKAVNLLETYFDVEDGDVEGLAPAVDAAAGM

SEQ ID NO: 13243 - protein, 99 aa, Chlorella protothecoides
MSQRRQKPTLLYHTQWLRKKGLASAEKKAGRSATEGAIWSFVHGSKIGVLLEVNSETDFVARSDEFKDLAADLAMQVLGGKGGGGGVGVMVPTLLCMVV

SEQ ID NO: 13244 - protein, 204 aa, Chlorella protothecoides
MGARAAGPQRSGRPGVGAVRGGGRHARPLAGPGPAVLRMGRAPGAGRAARGPLRLAHGLGPGPGGPDARDPGALQGSWACGVDCIGRDGGGRGCPGAVGGIAGEWRNGGWEENRRGLLGTHQTNHWVAVHASHQSDGLVGKRHRLREAMLWEDAPEYYTEPRLLSMDLKPPSVPEKLSLGVMDEGGQTALQMAHKRGLQFQLQQ

SEQ ID NO: 13245 - protein, 285 aa, Chlorella protothecoides
  MOD_RES (23)..(26): Any amino acid
  MOD_RES (231)..(234): Any amino acid
MLSSSSQGSPWPAPPCLKTVLCXXXXTHPQALQFDHDAVVQQPGLALACPALPQDCFVPPPRPQAPLTDHSPPPKNTSPIFPCPGGSKACEQDFHNSTACQRIGLARAFLSYGLDVTLSDADWAFAEDPRPFFSRQPHADLLAAGAALVNSTADGDGGLELAASLAAGTDDGLLLLRAAPAMLSFLQAWARALPGRNGQAALESALREGVGATPALWPGQDRLAYAWGGRXXXXRGRGRVAWIVSGGMVVGGGVRVPGGAGAGEWRSGGWEEDRRGLVGTHQTNQ

SEQ ID NO: 13246 - protein, 568 aa, Chlorella protothecoides
  MOD_RES (322)..(324): Any amino acid
MQVPGATHAAWPPLWTSHAVDAVPPHSQAWSCPPPLPTPADPDVTRHPISGRASLGVFHFTADRSPSPSPPLSQKRSPPYSHTHRHPLHLSSIATAGDFGWGSPSFTKMGRQKVDLAHTFLSYGLNITLADSDAVFVADPCAFFASHPRADVLAHTDKLNSGLPVGDAGLEEAGAIHAVANIGLLVFRARPQTLAFVAAWRKGLNQDPKAWDQTLFNQLLHVGRMTPEPAPSRLTRAWDDALLVGILPTASYSSGHVAYVSGLAAQKKLTQVSGCWCGKEGAVAGGRERDWQRGARRGGGHLPWSLPCISFQRWTPTMAPVXXXPAMEPPLHFLSSLLDTVHGPCYPAVPCRHLGHISTTARPQPHQDTHMRTSACIPTPAPTPTHSLDALCQVMVHTTFQYGGTPGKRNRLREGMLWYDPPAYYAGPRFLSIDMQYPAIPPGIQTMGEEGMHAVQLAHLQGMLQQMLQIRAGMAMAVVLNRTFIMPKEGGGGGVRGFSNEMGPRSKARGGRVHRGGPAVFLPCSNPHALSPAYQGWRSQSVTSRPPVLLTVHACNASTPRGFTAQYL

SEQ ID NO: 13247 - protein, 434 aa, Chlorella protothecoides
  MOD_RES (377)..(380): Any amino acid
MLERMYTRWAERRGMTWRALYRSLGEEAGIKCVELEVRWAVANGIFGVSPPCIQTGHGALGLWLAGRGEGDPPLGPAVALQRQGRAADLLCRRGGDAGAGGPGGQRGGAGDGGGGVYHACWRGGGAECEQGGNRGADRAPAHRHRGAMPGGANAGVQGAPQGGRGDTGRSALNMWSGAACAWRGAVWGSRQTHGSPKWVPPRQPHSHELHRTQTPPPPRPVQALNKALAFKWLKAKLLVLAQEKQREAAAGIRGDHVKAGGRRRQAGWGQGWGHSQGWWDGARLTLHLKSWAGIPLATHPAPPGTHRVGPADPELRATPIPPGQGRAHGKRKQCGGRHTRGRPGRLHGRIPQLGAAGGQAGLGFGKYDTPRRLCSGXXXXWGQQIRNYVLHPYRLVKDVRTGKESSAVDDVLGGDLDGFMAAYLNWAQREARQA

SEQ ID NO: 13248 - protein, 224 aa, Chlorella protothecoides
  MOD_RES (95)..(97): Any amino acid
  MOD_RES (118)..(121): Any amino acid
MAALQGRIADLEKQAGDPALWEDTSSAQTLLQRLSEAKETVASLQELSGICDDVDLTVDLAALEKVGLVLECGIDFVGVGMQPLCAGLMRCPTSXXXDDVDLTVDLANLEKSFCPGGXXXXMFSNLLKHWHCVRNLATFAPPSLALADWKLTAARGFGRGPDPGFGSGGPAGSTGAAPDAERASGLDLCAMPRVPASAQQEFEHTIRGASAWLQASTVTQGCSH

SEQ ID NO: 13249 - protein, 799 aa, Chlorella protothecoides
  MOD_RES (43)..(46): Any amino acid
  MOD_RES (512)..(514): Any amino acid
  MOD_RES (570)..(573): Any amino acid
  MOD_RES (605)..(608): Any amino acid
MGRTVTVATTQMTCSWDIEENLVRFDNSPRPRPTLHSQAKAEXXXXFGNGDRAARVLPWPPVVSFQMADQLTATSPDLALPGKGRTERACRRGCGREHYPPAGPAWTLFRNAVPDRVIRRPVPCNPLDAKPNSPATPQELFEAPYFCQEQLAKHYALANPVEGNPLIERFAGLAKELGVVLPSESFRGGWDANVCGNGLRGLCTPTLAVMCSLSHTCPGMAQRRMWICAPSSVLQVLSPCARRRGCTPAFLARHWMWHSQARTHTGTTTACPAVSFFERAGNAYFNSLVVIDADGMTVCGLLDAPAHSHLPSVAGGRCGPAALHSLWLPLCLGIGSLEFRPSDSYLLPPPRPCSGPEQSLPCTLLAPPSPVLIPACRYQEKFYFSPGDTGFKPFDTSFGRIGVLICWDQWFPEAARCLALQGAELLFYPTAIGSEPPPAPPVSSYLHWQRVMAGHSGASMVPVIAANRMGREVFDASEIMFYGGSFITDETGRVVAQCRRILPVSYRHHGLXXXPHLLGPVVPGGRPLPGAPGRRAPLLPHCDWERAAPRPPGQQLPSLAAGDGGALRGXXXXWLSAGGCYHSATNTMLGTEQELRHNSNPSQHXXXXAGVEVCCGICGTPAASVCLFSTKLPAGITATHHNTPPLAPQVGSGSLPPNGGPDASPAKEEGFVTATFDLDEIRTARAGPGLWVCPTLVMHYDLGPPLPMGQVGHVQRQAAGAVWGYQDYGRIFPGPVNLRVSVVEAYLTCMLCSISRNVSNDTDLQCSMGANPSHANLMHILGKKQEGSRRKCCNSTLDL

SEQ ID NO: 13250 - protein, 434 aa, Chlorella protothecoides
  MOD_RES (179)..(181): Any amino acid
  MOD_RES (301)..(304): Any amino acid
MLQPPATGLLRASTLLTTAECLLHPNRNPGLSQAEIEARLMAFLGVTRVIWLPRGLVADTDTNGHVDNIACFARPGVVVLAWSDDAEDPQYERSREALAVLEAAVDARGRRLEVVKLPQGPAMHYREEETASIETPAPRAWWQREAVSVQLSQAGHRPSCSSPCNAQKAGAGEMDRVAXXXQCLAGSRGTAKAAMQGGQGGVGQGVAPHAHPPCNAQRAGAGEMDRVAGTRLAGAYINFYICNGGVVMPGWGIPDADARKSIAAGMARVGGPPPQHVRPLPEQTIVAGPRRCSRRCSQTGXXXXPQHVGPPPKQTIVVGPRWCSRRCSQTGRWCRCTRARYCWGAGMCTASRSSNPWANLPPWAALPSVHCEKCKTYRKPEHPDSHVTNSLDNSGPSPSDTSLNPEQLHALHTPRARHGSRTCLPLGEARSVSA

SEQ ID NO: 13251 - protein, 1375 aa, Chlorella protothecoides
  MOD_RES (152)..(158): Any amino acid
  MOD_RES (305)..(308): Any amino acid
  MOD_RES (350)..(353): Any amino acid
  MOD_RES (530)..(532): Any amino acid
  MOD_RES (652)..(655): Any amino acid
  MOD_RES (675)..(678): Any amino acid
  MOD_RES (738)..(740): Any amino acid
  MOD_RES (899)..(902): Any amino acid
  MOD_RES (938)..(941): Any amino acid
  MOD_RES (1044)..(1047): Any amino acid
  MOD_RES (1333)..(1335): Any amino acid
MKQRPLGFGVQGSGGGVGFERWVSSVGRAKLHNRSLGSRAQPAQLLFAGTGLSLKSTTFWWIFEKELGPSQEPEVETSIEFSTLPPMRRKHTEFPLIFPISFIKLGHGACTFNNRICHCEASTLTCFLVHARKALSCASHFVVSWSRLATQXXXXXXXQQPLWCRPDQDRSRPSQASLDHRIDHSIAGPLGKMLGASRRIQRALPRGMMWKGRSLFKIISDSPKRGVASAIHCLAANMKRIPSRIGRSTTDQCKFRSIRPRTVHALRTHVQCGASKQTQNVCRTDGTVGRTLLRPFRSGLEVAAXXXXPMALSTRAYPSPEQVPQSNGAAQKMVSALAAAALAMLAADSXXXXPEQVPQSNGVAQKMVSALAAAALAVLAADSSRLVLAPPPATAGLISTDPVKDAKALLRYALPIHNTPIRQVQESLESISEALRIPGGKAFGPIGRAVRNAASILDRETGTITKALVKERQKQGQDDLVLLKQGSCEGNSGGSTPQPCCEPRYSPPFERRAGVPSWWATPRNIHPCRXXXTQKLSELQAVLGNKDKNDIPVLQQECLNLVGDIEESMVSGYPFEVPKEYANLPQLKASGRGGLGRGRDLQRYNREYVGTLRACCLWRHPVPGASRHAVGQCDPWGRGVRCLQDTHGVLLXXXXEREAGVRGESLGTTRVAVPXXXXCLNGHSTCSGSCHAANGCEVLQSPRGQLDWRQDGHCRGWLQCPTQLPRPECAGSSHANPXXXFLIVIAWLSSVEQTWLPQPECAGSSHANHPIPLPSAGTFVDLAHKGFYDGMLIQRSDGFVVQSGKPESGVSHWRQHGALCLCCVVISEESARYPASMGIAPVLRTVPFEVMVQGDKIPVYEETLEDNGRASPCSQLRQEGPLALCPLSLQVQRAASAPXXXXFGCATGLHLVPKYDRRAHLPSALFPCRFNEQPVLPXXXXLPAEVTNKYIVSKRINPFPSATLRVKGIGADTHWIQSAGWAVCCVWICDRGSTTPERAPGGWCHRCWQAATWTAGLSALHWLAYRVAIGHHAMACSCQPCTHXXXXLKELQVGGATAVGRLQQGQRDCERCTGLHTGWQSVTMAWLAHDNPAHTHTHTPWQGGDKIERIKSCRWSGCKKAWFGPLTPSPGRTRVMNTPERALRTSAIKGVHAEVVPGKSLVTRVAIADSAMPIGALITASSSSETPESSHANSLEAGALGVNHRAIGTCAWDPSVGDHALLFLTPRHGHSGGTPPNCATTPSHHSAASGLDLEQMAGGGRGQRCMHPWSRPGGHPPGCADLVCRWRAGVHSFFQFIQLLHVRGGYGLRNRDMGCKLYRALHYLLGPGLNSRXXXKGAWDPSGRVWAQAQGHGMQIVSGPASPTWAWTQQPMPAT

SEQ ID NO: 13252 - protein, 205 aa, Chlorella protothecoides
MAHVGSFAGRSGVVCPGRPAPFQGLPSSPRGGRPSTRLGAGPKKLNTFDDSWQKRWFGAGYFAEEKDVSPSSMYRKIEKKKVLSGVERLGLLRGDISTPTVSHFMLMPLAHVSSLSPFFAAFRHPPPPPTWASLDPPPQQGGEGGPDPDQDRAAGPAGRGGEPGPPEPGGAAAGVGPRPHHQRIHPGPGAVHPGRRAHPPRHGAD

SEQ ID NO: 13253 - protein, 157 aa, Chlorella protothecoides
MRWLGLIIACSFIIISSCFIAYRSFQVMGARHWRGTTAPLHPPARSECDPVCPPVPLQVLPWGILATSVTILRVPTDEVPQLSKELAWAAADGGEIFVTWANEHFSDFAVNWALHLKDVGVHNILVGAMDVGAAKASSTGGGGGGGPELAQPPLFCG

SEQ ID NO: 13254 - protein, 66 aa, Chlorella protothecoides
MAAYKPCHAISHSTQFLVREGADGREVAGVDWEFNAWGGLYGDYSKDVKIASAILEVTRRLDGRVS

SEQ ID NO: 13255 - protein, 100 aa, Chlorella protothecoides
MLPDAAICTNVPSPDTCRYPIIFPVALALGAMTYSMGRHLWTNPEVFPSKKLRTEGIPEEETNRFRAEGYSKSIFRSLQEVWACAERQNGWGGWVDVRRC

SEQ ID NO: 13256 - protein, 455 aa, Chlorella protothecoides
MHGPAGSMAHLGPKGECQGLHAQAHPQHWDGGALPQEVHAHADVAGPGWRARAGRQHHRLVQPPLQIPAQLWPLHFIVSDHLWRGCRERGGIDGRIHGQDSVYDQGRTIVDNGVQGWVSLAHHILISQPPMWGRMALGQMQIGTSPVACLCHCAARCGNVRRERGGVFKSGTSSLEPSRPQGFSVHRLRVLRQVTPPLSRFIPSASLHGMIRLAPLPTRASTLCRFFVPRQARTRTACAAEADPFNQLFQKRKPTGLRPSYWLNSQDSIQSQLKASSVGLWVPCPMRCDSHLPGTAALAANNKPYPDHGIEVAYRFAGFDPFARSQYFGISLDLGQFERYRRIFYTPLYRPLLGHTSVEILSQLEVDDVSLVTRVLVTNSFRREEQVYEVCGPGAATRGSMAVWESILLKGTDANQTSLMQLSLRRRVGGRFDGAWFTESLIAEGSSRQTLYGVI

SEQ ID NO: 13257 - protein, 256 aa, Chlorella protothecoides
MLEGWHALDHVRLCSVPQSQSLLPLQEPEPALRPRGPTPAEAQDAVRVRPPWRPVPQRQGRGRDARGWALDAALQRWVPGHGKSRPRRQWPQQVPGQGTDKPSCDQTGYQGAYGFVAEVEWHPFDPGAMLFMDWRDDHLADRPDLRASNERLPSFLYAMPLSATSVFLEETSLVARPIIPFEDLKVRLEARLKYLGLEVRGRWVLGGMKIFLNAVMDNQHAAKFGCGNPVSEKEHPALSMTANPTLLSAPKDQEHI

SEQ ID NO: 13258 - protein, 101 aa, Chlorella protothecoides
MGLGCLAGMLELLRIRLPIPPLPILPSTTTGSIGYISTNGAFDLNIVIRTAVVWGDRISIGAGGAITVQSGPEAEWEEMLLKARVLRRSVASVDALGVVAA

SEQ ID NO: 13259 - protein, 174 aa, Chlorella protothecoides
MDPAINPLRTLLIDNYDSYTYNLYQGIAEVYGGHAREPESLHKPIHLYQCALHPPLPAAPPKVIRNDEVEWPELRRDLERGLYQAVVLSPGPGTPARPSDIGVSMHLLRERTPIPVLGVCLGMQALALAFGAEVRHAACGPMHGRLSGVRHSGHALFHGIPSGEQAGQGCRILL

SEQ ID NO: 13260 - protein, 68 aa, Chlorella protothecoides
MRDPRLLLNNLKCNTAVGVFGFKTVLTHRMTMGYVEVETTKNSVLMAPGRTARGQVFHYTEIVEVCVV

SEQ ID NO: 13261 - protein, 273 aa, Chlorella protothecoides
MYHELATGSPSLNLDGWMLTREAVCATFARGAAHADIAVVEGVMGLFDGLDGATEAGSTAQLAKWLRAPVLLVLDCSAAARSLAATVRGFRDFDPGVDLAGLVLNRVAGAAHARWLRDALAAGGLAELAVLGGLPSVPSVALPERNLGLQVPGEDPGGAAAAVEALGALMASHLDLDALVDLAARAGSGKDGPARALIGPPPAPPLPYRLSEEEREAPVRIAVARDEAFCFYYHENLALLEAAGAELVYFSALHEPLPGGVAGVYLGGGYPEL

SEQ ID NO: 13262 - protein, 186 aa, Chlorella protothecoides
MQFPQYHTQALYDMYEGQDWDPHSTLDLLEELEREVAECLTLEASTMQTSSTSAIDTEEATADAVDASQEAFPALGCPLVSNRAQQPSSRPTWAAKAAAAASAPAPRPPPSAAASQRAGSGTPTSAKPIWLSGEDVRRFETGQSVAADYSEVRAAARDHARLRNQFFMQASNMRGVKWGGVGGLGV

SEQ ID NO: 13263 - protein, 270 aa, Chlorella protothecoides
MHDGESYELCLTTQLTRQGAPPAWPLYRTLRALNPAPYAAWLDFGAHGGPQICCSSPERFLRGDRGGVLEAKPIKGTAPRHPKDPVADAASAAELEGVSGGGPGHGPCHPGGLQARPLPPSLTCHPPSSKHPSSLRQGARGEPDDRGPVAQRPGPSLRSRLCAGALPHGPGELCHRAPTGVHGHWPAARGGLGAGGGGGRGGLVPSPFPRPTLPPPGPAPSPLQTASVVDCLRASFPGGSMTGAPKLRSMDILGRLEAGPRGVYSGAVTD

SEQ ID NO: 13264 - protein, 104 aa, Chlorella protothecoides
MGGALPTLPQRVLGLGGTAGMVHPSTGYMISRVLGAAPLVADTIIDQLCSVSDRAQDRNTPRAPRSEEEADAMAAAVWAALWPKRRQRQREFFWFGMEVRREGV

SEQ ID NO: 13265 - protein, 297 aa, Chlorella protothecoides
MRHADRVPCCGARSSLCITEDSARRLRAGPPGTAPIPRPYPCTDDSCGPVLGTPLSATIDLGLVHARLGKGALPSSLGAAPRVFERLFRPAPHAWWLDSAVTDRGGRWSFMGSGKGGALWRTASYLGDGVLEEGLSGEGGASASTTTHRLPGGFWDWLDEDVQARRLCPAAATAAADLPFDFWGGWVGYIGYELGTELGPGAGLAADVAGNPPHASLVWADRLLALDCATGEAYALACHIQGDGRAADEAQAWVAGMLEAVQAVAGEPDGETTPGAGAAGSRAQPRPCARLPAPGAA

SEQ ID NO: 13266 - protein, 208 aa, Chlorella protothecoides
MLTRALPGPFGERHLADLLLVHVVAWPGAACTARVRRAAELAFVASPWAPACECGGGWGAGGANAPRVRVHRLTRGERGVLRPRPVLALIPHRLPPGRGAWRERRGISAPGASGRCLRPRGGAAPRPGLAPAPGPGRRGAGPSTLGPRPLGGCMAAGGAGCLGGGGALPGPGRVLCQAGEDGVAGGCWLEAAFTLMPRGRQALWSLGV

SEQ ID NO: 13267 - protein, 502 aa, Chlorella protothecoides
  MOD_RES (108)..(111): Any amino acid
  MOD_RES (297)..(300): Any amino acid
  MOD_RES (414)..(417): Any amino acid
  MOD_RES (493)..(496): Any amino acid
RAAARLLPAALAPREAAFLPTAALRLLDTLHAMLPGHALLAADFDSLPEVSIRGVNAPLVATTGRAGTSSLPRPLLPLRLAVDASRLPSPAHSPKPPGSHRRRGARAXXXXQALHLSPARFFPFASPWMPLAFQAPLNPQTPPAHTGEGEHARPRHLPRPARHRRHLLPHRLPAAGGAACRGGVRRRQTPAHLQQRRQDRGVHGHLGGAGGDAHALWVRAAAVRLQQHLRVPGGLPGAVRPAAGREGVTVRQRGRRGSVDPGLLGVGGCPSAHGSELGIQRRGRAFESRASLGCLHXXXXFVWGGALLPRERAGHSEKGRASESRASLGCLHEGDVVALEQNAAQGLARLPLHGNLLALVQHEVHVFIKALRGGGTEGVCEKDGKDSSWQHPGHGIEAAGTCSSLPGVPGCGCXXXXGRNGGRVGEGWERFLWVAPRAWDSGCRDKQPPPRRAGLRVCRRCSALNSHAPHRRSCGNHPFHQNQPSPLTMMRPXXXXAVWGMT

SEQ ID NO: 13268 - protein, 94 aa, Chlorella protothecoides
  MOD_RES (42)..(45): Any amino acid
MAPKVKRIMTQPIVSVGDGGCSPVGQRGLLAQAGSTGATSCXXXXRLTPAALCPHLQNLIFRFLQSRQKVQIWLYDHNDLRIEGRIIVSGDGCF

SEQ ID NO: 13269 - protein, 707 aa, Chlorella protothecoides
  MOD_RES (131)..(134): Any amino acid
  MOD_RES (310)..(313): Any amino acid
  MOD_RES (360)..(363): Any amino acid
  MOD_RES (555)..(558): Any amino acid
MPHVKGNKFKPAAAAPAAPQVGALDVAGPSPVGKQPVPEKASDGSAPAPRGSSDTPRPTTHGAQVPTAGKTAAPHATAPPGKRRRKGLKAAAPPAQQVVQSLPATVVPPAPKASASGAIVAAPNWAALKAXXXXPGAGTNSGRGVTPSSRTNPVTAVLALDCEMVGVGPDGERSSLARCEGGLYFFRSTPLLGKCSKLLDGRRAACDPPLQRALRSHPQQSDGNASNHPRSDESASHHPRVCIVNAEGGILLDVHVQQKERVTDYRTQFSGGWRGVARHACGQEQVMHSESICCPERCAESLHGNTFPLXXXXWASGPTGRGPPWQGASGVPTFSAPLRCWASVSKLLDGRRLPVSLPCXXXXVLVGHALHNDLEVRWGWAYGRRLQRAGGGCRACSYEGISSVFERSGSPTTAPSSAVGGGAWLGMHVVRNKHPTQRSGPGLAPGGCAGLGQRPGDRQGPGRPRAAQRSGGICDGYGTVWCAMLTPGQLPLPLSQGPLPSLFCYPQALEMSHPPAGLRDTARYPPFMFQQVSPSGPRPSLSLDIVVKRLHKGGXXXXLPLPLSQGPPPSPFWRPQALEMSHPATGSRDTARYPPFMFQQAQGGRYKSRSLKQLSAEELGLSIQDGEHSPVDDARAALYLYLKHRKGGKKTGSGAQAHKMPTWEELSRNDGMIDLSAELEILCRLVACRGSSFPPVMGVLPPECAAC

SEQ ID NO: 13270 - protein, 685 aa, Chlorella protothecoides
  MOD_RES (17)..(20): Any amino acid
  MOD_RES (185)..(187): Any amino acid
  MOD_RES (212)..(256): Any amino acid
  MOD_RES (635)..(638): Any amino acid
MRKEMTPGSAPPALPGXXXXKSVGSMREEMTPGSAPPALPGRAPKAPGDLLLTLCRFFNMVTIICSLVCAAAFGMAIAVRVHAPDKDIYYLSGQAVRVYGLLTAILVVFVELEVAALAAWWPLLEIWLGRAMLQSFVGVLTYRCGGEAEDRLVLSCRCMTGGRGVLVKVQNMQPIESQSGQGPPXXXVSTASLRHKPTLNSIYRTSTTSRAXXXXXXXXXXXXXXXXXXXXXXXXXXXXXXXXXXXXXXXXXXXXXREAEDRLVLSCRCITGGQGVLVKVQNMQRIESQSGQGPPNSTCKPLLDPASHPPSPLYMCREALPRGDTDFHRSLALYRGIASVALLVCSGVYAVGWISCLGTIKHSHSVNLPLFYHSSPDTSRPATTQGTGRVRGTGEAEGRAAAAPAPHSHPLESLCMAMICGLAPKRCSVTGRLLSLTFVQCNVSVHQEVMAIRRWGSPRAERWKEPLLRTCAGMRTGTGFSCGCKMAASTGTALVPHRWMPGMSVCEGRLSVHRSWRMLSSMTESFVSRRPSQRQELGRVDTPCNGVTAFLWTPEADGVLVGTQGGDLLLITFPPGAGPGVEEIGYVEGGVKGAAWSPDGMRLVLVSGNGQLLIMSEVRSDAGYVMGNWGRSMEXXXXWTAAHHVRGAVRCWLCHGKLGSLHGGLRLTSAICACTQLVQVWTGFL

SEQ ID NO: 13271 - protein, 331 aa, Chlorella protothecoides
MSPRGDLRGLEPHPALRKAHSQSDRCLTLPTTVHHNNHLQGKLGLRVEGVRELAMELADELVSASRPAEAAAVRLEYCRDVDAAAALLAAAREWREGARVAASHARPDLLDRYAARLEHLAARRRDLAAALAAAEAERGQEGGDDWDGSDAGRGPGSDAGDDAASEASGVTELSAYTDASLAPSAQSTRSGHSSASTLGGKRRQSAKSRRKASSLRASSLRVRQGSPEEEDQLANHLLSQAPSAAFCAEMGQLAEFLVLLGHESDARRLQQAVGELVAACAATGAAILASPPPGMLAEGGQGPSPQLALRVAAAEAEAKSVTWKWDVLRAV

SEQ ID NO: 13272 - protein, 218 aa, Chlorella protothecoides
MAAAAALLAMQRAARCPQLTARAPQLTDLRRALTPGLGRCWSSEATDGPEGLPLAQVAKACLAGNPRAQLTTVRGEALNAGTEPKVGSCLVHALAPRGLPPLVLLHPALHAEALRDLDLNPTNPASLCYGATDPPGLLQHVRAAGWLPPRLVLLGGLAPVAPSEVRGGLARCRRSAWRAPNPQIAGAESLEAGLFVRAPGHRQHHMGLAGRLPRWPRA

SEQ ID NO: 13273 - protein, 111 aa, Chlorella protothecoides
MPGLDVGPLFETVQALDSALTAQLAHPGQATFLLVGAAGLLTSVSPCTLSVLPLTIGYIGGYGDQAGGTSLLARSAAFATGLAASLALLGLVSGLVGVAYGQVSPGWCWVE

SEQ ID NO: 13274 - protein, 80 aa, Chlorella protothecoides
MHPPGDVRISVTPGAPKPNPCPQAAGSVAPILVSIVAMAMGLNLLGVLSFRFPTLDWDVRDLGLPPLVQAFLAGAWTAGC

SEQ ID NO: 13275 - protein, 67 aa, Chlorella protothecoides
MPWVLPRGIFPILFTHALRPSPAQGFDEYMNLVLDEGEEVSVKRQTRKPLGRILLKGDNITLMQAAK

SEQ ID NO: 13276 - protein, 726 aa, Chlorella protothecoides
  MOD_RES (715)..(718): Any amino acid
MRPPIHAHPLILPLESPRTPDLADLVTGAEGSLESGTRLYLACLQQCVVGHGGLEAILVALSDAWELLRHCRAHNAALTAYPSGRWVAPQKFTRVTRKFWMRACDAPAFKAEVIKHLPVLIYGDRAKFTEGDVEARRCLAGAAHVADAAAVTSVYFDNPEELPVYHARLRRADGATAVRLRWYGERAAASPDQEIFVEEKVHRESWTDHFSSKERARLVQGEVAAFLAGQDVGGSRPAEDAALLARVQAFLVREAQGPFLRTTYQRTAFQASDSAAVRISMDSDLRMIREAGAPRARGDWCRDLTRPLAPADIVNFPFVVVEVKLQRKAPEWLTPLLKSGKLLAVPKFSKHIHGTAVLFQLLTENVPHWFLPDAANPSLMTPATWHELADKSDALLRDAASWLFPSADGGRRRDADPDPDLAPKASLLRRLARRNRTAPVLLQPGVKGAVGSGGAEARGQSTAGAEWQAPVPPAPAGGGGSGERAVEEAGHADAAEHDILSGSAAHARMPTWPVFAAGEALPPPTTCAGPGDGAAHPTRIPTPPPSAFTGPGSTPQPSVYPVSQLVAVPMMLTPRSYHGNSGGGEDNGAGALQRHSSSSEQGPGNGKAKNTGSSTPEDSARDLEAGRALLGSAGDLKVLGGQDAVTLAATRSGRVQALVRTRVEPKTFFANERTFLAWLQISVLVMLTALSLLSGSSISVPGAGSASGGSEASCXXXXVKTPLPCP

SEQ ID NO: 13277 - protein, 275 aa, Chlorella protothecoides
  MOD_RES (132)..(135): Any amino acid
  MOD_RES (177)..(180): Any amino acid
  MOD_RES (266)..(268): Any amino acid
RPPSDPGPAAPRRWSRGRGGAPGAAHRGQTAAPAGGPARRARARGRPGTSGCRGRPAWPSPRACSRPRNVGRRAERRGPAPPAGRVGPRGPRGVRGLARGAAWGLAVPAWGLAAPAWRRPGVTHTPHRIPIXXXXRWDKGGQGWAMSWPGWHGGDAVKGAMQYPLLPRNLPRSTLPXXXXLLGVWPFLLGVAPVRRAPLTASPSELGAGDQQASAGGQQRRRADAPDLVLPWVERAHGAGAEEAVPGRGGEIRASAPQPGQGCGGXXXPSPPARC

SEQ ID NO: 13278 - protein, 293 aa, Chlorella protothecoides
MPPAKLATLLRQLDSLSRLSATSLPSKYMPHAGFSWAPFGCARALRTCTPPRASFSRSPDARPAPPCLPHGPLLDRGPWRHARRMSVEVAAARHSGGPQGVNPGALVQFRRGEEFHLGRVVRPNSRGWQVQDASGALYGIRAQDIAYRLPGEDADLAVLTAEVEGMLDPALLALGWEVSEASALYSVAQMASFLYGSEGPAARAAAHRLLQQDGTFFKQVGREPPLFSPRPAAAVEALRTERAAREAARAAAAEFQAAVHAARRAPPGSKPPPGAWAAGPHAERMATLAAYAL

SEQ ID NO: 13279 - protein, 239 aa, Chlorella protothecoides
MSSYLALPLHCCSDLLEGQICDGMLQAAARRGGLRLLGAPHRPSQALIDASGAQRLYSAGIDGARAGVQTAETSSPASAPKAPAVLQLHSDEEVQTALNALGGYMRDGHDLRAWVDRSREAAMPEQQRGCLCCSTEIPLLHLTRAGAHGLAILDFTAVWCPPCKMIAPLYEQLAASHPAINFYKVDIDGEAVRGTVLEQAVSSVPTFVSYRGGKRLDQFSGADRAALQLMVDALSSAAA

SEQ ID NO: 13280 - protein, 338 aa, Chlorella protothecoides
MGGPANQLGHPLRIEAADAAVFGYVLLNDWSARDLQKWEYVPLGPFTSKNWATSISPWVVTAAALEPFRVPAPTQDPAPPAYLRSQAGCNYDLDLRVGVAPAGRAGPDPVTHTNMRTLYWTPAQMAAHHTVSGCPLVPGDLLGTGTISSEVGSSGAEALGVPWSSGREACRTGCGLRQDTLCSAYSVPARVECFESRSAAMGFLECLLTREPPIGMGNQGAQAGSHAPHSSAAVGHHAGIGTPARHSILLTSSTSLPLMPTLAGPGRRGVPAGGDAERDETCGTPERRHAPRLAAGRRQGGPHRPLSGRGLPRGVRGVRRHPAARPGPHLGLGARGAA

SEQ ID NO: 13281 - protein, 113 aa, Chlorella protothecoides
MQARDLGGAAQNQVPAPCLIVTPLPHIRQAMDFAAETLGFRHEDIVAAGDSGNDVDMLEGAPAAIVVANAQPDLLEWVERSRSPGVIRTRGSRAWGILEGLERLGGGFQPPTL

SEQ ID NO: 13282 - protein, 243 aa, Chlorella protothecoides
MQPTTFRAFASSTRASWWPSSSPPETAKEGGTSAAAGTEPAAAPAGEPATEAAASDLTPDELKQALQAAKEQLELAQKEAAESKDRLVRTLADMQNLRERTARQIADTKQFAVQGVVKSFIEVADNLDLAIGSVPEKELEGGEDVDVERALTLLKRLRDGVVMTESIMLKLLEKEGVRKYDPQGEPFDPNLHNAMFRVPNSGVKSGHVAHVIKDLVSVREAVKKLGTVRGTRILPLLYTTEER

SEQ ID NO: 13283 - protein, 272 aa, Chlorella protothecoides
MGLALPRSREHGHARRELQCRVVNQPLAVCRSSSLPRHASSGACDPSNYSKVHHKPRCPAPRCRERLTSVSAFTCKDCGTTVCLAHRLPSDHACTSLAAPGGSRAQGRSSAGAVAAAAAQSRVAAAFSNLFSGSTARGTPAKGQGRRRQQLPSQGEAARPSSSTAGVPASAWEPHATPRSSQAGSQPRAPPSSANEECPACGDCFADVGQLIAHAEVAHRDSWASGARLLREACPLCELRFHDPVQLVEHVERSHSGGRPQQREPEAVCVLS

SEQ ID NO: 13284 - protein, 85 aa, Chlorella protothecoides
MAVGDADEADLLSVGTHCAFPDCNQLDFLPFTCKHCRGVFCLEHRSQAQHECARRDAEPGTLVCPVCALAIRPRPGESPDAAFEK

SEQ ID NO: 13285 - protein, 331 aa, Chlorella protothecoides
MLVLRVPHSHPSSQNQTIRPRPQATANPQPLRRSTAAPQPSVELAYSTGWSGASLHGSIAGQEWQTLGLKPVVSGAGAWHHLNLPVPAQGNPPTPLLEFVMTDGASGWDKPAEGGHYTIAAPGRYCLQHGRVESVAHSRRLLLVTDLDDTLVGDDEATAAFRDWWLARAMPAGARLVYNTGRALGLFEDLLCAKRGLLPEPDLLLSAVGTRVYERGAEGAWRAAPGHAPRLDAGWDLEAVRDAAYAALAAVGRDAMHFRPPAEQNEHKVTCGVHVGALARVAQDVRERLARHGVRLRLVASGVGDWRFLDLVPMAAGKRQVGGDSCVGCVV

SEQ ID NO: 13286 - protein, 285 aa, Chlorella protothecoides
MTVLHTISIVVPGTGAESFPFWGVPKQCSTWGCRGMEATGLPSETPPTRLYRVQLVSLCRFVGITPYGTDAFLRTRLRRHLQQIKADDRDIQAEGLASLSEDELRGACRARGMRAPFGEGAADFMRAQLAEWLDWSLNRSLPSSLLLLSRAFTVTSPLSGGRRGVDEDMLRSTLGSLPDEVVEDVELFATRDGDDKTEAYERKLELLEREEEMIKEEEEAAVAAETPITSGAQTAQELTAAVAAAAVVREAAASAMVDVLEGVSEEEKAAKYAEARRSKMRKVVK

SEQ ID NO: 13287 - protein, 431 aa, Chlorella protothecoides
MVQAEASPAGLASLFEELISLKTGSQLLGDQPDYAPALRAASEQILRLRALLRERCEHTESLRQDTAAAKAKLDESSLELKNLAYEKEHYTKETNACRAFNTSPTVPPRSAYADEALELLPVDQFLRIWGDQDVDDPHRLMLNRLTHEMVYRWGKHLCSLEAWPAALARWIRSPFSPVFPARAISLPHSHGPFARRKETIQQLEGLRAKRDALAAEVAGKRGTVSGLESELAGLHAKALALAERYGAAVPPAPGAAAAALASAATLAPPLYVLHSQLLAAARRGEAEASGRHASVEVAAAPGEDGRGGEPIVALRVTSGDAVSLAVDFRYSAELGAVLAAPHPPTTAAQLEAVGGGGAAAAGHAPESGAYAWAQSLAGLDLLPALPPAPASAAWSETELREAIDRYTAANTAPSILASLLEASRQEAMEED

SEQ ID NO: 13288 - protein, 518 aa, Chlorella protothecoides
MAAVRQGCSNVFSKATGGEIPAIKLRPGVALPHVTLPTTEVRGGAMWVCGVHGVCGGTLPPSRESWNRPRSCDVPMPPLTGRSRGAGSAYRKVAAGGGVPWPARSPGPDLPGCSAGTGGALACLGMGHACKGLSSPAWQHVGLHRVTLALFACSTSTLSLRSWEWISPPCQPTPVARPAALCLTLASKVCVRDGSGIGIFWMPFQATLWHASLATLFCSLTLFPAIHDASGPDRPLAWIQPARSFPSLCQVDDLRGAVLAVSPDTKAGRIGFKVAYGLNEEQMLRWGLYVSKPLGPDESSSLFSGELWVGGLWFGAIDDQISVPGALPTPPVPRSFQGLLMCIPSTHQLLTMLLSPPPPLNTTEPALFLINPAGLLHVVTYSNASFARPDLKQIVQGGFGREDRGTVWRDTAAEQSVMRHLLQILPSRRHPVCAGPQAPHPRHFPVTSRVAPPCEASSSQPAQASPGHTAHAPFPRIGSDTHTSGDGLTIAPVVIDPLCLKAPPPMDRARHMCRSEGG

SEQ ID NO: 13289 - protein, 181 aa, Chlorella protothecoides
MSIEDHAAFFARLVEMVPPKFYLHTDAGRVNLKYVKKSVRDEAKAAFKAQYKENKKAQLDPDQAKSTLDLQREVAAAAAAEQRASGRGNEAGPAPTTPVVVGEPAATASRQPAEGTAAPVATLVLTQGGAWRCRDLGLQGVVMPSRPRHLFAWQVVLKGRGIGRGTGLKQGQAHLSPLHLR

SEQ ID NO: 13290 - protein, 366 aa, Chlorella protothecoides
MKSGLWEGCGVHQTTRRPPAGHPYVEGCRARPATRTVTSDGDDSTEGHIISIDRSGLYAPDDHTVEGVEKEVETAMARHLKTLIKFRSGPITLAEYMSEVLTNPTAGYYINRDVFGTAGDFITSPEISQMFGEVSGGLKGCQKGVDEGRPDQCRLESFGSLHTVTKPGYQHFKPHATPHLLADGGDLVCQHLDADGEPAEAEDRGDGPREGHPHGRPAQGNGCVPHFPLCHTGVAWRGQSSSFGLDCGAVGDPAASQLHGTWPSTCRFCGWGQDTPTPLSTRRRSPPTGRPGGGVAGPPSPASPCPALRRGRAWGRPGAVPARPRSAGGRRRLAPVAGRRAPGPAHPLHRARVHRRPSRAPVPEDR

SEQ ID NO: 13291 - protein, 162 aa, Chlorella protothecoides
MLVCRAVHAAFRQSLSPPPPLTSLVAYQRSISPLRPCAVSRRNIFVEPPSRKDEELKELYPPGRFNSEEDEDERPPAQLSVPQQRIRHAQTPLEVSTVGPAAHSRVKSATFVKSSVTVDQCPHATHPEFAVIGRSNVGKSSLINMLTKRTSLAMVSKTPGGH

SEQ ID NO: 13292 - protein, 473 aa, Chlorella protothecoides
  MOD_RES (81)..(84): Any amino acid
  MOD_RES (334)..(337): Any amino acid
MREVRGDGAGLASAAFIAIIPSYISRSVAGSYDLESIAIAALVTVFFLYVKVGQRVFERWCDEWEGEGGGRLCLLGHGHSXXXXSSTSRWGKGFLKGGVTNGKGKVGEALPTGAWAFRLVHLAHHPNEPLISTGTNPHPPLISLPTLSDQTLNTASLRWATALFFGYLYMVASWGGYSFIVNLLPIHCLASIVLGRGRGVQASAWACDGCASGVDVRRGAAEHGPATEPATLFAAHRSAWTCDAVPLSTVLRRSPPHFMLPTDQCPMLHSPSPNDNDPFPSPVNIPVIGFNAVLMSEHFASFAVFGILHAAFAIKVRRCRGGGCSVVLVWGLGXXXXQGAPVSWWRRWCLSGVGLGGGVEFWGCLHRWSHEWMSGRLSKELQGFAGRHAHASAPRPCSFLHATLLVSPLPYPHPTHSHAPTPIPPAVDQGDAAATNVRGGQARRVDRRHGRGWRDPGAGHRVRHCLPHLWLDR

SEQ ID NO: 13293 - protein, 231 aa, Chlorella protothecoides
MKVDNSVELIRRPLCKGVAHPLQSGEGTARAVREMGESAPGAPSDRVPAMTDASNTPPVSGVATTSTDGSKKSDKRSPGSSAASLTTVLTLIAICLLATAVRLFSVIKYESVIHEFDPYFNYRVTRYLTEEGFTKTWNFFDSFTWYPLGRIVGGTMYPGQVPGPSPGSGHAMAWGCHGMNHVLANASPPIPVTPSSQGLIFTAGLIWKVLQALRSPIHIQEVGLLVLVRLE

SEQ ID NO: 13294 - protein, 306 aa, Chlorella protothecoides
MIWPAIAPKPGAGALLLGVSQYRFHGNVMSHEGRHTDMHWCGGIARSSFGSLPGRLEVRDDSSLRPTFRSSVNTILEFIASRVDNGLLAATEALAVGNLAECSRLLRVDADASSLRHRQLTVSLSLLAAHDSNAIWKVFDLDPRRTTLAELRGQYVRLARLVHPDKTGTPATAAAFHALQAAAATCTRDLAAASAALPAHEPGFAWWDEWDMEAAHSDSKGEAGPAGAAPAPEPVWEDMSLEEIRAEIKRRQAAMLDPPRDQAGGSVPLPLLRQALEEGKAALRRRLQQVEAYGARDREGGFVRGW

SEQ ID NO: 13295 - protein, 161 aa, Chlorella protothecoides
MPRTAVCWSLCSSPTHQDPSRHQLSDETRPWGRDPNFVSPTARDLSCACSVQGYQSLIFQSIQVAIGERWHSGELRAVLSVSGVACDRRDGRLSTQVPRNFRLLEELEKGEKGLGDGTVSYGMDTSDDIMMRSWTGTIIGPPSVRLGVREGAEGLWDTLAP

SEQ ID NO: 13296 - protein, 257 aa, Chlorella protothecoides
MHSSLRMHLPSCSSPSAPPTPAPCTHLQAAMRMLDNRKLSSKINYNVLADLFDDAPSPASAVGPGAGGPEEPRQPGAEAAVAAKLSASQDRQSAALSAELRASRTAGARLCHGCLVVESKRTGVTLSYRTGWPLPERQGRDLSAMLSDMHPFSYPVAISHARQSPGWAWLAADRVPGLPPTQRAQHLPLPLAAERRRGDPGAPLRPVQPQGRRAARALCPQLAAASVHCPCLLSPPGHPAPCPVPVHTNCMSQFVLT

SEQ ID NO: 13297 - protein, 118 aa, Chlorella protothecoides
  MOD_RES (106)..(109): Any amino acid
MLDILEVPSLMLTCVRNRHYDEALDLGAFVRKLETLHGGLPLVRRLAAEARAASAAMRGALLRRLEADVALPECLRAVGFLRRLACFGERELRLEFLVRREAWVAXXXXASASCASSS

SEQ ID NO: 13298 - protein, 575 aa, Chlorella protothecoides
MPPPPPLTPSNPNTADSDDDGAAARGAESDDDGKFRLARTGVVARPKDRVLTMDPKEITYEVVSKKLREIALARGKSTRLDRQEQVEMLAHLAGLARGPAQRLQVLVASLTVVFDMNRPTQAAMTPGNWARCAATLFDILALLEAHPELELVDSPPEDDEAGGFEGGAAAGAAGAAAAGEPAPGTPARVWGNLAAFLERLDDEWNGSLKGLDPHAHEYMDRLRDETVLLALAAAVAQRCEATGAFGALATVSLRRIDHLYHKTAPVYAAMRKLAELQAAAAAAAGGDVAAPGPAVEEEEGGSAEGFEPRDGSAAGPPPPVVRLPPGFALPADAAASLEALVRTVYAHGTDNQKGQALLASVYWRAVHDDYHGARDLLLSSRIQDQTGALENRLQVLHNRAIAQLGLAAFRAGLVPDAHACLADLYGTGRVKELLAQGIQAHRYAERSPEQEAIERRRQVPFHLHINLELLESVYLTSALLLEVPHAAASGNATLAGGERRRPLSKPLRRLLDNYERQTFVGPPENVRDHIIAAVRALSTGTRFWWSCVWLVGGGVGGGGCGRRGCIPDEEVRRGG

SEQ ID NO: 13299 - protein, 232 aa, Chlorella protothecoides
MYMGCPLCAARPWPLEVVQCPDECEESACCGRSSTEFMPAPYYGTPKPISPPDAQPPSHTHTHSFLMGSSDSESEDERRVVKSAKTKAVEELQNTCNDIRNKMNINDWSVIQTLFDKLNKQLEKTMKATGALGVPRVYIRLLVELEDFLAKTLAEKPKLSPTNTRALSRMKQQLRRHNAGYAEQIAAFRENPVSDSEPESEAPPSEPDCEFGVLLFCPSLFGAWGGYDSMGV

SEQ ID NO: 13300 - protein, 487 aa, Chlorella protothecoides
MTLIDLTYTAFLVPVSVAFDKVEGSGSFTWITYMDMVGSAIYVADMLLNFSSAFVVQWDLKHMLIMDGRHVASYYVLHGGFLVDLVASESRMEGPACLMVSLTNCVDDGLPGTLRTALRVSAESSDPPFCGALEFLSILEVSSTPPACQPGQSPQPPFAALPIIPEVIIAASPSANAPGLKAIYALRLLRLVRSVWCRPVQEPLLPAPDEVHFSARAVPDILAHGCLHHRQPARLAGVLHAARTGPADKHFLDMMLNHSLSPSQYPALCRGDRGRAKLLDGLRLLHFQRRGRQRLGAVGGGHLLGLPDTDHCRVRAGCGGSREQGKVLEGARGDDRPSSWHRARLPARMAGFIENTSGRPVNSDMWQQCHRRSLTGLPAQHVHLFPSQLRGRGGCDGGGGPDQLCRHAPRHPRIWVSGPALHAPDPPTPGMRSFIVSVIGDLLTVSSLSAWRGQQIRQQLQGVEAWGKVGGEGATLDLLPRYWQLGR

SEQ ID NO: 13301 - protein, 179 aa, Chlorella protothecoides
MSREPEPFLHPVRSREEKGVRVRLEIGPREATAKNAVLALTSAPGEVAQRTTLAAGPKLVAAVVEKLKALGQEVEACPVTGPNVSGPAHLAAAPVEAGASGKAQPSSGAAVKPAAAAASGTGKKAAPPAAAAPVHASGDQLDDDWVADGEAGPGGEAAAPAPTSTGKKQKKKGCRVVRF

SEQ ID NO: 13302 - protein, 344 aa, Chlorella protothecoides
MRCILSAARLVASRCSAVVSHSPTFLHAPRGEGGVVAAATSHALRASSYSTSSPADLDILGQDAGLVRIDSCTSAGFVIGESLIPGALLAYRGLLTGWRVDSLESISEASLSIVDLLKPVPGGWQGPQIASSEAWGRTPGPPGRPQPPDSNISSRLPLQPADLLVLGTGSQTLRLPPALARIARAKHLSVEVASTVNAVATFNILNQEGRKVVGAFLPLASPAPELGRRTFLEELGTPCRRPSQWIFHLILDSCLSCTSAVLAVGVKVAQGGLAPTCEMGAALTGQRAAAVCFAVCFRTPAPSNRCLTGHKVDYKPDKIATSAHSSLLDVGCGRRDGVHRLMLQ

SEQ ID NO: 13303 - protein, 83 aa, Chlorella protothecoides
MALKLQSEGKVYNPQRAKLKKSHKPRRAVQVIIIPVFWKQKHAEQDSIFQLADRIQADLRAAGIRCDCDTTNELTPGQKYRNW

SEQ ID NO: 13304 - protein, 222 aa, Chlorella protothecoides
MSGAFRTTALPGPEPTATTRLQLLDQEAGTVSHLSAMTVLHGSRGEELRWGAVGTYPAAGCRRPCLRGLALPERCRLAGESRGWRAAPWAPLQPGGATLPPSTFHPFPFRTDLYDAKRSKLGPDPLREDADEELVWSTARLPRALPVLAAPAGPRHCSLIASPGEQRRCTSHPGRVAEGPPPNPTYRLLLMDQSVVAGIGNIYRAEILYKAGVHPVRALGWV

SEQ ID NO: 13305 - protein, 333 aa, Chlorella protothecoides
MVLVEGACAVRHIPSDTLLHILELLSSREACTAALVCRRWHRVVSSLSWASRYAELWHTRDPRVSPTWQLAFSARMAQARSLDLRCTRTSMHGHSKDIKCVAVLASSQLVYTGSYDGTLICWDLVTGTRVGPPLRHGGTVRAVSLDEGWLVSGCSDGCVSAWTQAGAGCATHYNLEQPPLALARHGGPGRIAVRSPQKLATEWPLFTPCHNNRSGSWDGSVLEVNRTSQTVCRSFYLGDWIVGIALMSGRLLVAAGNRVVSARLHAEPVLHGGPARESEEASEREEEEYAMTSTVTAILGCSPSTGSWAIIGDGGSGLGVAKEENSGREPGRV

SEQ ID NO: 13306 - protein, 255 aa, Chlorella protothecoides
MGPLRDADEGPLAVRCIALRPGPACPGSHWEGGWLSRSWRPGSACREPRGLAHHDATFVCVASAHRVACLHDPATGPVHHLITQLLAAGRRSCRMASLTALQLAGCWALHPASAAHYTDTLRELCLYGFADDATALNGADDAVVDPETLLDLAAVRAPPDGTLAEAHAATELAPRVATLCLLHAWVQQAQQLGEDKLAADSRRTGHAAWAQLLHLALHDPELSSPKYQFKGTTHRRKASAGGGDGGWGHVEGTLA

SEQ ID NO: 13307 - protein, 1352 aa, Chlorella protothecoides
  MOD_RES (296)..(299): Any amino acid
  MOD_RES (667)..(670): Any amino acid
  MOD_RES (713)..(732): Any amino acid
  MOD_RES (763)..(766): Any amino acid
  MOD_RES (923)..(926): Any amino acid
  MOD_RES (1041)..(1043): Any amino acid
MLGWGLVSILSHSCIAGFNLPCHEQNQPHPPSQTIHQVRLWQALAVLCPLIVAQSGDPALLEEALDQVMSALTVTNASTVKQYQEVVAVVLLRATPDAPAALRARVLSLLCDCRTSKRDDLPSLILIASQFLLLEARPLRESAEPGPEPGPDLAAAAPPGPSVGHSSAGAAPQATALAREVVCAIVPWALSHVHPVRTFAQLALWRLLETFPQVVKDDPALVTMLGFFSSNTDVQRLRTALGLGQDLDSFDPERATCPAGVLYKVIYEWVRERRFGGISCPGARTAGEGCGTLDHXXXXCVTFEVVLRRETGCGTLDHVGGWHRGVALAGRSDELSTFEGALEPLVDAIAGFLVAERLKLRIDMKDRLVGSCSKCACFMEEQAAVPKVHASQRSRVGMRALLAGVVLAGCPSQQCQNPTLHPKCSWQEASVHEEYSRASAGRPCIQPSQPPPAPSRSAAQRKITPAGQSVVVEDPWAATLGFAPLAQGSLDDFEANELAPALREAGRAGAAPRQRLIVVASLVDKLPNLAGLARTCEVFRWGGHGCGGAICIWNGAPGHSRGGRKITVCADPGRAQAHVQRLDVPFTRLGSLPAYSPSQDHACHLRRATALVVADASIVSEPQFQSISVSANLWMPIQEVPGGLGCCSCSCMWSTTCSNVEVGILRXXXXLIVFMHVEYDMLKRGGGYPQRSRTFEESLPKPEAQISETWPDXXXXXXXXXXXXXXXXXXXXLSGSGANPRLRQHKGVFGSGVWVGLCVAGEXXXXSPSTRLASPPPCSLAGLCVAGEDGAGAGTREGGHPSAPAGPAAGHGGDPAAGPHPIPERARVGRHRCIRVYKAGSGGQGLSAARPGRRKGDRIWRQAHSSTAHEEGSAGVHASADVRACDRHPHEIGVWTAVQTGRDSTTAGHWGHQQDTCRWTRRXXXXDDCWTLGPPAGHLQMDEKDTEGRRRCLARSRRGGAIVTCAWGTARPQRGHAHTAASSAACPRRGRRRPAPAWSDAASRCLLQMWGERAVHGAFSTASTCFRTHSLGQPPLPAAVXXXGRGASEQCMGQCQQRVIVSGHKFWDSHLCRLHQPPAAARDGCAWMGWGAASSGALQQHSIALEVRVGDAFRARQGGLRYLPHGMKGVAGVERPRWLGTVASRSPPQSPRNDQEVHLQDQLLSAVLHQCNPRKAVGAPEPQHNDAPCKPPSCPDWSLRPSASTPRAAFQERHSPAKSPFQAPLEDIACIRTPRTWARRHSPPRLGSAGSDGGRRRSTSSQLASMPSNSQAASGLQAVAAQSPPHIEVYLSMNGMGIGRLDIGTSRSFFTDRGSPEVFPSRTRTALGGSKSIQRQLLVPPSFTSFRGRWSA

SEQ ID NO: 13308 - protein, 185 aa, Chlorella protothecoides
MVYPTYNSFLAIESPNDADDKQWLTYWVVVCTLQLIERPLYVVLYWVPLYSIFRLVLVAWLSHPQFKGATLVYDIVVRPVIIAAASKAKELPALTPFAEKFLLSEVQAGQDKKTKATSTKSSSALKAPFSTSTKAAPPAAALPSAPRLFNDVPAVVDQAAPPLSEPAFLPADIVEGSLAAKPHFQ

SEQ ID NO: 13309 - protein, 495 aa, Chlorella protothecoides
  MOD_RES (143)..(145): Any amino acid
  MOD_RES (399)..(402): Any amino acid
  MOD_RES (456)..(459): Any amino acid
MLTASLHIHRVVRQSARMLYVKTFRALPGRQGTSSVLKGEQGTKPLAYHGLASWGDAPGSMSTETTRLMKSKGEDYHPLHAYRAQWTCTALIITGKIACPTEKPGSSIGRCAAPEATGRTCKRQLAKSFFNSALLIVSLTKSXXXTEKPGSSIGRGAAPEATGQRQDREDCTAEPMQGYPTGPGLDLGAMQGLQSISLLGSFAPLVEAPEQASGQSPLDSPGHEQGVSGGHDSLTGPGMALKGRSGASTAGTRHGPDHSQSFCRASLLPSGGLWSPAGGPQGVPPGVHMARVPVLSSCCALRRACTRACKDSVFPPLPSRTLRASSEQSHGVSLKDSSSSRTQHTHTHTLSTHSATRCASTTSRSTASCATAYAPASASSLAVAGVAGDFHATSRTLRXXXXHLKVDCIMRNGVRSRFCQQCGRYQPLEDFDDTKRSCRVRLQVCAGSSAGGMAQXXXXQVLPPSLSLPSGTISVEGNGPTRRRMGCGRSSPAPL

SEQ ID NO: 13310 - protein, 404 aa, Chlorella protothecoides
  MOD_RES (21)..(24): Any amino acid
  MOD_RES (123)..(126): Any amino acid
  MOD_RES (200)..(203): Any amino acid
MESHDLGTLRGPTFFTLLSSXXXXVPEGCIKVSGVYELLSQGRVALSNSDHPASRNSPAELGRLRDVSCEALECPGKGSWIGNGSRLYGSSPWLHLHFARLAGTLGVVHGINTWWGCMGRGAXXXXSSPWLHLHSAPLAGTLAVVHGVDAWWGCMGRGASGKGVRVASPVTLEPSIGHRAGREHRKGEAMCTPHGAGGVXXXXGLPPRSRLHQASAAAPAGSIGKGRPCAHPMAQVEWTSTGLSLESAAVRAWGREPSFTNHTPSFTGCLDYVWLSRGDWQVVGAMAMPGGSEGGEPNQAAPGYRPLPSAAEPSDHVALGFCLRLVRAGGANPEGQRKQVCMTTSTADSLKWRALITEVSHAAAFAHVPVAIRASGKPPSQYSSLLPPHPTPPQPLTVNSAHSG

SEQ ID NO: 13311 - protein, 178 aa, Chlorella protothecoides
MPLPHSNTQAAQSGRPPDPVQLAQLQALVSLRGLHPPDARGAAECAGECSAAGSGGGGGAGVQGRYGVPIAGAAPAPPANTREGDGAPAGTAVATAVLPGAAPGVAFVPTPEVMLLLLKGYAGMFNYALEDASLRPLPDPCTAAEGALDPGTMAAFMPLPGGAMGEGIHPSLEQQMLF

SEQ ID NO: 13312 - protein, 146 aa, Chlorella protothecoides
MTLRSLPPHANATWTCGPFSPPPPRLDAVVLEPGDTAPFALRARALDETVLVKRFLDLETGRAFCAAVTHLYYHPRHPDLKVFQAHAACAAVRAFASAQGGPQPLLLAGDFNSLAEKRVSDEFDEGALSVVLSSGLNGSRQGGCMW

SEQ ID NO: 13313 - protein, 122 aa, Chlorella protothecoides
MEESEEEAEVRIVRDYVRVDPRAGRADPTGYVTSPLTGELVAVGDMAEHMRVSLIDPRWREQRNVMLSRIKETTRASDDEISRNLASLAATLPDVFGSSQEEVSAAVGRAVEADRAAAAAAG

SEQ ID NO: 13314 - protein, 328 aa, Chlorella protothecoides
MSPSVPPPTTPLPSLTPELRYNVHRPCAAQSWQRTSTSRAVATPDRATEVPPPTLRSPGPARPIPGYDPDTDRVGVLLLNLGGPETLEDVRPFLYNLFADPDIIRLPPAARWLQPAVAWLISTLRAPKSRRGYAAIGGGSPLRAITQEQADALAGALADRAVPARAYVAMRYWAPTTEQAVAALKADRINKLVVLPLYPQFSVSTSGSSLRLLERLLREDAQLAAARHVVIPSWYARPGYVAASCDLIQAELARFPAEADGVEIFFSAHGVPQSYVDEGGWNQGEDGAVGLGGWRGMEHQGSRELQWGWGEGGRPTLWVHAHVHGWCS

SEQ ID NO: 13315 - protein, 195 aa, Chlorella protothecoides
MEQCVALIMTELAARGVRNTHTLAYQSRVGPVQWLRPYTDDAIRYLGERRVRGLLAVPISFVSEHIETLEEIDMEELAEEVGIKSWGRVPALNTNPVFIADLADAVLEALPYAGSVAGSAVGDALVPMGESRRGGPEGWGEVGGRGRGEGRVGSRGPAQQGFSKPWGREERAPAVSGAVAGRWARGTRSGLGVSW

SEQ ID NO: 13316 - protein, 89 aa, Chlorella protothecoides
MAAGVQGGAAGGAGGGGRGPEGAQFSREELRELFVLKPGTDCETRDLLQATGAAFADGGPTCADPAICAAAGAGLVSFVHLESEQGGGA

SEQ ID NO: 13317 - protein, 61 aa, Chlorella protothecoides
MWMGEDNNGGKETRTARGRGGMLDGNPAMDRQAMARIWRDGQKKACTVYRLLTTGRRGVWR

SEQ ID NO: 13318 - protein, 318 aa, Chlorella protothecoides
  MOD_RES (98)..(101): Any amino acid
MAKRLSVRDPVPSDIDIAQSLDPLPITEIAQSLGLDDDDFITYGPTKAKVPMWPSCGWLDGGSSAGWDLRIKLPCRPTPTHPATLPSHMCDQVKLEVXXXXRIKLPCRPTLTHPATLPSHTCDQVKLEVLEKHRDTPNGNYGEEALEVECWHGGLGPSSGPRQPPPQCRLLSDDALRCEATVVPSGARGAKATAVIVAGITPTPLGEGKSTTTVGLCQALGAYLGKRAVTCVRQPSQGPTFGIKGGAAGGGYSQIIPMEACGVEGGEGVDKAGGRGSEPSFPPGGCRAGLHVRWGSDLGEPPGMAGSFRLASCASGPP

SEQ ID NO: 13319 - protein, 837 aa, Chlorella protothecoides
  MOD_RES (663)..(666): Any amino acid
MPAPGQAWQPRRFPMSMSNPTSTPDPRAQGTPPIFIPQFYFPGTGPGAAHKASADKVDAFFAVYPQGLSLDNLKALLKQVFGLPTPLAYPLFYKMAPGEEGLVSRAALRAWLDRAGFWGLDGPGRAMEILRAPGRDPRRPQACAGRHPDQSSGPGVPGRVPGVPRKVDGCFFGGVGALGGGVCMLGEWLGRGGCGGWQQLEFPRLCWCSACAGAQGEGEVESVVRASAWTHHLRGPALCPAASAWVHLPLVRGDGDPPHLLLAQSLRNRGAESARAAPRRPAGRAGRGGRAGRHQPRRALLLLRALLRHLLQVLGPGHGPRLPALARRPPALRQPRADLPDNGAHLQPGRAALLHGEPSSDGVRRLHLVHPVWDGGRVGLDWGGVRIHDTGRLEGIRGWLGQGRASGNPGCEFRAGCMVKQVHQWYLGARGLPCSATVLRSHSLIHLHHTTPTEEDKTTDTSLEYWFRCCDLDGDEHLHSSELYVSGTWDEMGEWEWGGGSVVVPGAHMQRECREVTKHRHARCSSAARSLPRPPANLTALPRLGFNLSCVPPVRHPPHMSRSTQYFYEEQLHRMECLSQESVSYFDVMGQLHDMLNPEVGGRGGGCGCWEMRGWAEHPRLRVQLGGPICHLRAARPFQIPTCKTRPVPRPNPPTPSFPSRTXXXXCAPHGPSKSLLAKPDPSHVPIPQPLAFPPEPDVLHAGRPETESGHGRNPVQRALQPEQVCAIRDPGPILCAAGVGLGAGWDASCRSAPIPPAALPGCRAPPCPEWVPVCFILIACTLPQPLLLKEREEIGVTEWDRFARQEYQRLADDDGEVEAVDAGGNTWGASALEVDL

SEQ ID NO: 13320 - protein, 733 aa, Chlorella protothecoides
  MOD_RES (5)..(8): Any amino acid
  MOD_RES (96)..(99): Any amino acid
  MOD_RES (665)..(668): Any amino acid
  MOD_RES (689)..(692): Any amino acid
MPRRXXXXGRRNGHQSDENCRAMPRRDRRGRDARVGASRSLSTVPDTPTPYQAGAQIKHLRAAHNPRPAKCGSSGGGTTRSGRHDHVVRGGDCLVXXXXTTRFGRHDLVVRGGDCLVQRCRASGPCMAGVESHTCCQGDGPELGTVTPYPLPTWIALSQLSAEHSSLSSSGRPRRRNLGSQANALHDGLPCDYLIRPCIARPRLAVVSPGTCGLSPGSSLFNLGLRSMERVGKIRTIMALDPAELVPRRHRSITMAAIPCHVGCNTSAGPHAHPPSLPPAPVQYHQVGKIGEGTYGVVFRAHDRVTNRLLALKQIRRGEGAELLHHRWVVRIPALPDSSHPLTCRLEAEEEGVPSTAIREISLLKELQHENIVRYGHLLVASWAWVWAGGAGHAMPSLRLRTRRAVAVPASDWPSAPQLPANRNPNPSMHSLYDVVHEDRKLYLVFEFLDVDLKKSMDSNPAAFKDPALVKVRFGRLVGAVARPDCPVTIPAESAKECGMLLHRDRQLLCAPSFPDDSTLTELCVSDAPGHRLLSCSPYTAPGPEATGKGSCVGFGVGAWHWSPHGCSSCGTGFPQKQPHNHPAPQNLLIEEKTNTLKLADFGLARAFGIPVRAYTHEVRGREGEAGLQALMGLATVRTGNLGQEVDASLTTCAPAAVLLRMSPXXXXLLMWYRTPQKQPHNHPAPQNXXXXIGQSGSGGRRTAGDLRTRCCSPPYEPSPHLSTPPPSFWRAR

SEQ ID NO: 13321 - protein, 611 aa, Chlorella protothecoides
  MOD_RES (366)..(369): Any amino acid
MGLLSIIRKVKRQEREMRLLVVGLDNAGKTTVLKQLTGGDVKSVSPTLGFNIETLQLKGTRHFATDTFSGHGYLLRCESLILPTPTISSLHSFRLNIWDVGGQKSLRSYWRNYFEQTDGLVWVVDSADRRRLEDTGAELARLLLEERLAGASLLVLANKQDIAGALAPSEIEQAPFVQAMAGFVKLTAWKGAMPEMYRSRCMAAQQATQPAPSPTHSLTNPLPPQPAPSPPHSGAAAAGTGTAALAPGGVQRRDRQRAPLGIGVSYVTPACCATHAFRLHCSPVTLGPWGTRPIGNFSESLKAKPLFLLSIRLNSHHAGRECGRILPSIADQGKLSRILSAPCIMRHYPPSALSASWIPKQNRVPXXXXRQTFSHPVSSLHHASLLPLSPEHKLDSQAKQGPLWSDATSTAITLVQLLHRERAPGSGVHGDLVGAGGALEQLVGLARGQGPVVAQQLGVQAVGGQAPLLLPLDVVLAVEGSEAPVPRHHDLLAAGELELGAAQRLLRHHHVRVAATDGQQDLADGHASAQGKGLAEGAAHAGLQPIRAGAGKHLVDAQDVERVHAHAQVEGVLARVLHHVLVGGNAGRLHGLRGDVLLLPTEKGGGRWGWT

SEQ ID NO: 13322 - protein, 223 aa, Chlorella protothecoides
MQPHLASTLPTPETVNLRAQPQPYDYGLLHVGGGGYDPGRMSPFLPSDSPGLGVKLELLDSPQQAPQPPGMPHPGAMFSRGHPDSLPPVPPTAHPPRQQQQQQQGGGGGSAAAGGGQSSRGSDARSSAPAPPRRDGRPHVSHSTVEKQRRDRINSLIDELRDLVPPQAGCGTGEAAEGSDSRRPKHVVLADTIQLVRDLQEKVGGSAGWRISDVWCVAWGGRE

SEQ ID NO: 13323 - protein, 348 aa, Chlorella protothecoides
MAPQQPTTPQQPAPRPVSLTPRVLFIPSQELGVVEACNSLAPRVPQPQQCQAPQRKRRDDAPQVSRGHGGFARALATMHLLCFERASAATPDYVAMLAEAWACCVWTGCRRLAGPNRSSPSPAPLLLPSPQEERSVRRSGRVAGKPAEFYDEDNLYRSLGIDRLDAFSRRGTRCTVPDPERLAALRAARGGAAGGAPDHPSDGARPAAPRVDSGRGVRVQGGRVYDSRYGVTCHWCRQKTLEEHVQCTAPGCGGGRRLPVSFWCVPWRGWGAVTPGSGRGHGDGRGPLAVRGNQGMPAQGSLAARHSQALPLAGPRCGCEGALPWWSRGLHSPRSHHHAPTLTLAHAK

SEQ ID NO: 13324 - protein, 164 aa, Chlorella protothecoides
MEAARIAANKYMVKNAGKDAFHLRVRVHPFHVLRINKMLSCAGADRLQTGMRGAFGKPFALCARVAIGQILLSIRCRDAHVVVAEEALRRAKFKFPGRQKIVVSRNWGFTAFNREDYIQWKQEGRLAADGLNAKLLGNHGPLAARKTHELFEGPARTYKIPVHA

SEQ ID NO: 13325 - protein, 180 aa, Chlorella protothecoides
MARREWGVATTWAALPPGCLPAPAMASLRRGCKGCMRRADMPGGPARCYRQIKGKPYPKSRFCRGVPDPKIRIYDVGARRANVDTFPSCVHLVRCARGSREGPPGQGGSPGLVDVSPDSSPQQTRGGICRVVGVASPGLRTLVRSPGRDCFPPCCLLETRGGGEELGASAKLDGRGWHWT

SEQ ID NO: 13326 - protein, 231 aa, Chlorella protothecoides
  MOD_RES (58)..(61): Any amino acid
MAAVLLTLQIATDVPPLSSPQILAAKVPSRIGKDTQGGYCSPHSFGMWPSGEPLPPPXXXXMGCQSSQPHRGVTAPLIHLECGLRVSPSRRLGMQPHQGCIHPMAPKNRSARSAEEAADPSFEVTPDTLQQLMASGNTELVGALQKALGKMVGSSSGYIESLPEAVQRRIEYLGDIDEQRSDLEAEFDAKVKQLEEEYSEKYGAQIELWCNQALPCLHGVQHQGGPLPPWA

SEQ ID NO: 13327 - protein, 1236 aa, Chlorella protothecoides
  MOD_RES (18)..(20): Any amino acid
  MOD_RES (63)..(81): Any amino acid
  MOD_RES (189)..(192): Any amino acid
  MOD_RES (564)..(566): Any amino acid
  MOD_RES (1174)..(1176): Any amino acid
MHTKTNVHTPPPSTALAXXXVPLPLPPQACSQRHTYIHRPPAPPSTAGSPAGTPSRSAAAVRXXXXXXXXXXXXXXXXXXXQPIEVLDLQLRHAQGGLHRLGHGAHRKLEHFAAVHGDVGKGGVGGGGVVVQRFVPGAQEPGVQVPLPVAVCAGGREAVGVWDRVFMCLNPSSPSLSSSPNPPPHTTSXXXXCRCPLPSVRGGGRRWGFGIECSCPQALPPPACRGLPTPLRTRRHPPLPTPQHTHLISGRARGGTPVAPVDVARQRVGADDQHVAVCPRAQELCGGDHAHDEAGAGGGEVEGGGVARAQPCLDRAGGAEAVVRGGGGQQDQVHVRGGDARGRQGTLGRQQGVIGQRLALGQDVPAPDAGAGHDPLVVCVHKALQIGVAQHPGGGGGAGAGEANPGARGHGAGVGGWGAGHRQAGAGPGRQAGRGDLGHVGRHTERQGCAGSGPRGKQTPAGEGGGWVWARGEAPKPVALRWRTPHSTGDPNWHRRRSTGRQICNTARAGSWLDGMRRRDSTVQGGSYPWQKLSLHVRKASVTKEGARFTHPRFHHFQVCSPLXXXKLYATRACVGFGDRTRFPGGGRSVITAACTPAAVLGCPRPARHSRVGGMNRLDLHAQRSLHVMKPSVTKGGAQFLHPSFHHFQVCSPPPWGRSSRSTWIAWSPPPLLPRYRRPHCRPGGEGGISRSRWPGGDPLTCAHPSPPGPPSRQRARPALTHLVIGRGLIVGLARGGCAIILAVVVLLAALVILQRLAREPQVGVVDDLLADDLGHLVIVLHGGLQALQLLLLDLLLVLRDGRWREPVEEGLGGGLLCGGGPLLAGAHLLLQHLHRHVLAGRLPLDGRGCVWRRGGGSRWGYAGGDRVHGRRKSEGGQRSQLHERALASPLPNPPLMSRMTRSSSSPIKVKLCMGSDRGGGGPGSGVSLKARNWGKSGNAPHCLPISRACSHHRPSVGTPRPRAGRPARWGLPSMTHRPQSTDLDPSIRHPFKLPAERHTPPPPPPPTGSPRGCRHVRTDEALAEAARNQKSPGSPHGWHVRTDEALAEAAWNQKSPGSMHGCTTFCTEALHPLKQGEGLQRCLGSSSPLEHSTALTRVSRWGSFRSAIIQKSGMPLGTLSAPSSVTTPVLDADDTESAAAGRRLGMRPPCMQRQSWLPQYVQPSGPSDPGHTXXXACSASPGSHSVLNRVVQANHDTISFPVTTWGLGDAIHDITQLLVQGGCVAGTGPISAGGS

SEQ ID NO: 13328 - protein, 177 aa, Chlorella protothecoides
MQLAALPSLTLSSPMHAVPSCIAPPASPPPSPHTATPIEWKSASKNVTVKVLKKKMRPGQKGTPPTKQTPTESFFNWFTPPPIPENEEEIEEEELEGLQAAMEDDYEVAEIIREKIIDHPYLWFTGEALQDDESSEEDYDSEDDGATPPGETDDESPSDDEVGQGRARPLAGWRPGG

SEQ ID NO: 13329 - protein, 95 aa, Chlorella protothecoides
MERVMATMNAHTIVSGCSAPGRVSHPRAVAPHAPTANRRALLGMLGVAPLALSIPRPALALIPDDDDEELVAKAKASRAERLARDKRQIGQFVAT

SEQ ID NO: 13330 - protein, 315 aa, Chlorella protothecoides
  MOD_RES (136)..(139): Any amino acid
MAALTGDLRALRDYVMTPGDMQNQSDSTVLLSVTHSNLKARFMEIRFDRHMTVSAVKDKLCFHTGSAPSAMTLSLRAAGGGASTILQNDKKLGYYSPQDSTGVDLFPCTCSLDPLHISSPGTHFMWRISTPHQRLXXXXCACIPRGAADGVKISFQRVQGDEAARGPHMDAGEGDGGKVQGSREPDKWSCVFCLGTGGKGDCSILCPALTHLKIPTPQLRPGAQLAPRHRVRPQTTRSKRSWPPASPWARGVRCRAGEGAPCVSWAGVRACPPASGSASRWVGERPRGGVWQGVPVVPVDSFCHGPLSFVCLDAL

SEQ ID NO: 13331 - protein, 69 aa, Chlorella protothecoides
MPPLKTIVMSNDKMHPLQDMVGAWEGVCGALDQYGMRHSRAFANLCNAGVRPSELGTAAALACTDADVA

SEQ ID NO: 13332 - protein, 238 aa, Chlorella protothecoides
MPAEGVDGGGCGWIPREEEIGVGARQPGRRGPVRCPVVEASLPCQLVFSAGRGWGIPSGWANLGPGTPLHHLTHDPTAPDAEFRGINAYSAARFAALGLEEARHDHGEPPQEPRATAHAEAHPAPAAAAPAAPQAAEAALPAAAPAPAAAATWEYQDPRGEIQGPFTVPEMLEWWVWRVAGVADVRGGGGRVVVVAGSHAASGIPLHARGWSDGGDCGALGLGMRGRSYPAQQATRIP

SEQ ID NO: 13333 - protein, 461 aa, Chlorella protothecoides
MSARAIAHPVKNWNAGPIKHVPLVHAGEWHSCAAAHHRGQGPSGVRPGPRYCIEHRDMAGLAGGRGSASASHSWRSPPAVRGRVLECPPSRGAGGACSDWAGASRLCQVTFPEALPQGGWAEGRPPGSGAAIPCSRRVWYSCARRRGCRRAPPVTVPVTLNPDIPRMQVNNRSADYDATHPGTVRWAGCVLHLRGLPDHRWDGRQGVHHRPTLRACGCGGAWEVHGGDLFAQRARGRVDRQRLRLRPGLGGLGFRCLTPPLPPPPHTEARKSPVVDGKVQRAADGKELRFPVLLSPQVRTAGWGGCGRGHRRSLWGSWDGETSGVQEPAGRRGARPSLPRTPGAPGTPPDPAKHSPTTPTPHPSRRRRRRPEWCPWPSASASVALTSCVPSAASRMCSGKPRLEAADGCPWWSPAWGACRGARRWRAIGSGVTLCRSFLVPAGSLKACPPPLLLPPSPGPP

SEQ ID NO: 13334 - protein, 327 aa, Chlorella protothecoides
  MOD_RES (173)..(176): Any amino acid
  MOD_RES (294)..(297): Any amino acid
PPPNTPYPPTPPGPTNPTHTQLTEGGKGVHDQVHPQQLQHVQGQCSRGDRGDEGDNEGHQADGELELEELADVSKHVPAPQHRLDNGGEVVVQNDDVGGVLGHLRAWREWGESGWWNIGLGGSRWIKWENCRHAELQGEQIKPHALSRPNRHITQTCKTPSPPHSLPTCNAHXXXXVERKMGGGGAALMGASAHAQYGLQACTAVTQAKQVPYAATPEQANPSTSKRILPWRSASPPAMPMASPTSDSLRAGASLVPSPVTATTSPNSFRLCTRVCLSVGEERASTCTGCAILXXXXPGASGCALGCACRWGRSGPAPAQGVQSSSP

SEQ ID NO: 13335 - protein, 189 aa, Chlorella protothecoides
MEGPEFRNMDEQELLQLLPRLQVLARSSPTDKHTLVHNLKLLGEVVAVTGDGTNDAPALKESDVGLAMGIAGGLALRQGRILLDVEGFACSGVAAYGTCLACVTAVAKDAADIVILDDNFSSIVKAVLWGRNVFANIRKFLQFQLTISLVALIVTFIAAVSTGTLALNVLQLLWVNLIMNSFAALGELR

SEQ ID NO: 13336 - protein, 229 aa, Chlorella protothecoides
MTVVDGWFAGAATKGLPDWADLPQPLAEAVTENVAVNSSAYLVESEHGGVDFVGNRTECALLMLLRGWGQDYRRKREALAAQLVTDYRRKREALATQLVTVYVFTSARKMSSALVRRKGAGLTLLCKGAAEIVVGRCTRYAGAGGAVEDLGEGLRQELLQLVTSMASRGLRTLCLAMRGEARLVVLSLWSFWEGGFGVGRALSGAGRALSGARRGSDVQGPRCSLVCAD

SEQ ID NO: 13337 - protein, 482 aa, Chlorella protothecoides
  MOD_RES (124)..(126): Any amino acid
  MOD_RES (182)..(185): Any amino acid
  MOD_RES (209)..(211): Any amino acid
  MOD_RES (309)..(312): Any amino acid
MCEPGAGPWFRCSTPLKRCWWGWAVSPTPSNPPSLPKTPHLPIEGAGWGWSQWSGSTEGTRYALRQLEAAVAACASQALDHGHGARPHGRAAGGAGLSPPPLPTLPLSPKPLTSPLSPRFNTRXXXAAAVAQPSPQPADGRRAGRARRAHAPGPAGADGQRADGPAGRLGRGGRGRGRGRRXXXXLQSLSLVLANNSLTGAIPAFASAXXXAHGQRADGPAKRLGRGGQCRGRSRRASGRAQPGRQRPRRLLPRRAGRLPRAGLPGPQRQQADRGAALRRHHVFPQPALSVCGRERAGGQHRERLAGVXXXXAGSFPVGLAAYPALASLDLSNNKLTGELPSAGTTFFPSLHYLFAGGNALEGSIGNAWQESGIFNLVGDSLRGCGCAGRTGGKRGRITEEGEGGGWDRRRRLTNGMVVVFSSGRQAACAGSARSLGGLWAPLQANACYLTAHAHSTIPTPRRPWTPMCPPPGTPSPSRTTS

SEQ ID NO: 13338 - protein, 302 aa, Chlorella protothecoides
  MOD_RES (94)..(97): Any amino acid
MSGLTADARTLIDHGRVEAQQHAFTYNEPIPVESLTQVLIRKVLPSRPMLWCRFIGVGQPIARAEWLRVYVLTPQPHPQSPAVPVRPVAAIWRXXXXNAVQQTHDLLQIHKSGSTYHKGQAALSTCLNSSTSCPLPCSLCATCRCDLERMRMVGMVACVLPTLSPPAMTPQSRPFGVALLIAGWDTDSGPVLFHTDPSGTFVRYQAKAIGSGSEGAQTALQEGFRADMTLKEAEELTLSTLKQVMEEKVRPGAEWVHAFVSRPSSTRTAFPTSCISGCSLARRHTAANDGGVWKAAHIVTAA

SEQ ID NO: 13339 - protein, 581 aa, Chlorella protothecoides
MARTSPGGRALQTHAHAWLVAAPPGQGSTRGGVAGRDGPRVAAPFPAHSLLPDHSVLVVLHVQALARGVQVSLAQRGLAVGGGASDECLLRGLHVLRLPAPGLERGALQRAAEGEGQRPGLGQVGDLVHGHQVGGGLLLRLPAGQEDDAGDGRGHGARQRAHRQPCGGAHVHLGPLRAGEHHVGLQQRALQQHVVVVQRLVDGAQHTLRDRGANLDAVGAVGEDLWLHDGHQPVLLADDRVARQAVRILVDAQLARLLGPDLQHRAPLGEASALLVVLGAALAQVVQALGLRLAVSAREGDHARVHLDAGDHAQVLQDLGKGRAVVGILVQGLLEQDLVETLHPLSTTTWAIGLPEPRDRGTHPSPERAHNPTHHAADVLVGVGGVEQELAQVTAGRLLVRHANALQLQPGLGVGQGWDGHGTEDRFGTHGQHAMHTCMGRGREPNSTRQGDALAGSDDGLGSGNQLLGILVLPGVSQDGSHCENGMWSGIRERKILEWRVEVFMGWVPARSGLCWRRPGCMPGPSLITCGVRFFLHQGLGRREGGALAQMQTLKGALTASLFFFRTQEYVQLPAGTFDFV

SEQ ID NO: 13340 - protein, 664 aa, Chlorella protothecoides
  MOD_RES (313)..(316): Any amino acid
  MOD_RES (331)..(333): Any amino acid
  MOD_RES (466)..(469): Any amino acid
  MOD_RES (565)..(568): Any amino acid
MHLLTHELLLFATGIWTNNIHDNIDGKGQKQLLPYPFPQVPPVMGAYYHTIHHTMYNKNYGHYFTFVDRLFGTLLTPEDYRAMIAERKHVLLRQSVCWVALAGWCGMVFKCRRPDDVTTPSIFEPQQRRKWKPPPPKYSEQDNLLLKIVLERPTHSVVCLDVSPPLLRGWRLSWGYKGIPLGLCPSGTRRNGFVSTIHIQQPTGCYCHDQGARGGCLSRDQRAVLVARVAWRPHATTNAQDADDYIPVSKEDAECFSMWGVSLADENRAAQETAFCTPSGQQGILIQQLRDELELSVNIPPQHSRRLTQASIXXXXQAWAPPGPAGLGRGXXXTEAIPSGQEARRRSCSRHVPVDPQGVSVVHAAWRRKRLCLQPPHSPRTMQWREEYGADRVLQDFVFNEKPEFAKFYPEGGSFVVPGANWWEPACAAVSIPLLCGLTRITVHAPLPPHGTLITPGCYGVDRAGXXXXPPPPSPMAPSSHQAAMALTGRAAPCMCSSRGTSIWSSSSSSPRKSDVCATMCRCNAAVFCAVVMWGGGLLQVPHLCSLLRPALSLLDGGSHIHSYXXXXLRCGDVGWGGVAGAAPMQLAGTSSFLARRRVSHPFLTPAPLQQQERYINLIAPACSVAAGRCVDQSLVLIDLQGAGLKGGALPPHRHRVVHTPVSS

SEQ ID NO: 13341 - protein, 216 aa, Chlorella protothecoides
MRAGPLVVALLAATAVAIYASPLTDVLVWKLGSRGDGLGRDEGLDLTVSGTGIPGSVEAWGTPAPASLTRRQEQLLEFREENAFKDNLALFWLPNEWRAAMPPYVQSWLRNWIMVAILYYVLGGVWVYYTYYAFGSQLFKPGEIPSLGAQLEQMKVWCRFTGRLGVPPACRQRISRVDFSRRLAHNAFPVKSLVLAASATPGLRSCCTMLHLLKIL

SEQ ID NO: 13342 - protein, 127 aa, Chlorella protothecoides
MCFCRLKDGNSKTEIHLINKPPKWNQMLQAYCLNFGGRVTQASVKNFQLITSENEVGAGMRGRYRDACVKQWNHASRAARSPRYTTKLPGAPLSGRCHSTFVKVPRSSFTMDFSYPMTLLQARFQIA

SEQ ID NO: 13343 - protein, 251 aa, Chlorella protothecoides
  MOD_RES (84)..(86): Any amino acid
MHPDICRVNTRGVASSLLRQEAIRLFDELAASPRHSIRYQLQPGGKDVWEIHEVRPRLSVSQLRPSLNAANLTHCATFLTLQVXXXSSPFCVTVAPPPQRCKLDPPCDVSHFAGDIQLLSNHTVLHARSAFVDDAEVRPAAATARVCPCREVLTTRSGPTAQALLPCAEIHTVNNLCRPIPHHDQTLHPTPFLPAQDPNLRRHLLRLWLAPPDEFPLPEAYADILGGSVEVGKRGGIVVSGTRLNIPLEAE

SEQ ID NO: 13344 - protein, 208 aa, Chlorella protothecoides
MGVGYGHYLRVSCDCTLIHLPALVEASQLEEVHHRWNTHPFAALLCLNEARQGGESQWASSWAGIRALGFERLEETAGPALFKLRACAANGTTLGAGASHHMHQAGRAPSSTPPSPHHAAVHNEFLKLRPDLGPVMTENWYFDRKGEVPAGKQPFFAIPAFNYFQVSGRWGLRGLEETALPAFVHTACMCSVWHSAGSWSVAPHAPSW

SEQ ID NO: 13345 - protein, 536 aa, Chlorella protothecoides
  MOD_RES (295)..(298): Any amino acid
MEAMRYLWRCTGPVMSLCEMGIARLRSAEPALQSILHADTSSPMCSSPLPLPCGAPPNMLQLDRHRHARLQGEQGFFSPAFPKVHSAVHRLGEHCGSSHILMGGEGGGEVSMCSASGPYGELAMQSHAAGLSMRTLRSINSCVTLHLERYGRGGAVQVRERSGDVDLPPCRDRSHVQEHILHGGQGVSAAAEKYAAFDLSRSRGGLLRSSLRVPSGVSLNRDSDVTEGLPNQDIGPTPARLLVRSSKFRLLEHSRVLAKLAMCPGTQEDYTISIKIFSTFSTVAETFSLRHSFVXXXXTLPCSGKARDVPWNAGRLHISYRDLEHIFHRGRNLLPPIFICPPCASYLTCRFRNHARGSRSLSHSRQGDNRPVSGPAVWYADELIHRPEEWRFQLSEEHIAELEAAVDAAIESGQILEVGWAPERGQGRGAATCAAPGRTNYLRDALVVLQGLSLDNVSLPTLGPILTGFRVEAVHGRGFQLISGLPVGRWSREQTVAAYWIIGLHWGKAVSNNHKGHLVGHIKDIGHDPASPSTRL

SEQ ID NO: 13346 - protein, 82 aa, Chlorella protothecoides
MAAVSTGRQVHIPTPLSHLNCPSSPISFQDVAAAAVLSETVYRAVDFGEGRAEEALLALQSRMPVPIKLEHVGWSPAGQRQR

SEQ ID NO: 13347 - protein, 98 aa, Chlorella protothecoides
MALVGNTASATMPAGHRPAFEAGVQMLFQRWTALQLGVLNEWGGSNSREKAAGIQHEVLEWFYGKKCHEMLDLADLLDQAISEDFNIQAEDDSPYQVR

SEQ ID NO: 13348 - protein, 85 aa, Chlorella protothecoides
MPPHQVLSSNWREELQEYIAPDQLPKEYGGTNPAPLSDPPGPWRDPAIVEKVRLEIGGVPWFPYPVPLLLQVAALTVDGSFCFRA

SEQ ID NO: 13349 - protein, 382 aa, Chlorella protothecoides
  MOD_RES (135)..(138): Any amino acid
  MOD_RES (368)..(370): Any amino acid
SNTVPLAERGPGRSAAAAPSSPESEAERELPAAHRVRDGPAAEGETRAEREERRQRDEIREERRRERERERRLEARDAHGHKRSKLTRDRDRDISEKIALGQAKVGFIVCGGGPCQGMPGRGPFRVGPWLWRNQXXXXSCVEGGLARGMPGRGPFRVGTWLCRIRSPGARERVSCALPLCCLERSLLPLALNPHLAMAIFTLAEPTYLPASPPPDPITQATPPTLHPSPLQVSGGEAMYDQRLFNQDTGVGSGLASEDAYNLYDKPLFADRSEVFRSRGRQDEEVHGAGAGGDDAAGERRFKPDKGFSGVDYGAARDAAAGPVQFEADAAQADVFGLDAFLTDVRGGKRREGPLGDAPRGGSMAAAGXXXQGLQRRGLWRSA

SEQ ID NO: 13350 - protein, 222 aa, Chlorella protothecoides
  MOD_RES (152)..(172): Any amino acid
TASPPPALQTALHALLACAEAAGPAFLPHVLPALELCRDALLRADLYDEPGLLPAAGRLVNAAVASLGPEYALGSRAHDLCKLVVAEAAAAAALGGGTGDDDCSESAVGGVGENSGGSGSMPSTLTTVAAPASPAAALVVVLHTQMLVLFAXXXXXXXXXXXXXXXXXXXXXGRAARGSPPGGAGGPDGVAQRAAALRHAAHAAPPGRARRGCRPGLAGRPA

SEQ ID NO: 13351 - protein, 283 aa, Chlorella protothecoides
MAILWLLFGMDPVPWRKRALESQHGTLPQDVLDPSQCVRLRRFLRSLLLHDISPNLQCRGAGSHDLSLRCNLVVDWLLENKSKQGTTRWMRRRPGIQGLQRTQATRESFKALGDHVNQTKLELMRSQMVVFKESLEQFALKYRSDIRRDPAFRESFHAMCVTIGVDPLASNKGIWNRLLGFGGAQGCMTGLGPTMRGRGMLLVLYIHPGRGSIPAAHPISAWDCAVRRDLPGPPIQRGGPSGAQPPAATHTGKGPERGQMPFMSVQLGIDHHWNPQGPLNMPF

SEQ ID NO: 13352 - protein, 846 aa, Chlorella protothecoides
  MOD_RES (252)..(254): Any amino acid
  MOD_RES (579)..(582): Any amino acid
  MOD_RES (710)..(713): Any amino acid
MRSPGVHPAVTPGTRPVAGFSNPPSSPRTPPRRSAGCREIVARRVAPENDQGVGARRLARVLPEAALRGGLHRQSCRWDALPVGCAASYRLRKGVQHVALGDSRHLPCRPEDGVSAHPAHCPGDYLLTLDLPGSEGLPEGPTLLESALGMLGLLVRTSREAAQALAGAGAVPLLRDLLEYSSPEVVESASRLCAALCARSKAARREVLESASSALLGCALAAADDPGLVGEAARRLAVIVGDCPPADLWPRXXXVGEAARRLAVLVGDCPPADLAALTAERGPLWTALRACQAKTGGGDAPDSAAIVSTFSKVLALVRGCLDRAQRAQRLAPRQWPHGPGWDAVPREVRTLVLPPPAAGKDTQPLAFPTLPKGFLRRDGKAEERPVGQASSYKNSSVTIQELEATAPPTPDAQSPGDTHSEASAQTRCADDAHSPECLPDLRTVYDSTPLDAATRRARSVSCGDGVTLRRTWASYLSQCRAWEGTMPLEAMPGCPAGRSFHNPTLNSHAPRSCPRPGWRSPRTAGSRGLAGEAGGQQDLVDPDLYRCLLPHQPPAGHAGGRGQGECSWFLSTCSAVLGXXXXTRAAEVRVSAAASRLPAGAASSLLLASLTSSSRSALRSPGALCAAAPGGRLALVWQAAGRGALGGRQGDRRHMVPGGCRGEARGGQGCGCLGGISGMARPHRLPQSSTLWLFHRVLHNPSSSISILPXXXXWYGPASPPPTIINTLAWSSCSSHLLLLHLNISLTPTPPPSTPKHPQLHILLPKAAPGWWKALLRGGAERTYHELLHEAVHADEPVTAYDELTDDSKDLIDSIRERQAYIAAGMLDPKGFDDFRVVIGENSLRG

SEQ ID NO: 13353 - protein, 290 aa, Chlorella protothecoides
MSLAHAEAAARGPGSCVACLRLARTPQAPDPNICTPGLSFPRTHPQVYVYRFLTTGTIEEKVYVYRFLTTGTIEEKVYQRQLSKEGLQQVVDTSAGAGAGGGGGGNLMSIEELRDLFTHDAATLSSTYDAVCAKKKAGTGGGVSGGAEGVWRSGDRSAQARVGGPGLGASPPSSRTSRPSPAPRSTQHPSTHTQGARLAGAHLAVGGAAQAPQRAGAGPVALPPDYHRSQVGHPPEEDLGSWAHHRSVHSVPDPALREAGGEHVSFVFALDVAGRDIGPEAPLAPVARRP

SEQ ID NO: 13354 - protein, 303 aa, Chlorella protothecoides
MVDFCNPGVLGGAGAFRRYFEGPILAGREPDASDAEPASLSIVQETVLCLYCSSHHRVGMNNSTTPCLNLLPTSPATLHRAGGGRRLTHRRAFLHRQPLHPATHQHAALRPPPTQGGGGGVLQHDPPPGLPVHPFPRLQGCGSALHLPACRQGPQRHHLTQEAAQPPQVRGLECCGKGKWGRCVGDMGALSRGMHPSHQQQMCMLERTMTAAWQQRFPTSTMYPRRLIYDTLHAPGAKGGDADGFAGAGAFFPPGLFDDGRPGRGSMPLGWEHLSGECMTGAWGAETAVGAPGWPGRQRRARG

SEQ ID NO: 13355 - protein, 96 aa, Chlorella protothecoides
MGLGKTLQGIGLLWTLLHARAPALGGTPVAKRVIICCPTSLVANWDSECSKWLDGRVRTLPLAESSREDVVAGVNSFLHPNHIHQVKKGGACWEGG

SEQ ID NO: 13356 - protein, 96 aa, Chlorella protothecoides
MNQTTIVPLWPPLYLLDPQVMIVSYETFRLHAERFREAGTCDLLICDEAHRLKNDATLTNRALGAMACRRRVLLSGTPLQNKLDEFYGEFTACRTG

SEQ ID NO: 13357 - protein, 260 aa, Chlorella protothecoides
MKSYTGELYWAGDPQLLAERRSTRKLMRRYNHEIDYEDEPTKLSLLKEMGITFDAQHPPFFEPPLFLDYGYNITVGKECAGKGYTRLNRVLRPFHSIVLIITRLAGMVHAALSCWPSPPCDCAWPRSRPLTSLRTVKVLLQLQHHVPGHLPHHHRRPRHAGTGRAALCRLPPAACRHPQRRPQARAGRAHHHRGRRVGGRVGRDPAGRHHRSAVHHRGGGGGNQERGAGHRRGGQPRQGHQEARPKPGRSLRMMGMRTSS

SEQ ID NO: 13358 - protein, 846 aa, Chlorella protothecoides
  MOD_RES (417)..(420): Any amino acid
  MOD_RES (725)..(728): Any amino acid
MDAGALSVEQLSALSRAVPDDSERRDLELYLQGSHPKHRGVSDPDRLGTVERYFLEIKDIPRLAQRIRCLIFSRTYASTAGLVRGMGVGLECLRMGLAVAGWSTARHDGPPPPITPPSHPNHPPTITVRGPPGHHAERLLPAPDLPRPDPAADGGAGAGQPPECGDPPRCGRRLPPGHPAQTGRCQGRGPQDQPAALCGPPVGSPGRHRRPAARPALRRPARGCHAGASCCYISGRFLTLLPCLELTSPPTPTLHPAADQHPWHDRRAEGRPARRDRGDHARCARWARQLCGRVCAWGGGRGRMSQVQRAHGRVPRGRRHPLLRPGGAHWLGGMVISCSSEWSGWVGPPVGMAQEKAMYEDLHQVADYFGEAFKETDPAHVVHVVRDFVLLFEKVVREMKVGTRGEAGGCGAVAAWXXXXKVGTRGEAGGCGAVAARGRRAGDGAPRHGAHGKSPLPEKPLLPRTQTTSQVSEEAAATSAKQRAAMARKKGNAERALGTPRGAKGKTQSAAVPEQLLEIEAAPGQVEVEQVVSAMVQTVAERAADGVEYGVAGEPATMTELGKVDEATEAPEAAEAAKMAGAALASGCATGDLSLDSEGDTPPPVFDAGLCKEPEEGVGSAATQEPLHSATSIIQASEGAACAENAHCLVQGPEDASSSAAASSVPVTPEEALAPGLDISVETISLDEQQVRDEILDPSIRAPLGGNCTAQDSAGAEIVDPPALXXXXALAPGLDISAETISLDEQQIRDEILDPSVRAPLGGDCTAQDSAGAEIVDPPALEDPDAPCQAADQDLPVIVALLSTDEEVPGTEQRAQPCGEGWESFDEDIFSNLEARLLSDGEDNSV

SEQ ID NO: 13359 - protein, 237 aa, Chlorella protothecoides
MSNPRWCEYPRSHAQESSFSGPSTRVRRLPARQGRGGGPGSRVPGPACGDREGQGPGPVDRSSPRTFFPLSQWRCGPYALGWSNLGCICLVQKVEQSLHARDHSDTPVPRPFLPTAKTPEDQAKEVVELLLRRNLLQRCERMFKRPPPGSKKLVKFPKKLVPPGPGDVKSFAEDAFYAWTYDRPSSPWMLVFTILGMAGVLAACLFPLAPYGIKVTVFYLASGLLTVILGTLPQAGS

SEQ ID NO: 13360 - protein, 120 aa, Chlorella protothecoides
MQEVPLSGLLKPLVSVQQPDEDKAWANSWLARLSVGVSLASLIFVLYTHSPPKGATPAQYLRVRAHPAGTVTAEASRYRDELFDLFNIRKEGNARLGNSSASTAFEEAPAVEDVIHDSDL

SEQ ID NO: 13361 - protein, 279 aa, Chlorella protothecoides
MALLHNGPHSTLPCISDIKSKVFGPDTFWVTDVLPSSGLEGGVMFRGNLRGKREKVVAEVMQRLHDAYGALRGAAASDPLEPPLPIVPVLLTFPVGGKYVLRVILDVEAAFKADEDKSDRSLDSFVAFEVLPAAAAVPPPPATWQRWVGVLLVALTAASTLSFGLASSLLFLPKVRGGMLARNGPQSLASNQAMDPRWVCAYPPTCTCGGLKLLLCTLPVPQETLAFLANPSSISGDALPPGLEGFDPQAFLTAAVSVGALSLIPQVRDLWGHDSTVQQ

SEQ ID NO: 13362 - protein, 126 aa, Chlorella protothecoides
MPPSFLAAVGCTRCRTLPGGPSAWHPAEGTVRGGQAGWRRSLLVTAHLSLFPPTLASLLVPSTALGTFGSIRQLASLVRSRTDLFDLAAAGLLGGGGTALALMIAGLQASHGGAVAEASVCRGCAE

SEQ ID NO: 13363 - protein, 220 aa, Chlorella protothecoides
ILPPPPSSQTPPPPLAGEWFCSGECSAIHARLRARVEEGVVDIPGHPQHSWQVLRGKDGRVASAWALRAAQEVLQESFDPIVDMVTGADLLPLMLHARSHREWDYKGMHTLLLRHKVIKSARLHPLGCRRHRLQSIRWVSHDSRLTAATHRSPRPPTPTKKGQACGVGHRARAWPRRGGAAADRHTLRGAAPGPRPCAGGRLLRFPGGCGGAPPGAARRA

SEQ ID NO: 13364 - protein, 94 aa, Chlorella protothecoides
MSVEMGPPSAVTCDWHQCPTPILPSPTPCPYRPLIEAAAKAPLHSVYAHIDPVPLAAASVAQVHVGVLRASGKRVAIKVLRPGIEDTLRTGVSV

SEQ ID NO: 13365 - protein, 183 aa, Chlorella protothecoides
MMGVHPSLSAMHGMLSALNPPVRPFSTYTLVPQHRTRACPPPTHISRPSLWPTTQQSALLADIQDALLSSGPRGILRGAQVARIAAGLTLEQAQRVAQRRPPLPGPAVLRRLCEGLGATYIKLGQVIASMPSFFPPEYVQEFQACLDAAPPVPFSEIRCAAEAGDHVGWGRSGWGVGWWEAGR

SEQ ID NO: 13366 - protein, 150 aa, Chlorella protothecoides
MQAHRRLVRPCADSRPRLLTPSSPGNLLVLRDGRVGFIDFGIVGSVSPVTWAGVRALGQALVAGDWAAAAAALATVGVTEARVSVQGLAADLAGLAGRLGELDAAAVLSSMEGGPSAGALEAIEPQVGWGGVESGKGRVFAVWDGDPKGG

SEQ ID NO: 13367 - protein, 155 aa, Chlorella protothecoides
MTFLVLGARLLEAASPSLSRTSLAAMLSDFRTSVLGEANLEAEARHMAAFSAYLDASGARRLATCPEPYPAFSSRRVLVMDLLEGVPLTDAAVVVAHAPGTDPEAVLRAALDTWTGSLLACETFHADVHAGGRESRQEWECVVRGLSAQAHRRRV

SEQ ID NO: 13368 - protein, 90 aa, Chlorella protothecoides
MLEAMWAANVLDVQSTLRHVTRAVLQEPGVDRATRRRRAEGLLELGRIFVAAAPGSTGRGGAAGEDAKKRMEDAMLHVIEKRAGQVPSEP

SEQ ID NO: 13369 - protein, 483 aa, Chlorella protothecoides
MNVNWRRSSCILAPPRCGSSTLGALMSLHIGFSGWPSRGALYSGHTLLRRITFLTESQLSRTGTQALTVPCHRVRPRPKGMIGQKTAIAVSFLAMVGLICLVVQPRHPDGMASRANSSALVEFYGEVGLQYTVYGHAGLSVHMLKPVSAGHAGVGTRAWNLKPPPQSLCPDCRHMVLDVLAPLYENGVAQLMHLKATSTMCSPFPIHNPEPARRLLVRPQHMSLGACTCLWCAGNTASEFKQLLQPPHPPLTLPPFDPGFHMSSAWPRISPASQPMRLAAQRPRGGTPRSWMPAREVRLREGFVIILSRLRLPAALSLLLSQLTHNSLCIGVRRSGRGAGEGGWRGHHPAAARPDQCPLGEDNAGGSRSFDPAHIATDVMSPAASSPPANLFYARPLHSQTLCPSLPPPSLRAWARMEGFAFLESVGVPPCSHLQQEMPPSSCSRLQAQCVCRPHRQHTFWLRGCPFCRSSACNIQMQAGVGD

SEQ ID NO: 13370 - protein, 362 aa, Chlorella protothecoides
MQLSCAPTLGLQAAVARRATVWTHRCTPQPPHPRLGRHVHARRPIHAVHAGPQGTLQSLESTPLIQLDSPSPEESHQLDLPGVYAVYDGSDTLQFVGISRKVGISLNSHAESLPDVVRAARVLSLPDASREELTEAWKAWLQQSGGVVGWDAGGGCRGTRGCHGEDSARERSGSRPGRLALPPGSEAQARAAFDPRQGPAGPHRQPRGAGAECGAELQGMGVSECAGGHTCDPAHNSPLPPRAGGRLCQRHAHLPTVWVLLQGADPAERGRMAGRDGLEMQCQRCSDGQMAASTLLLAKVDYEVVNVLDEHHNPGLRETIKAFSQWPTIPQVYINGEFVGGADILEQLSGSGELVELVNPTS

SEQ ID NO: 13371 - protein, 205 aa, Chlorella protothecoides
MARRALMALPYGDRAGGDPRDALVTFGAQVFPLTRLPSCCQVSGLKTPKFRFHQLLGERQHCSGGAHLSAAPFGDSGCLTSAEKGAGTWWSTLDGHPPMGASNSKLDKVILELPDDERYFGLENFGNTCYANSVLQTLYFCRPFRDRVLRYAAENPPGYGNENLLTCLADLFLQVRPGVRACGSGGSGAPCCNLPPGNGSVLSQG

SEQ ID NO: 13372 - protein, 414 aa, Chlorella protothecoides
MGGAHPCRNWPLPRQQVKQRAHKPKSPAHGSKKSSKGGWSIRRAVCAAKRVMCGLVVTACHLGDAVACDFAWHLLFLGACVYRGVTSVGRRPSTFILILLPVTSREEDMFDLSLEIEPNCSVTSCLKKFRWACTADARQCGLYIGEGIATEVLDGADKFFCDQCNSLQEAQVCLALLFRILMPIPGICEAVAWVLIWAADYRDDLDRPWALSCMLTWKPVSSSAVSCQSLFAEIHEDASSAPGPVPAFEALQVQRAAGKCNGNSADLHLLRHARYFPTRSPPPLPAPTLRPARLSKLSHRVVFPFELKVVNTTPDCPDADTPYDLFGVVVHMGAQPNHGGGALESMREMGSGVGSGVCGVTTKSLRAGWNMLSMHNPPATLHEGHYVALVKSCGQWVCFDDDQVIAVTEAQVGD

SEQ ID NO: 13373 - protein, 298 aa, Chlorella protothecoides
MAVQCLMTKGPAPAGHHRSSWHACKPHNGPLRNRGIVKGQPDSKQPGFGGALLDFMIAGKKLRKWYGAEDLSLVKDEEEGPEPQDRSAGNAPPPSIIQRLSPETILVMDVDSDPVAELCLLQLILTRAEVAACANDESAARRGFGDYVTVVSREEAGRAAARCAVAVATSATAVQRMVASCAESDRLPHIIALRVAPGPKGGLAQLRPWQRADRRDPEALLRDAGVASFSVMSVGSMSASIGPQARNAVELQWQPVTGDDVMGAPANVTAMQAAALLAKLASSRTRGSGVELGVAVIP

SEQ ID NO: 13374 - protein, 359 aa, Chlorella protothecoides
MIKGLGGAARADVDPVAQRVWAASSSEAGIHVVTRSTFPAHFVGRAGAPAAVWTEVRALPGSDGLLVDILWENKTATRLPETLWVRWSPSEGAMEKGGGGVGKQQGSRCPTSVTTSLPFTRSSSPRAHSGCPELGHVQAGDACEPPGGLAEREPCHARCGRRGGGRELRGWHSQAGHQAVGLHTLGIRADFPAVASTHQGRLDTPPSLLCRSLDAALVSPGAPTPFPVLDGTPAMEEGMSFALTNNIWGEWVSLTGVLKTHVPRTVGGTSLHASTTPTPTLLTSKTSLHPWGTETSHIAHMLNPMPLPSLIARDKLPHAMPVQGEHQGAGRTLAALFYDLYVMQALPQQNKEQKSKRGI

SEQ ID NO: 13375 - protein, 483 aa, Chlorella protothecoides
MVAGPGGSDTNPPSRPSRPSHGVLVELFPTTKSSTGGTAVRRSPLKARPGLSFRPREPNLGGSWTRYVPSSRTSLHFKRDKMTTRGMMAENMFQGKGVVLGWLNSVLSLRLEKIEDVSRVGAWGVGCLLTDGLPAPWQCQHEEGAPAARINALQILGRAQALARDRRQPFPYPCFPLQVDFNVRNDYEFVGNYKELQQAFNKHGIDRAFNVAALSKGKLQDNNEFMQWFKGYWDSVTGETGLQPKCAAWELRAMTDQGGLEIDDYDALARRQSCKTGDWKKTNLPLRVLTPLHLVTSTVQWSAAAPGAAPRPAARASSAAPDTIAAYRRGSAAPAARASSGLASNAKVCVPALLLNLWAHQNPLMHTGAQRCHPFSSHPVAILANPQSASTPKPLQSEAKAALLTKAELSGMTDELGALRVEVEDLKDENEDLRAKLHTLEHERDFYFNKLRDVEILCQWPEVAAAKPVRACVPFGLVVGDGT

SEQ ID NO: 13376 - protein, 210 aa, Chlorella protothecoides
MSSRRPVLPPAQSPDHQPHAATPEHVSEPHPERSPGRGWLAPPRRPQEGPGVLRGEEAGAAMGVSASVSLAASCSREFIPFLSNPACQDFYEDIFEELAKAGEIEYLNVCDNLADHMVGNCYVKFRDEEAAARALQLFQARFYAGKPIVAEFSPVTDFREATCRQYEEGTCGRGGYCNFMHVRPVSKQLRKQLFGRYRDGTGGSTKFHDK

SEQ ID NO: 13377 - protein, 89 aa, Chlorella protothecoides
MGSAGTAVPALAVQTEGEGAAGATPQPVLLYFAIIDFLQDYNLRKRVERAVKARFHPAADISVASAEVYATRFKAMVRDLFVPGPDIKD

SEQ ID NO: 13378 - protein, 291 aa, Chlorella protothecoides
MHQRSNLRSSSMQHAPTDPHTPSCPTTQGSPLGNLLSPHAPCHAARQREADLGVVELLDVGPLGVGGLDGGRLDDLQRGGAHAVAGAHLLVHLLHGAIQGHVAVLLEHVVHAGTGGVPHPDAKVLDGGRTALEDLVHGHDLTVGLLHLAQLGQEVPEGGPLPSSRARCIRRSDGVRRRLLPPPFSEHSSFLWALGSPELALGADRVLSPQLHAEDGGLGILLSRQMAAHHLVLVVLVSSLRVRGDGGLSRHRLGLLPGPVGGAPNGPQAPPSPADHACVAIPESALQRGAR

SEQ ID NO: 13379 - protein, 321 aa, Chlorella protothecoides
MPPRLEAATLLHPPPSVLFELCDAREHDSPPLLRLASRRPLALLALVPRPLVLFTAGALSGAIAKSLTAPLDRVKILLQVKGGFQKGALAAAAARGSVVQSLIAIGREEGLRGYWKGNLPQILRVVPYSAAQLYSYEVFKHAFRDGEGRLTVPRRLAAGACAGMAATLLTYPLDTLRLRIAVDPACRTLAGAVAVLAREGSGAAFYRGLGASMMGIAPYMALELSSYDLLPPALPSFARGFLAALIATVSCYPLDTVRRHIQLSAGKSIAWHVAAGGIVRSDGVVGLYRGFIPNSLKNLPNKGGADGRAAQGRRHWLGCGN

SEQ ID NO: 13380 - protein, 149 aa, Chlorella protothecoides
MCQSILNTGIGSDPGKLAEFRALLRMRRAAPELKEDPAFDAFSRLLLKAGLWVVHVAWGLSGEWASCSFQACAARMAGRRDVAGARAHLGRGHQESPDGLYTLEQPQVPSAGGRAGLEIRGRRSNQTHCTAAGCTCEEAAHFWRPGWGA

SEQ ID NO: 13381 - protein, 98 aa, Chlorella protothecoides
MGAGWALLVCLALTTSCRAHDGDHVSTVHVVFGNHLDVGFDGIDPAVGTDDNVINVYFHHHFPKALAVARFLRQRGGAERYIYTTHVREAAKATNPVA

SEQ ID NO: 13382 - protein, 172 aa, Chlorella protothecoides
MGPRAGHYEGGGGPARLLQFSGATYRPPPLHAFNPIPAIKTPYLASGKFDLVTYDRLVDAQIEAGVDGLIIGGTTGEGQLMSWDEHIMLIAHTVNSFGDRVRVIGNTGSNSTREAVHASEQGFAVGMDAALHINPYYGKTSAVGLATHFQAVLAEGPAMLYNVPGRTGARMG

SEQ ID NO: 13383 - protein, 152 aa, Chlorella protothecoides
MACGTGAAVTVDHAVPWASQAAVHCQPPSHPAGAGDPADAHQAHRVSTRRQDIPDDVILALRSHPNLLGVKECTGNARIAGYVGRGVTCWSGNDDEAHAARHEHGAQGVVSVTSNLVPGAFAALMARRDDELAAKLADLIAWLFAEPNPIGL

SEQ ID NO: 13384 - protein, 131 aa, Chlorella protothecoides
MCGLVKPVFRLPYVPLQREQREAGVKILEAVREFIPGVKVPRGRTVARDPRVEASMGPRQSQSSSCGLDGEGTVILDNRPVPDTVEHVGPGCGQQQSKLSSYHPSDVPSPPFPTQDIRVMEDDEFTALASF

SEQ ID NO: 13385 - protein, 140 aa, Chlorella protothecoides
MPDKSLDEVLAAVGLSHPGPPQGREGARPILEWESTLVLVTGVTESHPANWKARCRVYLRDLQAEAGLSEAALQHIARIAGPRYDRGTGRLRLTSARFPNREDNRREVMRALEALVAEGHRAFPREQAEAAAGQAAAPRA

SEQ ID NO: 13386 - protein, 165 aa, Chlorella protothecoides
MAMRSIVRACSPLGTLAGTSGSRLATPAMLACGGAWYSSGQEPPSSTEPPSTGDVVPAEGGTEPETSEAPGLDPNYQYSKAQLAHYAPDPEKHKRFLPRLSRKDRSSYADPQVEQEFFEEAERFPRVPEGVPLYNLRDVVPEIYQSRSGGFGPGLCAFLAVHLGP

SEQ ID NO: 13387 - protein, 109 aa, Chlorella protothecoides
MRTVALLRIPPLRHPRPLPYRIQGVLWTGIPTHQLWRLWWQCKGGCQVRQGGRVAQGAYHFRRVRGWTYTFEYPIYWKSEVVNKVSKGTQGVDGRVFNVSIARSMARGA

SEQ ID NO: 13388 - protein, 145 aa, Chlorella protothecoides
MASPRACRLLAMVLGMLIACVHAQGPSSYNCRMAGEAANSACGLPYALSNFQGNFACDSEVLVGRPKNIGELQTLVESFPKVKVRPRWSAALGRHKFEHGHDRVGSIRRTLNPSTHDHPRRPMEWGGPGGSRTSAPEMTPRASTL

SEQ ID NO: 13389 - protein, 95 aa, Chlorella protothecoides
MAGPLLASPPSNIQDENFKFKHTKVGLLSMANAGPNTNGSQFFITTALTPWLDGRHVVFGEVIDGYDVVKKIEGTRTSRGDKPVEPVLVADSGEL

SEQ ID NO: 13390 - protein, 89 aa, Chlorella protothecoides
MSVTETTTRISTTLAPYIQMEVAIPLEIAGTCLKEVNKVVYGRGSRVSRDFRNPALIRFVSGEPFYLSPTHGGPRMYVNIEVGGGPGWA

SEQ ID NO: 13391 - protein, 155 aa, Chlorella protothecoides
MTPTSSLQDWLTLSGTPNKGYDQGTQVPRAPALGQGRLARVRLLLRRRDRVPRLLVPLWLRRAGAMGDAQRGAPGHPWAGTHPGTGVGVLQLLTPRTAMQTLDPYAKFEGVGADRTAVWTWNATRNGTVVPFDTCCTDTGFSPECTCASRTDCHA

SEQ ID NO: 13392 - protein, 391 aa, Chlorella protothecoides
  MOD_RES (255)..(258): Any amino acid
MSSEAEPAPMMVDDSAPDEAAPGPPSPGKGPPPKHKAPSKPGNGDEPAPPPAGGGAVFVSYSERREHVSNKGGRKTGGHVYQIKFFLVDATGLEHLAAVGEDQGDAHYIYSNQPGFPGLYGHNKQDVKRWLEDVMAASQLRAGYHLDLGGGGASFGGVGACAPCPHCAPDSTEPFSLFPSPTKKIQKARADGAGRWAPRHVLVPGGRLWQGAHCHLWEACTEEIALGRPAGRMGHTSGRVECQSACHRMQGRRRXXXXTYPCVCMMPNSGLSPSPTQPPRGGEGDAGRALRLLHAGRFPRRSPPFLPQPGGGGALAGRARGAQGPSGRGGHGEAARQLPHRGAVRAVGRRQGGAQARLRPGPRRGAEEVAHRARRGRAGRRPRAGGARRAG

SEQ ID NO: 13393 - protein, 80 aa, Chlorella protothecoides
MLAETFEAVIAAVYMDGGLPAVVGVLEKTFPVSPDHLDLLKNAATVALPVSSESKVLLPRPMDPAGDPANVQQGHEPGVA

SEQ ID NO: 13394 - protein, 207 aa, Chlorella protothecoides
MGFEEMPTNNYVESSFWNFDALFQPQQHPARDAHDTFFLTCERGLRDYLERVRETHQTGGWGSTGYGYAWQEAEAEKNLLRTHTTAVSSRMLYRLAQNGFRPAKYFSIDRVFRNEAVDRTHLAEFHQIEGVVAGVGLTLGDLIGTLTEFFARLGLPTLRFKPAYNPYTEPSMEIFRWGREEWRGQEGAQGGPGVLAGCPHAGPVPWS

SEQ ID NO: 13395 - protein, 258 aa, Chlorella protothecoides
MAADLESGLLQSIDEAGSIQDTGAYAESHSVDHMALVGVMKSLLAAELILVEDIDHSRLALTEEARLYLEAGSPEAQVFNAIPESGISLADLKVASVCRFADRFCPWANGLDTRSSAPFRKRALPHPFKQHVWCLVDPPVPTPCHPQTTPGQAKLDGTVGDVGFKQAMQQRWVAISKEGGAPLVMRKVPTIQDAVQTALVAVDRGQDTEVAAATVAALKKRKLLTTEAWKTYRLTKGIKFARQRVKEATDLTADMLAK

SEQ ID NO: 13396 - protein, 157 aa, Chlorella protothecoides
MYSGHSLTCSHGLQVSLVARAITFTDVALEPPREPTPKEYETLQGKLGYTFKNRYLLRLSLTQQCAAAATNNRTLAWLGDAVLQLVLTEQVLGAVQGSLTATPLGVLDRLRATLVSRAAFQQSARQVDLASYVIMSRNTRGGFACRVQGMTLSTLDA

SEQ ID NO: 13397 - protein, 99 aa, Chlorella protothecoides
MGRKKLPFYRIIAIDSRTRRDGRPLECCPEWVAATYLLHSQNTLLLLLPPSFPQFLGWYNPLSKETSLNAPSIKKWLEVGAQPSDTVAALLKKAMVLDS

SEQ ID NO: 13398 - protein, 618 aa, Chlorella protothecoides
  MOD_RES (303)..(306): Any amino acid
MEDDSQGKHKASDVRSRSALLTVALFAGICLGFMGAERVYLYNHGGAVATGGLMRSRVARSLGSKPANELERVLREVAPTGEAAEIAVRLTASGRLAPCNPCTRQDTNIRLPLHILIHHSQSLQRLPFKNWMVVAIDEQLRDYCKEKGINHYYRPVVVSARGTCSDCIPWVVGSLWGRNFVTLQLIRIPGTQANTGDNHAISAMKFEILEEFLQLGWDVLLSDVDIITVQNPFDFLVRDSDVEGMSDGYDASTAYGEIYGVRRVTGRGVSLHMSLPLALRQISYHSAGELRMHIRVQRQWASXXXXFSWARHKACQVVVVCMLSQSTTSGSQKSPHDIEFPCIAPACLPAVHTLYIVCAHGVFLQSFIWPRGSPALASTATVQLKRSSPHTHLLLLNHLPAPKPSLPSLFWLKANARTIRLMQRIAKRVNTERQWDQSVYNQEIFNLAHGEYTSPQVSVRVMDIYLFINSKTLFKYVRKLPLDQQKLPVMVSQGGREGRLSVGASTFAMWQCNCDVGRSCAGPGIATCTEMEFLIGNSHDVILVVEDISQPHPSEYCAQTSCFTDAHELPSGEDGADEGSTEVLCGRGQESAGCVPGWVHVRGNPCSEAAIEMDLHSK

SEQ ID NO: 13399 - protein, 469 aa, Chlorella protothecoides
MSFAKQNAWKRAENRPRPPLAECIGLEIRAPSQLEQTKCIARFNRHELSGRQDGQWLQASQRRDAAPFPPGDGKACAREVRPTRGRPGITPRIATTRQGSIPKHSSMHSMEIGRRERLDNALLTCSVLEVRGEQGCERDRLKFVARGCLEESGWVDVVQELCRGERKVVHRPIGHGDQRCHVSFKTRGAMDHLPLGTPPPPLPHPNPGSPPAHRPLLSAWEPRGGRAPCSPRRGPRSRQGHGAEGRACQHLPHRRLLAPATNRFSSVHLHGEVQRAAGAPRGRNTPLGSRSVPPPGPFNMHVVLEDQGVSWVPADGQQVLLDAGAGCLHTVEGRLVASIRLPGAHPDVSGAPATASPVSTSTSPDRPGGRAWSPPGGSPPPSQSPRTGARGPPAAHTRALSREDSLASSATLRTGLVSAGPPVRGMLASLDGTLSALRRGGRQLEIIDHTTGNMFVEAPGASSRGQQQG

SEQ ID NO: 13400 - protein, 473 aa, Chlorella protothecoides
  MOD_RES (292)..(295): Any amino acid
MGVPCRILRQVCSTVHVQPDPATPSMPDCLSSPRRIAQANIQKNSTPEDWRAREAATFAFGSMLEGPSPETLGSLVSAGLPFLLAALKDAHPQVKNTTAWTIGECSGAVGGTLLVDSARQPKYPRPDACTHPAHPVPCAAPHRRPHAGVCAWHGSRADRPPEPAPDHPGPAGGHRRRAAGGREGLLCAQPAGGRVRRGRGHLAHVPLLPDRHPGPPPDGAGRVWLEVPKRDQECAWWVGGHWAGWHAGPRPWLVCVHVVRGQTAAAPVLQGRPARPSSTPRDPPPPPPRTGXXXXAQAGPGVCVVGGRVLGGLACRTPPMGSLRARGERTDCGCPGAAGSPRSPQQDPTDAPQPPRTGVPDDGGRRGDGAAADAGLRGHQRGGPRLGPRHRPPGGAAGAADGGAPAGRQRARRALPRGGGEAGGGAGPALRRAPGPAPAAQRRRRRARRCGAGRRRGGGRAAGRLRLPRRHRA

SEQ ID NO: 13401 - protein, 506 aa, Chlorella protothecoides
MAQVLDITSLLDSAQSPDAATRNAAEGQLKGLQESQFPSFVLSLAAELGSGDKPVSSRRLAGLVLKNALDAKEASRQAGLSERWMSLDAGVRSQVKQSLLATMHAEVIIRDWGDGVRRRGKAASPGSVWRWCTFPWAQLHSSVTESRSYVPQSPSYVTPTPTLPGAPGHYDDSSDSTYRTAPHSFTIPSLSTRQVADARHTAGLVIAKVGAIEIPAGSWPELIPSLLAAAGTGTAAPGVRHAGLETLGYVCEELGALEEDYLEQGAVNQILTAVVGGMDKGTADAEVRLAATTALGNALEFARKNFESEGERSYIMQRVCEGTVAGDARLRHAAWECLVSIAGNYYETLPAYMADIFALSQRAIRGDEESVALQALEFWCSLCEEEAAAEEEGGVLHGFVAAALPQLAPLLLEQLTKQEEGEEGEEGAWNLAMAAGTCLGLCAGVVGDAIVPLVMPYVQVSGCLVLLRGEEHGVCGRVGGQQVSCASPGGGSWGLWGGEGIRPGAS

SEQ ID NO: 13402 - protein, 214 aa, Chlorella protothecoides
MGGDVVDCWRGYKVNEASMGKGPGGRVECGGPVMAQSFDGPVGAGRPLSIEPRPIRCLPPARSDIALQDVSREVIATENAPGAVGAYSQAIKANGFVYISGQVPLVPGVSCILWVSAPGRGGVSVQTKNFNSEDVEEQAEQVMKNLEAILKEAGSSFSRVVKTTILLADIADFAKVNAVYGKYFPVDPPARAAYAVRDLPLGAKVEIEAVALAP

SEQ ID NO: 13403 - protein, 342 aa, Chlorella protothecoides
  MOD_RES (54)..(57): Any amino acid
  MOD_RES (233)..(236): Any amino acid
MPHLYAPLCTDEKLRYYFENFGVVQVGFAAKKDSTNRWLAITAVESPGSCDALXXXXVQVGFAAKKVLTNRWLAFTAIESPGSCDALPPGLWNESCGALLHSMQLACLRPAQLPPTPPSTRALPLPSLIQEAFVSYDRHTGRPRGFGFVVFADPAVADRVVSQTHTIDRREVEAKKALPKEDSPVSKEGAGSNPAAASPGPGAGPGAAPAFSPRTRKVFVGGLAASVDEAAFXXXXFPAHAQGVCGRAGRQRGRGRLPRLLLDLRCGGGRGGHVRPREPAPTRLRLRHLRRRGQRGPPAGRRPAARRAGQAGGGEARRPARRHAAQPPGRPLPRPACRRRRG

SEQ ID NO: 13404 - protein, 286 aa, Chlorella protothecoides
MQGGRPVLLRLGGLQLAGCDALEALTLIMQVGGRGAAVRSLGAEDPGGPPGLILRPALGFPPPLLPPPPLAAVACGRCGATATLALALQGREGADAEEACPGCHARLALHASPRIVHEHSNVLCRLDASRCAPRDLSLGTTVQGQCGNCTALCALRGVQVGQWNARACRACHCSVGFKGTVSAMQPRAGQPSPSLHAHHSQFDQPEFEEQGPPGRDPGARRREAVAAGGGPKRSRAPDHILKAGQPLPSFGTCRHYCHSYRLGAEGGQNWRFWPVTRVADLLLYLF

SEQ ID NO: 13405 - protein, 408 aa, Chlorella protothecoides
MQADLLALQSRVPGLRLQRAARGTSDDAPFPIILSAVVTAPPQGSQYDVDSIKVVVRLQAPLPRPAVSIEVHSPILPERLRRAVAEDVLATYQVEAAARAGDAGGLHLDRIWADLRRRWVTLISSCPELLEAYTSSDADGRTVRRYAFVDEEEVPAGHGSATGAPDGTGAELGDRAREGASLAAAAAGLTLGQGQGAGPASPPAASTQLPAQLAADVRWAEVRYRAACQVFWRPGGRPGPGHFHPASRPTGGGRALGRGAVPRRLPGVLGPGWEAGLRAAQAAQRGAEEPAEHAAGPDPGGPGLAGGGHAAPVPLCRGGGWRGWAAKCSSVRPDLLREHPPDRSGKHGAAAPGPGPPAPGGRRQAAVRAAHAGERRGRPPAERALHRRRGGAAPGCGGRQCGRRRWDR

SEQ ID NO: 13406 - protein, 659 aa, Chlorella protothecoides
  MOD_RES (271)..(274): Any amino acid
MHLRVEEVTGSPSQRASEVARAEPKIAYYCRLYAVSQAVSLGVSNLVPDIKDLLNTLLASLEHDKKALELGPDDAILCETFALTVFGRADRADRVGQADKNTALTYYAASIFMEIINQFGELAPETLLKQRFAAWRAAEIRRALAEGRVPDPPPSAAQAPVTEEDEALLASLTSMPSVPQGGAEPEAKNESSSQLDDFPVPPRHDASVQRSGTSVGPSADSADLPGPGPAAGPEAGGQGRNQEHNGKDEEEGSLRLPSPPLSPPMGSGELXXXXGPEAGGQGRTQEHNGKDEEEGSLRLPSPPLSPPMGSGEVGGQARPISGMVWTPPPPRAFYTFQKDSGWDTSVHDAMPPTACRQHPVRLSMKPSHPTLQVLFCPEGASAPAKGTVARVSPATSAQCPFSIASLDRCTPAPSNNELPGSIEACGAEALVPDLATGENVLVHTPGGVTMDATVAAVDSSRWCGAQRRGELGCVLISSPPLDSLPAHDPHHTSSPCPPLRHHRPPSYAVRLADGTYSTTSIERIEALGTGPPGMPGDGEEELEGLKGEGASDVGPPAPPGGEARPPPPPSPPKPKTGEGLGRSPVAPPSRPATSSLASAGPPARPPEPTTAPVPGFEPSLAAITEAQRLTKTATSALSFEDVRTAVRYLNDALRLLTQP

SEQ ID NO: 13407 - protein, 106 aa, Chlorella protothecoides
MPTKPGLQVLDEDHYGLDDVKERILEFIAVGKLRGSTQGKILCLVGPPGVGKTSVGRSIARALDRKYYRFSVGGLSDVAEIKGEGKQGAREGAPSHHHGACLKPCH

SEQ ID NO: 13408 - protein, 515 aa, Chlorella protothecoides
MAPGAPHPEAATAAATAAAPPPSQGSDGSDGASALVPASPEQRHREVMAVALSRRPLFPGGIMPVIVSNNKLIKELFQLRKQNAQAYVGAFMQRVPDAPGTAMDGVEDGSFAVDLLGEQGCWRMCSLDGMHIIRRSLPHRHLMSPEPPLLHLSLTRHSPVSIDHPITCTGSAAPPHKNDDADADPAADPSAALHEVHAIIPHDQGAQLLLLGHRRVRRTGLAGRDPLCVSVQHLRDGRYDPEQDELKATTMEIISTIKELLALHPLYNEQMRNFIQFGADFHDLSRLSDLAASLTTADAGALQACLEELGVAERAAQVLLLVKKEVELCRLQADIGRRVEEKISKDQRRYFLMEQLKSIKKELGLEKDEKSALGCVGAVGEWVRGGGGGCLTRWGGVGLVPDLPQPLSMHRFRERLEPLGSGVPEDVRRVIEEELEKLQAIEPASSEFNVTRNYLDWLTALPWGKISTERLDIPAAQEVGGEGAEEGGPARGGEGPHGFYIGNATRTTADDGGWE

SEQ ID NO: 13409 - protein, 495 aa, Chlorella protothecoides
MPGKMVQCLKNTGISNPFVLIDEIDKLGRGYQALLPQTLLKHGNPTPPSHLIHTSISTQGDPASALLELLDPEQNSSFLDHYLDVAVDLSKVLFMCTANLLDTIPGPLLDRMEVIRLSGYIFDEKVAIARRYLEVQARKDAGVPRGAVHITDAAMTALVEEYARWVVDCADEGPGGEESTSSAMGFAAWGSGYGSLLEPMPHCQPAHTNCITPYREAGVRNLKKQLEKIYRKAAFRLVKEGLVDIPVVKDAQESDGEATEGPDTLPPSTPPTASIQGEVPPPAESVERERVEEEALPAFDAPAVTVDAGDLAALLGPPPFTSDKIYASATPPGVVMGLAWTAMGGSTLYIEAAAVERGEGKGSLRTTGQLGDVMKESAAIAHTYARRVLQARGDAAFFEQSALHVHVPAGATPKDGPSAGCAIATALLSLALARPVRPDLAMTGEVTLTGKVLPIGGVKEKTLAAKRSGVRHILFPEGNRRDWEELAEMYITQGA

SEQ ID NO: 13410 - protein, 510 aa, Chlorella protothecoides
  MOD_RES (65)..(68): Any amino acid
MFGGAGKAKGREAEGRQRWHLPGFHPPTPPLVDRSRELAMRMPIIVFECRFQPVNLFVLINSPSXXXXKAVTTDSMVYRGWADQGCMLCMTGNLPLQTSRCTTNLAHPHHRIRVQIPACERVCSCKFTIAGQDQSADAMIGTEAGMAVLPPAITKNIADKVARLGGVGWGGHLVVRRPATARLLAALEVEQMVRAQTVAGDREGIADLLDTLAINYALSAKAAFVGRTMPRFQTKSEFNQHHPAAPSAADAVRPFQCQCQVVSCTSDMLHAHSLALKIHLHSPRPPQANARKGGLLCLAASAVGMASAPGAHGEVVAEAMMPRLVPPILSSFTDPDARVRYYALEALYNVAKSTRAAFLAAFPDVFDALFRVCADADAGVQNAAAFLNNLVKDIVAEAEQWRLEPFVPQLAACLGVEDPHKRQFLLGWVGLLDSLPGRDLGRHLPDLLPGLLGMLGDPTPEIAHAASRVFAELEADELGGGGGGRGAARRRPEVDAGVAAVMAAALTRAC

SEQ ID NO: 13411 - protein, 204 aa, Chlorella protothecoides
  MOD_RES (43)..(46): Any amino acid
MPSTTCAPNLSRRQGAAIASSMAFPTPRRPDQSFPPFSPTRHXXXXFVLLITACGVNSVSPGSEKGGPGIVCHRPAVPPVFPISKVLQSLHAWPPPPLDALINLCPLSPPPGIVAVVGGVVWTQCLPPAARDEWAERASPALGVAASVLWAGVDAVIGAWDWARFKWAELTHRGAAREAYFEPLSDRLDVDPEDHRSPPLFNGP

SEQ ID NO: 13412 - protein, 351 aa, Chlorella protothecoides
MTPSPPNSPPTLQVLGIMGALDPHIHKLNLAELQGEGKLEAEGVRPQTREQDAINAANLPVGDQGLDLLPSAGLVTSSEDYYPTVAINALMRLLRNPGLSALHGRAVAALFDIIKSMGFNFVLYLPKVVPVLLQLTRGADDLQRRVDMVRALTDLVSIMRQHISRFLKDFLDLVHEFWRGAPVMQPYLLTLLGELSRESASKGGGLRRGVRGRGAWRGGGHAPLRQGKGLPAGVRGSQPSMSRRASPIMAPNPLAPPPPAAQTRCRTTSTPTCPTCCPCLSRCSTTPSAPATLPWWAAARPDGQDPAPLPRAFPWRGSASSRCIVHRACRGSIHLRLLFLAAPPTPPRATQ

SEQ ID NO: 13413 - protein, 215 aa, Chlorella protothecoides
MQLSAPRAQFYRGKAFQSVAPGRTIPPRVRRQVPIKPTAKIPGVEQATAALKTYRAVSNLPSWVTTVAFTAFQVLPKITHNPLPFVPDSSLLFNLLAWYTLLYAGTSLFNRKVPAGVGVRRRACSCVHARTVWKGKNTPDTRGSPTLPIPSLHPQLEFDGVGTVIGPAYLAVQAMGGLGSFLSPLNVATALFGVFLSYRLPVRTRERAALPAQGS

SEQ ID NO: 13414 - protein, 311 aa, Chlorella protothecoides
MARGSLFKVMRASAEGPLPLRLVRTVAVQVARGMASLHSRPQPLLHLDLKSPNILLDDKWRVKIADFGLARLKVHAHVTPGAPSGTPEWMAPEVLRSEPYAEGADVYSYGVVLWEMLTGQQPWEGLLPVQVVGAVGFQGKTLPPPATGDPFLARVCESCLSQLPGARPSFDAILQELEQEFAPSGYSKLSHSLSAAGMHLQAQGEGRDSGMRTGSTMQRGSYEEGARPTTSSTRPSFSLLSSAAGGVRGSRGDASLRSSFEGVGEGRSLDAEAGEGAGGVGAPAPGRASPRSPLKSLHPQGSMTNASPFAQ

SEQ ID NO: 13415 - protein, 217 aa, Chlorella protothecoides
MDEVFPSSGGEYDRKACAFRLADLTLADELESLRQQLAAEQRARREAELQAESSKQAQLRLQVIDVHSGCREEGHRGQEGGHDHACGSMMRYSERDVVPPACPKTKLLPAARDELAARLLNEQRHALDLEEDLASLEGQRGGEGDGRAEGRVTAQSPAAVAPSKIVGLQERVAALKAGRDRLISALDTQAAEVERLQSLNAALAEVGGRWGCRGLAR

SEQ ID NO: 13416 - protein, 133 aa, Chlorella protothecoides
MSLPFGGGARPLWCSAGTPRPPPPSRQHCGAQAGASQRSHTTPPGPPCISRRAKMTQFLLFEAASGYALFEVTALDEIGTSVDAVQASVTDLSRFGKAVKLTAFRPFSSAANALEQINAVSESQVGPAPHPPG

SEQ ID NO: 13417 - protein, 212 aa, Chlorella protothecoides
MARPGGQRGSRGQPPKRKKRDEFFEDEDAVDFFEDAGDNQAGEEADEGEPSSDEEETAEQKRLRLGGAPPSNDLPPTAKEYLAGIRAVEAAGRDGAEDGASDEDGLDAAVDRRLRQDAAEAMGWAQRALAARVVLPEGVPRSIPGQKLHRGHSQSVTALALTADDRTLYSVSKDGTILRHDIESGNRWGGGGAIDVAPAGQSGLHWYDLHDL

SEQ ID NO: 13418 - protein, 311 aa, Chlorella protothecoides
MSSGAAAGPSGAPAAHWVVPGARQTSRAALLACAVSSDGVYVAAGGGSRVVHVWDTRAGLAPIKSFPGHKDAVTALAFRLGTHELFSGSLDRSVKLWSLDDMAYVDSLFGHQAEVLALDALRTERVLSVGGDRTCRLWKIPEETQLIFRGYHPVIESCAFTKGGEWVTGAADGALGLWSAARKKPLQSIRAAHSAEADASPLGSIGGNAAAGVLSVAVCPASDLVATGAGDGLVRLWSLDKGTKGTKGLSQLGGLPARGFVNGLAVARSGRFVAAGMGQEPRMGRWGRDGKARNGVLILPLTLRAEDAAEE

SEQ ID NO: 13419 - protein, 336 aa, Chlorella protothecoides
MASLLGHIPLGVDRTTVLPLHTWPLAPNAQSGAVDGQQLARTPGALPFFLRNLLPETDFYIKYHSLQALRGLVAACPSLVQEVPDAGGWVICPILAAAGHLALHARRGVQRAVQGEPLAVGALLDVLSGGHEVLRNEVLLLLSCLLPGAPELAKLVVFEGGFDRLLDIARWAWAVGMHGCATTGGLGAPGAPASLVAADCLDLGAALVRDNPATLRMLWETGHLSPLLGLLPGDAADPILPALLRLVAAAAGPSQAVSRQGSGLGGGAETRQHVLAAALAAGWLPRLLALGLGSCLGTAPAHDQQQAEVGPEGQGVLCMETHNEEPRMPCWHSMGV

SEQ ID NO: 13420 - protein, 132 aa, Chlorella protothecoides
MPPPAPPSHFNHSRYLANKCSIASRIDCFLDQSTDAFGAKMKEQVEERLRFYEEGVAPRKNLACMKEVISGLAGGEEEIVLDAPVTEKKKAKKAKAPAEEEEGSKKKKKRSAEEEAPVTEEKTKKKKKKASA

SEQ ID NO: 13421 - protein, 121 aa, Chlorella protothecoides
MNRLNKFLASPAQDRAGPRVDALIHRATESSFPGDRKEAVAELKDLISQDAAARTALGSFGFPPLLTLTGEDLELDRSITECLAIAVFAEDGEVRADLCSARECRPAGRGWHLCWGTFHWV

SEQ ID NO: 13422 - protein, 153 aa, Chlorella protothecoides
  MOD_RES (14)..(17): Any amino acid
MVQGKCRSYLPHDXXXXSEDAVVTGPCIPLSMIHGKGPSYLPHHWPPQPPPPHRPGHSFKRYRTLVSEALFDKYDAVEHWAKVEPPEDAAELEALRQRLGRRFPVAAFQAARRRLDPKNILSNDWVNALFPLPQTEEAGDSDEGQPAAKAEAA

SEQ ID NO: 13423 - protein, 395 aa, Chlorella protothecoides
  MOD_RES (50)..(53): Any amino acid
  MOD_RES (243)..(267): Any amino acid
MAEEGHPGRLAVVSKGLETTATACRCWSSIVHTAPGPHRLGVRAAFRARXXXXEGHPGRLAVELKGHETTATTCRASTTLKHTHDAQESDPELFRLARVGLGCLGVVAELTLRCVPAHRLLETTSVESAAQVRAAHATRLAAARHLRYMWIPHTDAVVVVQSVEAGPEAAARAEAEIAAAAAAAGQGKADPAAALHALAVTARLLSEREAAPLSAFQLRDELLAHAPLDAGWVRRVNAAEAAXXXXXXXXXXXXXXXXXXXXXXXXXSAGHRVGWSDEVLGFDCGGQQCVSEACFATGTRAAPAGADLAYARDLLALVEREGLPAPAPIEQRWTAGSASAMSPARGGAADLFSWVGIIQYLPVPEDGDAEGERRRDAVVQRCVLSVFNGAQDMWE

SEQ ID NO: 13424 - protein, 479 aa, Chlorella protothecoides
MLTVRESVQALREPAGEEQHTETASEVSTLHAMEAMVGRLWGGARLCCVWGQHWGLAHLALCGCDEDVASNVGHAPASPVRPPQPDAFLICTMPVQSHSEHPSRSMQFIHLPQDEDEALARAIAASLDEPAAASQAPPAQPRPAPAVSRPATRIHTLASASGRDSGEAHAAPPPGAEVMLPDGSCLVRRVIDADNSCLFNAVGYTMESGLRYKAPVLRQMIVEAVLADPGQWSAAVLEKDPVDYCAWIDDPHHWGGAIELSILSKGSRGEDGYLLVGCKARGGRRYGRQIAAFDIQTQRLDLYGSEHADYTERVLVLYDGLHYDALAVSPFPGAPEDMDATVFPVDGPRTHEVMTAAGRLVAAAHDARQFTDTAAFTLRCGVCGAGLRGEREAVGHAKATGHADFSEAERSGARRGEMHAGHGHDAAGRRRRPNRDLLSWRLSALSLCDTVHIHTADTPAAALTSFTHKLLLALPAPGS

SEQ ID NO: 13425 - protein, 259 aa, Chlorella protothecoides
  MOD_RES (211)..(213): Any amino acid
MMFIARGDAKKLRLDSAVPPAVRPHTPFGSISLSQDTSRDAPPATKEPRTGTFYPGDFCLRADQSPCPVLIGTGWIACDDTLFIPSSSRVRSRKLAGFKNLDIYSLGLYVDVPRLKATAEGQELPLSQMFDGAVTMHGWRLVDAPHRHHQPARHPEPISPRSGGEFGAGDGAGVSKGGARPSSLLAGASVSSSPARSKLLSVSGHHEIHGXXXPARHPEPISPCSGGEFGARDGAGVRKGGARPSSLLAGAGRGAVTGF

SEQ ID NO: 13426 - protein, 771 aa, Chlorella protothecoides
  MOD_RES (201)..(204): Any amino acid
MDPDDWAGGWPALIRRPHPFWGGGRPGEQDRGRARCGLGISRMGGRGFGKTALRTLEPSGALIRSGSTDQEWVQCNAWPLETCCPPLLHLRAPAVPDAPPTKFLQHPTPTSSLPSSRQLELDMPDMAALESLWASIPADQHRAWGERLAHSIVHGSPVWHVYRETPVQSQEILEATKGGILLSGLRDDAGGSAQAAPPPAXXXXGILLSGLRDGAGGSAPAAPPPAGVEEPEARYMIDWKGDRLKVGVLDVEGGRLPPPTPPPDCCCRRAAWRQAKGWPCAAQGDTMRRTPSDPLLTPPPLPTPRPDQPWGQAAGSRVTSPPPLIPLLANLMLPVWLPNATIPSFSQSDCLLQCSMKSRPQGAHNALIPHPAPCQPTSPTLLPPSTPSAVAARVSLSAYSKWQRREPERATSAGRGTSPAAGPRRPPQRPSRLGGRGALGGVGDADDAGRQALLPPRQLPLAHGLVLGAARLELVGQRLLANAVRLLLVDGLHQHALVLVHVTLDLQVQLAVQVAVDLLGVAVLLEHAAQHAQAAQPQDLGGQAGLAGSAPLTCMWVPGMEGGGLHVRPAVPTNLPPSVVRKTRTVASVSALGLSLCRCTRARAGVDLLGLADDESVLHQLADVLPCDDGEGRGRAVSPNVCDERPGLSARDSPGQRDSRGRASHSHSIHDRAPRPCQAQRSRDRAGREAMPDCARAGQRLRPPLAAHRGPHPLSIPSTDSRELAMEMSFTSLGSSHTFRRPHPSTDAARRFCSLSATISRAPCYVAGPVA

SEQ ID NO: 13427 - protein, 135 aa, Chlorella protothecoides
MFGAIRRTPSSVPGTLRLPPDSQLPLASLPHPLPENLIPPLCTCFRFAEIVPAAQRNLVYAFDRCFEGAVAAFAAPLVGLLAEKWYGFSGASTVTGDRERDLANARALGSALLAFLAIPWFICLCVYSGTSLGVS

SEQ ID NO: 13428 - protein, 293 aa, Chlorella protothecoides
MSTLIGSWPLQAGDNLVCELWECDGGVGGCDPAKPSLLPNATAGDDRLGELTLGMDDYAAQLTLTSSFNTSATNAAAGVMLECDKCWQLWRDNNGAWVNPYRQGDLPASMRSGAGISPPPAPPAGAAGSWLVAGQAGAAPESGAAPKEDAAKPAANAPVAAAPAPATSAPRAAAPSPTLESGSPRSTPSASPTAPAPPSPARQQVLAPVPSPPAPQEVTSFDGPDESPSPVEQSPATAESPAPADAPVKGGGLATGVIAAIGAVVGLLALLAIGTTIYCARRGKCCFGRGKVS

SEQ ID NO: 13429 - protein, 392 aa, Chlorella protothecoides
MGELAPEDAVHRTRTVILIAAASILEKARRLERAGGCGDATATRMAPGPGPRYPGRRASSPNSTFRPVPQAQPSAPSPQPSHPSTLPFPPQCDEQILPALYAWVGAAFQATPTQLGNLALARAMMQALASPLGGVSSALAPRGAVIAAGCLIWATFTALFGTLSSYALAVPVLAMNGLGLALVIPNVQSLTADYYPPGARGRAFGALWLVISLGGMLGALYATNMGAATPLGVPGWRFVFVSVAVASAGVGLANGIWVHDPGYAGRAAAAREAGASLSSTLRAMGAGVLAVAGIPTFLLIITQGIVGSVPYASLIFLTLYLQLAGMSDAHASLLVAAYLAGGGVGGLIGGAVGDLAARLSPGHGRILATQFSVAVGIPFAWVIFRVSPGTAW

SEQ ID NO: 13430 - protein, 141 aa, Chlorella protothecoides
MAERRQDLFTLFRNAARLDPAAALAFVRSALSAVLFAPDAPWQGVELAVALLYQLGEAPSDADLRPGTGALAELALGVMRSDHPAAAHRLVALGVLEACVRYARVLAAPGVAAGTLPHVVAGFLGARGLGHADPGVQRRAA

SEQ ID NO: 13431 - protein, 638 aa, Chlorella protothecoides
  MOD_RES (28)..(31): Any amino acid
  MOD_RES (62)..(65): Any amino acid
  MOD_RES (494)..(497): Any amino acid
MEAKGTPASASARRRALSTGASARGSVXXXXAPRRAALGQRVAGPQAVEQVLQRHHRLGVGXXXXVPARPGQALRRCRQRARPGGRLQAAAGAAHQRLRQALQAQRVHLEAGLIADPLLVDGVVEARRDAEHLRPARIDADGAAKRVAHVHRLGGGQLPVAEGEGRGLGRQRAHGAQVNHVGGQLAGQHALHVGPDLRVPPAPRHAQVLHARHLLGEAHAPRAVDAPRHHRLHQGPQVLVHYRALDLREAGAVRAKRHCLAYDWGGGGVEEGGVERRGGFCGPTGVRRGRAFGEPWGQRHQPPCIGQDIAPRRQMGQSRGWLMSRNSITPSRAFFTRGVEVLMFMPGPAGMAQDATGLGLFSTCRAWRKGVGVSQMTGRRDCPQRADQSHQRVNVKGPRTQAFCLGPDATGSPSGQDPGPIPASRRNTDRNTTIPPLQGTCGSCRRWRASGDSKTCAPTGGREGYAQWGKGGKHGMKDTVFARCSYVASCQPAXXXXGRASCQPAFPDDGGLSAHLGTSTPAASQACSTLEPLGTFTGLPSTVTSMRSSAGAGAAWAAIARQGTVSHEEPLREKRWRARSRCMLPTTWRANRVSLLAACRCQERDLGVGDQDASLCVSRLEVLPSVGGGKAGSSNASR

SEQ ID NO: 13432 - protein, 68 aa, Chlorella protothecoides
MQRLRALQRFSRRGSSWETVPCRAMAAQAAPAPADDLIEVTVDGKPVKVPKGSNVLQACDAAGVDVPR

SEQ ID NO: 13433 - protein, 444 aa, Chlorella protothecoides
METEGLVHAAVASGADEYLSKPVTRKEAALMWQHVLRRRAGGRPRVPSQGTASSSLPSAVGLEASGNGVVSSVSPPQEPAAGSTQGLLAEPLPSTVFKYCDAGQHPTLGAAASLSSIPRRPSNASQAMVDVGSAAARTAPPLAFAAGARRGAPTATKGDVLEVLCALRRTQRAAAGRLRRRLETVARDLEAAKEEAGRRWPQAGEEDAMQTAAPPAKRRAVQASDARPGAGGDRVVPGSEIVDQAMGQLQDLYFQDVAKAGSHSEGLSKFAQDLAELTRCSNLEPVATLNSGHLGGTAEVICAAAFDAYEEHFASVGVSRVIRVYDFHALLANPSALQYPILQLHTRSRLSSLSWNSYLPGRLLTADFDGGVQLWDLWDVGTGADLNFFEEHSRRVWSVNFSRTDPSRFATAGDDACVRLWSTGDETSVATINVPAPACCIEHR

SEQ ID NO: 13434 - protein, 432 aa, Chlorella protothecoides
  MOD_RES (114)..(117): Any amino acid
  MOD_RES (254)..(257): Any amino acid
MPESQPSSQMSPRLPTRTQPHHLLHYPAVLNVDPSDEDVRRCKVVLLLELNRFADALAAISAHGLDKELAFERAYCQYREGKLEDALVTLQMVSKDRQGVVTRPSGRLCDDLCXXXXPHRPHGVSLWVAGRVLLLDPVDRLCDDLCSSLPHCLPGGQAPARGPAAVPPGAVPRGDRHLPPAVPAVQGRDHGGADQCAGRLCGGRPGRGGPCRARGYEGASREPSCSISLTLCQVLAVPGLGSAFPRCSVILFIXXXXAVSASLCAKSLLCWVWDLQSLDPPPDHLTPFPPSPSGVPQGQLRGGLQFGLCAAGNRGAGGRAGAPAAGAACRGRNPDRGRAGGGGAGQGAGPHHRPAGLRGASVRWRKEGERAEGCWGVGGGLWRVPGGRQLCRRALSSVFICVTTPQNHIPPPLHPPSINSSQPYHPPSPPQN

SEQ ID NO: 13435 - protein, 624 aa, Chlorella protothecoides
  MOD_RES (24)..(26): Any amino acid
  MOD_RES (150)..(183): Any amino acid
MRPLPSSQGTVYLRPVPLHDMHPXXXCPCQVPREPCTLALYRSTTCIHLLQPWNLHCSPQHTRPFLNFTGRGFCAQAGQGPGWEPGDQLEPRGIPCAPALAAAPAQHRRRVRPPPPGRRRLGCASFCLLRWNPELWPAPSFAALKTCPCXXXXXXXXXXXXXXXXXXXXXXXXXXXXXXXXXXRNWLHPGTSSWLPTTTSCAWEMPIAQIPCRDHPLPSERTQETSFRPSKSDHLPPAFLVQDAGALADAAGAATALPPALEQRIVCVRAMAAAYAVHAGAVGPFDGVEHVARAADATASKALRAACLAFLATLVAPAAGVGEDGTGAARQAATANADALLRAGGVGLLVDALVGAGRGWMGSNRGFAWLAALTSNLESSSPAQPGMRTAAAAAGWQPCTATSSRPPRRRNRCACGGCTCLMARRGEIVWGECQCCSAAGRANSKKSPGPEHPRRASCLGNAGGTLTSKIHEPHQFCGHEVSLHKPSALFSPTPSQHHQGLHPAGAPPGLCAGRGDTGHPALLSRLALPHKSRLRARAALGPGIQRGRPAARGGDRGGRAEHAGRAERATAGAGCRGRARGSRARRAARAGLWRDAAAPGAGPADQRPGPGVGRVHAHAAHAVS

SEQ ID NO: 13436 - protein, 593 aa, Chlorella protothecoides
  MOD_RES (263)..(265): Any amino acid
MLRHLGDFPARLREHGHSLYEYTPCPPVGYPEIEVGGQHPKSACKSPYADRCPALSPSLDLLDQIRRGSCGATGTICATWSMRSGSLTGRSRMPCRSFRGGKRAGRWACGGVRCKRKGWLEMVGSTREVRGAGTAVNKTGSLLLASGILLQATHPFPAGCLARGAGPAAAQHDGVGCLRRAAGAARRYRARARGLAQGRLPPVHWGRAFQGTVATPGVVCPVLRSSTGICLHVSETFRPSQRSGPPQTHTPPAPSHPATGSLXXXHVSMLARAFHPDKNPDGRDRFEAVQRAYARLQAGAAGGQGPQPWRLLLLIQAQCLVFRRCTAELAPYKYAGYALLLRALTPPDPGADASEAQQLLGGEALPLVRAAAELAWLTCAASGPNAEELCRSGGLEALGALFERCVAVTHADASPMRPEVAILTHCLHAFAAMACHPAPRSAMERRPGLASDVVRCAGLERAHDAVDAALRCAVHMAASPALQAALLRAGALGRVTPLILRYDATVPGADGPAAEVVPGMSPGDRYRPGPPVADEAVNHGFKSSGSDGPGAPARDPGTAESARLNASAMLAVRTLAGLAGWAGPPGPEAPASA

SEQ ID NO: 13437 - protein, 291 aa, Chlorella protothecoides
MACKPFTAHGAGFAQGPRAVPRRGSFAQPMRAASTAGASGDELRDELGFKLMRKGVKEFSGETILTPRCAQHSTAWANAPGGPKHQIPRGCAADVITRPSRIRPRFYTTDFEEMEKMYSLEENPNLKMDELEAMLAEFRRDYNQCHFVRNATFPEAAKKLTGNTRKIFIEFLERSCTAEFSGFLLYKELGRRLKKANPVLAEIFTLLSRDEARHAGFINKSMSGECALGWVFIIYATYLSEKIGYWRYISIYRHLQRNPDCQLYPLFEYFENWCQVRGKGWGLDRPGGAGW

SEQ ID NO: 13438 - protein, 177 aa, Chlorella protothecoides
MWRDCQVKAVLSPPSAPQPPHAQDESRHGDFLAATLKCQPELLEGTAARLWSRFFCLSVYITMYLNDHQRSFFYESLGMDTTRFNKHVILETNNTTERIFPEVPDVENPAFFQRLDEMVKHNNAIVQIGRSDAPNWLKNLQKLPHLERIAKGCILLFLAPAKRVGSLDVEGDAAFQY

SEQ ID NO: 13439 - protein, 180 aa, Chlorella protothecoides
  MOD_RES (5)..(8): Any amino acid
MPHIXXXXREGGDSLRKQSCLTHLRKCWGTRGAWHSAPPPTRILTCKPHIQSPPFPLLPLIMIHNDRLLACLATEILEAVKKIENAVLSMAAVGLAVDDEAGREAEASARGACALLDALFPALLRALGGGGEEVVAAVLPFLLSYVGWVRAAARRKGNAGGGEAGAGADGATTPARGAAH

SEQ ID NO: 13440 - protein, 646 aa, Chlorella protothecoides
  MOD_RES (326)..(329): Any amino acid
MDTASTAAWSSDPWCAPEQGPREAHPACTVLGCWYAAGACSVHAHPSIPLASPPQSGAAWSIYIGQGSGGLATGLGVMLTGAGDWYAGSWRDGAVWGRGLHVFSPPPAGGGGPSQAWRRDFAGSFDGRPFGLGRATWWDGRQEHGRFHGTQLVEQVGCDRVDEVVGSALQSARAACRHARRLWLRIDSEHAAFAAQCLAQAPDLPSALSRIDETLLVCMTCWMADRPLEGTCRASRDRSRAQTSLGPSQAACRWNHRRTPPPALAPSSGRRGTTAGCWAEETALEGSRELKQVSKAVNATPWLVPAALGPTAPLPPLISLSQTLPXXXXRGIGSHCTLNSPDHMADDFEKAVFYAFAQPGTAPADVSARAGAALEAARAGPQAWALCLAHLRSSAHAEVKFWCLQTLHGLVGERYGELAPDQRDALKSALVGTALGDPGLAPFLRAKLAQVLVGVACREFPSAWPAFFQDLIATLPAGPPAADLFCRVLVAVDEDVVSLEVPRSAAEARASMAFKDAMRDLALPDVAAAATQLLAASHAADPPAAAALLRALARYVHWVDIGLVANDRFVPLLFGVLGSRDEGLRAAAAGVLIEIVGKRMEAEPKLALIQQLGVVPEAAKWAEGLPGAEDGDAGSELAAKYARQGG

SEQ ID NO: 13441 - protein, 1571 aa, Chlorella protothecoides
  MOD_RES (73)..(75): Any amino acid
  MOD_RES (116)..(118): Any amino acid
  MOD_RES (398)..(401): Any amino acid
  MOD_RES (1406)..(1408): Any amino acid
MLFTEQGRRFHPMNTVPDNHAPWQGLTLAGAGVEMEAFMLLPIPVQGGNDGKRRPKMGRRTVQVLTLSIETTXXXVGMMCLRDPRCLLVASHKRMDPQRGIVPFILHHHKYQADRXXXCLRDPRCLLVTSRKRMDPQRSIVPFILYHHKYQADHDGGLSTVTARGLGEALGSDLMSRLPHLLVGTWLLALVAGVPEMCGVTTTVEHGVHLSAAVSPPVTLLQLSDLHLAAPNSSGAWAAFGDREGDLRAFTAHLLPRLRPRALLVTGDLTDGKQAGGRGQQQPAEWASYRSFLADVEAAGVPDVHDVRGNHDTFDVPRRGGAADLFAASAASARRRDPAQRVYAQPLWASEPDQQGPEGFRGQQGTTPRTARDRCFGHVASPLSPRLPHLRPMALVIXXXXRTARDSRVLPRRRPAEPGPGAPRGPAQPLQLRGRRRAQPPARAARRRRGGVAGPRGAAPTLLGILPRAAGGGLRPLPAEHGGRGGRRLAAGHAAPPGPAPAPAHGPAGGAAAPERDGLPFRAPARRLWAAPARHARGGGRCGRGASVVCWERGGCPVPLQRVAHIRRPGAGCPGACRAREADTKTLLRMDNPIAGPSGHLAELETAAWKDDRRFRLLAVDGGLLSFQDLFFHAPGSPGQPRRPDAAARLDPGEFLDGARRVGGWSCTSLTTGESLAGREEPGVSRLPVATRIAVVLPGPSACSRSNSPEDASSVPCRAGLVSLLTTPHLPPNPASGWAVAYRRRGWGVTALDASARVHGAAALITFPPDARYAPVPQHARAALPFDRGTVRALVYDLEGAGPGLVHARLTCGARGSGPDVELARQALQALEPEAPGPTLFQGVVRLDRGCPGTADRAWLQIEVSGGAPGGGGASPRQHVRLERLAGGGWTVAPLPEPLPLDLGLLETIGLRVDFAVLAFRCVGSGGVVCSEEGRRVAACCLLWRGRASSWAASFYPGSCTPGAGVSASPPAPCTPALRPGARPWPGPSLGPWRPWSCLPATPAPGPQWLTPHAHVPSVCRAIVGVTWGGSKFTAGVCILPPARTLGSGEVAGGCTPWPPATRGCGDAAARGRPPRPLHARPLLRGAPAHAHGGPASAPLGVLRGRGKGAAGQATGGAGARGERPTRSESKRQQRQLRRERRLPRPSVQAVCRAAAQRQQGRRGRQGHNGGGAAAPRGSGQGDACPNCQARRPLAPPAGDGGPGPGILRRRGAQHGAALQAHARLSGPLLPLVFAGGRVDACTRPFAHALCVRANHMGYKLRCTESWRIPLHQALAAHDGYIQGSCHAEGLTCHLNAVHLPNFGSVHGSEGTFSFNVAPVSARPSWSTAPAGPATPVTASAWSPPRNECASTAWDGVWHRQTHVRFKPDHHTNKPAAGALERAAVAASSALFPDPARYRAVKGHAXXXERAAVAASSAVFPDPARYRAVKGHVEAGYALQSVPLSIEPGGWIRVPRRSHLWRESSVSDGGNLMEESKVAGWKPWLRIRALEELHDVMGAGQATSFPTYHPARLWRRVVVPMPHARGTPPVRSNGNLRHSASAWMHCCTCRDATAIATIDSMRQARIVMERR

SEQ ID NO: 13442 - protein, 173 aa, Chlorella protothecoides
GGGPAARAAVAAAVQAHFRPEFVNRIDEQVVFEPLTRDQLRQVAALQVAELGGRLADRGVTLTATPAALDYAVTQSHNPAYGARPLRRWLEHAVVTPLSRMIVGGELPDDSRVTLDCPDPATGLTFDVRPDAEAAAARAAAAGSRPGSSAKKLRLTDRALENGMDLDSEDEEE

SEQ ID NO: 13443 - protein, 929 aa, Chlorella protothecoides
MLQRALPAGRGRAALEADLSAARLAFLRDNVVLGRGVLATGAFLELSAAAASLLTGKVIAGLEAALRDIVFAVHVSLRSSSGAATKVVCGTGRLPGSLEITTPEGGRLRTHFHASVAAALEDDAKVGTGAGQPRGPEAGTLALLIARAAMAQAGRAPTVVALTSPPAGFSPADGETWAGPHPAQVEASLVSPAALAAGSPVSRAPPLRVTARIEALALPPPKESVHTSPSQTPAWLGTTLARSHYASSHALGAGFSLAGVEHRRLLARRPPLMTPRTPRTPHSPFGAGGGLATPRTPMYFLPSSPGAGDWSPAPGMARDGPNAFDRAQEAIEVDAEAVLAAVRAAVAGAVGTAVGDNDPLMAAGLDSLAATELQQGLADELGLELPSTLVFDYPTIAALAEYLVGRMAGGAGGGASQALGPESSLALFAASGAAALPGGPGSAVALMGAAGQDHLLQRYVHGSGDAASRVPLARWDVDHAARGPRDDGALAPQFGVFVPGVELFDPEAFGIMRSEAAGMDPQQRMLLLAAHAALAQAGGVPSAGRAVGAYVGISTNDYEPLCERSGIPISSFSFTASSASVASGRLAYVFGLGGPTASVDTACSASLVATHLAASAFRESPLAGALAAGVLLCLVPESSLMLARASMLSPEGRSKTLDAGADGYVRGEACRVVYLARADPQDPQPGALGLLRATAVNTNGRASSLTAPHGPSQQALLRWALTAARLRPAEVDGLQLHSNGTALGDPIELGALAAVMLEGVRRDAPFALATVKGYTGHQESGAGVAGLLEAAAVLTHAALPPALHLRSLNPHVRSALSGHAAVAIARGGPYGLPALHPGASTLGVSSFGAQGTNAHALLAGPGHPVTPPFPLAPGAGPLWQHSVCWAAARPQVKGVGVVRQVFPRHVQTLGRGGPPSSGPQAGAMWAHTV

SEQ ID NO: 13444 - protein, 654 aa, Chlorella protothecoides
MQVDGVEGDLARQLQPHHHHARHPEEEDVVPRLQQRAGVKPAQVGGVAGPAEDRHGEQAGGEPGVQHILVLGQAQRTPREARRGQFQRLGLAGRHHPARGVLGGRARRARLVALPGDVVGGDAVSPPELARDAPVAHVLQPPEPGGLELGGDNAHGLGAHGLAGGGGHARTGHPPLRLQHRLDDVGGAGADAQAHGIGRRAAEQAARLQPVHDRHARGEARHARELAGAVAVHPAVVVQHVDKLQAMPLAGGKVVGVVGGRDLDRARAKSHVHQLRVGHDGQAAAVHRVDHVPTHQRLVPRVLGVHSNGRVPKHGLRAGGGHHHLPLPALQRVGKGGEHAKLHALGVAGHGQHRRPGDIHVVHLDVADCGLQPAVPVDQAVVAVDQALGVQAQEGLLHRSAQLGVHGEHAAVPVQAGAQSPALVQDAVAVARDPVVHAVEEGGAAQVVPGLPRLPRQLALHHRLRGDAGVVGAGHPAHLVAGHAPPAAQRVLDGQGQRVADVQRPRDVWGGDDHGKGGLAGVAGRGKVARRLPPVVPFQVRRRSGGAIGQGTRVKRGRREGEDRGSAWCACEPAPAWCLNPGPQHPAAPQDPTHPYRHAIQRTSRSPRPWGRSPWASCQAAPSWSPWGSSAPAPAMPPAQRPPRPGRKVRRGLL

SEQ ID NO: 13445 - protein, 164 aa, Chlorella protothecoides
MVVFCPNLGLLSAVVLSLVPLLLPFGWQSLLLPVMPYPRSRLDLLDAPVPFVAGIQYKTPEVWARCGALVRVNVYKDRVSNAGRLAPLPSRATLAEALAGTYAELSALGRTPAARARPAHQVSDAQAALAGVFLSTVQTYLRSLVSDLRAYTITDVSASQERTR

SEQ ID NO: 13446 - protein, 429 aa, Chlorella protothecoides
MERRPPPRPTRLTHPNSWRGQGRPRPLHRSPPLRPHPPLPPLPSPSPGPSEVQVLDDLLHVFVSTAAAVDHDARAVGQRGTQRVQVGQRVAGLQGGDDALQARQELEGLQRLRVGHRPVLGAARVAQVGVLRAHAWVVQPRGDGVGVHDLAIRVLDDVGHGAVQHAHAPQRQRRRVLVGGQPVPGGLHADEAHGCVAHELVEEAHGVAAAADAGQQHVRQPAPGLSGLPAQLAADDRLEVAHDLGEGVGPRHRAQDVVRPLHVGHPVAQGLAGRVLERARARGHGPHLRAEQAHAEHVQRLALHVLGAHVDHALQPRAGADRGRRHAVLASARLRDHALLAHALAQQRLAQRVVDLVRARVVQVLPLQPDLGAGAVGAAVVLRQPLRVVNGRGAAHIRLQKVVQLGLRGRGRGGFGFRRYQESRWGVVE

SEQ ID NO: 13447 - protein, 151 aa, Chlorella protothecoides
MRATRGAHPPLPAAFPRVPITDQPPQPRCSWSSAILRGPATPQTTSSWWCRMASRWTSPWQRPWDPFSTPRLLLPNKQGLFDVDKELARLRKQQERLEKERAALEARLARPGFADKAPTAVVAEVRGALAEAGQQLAAVQAKIQALESQRG

SEQ ID NO: 13448 - protein, 309 aa, Chlorella protothecoides
MTEWPAYRGRDARTVTQPDPVLFRGGACSALLALGRCRGKVLFRHPWTFTPACLSHLPTHSQKLYEQYSSIHFAAAAAAMSLRRRLKNNRPPEGWELIEEQIPSSSYAAQVIEDFEQQMKEAVNDEHEGKRKNETSWKIHRIHWEKNRFIYDLMYVRKVMSRELAAAPGGSRKVNSSTLSPPSPSQYDWLVREKMADGPLIAKWRKPGYEILCSMLAIQKNNHNFGTTSHCRVPMKLRAFQQRITPDVQTGCICCASGDGRFGGPLWWNTPIEEDTEETAEANRAVWGQEGDQQPAPAQGGSCSVLRWV

SEQ ID NO: 13449 - protein, 282 aa, Chlorella protothecoides
MAGYRDVCPKALRAAAPFLIVLDRPDIKNLEPKYRWWGGGGWVTFPLAEVFKLDVRGMKSIDDYTKILSKKGRWNFKDRQKKFNNAKVINHEYVDLPPGSTEMVASLWPLYKSTGDANGFCVLSEKEFADFHLNTPGLTLMLIRDVAAEGKLITFCTGVRVEDTLMPMWCGTDYENPLAKSCSTYFNMYEGGGAGRNWFGWGEGVVGAGRKHALYEYVKVAIADPEINWVDLGASRRQAKTSIGFQGYPVSAYIRCKNAIMESIVETMAADYFKPSELIADP

SEQ ID NO: 13450 - protein, 514 aa, Chlorella protothecoides
  MOD_RES (102)..(105): Any amino acid
MHQAGGAGRRRQREAFDDVCAHFPPVLQHFFLERFHSPGEWAGRAGGRGRAGARARCTLQASFKILGAQPTTTPVPARSPQSCTFPSPHPPLLSTANLPGHXXXXPPRRYQLGPPDPAPFLPPTPPLCQLQTCPDTPLTSPSPAVHLPQYRRVAHGPAGLRAQRGGRQHGRPRHWPGRSPLPEHPAAAARRRGGPHRPWHCLRAGQVSEYAGGGPLPLDPGPGGCHGAARRGWGDDPLLRSGAQGEAAGTAVSDADCLSGQCWWWWGGGTRMSGVEKVIKPWPARQREWELARRWVVRGRGRAWGGDSITATLNSKLARFRWFPAWFWQDSAGAQPGCEGLVTIRAVPLVCPCAAFSAPHSLLPPHPQVVRAHSESVLTVIEVFIHDPLYRWALTVPQAHARQAGNEGGGLSEGPGAAGVINADAERTILRIKQKLRGAEGGEPWTAARLPGEGLEVVHPAADLPAHALLTLRWGRTGRGGAGAAPATGSHGPRQPVAHVHRLGAVAVRVTPAA

SEQ ID NO: 13451 - protein, 241 aa, Chlorella protothecoides
  MOD_RES (14)..(17): Any amino acid
  MOD_RES (183)..(186): Any amino acid
MATTLAESPKTSSXXXXCHGATLKRQINPHGHYPGRVAKNLIPPPPSIPQDAGAGAAPAAGPGFQAVLTELLERLCRDHPFHALFQVLALKNGDRGRDGRRGVSRPGMTYAVDHAKVAAAEALVARLKAAGAPPAARELVAQVGGRLGLVGSCEGCDPRSRGALKLRCLCSSCVITGHCCLCXXXXGWEVGAGRISRGMSSSQPGCAEAALPALLLRHHWPSLPLGLGCDSCSARPPSPPP

SEQ ID NO: 13452 - protein, 98 aa, Chlorella protothecoides
MHALFLQAVEEREEQMLRVALHNYARCLSTGQLYDLPVAFRFVQLWLELGPRIAWVNDHAAEAFQDAPSHKFLPLVYQVASRLSTGGRGGSMGFRGLS

SEQ ID NO: 13453 - protein, 439 aa, Chlorella protothecoides
MKRNTALTRKLRTLTEETRASVLEDAARTNQSKYVAEAAAALVEAPQKARDVAPAAEVACALHRRYPDFGEALLGALRRELDAPLPGDEERGALARRRALLRLLAELTGLGLAPSPALVMAEARRLAAGREELLGLPPAHAPPPGSVDADAGTAADWRAPAEAREALSTLLRGALAAARALVARGDLAESTLARYEARREARDALLRACAALAEALDAPPPALGDEEGEEDEGRGEEVAAQGAGAAAVATESPFEDEETRAFYEDLVDLRAYVPAVLLGPPDAGAEAPVTDQETGSAPDDGDADVSAADVDHGDMSKAEDPLPEAGAPGPTWPGAGPPVSPEAEGSPAPGAAEEQSPLQKPNELQAMLARLPVCVSREEADEAALAFCYAQSKAARKRLVRTLCDVPGGALALLPFFARIAATLGRIWPDIPAGEGLKG

SEQ ID NO: 13454 - protein, 281 aa, Chlorella protothecoides
MHHSPPHIPRSPPGELLKFQAFPAGVAFRALKSLLDDFTGSSIDAACALVETAGRFLARSPATTARLNSMLDIMMRLKTARHLDARQSSLIDSVYSLVKVGGSDLWDACRARRSLGCGLSSIALHRPRPDTHTRAHTHTYCVIHCPTPQAKNLVRQRKQRPPLHSYIRHLVYSGLEDRAAATGPMNRLRRLPWAECEAYLVRTLVRAACKGRHSALPSLASLAAGLARYHPSLGVALVDSLLEDVAVGLESPGEGGGASHAFMCSAGRPSASPPGARGAPR

SEQ ID NO: 13455 - protein, 373 aa, Chlorella protothecoides
MAAVCFLGELYNYKLVNSGVVFQTLQLLLTATPEGEGYSAPGQGWVGDVREAGVLKWSLWPLAFASTILVECMLQLIVPDASLDPPGNYFRIRLACALLETCGSYFTKGPARRRLDAALTRLAAYTLSKAAPLPLDVDVDLGDLQTRLGVAMPSFSTLDAALAAVAELDSSGEAQEGPSLAEEEEAEEEGEVSGASTASSEDGGASSGEEESSREEEDAEGAGEDGDEEALLSPAATAVTPVPVEVDEDFEREFAAMLLEGKRGGAPSIAADAQTPTVSVSFNVMLRRGARDTRTLRTLAIPVAPSVEAGIRARVAAEAAERAQLKRLVLEANRRDMADEAESEAAVLWQGRHRAKGGSHRVSFGGAGHRGVG

SEQ ID NO: 13456 - protein, 771 aa, Chlorella protothecoides
MGVHASLKEHAGYGTAAGGMPASAAPEVAAISCTPLPMERPRRAASTPPPRRGPARLLPRLAARRAQPCRSGDVADLYGAMLLAGALDVGHHHHQVLGGHQVAALEQLKGARHVGLRVVLEADEERDDAPAQVQALPHLLAVGEGEDGAVGAVARQPGGVDAAAREHEDGGGAQVVGHGGGRGADLLPDARVQGPRDARQRDGTRPLLPAPALDARGHDAQHLQRLLREQPRRGLARQHQRVRALAHHVGDVAHLGARGRGQLVHGLEQVGGHDHRLARLPAAQDHLFLHGGHVLQADLGAQVAARDHDAVGRVHDFGQVGDGVGGLHLGDDVNVARRTALNVGLEVVDHVRRLDKGHRDEVHALLHCKVHINPVLGGEDREHGVLGAHGPATAAEGQVGAGQHQAGVHHAAVHVGAGLALHLQGHHAAHSRSPPASHRVDTARSFPHPHLHVLGKGVVGHGDGGVVAQAGGRVAHGEHQLLPRLSLERGGHLHDVHLATLRVHHDGHGVALLLVQGANVGNDLRVPGVRAVGHVQPGHVHAVAGHGVQHLLGLAGRADGGDQLGTPCGAEAWCRSMLGWGVENVLGPLAHRGPGVPRASESVLRLGRPIHTHSPRSLRRWDSRTHQTCTHPTIAAQLLLQHAVDLDLGGAGGGQGGCDVCHCHAGRARPAGFPPVALCVGAGKHAGGVKAGAVAGRQRGRSGQPGTGEGCRHGVGRGGGGRCAVGRSNLVRCHHLMRYWISIGRRACGWVVLEAGRWLKQAGRPPGSRLP

SEQ ID NO: 13457 - protein, 580 aa, Chlorella protothecoides
  MOD_RES (517)..(519): Any amino acid
  MOD_RES (549)..(556): Any amino acid
MVVSALGLSGRRGALAALRALGGSRPSQQTGAAACVWGLLRSDAAAFSSLQGVPSVGFSLRALPTTASWVPAVRCISSTPAAWKTVEVEVPSMGESITEGTVATILVQPGETVEEDSVLATLDTDKVSMDIKYPNKTPGVVKEYKAAEGDTVTVGQLFAVIEESEGGAAPAKKEEAPKEEAPKEEVPKKEAPKKEETKKEEPKKASPPPKKPEPASKPAAAPGGAPPSSGPRPERRVKMTRLRARVAERLKNAQNTYALLTTFNEVDMTALMDLRKAHKDAFLEKHGVKLGFMSAFVKAAANALETVPAVNAVIDGGDIIYRDYYDISVAVATPKGLVVPVLRNVDAMSFATVEKTINELGKKARDGALSIDEMAGGTFTISNGGVFGSMLSTPIINPPQSAILGMHATNIKPAVVDGQIVARCAREGVFLGEGCDERRHLQPHGMRRKGKHSLETTPLGYCAARPPQLAPLQPILYPPELQASHVPGTDLRPPPHRRARGGHLPQAHQGGHRGPPXXXKHSLETTPLGHCAASLRQLAPLQPILYPPXXXXXXXXAALQHHWLNSHPRRGADAPPSRHC

SEQ ID NO: 13458 - protein, 302 aa, Chlorella protothecoides
  MOD_RES (262)..(264): Any amino acid
MARAQQQLGAPHGTVSAGRELSGKTISATGVASARQSQFLAPVKRRRTDTPVLRDWVEVDTFGHGSSGGKLSFPGEMLRRGRHIHEIMLAVTAARKITPAHTSAPPHGAGYGQDKQGVCGPEDSGKRHSLSRDIQLVSPFVGQSTYHGLAAGSSSCQPRTFIPPLHSVFLAEEEPSMQPGKVGMNAIQRRVIRASSGDTVAAQPFIPPGTHFGAVLLNAELEPISRRGGEVDLPAPEVETHIQSRFADQVMSACRRELLVAXXXARGGDPHPVQICRPGDECMPKRVACCLWSNEFRPWSGL

SEQ ID NO: 13459 - protein, 224 aa, Chlorella protothecoides
  MOD_RES (28)..(31): Any amino acid
MAASRCWSGSTPQGLHAVRMETVSVPWXXXXVEWPLDRNLLNQWLHLDAGVVLPHKASMLYVWRLSQSHGCPSHPPVCLPAGHCHHPTPSQVFTSGQELTFEFQGLNYLLRVSTLTVVVPGGEQQTVPRAMLSLATSCVFETRKGSGIKIVGQKRWGGRLWISAACITVCTWQDLSNGFQLVRSVVHAWLRVHDDCGTAPHSPITPLAPQHHDLPAVQAARGVL

SEQ ID NO: 13460 - protein, 277 aa, Chlorella protothecoides
  MOD_RES (70)..(73): Any amino acid
  MOD_RES (223)..(225): Any amino acid
MGTGGGGGSIPGSEHEESPAFQAARLLRLTACNGWEDVHPWLHPLSPHRSQLPSTPPGERSSPGASPPRXXXXSRCASLAVSFVSSSRPAPLYTTRRAFESRRLPPSVVERLGIKHRKGILLYGPPGEMLGRVWADHLSHAQHGPRICTPGTPISGTGKTLIARQLGMMLNGKEPKVVNGPEVLNKYVGASEENIRNLFKARRERGYEGQGWGGASNTDAEAXXXREHPESLQATLCWINGNAGAKGGCGSQPKDSTRVLTSVKSKPTVHRTPRKTT

SEQ ID NO: 13461 - protein, 172 aa, Chlorella protothecoides
MPPALPSTRDTHFLLRLPSDLCSVMQFRPQPSSSADSVAVTGATTSSSPLPLSTHPLQSRGSVRDGSGVHDTIVNQLLTKIDGVNALNNILVIGMTNRLELLDEALLREGRLDVHMEIGLPDENGRLQILKVRSRVVGMVNEDTKQGAHTHEIEGGGCALCARKHMGSLSPC

SEQ ID NO: 13462 - protein, 347 aa, Chlorella protothecoides
MQRKSEEPEALQPPHAPHARSSSIHVPPSATVCTSAHTSPLPPRAQVKEVYLVYLLEQLEALKLRSAIVFVSTRRNCSLLQHLLAELGIKAAALHSGLPQRDRVAALDRFRAGVVPVLLATDVAARGLDIPDVDLVVNYDLPHLARDYVHRCACWGSVCAEGWWIYRRVGATAPGVHSSVRARPLFGPHGHVVCSSGSSSKGPQQGWVDAQSVHPSMPYQPLMPPLGPPHQIHHCRVGRTARAGRAGWSLSFVTQYDVELVRAIEGLLGRQLAAFEAPEKEVLAGITKVYAARRMAALRLAEEEDAAGATGQRRKKARPAEAEAERPKGRPGGERTPKTATIAREEV

SEQ ID NO: 13463 - protein, 144 aa, Chlorella protothecoides
MVEEGGIALFARPPSKLKTRPRKEENALPKTVTRPAAVAVPPSGAKAGEDDTATFRSLGLSDWMAGVCRGLGMPSPTAVQRACIPAILAGRDVIAVSQTGTGKTAAFALPILQLLARDPFGVFALVLTPTRWLGRWILACWRMA

SEQ ID NO: 13464 - protein, 107 aa, Chlorella protothecoides
MADLSKPVVEENIRVTRADFLRALDEVRPSYGAATETLEQYRPGGMLDIGPQYHATLAELQQLLESVEQQEAVPLSAALLWGDSGTGKTGEAQCAWLGWCMVGVVLA

SEQ ID NO: 13465 - protein, 316 aa, Chlorella protothecoides
  MOD_RES (181)..(183): Any amino acid
MGDSGLDLTHTSWRDDLWLQAYGISPLNILDYFSLSPFYDKNCSNEGAKQQGLELTQLAILAPGIEYVLRDSQPPHLFVICRQHRAAPSAPAAPQAVYYVLDGTVYQAPALHAALTNRMVRRGDGGGAMRGVTGVWGTDGWEACQRPGHALRVEQGPPPSQNPASGTLFPATALSLHPCRXXXLTRGYERDLTVWLLGVPALVTVWRLHREQGPPPSQNLASGTLFPATALLLHPCHRPAASHTLCPFIAGQVSVQHAGGLYSDAGGSAPMHSRYGVQSIPAIVLVVPATWAAAGGWPWTLTIPLFPLKSPSYRAA

SEQ ID NO: 13466 - protein, 148 aa, Chlorella protothecoides
MAPTPQHVCLHPLPRFQPLYSQGRLPRLTPSPPPPFNTPQVRSVPVTLSLTDLADLALPPPRIREVSSVEASLRLDSILSAGLRLSRSKAADLVRQGSVRVNWRPVAKPSVELSAGDIISCSGKGRLVLRDAQPTAKGRWRVTMTQTV

SEQ ID NO: 13467 - protein, 206 aa, Chlorella protothecoides
MLVRRLVPLPAAGCTLAAPSPRFRHAATFARRHGSSSGLLEELDREVDRALERATRATVTWTPLATGFVSPAVTAAVVSALSTSADTGVIPWGGYPQAERARLLLGPRDMLDVWAGEPAGAPWPPPPPPIQILHVRGNFLFDPGRHADFLGAVLGTGIERSMVGDVVGVGDRGAHVFVSSSIVPHLEASLTQARRFWGSGRDLNYG

SEQ ID NO: 13468 - protein, 262 aa, Chlorella protothecoides
MRSQRTLGRASQCVWPVRDTAGGRSRDSSVRHVAGHAGAKRPDACAPVSLLTGRTHNVRQGRTLPHLYHPPPYRVAARILANLAVAGATVLFRAATQAYRQALVNAQKSGVTADSVGAAARLGKQLTRQEAEQILGIEAGATWEEISKVRGPLRLMWVGYCHESGTCMWTDCGLHCATLCPRPGHAHALVSLPSMPPSSVQKYEHLYKKNEEAGSFYLQSKVYRAKERIEQDLQAEGVPTPDLTDIHTQQQQQQQGATGKDA

SEQ ID NO: 13469 - protein, 290 aa, Chlorella protothecoides
MPPFLSQISGPPPLTHTPATPTTGLVQSSFFYGYLISQLPGGWLAARLGGRRVLPIAVALFSAATAGVPFLAGTLLGLCAARAAVGLGEAVAPSCATEMIARAVPVAGRSRATAAVFSGLHVGALVGLLAAPPLIAAGGWRAVFYVFGGAGLVWCLGWEALLARLQRQDPAMVALLDGSRGPRPVRRTGAGARISPPASAPAPAPATPWRAFLSNRPLQALAFAHFCNNWFHYVMLAWLPTYFTDRLALDLDGAARFALLPPLAAIAVSFAAGKMEWGGSRVVSFLGGNV

SEQ ID NO: 13470 - protein, 411 aa, Chlorella protothecoides
  MOD_RES (206)..(209): Any amino acid
  MOD_RES (266)..(268): Any amino acid
MHCLQQPGRSSPTPNGTPPPPYTRLVLQVDDALDLGISDGALGGHQLLALLGGGVEEARVHLRLLVLQRDVGVQDEGPLHAAWHVRVARAVVQHQAPHQPRVGVQPVAHVHDLHHVQVNGRAVGGAHYAHRVGHDVGELVGQVLAQLRAERRPGDAAQGLAVGHVHRLLEAVQEGQRRALGQLITLIVLGRVNGGVCFWSGGGGSXXXXAAPSHVDQCPAPLALATPPHLHDDARVEALANVALRLLHQLADEDDHGGGTVPGTGXXXPVERAILWRGMHVEHPGHQSGDAALAQHASRRRREHAHGLMLGRQFPGGHRRISPRHPPGDVVLGDGSTCDHHGRGVLDLHLPQQHVAVLGQLDVCVWWGVRALAWQGHITLGAYQAAGPGTTAAHQSTHFATAHLLRPPQAS

SEQ ID NO: 13471 - protein, 112 aa, Chlorella protothecoides
MVTYGAMSKQPLAIPAPLLIFKDLRFRGFWASGGFSKVGLRRTQGQGVGREGWGLRTLASTERMRREGAGTVANSSLTSPTPVQDEEGLARKREVLKEVADLFEEGALDAPK

SEQ ID NO: 13472 - protein, 216 aa, Chlorella protothecoides
MIIFIGELMKQAERYIGEGLHPRVIVEGYELAKRAALTFLDGFKEAVDVSDREALRCVARSALRTKLREDLADQLTDIVTDAVCIVRPADGAPIDLHMVEIMHMRHRLDTDTRLVRGLVLDHGSRHPDMPRSVERAFILNANISLEYEKSEVNAGFFYSSAEQREKLVAAERAVTDAKVQRIIDLKNKASVWRRGGSIGGGGGSTRLLQAMHSRCA

SEQ ID NO: 13473 - protein, 366 aa, Chlorella protothecoides
MGSLSGASTGACPPLLGLCGDQPERHRPPLPGPARQGGHPGAQVGSGVVVPGGGPPRGGFVVINQKGIDPLSLDLLAKEGILALRWGAGWWCRVAAHLEGGREGPPEDCSTGRESWHPRLGFVDSVPWIRSGLPPPPPTHPFLAPPPSQAIQAKERGAPAAVVRGLRGELRGGARAGVPGPGRQCLRTRLGGGKVHLCGGCGQAHLLHHPHQGTSAGGGNRGAWPCGGVDGGAPCHSRQLRVLGAEQSAQLSLRRPSLRQTPDLAGARHPASWDVGHMLDSLQDVDPIGQVTSACPHSQQSSARHSFPLQGPNDHTIAQIKDAVRDGLRAVKNTIDDAAVVPGAGAYEIAAANHLRSVTVKTAEGR

SEQ ID NO: 13474 - protein, 122 aa, Chlorella protothecoides
MGRQAALFMNINAAKGLYDVMKTNLGGRGRGARACRLVGTQSDVPLPCQRPHTPPHTDIKLTKDGNVLLREMQIQNPTAVMIARAAVAQDDVTGWVAGANTPVASRKLSPKHESMRVLASTS

SEQ ID NO: 13475 - protein, 244 aa, Chlorella protothecoides
MATAVTCKSLVYEKPGDPVEVLSLKESPVPSPSSLKDGQILIKLIASPINSSDINTVEGKYPLQPELPGTPGNDGLGRVEAVGPKVSGLSPGDQVVPVAACPGTWRSHAVAAASNWLRVPPTLSPEAACALSINPPTALLMLRDYVDLAPGDVVIQNGGNSAVGRLVSQLAARRGLRAVSVVRGRGDAAADAELARELEGLGAALVTTPERLKADLAAAGLPPPRLGLDCVGGEVALALAKTLE

SEQ ID NO: 13476 - protein, 277 aa, Chlorella protothecoides
MNDYMVAHVFLQPTANHVQPVHSKGRSTGAEDVGDHRAKQGAGHLQQHVGGFESVSVYFVISLFSERFTIAVSSPRQQAKAATAPFKVTAIRRSSKGIRASTSAHCTGGGEARSWWRGDAEGSGGCEDRPEHDQGAAAGEHQYCGCHCHSLCDQGEDTDVVGLDVSIGGSGARNTQVGDCVTSSVSCKKGWSQAAYEVTREVFEASKGRLRVVGRAGVGIDNVDLTAASEVRAAALSGVCGMGDLGYVTRIPLPALGGMGVLRGDPATRISYSNSSN

SEQ ID NO: 13477 - protein, 208 aa, Chlorella protothecoides
MQELLAAAKRRALLSRMSTRYSGEGAPGSQTMDRSDDSLPPGEQRAEVSDTAWRAGADGRVTLPAGKLRPSLCAPCPPSHAAWRREAGGVLHHRSCAHAAASGERPYHEAGGDGALPGRRCGMHAFLPAAPGVPRWGGGAEDLHCWAFCPPGGLMSWNLSVISRRFCTSLVVGKDAISRLSFNTVKRMVDEMVVCLARYAAGLECLGK

SEQ ID NO: 13478 - protein, 316 aa, Chlorella protothecoides
MRGPGGTGWSGRACEDRQARRVPAGSRLPDLPDFLSGSSGESWGSFGDKEWSERVHASGSGFKILRCPWQGASGSGAPLPAQPCGIPARQAAGRPPSPADPADRSPEPAGYQSGDHHLGEAAGKAQDGQTKPDCLIDSWAAAKDHGSLWRGGGLQRRHDRRLLPPLPGRHLLRCWAPDIQPSPPLRAHYYALDAGEAALRGGCAHAPRPSPHECTPGSNCLPAGGIGAIPEQLAARLRAPALRLNTRVLGLTPGSGGWEVKLGDGETLHAPAAIVATEGPAARQLLGARLAPNPSAEGPGVGSICLYFAMDGGPPR

SEQ ID NO: 13479 - protein, 404 aa, Chlorella protothecoides
  MOD_RES (294)..(297): Any amino acid
MRGSFVMRAWRLTGASNWRFGPRRSHKQGGDAKRGSHSARAGASASLPFDPKWLLLPPAAAALLGGVAYAHNTQFSLSPSVATALQQYSGQHTPAHDWEEVIASEPGTLRVLTAEALLAQDHPFLEDDHMFSAFVSKGIVEDLTGYYNPEQRRWHSVVALGREVCGFPRVVHGGLTAAMFDESFGGLLFSLKQAKALDFWGEWAGGWGMGKGREGPGWRGGAMTWARTPCTKYVCMYTGPLWPTLVREEIEGPARKRHRIPCLAPDTHLPLPPLPRPSGPAYTVALEVQYKAKXXXXPSPTSSLRPCIHSGAGGPVQGQDPGRAAPAVHRRGGKRGGQEGVDEGHDDRRAGGQGVCHLPRPVCGAQAAESGPHGHLLPLAPRVREQEGGPCQPGVEGPTGEAPR

SEQ ID NO: 13480 - protein, 499 aa, Chlorella protothecoides
  MOD_RES (79)..(82): Any amino acid
  MOD_RES (401)..(404): Any amino acid
MHINLGFEASSGTGRTPVSSQSPRWHSQPHSAILILTSHIYFRKDNGVAARYRSRQDRHQGDGAGGHPRVRGHSGRQHXXXXSQRDGAGGHPRVRGHSGRQHRLPRPPRRLPRPGSRCRVQDARGGAGRTQVCPALPAHLPHHPGRECRPQDAQRGGTACMTHRQRLVDADAVLPFLVGRDLRMHTSTRPLYGFSGRDPAKFLRAAGHPDVYYVDDPDVSVASMLATPLPRPPVEVAVVPHWLAIDGRQPATPENAPPAVPARRAAPAKAAPAAAQVGAPPAAAPNKALPAASSGGEGATPAVAGPQPAGEEALVRAPLRHVLTRELQAYLDRVGAWLRHGSLEGGGALVAPSPAAADSAVLASLAGDAGLQPLLPYLWRLIGEEAGADLRELARLPRLMXXXXPDRGGGRRGPARAGPPATPHGGGGGAAVKPGAGLRGAAARGAAATADRAGGTPPGPERRRGALGCAPRRGARAGHAVRALRSGPRLAPTTRAAHA

SEQ ID NO: 13481 - protein, 163 aa, Chlorella protothecoides
MTSNIGSATILESMERDPADIKDAVTKQVRLHFRPEFINRIDEFIVFQGLQRSQLRSIVEIQARRVAERLAEKKMGLRLEPTAVDYLVERGYDPAFGARPVKRVVQQELETALAKGILRGDFQEEDKIVVKASADGTRIELSVAGKNGATVPGDTVSPVQLVP

SEQ ID NO: 13482 - protein, 532 aa, Chlorella protothecoides
MSPPLPLTPPTPPRNSSIIDRARPAHCLAGLRDSPCPTSPLIEGGGPLSALRASPAASGVTTAPAGLSSLASLSSAPRLAAPFLPSRLASPPRRSMAAHAASGGGGKRISQTDFTEKAWEAIVSAPEVARSYNQQIVEAEHLFKALLEQPSGLARRIVSKAGLQPGRLLESADAFLRRQPRVSGTSEQVLGRSLEGAVGRAQELKSRWGDQYVSVEALLLALAEDSRFCGPALRDAGLTPARLEEVVQEVRGGRTVTDQDPEGKYEALARYGRDLTQAARDGKLDPVIGRDDEIRRAIQILSRRTKNNPVLIGEPGVGKTAVAEGLAQRIVAGDVPASLQGRSLISLDVGALIAGAKFRGEFEERLKAVIKEVQDSQGAVVLFIDEIHTIVGAGKGEGSMDAGNLLKPLLARGELRCIGATTLDEYRENIEKDAALERRFQQVYVDQPSVADTISILRGLRERYELHHAVKISDSALVEAAVLSDRYIADRFLPDKAIDLVDEAAAKLKMEITSKPSALDEVDRKVGGCFGG

SEQ ID NO: 13483 - protein, 96 aa, Chlorella protothecoides
MPGLQHCLPKHPPDLTVFLTHTHRQLTEVVRRRPYAVVLFDEVEKAHADVFNILLQILDDGRVTDSQVGSLAWGVQGGLIGCLVLWQRSRGAREHE

SEQ ID NO: 13484 - protein, 187 aa, Chlorella protothecoides
MARDPGQHFDLANQHEQLRDGLPGYGGGDRGFRGGILPLRGYYEAAVAFGRETGTTTSANVSSAIERTQIRKAIQDGDIQLAMELLNDAHPQVFLMVQCREPATRAHAAQSPWLVPVPNFRIFWKFHGPTGPQILEEQSGLLFHLQQQQVIELIRAGRTEAALDYAQEYLAPRSENNPDLLLELGGC

SEQ ID NO: 13485 - protein, 242 aa, Chlorella protothecoides
MERLSLNKAAPSDKGAAARLASLDAQLGTLKEQQAALSSAWERERDEMTKVQSVKEEIDRINIEIQQAERDYDLNRAAELKYGTLMELQKTLAAAEDALASSDTAHRMVHTEVTESDIADIVGRWTGIPVARLVASDRERLLHLDEALHRRVVGQDEAVSAVADAIQRSRAGLSDPARPIASFMFLGPTGVGKTELAKALAEEMFSTEAALVRLDMSEYMEKHSVSRLIGAPPGYIGYEEGG

SEQ ID NO: 13486 - protein, 132 aa, Chlorella protothecoides
MALLIFDDVSTSPLADLMDVAQRQKTADEVNPCILRTQLEVGSLGRGGGPSGLQSIPAAHSSVRLVQITTATAPLQAHSPTAPLQEAESQLPVLLKLMLWMQDRLKGKVVFPVIEDVLVAEPILAPSNEAAT

SEQ ID NO: 13487 - protein, 435 aa, Chlorella protothecoides
MSVSSWCIPRVVGPDTSRGVADPPIPSPLPLQALLSRDILVTLPEHGLRLAFEPLTQRLRLLEILDSSHLLVTYQKARAFGGMAHPPCLGGMYDTFGPTYPGGGRGGRAVPVTPVLPDVFDGGKHTGDVFDGGEHTGGVMPVGCNSGGWLKCQPSSREVTSLSLRRISPTPSLSSSPPLQTLFSVEWDPASASFPLLYPGLLLLFPVPPCDKATSLAPGNDAPQGFPVPPTTQASRVCLFTGAARDAAAALASPPPPRGHPGAARVLHAVPGRGVYSEAGPGGANNVCVELGDSPQAVVTRLGPPTFTSAAAEQVLGVLGWGCGWEGRWCGGIRQEAKPGEETPVLSHAPSPCHRADAAQSPPCPCSEAWAPATSTCTPTWGWMSCWAHGLTPWRSWCCTPACPAPQASASPPAAPSGGHGALHFGSVRGMLRQE

SEQ ID NO: 13488 - protein, 313 aa, Chlorella protothecoides
MLAETGSGGRLLDACDLEADTIGVASVPSSASSAVLSDYFIFDTEPLLADWGALPPINPGPYRSAPLAASAGQPWAAGPTTGYAGSFGHTPAITESSPFLLDGTALTSTLPPSPGGHALVAIDPHSVPTRASGSHPHPPPHTCVPHCPRSEAPQAWLQPPPSVDGAPSPPPYTGPNMPHTQSLPELHVRALPSRRSEPELRLRGPGSSRRGPPSHPLPRSASASQLLDGCRPAVPHMTYLTPLHLRKGKGGRQPAADPRMDPRIDPKKARRILANRLSAAKSKLKQKGAAGEAGSRLRHSSDDLVGLEVGGCE

SEQ ID NO: 13489 - protein, 246 aa, Chlorella protothecoides
  MOD_RES (107)..(109): Any amino acid
MTAALQRAQVMELTIAGLKRGAGARGEGCATASGEEVPPRPPPSGRETRGGAAGAASRCGAPGLAPAVGFLLPSSAEPLSHSRNTSHPSHPRGSEESDAPTPRSAAXXXRAEPLSHPRNTSHPSHPRGSEGSDAPTPRSAAPSDAGSPFGSDFTLRELLQRTAALEARLLEAGTEKNGLQAELARLPVSSAGRTIRFLMPPALRRPTAESPTPTSRPPLLLPRGRSGGAERKSRRGWMIWSARCRA

SEQ ID NO: 13490 - protein, 250 aa, Chlorella protothecoides
  MOD_RES (48)..(51): Any amino acid
MVDSAAHVACRNSLRWSKAMQRCSGCGRLRIDCPRPHDIPFPTPLSMXXXXPLAPCRYVVKCMKPPMSIFHGLPGTAYQFEQPGTHNELKHIETAKTILRQRFLHLLQPRNVKYELHLYAENVEAPAAKIGTLILEAAQNLDPTLVVTAAHNKVGFEWADGGQRRSRCVSQLAAMVLGHAASCSGCRKLRRDYHRPPGITFPTPLSIIPKLEASDRYMGDVGSVALYLLENCKLPLAIIHPEEDGADEAE

SEQ ID NO: 13491 - protein, 325 aa, Chlorella protothecoides
MRRRGAPWPAAPLRRAGGERGQPRVRHSRGHHAGPAGVAATGAPPSAPGPAARAARLRRPLPPRRRPARRAGPAAPRGRWGPGRPPRRPAVSAGRGGELGAHHDGLLSLLGEVAADPTPPAFLHFDPGAGAGSGVESPAARAGLACAAARTGPLLRGGLALSVWLRREAEGRGDVALMRESEVPPRGRTTPRGGALQGGGDGRPTTTPGLQGTLSEPPPRGRTTPRGGALQGGGEGRSSPTPGHQGTLVWIEEAQGRALAVALDSAAGAVWVHTWSPAHAALAFDMGRGLTSGAWHHLCLSLAPGGPLSHATATLWLDGRLQVQI

SEQ ID NO: 13492 - protein, 78 aa, Chlorella protothecoides
PTSQSAEPHLVTCHPDPVALNPAPFLSPIAVVGYWFAALSPNMDAANALLPLYITIQLLFAGFLLPTGAMPNYWRWAA

SEQ ID NO: 13493 - protein, 71 aa, Chlorella protothecoides
MQYGWGALMKNQFYGDRNVEYVGGTILGFYDLAGINMWGWLGIEVGGSTQAWARGGMHALDHAGASSVPTP

SEQ ID NO: 13494 - protein, 484 aa, Chlorella protothecoides
MGLTPGAGIAQRKSRPHSGNRSGGGGRAGPRTPLFPENSGGGFGLPGSAVSMAWSPYPAAEALADAVAAKLIFETPGARPTSAGHSDVASRSRPPWPTGVRIGEDPPPRWPGSDTGGAQPSKMTQGSTEAATAPAFPDARPASSTVPNPGPAAAPALFTAAPNPGPTAAPAFFTATPNPGPTAAPAFFTAAPNPGPTAAPAFSFTAPSTGPVEQPAFSFTVPAFQADPAPTAAPLPRFTTAAAPSDAPSASPPDAAQPPALGEGGFVFGAAAQDARPARARKPKSPGSGKKPAPIASLGASNGTVTWEKILEAVADFDAASAEKEEAAHSVPTPSPPQSPSPTQPVSSVSAGPLPQPPSFLLRAARHASRSPPEDSAIMEARQAAEVAAERLRRAGNTAFGEHRWEDAREAYTQVPEAADPRLRAAALWLGARERERLFWSPHERTDPHARITAPRNRPSRRCGPLKPSAPNSHRCSPTARPPG

SEQ ID NO: 13495 - protein, 234 aa, Chlorella protothecoides
MGLLTQTGGLASEPLPPPSSHDQATHGWSNPSPSERHLQGERNYEELKGDTGPLVYPAGFVYLFTALQALTGGSIAAAQVGGATGPVYYRTWSGGAIVPAEPRLYVGSGGTLPSACQNYPNPGTTPTPLQNIQAIFAGVYLLTQAAVMALYIRSRALPPWTLCLLCLSRRVHSIFLLRLFNDCWAMLLAYAATLLLQVMLSWEVPYVAVPTSWVACFVMLHILSVHEFCSCLQL

SEQ ID NO: 13496 - protein, 334 aa, Chlorella protothecoides
MRLQLSNKGSNAETYSNFGNVVVAFAFLLIPVIGWLLDKKAQEEGGEGRAGRGHGDQWMERLLERPRASRAIGAHRRLRCSFPASPSLSIIHADLPRVYSLFPPQTRPSTNPVQGYGSTLGSILGLSVLTLVLQALPSLPLQVVTILIWMTARFFMYASYFAIFGALFGFRNFGRLVAVDNIFNGLFGLLQYPLTYLAIHPLNGNFMWVNLGQHLSCPITTALCVAPAASSPRPLGPPHPQPPHPNTPQAACLIPLSWFCVAMYRWEREDLVPIRPLEGEELPCDMLGHQERKKLKDLHLPNLGLGELRMPHVQLPEAIRKLTRSGTREREVDV

SEQ ID NO: 13497 - protein, 210 aa, Chlorella protothecoides
MVGHQVILPEGYRDAKLGMIIAATIGEIVQGSLLNILGLILFGVSQSSGPNAFIPASIFLGLGGITFHLAQMHASALYPRKRGMLTAVFVAGFTGSGIIFYLLLLIFQAAGSTRLVARGGPEGVRGAVLSGTPVLSESMMMQGLPTSTQKHSRNSPHPHSPQFLLQGGVHGRADGVCRALRAVDPAERMDDAKLPLPGGPGLPPHQQVEV

SEQ ID NO: 13498 - protein, 373 aa, Chlorella protothecoides
GRGVVLGREAGGWGPPRRVCVRNVSCAGVWCADALALVPNPSITATGDAGLWRAHLVDLAGGRVHPVVALLVQPPDLPAGEVRGWVQEEAEGEQGAALRMSRLAASLAPPPTSPRRCKDDFEAWILWMTDVIDSEAGSTWYSWNKSNLERIRNEKMSLNNPMATSLRGIAGALPTAVLALAAISTLTNTSINRWVAGCGGDVGKAGERLKLGHKGTCLHLVRLHSRTRPLHLQVGHLWHRVRGLLDVHPRGVGGQARATLQLLLPALEGDAHVLFPGSHSLPGEWERGLVAWPWSDNAHRLQERSMLRCSLSPGAAPRLQQPLPTLLQVCCVIFIPGGFSAGVGVKNLIIIIFANMSAVSVATQVGLEATAPA

SEQ ID NO: 13499 - protein, 334 aa, Chlorella protothecoides
  MOD_RES (54)..(68): Any amino acid
MVAETPSWLGTSWMLPTGLCWPADTEASGPCRLAHAMQSWPSANHHLPPPPSLXXXXXXXXXXXXXXXWPPRTLDWILGYIFFSFLFLLSFIQVVDMLQGAMLYNMKFAKALQRSRLMESNFLPSYVDRAMERLSRTLQEEIVASCAVSLRPVTEPFCFEEILMPMAVPLGHQSSSVTCSTCAKHDSTWLQFVLVQTLTFKPHYAHLIFTKAHNLTARAVSEVVVGGPDARPGALMDAFDESLLTDSDGEDDKNVGWMGRMHGNSKRSPPACPAIYPHASCMPGHDARPMISPQALAPASKEQLVFLIQGHESLLELANLEDEVKERHSRFPWL

SEQ ID NO: 13500 - protein, 585 aa, Chlorella protothecoides
  MOD_RES (3)..(6): Any amino acid
  MOD_RES (124)..(127): Any amino acid
  MOD_RES (201)..(203): Any amino acid
MQXXXXSERPPPPPFPPARQTADGGTGGGGAGHVCAGRGAPDEGAAHPGPGGWPAPAGRGRRVHAGHEMPARAPARHRPAVWRGVWAWWGRITRFYSFDVKEPACVGRGGWVGHVGHMGLYRSXXXXGACLCWSWRVFGSRGSHGVVLVAWRPCHPGARPRSQILSICRGPLPSLHRISPALTPLPPPPTPLLPPFALSPXXXGPLPSLHRISSALTPLPPPHRPFAPFRPFPKGGPVRQGEQPVPDRAADGRATGGGRGRHPHPHCRRADQPAVRGHDPAPDGALWRDRAPPGGPAAPPHPRRPALRLPRHRVCGGRRLLRPPAPGVRFLPLWPPPITQSHPLPPHQPQLLPPQTHTPASYFLAGAAITGGRLTVHGCGSDSLQGDVRFAEVLGAMGASVEWAPHTITITGPPPGGLRGVDAGCVDIPDAAMTLAVAALFAHGATTIRDVGSWRVKETERMKAICAELGKLGASVEEGETSCVITPPVGGVQAAEIETYDDHRMAMAFSLAACGGEGGRLRRGIPRRDCIQEVPAPGPGANSHALGEPAMAHACPYQFEANPSPSWTLGAPGRPFPPTLMSWRV

SEQ ID NO: 13501 - protein, 309 aa, Chlorella protothecoides
MEDVRGESYLGIKIFRFYYRCTACSAEFCMKTDPKNTDYTVEGGATRNYEPWRDKEKAKLQTAAEREEEERGNAMKVLENRTLDSKREMDLTAALDEMQSLKARHARVDTEAALAALSRAREGDGEEPPDLDEEDEAAVRAMLLHRAGFVRRLSDSEEEGSPVGPGPEGGGGGGGAARPHAPRLSVAAAAWDEEEDGKEPAPGGKGDEIDAPSGSKSGSEPAGERANGAGEPAGLDDYQAPAAAPAAAKPKAPPVNKPATVMRRFAVKPAAIVVKRKAPEPDGEPAVPEDVGLQSLLGGYDSSDHYESQ

SEQ ID NO: 13502 - protein, 237 aa, Chlorella protothecoides
MSPQEESWDTVGIFVFPGFEPLDAYGPMELFGSMIREGLRKVKRIVFVAETAGPVPSCFGPSTVAEYGLDDCPPLDVLVISGGIGTRILMHNTRVVDWLRSQILDHDVRHVLSVCTGGWGVGTLKAVDWQGAALLAATGLLDGKPATTNKELFTYIRQLFPAVQWQGTARWISQGKVVTASGVTAGMDAALSIIEGTFGVEVAERVARDVEYIGDWRQASNDPFAHHSSSDDGEGAG

SEQ ID NO: 13503 - protein, 424 aa, Chlorella protothecoides
  MOD_RES (86)..(88): Any amino acid
  MOD_RES (285)..(288): Any amino acid
MNWIWARGGNMIRPPEPAVMVNSWAREAWEGGNSSVEWVQPTTQRRKVQIKCPACCGSHHGHLKPCTYMSPPPRRPWLHLVTFAGXXXKNRVEKVGLMHWIWARGGKMIRSPERAVMVNSWGKGSMGGGELIRGMGSAHHPEEEGPDQVPCMPRVAPWPSQSLHVYELAPKMPLASFGHLCRPTGASLGLGGAQVAAAGPVRPAVRPGRPPDLQGPGPEEGDDGGEPSHGMPQELYSQYGLDAMTVDFMGHALALHSDDSYMRRVRGLGEKRGGAMPPSGSGPGXXXXHAPGERPRGKEGGAMPPFGSGPGAAGLLSRDVPDSHHPALETVLKIKLYYDSMMRYEGLKSPYIYPLYGLGELPQAFARLSAVYGGTYMLAKADAEVVYDADSGRAVGVKSEGQTATAKFVVGDASYFPSKVGFWE

SEQ ID NO: 13504 - protein, 316 aa, Chlorella protothecoides
  MOD_RES (28)..(31): Any amino acid
  MOD_RES (312)..(315): Any amino acid
MVQARNYMLPSAEPPTRHSPDARGALAXXXXETTCYRAQSLPHATRPMPEEPWRWPGSWKGGCAATSQAKGQVTLSGRSGVMKMRRAVADRVHANHMHLFPLQVPGLPRIHIPATMAKAVDKRQAYSIIGLAALQVTADAVGGSSGVPYVNSCSAKGTGVGRPLLCWRKGACSRYSSVRAPVSTCTFGRPRICRYSTSFPALPTLLHHKQVIFQVVIGAVTGTKLDQGDLCQLNLDPQSGRVCDFVYNTVGFGLLFSLILIGTVVSGGCFRDWGLCRGSVLLAAQLPGELGLAKRPNGPCGEVICGLLPHNXXXXS

SEQ ID NO: 13505 - protein, 234 aa, Chlorella protothecoides
YAADGYARATGVGAVVVTYTVGGLSVINAVAGAYAENLPVICITGAPNSNDIYSNHLVHHTIARKGSMEQELHCMRQVTCDQVIISQLSDAHEQIDHAISAALHNSKPVYIAVCANLAALHHPSFDASPVPYSITPKRSNPASLEQAVRCAAAFLAGKQKPVAVGGGLLRLAGAEEEFVRLVEAAQYPFAVMAAGKGLVPEDHPQWMGTYWGQGLQLSVHAVGRSLRVHSHARA

SEQ ID NO: 13506 - protein, 72 aa, Chlorella protothecoides
MIKVEPYRVVIAGGKGGQVFGCVRMDDFLCGLAEAITPNDTAHQIFKRLWVPTPVVEPSEEGSPLRTKVICA

SEQ ID NO: 13507 - protein, 184 aa, Chlorella protothecoides
MELSPHLAPHLPALFKEIRRRGLELHARPYATLALSDMGAALGLIPADLEAELEALIVGGRLSARIDGAAGVLRAHRPDARAGALGAVLAAGEEFVAASRLLALRASVLQHGLVQVLLVAVYVEEWGEGMGTEGGHGLVLCAGSWTLGMYAWRRTWAASTLGFNVVCAALLARHSCGAGAGTEG

SEQ ID NO: 13508 - protein, 519 aa, Chlorella protothecoides
MQHKQRCPICKACVGRREVAQDAAMDAVLNAFARLKADKGEIHGLYSRERVSGLFRCERTASRSHVKVNRIHPPPLRRECDGARATGRPRDCAPDAEPAARHLPGAPSRSRRGVQRAGHRAPGVRGPGRVHGLLESVALAGCAVDQVPPCSPPNAHTLAADPLSGSIYLPSSSVKKRRVPSSQLAPAPEHEAPGSAAEDFVVPSAGTAVRGPHDAAPAEGPSRLRRRQREPGSTATQEACTAQTSVTLSRRAGTGDEAACSSSELPGAAAAPVASPPRVRDAAAPLSGKAAGAEGPARPPRKRSRQRGPTRREARCRERAPPRVRTSEGSGRGNAVGRQPGRGAAPSQGRRTPLDMLTPAAAAATAEEEERLRRIPTRLLPWSCSACTLENKFEAKVCEVCLTPKPGGGARAQAPRPGCTAPSPDTQSGTRAPSRATGKEARGRAGRKPGAEEESRSADPRGELEVGGGAIKALGSGLSNVPSPGTLCQLARCGVEVVDTWQPGVTHVVCGVDAQGAAT

SEQ ID NO: 13509 - protein, 579 aa, Chlorella protothecoides
MMRYGQNPIIILVNNGGYTIEVRVEVGVACVARQAGQPCTCWPRPAAAKVTLLPHCRAQVEIHDGPADNNYNIIKNWDYVALFKAMQNKEGQLFATRAKTEKDLEDAIEFAKNEAADSLCLIECIGDGGYDARAEALGAETCRGWYRGAAEGLNWTWQEGERAQGESPLQPSSWEALKTSHRGPSRPSAAALPRSRQGGGPRLQPGPGPTQRSVPRRQGQPRQVQLLPVLTQSELGDLVQREVARDVQAHAAPAARGQVQRHRRVGGGVHQPQSQAQAVQEDGQPGNRGPQRGPGRRLAGRLRPALAQEQALAVGRNAGARGHACAQLGQAVIGGGDEGHPPVDADVLLGPGQKATAPHLACQALRQHQPVEIVQHGPGQPPAVRETVGSGAQQLLDPGRPSLLCINCEKARNDEPVQWSIPCSQRQLMERGDHHSPPQIKAPHHTFHDQAEAVRGAAGDLGRSSQEGLQRDAWGHLQPAVPAAPPSHSHMDGRGGRGLRRGPFPAKPGGEELGSALHDGSVGCRAPDPLRRRGWGGGGLLLQLPREAGSGERHRPGGKAVHARGPRQAPIPLPHGSQW

SEQ ID NO: 13510 - protein, 225 aa, Chlorella protothecoides
MAKSQLAAAGGLYSLSQAKFEEAARSYVEVWGVDGGLPPGGSGKSCEGSDAESARHIQDGEFSEPSTLAIDIVTQVSPDLGSEFSDVISAQGMRLEAALPAALCSCLATSQMLCKLPCTVDTVCNPPPLGPPPPGRIPLSSTQDIATHGAMCALASLDRPALQSLVIDSPGFREHLESVPEVGAVRGWARFPCGPGNLVGGGRVARRIAETQLISSSTPPRFATP

SEQ ID NO: 13511 - protein, 219 aa, Chlorella protothecoides
  MOD_RES (61)..(64): Any amino acid
MASLTSNKHPSHSAPCAGSLSHAAPAQPPSHTHTHTRGVFSTALASITPHYSQLPTLPIPXXXXGVFSTALASITPHHSQLPTLPIPDEIDAIGKARDASSDSGTQEREQGLLQLLAEMDGAVQADQVLVIGATNRIDQLDLALMRPGRFDRKVFMGLPSRPNRLKILKVNAVGAGIVSHVHVWGGGGECAAWKESLGLGIVGTRCTGEHASPGRWRRG

SEQ ID NO: 13512 - protein, 249 aa, Chlorella protothecoides
MSQRGLARESQQRLADYMSILRGSQTADLSAKNLGDEGFAYIIDALAFNEVCLAADFSKNGIGAVGASQLATVLPSNGTLRTLLLDTNAVGDEGAAELAKCLVGALGSVMRGVLCPVGGNASLKSINLSGNNIGNVGAAALAEALRSNTTLRTLELGSNVIDPAGVKLLAEALEVNTGLRALTLSDNYLGAEGVETLAAALRSNTAVQELHLKGNEVGDAGVKALCAALEGRKESGGVWAGLEGRACLP

SEQ ID NO: 13513 - protein, 198 aa, Chlorella protothecoides
MGYNPIGAEGARAFADILKFDMQVGWAVRVWRGTSRWAGGVVCRSVGGLGPGVPTGTGVLVIPPRPHHSMQVESLKLGWCKLGPGEGAQAVANLLQFNTTIRTLDLRGNNLGNDGAILVSRALKEHTNEKLRELDLGYNEIKDEGACALAQALKANAEGAPRELKVNANYVTSFGQVALTEALDMVYDMAKRQITITF

SEQ ID NO: 13514 - protein, 285 aa, Chlorella protothecoides
MPHPRPAQLPCFPPPARPFPNPTSTPPCRVAEEEIFGPDGASLSTGRELGLASELARWLVVDSTLHPDYRNTVLRSNMTLGGYPDPTTEVREGRGDERGLCSPWEGRGMWMDELHDDAILALQEAAHERAVLLVRQRRPVIEAVARELCDAADETVPAARILDLLTATPLAVPQRVTARQEEHRAVAARVLGERQLADDVVRGLAEVVMGRAEGWDFLQPRVVWEKAAAACEALADAETRARLAAMREFVVSGGAAPLPPPPSSPLLVPAGHGVGPQVPEDIFVR

SEQ ID NO: 13515 - protein, 315 aa, Chlorella protothecoides
  MOD_RES (72)..(75): Any amino acid
  MOD_RES (233)..(236): Any amino acid
MRPSAPSGVRGAKRWRPCAALPEPTKGPRLAADHEGPSNQPSVILSRLKTWPTSALHSLIVAWTQPPCHSWXXXXGARVESGGGLLAWMQSLSLCLSGRRVLSIPSSWCGPNHHVTAGTTILDGVQRKGPGTMEASKSTGLDPWHDGHQVLDGFRVGLLSRYEVLLRSHKGVTGDDLHGLSESAVYSAWEHEVSAAAGPCPDIAGLDASKPLDMFGKREIPQHQPLSPHAGIXXXXWQEGTLTASATVTPRRDYYQSLLAVEWREWMTRRFTSDYLSGTSYYNLASSGTVDNPDQRISSDVRWPSHLPATSAQHP

SEQ ID NO: 13516 - protein, 461 aa, Chlorella protothecoides
  MOD_RES (360)..(362): Any amino acid
MERARALGHEGSRGRAPPAGSFCMDQPSARSAVPEALKAFPANGMQILDPAAAGSGVMVVVSAWSFVPPTLHTVAGRTYKRFPSFRSAPFHSFLPAFNHILGDVSLVVYQFESLAGFSAIIDRLGQFREILEDDGGTAASLSSGKEAPALDKGNDSPGTAKLTNGVATISVVETDVGNTGETRHVEAVTFLSAPGCRAYFPESAAYTGILPRICCLFWGDTLLTVQDLTLIVPGGTSSNPLLISALDLTVRRRSSVLIMGPSGAGKTSLLRAVAGLWRSGSGTICCPARGSGLFFVPQRPYMVLGTLREQLLYPTWTTVVSGPGVSGAAEFTVVGTGRHNGKPQLPLPDDGHLVAALQRXXXWGQRRRRVYCGGYGAPKWEAAAPAAQRRPPGRRAAARPAAGPAGKGGGRPGLPGRLGRHALTGRAAAPGFRQAAPRQVRGCGDDSAQRPLTPAWCLVVR

SEQ ID NO: 13517 - protein, 356 aa, Chlorella protothecoides
MSLIRAAVVHPSAPRGLASMQSLPLFRFGVVADVQHADIPDGSSFHGVPRYYRGALQLLQRAVDDFKEAHVNFAMHLGDVGHPGGVPLSMTHPPCTLSLTDCGLSQLSDPRGGERGAVQTRLCAAGRPGHLYSAGGAGLPHARQSLPVLPQPPGAQPASGPLTHPSTTQPGISELQGGQQHSYYAVQPLAGWRVLVLDGYDVSLLGWEPGHPLHELAEETLQARNPNKVRPVWLGVRRTSRQPSPDLGLAAAGLHGGAGSVWGGPRCHNSSRYMEWREASLKGVSTFRAHSNQPPPFPQSSPGEEQPRRSGGHGAALREVWRRVVGRPAGVDAQPAGRSARSGRPCRGGLPPAHAP

SEQ ID NO: 13518 - protein, 261 aa, Chlorella protothecoides
  MOD_RES (8)..(11): Any amino acid
MDLCIPVXXXXGSRSSLVLSQVARQGPPLHWLGRGGKQGPPTDLRRPKPGPHAMVHTREADPSDPALHRLHPASHFPLDLLRSPLLQLIHTPPQSTPQTLPSESLWDSADGAAAFGVSAGASTGEVSAIILLKLVMDNYLKAGGRGAYAPTLLLLQRALSSGRPAAQARVFDLLYNLSLHGELLYLSPAAEVPETAAAIRQSGADRAGLAGWRGGGGGFPSTPADWDWCLFCRRRWLADLPFQQRRPAPLQHSPSCGLCAA

SEQ ID NO: 13519 - protein, 65 aa, Chlorella protothecoides
MPSLHDTRPPQNLLSPARIPGITYVSVGHRPTLVRYHEEVLQLHGGGAWTLHAASEAKLDLLGAF

SEQ ID NO: 13520 - protein, 87 aa, Chlorella protothecoides
MRAMHQVAGVSSLPLRPPHHEALCMPPSSPPTLPPAWAFNLPGRGDEALVWDTLVDCLRDQSELGAHIGRGWLLKLLLASAEQELQR

SEQ ID NO: 13521 - protein, 125 aa, Chlorella protothecoides
MKSSPTPSSKNQKHLLQAVNAPAVLLSTLCLAVEWLLQAPQEARQGAMLQATQLLLSFIVVTPGAGEEARGDASPSSRPRRRSTAGWALGPLGEEAAGEGSVGEAGAGEDGHGDGGAGEGGDHTG

SEQ ID NO: 13522 - protein, 184 aa, Chlorella protothecoides
MHRMHTSTQLLRCYREAPTSRARSNVFCVMYDYITSSQVGQVLGCVGYQHGLNLFGFIWGPEGSSMCTSRPSLHRAASLTTPLSITSTHLHPFLHHHPHLYPQGPNEYDSWSPALAQGAHSSEVVALGAALLHLRAADALHPMFLAGTPGYVPGVADELTTQMAAVQVMLVMLVALMVGCWVGV

SEQ ID NO: 13523 - protein, 191 aa, Chlorella protothecoides
MGTVGPPQPAISFRLEGVPEMKYSPSADPPRGEVCIRGASLFKGYYKDQEKTDEVLTRDGWFYTGDIGELSPTGGLKVIDRKKNIFKLSQGEYVAVEKVENAYKLCPSVEQIWVYGNSLESVLVAVAVPTQGRLDAHGGAGDVAAKCADPELKKAILKELAAAAKEGGLKVGMWSRGGGGGGGGGWAVGGL

SEQ ID NO: 13524 - protein, 385 aa, Chlorella protothecoides
  MOD_RES (225)..(228): Any amino acid
MSRKNDVLPFEAGGDVWLESHGSRANCSLFAVGTHSKKRPNNLVLGRLYDFRMYDMIEFGVKGFAPIQAFSGARSSQLGNKQGHPKMEGEVDGYMCVPTSALSSQPAFVFAGDGFESDAVLRRVKSMFLDFFRGRQVDALNLKGLDRVVFVTCLPGSKTIVFRQYSVKLKRSGEVVANVHVMAGSCTRMGQDSLFIVWAWAERLLQAHSGNRLTPTHTTRDQGAXXXXDTCLTYTPHWGRIVSLQLTQTGTKVPRVELEIMGPSLDLEVRRTREPAADLEKEAMKQPKLTRTKEKNVATDALEGRVGRIYMPPQNIDTIALHKSKVGEASLRCWPAHNAHSSLCPRRIASSCLLYNHDNTQGLKKRKDAPEGAGGAEANGQKKRA

SEQ ID NO: 13525 - protein, 123 aa, Chlorella protothecoides
MGNSNHDVARALLDCAVQLLAAGRVLQVLEWAAEYRARADPSLLRHLAYGVLEAALPPYSPAFASALLRLMMHAGVKQPRAPGRDAGLRALLDEFAAGCSALEFRPPLSSRESAFLLGLCDPR

SEQ ID NO: 13526 - protein, 593 aa, Chlorella protothecoides
MAVPKLDPSIGGAVAISEYSSWAGVPDDARHGLGPLWGLLSGSPLLPTPRHRRVRVAKDGPPTVKDINTLSDLFSHSVSRFGDKNCLGKRTKEGYSWRTYSQTAREVAAVGSALVSAGLAPGGRVGVYGPNAPEWMITMQACNRQGFYCVPLYDTLGESAVEYIVKHAEVTAVAVLGSKLGALAASLPALRDRVRTVVYWDEADAATLRRVADLGIAVHAFHEFVALGEASPAAAATVQADDLCTIMYTSGTTGDPKGVMLSHRAVVSTVLSLDAFLTDAGVRMGTEDSLLSFLPLAHIFDRAAEELILYVGGSIGYWAGNVKELLPDVKALRPTLFCSVPRVFDRIYSTVTGQGPDGAALILTATLESQPCSAHPPAPSLSHITPQIASGGAVKKFLFHTAFNTKLARLKRGVAQDKVRCQTLRGAGACGAVYWLIAAVYGLIACLARTPHQFSAFPWLPGAPCPTRTPPHSSTCLQAAPIWDKIVFKKIKAALGGRCRVLVSGGAPLSLHAEEFLRVCMGALVVQGYGLTETCAASFIAYPSEPVRGRRGGGGGGGDREGHPQNAAQGWPEERRGVVRPCWCPAPGSTWAR

SEQ ID NO: 13527 - protein, 91 aa, Chlorella protothecoides
MAVLVCQWLAAVQHGAAENDPGTPRAASQPPLDEASCLRVGGLDVSARPCSWVLELVKERFDPKSFHGIFSRGGAGAPPWLHSLIADAGEQ

SEQ ID NO: 13528 - protein, 433 aa, Chlorella protothecoides
MSKPFLISTITEDARRPRSGLPWRVPHHACAPDAQLGYAVAGSPSSRPPPPAPTDGRQLIYDLSGRYANSLLLNFAIQKILQQPGREAEVAAVGPRLGSYFGVFHRLMVTRLSAALASTSERELDKLSAEIQARGGGGPGGSVPACLRRFREEGCRDVGSRPTFAGPGYAERQNASQSQHTYIHVQSVLQSLGAHPQGARFRRLAADLAGHAAQTQGAVVWRLSPLFWGEPGSGAVGPLLADLMASVEGGPLPSLEVIRLCALYGAEPAEARPSLDLLRHPRVFRVLLAALFGPGQGLAGQALAAAVELLARAAAGGPEREAAVEATRAALMGAVTLTRKALHDAKLSAEELEGTGEVLTEWQNYQKKGCRPPPFPAVGPDLIRPRHRRRAAVRHGTALGQAGLLEHDLPRSAPASLPRPPPQGHTAAAPAPR

SEQ ID NO: 13529 - protein, 184 aa, Chlorella protothecoides
  MOD_RES (64)..(67): Any amino acid
  MOD_RES (168)..(171): Any amino acid
MEAGAAGFVRRYCPGALVYWLARQGATRSRDLGTDSHADRSCPTVARVSKVDLAIHEKPHLRSXXXXEPDRCGGRRQAWAGTAIMPPPQRFKGSGGLLDNAALQQVCPIPFDEGRLWRGEEGPVLKEQLRVSGDVGWGWGVGLMLAAEHRRVYLGGGSRSACGRRTGXXXXVQQPVRSDVEGAQ

SEQ ID NO: 13530 - protein, 505 aa, Chlorella protothecoides
  MOD_RES (256)..(259): Any amino acid
  MOD_RES (454)..(457): Any amino acid
MLDNVLYARARGVTPSLPVLLYQDLAGLNEPNSCHMSGTVVDCCEYSWVAGSGVSGGRHWGCSNDKGGSGVSGGCHRGCSNDKGGCSYSAVEQVNRDEIGPILDKLVQSAFFRYFKVDLYCDCPFWPDDGMCAMRDCSVCECEEDEVPKIWRAAEGRLASADSPAAACAGACVGGWEFRGDEDAWHGVRWSLHLGARKPGLFPPGQWFLAARKPGSFTPGQWYLADLTAGWGLSGRPPTDRSAAPALPPFNPHSIXXXXTNRSLRCPSTPPLNPHSINHPTSSGGAGVSAGPHAAARHPTRAAGSTRLARVSQPLDAGGGRRRRGVRLHQPPAQPRALHGVRGGARRTRVAGHLRPAGAGGRGLCRAGAPGLLPPHLRPACLHLRSSSCGIAAARRHARGLRLGPGPGRVQAPPGLPGAAGPRGEPLLRLPLRAACGAEGSAPSARRGILHGPXXXXLYFAYLFVLRAVQKAAPLLRGVEYSTGLPEEDAATQHFMHKWASWLGF

SEQ ID NO: 13531 - protein, 219 aa, Chlorella protothecoides
MTQTPHLSNRAGEAIKHEADAALRGLDVLLDQADHDVVADQGPRLHGLLRFQAQGGLGGNGGAQHVTGGQVAQAVLVLDGGGLGALAAAGRPWVCVWEGGENGNLVHRGPPLARQPDGMSGPRDPTMHPPTYEDEALLGLVQALYPTLHLMDELLGGHLGEVDGGCHGVPVVPEQGLMRGRTMSGTIGFGTCVCWHIHARSSVGSKHGYYRFMTQRRWA

SEQ ID NO: 13532 - protein, 377 aa, Chlorella protothecoides
ARRRGAAPGPRPPAGRRPGAQPSPAARLGRRGPFPAAAHRRLCRQVGGRPRLDRLRLCPARGVPPGGAHRDHVGWLHPHHAPHPTHSLAYPQNTPPHPHHHRPPPLLPSPSGGKEVTLFQHGVLDTSLGWVANGSVGSQAFAAYDAGFDVWLGNSRSNAPRMHADRACQGLRYWHYSANEQAMGDVGAQVEHIHAVKMAELGGSNGGGNERERGGAAGEGTATSHAAGRFREDAPATRSSSRRRRTSGSNGAAPRRAPPADELQGDDEGERREATASAAGAGRRHPASDHPLQGPEFQDPRGAPRPRPRAPALQSSGRGALPGRGLPAHVRHGVPHAGPATSPAAPGAHEPRRLPLPRAQGERGPGGGGMIEEGRDS

SEQ ID NO: 13533 - protein, 160 aa, Chlorella protothecoides
MWELIAAAAAGLNAGSGLYIAAAEHPAGLEAGVATYWSFFPKVSTKAVTLSTTLSVLTAAGAAAAYFTGDPDRDPAWLTCAAGALTVPVFDFLFVAPTKAVIDSRVMIDQPVAERESWLRSWGRKQIVDVALKVATFGALLLVLGAKGEDGALARLTRPR

SEQ ID NO: 13534 - protein, 163 aa, Chlorella protothecoides
MPHYNQYSMPALSLHTGAHLVQLINERRFRLYDRGSRRANRAAYGVARPPDLAAQYHLLAGLPVDMVAGRQDGIVAAADVHTHYTMLRDAGVRVRLRKYGRGRRGIEADTQPLGGEVGGRWPRATFKEFDVGHLDVVFAMKDEVQHYVLHRLLLPPAPLGPLA

SEQ ID NO: 13535 - protein, 128 aa, Chlorella protothecoides
MDCVGCEKCKMWGKLQFLGVATSLKILFSAEDCSGAPVPEQGACCGRVGATQGQLRIWPVPCLYNPRLERNEVIALVNLLERLSNSVETVRTLSVQLAGGSVAHPQGLGAIQDVVQHGLAPQLRTGGG

SEQ ID NO: 13536 - protein, 221 aa, Chlorella protothecoides
MNGLYEGAWIGADASACAVVGAVIGGDPPFPATQDYVTFLDSFPAPSAVSAGRPPPRDPGRDGGRREGVDFALDRAVEALAREVTAEPGVLAFLAALRALGGTGLLGALRTSTRIRLQAELYALTQPGGPRYASRAVNRAAFRALDALFPRGRRARRLVNAAFRVLHPGEWPWLWWDALWDGARAVRAWARLAGRAARGLWARLAARLRWRPGTGRGILCG

SEQ ID NO: 13537 - protein, 237 aa, Chlorella protothecoides
MANWEETLKACLREVLAYATRLLNGASNAVVALLFGRSASSRMRATRARPSPWVDWWASRGRGRTGTFNAILARDGLVPGGERAGADGSIAPGLHPPGRAQRQGCDDGLTRLPPKSGAGTPWRWRWGWWRGRRGRGASASQSGPRAVRTRVQGGERAPRPAHSSGSELFRRPGGSGQSQGAPRRGFMEEGRLNAELALTNTFAWLRTATRQALMLPDPSVTGSGDPGWGPSFNVRGV

SEQ ID NO: 13538 - protein, 283 aa, Chlorella protothecoides
MAPSVDLAEVTTEQLIHEVQRRIECLNKPEKRLILIGGWMHGGIAGARHPIRLPGQGGPPVHQISILTPLPYTYPGPPGCGKGTQSPAIKNENCLCHLATGDMLRAAVAAKTPLGLEAKKAMESGALVSDDIVVGLIEENIKSPECRVGFVLDGFPRTVTQAEKLDSMLSSKGAAIDRVLNFNVPDSLLVERVTGRLVHPASGRSYHTKFAPPRKEGVDDVTGEPLIRRKDDNAETLKARLEAFRKQTAPVIEHYRSRVVNIKGDQSADAVAAEVRAALNAST

SEQ ID NO: 13539 - protein, 259 aa, Chlorella protothecoides
MTETSGSQPPGWDMRRTVSSRAVQGRLAAEVLRKLSLAASADRKEDRDIICSEVFADITGDLNSAAQGALGGWTWLAGRGGLRPLFTQGCLTPSTPFPPSPSSPSRSQKPAGSTGTLYTRWYEVLAPYFCADEGASEALLSACRRLWGQPFTTPTFALLLHQWLLVHPGAGGADQRLKYLNVLVSGARQLFVGDAETGSAAFAPMFSFLAERVVLSPGGARLAALPETGREAVMALAASFAPYYLGPSGVSAWGGRGGF

SEQ ID NO: 13540 - protein, 162 aa, Chlorella protothecoides
MQAFSPAYLLVKRPEKGLLAGLWQFPLAELEGGGEESAANQQRAVDSLLAGLLPGLFDESKESTAPKVVSRRALGEVVHIFSHIRMTIRAEHVLVAASAAQLEDWKRGSGRSSECPECQWLEQEALDAKGLSSSVQKVLKLYKSAAKEKRQSITRFFAAKTE

SEQ ID NO: 13541 - protein, 96 aa, Chlorella protothecoides
MELGATVCVPGTAPRCDACPLAGRCAALRRQREHWGEAGPTPGGPGPRVTDYPTKVRRRMWVIDPGFAWGGGLHASCRTEISSPQKRHGVQRAPQR

SEQ ID NO: 13542 - protein, 90 aa, Chlorella protothecoides
MPRSSSFSHNLRGLSRKPSFNSAEDLQHWTVADAILRAGYPLESHIVTTEDGYILTMQRIPRKGEGPVAGVGSGPVVCLLCAGGLVTAST

SEQ ID NO: 13543 - protein, 811 aa, Chlorella protothecoides
  MOD_RES (28)..(31): Any amino acid
  MOD_RES (257)..(260): Any amino acid
  MOD_RES (288)..(290): Any amino acid
  MOD_RES (440)..(448): Any amino acid
MYEQSLAYLTSSYYQQDHLVNGIVPATXXXXRAITGIPYQLILSIGPLGQWHSPCHTGGMASRELFADWTLRQLQARGLRLCCPDSTLRSNALQCYPCSTTKGHSSHSSPLDAQEYIDESGGNSASARSRENLITEAARISQLAQEHTATRPCQNTKLFHLSICIAGSREVSPSACSPAWPGPDRVLPRHRQRIRAATLPTGTAAAPPPRSRPGAVWRATHPSRRWPGSSPCAHAPGWWGQEEGVHCGHQLPGSARXXXXGVGKGEGEEHCLNQEKAWVQTIPVAQAXXXRWAREEGVYRGHQLPGSARGAAGLHQRRTVHGVHAAHALWLLPRKHSADDGGHQGPKPPCPMPQMRELSPLTDLHNTQTHAVQHILRHPVAHFRDEAGAVGSRRIRLHVLDDAAPSLANAWRGDSLVFHYSGGYVSSGERGHGQRHTHVXXXXXXXXXSQQPDYSGEEPDGKNETLCPLDFQQAGEIVDNDLNRYLINPIPQVRLTGSRAGAWSAEASMRVGAWCAEASMRFQQQGRQGWASCPVSSTHQHSAALHLPTPQLARPLPFCPGREAACHRGCVPLGVCDGPALLCHELQRRAPMEERVPVATSRPQGAIGFQLDTCWQGGFAVQIGASTDSQTAADTTQLSGDGVSAVAIGKQRVLYIHMDDMLASANWRELRDLFAFVVLDLASQSISVRPLFGHVLRVYVHRSSHVCLHPGNRAARNDHDVSRAWGCFGRVLVAVIGFSTSPGISAGCPRQSAFLGSGRMQAVGPEADHTALVLPVFLQGMASCWWPWTGRCTTRWEAPRAAVAAASADPC

SEQ ID NO: 13544 - protein, 288 aa, Chlorella protothecoides
MAPFLAIEGATLAHYGPRGWASLWNLLDLTTYGLQAYITFLHLGRVTLKAGWLSVAAALQCILLLFRLQYFSRVFKSTRFSFVDDLKEVMHDVKYYLVFLLLVVAGWGLALHILFREDQEEHKEFSTYPLTLLTMVTWLDGDVELDGLHKSHNPVTASLLGVGFVFVMGVVLMNLLIGILTASLERVTDNEGLRMLLSKAQVIDEIDSTLPRCWGGGAVLRLDHVEVASVWGKEEENEAGTENMEAGEDGEEGKDKGPQGLEQKVDDLKKEIQELKDLIMSMQHTSTA

SEQ ID NO: 13545 - protein, 194 aa, Chlorella protothecoides
MDEENHPLLVHAGEDELWDAVEEGVPGADRTFTVKRLLEEHPTEVLRTLQKRSVRRVAEFLVEVGSGTPDPRAWPAQRTGIRTAPASMDQCQNADHLVLGRLGDDSILTMGSDSPTLDNPEETWLRFLGASASKKKQKKGQHGWSSTIPVLAYSIRVENAAAPDQDGLLQPLLKRWQGAGCGMDVFALPAVQAS

SEQ ID NO: 13546 - protein, 146 aa, Chlorella protothecoides
MEHAGAKQLVVQAQLIDEVEATASALNIATSFLRLNRPDGHPDYVHVLRIHPDKLDPVEEDQLHRRLGKRSAKRLRSRYRGGPREGSDSEDSSSSGEGGEASAEPRKPRGTPARQEDVAKLLRQQAEILELLRAKHGIPPSNGQSA

SEQ ID NO: 13547 - protein, 224 aa, Chlorella protothecoides
MCNSWAASSSPCHTFDSSSSSTPQHTHPSQKLVKDVCGPRVKATPSLIAALKQLAEEFVAGGIAFGLSLACQRQSESLEAADLQLYYQRCWCVPGMACAWFLGEGMDIHVPGYGGTEVRPYRRPVGSDLHRSRAAAVRASLAASGEGAGAGADPAAGASPAPVAPRANGEATPAAVTAPSGSEAKPGAAEAGQAAQGAGSEGVAQGSPAPPSATEGLPNGDGSA

SEQ ID NO: 13548 - protein, 369 aa, Chlorella protothecoides
MHAPDHAPTWSGICEAPPAPGPLSPAPHEQESWASDPVFQEVLAFWWVYRAAGWPAESMAAWAAQHYDPPHAELDYEAMLLDPGMQALAAEYVAAHPNRTSPQGSPRRGEEGGGLWRAGMPGSPAAGLHGAADLDGGAADLPEDGAGPPTAFAAAAYSIEEEAHGAGVYTQQATLCSMDAGAYAGDAEAYADGTAGAYADGTAGAYAADAEAYSVDAEAYAGGSAGEQDASAEAGSGEQSAAARLPGSWSVPDRVGSIWQHAEAGDGWAAPTQVALGVDGYDPEGADVPGEDGAAASVQYQPQAARELQYPGADEMAAWQELPGAAPALRDARRRARDRRPVAGVGAAALCRLRRGRRAGSGGWPCRVG

SEQ ID NO: 13549 - protein, 201 aa, Chlorella protothecoides
MSPGRLASELGVPRSALTSAAAVVAASDADTLSTREAASDGEGEGGGEWNRDSRSSGKEEAGMLFQQRGHWPWAHGVVAGAGAVPVFPASGFLSKHSALLPGFLRGICSRKPSKPTVCHADEAEGQDVGPPVAEDEAVHENGRAADWGAPADGPGLPSGAGVAVDALPSQDPSPRFAALAEDLDAGADGEWGDAVRGCSVP

SEQ ID NO: 13550 - protein, 294 aa, Chlorella protothecoides
MHIWRNGRDRGVSRSRMRLDEAPSQSSCLISTRPWGRSPLASLGISTSGADLPEQALQFSVRCTTACLRCPTQHRRSPCVQELYALRERWRQPRPDGFLLGSRPGYREQYVRTGTRWSSPRCLPLIRKLGHGRRSIALNCRRSLSCCLLSSLSFPSPSPAPSQLSGWTVTEDGHGYLRLRQQYRMKSFLKALELCDRIAEVAEAEGHHPDVHVTGWNRLAVELWTHSRHGLTEVRKGRGCQELACHLLTPQAFTMKHLYILMALLQNDYIMAAKIDAIPKDDLLGGKKKKFGDI

SEQ ID NO: 13551 - protein, 352 aa, Chlorella protothecoides
MKLDLRARLPRREKSSFQVLMEMQKPLRQITASADLTVFPEDPARILRQGVPPLEQAALADEILQWITMKSRSAASVTRHSSNRHLRVVCCPRTSYQPAEIHRDTGAKGRQQCRRAWSPLPTRTMLRFAVNRVATKAFPVRAMATQATTVSTADFEAVAALLDSDEGRRSLANIKSQFLESQARLAEITSEVRHTTGKGKRMLTMRLLKVRGESCSGAVPFLMESPYDRPMATKWDATQNPCALANPIQAGPKIDWAELRKNVDPALVQAHDEALKSITWPKFDNSATIEDVRKKFEAFQKEAAALSAEAEKAVADIDREVAKTERIKASTKSPGCGSFVHYHGELERGLDA

SEQ ID NO: 13552 - protein, 398 aa, Chlorella protothecoides
MRLARMEKYIRRNALQVTFRDELNQAERREVVNSDQEAKKLAFYLFWNVKADYGRSHIVDADLAAFVPARDVRLAAELLDADGDGVITSQDVCAAILQVFRERQNLAASLTDTKSVVGKLETMVGVVLHIVMAFLYLVIFRVDVMNFYLTFSSMILAFSFIFNQSLRMIYENAVFLFVIHPYDIGDTLLLDKQACRVDAINLTYTTMTDPSNAQLWYPNEKLRAAPFINLSASGNRCETLAVAVDVDTPLGVAEDLRAVAAAVTRLQPKEVDGEPGVALAASPDPLKYVLEVSWTLSHNGVDAARGARLRNAVHAALFARLAELGVRSSAPPPRAPGNDAYGALRAAPVHEAAPAPSREATQAGAAQARAQAGLAAAVQAAEAQQRRGSPGGALERPV

SEQ ID NO: 13553 - protein, 78 aa, Chlorella protothecoides
MAVKILFFARSRELAGVSETSVAVQAADTTESLLSHLLEQELDGRFVFSLNHEYLERGSVVPLKAGDEVAIIPPISGG

SEQ ID NO: 13554 - protein, 164 aa, Chlorella protothecoides
MQCHAQVWLYSLLNTSVRSMQILLPRTSPPPPPRRPAMLTPRILGAVPIVPVSSIKDSLTWYEKLGFVPRTDEDGDADNYALLTLGPVELHLRQVNSSEKLDAEANANGVYVRVEGLDALHDEFKGKGLSSLKGVQDTQWGMREFALSDPDGTLLRFGQIKTSS

SEQ ID NO: 13555 - protein, 651 aa, Chlorella protothecoides
  MOD_RES (20)..(23): Any amino acid
  MOD_RES (218)..(221): Any amino acid
  MOD_RES (626)..(629): Any amino acid
MTENMKPVFVCDAYRGLSAXXXXGDPIQAFKKSSRAATGSRREGHITRIISSFRHAMTENMKPVYVCDAYRGLSAAQPPGLRNRYRGSGTVRSDVQYDNLPSPPSCMDHRWTPCLGDGKRHAVSISHASPAPLWTLGNSFGIVHEVCSASWVTSRRRGLHSHICDCHKQAPASSPGRPIPSLPTPPRQPAPFEMQGGPRGVLQRVAHRVADDGSLVRXXXXQSCSRSRPATLAHEGGGGIVAREGARAHSRPSTSPTPHIKPSLPLLEEAEDEAVGGVRQEEGREHQALHRHELDEDVQGGPRGVFQRVAHCVADDGGLVRVGALAPQLARVLRGPRLDVLLGVVPGAAGVGHGHRHLHARHQRAGQHAGQRAHAEQHAHHDGGEHDQGAGGDHLRQRGGGGDLHAAAVVGAGSALHEPGDGVELVAHLLHHGQRGLAHRLHGHGGEPVGEHGAHQQAGEHLWVQDGRVGDGDAGTRDVGAEERQRHQRRGADGEALADGGGGVPRRVQRVGALADVLAHGRHLGDAAGVVADGAIRVDGQAGGQRAQHAQRRAGDAVHVRQGERDEDGHRDGQAGDDGGLVAQGQAEDDVGGGAGLACVGHVLEGLDLLISRGQGAPSGVGSATXXXXDDVGGGAGLARVGHVLCDREDV

SEQ ID NO: 13556 - protein, 311 aa, Chlorella protothecoides
  MOD_RES (218)..(220): Any amino acid
  MOD_RES (303)..(305): Any amino acid
MREWPSDVRHHMCRKGAPPAAARARAATTHPARRTTMKDPFCPAFQANLGTLVAVTGVILFWRGVWNMWCEGWVGIDGMSVRVGEGGDSTPFAGAGARELPPLDPRTPVRRPCSPFLSPWPLQGHGGWPLAHQRPAVHGHRLGHHALHPLLPGAPGADVPGDVNTFGVAWARWRCALVHLPLLLGMSMVRGRRGAWRRGKPGLLTFGVEPCTPSALLXXXGWHGRGGGARRCTSRCSGARPWYEGAEAHGAEENLAFPRSVWNSAHPPLSLDAIRSLHRRPLYLCTAADTARVIVPQRLWARXXXHSIGGP

SEQ ID NO: 13557 - protein, 458 aa, Chlorella protothecoides
  MOD_RES (380)..(383): Any amino acid
  MOD_RES (408)..(411): Any amino acid
MGRGVVPDTYEHSANAARSLALAGADVALVFGARLNWQLHFGEAPKWAADVKFVLVDLEPSERDARVSHLVLRGDAGVVAGQLLDALQGWGGQGRGIGVGDALVVPRGLGRGKRAGWTRRDLGRQMARDGRNTTAAMECEQAIPRSPWHPSALVEAVLSRGVKVHLSPAQFPPLFPTPPTQAQPHSMHGAAPPRVARLDVAPGGQVRGGAGEAGRAPGAHHAPAGLRHHAARGARRAGHAAPPPAGGGRGRQHHGQRAPAPGAGDRAAHSAGCRHLGHHGRGAGLRHRLGHPGPGPRDGGCGGRLRLWLLGHGGGDHRALRPAGDADHLQQRRHLWRRPPRAGAARRRGAGAGGRGPRGRPRAHRLRPRLALRPAGAGLXXXXGTAEELAAALREALASGGPSLIDVXXXXGTAEELAAALREALASDGPSLINVAIDPQAGVESGNVHAFNFKPPEK

SEQ ID NO: 13558 - protein, 463 aa, Chlorella protothecoides
MRWRSCGVSGVAPRHRVSAPITLVPPHGPLILRDPPYPIQQVRGGASSGNSNGREYLLEEEQRGEAEIEEKVADLQVAIAEGATSFLFTEYKYVSFFMAGFSVFIFVLLSSQDGFKTKWHRDESGVLRAPALYNGAFSTIAFIVGAATSIVSGYLGMSIATYANARTALEARKGIAPAFMAAFRSGAVMGFLLAGNALLVLYLLLAVYSRVFGDDWEGLYEAITGYGLGGSSIALFGRVGGGIYTKAADVGADLVGKVEKDIPEDDPRTPAVIADNVGDNVGDIAGMGADLFGSFAEATCAALVVSSVSALGVDHLWVAMNFPLLITGSGILVCIATTLLATDLRPARVVAEIESTLKLQLIVSTLVMTPVAYLLAVAALPPTMTGLFSDDPMRPVKNWYLFVCVAAGLWGGLVIGLVTEFYTSNRYAPVQVSGRRREGWAALGSVGRSTRGAADTRGCSLAP

SEQ ID NO: 13559 - protein, 380 aa, Chlorella protothecoides
  MOD_RES (60)..(63): Any amino acid
  MOD_RES (202)..(205): Any amino acid
  MOD_RES (288)..(290): Any amino acid
  MOD_RES (315)..(318): Any amino acid
MNSEEQDAEIDALDALGALADFARCVGVVVWSAFWALCRQAFGPQCLPDVLNRPPQTLPXXXXVPWPTLQDPAPTQNRPCSEQASEDEGGHLARGGSHGPEAEGPGGRDLQKWIQCSVCEKWRKVPFNLSDADIPDDWACGDNTWGLDSATCDAEQAMSNDEIDYILSAQAAQLETEAAGDAAGVRLGTGAGGCKGRQEYLXXXXRPRAMPRGERQTIFFWGGGPLGARPCVAMPVRFLVQGEVGRGCGRLQGLPGISRVIDLRRRVPVSLHHAMCTTPAASKPPCTXXXAKARASFPPPRHVNDASSEQVALHXXXXPPRPPPPLRTPQGNAATQARQRTRRGARAAARRTGQGRRRWAPGGRQPKWARCGCRAAPRTP

SEQ ID NO: 13560 - protein, 315 aa, Chlorella protothecoides
  MOD_RES (255)..(260): Any amino acid
MIHCPSSSTTDPGQLVIEGPLRPHMSHSQDSERCSDNTPRDAGLSSDPQLHAIQVPSWLVKGGPSTGCSSPKGVLLLEIVQLTALHAIQVPPGWSGGGLHWLFLSQGGFTPGDSAADSGARPAKPLPFSRTALAQICHLQMTCSWESRAYIITPSPKFSSLPMQPTLWKYPRELYKLLDAETLFFAFHHLPGTRAQLLAAQELYRQDWRYHMWQGVWFQCISTLGAPQRYAEPTAGGQPGDDWEKGSYIYFDYLXXXXXXHDIGWCYRLKEDFLFQYAALAVRLMLEECRPEGDPKSVTLHWAWQSAQHSPSRIS

SEQ ID NO: 13561 - protein, 386 aa, Chlorella protothecoides
  MOD_RES (28)..(31): Any amino acid
MLRRVAVGVGVSPESRVNSAHDCHNPPXXXXASGGCRGRGPPGKSSPPHMTFTTLRPTPPPPSLRLSERRDGRGESRPVGHLQLPAALPAPGPPGTHQGRPPPPRPFPRQPPAARARRGALAPGRHLCHPGQRHVAGGECAAHPPPARRRAPGPAPPGPARARPGQPGHLLPQPWDRGAVCRGVQHVPVPRQAHVHPRDLGRRGGPPRWLRRDLLRRPPAGDEPPGPARHRTQEAVCGGAGPPGGRRGPFGLPPLRAAGAGGRAVCRPGVLRSRDWHDRLKRPLRSSCVGAETTSQHRGHPLCFTLHLLSLQTPHRDGFLPRAPLALLGNVLCSRARTRIAAATRPHPLPPAGLRPPCITKPCPLPSLERSRFILDCIAPTEPFAA

SEQ ID NO: 13562 - protein, 411 aa, Chlorella protothecoides
MSPRFCVIPLEESSTGSPRRGAGAPPLPPVAEEGEEEGGGDPLVHSRSSTATHDAPVAIRFDRPGAGYGEGVEEQGLRAAWEAVVRGRGEDDKGASGSVTPDLKLSCCEELGGANGGASGRATPDAVRSHTPSASGTDARGGSAGSLATLDEARGRRAPCGGLMRCWRRPGRSVLRVTPGWGRQYAFLLVRAGIKLSRAWGTKFLDLLLLVFAGIVTGEEEWVHRLAGSQVSGWNPAPVPRCAAGFCPASVCAAIHPSPANTIHRNALPHPLTTGAMHGTGWTNWDFKGHIALIMLTLGIIAASGALAVFGKERLVHWRERESGVRVFSYFMANSTTNMVDVFIQPLVFLSVYYSMTIPSISFGLVRRWSCVCVCVGGGGEQVPAALAPTRPWHAPHLASSHSACTHALPS

SEQ ID NO: 13563 - protein, 543 aa, Chlorella protothecoides
  MOD_RES (36)..(75): Any amino acid
RRDGGGAAPGPDPAAGDGRLVSQGADLEALAGALAXXXXXXXXXXXXXXXXXXXXXXXXXXXXXXXXXXXXXXXXFGLHGARGRAGPGHSAARGVADRGPGPGVPGPAQASEGDGARVTDEWMAVCMNGRRVWKGRNVDERQGLQPSDWKGAPAESRLAPPTLREPAHQSLCMTRTQAAGAGAHDGRAAGQHAALAGPLGRLPQGLHAAAPPLPPSTRSPCSPQPHSHVLEVLAAAQPSARVVVVEALGRVVSGALARIPAAAAAPGGEAPAAAGAPPAPGPPSGLEHMLLVSLESVYGGEREPEVRRAVLRVLLSTLQRHGERLGGGWGAVFRLLAAVPEARDAAATDLGFQAVQLVAGDFAAGLGAARLRRCLEVAAVYGAQQVQGPQRGWVCGACVGENRGVGAEGGGRGEGGIGAWSPRPALGIELRTRVQGPGGLGTPPASSCPSPVRICKPFPPRQDCMPAHTLHHTGGCEREPDHHQPAVERGRSGGQGRAGVRRRRPWRRHRGRGRVAGGGPAPDPGGGRCHPGAHLLGPAGKSG

SEQ ID NO: 13564 - protein, 789 aa, Chlorella protothecoides
MASLPPSITNASREQLQQYLLDTLKKLKSRDKRLEELQAAASASAAEVEGLQARLVSSSRESQARLDAEVELLASQHARELKEASATAQDLVAQLAARERRAAQLEGELEGAEARCEAAEQAAAESAAEHAQVLEQAVLEKEAAEAAAARLQARLAEVETAAREAQAPRAQDGKPGTLPSDAPGPEAWASTSPDPQILEKIDLLTSTVSELEQRQAELRAENARLLETEEQTSAELLTRLAAVSSANRQTFEALGEKEGLLAAVDVMQAHVAKLEQALAEREQESAELESLRERLAAREATANGGERGKDDPSEAAAPRAELERAKERVRELELELETSEAALQDLRTASAAESGRAGGALAAMRTEVQALQAEREALQAECAEVKAANLRQEEQCAKLERELVSLQVQLASRSEEAAALEARLAAAAEAGKSGEEEEEQALADARAELAGVRAELEAAEGRLATAKGELEAQTAQLAARSGELESRTSELTAVKGELQAAASDLAGAKTAEARLGSELAEARHGLEELGARLAASEATTAEQRAKLDTLAGTLADAQVRRRGFEYFGYGWAYIPLAGQKSARGGTALKGMRWCVSRRCKRMKGCGHVGSATPKHIQSSLPSCLPRPQAAATSSAQRVQELEDALAGARSASASGDSAAASQLAAAQGALEAAQKELATIRRQQEVERGRVKKAIADLKRRLEGAAHRVLTDYTAGSRIKAVRRLSSGITTPSPALQSRHHLAEHGISSPVDLPPPKQGHAGEGRSHRVGRRRRRPGPGLAGGRRGPPG

SEQ ID NO: 13565 - protein, 454 aa, Chlorella protothecoides
MVGIVTYRNAGIIAVEPSPWAEVQPFNVSLDALAAVPIIIFGMQCHAQVITVFNELEERPRLVKNLFPSGLFRLRGSDEEEDGAQDAVVEGVADGTGAETESEAGPRQSGKSRKLRGMRRVVMAASECGASADEGTVLLYLPWGRGLGVPLLCASSIPPTPVPRHPTFPSWTDGGGVQRHRADRLPGLPPLGPEQYPEQLLAPRRAHAALPRAGGPDEGGVLPHQPPPGAHLHPGRGGRADGAPPRQRRLQLRARRRLLPGHPGRGPGRQRPGPGVQGGGRDQRRLPHPGPAGGAADEVCQRQGAGLAHSSGGGAAAAGGAGRGATAAPLPPPHLQAVVGGAGPGGALRGSAGPHHRVHRLPHAARGRVSAPVGGRGCWVAGAHASQGWDRECRPWRQMNGVPVAMELAGGRVCRSRSWACDCRHPQGKEVTLRDGARLILTIPPPHMQYCQQW

SEQ ID NO: 13566 - protein, 299 aa, Chlorella protothecoides
MRWTRCARCGAWPPGPTFPPASSPGWRATSARAALGSARQTCAPWPGPCSTSDTSPVGVPPLGGVPQSSRGGQAALCTDGLGWDADGHCQGFPWMMLVSMLSHVVTRRTLLKSPLLPPHPPSIVRRDAEGRTGGGCTTPGPRHPPSPAGEAGRGVLPPAGRLPAPPRAAAGAAAPRRAQRAGVERGGPVPPAGMLCALGVRCAARPLRGRGRRHAGAPGAEDVARRPAARAVLPGQLGPALPRRPGPGGAGGARLRGSSRAAARRRAGEFPPGRARARPLRRTGGPAGAAGGPAAGRAR

SEQ ID NO: 13567 - protein, 82 aa, Chlorella protothecoides
MAGGISSGTPGEASARSSIVTLINSSVGVGVLSLPYAFRAAGWVGGLALLAFVATVEAFTLYVLSRYAEHTDAVTYAIVVGA

SEQ ID NO: 13568 - protein, 111 aa, Chlorella protothecoides
MPLLRKRAVEYDIPDADTHFQDNEEVRFGVSYGSGHEASPGHAPTQPYVQVFLIRSTGEVVREYETYISKVNLYRQRIWTAAHTGQGKLTWAEAKEEEEEARAALAKVQAS

SEQ ID NO: 13569 - protein, 75 aa, Chlorella protothecoides
MAASMLSFEPIVALGPDRHLALLRWLTDALLETQKVRSAIQKREETAEDVKRGFRDEMAEERRRLKDLLEAGAGL

SEQ ID NO: 13570 - protein, 302 aa, Chlorella protothecoides
MTPLLPTPATWRRPVIALPSLNPHPHPHAGAVLLAAGPGRRGGRRGHHALRRGGGRRSQGRPGNLRHRPPPGGERRGRGRAHAGHAAHRDPGPAEGPGGRAFQRCGPAPRGRRRGVGLRVQLRLRRRVGGGGGAAGRQACHTPPPPQGAWMLGAAAAGLWHRGPTRDGHPLAGPQPPPFITPHTPQGIARVREVVDDLFSPTKQAREVTSRLWRRASERASWSSDLGGSFTAARLAYCTAVLALQAQPLLKHLEADKAGQAKQAAPEAAVKPRPAAARPAGARDKRKPSVAREGRVTRSRTA

SEQ ID NO: 13571 - protein, 301 aa, Chlorella protothecoides
MEAAVAAAARVVAATQKAVTSAEAAVNQLLKRSANQDQRTAAQDVKAKERELREKQRAAEREERERQKALAKRYPMEDLQLLAESQAEAAAQGASRAFGLCDPGVVGGCCRSSKATATDVHISSKGRTRRLPPEHLPGKPCPSSDVVQPPWLDAEESQRVTTLLYILDTLQQFGKILDVRAPPLPESAALLAPGGERKGGTGVESCAEDVQCHPLHSWHRASHVQTFLGTAGSCIPSAELPGYKGDRPPIPTLQALLADLRDTDALGPQEKRWTAVLSSATWPEVLRRMVLTWLQDPDAHP

SEQ ID NO: 13572 - protein, 141 aa, Chlorella protothecoides
  MOD_RES (58)..(80): Any amino acid
SAAGFPAAAASPPRPAPGQEGIAWRCAAFLAPEGAYCCRANSLQAYAEVNRDVLAGGXXXXXXXXXXXXXXXXXXXXXXXRGAQRQVRELCPFLSPGGQGVLGTEGAWVESPGQGRLGCKPEPSLDPVLMKEAPVSAPSAR

SEQ ID NO: 13573 - protein, 225 aa, Chlorella protothecoides
MGSKAAVGAGCMIGEDVVLGDKSTVKRSVIGPNCRIGAGAKEVCAAITVRPSSSIQDGARSPPGNLQPPTQMTSPCPDHKQRAHGRRDGGGWGARARLHPVQQGGGGCRGQPEGLPGQPRVQGGRGRRPARGGAGLQQMKRIRQCLLYCFPASGAPAECCSVCNSGCRWRGGRRAGILRLPSFPKKRPRAEAPACGTPGTSPADTTASAMGCIDHTSVRSPNDIA

SEQ ID NO: 13574 - protein, 289 aa, Chlorella protothecoides
MGVSGHSGVRDQPGDSCCLLSRSAHGAYHADPRTQTPPQEASEEHLRPTQRQAQRAGRPLPDRHSDLPALPPPYPAQPPGCQGLPAECYCGGEGGHIPHPAGKGPQSEREDGGERAPAAHHRAAAGGGVHPEHASPGGHQAGRGDHARVGGQDQGPGGEAAGRHRALHVPGGAGTWFAFFWVGVSWQGLGHQRPGHGRARRLSCVIEAGAAAAPRLCWVLQRTPLWSTAGMGAPLSEAAVRPCAGGECNARLATALSEKAAADSRATYAESLAAAAEGRATAAEARAAA

SEQ ID NO: 13575 - protein, 423 aa, Chlorella protothecoides
MPRHHPPVMVACMPCRHAPVPFPRPPIAKTQKLFDASSCTALARACLFIFIPCLTFGKLAQSVTLDSVLYLWPLVANIVVSLPVGLALGWAAARLTGMPRAYTPHAMCCVAFGNVGNLPLVFVAALCHDPHTIFFRRLGAPCEVLGMSYTAFAILGATVLQFTVAIQLLKPEPELAVEVVGGRAGDFRLGPGSDAAAGAGAPARGAAAADPAPRQLGPGSDAAAGAGAPTRGAAADDPASHQCQQAPGKRGAGSEEEGHMLAAEHPQPIWELARREDSDATLDLRSGSLLSVELPLMSSPRMDSAAGLAAGREGAGEGARLLPGAAAPVPERHEPGAGQRAANSFRGRLRHSARRLAAVPWASFFPLPTQAALAGVVVGCIAPARNALYGHDAPLTFLGDTIETLGNGLIPCTIVLLGAVLYR

SEQ ID NO: 13576 - protein, 221 aa, Chlorella protothecoides
  MOD_RES (189)..(192): Any amino acid
  MOD_RES (212)..(215): Any amino acid
MQTLARSQARMLHCVRAWHLLPAGYAPCTSKATAFSPICHPAPLGHGRRPFVILSHLSSTWQRPSGRRPSLQSCRPCAAASTATVSVTPPISEPAPHTVVLDVSGMKCGGCVSAVKRTLLRQPGISSASVNLVLEGAVIEARDDEATVRAVRALASAGFPSIIRPREAHDLRGRGAEKEAAREEELLQXXXXASPSLGSCGSLPTPSSSRPXXXXWCWRGR

SEQ ID NO: 13577 - protein, 203 aa, Chlorella protothecoides
MRILGSDALVCLAFRLCPVHPQAGIAPPCTLQDSASLPLLTAPHDALRNGLVTLKDGAKSGHPVAQVQAGLRSTVEESRMAMLKNVYGSGLPARIQIERQILERCVAVTCAATRKDVPCLLCGGSELDSSHLSPTRRRVGRLPGLPSSRIGLDSMSGALDDFSFEDYLGLPGDSEVAPPDLHSLMEAHLGMARVTKPASRAFL

SEQ ID NO: 13578 - protein, 363 aa, Chlorella protothecoides
  MOD_RES (113)..(115): Any amino acid
MCRSHSHRAAPRRTGSSGHPGSPRFPPGRHRGHDPASRTSGLNPHCRWAGVGPVPAVEPRGPATLLPQPLGPCRPHLRPLEPDQARWVFSASMPSLPLAEVLHDAGIRGAVPXXXLEPHAMYVHAPPHPAVLCLGRADGLMEVWDLLRGQSCPVQTLQVTDTAVTSLEFDPAQQGQVGAEEAGGGAWDGTAGQDHLGWPSCVGGHAPLGATGEVHLVQLPRAVHRQSIRELEDFLTWFKGEKRAFLAAESAQETAVEHDSAGKEGQELDAHRAEEARDMSAGVKALRSDRSVEDEEFLAALREWELKRIDWRNGSLRVSCAQGQPGAGAKGGCAHSGPAVMPREPHPGRVRPIARMRRGPGKS

SEQ ID NO: 13579 - protein, 473 aa, Chlorella protothecoides
MRRGDCLGLLREGGRLASTSWTIWTLGNCLREPRRKRQWARQTRCHASAAGKPKRRVVVTGQGVVTSLGQSTQQFYDQLLAGASGITHIEGFDTRGAGMHMLANAPLGGANDHDSPQQSNLSLTRPQHTHPGTRRLLDQDRRRSEGEEGWRDWRRVEDGQYALPAAQHTVFAGVACMARLSSKSNRPRTQALEDAGLPFEGPGLEDLDRKLCGILIGTAMGGMTTFASGVEALTLSGGCWILGFEGLGVKRGGNEVVGRMHGTPSGLSPPLWLAEVAERAACVRKGSVSPHDFAFQVMGAQSVWIVHHLPPPFDQHSPDLTPPTTQPLPAGHRKMNPFCIPFSIGNMGGAMLAMDLGFMGPNYSISTACATGNYCIISAANHIRNGDAVLMLAGGADAAVIPSGIGGFIACKALSRRNDAPERASRPWDAGRDGFVMGEGAGVLVLEELEHARARGATILAEFIGGVVGGGSG

SEQ ID NO: 13580 - protein, 174 aa, Chlorella protothecoides
MCHFALGLPTLPVHTFPSTWNAAISWGLASACLLHHAGHALHALGLTMHAHSGVWGWLGHPYVGAGIGAAALAGPGRTLIVNGARALSRGHPDMNSLIALGVATAFGTGLASAFVPGIPLDASLLEEPVMLLAFVLLGRTLEARARKKASGEWRNPKETLACPCMHWPGMYLQV

SEQ ID NO: 13581 - protein, 121 aa, Chlorella protothecoides
MAEITLRIKPTTGSPPFEVKTTREATVGDLKTEVARACDSPADLIRLIYKGQVLKDHATVESYGEPGVIRRAEFGEEGGKVRSYRRMTVPHSLYPGLEHDHVVHMVKSKGPPVNRWVKGGA

SEQ ID NO: 13582 - protein, 60 aa, Chlorella protothecoides
MGGAAGSAVPAPPANPEATYATQLQQLQDMGFYDRETNLRALVASSGNVHAAVERLLASF

SEQ ID NO: 13583 - protein, 373 aa, Chlorella protothecoides
MHPAVDLSALSNLIPEQSRLVIDDGEGSGASRQVPTDILRRGDVILVLPGERVPVDGEVVDGRASLDESLVTGESRCEGCCMSRAKGLHPIPPLCPAQHSDARQVPPSPIPPSPTNQFLGRLVPAAPGARVKGGVVCHEGVLRVRASASAALSTVSGIARMVEDAQAREAPVQRLADAVAGRFCFGIMAVSAATLAFWAGPGAALFPGAVEAAGLGAAGATAPYVLAARLAVDVLVVACPCALGLATPTAVLVGSSAAARRGVLIGGGDVLERLAAVDTVVLDKTGTLTQGRPRLVARRGAGEDATLALAAALESVTRHPLADAFIDAARARGAALVVEGAGLCAVVWRDGVEIECHVTVEEFAGIVLGHKIA

SEQ ID NO: 13584 - protein, 121 aa, Chlorella protothecoides
MVRKRRIRPAGSDGVRHCWRPSLGPPPPPPPTPSPLHTVQEGLPGGAAQADALRAALANPAMQSLLSNPDFMRDMVSNNPMLRRMTEANPQVAQVLNDPAMLQDIVRIMGNPVSVGLGGTG

SEQ ID NO: 13585 - protein, 164 aa, Chlorella protothecoides
MDRFVGARRFRAHGAGWGWSSKASTMGVLIPADPTLSAPHRSAIPVPEAERKRPAKLAWTTLYRKQHRKDQELLVQRKKRRAVTKNATRSVAGTSLEVIAKKKAEKPEQRKASREAALREIKERAKKDKASKAGQKAANKAAGKSVAKNVPRAAGKAGAKSTGR

SEQ ID NO: 13586 - protein, 207 aa, Chlorella protothecoides
  MOD_RES (58)..(61): Any amino acid
MADEKVVQGTMRSKVFPGAAASAAQQLQAPPCIPSPPPLNHHHRHTQSTNLTFQPTRXXXXPSSIALYSLLTLPQPRPHTHTNYKPDVPADQELHAAGGVDRGAATAGHAQLRAVVQAPGVHLALQEGIWVVWQGKVTGWPVRGLGRRGEGTGAPWHGLRTPLSDPGRQKRPCVTQKQPCVIQRRPCAGQKRPCASRKRPCASQVTR

SEQ ID NO: 13587 - protein, 1425 aa, Chlorella protothecoides
  MOD_RES (1036)..(1038): Any amino acid
  MOD_RES (1183)..(1186): Any amino acid
  MOD_RES (1213)..(1216): Any amino acid
  MOD_RES (1287)..(1290): Any amino acid
MRACPHLASHRGGVRCAHGQAGPAPRHLEGLGLVNLLRAGANAQLPTAIVTWAGRGGEGERGEGGGGGMRQDGQGTSCPTRQEGTSHRSLEDLRVGKPLSPQFSQPKPHTSLCSPQTQPFSSSSVLTRGLWGLIWQSTSPCTPGMASMDEYSSSSLHCMVRSGQRPGRWGPDWSPRSGCRVLGGWGLAGTPAPRPRGMYPRPHIPKSNQQTPAGIAGSDHLECGYAGVGADLQVDVPRVGWAPASHRRVHIDIHSLLACGATGASRPSCAGWDPSSDGGWARERAVPCDSRKYSCLLAPVGIAHHTRSVHGRGLAKDLGLLLQDGLPDALALGQADQRLVALADDEHVGGTGGEGVAHGVADVHDVEGALVLLLAGDGAHAPVVVPAGHHDQGADVKVHELADLAGLQIQQDGVVFLEIDERMSDEDRRNRAGGGMGGRNGIPGAKTGPQWRGPTMGTSVQSSLQPTSHPHSVPKQTTHQASTHPDVGVGVADGAAVVGGDVGDGALAELHPLHLAQLVGGLLLGDAVHHKAPLGIVHQAEVLVCEGNRKGWEDSGEGLWRRPRGLQPTSHSRHISPLRRPTAAPTPHLATRGLVGPHLAVHLHQAVLQDGHDLTTGQGIPAGEERGGEGTGCSHGTDGRYYGGTLSSPAQGSRGGRHSLQTVAQQQDEWQALPGLVWAGAGLGSLHGRARGTVTESGGSHRRACRTTLVGPRRRPSPGAPTAGQHPAIDWGQTITVHPPSAGLTKIPPSLSSIQCLGAFSRFRCFLGPRTMVVGAPWRSYRALDQTLKGQHLARWCPMCGEPPPTQGRNMGALSTTPHEPRFDRSGNSHRVLLPNRQTLRWWICRVEVNLTTLNKHIQSLALVPAADSSRGLPLDRLRVDSHLQQRAERVPAPHPYRPPGAQRGGRHLPVKILCVSAEWACKVRPCPASKYCFPGSKRPCPSHRRHLQVGSCGGAASRKTSHANWRDMQACWGVDKERVLGRCGFTSAQIATHNAIGSWQNRDSTIHAALQRILTASGFKSLHTSARRLALEWGXXXDAIGSRQNRDSTMYAALQRILTVSGFKSLHISARRLALEWGLLTCSGRTPEATMASSLYGDIKRRDHKSVFIRPQEGLFGLKEWIDQGYLPPMPDNSVIMAQTKRGCRPTQGSWDSLWARDRLCTVAETREAQGRRAFASDPPLXXXXGPETGCAPWLRREKHKGAVLLPLTHHXXXXPPRGPWACPLPHPMPSPARSRNWRWAHPPHPPPLKSLEDCPRASCEHTAASPGGPGEGGGQWWVRGKSTAXXXXRGAWGMPRGRAGASALGACGALPRVTDARLVLVPPTDAPPPPECAPCKADTRPPRGIPEEGHHPGGASPPRPLHLPAILLSQGSMRCRSWLRHWTSAQRRARTWRDSLGDNTHVRTPGRRLPDRLQPRCGPGPGK

SEQ ID NO: 13588 - protein, 186 aa, Chlorella protothecoides
MLAIPGVQGDVDCQISPHSPLVSTELDENGWVCGDNSCGQLGVGPGAQEVHEPQPLKVARRWACLAMGASHTAAVTGQVRACSHWLNGGTEGTNGHRVTWLAHGRFRLAHGRFWPAHGRLWMTHGCFWVTHGRFWRPGSERGVLSPCHGAPVPSPRLPRPLTGQPVTFPCHTTQIPSCRARCTPGA

SEQ ID NO: 13589 - protein, 164 aa, Chlorella protothecoides
MARGVQRTLHRGAQRGAWGTSPLGTCFRTRYAIPATHTPTCSVAPIFITHSFVNLQENDTVLLDLETGKIREFVHFDVGSLVMVTGGHNNGRVGTITRKEKHKGSFDIVYIRDAVGHSFATRATNVFVIGKGDKPLVSLPKGKGIRQSILQEQAKIFGKTAAVH

SEQ ID NO: 13590 - protein, 180 aa, Chlorella protothecoides
MAATGALSPSLLPCRYALTGREVVAILKNRLVQVDGKVRTDKTYPVGFMDTITIPKTGALAWLGSCGIMGIPSAQRKPRQGFWSSWSVRRPWLATQARWGSHPVARYGHEHFRLVYDAKGRFVVHRISKEEATYKLCKVKRMQFGKGAIPYIATHDGRTIRYPDPDIRVSARLVCCLLGN

SEQ ID NO: 13591 - protein, 395 aa, Chlorella protothecoides
MTWVPRAGGDGVVVVGGGDRHATALAESGGRLLWRAPLVAARDALAVLPRGAAWGCREGRSCARMLRPPSPSHGTPPSQTGTAGLPPPRPPPSPHIPPRCSGAQDRLYRVHPRGQAAHGGVCGHDEEGVHGTRGKCALHRLPGRRCIPGGYLIILRNLRGPPRHPDLAQAAAAVTTSSYRNAGQTCICTNRVFVHVRTGRDGGIRVWVAWAMHSNQRQGECGREAAQGRLATAFWRAMVVILPACSKSVSLASTSAHNHSAPCLAHAVPDGPGVCARRLCEGAGGSSAEAARGRRHGRGDHPRPAHPALCRRDGGLVQWGAFLLGNRDVQRVRSTPGAAASLLPSCEAQTATNRVIFLVLHPFPRRWRPRCRTPSPRGQLWLSGGSAQSMTPATL

SEQ ID NO: 13592 - protein, 364 aa, Chlorella protothecoides
MVVAGVEATGARKLQGCGAAVPAKYALRKCAYTFDLSCAFLPYMAAPLPVTTAGATIDMRCFREEMFGPVTPVFKFSTDEEAIQMANTTEYGLAAYFYTKVACRGGDREVKGVERQGMGHPWRGSSQCCQGRHRPRPRRPRPRPRRHRPSPSPPLPSAAGPGQGMEDGRGPGVWDGGCERGGHHLGCCPLRRGQALRPGQGGVQVCTGRLPGHEDRVHGPGPAAARVQSTGWPLEQAGLACPNPFQHAVPLPTPLALCTTHSHCRYRDGHRHERNGLKGEEWERTGHLLVFSEEELVDDVHNVLGAGDGNVGLQDLAAVAALVVGVVPDRVELAGVVAALLDLHLHARWGMGEVGGGLMDGEGV

SEQ ID NO: 13593 - protein, 234 aa, Chlorella protothecoides
MTNCARLYASATPGDHIALCRPCQLQPLRLAATCLTAVAPAALAPPTAAGASVLVAPQPGCRLWSRGRIEAGASASGPGAVLVRVRGSVQGAPGTLMTVPAAHLAPAPAGHGEDELGADPSWTSCDQYEAASSSDVTSDDSKEEGTGEGPVPVTNPLGLASWEAHTRGVAGRLMVAMGYGGAGLGKQGQGQTQPLQTVVLTQGAGLGVAGGCGARGGPNVGSLEHPVAVEAELH

SEQ ID NO: 13594 - protein, 488 aa, Chlorella protothecoides
  MOD_RES (14)..(17): Any amino acid
  MOD_RES (48)..(51): Any amino acid
  MOD_RES (76)..(79): Any amino acid
  MOD_RES (121)..(123): Any amino acid
  MOD_RES (225)..(228): Any amino acid
  MOD_RES (351)..(354): Any amino acid
MRGRGQPHALALCXXXXRCRGSRDIHRQYPIVPKPSSAPSPTYESPMXXXXANASFPHTYPTPPHPALTDTEANFXXXXADACFPQTYPTPPPPALTDTEANFEPGSAQHESRSVGPHRPXXXSARVSQGGQNWADRAVPVVLTPTELLRPGLGHFAVADLAAVNRSVTPWVVVGFHRMMYTDSYYGFTPTSSQVVATDMRAAFEDLFFEYGVDMTWQELSAVGXXXXEYGVDMTWQVCGGVLSSIKGWGVLAGVAGTVSGGVAAGPFSSSHATPGRFLFEASARGQAAALHLPKTMPVPDKDRHPPTTESDAGSLLPAADHSRHSLAPLHITTLCPSPSILTPLGPMDPXXXXAADHSRPSLGPSTSPPSIRPPAYSPPLAPWTPPQGHLHNYQRTCPVYNNTCVDYDDEGVARGPIHVTMGHNGFMLTPFYQPEAPNAFDGQPTFASFGYCRAEVNRTHFNLQVTVLPYGVQDRSSANALQPRHGA

SEQ ID NO: 13595 - protein, 235 aa, Chlorella protothecoides
MEPPVPPASHRDLKRVRDEDASRFSNFPVLNDRYVLLDLLGRGGFSEVYRAFDLSSQRDVACKIHQLNGQWSELKKASYVKHSVREYHIHKKLHHPRCEWSAEARMGWLRCWERSVCPPPGPAFGFRQQEGEDEDVPGRLQRRGPRYIEAHIPPTPAAPGSCRWWTFLRSTTTPLPPCWSCVRAATSTPTANCMRWGGRWIWNGGGEKAERRRRDPGSPGPLADRRLGNVLLPGW

SEQ ID NO: 13596 - protein, 330 aa, Chlorella protothecoides
MTWCGLSLRSKNGEIWRTGEQARNAARSMALRPPCKHQPPDSVLTGRWGEEAKLSANWTPEMEGEATEFYCRNYIDTFSTTHIATAMACIPQLMQWVKSTDPAQGCPSAHLIERARPRFPQSSACTCKCCPADLPGPQPTALQGWLGRGLPLSSAQLNLVMSACAYKTYSSAPHLCPPPDAGPVPSGEALFPPVPEAHHRGAGALLSSSSQATSPTHCKQETLPASWLFHPQMTPLMGCCSVQPFIPSLLQPPCRSYHSVHYLGPTVALFSVDMRTQRTRSVCVPEVGIEFLGRGPELPSSQAHAVGSALLTRSVLQWGCLPGSPGVACP

SEQ ID NO: 13597 - protein, 388 aa, Chlorella protothecoides
MMRAILPRRGTALLAEWTLARACTPGLQLDATHGLLHPECRSFTSDSLVRLTPSGEHLHLWRARPACALTIVGVCVSPKKHHLTALRPLPITTNSPPTRRTGAELQKRGTHFAALAPGAAPGLALWSRLVRQVHATFMPAGYPVTVAPGYRTYVAWQGLHHAAGSANGVLASTFLLYALGLGAEAIPTAGAINWVLKDGLGQAGTLLFGRAIAHNFDVNARWWYVASSAKLNLAMGLEIGTALAPAAFLPAAALANALKGLAWMAGGSARAVFNGAFAANVNIADLTAKATSQTIAASLAGTAAGVALAAGVGQSLAPAAAAYAALAALHMLSGVRSVRSVPLATLNPSRVHALGRAFLDGGGAAAAAADEVDGGLAALGDGAVVPAD

SEQ ID NO: 13598 - protein, 197 aa, Chlorella protothecoides
MEAEEARRDLQAARAAREDAEDRLAAMQAELGEARRSGAAQIAHVRATLLRLARTCAALERESTAQSLRALAPRLGSLGVRRRGIEVQEVWEEGQAFRDLRAKLTALAEQRDAIEAARKAAKRRLPLPGQPLPEERNEGTDAAGTSTSTLHPEDWVVQVGVPGNTVQTKTDRHPGGDVAPDRYRAPALLQTFCTEAT

SEQ ID NO: 13599 - protein, 185 aa, Chlorella protothecoides
MSIFAWLLVVALAACAAPDAVGALASTAPRKSAPFQTRNLIENHQKGLKLRVSTTSIDTSGQYVTVSWSGVEVRCGVRRGCDGQHQLHHPTNPWHPFPQDPADTDMVAMYLADRDPSETWPMKYIWTSTVYNYYEPIKFVFLRGAFGDKFIAATSENITSTNPQQPTQVKLAFTEDPRWAGMTAG

SEQ ID NO: 13600 - protein, 138 aa, Chlorella protothecoides
MTGLEPNTRYYYVVGDEGEGPSSKVTSFISAPTPEDTVHLLALADLGQYNEDGSRNFAYWYQYYEPADEFYAIDTMQYTVGPLPEGGRGGEECLGWVRTNRAAPVAECPCHAALDLLPVQLCSSHTPPTQPLSKPCLR

SEQ ID NO: 13601 - protein, 171 aa, Chlorella protothecoides
MPEAKHKKTEGSPPTAEHACRKMVDRGWAGPYLRYINILPEEGVWLGSVLLLVRSERLGASRTPAQPPAESADGPTRPGDTQSHDITAEMVMWEADGKEQGQSTSQGVLLTEVEGWQAWRFGISLSLHRSQRPIAYQVAVGPVQTEQCVFWIPGGGQPMHWGYVCWARAQG

SEQ ID NO: 13602 - protein, 445 aa, Chlorella protothecoides
MEGASPPPQADDSDVLDAQLYLDEPGDAPHAAQEDAPRLAGAGAVSGTQPPARISRVPRVTLRTLPFPAQVKFLVPNVAAGSIIGKGGVNVSDIQAQSQARIQVGRAGQAGLVRARWSKGSRRTACIAPGLAPRGRAAACRRRMCPLVQLARSPPPFNGHPAAHFLPAHPPIPPSHPSPPQLSKIGEPWPGTLGEFGTPPAHDRLLLITGTLDALLTALHAVLATFRSELAALAAVAAREDGAMALRMLVHARLCGTLIGRGGATIRSFKDASGAVFNISPPPGPGDPPERVVRLTGTPDQLLRAVALVLTKLSQNPDYPLLTDVSLGFGPPAAAPAETWGGAAPPPGGGAGAFLPHAAAAAAAGVGTTSLVMAVPEDRVGVVIGRGGAVINQIKAVLGVRIRISRRGECLPGTNDRSCEISGPPESVALAQRLIQQKVEGVERE

SEQ ID NO: 13603 - protein, 716 aa, Chlorella protothecoides
  MOD_RES (104)..(107): Any amino acid
  MOD_RES (162)..(165): Any amino acid
  MOD_RES (242)..(244): Any amino acid
  MOD_RES (380)..(412): Any amino acid
  MOD_RES (544)..(547): Any amino acid
  MOD_RES (666)..(686): Any amino acid
VVRRCRRGARLAPRPARRAGPGKRGPPPGVQSRGRRARRAGRRRRACGVRRRAGGRAGHPHRSPDGSQGAAGGLRLTAGGLGPGPWRGASRRPPAPGRRRGGGXXXXWVRDRGAARADDLLPPDVAAAGGRPTQTPDGADDVLPGPRLVEGAGGGPPAAAAXXXXPAAGGGRGWQAPSGRRSAGPALPGAGAAAGARGAAAEGQRGRRRACGPAGGLRRGRCGPGPEPGNATLHLRAVSSRXXXGPAGGLRRGRRGPGPEPGAGLDRGLSRGVEGGNPLRLWSKQGKCHAVSPGRELTRDTDSPLKRHPHPHTVGAGDGGEAAARAAGAGAAPHPRSWPGLVGGRGGGRARARAPRRRAPALRFLRRAAAAHAAAPRAGXXXXXXXXXXXXXXXXXXXXXXXXXXXXXXXXXVASALPLFEGVELWDSVIVCYQLLGKRGAAEALVRRRLEVRPSDPRLWCALGDLSLDPGHYRRAWEASGGRSARAQRSLARLAAGAGRHAEAAGHWRAALALSPLHPEGWFSLGYACLKERDHAGARAAFTXXXXGLRVPEGARLRGRARGFHPRRAAAAGQRRGLEQPGRGAHRAARLAPGLRRADRGAAPQARQLAGLGELRRGGGARARVAGRRARAAGSAAPVERRAAGPGGAGGAGAPAGARRGGGGGXXXXXXXXXXXXXXXXXXXXXEGMEEGDGGKGGDEEDGDLLDPYDEEVDVR

SEQ ID NO: 13604 - protein, 262 aa, Chlorella protothecoides
MGLVPGAATGASVAASSPGAQHLAEVWNALNGQFSQSPALPELKRTGSAEALEAELAAAAGDERELKRLRRKQSNRDSARRSRLRKQAECEELGKRVKDLIAENGELRAERIALRAQIEVLDAKLAMSGGGEAGARAEGHGTTWEGMTWGQRRALAQCATSAFNLALGAGELEKIQADARAKQAAEATNVAAAIAHVNALTANSNAADQEDEEGEDRGRGGPPSVPTPASGPQLPPAAAASGAQAQGHAAAAGALGPQSTSA

SEQ ID NO: 13605 - protein, 717 aa, Chlorella protothecoides
  MOD_RES (11)..(14): Any amino acid
  MOD_RES (449)..(452): Any amino acid
MSKSGYATPKXXXXAKKARAPAPRPGTAWAPPGTIGASGTRAGARRASSCWTPGPGAWRVWRRGMPMRTAWDSRSGRREVRFMGRGGSRRFITGWHRVCALAARPRQLPGLDAAPGHCLLLQPPLPPGTGAVAAAGRQRQGRGCHRGGAAGGGVPGRGRGARGRIIPSRDAADAGDEQRLLAAVQPGRRDAGLPEPGRRGGERGARRLGVPARADLVRGGAGPGAPAHAGRGGGGSPSRRPRPLRRLPGPLLRPDPGPALGGRRHAAPHLPVAQHHGSAGRVAQCAQRAAREPPAGARPRQLEPAGCRRGWAARVDCAGSGNAGLLEGVPAHRQRQASIYRAPQAGRLAPGCPATDCQLASLGHFPARSLASASPVRYTHISLHQPPSPYVAHLGRGEALGPTSWAHLDLGDAEDDAVPPELAATLRTLRTTVVCPQPGDDGADGSGPXXXXLAATLRTLRTTVVCPEPGDDGADGSGPTWEALLLHAAGEGAPVSASTPTPGEPPANDDQPTSAGRAATTADHMISTGSSDSTPRPLLLMPHGGPHSAFSSEFSPVLGALCALGHDVLLVNYRGSTGFGEASLQALPGRVGELDVGDCLAALRRARALGAGAGAGAAVVGGSHGGFLAGHLLGQAPGDFFAGVLRNPVLDLGLMVQLSDIPDWCYVEAWGAEGARRARVKPLSEDLDRFHAVSPIAHVDKVCVCRGERDGSRVREL

SEQ ID NO: 13606 - protein, 74 aa, Chlorella protothecoides
MLFLLGGKDRRVPLRDAQQYANALRVLRGEAGPATKILVFPEDNHALDSPQTEFEQWITALEWLQRHGPGSTTM

SEQ ID NO: 13607 - protein, 203 aa, Chlorella protothecoides
MGAPRPSTPALITSFPMGAGMTGVYLPLIAAGAGQACWKEPVAVLFSRSHFSLLAAVEGEGPVSPPLLALAGAGQPLLPRFLTEEEESGAPPPSLPLLVRFMACVQLAGGALAVRLGQSPRPNVLLSLLRARLLNAGAEAVQSGGVQAGSDAGQSGQVEAGTEAVGSGEGEAGASTARGGDALTVQGAEAPSARPEGLPPLHP

SEQ ID NO: 13608 - protein, 339 aa, Chlorella protothecoides
MHQGVGRIRITHPPLRQIVVAVPLSPSGRDWIKAGRAWRRGLRAAYVADFNADAELRLDGGLHGEEFIYLNSTDIPFHYYGKAAMVPSVAHEHFGQYNYKWMLYGDDDTIWFLDSVVNIVKGRGALQSITWSVVVLGMLLGSPTSAEVPQAMCLGLRQMLHAEAPGPRPQTTPFTSALRSQLRAARPRHAAPDHRPPLVLGPHRGLPLAPRPSGGGCPPLPALRLQHQPPGGAGAALRPAPGLPLLHLAEALRGGRQAALYLWRRLRVQAAGGGSNASRVHSSQARAEGGAELVPAPQDRPQEQRPHMASHPNPSRDPAALRRQSSWRTAAAASSSAWD

SEQ ID NO: 13609 - protein, 170 aa, Chlorella protothecoides
MSAQRGGDEATLMDEGPSLSFGPLVPLAEQGGPGAAPAGPAASTGQPVPVVPQGGHAPSASSPPLPPARGDKLEPAALGDDVAQVSLSTMSRMQAMFQAALRQEIPYSQLEEFLRAHNLLPDGTPAGAGGVTPPRAPTPTQQPGPTGLTDMKSIEAALPEYPAGSHGHRI

SEQ ID NO: 13610 - protein, 225 aa, Chlorella protothecoides
  MOD_RES (81)..(84): Any amino acid
RAGAARRRTPAHAARAGGAAGRRARRGRARAGGGPGAPALRVGGPGESGRGHGGRRPPGLPAQGRDFGMGGVYWRGGKGGXXXXLRFASEAQEKVAGVMADVAPLAYLLKVGIWDGWSVLEGWKGGNSARARAAGMPRPPLLCRAKTPPTTSKHNSCAQFSGEAEAAAVWERVWEESTASVGSGVRLLAAEICREAGAALAGASWGAKRAGAAALAAAAAAAPEA

SEQ ID NO: 13611 - protein, 214 aa, Chlorella protothecoides
  MOD_RES (17)..(20): Any amino acid
MSGQQRADLAKPCPRLXXXXRLRHSQRRGPRMSGQQRADLAKPCPRLRASPASTPPPLPPSRPRPQDQEQGAAHEVHGARAHPAHVPTRLHQPARARLGMLPACAEEWSRAVCTAPWTLHRNLGLACLIPDSGQAHTAPPLPSSNSGFGVLTSAYDRSQRYLPSLTAAQEALDGLLAPGQCSALVQAVVTKYIALSSEELEEWQADAEGCGDCC

SEQ ID NO: 13612 - protein, 224 aa, Chlorella protothecoides
MLERETESVSSALVEAAGQLQVSGCGQVVCSMAGPGCKEGDGSPSHEVDQRRLPRPRALACLEKAWGRKPSSHAVQRSLRHCPRRSAVLQDALPLHLTIAPAPQSPHPCPQTAPLTRETLLLREATYRALGECFSHVRTKVDFPNWYETELRGILQPTPNAGLDAHILQARALWLVGVCGEELGHEPWDEAFGLCAAHISSPDLVVRCWAPEPGWWDPGVAWGG

SEQ ID NO: 13613 - protein, 491 aa, Chlorella protothecoides
MRAGRRGNDEAAWKRWAARLMLTPPQHHTHPYPTHPFALSLPFTAVISMGTEVSEEDVLNVGALCDQVIALSDYRGQLYDYLKSRMAAIAPNLTVLVGELVGARLIAHVGSLVNLAKAPASTIQILGAEKALFRALKTKHETPKYGLIYHASLIGQAAPKNKGKISRVLAAKCALGVRVDALADVSDNGAIGLEARTKVRRVGGRPPRVCRPACATVQGRACPTRAGHKPLSRTPCQEREMGTDAYTGFERGQQRCVCAWHPPRPLPQWAGGGGARPGPHSSVPGPVPGRLQIACLMRRQGGCQTPLRQQFLPTWTHPPPPSPTPAAIVQVEARLRQLEGRQLEGEAARPRGLPGAAPYDAARQGAAPTLLTTPKAYNADADVVAATTEKKKKKKREAEADVVEAEEPTKKKKKKKSGDAGVAVNEEEAEAANGLENGDKAPYPCQETANLSDAFSHKIFDIDDLKSVQRTHPITHPSQKEKKKKKKKADA

SEQ ID NO: 13614 - protein, 917 aa, Chlorella protothecoides
  MOD_RES (40)..(43): Any amino acid
  MOD_RES (372)..(375): Any amino acid
  MOD_RES (420)..(422): Any amino acid
  MOD_RES (455)..(458): Any amino acid
  MOD_RES (634)..(636): Any amino acid
  MOD_RES (809)..(812): Any amino acid
MDDELLRDLLTLDGDFSVRNTSLDAQLGCLYQLCPSIPWXXXXMNGFTCTSWGPAFVESSIVENEDLVLINLCHAPTTQAPPAASAPPAPAPYIPPPIPHPAAAPSQSQAHAAPLHPAAPAGGQSPPAPPAPHPAPAAQGQAPSRTLSRSVAPFLAKFSPAHWHMLFGALHKYDSGSKARLEAIFVQRYPKLKAAAATSTEAYVAVGFKMLEALLEFLPEDRLISFMHKCVEHVAEKKSAALAAAAQQKQQQQQQQHWQQGTGGEGAGAGPSGRPPSAAPQHPLPTQPPGHPQQPQQAKPGQQPLGGYPQQQQGRPPILGQGQRASQGGEVPGVALGRPVGPVSGVGFPGSQGDGQQRLGHPAAGVGPVNPXXXXAAKCRGLPWAGRWVLCLGWASRAATGMGSSALGTQPPASGPSTPXXXEGGREWAEGGRGAGGVGTECLATPASPDGFMDXXXXASSSQARSSPSRGLHGGNPGRGRVHSGRPAAPSVGAWVGRSRWRVRGAGVGTECLATLRRQPVSWIARRMRCRGCAQGCDRCDGEGGSGQREGKRARAASRKDRDGDIDEILGADAFIDMEQETDTLMAGLPGAASYNGACPSWNACTRDPFSFHLGVLQEEHLLAIAGSAPRIPXXXAFLGLLPTTGFARAGLRALQEEHLLAIAGSTSAADAGPGVGGRQPDPERVAAGERVREADARGGAQGPQAGVLRGHPARLPVAGRDPAAARDGGGSPPPGQCKVCDDGGERALVDRKGEGEGAVGGARGQVPEGMRLRLLAVTPQLLEDAHGVACSNAWHTASSSPPMKPTHXXXXLPRQPGVSVTHDPRRGVLGLERAARAAAEAKLAAEREALLKAAGSRRADEETKERAQKAKAELAGRAQASAANAAVAATLGGKGGRFARFERLGAAGLGGKDGPG

SEQ ID NO: 13615 - protein, 342 aa, Chlorella protothecoides
MLHATPTAAPHHAALADDAAAALKLRALSNLADLLHPEGATRTAGERPGAVAVGSVPTCNGTGDALSHVGSIVQVCGSGAASLWARALWAAAGLRHSGARALHPIAAPTRPPPAPQDHWDLVLARALESGAEEAEAVRARALDVMEAVLRCSGGGRGQRGAGGALPPFRLDPGNHRAHRSIGFLLCPRLQSHTPTIREGLVGPWTAVQALGTLACDPGAENAARAVALLGSLVARHAAYVGAERLVQGIQAAPAFLATADAGHGVRAGLGGGWGARAWFVQGWGLRPLNVPACDRAECASCRGPKGMGAECQRTPCDHPPPSSGHPAAGASPGEERPLCLAG

SEQ ID NO: 13616 - protein, 414 aa, Chlorella protothecoides
  MOD_RES (75)..(77): Any amino acid
  MOD_RES (184)..(187): Any amino acid
  MOD_RES (345)..(348): Any amino acid
  MOD_RES (400)..(403): Any amino acid
MVSCRTLELTCPIYNPYQTASMKDMALEMKRMRGQMEDNKDLAVLMAGLRGKNLSQSDFAENDVQVSLVQAWRGXXXQQKLAMPGVMQLLEMVDGVDEEQLPQVYSPAGIQLYWGRRPVAVCRRITQLLSEFGWWTRWCRTVGVQGGLWPSAGASPSYSVSLDVGQGGAGQLVYRVKNPLRSLXXXXLGRLKRTRNCTKNLPLLSTPTTLQNPLRSLHPSPFPQTAIGAGFLFSLGRDALAGTLRDNAVVHAIRLRGILTSLGPAYIKLGQALSIRPDVLPPAAMVEMQKLCDKVPSFDSGIAMAMLSTELGRPWTEVYAELTPEPVAAASLGQVQMGIGSADGXXXXGGGSLAGPGADGDGKRRWGWEAPMGGRESALKGAEELPWVHFRSMTLIFTAXXXXGKHRWVAGRVH

SEQ ID NO: 13617 - protein, 229 aa, Chlorella protothecoides
MTVPSVAAHDGSVPPPSKLIKTGHAPALLVKKLSEYAVLPKRGSVGAAGYDLASAEDVVIPARGKGVAKTDLSIACPPGTYARVAPRSGLAVKNFIDTGAGVVDEDYRGNVGVVLFNHSDVDFHGGLCLLGWGASWQGGRCLFRPHRHVYWVSPHLSCPAQCSEAWRPCGTAHPGGHPDPGGGGGGRAPHHSARRWGLRIDGGQRGPLECCYIEDVECNLPRAQPLSVL

SEQ ID NO: 13618 - protein, 425 aa, Chlorella protothecoides
MLGARRPGEIWNTNSARADVPASPGCHLSKPKDMGDFQHHYALTTSNWGRPAEDADKYALSMFLTDLQVCPLNAPHRPVAESIPVASPQPALPTASSAAPRNGASATLRQSFLDLGQRSFHFVQCPSCGLTYSPGQPDDEALHRQHHAKACRPAVYRAGKGHTTVWSDADASIIQVPHDASQAQVLQACLESRWVHQQGCSGGIVGAASDIRQPDPHSNAGSGDGAGCRMAWAHPAATVVVCRPGVQARPGGGLGRATARPPGRSAFRRPSHSGGTHQPWPLRPDAGALAAGPLPCRRARGVGARLSAPQRRRQPTAGGGAGGRCRAVLSTAERQAGVHRPHGRRAGLCARFPGTGRCIRAAAVHRHGGASGVRRRVTAVTRGRTALWTAHPQASLHDVPTPTAPAELVQRDSAAEAAGLGGSRL

SEQ ID NO: 13619 - protein, 277 aa, Chlorella protothecoides
  MOD_RES (46)..(49): Any amino acid
  MOD_RES (231)..(234): Any amino acid
MRSKTDASADRTIEYGIAHSHVGIVPFERHGQSAGYWSRGGCGGGXXXXYGIAHSHVGIVPIERHGQRTWGPDSALTPSSRLAIGAVAGAAVGGALTFVVVRRHPARSSVGPGQYFLEVKLSCPSEFLTGLRRVSHSAIFLHEACGRNTQQEALRPLYLVMPPIPASSMYSCKHPPLPPPPPSLIGLPMSDGIRMYTNFIASIDTRLRNPKWVIEHLTRSKLKGDGTRPPXXXXTRSKLKGDGTRYVLRVARSPGQPGHKSPSMNHPVGASQASYCL

SEQ ID NO: 13620 - protein, 744 aa, Chlorella protothecoides
MHLTHCGGKITMHSLAPQTRHGVAVRAHNAAPVHVGPLVAPPPMGAYAPHAMSPLDRRAALVGLMGVGYLPWIPVSPASAARSPPSQPVRAYLPPASTPGFVQYTPDEKKTPAIRADVVCQDRHAEALTGERFCWGHTQPAFCYTAVGAHSQYPLGQLLHAPLRRALVRSPLPKSGRGQSTGGKEVHAIDANEGHNSIFDDLFRYSYRPQCDPMQLIVAPLFRLISKAGAQLSDIGPPERAIEKVGNYVTGSSLEAEDDVISATSKTLPDGRTYYIYELNALQAKDGPHILASLTIKGDQAYLFVVSASEKHESESEAASLDDVARGKCSAWLSALLRFEGGVSGIRCSPGPQTGYEDQSSSCQGVGTNLHAAESRRLSSMASLRGASAFVTGGGSGIGRAICVDLAKHGCHVTVADVSDAGARATADLAGPNATPVHCDVASSASQEAAFADHIRRNGGLDIAVLNAGIPERGTGPEEGLWLDLWSLLHPHTLRSPKLTESAAPSSTPPCRSITPPNPASIRRPAQCTGRLLAPHPGHRSGRGAGRHPPGQPGHGPRRRAAGGAAGRPHHRGERRRFLLHALLPRLRCGQGGRGARHALRGQASPRAQHPHLRALPRGELPAGTWHAPRCQPDASGPVSSSSHMHPPACLKPRSPTNTAPVSNKPLHSPSTQFVDTPLVAEARAQSGPQSPFYRATAGTLLTADKVAEAAHVLITDPNRVGQCLVVRMTGEWMEAVPPSQTLQ

SEQ ID NO: 13621 - protein, 528 aa, Chlorella protothecoides
  MOD_RES (68)..(71): Any amino acid
  MOD_RES (262)..(265): Any amino acid
  MOD_RES (327)..(339): Any amino acid
MRSSNRRPMAWRDAHGVPDRFGGPLLVAAPLSMSPYPSRPARRTRRAPLLHPPLPITTQVHPSPRHLXXXXAAPFFPPPSQSSPRYIPRPATSTSPIVPAWREWATQGLAGGRTTRTVMIRRLSNDFRAATRLETRPVPAPGPGQVLLRTVYAGINASDINYTSGKYHASTAAAEAQLPFPSGFEAVSVVAEVGPGVKHPRPGQAVATMVSGSFSDYTLVPARACLDVPGPSPEYVALLTSGLTASIGARGGGRGAASFPRXXXXLLGWADGRGVWHVVKHQCTWGKEGDSGGRGAASFPRRGWQAMGCACILIAREPPLVSGRPSXXXXXXXXXXXXXSKQPHPPVRTAAGLQECGRLRKGETVLITAAAGGAGQFAVQLAKLAGCHVIATVGSEDKARLIRSLGANRAVNYRTEDLKAVLRAEYPRGVDVVWESVGGEWFGTCLNALAQKGRLIVIGAMSQYKGPDGWKPMPHLGLPEKVLNKSTTVTGGHVGWGGKGEEDPDAKDQVPRGVLCRATSHRQGCAEA

SEQ ID NO: 13622 - protein, 259 aa, Chlorella protothecoides
  MOD_RES (203)..(205): Any amino acid
MQVRSIRIPQVGDKFASRHGQKGTIGITYTQEDMPFTAEGIVPDLIINPHAIPSRMTIGHLVEALMSKVAACLGKEGDATPFTAVTVEDISTLLHGCGYQQRGWETMYNGHTGRALAAPIFLNPTYYQRLKHMVDDKIHARGRGPVQILTRQPVEGRARDGGLRFGEMERDCIISHGASAFLKVGGVGGGKSGLGEWVAKGLXXXRLCLPQGGWGGGWGVGVGGVGCQRAASNKQGLCRAGIHGGVPTGRRSCQPRIPF

SEQ ID NO: 13623 - protein, 776 aa, Chlorella protothecoides
MFGDDEDLAVAEDQEIEENDAWYAIVFDACEEWFPAPPLLPPTPTRAVISAYFEEKGLVRQQLDSFNGFINSSLQEIVDENSLITVTPNNQHNPGQSLEEEAESTTYEIKFGQIYLSKPTFVEADGETVAIFPKEARLRNLTYAAPLYVDLEKRVITRRPGLDGEGEESEEHVTPYDKVFLGDVPIMLRSDYCNLHGRSERDLSDLGECPYDQGGYFIINGSEKVLIAQERMANNHVYVFKKSQPSKYAFQAECRSVCEGSVRASSSMSVRMLSRAGAKKGAGQCIRATLPYIRSDIPLLVVFRALGFTADRDILEHIVYDFGDDAMLEALRPSIEEAFPIGDQEVALDYIGKRGTTVGATRERRVAYARDLLEKEFLPHISMEPACETRKAYFLGYVVHRLLLVALGRRDEDDRDHYGNKRLDLGGPLLANLFRALFRKLGKDTRAHVQRCVDRGREINLTAAVNKDTISRGLKYSLATGNWGVLGGPGELRPGVSQVLNRLTYASTLSHLRRINSPIGREGKLAKPRQLHNTQWGMICPAETPEGQACGLVKNLALMTYVSVGCAAGPLLEFLEECATEALEDIAPGVVARATKILVNGVWVGVHRDPGDLVARLRAMRRHVDIETEVGVVHDIPLRELRLTTDAGRCCRPLFIVQDRRLRVRKRDVVALQARDETGFSWDSLIEAGAIEYAGAIEYVDVEEEETTMMAMSIHDLKAAREGEADWGGRACDWSGVQGGGEGGIGAGGWGGAWAVPRECRASYLGVSFAAELLRA

SEQ ID NO: 13624 - protein, 136 aa, Chlorella protothecoides
MYVTNYQVRMDTQGYVLYYPQKPLVTTRSMEYLHFRELPAGINTIVAIACYSGYNQEDSTMMNQSSIDRGIFRSIFFRSYKEFIERPSREITAGMRHGTYDKLDDDGIAAPGTRVSGVWNWEKGQGAGHTCGIHRC

SEQ ID NO: 13625 - protein, 65 aa, Chlorella protothecoides
MPKSHIASAAAAAARLRNLFDAKDVAELVDGIRHGQRLAVSRAITLVESTRPQHKQSVRGTMRCG

SEQ ID NO: 13626 - protein, 126 aa, Chlorella protothecoides
VEALTRAARHLAVQAAAVLRAAAGGELVFEGEPWNGTNVDLIRLAKAHSALLLHRNFLEAVEAAAGELKPATTRALRTLCQLHGVTLLVDAAGDLLEAGYINSEWCCVGGKGRGWSGFPSLVLEEG

SEQ ID NO: 13627 - protein, 162 aa, Chlorella protothecoides
MHQSGSPTTISPLAQTEESYISAAELGRLSGMRAEIVLGTELTLLQGLKFDLIVFSPFNAIEGFMQVMVGEPEESVIQERAQIPGAVEPALLGLQESTADRARRAALAAADALMLTDAPLLFTPGQLALAALRSGFHKVVCDGAHDHAVGQLDAGVWNSIWP

SEQ ID NO: 13628 - protein, 201 aa, Chlorella protothecoides
MREDLPQVVVPRTFPEYTSRRVLTTSWLEGEKLSQSRESDVGSLVNLGVICYLKQLLETGFFHADPHPGNLIRTPDGRLAILDFGLMTQVDEDIRVGMIEAVSHLIHRDYEAIVQDFVTLGFIPPGTNLSPILPVLSKGLSADLAQITFDYPFRIPPYFALIIRAIGEQKMSFILVHKCRIPFGGWRAPGMHLTLVLLGEG

SEQ ID NO: 13629 - protein, 89 aa, Chlorella protothecoides
MPWQAALGAGAPVLAPQVSPEDEQIMQSMSRVVAYLSGRDAGPGSLDLDLLRGLEPQLAAVASRMAPDLGQRLLSRVAARALRRGAGYD

SEQ ID NO: 13630 - protein, 268 aa, Chlorella protothecoides
MPRHARAGGEEIDEAGEGPSPRLFSIDVQIRTAAMQHLAEYGVAVDCWQGAEVAQAPPSAEPAQPVADLASRLWPLWGWLGWAGAPAGERQGAAGGASGNGSRAGSGVPATNGSQATNGSPATNGSRPSVSGAANGRQVTTAARVAPWNGSSGSDAGALAWNGGSEAEGGGLMLQARLDAGAMSRRINWLNSIRQWQEEFLGTLTGTPRRLPRSIVLWRVMSAAAPVGSPSGSRLLRAMEFVQCVTDDLLGRGVFVFTPSGQIKRMPR

SEQ ID NO: 13631 - protein, 421 aa, Chlorella protothecoides
MALGFHAASPDCAQDCPALLLATRALLFMDHASRPGLLHDTVEDCGDVVGLDEIGFHFGPGVRRIVEGETKFSKLPTRPAEAGEGGLGAAAALRPPGSSGGDSRAEDMRFLFLAMTEEVRIIIVKLADRLHNMRTMRSMPGPKQTRIARETLQVGKQGGGGEVEAGVWNGADGVCPAGPPAGPVCGEGGAGGPGLPLRLAGAPPLHPAPGGAAVARAGRHAGGRARRAGLRAGRRPADPRRRAGRGCARALPLALLHLAQDGGGGAKRARRERRLPAGRGAEPWPGSRGCGQRVRGEGVRGVLGYVGGNRDCLGAGIPREKGRLGSCMHAGTWVGNVRSLTSLVEEDGVGVGGRQVAGPTRPRIPHQAFLGTHSVSVSSILHQLMYPLHTHPPMQYQRQPDVLPYPGPGAQHVDPHPRHVS

SEQ ID NO: 13632 - protein, 382 aa, Chlorella protothecoides
MPQRVVGACRPGCVCAGLDKRLPAALCLIPDLTQTMSRIESVLPFDASTLNMSCLQQRPGQSNHWGSVPPGCCSASTRWYWAKKRSAIPPAPPSSCPSLPLDFLVSTQGGPRSGGPAGLCPAGPAGDGDRGHSPGPGGGRGGEATPLLGFQGRESVAVPCFAVHSQAGEGWPSEEPVFYLQEDGAEGGPPRAGTGRPGTAPHRGRHGGQGPAPGLVACLQWPSSSRASLPSWPPESTQRPDPCPSPSPNHTHTHPGRSREDEAIAVCYRLQALVHRLWKRVPGEDDDYISQPKVGTEGRGGEGRLDSMPVGAQQGRGAEGVVCQGPPRPAACCEGITFPLLNPNKPSAVGVPVPPHGGAGSGGRGHGGPDPDLHHARPGRVR

SEQ ID NO: 13633 - protein, 333 aa, Chlorella protothecoides
MGLLLYSQLLSPLHSPADPFLLLHQQTNASKTAKAAKPRIKKAAATVADEVKPAAAEAKEAVTDVAKTAQKKGKPAIDKALKSAKPAAEKAVKKAKPAVNKAIKKAKPAVNKAIKDAKPIVDAAVKKAKPVVNKVVEEAKPVVDAAVKKAKPVVIKAAKTTGNAVAGAAKSAAQQAGAAGEKLKTAAARKIKPAVDAAAKTSAPKALSAKKAGVKKAKPAAPKKAIQQHNRGTRQSRERGGQRRVSPPTARTSAGPAPRSGQPPVMRCVCVVEHTRRREWKQGHQRPRRRPMHVVMPPMRPPLTHIIPAHLMRPAELGERLRHRHPVGAPNGG

SEQ ID NO: 13634 - protein, 148 aa, Chlorella protothecoides
MERGAPAALFACLAGNHANLTGAGDGDGTGSGPGPMLGSTDEIVAKLAVSSVLRFSVWPCGREAVAAVQDGTFKPEHAALVQALALTAPAVLGPGLRAAVLEALARPQDVDRPATAAAGECLAGLVASGVPFEDGEGEGEVGEGCGGK

SEQ ID NO: 13635 - protein, 164 aa, Chlorella protothecoides
MQHAKHSVNVILGSMATLITAAAAAGVGGTIALNSKPRMLAERREERRGGGHVKFPELLYGVDVSDSRLLNRPRFQAAAELAAEAHAGQVDVHPAYGFGRWHRCWMGMSLTVVLDVGVGWKMSSPVLLQRSPQVRKTREPYITHCIETARIMEALLCPSEPDAR

SEQ ID NO: 13636 - protein, 358 aa, Chlorella protothecoides
GAGAGAGAAAAGPEALGTHPLLNAAGNAVFFGGVAAASFFGYYYWRYEVDELEALVESTSRPENAFPGSGAWAAVMGWYVERRRALEGEVKKYADPPSDKLLPDLPPAARHIKTLVLDLDHLLVHSHWTRERGWRCYKRPGAEEFIAGMAQYYELVVYTDKLCTYVDPILDRLDPQRLIQYRLYRDSNQWENNEHVRDLTKLNRDLAQVLFLTADPEARFNPPENGIRCTVPWQPVNHVRCTSIPTRLPSPNPPSHKTPAEAVEEGAGGHGTGGHAALPGGGGGHPCARRASHRGRLCRGGGHPPGLQGAHGSRDRAARAAAGGGPRPALWPGRRQVRACPGRRTQRHCRTAAAEGCR

SEQ ID NO: 13637 - protein, 238 aa, Chlorella protothecoides
  MOD_RES (39)..(53): Any amino acid
MNRVCNSLPLANNTLASPKRSAPPTAPNPHPQPAHHPPXXXXXXXXXXXXXXXGKPVPHVYCIGDANGKYMLAHAASAQGISAVENIVGRPHVLNHRSVPAACFTHPEVAFVGLTEEAAREEAAAGGWAEAVAVAKTYFKGNSKALAEGESDGLGKLIYRRDTGEILGVHLYGLHAADLIHEFSNALAQRQSVQDLYFNVHAHPTVSEVGVVGCYYSGRGVGGEKGMRCVGWAEERGH

SEQ ID NO: 13638 - protein, 663 aa, Chlorella protothecoides
  MOD_RES (12)..(15): Any amino acid
  MOD_RES (146)..(149): Any amino acid
  MOD_RES (349)..(352): Any amino acid
  MOD_RES (427)..(429): Any amino acid
  MOD_RES (610)..(612): Any amino acid
MCLLCNRTASPXXXXSSGASGLHLVGRGLVHAQCFHGSACLCLATLVALHSSHAPSVQSHRVSQPLPPNPKVFIIGEEVGEYQGAYKITRGLLQKYGAKRVKDTPITEASSWWEGWLGCLRCGGDAWKSSMSLTYNGRLHWHCGGXXXXFMSLTYNGMPTFHAIKRSAVFPPRQNQPLKAFPLPPSDSPLPLPLPLQAGFTGIAVGSAFQGLKPVVEFMTFNFSMQAIDQIVNSAAKHHYMSAGQITCPIVFRGPNGPAAGVAAQHSQDFAPWYASVPGLKVIVPYDAEDNRGLLKAAIRDPDPVVFLENEIMYGESFEVSEEVLDKDFVLPIGKAKLLAIVGDWMLLXXXXPGQGFCAAHWQGQGILRGDASRRCPAHAKGEIEVLIARHYVGLMHLQCPTHPSTPVPKPQTPNPAPTDPEGRHRXXXMRGDASRRCPAHAKGAIEILIARHYMGLMHLQSAGSRDDCGEREENPPAAHRGGGLAAARPGLRDHCGGGGGGLRRPGRTAGEGVRRGDPHAIRHAAGGRRAAARLRHRARRAPHVQPGVTKTPDGSGGGGKAAAAAAAAMLGGEGTIHPEIQGMAPPSPCVRVNPVTLARVMGGCWCDAXXXGSGGGKAAAAAAAAMLGEGTIHPEIQGMALHHPVSVCEPSDVEESDGRLLV

SEQ ID NO: 13639 - protein, 353 aa, Chlorella protothecoides
MPCACVADGVCDKAPALTQWYKYVQQINLRRSLNQLPISPRPSLFRHRARHTIQDFVLSYLPYHGLSLVDFLKWWDVLVWVEGTIYAMDEGNEELTADMLGSEPGNGGVVQVDPSHQVLRETLDSSQSASPVERSSSSFLGMTAGFATIGSVLEGLGLYSAHVADELKKVNAKERNVADRTLPCSVGTIACFATIRGVLEGLGLYSAHVADELKKVSSSSPVLGPARCPIPHTPPFPSGPSQGLEYWEGERRLCAAMAAQPCIPKGGSAMLSTGQLHAVSAKKSFDYRVLHHLLCGLCGIERNNVAPLFEFLALDEWLVDIGDDLVDYEDDVLRSVGGSILGAWTGVSHLVSL

SEQ ID NO: 13640 - protein, 476 aa, Chlorella protothecoides
  MOD_RES (184)..(187): Any amino acid
MHRLQGRVALQIAIVTGTSIIREADITPLGPRPCPCWTPCHQDGDQRPRAEGAGEAGDLAGVGRGGRGWAAGRACHRSVLRSSSFSSSQDLSTLDVTKLTPLSPEVISRQATINIGEGEGLIQETHYKAQGPAGKAVPCMLSSQPSTLSPAAITISSPSLHHLTSPANPPGTIGHVAHGKSTVXXXXAVPCMLSIQPSTLSPSAITISSPSTHHLTSPPNPPGTIGHVAHGKSTVVKAISGVQTVRFKNELERNITIKLGYANAKIYACSDPACPRPATYRAYGSGKEDAPPCEVPGFEGVPMQLLRHVSFVDCPGHDILMATMLNGAAVMDGALLLVAANEPCPQPQTSEHLAAVEIMRLRHILILQNKVDLVTESAAVNQAEAIARFVQGTIAEPAPVVPVSAQLKYNVDAVCEYLVKKIPVPVRDFVSPPQASWRFEGFAGGFFGAGSLLEEMNRRSVKGGRWEVSGGGQAPR

SEQ ID NO: 13641 - protein, 148 aa, Chlorella protothecoides
MIVIRSFDVNKPGSEVDELKGGVAGGSILQVGVCGEGGGSDNLVSALCGCGWMDGGWSVGRLPCGCGPVLNGGVFPGKAPGSGAFHVLQCCAFLPPTLRLSSSFPLFVLLRSSLLAPPSLLPPPFHVPGPLRRTHGAPDKKQRPQIMA

SEQ ID NO: 13642 - protein, 140 aa, Chlorella protothecoides
MKALAAALTRLERKEVSLAQAAAAGQGADATRKKADLLMAHAHLWSPGATSLEVEDWDQPGTTVTLPLDAKESAVEAAEKLYARARKVQRGAATVQPLLEAARSQIQQLRETRVLLEQLEVPADAGVLKEVQVRVGTCRI

SEQ ID NO: 13643 - protein, 100 aa, Chlorella protothecoides
MHARGAPGAHLLLRLNRGQSPPNEDLGFCADLAAWFSSARGSTAVDVTVAWARDVSKPRGAAKGRVTVKKEMAVLQGRPDREERWAAAAEERAAGHHADG

SEQ ID NO: 13644 - protein, 371 aa, Chlorella protothecoides
MAMLARATRILPHGFTSLREWHGSRLACRAAPHPPAPPAPATDYTLLSACVRALEAGWTPSRVDTVVQVSGTSLALALRTAEAHTWLHLSWHPRHGHLGLGPPPPRRGDPLLDSHALGAVLKAQLAGLVLTRAALVLAWERLVRLDLEAPQGGSDSRRRIYLELTGRHANLAVTDSDDVILAAGHQVRCGAHGTGAWHGLAGGAVGPAQSAARPLQVGARYLPPPAARGLDPEQCPGLAEWQAAVQGTLDVQQAPCSCAAALAKTFRGVGSGVAGEVWEAAGEVGPQGPSRDQWAAAHAAWLRWVSAVRVGELRGAQLPDGSWRWLGAGADVQHTGSEGTCDVLHAVHAAQTTQLEEAAFEKVGQWDGGLG

SEQ ID NO: 13645 - protein, 208 aa, Chlorella protothecoides
MCKRATIGIAPSVYVQNKTDAGLQEALVNLLTKHGLSKSSERKAPLKSSVCIPCNPGSDAVEAVARRLAKERDLDGIDTSNIVSGGRRRQPVQAPRTYKCVVASALDWKAWSLALLGLEVCNYPGARLFPLQRPLLCRAASDSEDSSSSEEDPESDSDGVQGLPSAMHLSMDTWCGCNTGPAVTQGKPANKTHLRISPKPGQDFGTPT

SEQ ID NO: 13646 - protein, 578 aa, Chlorella protothecoides
  MOD_RES (140)..(142): Any amino acid
MAPRSDGRFLSSGYEAQSATEPLPGDNRDLSADAQSADDRHIVEWMNCRKSALHPLARHHALGVRHIMPVWTSRMTSHIRILKRAAGAMTRNGQVWTSRMISHIRILQRAAGERTRTGQGFGTQDPKYTPCQQGEAVRSXXXCYTAASTACNVFMFQGKLCGAAHHSLVHVHDSLRKAWKGGNVASQGQLPPSLGTFDTGTFDTVNTMTMSCTMHTTQSLCSRPSLRPWQPAVHSCKRMQGPSRLAPARHARHLARAITQDEPTDPSEAASSAPSRLPLGAWGSTALMLAMAPPSSAQEMISGSPPASSYYVSLGLFVITIPGLWSLIKRAPRATVKRKVDGPAVEGAMAPGARARQILEYFMRYNYEVKDMGEVITFEGNYRASAACTLAAPDKAICGLRDAVWSLHEHCQLALWLRPVKRSVLYKALCGPQSYGLRVFETVILCCMRLKPCDPVDLIRPGCVAGGLHIHWPGQHLPGALHRRALGRQLVVCAGPGQPGCGMVLLEECFQVLERRKGGKENPVRLDLTEQMRVKMVTADDQSTTDIVVEGDQEEIERFYKELGLTEKGKIYVKGVLE

SEQ ID NO: 13647 - protein, 209 aa, Chlorella protothecoides
MRDSMIDLAKRMTEIKEVLDAHTATDAVSDAERLLEELLDIVESIDAARDLATIGGLPTLTQLLASPAPGLRWRAAEVAAACVQNNPEVQASFLAAPGLTERLVALLADADADCRTKALLALASLVRGHEPAMRWWLESAAGTQTLVRMLRNDPDARVRRKAAQLLGYCLGVDAAQAPLAASEGLLGALCRALSDEADAATREAAADLG

SEQ ID NO: 13648 - protein, 265 aa, Chlorella protothecoides
  MOD_RES (20)..(23): Any amino acid
  MOD_RES (173)..(176): Any amino acid
MGTLQRLPGIVGQGEGHQSXXXXQEVDLAVIADMGTLQRLPGIVGQGEGHQSEEGQSLAGSSRRARELALTARQISGLEAEGMGLVSATLADPAALSQHGLAVARSIAAKPPVAVAGTKHVLLYQRTAQVRKALLVWAAYEVLRSFGSSDTLGPLFPLPDTEITAWQTGWTMXXXXIIARGMSTALGQHGSSEKALLVWATYEVLRSLGSSDTLDPLFPPPDRDHSVADGLDYVSAWNASMLNSSDFVEVFSAAKEKRKPVFSKL

SEQ ID NO: 13649 - protein, 289 aa, Chlorella protothecoides
MQAPRVPWRGSVGLPSPIRPLSFPRQRRCHAPRRAEPSKPADVLLKLRESVQSRLTVSELSEPGYEGLDPLPEFNPPAAVGGATYEVMRLDPAEGPRRLCVRRRDLLRAHRLAPRDLRQLDHDSSASRAPPRVVLKDGCVLMNLGGVRGGLAAGREERQECRVFRIPPKAPGAFRVVQAAAHGGKALGMKRASWRRQPQPRKPLLSTHTRRAIIEADRCLVFDPDTPPATHFLDMTLPKLEGTRVGLASAAGRGEAKGGAAGFESDQASLPFELEILEGGLAIATGEVA

SEQ ID NO: 13650 - protein, 117 aa, Chlorella protothecoides
MVGFGVAEATGVLLRRRAGHHEPPEVGVPTMRGRIMQEEEERELEEVEDLLEYYRQRAAMTQVGGLLRGPRLSIRSEAERLLEGARDLEESIGVSLSARRFEVGRLGLVGKDGGAPG

SEQ ID NO: 13651 - protein, 244 aa, Chlorella protothecoides
MAGAGLGEVLPEVLQQQARIDDPHAAQRKAFHRRVKGSLPPLTPEERYRFRMAGAGPECDPQPHILRSPSPSPLPGAGLGHIPRLSLGRDRFNIPQGSGAGQAEAPGSGAGQAAAPARALSPEAVEVARRTYVAGLRALVYGTLLGFGALALAGTYVAQAMELGQPGADAGRSVRSALEPTTRRLRDGAARLRAALGGWAARESGEWEPRSEFQQRMMARYNPGSLGGRGDGEFRAPGREWREP

SEQ ID NO: 13652 - protein, 425 aa, Chlorella protothecoides
MLRAATHSPHPAKAWEMLSQCLTAVDDHIAALDAATSAVAADPGWHVTLRTLGRCRLNLGDLEGAAAALSAACRGAGPSSDEESRADLEHVGRLLQRRVGHAIGIPGLVLANTAGEGPSGLVWDAGRVLAAWLVQAYAPWVESGGAVGAGCGPGGCRLDEILHCCRREKQGTLRPGCGVGCDASLCGDPSASGHTHRSRVSERSDPADSDHAPKTVVPNCTPTSPRNAANLLQHVTLLELGSGTGVVGLSAACLGARVTLTDLPEAAAALRANAAANRALVERGGGSVAVRPLAWQEAEGSAVAAEGYDLVLGADLVYNDAGLGALEAALRALALFCGGPRERRPSAFLYAHKARHPGLDAELVRMLDGVGLWHEVLARQPQDKVTIYLCTECAVVDDASLEGATRLGCLLFHRSKRTVSPLRAS

SEQ ID NO: 13653 - protein, 198 aa, Chlorella protothecoides
MVSEYNATMAAKMGWSSTRSGLNPFEYHPERGIYYHYLTSDLLLGSQPRSPGDVAHLAKDEGVDAILNLQQDRDLRHWGVDLASLRHAASEHGVQYMRAPAVDFDPGSLRHALPTAVGMLLEALSQGRRVFVHCTAGLGRAPAACIAAIYWAGLGVLPARDGLVRLEDAYKYVTDIRPCGPNQVRRGWGVASFGEGRL

SEQ ID NO: 13654 - protein, 124 aa, Chlorella protothecoides
MPPQEATFPKPHAVVKTATALVRHISLAVEPGAAPGSGPARPLIVARAQRAWLPSSRLWLFRPRLDTHACGGWSFRLSPHAARHGVHAHLLILLAAFESLDAELAERQPSWGQAAKQRLLALMK

SEQ ID NO: 13655 - protein, 128 aa, Chlorella protothecoides
MSLQTLTPQASAIATASGKGEALAKAAAQAVSTGGASANATAKAISQGTGTTVDPGAITKVEATSQALNDGQEGLVEAVVVANSGAFSEVKTSTASALATAVADVCGGGSASAEAKAIAEAVSKVSPV

SEQ ID NO: 13656 - protein, 825 aa, Chlorella protothecoides
  MOD_RES (405)..(408): Any amino acid
  MOD_RES (432)..(435): Any amino acid
  MOD_RES (456)..(459): Any amino acid
  MOD_RES (724)..(727): Any amino acid
  MOD_RES (806)..(809): Any amino acid
MTVASQDTRFRSLPAWFKPGEFADPAFSAATYVADLQQYVPLEVLHQELQAHLSVLHGDLVEVINKDYEGFLHLTSRLTSVQGAVKRIEGPLAVIHRQPGLMSHELSGGKGSSQWAQGYRARRHGRLHYCCPWSLLERKARASATRDALLAESHALTRGLAARADAAASRGLLELMQDLTHVLSKVDKLLAELPPPGDAFLGKHSSPEAVEGQCHVLNRVTAEVARLQYQVKKGQDLAFVQTLAPRIIAAADRLQVPGEGGCGVIWFLACRSCRRLGGLGRTLQHARTMRGIELAYPVAGWGGVGRTLEHARTTRGIELACMRHGTRSRRPSVRSDNIRQNDWGPAFPRLLPRPPWQTYLDLALEAAIRQQVPTALGACLNSYASINRPQAAEQVPTQGSGKARXXXXSYASINRPQAAEQVPTRGSRKARXXXXLQKLALGGCARNHAPGVLPPXXXXLGSRVLACEQAAALEPLRCCRVVAQHACRACNAAAKACPRRVRTQSCSGGCDRPLAVPVVRSTLTRPLVEQTLAALRETTPGAAGAAAPAQRPGSGAAPAAVPPAVPLPAFLEALTRGMADELGPFLAHAMATSSGVHAFEFLGNGVLAEVLEAVQARCGADLSPGVPHAFHVGARAGDAFLEALESHATAQAQVARFRACQPYSAFMKLWNLPVYFSLQFQVGAGTGHMEGLLWGGVGLSGLELAPRAMQRRCSSPLPLCAVCXXXXMEGLLWGGVGLSGLELTPRAMPRRCSSPLPLGAVCSPQDMWGLSTAWAEECEAETAWQAAAVPGLSRWAATLDRGSVDXXXXGNMRPILQRSRLGIAV

SEQ ID NO: 13657 - protein, 316 aa, Chlorella protothecoides
MHPGKATLEGVSEAALSVQTQGGDMSLGKVKASSLTARSGGGRIFGSLVGHTVRIESEGGNVTLGNLSGEDVSVATRGGSVQAAAAYAAQLSVSSGEGCSAWFCGIGALQLLESCKTHPGCNGYGRHAIDMANTHWGCAGSLLKLPTSFITGGGPITVDSMRCGSASLESGGGTIEVSSLDGDAVIRSGGGAIQVGTSALRVHAQPNAGNLRLYSEGGPVHLAWSSTLVGTVTVAACGSLLLPLGCEVEEGRGGMRVISPTGVRYFAPGANPGCSWTDSVSGPTRGCTLLVDTGGFWWCGTGARGCLRDSPAFSMV

SEQ ID NO: 13658 - protein, 693 aa, Chlorella protothecoides
  MOD_RES (537)..(540): Any amino acid
MASMVAPRLRHTSKIDIAPRSHRSVWQQIRKPNSAKRGRRLACPRGIPGGCRASRLSTGQPTSQPNSVFWQQAVEMQRALPVRGAQWATWGPTFADSRASVASTGSRHLHASFLINWDMRRGPGPGNMTVPEVVIPEAAYENVRTGCAPGLRQRPGWFNGAFELPSWRLVSTAPHPCLQEPSTPSGRAPLGGGETPGSVPRSPALDGLADHADRFQLDAFNRARLSGSSGKGLGRLLGFARSPRPAAAAASPGTPEHLTLSTDDLLVFSEEGLPTSLLKHGSDNAGRAVKMFSSILTYQGVHGDALPPLAGLELIQKLLHQGLKRAELRDELYMQLIKQTRGGPGGAPTLRAWQLLLVVAASMPPGRDFTGLVSEYVHTASRDEAEDEGVRALAARTWAALKRTTKAGQRRTLPEMAEIDALLKGVRGATVVYFLDETFEEVAYDMSTTVAEAVEAIASQIKLEHYQTFSLFSVHKVGGGVRRGLVRRWLVRRWWEDEVGGDGATDLCQLCGGTPIPASDVARPRPSQCPLPPSPRXXXXDEVGGDGATGLCQLCGGTPMPASDVARPCPSQCPLPPSHRTQSAEQGRAAAGHGGRRGRAGVPGRHALHRRRSVRLQGGQGQGGHRAAPALPQEDVPRDRRGHHRAALHGPVLHPGPARLPGGTGWEPVWRGIFAEVARGRGWAGDAGMTGAQ

SEQ ID NO: 13659 - protein, 216 aa, Chlorella protothecoides
  MOD_RES (129)..(131): Any amino acid
MEISEARQLIRDLGAIDVTQIGSPSWTRQHDALQRLTTMAQLQARCQEDEWVVDLLHVSGKMDVLITDLLSHEMTRAQLLKCIGINLNSTAAWVFHRLAPAASASNSSRPCLNRHGALMSCLLCSRRLXXXHLHQLELNRCIGLPSARTHSLCIKLLSPKPQQAWCTHVLPSLLEEAQASECNTVNIALYSLQSHSGVLAALLEVAFFHEVGRARV

SEQ ID NO: 13660 - protein, 69 aa, Chlorella protothecoides
MQADRDALHKTLHSRHVMYAFNHRKPMSCPAMAQLLSNTLYYKRFFPYYTFNICAGLDEEGAPGGLRES

SEQ ID NO: 13661 - protein, 449 aa, Chlorella protothecoides
  MOD_RES (372)..(374): Any amino acid
MTAVWFACRCCPSPPIRVELSSSTHAGRGAVYTYDAIGSYERVGYGCQGSGKELMQPVLDSQLKAASPLLLPPQVLGGWVLGTLQGIVVMLGELARSGETCRRALGRCELIHPPQTLQPWLSSLPLEVAIDLVKSAFTSAGERDIYTHLPGLLAITGRRRGDPHHDQGRRGGADPGTETRLIHALVQPQPLVGEKRECPGIGCGRGAQTWEQRHGCDILSSTMSYESLNSCQHGVRNSSACSIPAPPAPAVSPQWWPALLDPVSLSKATYTANAAMPMPNPGIITLWLPVSKGCWRHFSAARQLYAMAPRLSSPVPPNWMSTDYSLRISRRCRQWLQIKNNSGHHHSEIESDEAARPCECSCCSLAPLHQAXXXRDQNSTLLDQTAVNGSKSKTTLDIIILRLNAMKLQGHASVSAVVWPLSTRPRAAVAQGSRSLRGCEHAEAASWEI

SEQ ID NO: 13662 - protein, 447 aa, Chlorella protothecoides
  MOD_RES (79)..(82): Any amino acid
MQPCGGAIPICMVDEFSLPPEIIDRRVTKMKMISPSNREVDVGKTLNDKEWIGMCRREVRQVWQNHPCTSISPATVISXXXXLNDKEWIGMCRREVRRVWAESSLLDLEGSTAAKGQTLLHLASNSPQHPATPHALSPKVLDDYLRNRAQDLGANVINGLFMRMDQAPGDGPFTLHYNKYDGVSKVGKPSTLEVDAVIGADGANSRVAKEIGAGDYDFAIAFQERIRIPEDKMEYYKDLAEMYVGDDVSPDFYGWVFPKYDHVAVGTGTVVNKTAIKQYQQATRDRSRVKTEGGTIIRVEAHPIPEHPRPRRVKGRVALVGDAAGYVTKCSGEGIYFAAKSGRMAAEAIVQASARGQRMVGEADLRVYLDKWDKQYWATYKVLDILQKVFYRSNPAREAFVEMCESDYVQKMTFDSYLYKTGEGGWEWILCLFDMVVGCLRKHAKDC

SEQ ID NO: 13663 - protein, 272 aa, Chlorella protothecoides
MGDAVLRDVHQAAPAALCHLSAALFHAGGGPRPHQLEQGGPPARSAGHGQDLALQGPGPEAVHSPHAAVRPGWTGFGRRERSIDACDGPRISVIAAPCAHRVETCQRAPRVAPMVSLRAASSRPSLMHPLWFSQGILIEVNAHSLFSKWFSESGKLIGRLFAKIQEVVEDASSLVFVLIDEVESLTAARKSAVGGSEPTDAIRAVNAILTQLDALKRHPNVMVLTTSNITGGSAVWRVHARSEASVMLVTSGREDGHANIRLLRYVPNAGKG

SEQ ID NO: 13664 - protein, 551 aa, Chlorella protothecoides
MHLLYSSHTHRLWLVRVPKPPEVTALAALEQELAAYTQQVKLLNESASVKKDHFPGRGPYQAVTLRRVMRRQPTHVQGRPPPPLFCQVARDDARKDTQAAREAYRLCRDAYNACMEVVIPLREAARGSAGAGPRRLRESYPELEVWSVAELDERLAGMEYRLQHESVPLAEEKRLVAGLKRLAGQRARVAEYEAAAGAARDPALLADAARARAALAEAEEEARALREERAAQKEVLDGFWEAERAVDAEVEAILAERRRLKELQDEAYARVSEVRRAHRERKDAYYSSRRHSTGVRALLREPGGVEKARAMCVEQVDRQLAVLRDNDDYRAGAWGVCVCGGMGREEFEKGGGDGGVQVKGPHKSLVTPTPITTTHAEYLTLIEQQRGRPSTWEEGEEAGNGAKRGHSRQPSLPLTEEETKERAQGVSRGTGGWGGSGRGRCMHAEPIRCPGRGAGRAWHPLGTPRCHTNSRSSRSLHLVATPPQTIAATIAAVLEQARSRVVDLKHAAAAATAAAAPHPVAVEVAVPVAPAEPRAMPKKAPRAEPAHPEPE

SEQ ID NO: 13665 - protein, 241 aa, Chlorella protothecoides
MGPEPLRGTREIHPRQELCDGTACAVPINTPNRRAVEKDVAELARSATLRLRGIRLCSSGRGEAGATHLVVGRERRTIKLLLALANGAWLVTPQWITASLDAGEWLPVRQFPVGERFRAAAERSRSARERGAALLAGQRLYIHARTGSGTARPRKSDASVERREGGAASAADLGSLRRLAGALGAEVRGPGGCYDPVVAAHVTFARGDGVLHGGVRDDQGSGPLKSAVGRLYVHGRVGDHA

SEQ ID NO: 13666 - protein, 157 aa, Chlorella protothecoides
MESPRSQAGLGIKASEANKNTNWLDSPAAWVYYVALLLLSWLLVSSFTDPGIAWTYVHIAHGVLTYIIFHWVKGSPIANDQGVYDSQTFWEQIDDGQQFTPARKFLTAVPVVLFLLASNGTDYRRQPLGVNLIVVIVLVIAKLASMHRVRILGINKY

SEQ ID NO: 13667 - protein, 535 aa, Chlorella protothecoides
MTLFGLAWSSEDRLEEAAAAYAAAIGLAEDARELHREQAKNGVRVRQVVIACLPLAAVLGSSAPALHHASYFPQESMDVLNPSLHRARRDLSQILLKMGRQDEAVALLVTSARQLCGLAADTEARTLAAGVTRAALAAAVAGEDGSAGETRPAQQDKLEVRAGVVSFDRAGLGGRPHPVDACGHRGLQASHCKRQSNPWSICRDPQPTTLRILQLVHSARRSAIRSLWEAADLLAPPEGAAGAAEQAEQLLQEAIQMAGEGYGRQSMVFVQCLDALARFSRRQSRLEEALLLYRHQLAILDGFRAYELPMVQHRAWGAGSCPGHRKELSSGHHKPRLAACLAPSELVSWHYPAPLPSVHRASAEALDQLGETGTAVDYANQALLQAQALVKVGSEPQQRAAAAALEPLFTLVAELKEKVCRGAVRWNGKSLITIAPRAPSLCLAKRASNPTRMADGGQGGRQEGAAEHAASPLGEEAADVHFAGKEGAQGDSSEQAQGSGFMIDTAMTVPCIGIKLVFQLGVRAWKTVPSSCPVV

SEQ ID NO: 13668 - protein, 90 aa, Chlorella protothecoides
MHSCRAFPAEAIDVAFVDRADIKAYIGPPNLEARYAILASCLSELDRAGIVRDMGSIPGFSHALRLGTVMDEGGAEGLADHVARCLGPIS

SEQ ID NO: 13669 - protein, 614 aa, Chlorella protothecoides
MEGRAAAHAARAGLRTLRRCRDLAGVWSWPAVLPLLRHSSPGVRWAGIHLTAVLLGLADADVRGLEARLLSPEELAAERRVWQEEAAAFAVEAAAALAPWDRGRARPASRKRKATRSILAGDGSNSDTSSSERFSGDEGVSSSASGGKAGPQPTLAVPGYVRIAGVDLPQSTGPGPAPPMTLPASRLVSTPGMLRTLRGVALGLCAASPVLLEGPPGSGKSTLLRHLEEVTGSAAGAIHLHLDDQTDSKGLMGAYVCTARPGEFVWRAGPLTQAVAQGRWLVVEDINLAPPEVLAALIPLAERRQLHVAARGQTLTAHPGFQLFATVTSTPQGVGAGAYGSSAAVVDMLGGLFHHVKSEAGRGWLEWRWRRACMRGMGGEIGGQRGAPPLTLAGSSSERALPCTATSSLIIPLPFYLTRAADAPGEEDQAIILRTLYPALGPTLLGTALRMLYLARAMYGQLPADECPSWLPAEYGSLPSLQGVGRHFSLRDLARWAARMGAVHARALAAAGSLLGTRQATSPVAAGYLDAGSALHSLPAGLRLAACMEACDMFAGFLADEHDAGAVRTVLSTLWCVVPAKVEHAALAARPTLARTAAALAVGRATLPATGPPP

SEQ ID NO: 13670 - protein, 707 aa, Chlorella protothecoides
MAGKVRAGSRRHSCTADTVMPGRTSAGYGEGRNVGEMCNRALATHLFNHACAFNTPGHHQRTHLELEQAVHGGQTAGGGASHQQPLEIVYHIHSRSMTTSGRGYGPSPRGRRLPSAPATQESPWALADDKPGWGNEGYSFLMINRKLTGLGSRSVGEGRWCKVLACMDIGSTGTLRAREMFTAASGQRDRGRILCYRPTSTQIVNALPGSGSRLQRCQYGFWHHDLASAQLKGAEYMFGALLLTLSAECCPWWGPCLRHSFGAQEGCIKGTSFRSVVFISSLTAVQSVTLPEIQMTDRRPLQNPPPKPAIHGVQPPPLPGPGRSVPTGVTHDGALYIPVALGPPSLYAQLMIHTDTEFFDTSQCTRPIREAGAGGSESWQAPLNQEPSASQTAPTASSSQDTPRTACINWNLEKVTSLDMEECQHRQAGTGLNNRSGYRGVRKRPWGKWAAEIRDPHRPTRRWLGTFDVPAEVKPHCIALALSRAARAYDAAAVAIRGPNARTNFIYPFELHSIPPQPSPAKSAEVKRATSEPAARTPGASSSHPQPVVLGAAPFGVELMGSSLPFLFTQHPAIQSYPQQHQPVAAWNQPAVPAHQLLSSLPQVLGTSLHVAAPTLKPAIPATLAPHSVGLHRGAQGSAHVICCRDWEAPASRRCTGLKDRMPSATLRHIHLAPMSRRVQWRCPPLQHPGPHLSRVPLHTSRTRMSS

SEQ ID NO: 13671 - protein, 563 aa, Chlorella protothecoides
MRDACSELIDAVAHVGFLNESEAFSSGQPHHDVQILEDIVKEGPESDRVLSIMAYAYKDADRCCRWWRHGALLTPISGSLSAVPAAYLSECLLEQVGGHPVGLHSSCSSTSRGRGDAEGIVWGVCQLIGLGISPRGAADSIQGMHTPHSLISSAGDFTKQQATALQLIKLSPDAVNYLWWAAVSAAMQARASIQGQASALPTASLLTLAGRLMDRALDRTPPGAFTFEMLLVVLDVLLASGQHARAAALLEGSRARKACTSPTDLSFLCAAVAAGAGEQEAAARRCREVLTVSPHDWAAARLCLDCLLAQGGSGRTLRCRWPVWVVGGLTDTLLEREPGSQEDQTAPEPLGEVQRRVLADWSDEWGSNLPPSDCSGSASPGPLLRATHLALLDGLARGLTARHAEQVSTEPSGPADKDLAKQISSAFRTLSTLGNVVLDLGPYLAILGGAEAQSLADEAKAIGEELWANSSGAGNTGTRTGAWGLMTARETCDSDEHYERHDDKRTQEAGLQALSNGYQVGCGMLGPTLRGRHRKDVVLQERHQCCNASADSYHASLPTEIIN

SEQ ID NO: 13672 - protein, 444 aa, Chlorella protothecoides
MSIHRPSHVMPLIAQVEFELGLPRHTSGDQARGAAAALLTTYAAALPLSGEPEWNGGCSCAMCKLHYGHQTSSHPHAAAGLDAKQRGHGEDLITLAVTRLLQGHALGLHGLLPSALFVLEAAQTTRTSSAPLRLHAAALYALLGCPRAAAMQLEALGVKQILHDSMTAHWLLPALLDTGATAAAGESLDMWVRLGCGTALALVLFLLSPVGRKCAKVCRVSVSLRCSLSWSAAGNAQMLAMAASYHTCQSRTNAYSGLDTAEPLVLLMRCLFPQHIPAALPLQVAEFVSFKERLAASHALHVVRAEEAIRKLRLLASSPVSPHTLVKAARHLEVGGLPPARLLTGGLCHRPCLPCINGFLAPRKLHRCISNARRSRHLPCRHASASTRTWAHGQPGSRPVRPPPPNLGRHWLCDPVGCGGERHRLPPGPPVPRLRPGGAPRGPS

SEQ ID NO: 13673 - protein, 152 aa, Chlorella protothecoides
MLTGGYDLSSVPLPEEKPFWADILLAFRRLESSELAAFDPSGTSVDGYGFTTIVTPPHALNLQGGQRLCPFPPSREGRLYLVWLMKQIEQLGGRHERRHVSSLDELADYDAVVNCTGAHVVGLHEPARGAQPSPAPGTGTPTPFCIISREPL

SEQ ID NO: 13674 - protein, 193 aa, Chlorella protothecoides
MAPKLVDGEEMYPIRGHVIRVRAPWVRQYTNKDKDIYIIPNTGEARGPHATLAPAASSGMRLVKGAASPGSASNPPPPPPPPMPADTVVLGGTIQKGDWDTVPRPEERTRILERCYSILPSLRRAPIVREWVGLRPGRAAIRLELERRALPATAARRGTLPVVHNYGHGGSGLTLAWGCAADAVQLVQAALQL

SEQ ID NO: 13675 - protein, 416 aa, Chlorella protothecoides
MHRYGSDEEVSDDEDWIQTFWSATATHMKAPLPNNKFEVQQPGRIPLSSPSGLITENGKDAVKRSSTEPSFVPLFLRPSNTIKCLTQAANAWRHHRSTPILTIPTQTSDVLQPILSGGSLSHFCSAPQGFVVMNKTQAAVGCLDRCSCRSGPMSCPCRFLLHQALVRRKVRVCDKNEVVTMRIPAAPLPLSWGRTVRPYSPVDPSADAEIVGSSVDGQEKRCPPVSYESWLKCKAAAATYEAVLINPGWVESGDDGAGLKVSTGRPCTSRCLRQGRRLECTIPHQVEAVLPHALLNVQSSQHAQRFATLPLPDLVPAGMVFMFIPKQYIQSVCQQVHRHQPSKTMWRGGWVIQSLSPRGAKPFLIHTWLQYGELGLHVYRKPDVGLPFPKSYCISGGVALLCLLPPNSVHVSMGRY

SEQ ID NO: 13676 - protein, 264 aa, Chlorella protothecoides
MSYGKCLLPSHRSITPRPADVVMLRSLPGRMMSTDSVGLAKAALRRDVLQRLKGMSVQDMQSESESGVREWRGIVESRPSSLGIPLPSLCFLARCCNWRAGGKLYALQNCPVCRGEPAPGSHHQSAAETLPNQGPSNPAQPFIPMRGRVYVPRVLDRDSNMHFLRLQGLEELVQVPPFGIREPPLTDAAGAPRSDALQSPDPLQLVSMHRGRLQAGGGVDSRLDLTPGRWTHASGVLQSSISSGKSPLHRHRPQALPYVSPRDS

SEQ ID NO: 13677 - protein, 254 aa, Chlorella protothecoides
MGVLYDFHHSLSTDGVGIDLPIFGVSHDTPVQRSLERSWKTPLLVALAFNAQMVDSIPVGHHDVPVDVIVTPRGPILSIPLCPTGSRQVGSSTVMNPEVEASRCCCKHTACNAVGRWHDWCRPHTSMFREHMLPVSDLAIVADLASFDVRLCVKQPPDLISFHTDRKSPGMRPCCRCRSVRSFSRRVSAPRTTYFHAARYSAGLLHAGSASRNETSVPQSHDHGHHDMGNGRLHTRGAFAFKHGQLWFPFRHHP

SEQ ID NO: 13678 - protein, 136 aa, Chlorella protothecoides
MDVIDDFKRLLVRCPPAGSLSSVHRLLQLQVCTLVVARGVEGTRECLLDPALTLPAITILRRHVLAAISTLVHAVLNSRNAARPSLELSLALASVLELAPHADRYWRPALDMRMIADCHGDTDVDKLLHLAGHTCY

SEQ ID NO: 13679 - protein, 72 aa, Chlorella protothecoides
MELRHQRNPDVLFDCCLPIAGSPCHAVPQAVYDTIETLLPGAKDRFLELWAAQGSARPGWTQAAFALDGVCT

SEQ ID NO: 13680 - protein, 302 aa, Chlorella protothecoides
MAAVTYKRNKDGNQRFMIPHITICSGVLDDVLHKGKVLIKCNDGQALNRAQSCTEFDLMAEEDVSSSLKNLEGRRDSNSLQINGEWSQPGTRPEDACESSKEGPDVSRKLRVNELRIGNPAIRTRARVWLLRNPAQPGTCGAISMRGQCAGPPHGMSAWLPSAMSPGGGNPRPVPTELVLYTDIFYLGTLEESIGDIRGACIVVRGNLIEWVGPETDCPPELRLEATRVVSLADQVVIPGLVNTHHHMYQTLTRCVAQVRHRPGGSMSDDAALGINKGSACLATQRSHGPPTTQHPPPPPGG

SEQ ID NO: 13681 - protein, 468 aa, Chlorella protothecoides
MVLHTLDSSQPWTPRAFRERGQRRCRLQVSNAREVVHQAKCSQINAPAQSKHHVADLIAHEKSDWHIPTQIPMACRHEGFSKAGTVRTTTLHIMGLSMSAVRVSTLEILTPSSTKMIVNVECLKEGQKPCTADSDGNIGSGNKGKNNLGTNNVGNYNIGNSNVGTANWGDNNSGMSNPCFNKTRHRIIVSDCSLLVFRKRAWVLGFPPPPAKKSPPPPTKKLIPPPAKKSPPPPAKKSPSPPAKTSSPAPTKTSFPHPRRHLHPHPQAQALLHPDPLLPAPLLNQPPSSTQPPSSTQPPSSTQPTLPIAITTSTKPSFSASTTTNDRHNPIRWNCRWVCRRHVCCYHWGAGPLLKKVVPLTLLNPSPPPPASLPPPPSSLGSMTGSIIRDDYDFTFTAEAGNVSPSSINYIFFTVGGAAIDATSTPNSGSPTSWDKQLDSDAAALASYAPVVGVQGGSGSSNVLTLNW

SEQ ID NO: 13682 - protein, 396 aa, Chlorella protothecoides
MLSCSCPLNTLLGMDAVLVKTMRIPATCTGIGDLNEGHHIQISTCSVETGFHSSGRAARALRSAWVQERKRERSGHRHPFNKQSFLHGTIKQGRRTVSSSTFQTAFTSRMEHKTSGSGGGLSVVHDGNPLVSTKVHSRRRGGSSPLRRAEDAAKGEGGLISDERRQNYLPLARGGFLMEGGEGFLAGGSRLLTGGGGEDLLVEGDDAFPLEGGGGLLGAEGGFLIGGEGVDLREGGGVFLMGGGDGGLREGGGGFLLGGGGDRLGKGGGGFLAEGGGDGLGEGGGVTLRETAAMALERGAVMAWERGAGVTLRETAAMAVERGPVMAWEGGAVMALERGEALMAWERVAVGSQQGPGMGWQVVGLASLQVMVTVVDGTPRAVPRVETPVKVEGPQD

SEQ ID NO: 13683 - protein, 464 aa, Chlorella protothecoides
  MOD_RES (136)..(145): Any amino acid
  MOD_RES (431)..(433): Any amino acid
MPARPASGQIGVEMQPRETVLEVLNDTDPLLATSPRHDPAQGPEPPPSPRSWVLPTLRSFPGPHGTHAHPSTPRSPRHLLLITCIAAIGGFLFGYDTGVISGALPYIRDSLLAPLAGHPARLARVQETIVASAVVXXXXXXXXXXAGAAAGGRLSDHWGRRGTLALADGLFCVGALAMAAAQGLRVLILGERLGPGALPGSGAGGAGGGRRIRHRPGVDRRAGAAAAAGAPGLPQRPRHHWRPVCGVRRQLGRRTPTGQLALDAGGSGAAPASAAGGAGHGARPAIEKAQRGDALGPAGAARRPAPAARRSGSAGPAAAVRHQHRHVRDGAFGGAVLVGIEEGSCGGRSPSHSTHCMPCPPMRPISEDISSSYISPFHPFPLCNPAQVLHSADPGGGRGAEQADGAPALPLPCWRECCGHAGRHVLHREVXXXHALPTDASHQQGYLVLLHFAFPPFPLLQPCP

SEQ ID NO: 13684 - protein, 533 aa, Chlorella protothecoides
  MOD_RES (115)..(118): Any amino acid
  MOD_RES (177)..(180): Any amino acid
MQLFLRCLEGRTTVLTLPSSSTSDELYTRACLEGAPDVSLLHCSRTVEPGELPLCSLGISHGSSLHIVGRLRGGKGGFGSNLRAAGKAKMTDNYDACRDLQGRRIRFFTPTGTPXXXXMGCHWTWHGLGSSHRQGHPLHCLPAPIPAGATPRRVLDWANPAQPAVFHLPWIFKLPPXXXXLPYPRAQPRAEVSTGRTPPSLLCFISPGSLSFPLSPSFNHSRQQTAAKKLEEWQAQAGERELEVIALRHLKQLAKEEKASQKAEVDVATVRQDLRQSLLNVSAGVAAALAAGKRVGSTGGAQPGKRGRIDPLTALSDGSDSEDEEGQPAGEGRSASPRTAVDGPEPGSRPAAAGADAREQAGEEGREQMANGDGGGARGSDGAALAGSAPEHAARAVPPTEAPAEEEPALDLAWRSAPTASSCSSPWPLKRCRAHTWQSRDAWTVIVCEACALPKACKEGGDGREPTIARNQFCIGKALDLAARSHDWCRQLARHPSQSPCARSAAETQQNWLVHRTDHVEEHMGSPRGQRGW

SEQ ID NO: 13685 - protein, 85 aa, Chlorella protothecoides
MLPQGSETEALALGSDPQSLAPPWRLLLLSDGSVTRHLSLLTQSEVNVDCVGMDLHSDADPLPEEAEVMGEGLLLRQVGRRACNS

SEQ ID NO: 13686 - protein, 69 aa, Chlorella protothecoides
MSRPATMGYAFCEFVDTSVTDVVIQALNGRAVGTKFLTGELPLAGLGRVLVGGVMGVRKGRSGLDGAKC

SEQ ID NO: 13687 - protein, 225 aa, Chlorella protothecoides
MGRWDGGPSARGWLHTARGRRDVSRITHARAPGPLPPQAGDHPRSRAPTLHQQPHQSSEGVCGSGLPHHLLQAVPGEVRGAGGWVVRRGAPGTGCLVESLAPRSPWMLRGSCAAQDLMCPPDLHPRHPQMHPGASEGGLTGLHMAQNNADRTYAFLELRSIEEASNLMALDGVIFHANPLKVGLTGSGRLVRGWGGGEPPASGVWSRPRRRGLPGCCEVAVPPRT

SEQ ID NO: 13688 - protein, 335 aa, Chlorella protothecoides
MLCTFTTPRPAPHPLLEPLRGRCPCPQAFTLYPRNLVTSRSYSLRRCSRQAALSSAAEAGSRAAHPEAPPAIHFDKHELVLEVGDRKVCGLVRGFVLHACGPVVCGLGLRLVGRQHRQVPTPSVFQITLETGEIGRQASGAVMARDGDTMIYTTACCDAAPEEGAPGARHGSPLQVHYAERFSAAGRTSGGYVKRDGRAKEHEILISRLVDRPLRPLLPADWRRPTQVLSWVLSFDGARGTEALAVTAAGAALALSAVPIRAAVAAVRVGLIPGRGLVLDPDSEEVEASVLDLLVAGSAEGLLMVEAGAEFVTEADMLEVRGSGILCSLDGGEPS

SEQ ID NO: 13689 - protein, 167 aa, Chlorella protothecoides
MQLSGVLSPRGLLNPLPSLRNHAGPGLYAAPQTTGEALKGGRLAAAVMQGAGYGVTPASGACRPWSAITAIRLGSPHAMAAFASAVQASSPIGSYVTPTPGVTPGYADPVVFADGTFVAGSTSELGAGVGAGRESVVTRVAGCNVLEQEGHAPLLVNEMPGGILMMP

SEQ ID NO: 13690 - protein, 658 aa, Chlorella protothecoides
  MOD_RES (272)..(275): Any amino acid
  MOD_RES (490)..(493): Any amino acid
  MOD_RES (643)..(646): Any amino acid
MFTGTSSLKPPQTIWFSSKSIHNSRNGRLNDLHVRRGEGRAANRSAWMGAPPQHQVHEAPTGLHPQTAKTQDPPQSPLKTAVHQPLSSTTDLGMRGGAATRLQRDRPPHCCKCGAHAARLCDRQDWAPPLPGLHRLWSWRSGPGCPRPGGAREFRRECPEAVRAGWALACAWNSTCCNPPSLLACTGLRQIMADVMGMEAAAVRIQFVSGTHAIACALFGVLRPGDELLSVAGRCGGPGLSGDREGLPAGRKWNHTRHTGLCPWLCCTCHFXXXXDPSMHSPMKPGRHPSPTPLASPYDTLEEVIGVRGTPGSGSLAEHGVGYRVLPLAPGSGAIDWGALATAVKPGGKLWRATKYRCCQGWDPGVASSRQESSARAAMRTAPPSAWRTSGELCKSSRPRALASSWRWTTAMENSPTPLSPERWGLGECRKVFSCPVWVVEAGTVWQASVPPDVSQAIVHMVCSAPNLHLLFPRWGPICAWGRSLRIRGXXXXLSGSWRLELYSRPAYHRLFHRRLCTWCVQLPTSIFFFPGGGRSLHGVAHQEPGGDARTWRGLCGRKAPPGGCRPGEADGAWHRERGGRRERGDPAPHVSGWVFGRGGRRCKARYKPTLAGGLGSACGLHGFCQRRLAWLRVKTMLKPWNXXXXVHVGCMAFASGG

SEQ ID NO: 13691 - protein, 68 aa, Chlorella protothecoides
MLSSSLAQFVSYPLALTRTRLQAQGVGGQAVRYTGMMDVLRRTFANEGFRGLYKVRSRGAAGKVSRGV

SEQ ID NO: 13692 - protein, 69 aa, Chlorella protothecoides
MADVGQEAEALTVVLTRLASTPDEALEKLLVRLLPVVIKKLSLGDPTVQKRVLAILSHVNKAGRGGGAS

SEQ ID NO: 13693 - protein, 322 aa, Chlorella protothecoides
  MOD_RES (144)..(147): Any amino acid
MDALKGAGYTTCVVLGHSKGGLNAFMFGAQVASPPPLVVSLAGRFKPRDGVLQRFGPNILDQLVASPAMPRKEANGMEWVLTLEEGVGSEGGVDAICPWNDAAPRNAQCHTPEPNLWRIREARARPLQQKLGPVHAHGRSSGLXXXXREARARPLRQKPCPLHAHGCRGAGEHRRGGPRHALACRHPPGAHPRPGGHHDPVAGGGVPGRAPAPRQDSLHPWGQPQLHRPRRRAGGRCSGGRPGRGRLRAAAWAGAVQWEAVDLCCCHECHSQLTGDTLCIAREQGDRPPLTVHVSRGPGLGGITSRGAEDRRALASSSGPAS

SEQ ID NO: 13694 - protein, 255 aa, Chlorella protothecoides
  MOD_RES (61)..(64): Any amino acid
MGKNQQHKAAQMSRHTSRDGDPADTTNTGDGVDVSFHSAAWHEARLAALQVERPRQVDLCXXXXFHSAAWHEARLAALQVERPSYEEWKQRQKDAEARELEAQEAQDALMREYREGLAADRAARMGLTAPGITKHDSKRKSSKKDKKEKSSKHKKEKHKHKVSLEALCTESEVNQRCCCGGLAVCSRRPDGMPCCTGTLCGSSPPRTQTLTGPPLATHFRRRSPSRRRSGAGPPAATAAAATARPAPTMPRRPGR

SEQ ID NO: 13695 - protein, 126 aa, Chlorella protothecoides
MPRGQPVAHFRISWSHAKRSTRLPSRWQPQPPPDPCPARPQRIQPLPTLRLPLAELAGVYTSPGAGPMSRNFAAVYLERAGARATPADVADVVSGGGAGLVEGHGPGLLGHNTRGCTLRWLCIRVQ

SEQ ID NO: 13696 - protein, 406 aa, Chlorella protothecoides
MCRRAEWSLDTTFRQQQTWKEASLAQAPITPSPCLVHSPFPPPFPLPQIGNLQAVAQFLSKASGSVSGTAADLLTPARMVIFGTLLTTINKPMFAASGAVYAGFGASACLYWITFGKIFDRVSKGIREAPSKALIGELAAASGDSPAAAFSLRQSMATFGALVGAASAAAAYKLSGQNYVATFALAALPATLALVLVSAAFRGVVVGPARDAAGPRADATAAASAGDGPRLGLVGKARALLGAFQPAYWQALAVVGILYFARFDASFVTLRAKTVMDRASLPALTSIMMVTQAALATPAGLRAKRSVAARNAVVVLGIFALIGANAAFALLPSTPGMMLGALLIGVHMAMTHGVTIGMLSTYIPSATIPGLGKVAGTAWSFTDMLLGGCGMEGETKERGLGHGRCC

SEQ ID NO: 13697 - protein, 155 aa, Chlorella protothecoides
MASSNKASGGRTLTIPDNSQETLRVLDVRPSFSFGTPRCVQGSKPEITWVACTGVSWQSVHPNGPSPEGGSVGDEVITCPTLRSKLQARESPFLRGNYHGGGFTSDNDRVLLQSVYFADRHSAGNRSQDRLEALSVQMKKASFKNAAIDDATSDL

SEQ ID NO: 13698 - protein, 394 aa, Chlorella protothecoides
MWAGLLVMLRAYPGIPRAVDVPKRVLPVLWSSVRHAFYGSGNASYPALLPLMLLLAPEVGHGMALQRGQFARAPAKLSLPRLLADPSTLAVPAQGTEAMAMWSQVLRCLWQGMAATCSASTNGTEAGRAAFCECAARSLSLAGDAVVEGRGAHTWSRELADAGLGTLLQATILPAATGSGPAADCAARLVGQLIAALQGPSLDAVLQLTSRHLCAALKQLLGSVRIQAAAPAAAADVLAQPREGDASSSDSADVAPATWPGLLHAVDVLGQYAPKTTHAERLAGPLLLELVDAGLDGDPHATQLAAALLAHQRDSGGEEGREGQGAGASGALKSRVLEALTRCVGGSLVPGRICATCWHMVWGTSETWLVITMCSASERARSVAELGGSWASSM

SEQ ID NO: 13699 - protein, 736 aa, Chlorella protothecoides
MLKGSDPAHVSAFSLHSPLLEPSVQVDSVDLAADPPSYGILLHGRFRLTERHRLAPRPESGAQAIVPPPPLRSARRVLKRSVQAVWPLVTEPEAEALAGMYCKLMAGLERAPGPEGQSSGSPPVPSSSDSSSLTHPSLDLAVLAHCPPASEAWALARRASRTALVREGDELAARLADSAACLASAACDAADSSGMFTRRDPAPALQFIAVLESEAPARRSARVARALAAVEADREQTAAAVAHTLGARAGPLLQAAALCEVVGFDVPGAAPALEQAVRLGTLLGAAWALMPGAEEAILSRTDAGPTREALALLRALTLAGLAEEGATERAQRAADAAAEAVGLGTVDCLLALALPRATGRAAPEPLARLAMQLLLRFPAMLCSLRGEEDEEEDEEEYGGVPAGQDGSLRLVEVRWVVVCFGVGAGPFIEPGTLGGRMSTCPRHGAPDTAPAPSPSAYHGTQSPAQTPHPPPNPPHNPSQLGLPLSLATALLGSPASPAFLPAWALLAGHLDACGPSDPGRLRLARHLHGLPAATGAAFDALLPGLPLDERRGRGAQRRGPGPAPRAGTVAEQVLAALEARAPEVLNVTGGDSPPAAPGAGPDLDPTAVQDSQLAYAVYAGMLRTLPACARQWFVMLSDRGKSGAVEAFTAQAVSGPLLAREFEALEGLRSTSSGKFTVRCNAPARQAWAGGWCLGGGGWPGVPVGSSHGVSSPWLVYWRNSVPLPLPYRLLPFYLI

SEQ ID NO: 13700 - protein, 101 aa, Chlorella protothecoides
MSEEEKLKWREEKAVRVGARKQTTQEKKARLEQALVKGQRLIVDLSFEDKMTDAELKSLCQQLAYCYSANARSSKPMHLIFTGVQVGAWRMCSGLPGQCTS

SEQ ID NO: 13701 - protein, 90 aa, Chlorella protothecoides
MGVLEILWGQGGRRASVHARSAQPSAPEWVAVWRLGGKGPLPGLVDGMMRGSLDPSKIYIVGGIVDRNRYKNLCAGKAEEEVSVYPGQAG

SEQ ID NO: 13702 - protein, 444 aa, Chlorella protothecoides
MPFPSDSLLSVPKYAIRAGARKRIYFDPKETRMAIVTAGAICPGQNDIIRAIVTKVNWTPGPLVSTPHPDLLSDHSSLAPPSTTPSQAKEPTHLLPAQAFDYGVPEGHILGIRNGFRGFTNRTRRPMVLTHSMVKDCHLEGGTLLGTSNDPADIREIIKRLDLWKIDQLFVIGGTGGNAAAYAIQRECERCNVPTAVVGVPKSIDNDMLLFDKCFGFDTAVEGAQAALMAAKVEAASGYRGIGIVKLMGRRSGFIAVQASLASGVVDAVLIPEVPFRLEGEKGLLAYVEKIMAREGHAVICVAEAAAQDLMHGEGPRRLDAAGNPVLSDVGPWLKAKFKAHFQDADIKYIDPSCLIRSIPASSQDRIYCRMLGHGAVHAAFAGYTGVTVGLINTHYCYIPIPMVIQVGPAPRTVDPHGELWARLRSAIGQPSFVDDEDEEFCPE

SEQ ID NO: 13703 - protein, 89 aa, Chlorella protothecoides
MCTNHVVEIMIRQQELGDWRAAFEAVIPTRKRKAGDTSDAVPEDNVPAVKEEPCAPASAPAPQKQKKDKAAVKGAAATKPRKETASVGK

SEQ ID NO: 13704 - protein, 240 aa, Chlorella protothecoides
  MOD_RES (75)..(77): Any amino acid
  MOD_RES (153)..(156): Any amino acid
RLPPQVVACLGAEGGEQTSEALGSRKVEARDGWQGAVPAHTSTSPRSPIRTPNFLYTQLYLSHDAQAYTDAKSLXXXASPRFPIRTSNFLYTQLHLSHGAQAYTDAKSLRYGHLMIMTDQDHDGSHIKIAEHVPCCCPPLVSVLPSLPPIPPXXXXHGDPSDINPRLRSGCHAVVLLRSQHCPPFLPSPPAGSDHELFPPFLPKPPQGPGVPRGVHHAHHQGGHGVRAWRMGGVELLPLM

SEQ ID NO: 13705 - protein, 191 aa, Chlorella protothecoides
  MOD_RES (68)..(71): Any amino acid
  MOD_RES (130)..(132): Any amino acid
MVDGLKPGQRKILYACFKRNLKSDIKVRRVDAGLNCLAVMSHDPATHSVPWTPPAWHGTSHLRAQFVXXXXSHDPATQSVPWTPPAWQGTSHLRAQFVTQPPPTTPCPLPSLPGRWPNWRATSPSTRPTXXXTPPTTLAPFPPSLAGGPTRGLRRRALGLPPRRGLIAGHHRGPGPGFHRLQQHQPACAPG

SEQ ID NO: 13706 - protein, 593 aa, Chlorella protothecoides
  MOD_RES (224)..(227): Any amino acid
  MOD_RES (301)..(304): Any amino acid
  MOD_RES (532)..(535): Any amino acid
MPNWRATSPNLIMPTAPPGGQPEAPAGGHPHSISSFPPPTLYHQHLSPPPPPSPPQPTNPVGPRQDKRQVLPGDRHDQAAGRDHAGDHGAAHPQVDPGLQGVPGGAGEAGGPRGGALHHRLPRAPHRHQRAVRGDADRGQDARGAGRGPGDQVQADHQDLLRQHDAVQPRRRHPKVRLAGAHPSRLLRPAPGVLLPPPRGPAQGHRPDPSRRWILTSAQQRGRXXXXRGLRVDQGQEGRPLARSFETLNPHKCPTARPLRPTWGGAWLSARLCAQWFCPSPHTNQPPLQAAEADLLRISNXXXXVLSISTRTNQPPLQAAEADLLRISNKVRFILAVVGGELKLSNRKRGDIEAELEREGYDRLPSAKKALAVAATMGEEEEDEEGSAAAGSYEYLLSMPLASLTHEKVEALQEGGEEEFWGDGCAPFHGNRVSSKVMCAGPGCPGFSSPRPPPTETEENRATVARLHATSNREMWAADLEAFVEVSCPDNVGGEGGAPAEAHQPPAAGGGGIATLDSACPHPTHAALEGAXXXXWPPAAGGWGSRNSRLRLPSPPPMQLWRALIDEDTRRTAVLVKQQAQARKNSKVRQRWG

SEQ ID NO: 13707 - protein, 360 aa, Chlorella protothecoides
  MOD_RES (59)..(62): Any amino acid
MERAVGLRAVACQAWETSCRDPAAMLWTICSPGGAGCTQLPRPCRSNHTSRRCSAPSTXXXXQLPGPCRSDHASRRCSAPSTCCTRSHPHSRAATPSPFSPPSSSDDSETELVRGQGPNRPRLTLSTFGLLFTHLEAWVGEATLELLGSGPGAGPASHAPAHDRPAAEALLRLLQAVTPGICAELAIAQLAQVQAALTQLVASFGVRGALPSFKVPCVCWCAFLCCVHACVLSAGCRQPPAPCWRGAHSHHLGKQERPVPMAGPIPDRSPPCTPNPTDGAVAAAAHHPAQGTVHAAGALPTAGFRVARGHQQAERCPSQPSVHHRGVLCRAGAGGGGGDAVTHLLACPWRPFPPEFMLQA

SEQ ID NO: 13708 - protein, 326 aa, Chlorella protothecoides
MSRLRSALPALRQLALLGGPGITGGDFLVSGCVHVGDKHSNELTPACDTICRPWRIARVRWPGGQGPCPAAQRSRGHPSGIRRPGAGTVFRHSPGGRTAATPWSSGWITGGRQMSGSTASHPASGCWEPGAESASLPHPPGARERRGGVQCHHRQDPPATCGCGGGHQLHRHHPRSPGGELADWVLGHGEVAGGMLWCFQNSPAGRWMLDDFPHASQFAAAVLYAAVNELLLQPAEYTCYNKTLDLIRDDPRVTVRLGEPVHAYGTESRNRSARQRIPHREYQDVEGRQHIQVCVCVRGSMSSAAPAPPAAPTGLLLLPEGSALSP

SEQ ID NO: 13709 - protein, 125 aa, Chlorella protothecoides
MPLPVTCFRLELQHPLPHPLQIQFHLSGPSGRATVNADMYLESGAWKHNFLYLDVQEPIRQQVGLRSGPGSYLMVCLGLARVGTDAMRPKSGAHGRAAPFLAPNQPPPASQVVLVRPEVQMVPAA

SEQ ID NO: 13710 - protein, 313 aa, Chlorella protothecoides
MNDTLGPPPPAPGYKVGHAVLPLRVSAFTHAEPRGSPSGLSGRCMTTDVNIRQPPFLGPPQITLGTDPDTNACQNSTSPICFNTAVSGQNIITGLWFNAIIGIVMLGLFIAWRGTFSFYQARLVSALLVWIFVNRTGESYPRGALAGNGRPGRLPVGRAALAALLGCFCAAHSDPTRRQSFHTHSRTHAHSSSRPPTPTHQDSPHVTRKPPRMKLTGHHRIWSWLVPVFTISDEELVRSAGLDALVGPWVEGTCGEVLGVGAGGAGLELRAAWCSQAWQEAHNAGDPLAQFLPPPSPSNLIACRSRRASSALA

SEQ ID NO: 13711 - protein, 1220 aa, Chlorella protothecoides
  MOD_RES (101)..(104): Any amino acid
  MOD_RES (144)..(147): Any amino acid
  MOD_RES (349)..(352): Any amino acid
  MOD_RES (699)..(702): Any amino acid
  MOD_RES (1109)..(1112): Any amino acid
MLPADETALGTGDFIEQSSSQERVFRRVQGGPCESKAGCRVISPPRAAATVPRETPGLSTDLDGSKCYTIDASHPMSGVTATAPIRPHGRHWWPAGQPTCXXXXSHERGNGGRPHPPPWPASASGDHPEPVARPECPRGLSGSXXXXGTRPAAGQEGDEETYITVVWDALCRHRHLETILSQLLDRSVPGACPDHERALRHKDAGNSFFKAGLYEDATKEYEECLHWLDARAWPVQAAQAYSNRALCWLRRGQATAAEEDAGQALILDPANAKAAFRRSSARMALEDWPGALVDALAAQASAPGPDVEAAVARCRAAVGGVDQLASGGAPACAERAAGPDTDGSLRQAXXXXGTVGERGDGAPACAERASGPDTDGSLRQAAPRPVPSQPAVGGRQAQDPRLGRELVATRQVSRGECVLREAPVAWVLGRAASQEPGVATPSSPQRGRTSPSPTPVLTHQGACMTAPPSSSFRPSAALRTLRHAARAPPQARRPPLPRMPPGPVLQPRLPHWPPFPPGGRAGVRPRVVPPAARQLPPGAQAGADAAGAARAAGQRAGRPGLRHAPVQRRGEAGGGCDGLPGRAVLGRARAREPEGRGRGSTPRPGDRSVPRLGPGAAECLWAAPTLELGAGHGLCPGGLPHRHPDEVRAHSSLWRGSAGSHSSPVPVLGARITRLGIRCSSTMLFADQGSLPLDPPAFXXXXVSKAQMRSVHAPVFGEGAPDLTHLRNRCWVHALLAWEFGAAAPRCLLTRVSPPGPPCLPSQGLTLCMNAVAATSAGTPLWHCYGASAAAMSRPQRRAILEGTYGFRCACRDCVNGSEEEDAELTGLRCPFTPGCTGSVLVPTRLPARLTSAWEVPAGSGICSRCRKDGTDPAHRTSLERAVGALAGVARQVEALELHMAGLAERGAWNHPEVDEAVQSLREGLQVGGKQVAAGDVVGGECSACTPQHPWPMTGICAEPAARALITLQGTCTGDASPAAASPACPCSSTWRASTWPAGAAATAEAAAALEAVRVATGAGPTSPALRRHAYLEGTGLGGRAAEALLHELEDARRLPDATSELAVWFGEGGAGALLDHIRALVGLSPHAQATRRAGDFTVERDITAEAGXXXXLQSDHRRPWNAISQPRPVSPMRRHAQRGTVKNSKACTQPLGSRAVAKLLQCGPQLRRVKLRGDYAAAEGALEQDEAQRAVHHLLVHAHEAHEHLGRHALRRWGWCCAG

SEQ ID NO: 13712 - protein, 134 aa, Chlorella protothecoides
MPRIRRTRHPAQEKRTNAVLEAVEAELAAGQPLTPADIQARCAGVEALTLDDPGVEAATLAFDRGDWQVVQQRAGVASGASGCRLAWVNGLRPGLRHDAYEPEEDAALADAVARLGVHQVRATGCGLRRGRRCL

SEQ ID NO: 13713 - protein, 311 aa, Chlorella protothecoides
METVEKGALLRQHIAGSSALVVTNDTVAKEYLEPTLAALHGGDSGIRVEHVVLPDGEQYKSIEEYLEPTLAALRGGDSGIRVEHVVLPDGEQYKTVEVLQKVWDKALQSRWVGQGHGVNGCLGSSSHCARECEPGVPVLPAPRMPRRCTAVGSIACEDSSRCARCVCRLLKSSTPHLGVRLDRNTTFVALGGGVIGDMTGFAAAAYQRGVAFVQVRWRCCVCAIACTSVCLVRHFTHPRTLLGLQIPTTVMAQVDSSVGGKTGVNHPLGKNMIGAFHQPQCVLIDTKALDTLPARELASGISGSGMIVNDG

SEQ ID NO: 13714 - protein, 185 aa, Chlorella protothecoides
MQSCLSGWRPTCLASWPGTPRCLRRVGGVSFGAGWRTRGEGHTLRRAPLAATRFCLGQAQGCAQAAPADHASLAAPQSQPPLQAWTHAIRRSCENKAEVVAADEREGGVRATLNLGHTFGHAIEAAAGYGAWLHGEAVAAGTVMAADLSRRLGWIDAALEGRTTALIAAAGLPTRPPKVGGLGLC

SEQ ID NO: 13715 - protein, 232 aa, Chlorella protothecoides
AAAYAAGPGPVPYGSGAGAAPYGTGPAAAPYALGAGAAPYAAGAGAASYGSGPGAAPYAAGLGTTAPYAAAPGAAAPYASAPGPTYSTGAVARLPPSLQAQLAALVAKSGGFLRVDHFNDGLVDMLLASSCAVRRGGRQPWVFVLRLQPGAGAVASEQAGRRCSGAATDMGEASAAGVLSRLGMRDLSMVRNMPGYIYGALRQPPTDAPPTGAPSRGLEAGGRGGGVRYRPY

SEQ ID NO: 13716 - protein, 390 aa, Chlorella protothecoides
MLLRPRHSLAQTLDIVGAGHNAALPGILPAAVILTSPKYTPPQPPCSERWCPAQKRAAHPQPHREVRVCPVPDCWPAPDRGGTPPRPCLLAGDVCACLHPGAEAHGEGGLDWRAQALQHTWSSKQCSSCLLEWLAALPRDRGAQQHDADLAAEQEPAHCGSRRPSSPSTTLAPGPVHKTQDGNWGLLQLALQASKARAVRRLTKVYTTIAFEKAAELALAPRACFNAARSLTVSGKDQFLSRMVDSGELTASIDQEHGTVRFGDASTSQVDSLKQLEGVLERCMAASRRLSAMNQAVSVVDVFEGVVLVWVMSHFTAYRAARNSVPWLQYPSPVSHHPCSQNRWWPSDLCHLCIPHMTHHSACLIAGAIGAGLYGQDCGWWGRRSGSIGP

SEQ ID NO: 13717 - protein, 94 aa, Chlorella protothecoides
MGLDELTPLGPASVVEVTQAGKREYSLEPRDLGIPRATVEDLKGGDARLNAAILEVERGSEWVGGGRTKPLQDHSGASTGRTVLDALLKIIDMT

SEQ ID NO: 13718 - protein, 393 aa, Chlorella protothecoides
  MOD_RES (292)..(295): Any amino acid
QPAARAARPRGRARRAAPRRGPGRVRQRAHQPWAGEAEEPQVGRAGGRRRPVPAPPSSPPSLQSNPNHLTMSARPERGWHNAGYIFPLGFVSRTLFRSSVALDQLCVHDCYVQGEGGEHWPGPTFRVVARDRPDEPLVAKSCTGCWTGVLKRINAEIEARRAAGEDLPPPPKTAIAGPEYFGLNQTNVSVPVCGGKGGWVIGRVEPERLGEWERGHARARRWAASRRDPRPAWALSRHEKAVNCDGRRRAELCRCHPLQRYENTVPLYNPRTTSPLPGYPNGADPGGGGGAXXXXPPTTLAQPASSPDSQTVQIQEAVEALDPHHLCVEYWAGKEQRCRAAAGLPAQPGPPPARAGRAAGPRPAQHGRRRAGREDPDGTADDEAEEEAGYASK

SEQ ID NO: 13719 - protein, 437 aa, Chlorella protothecoides
  MOD_RES (145)..(148): Any amino acid
MGWGRQPLWRQGRAVPGCHSGPAGLMHSESQSAGSVHPEHQGSPSRLVSERQGLLGRWPPGCPLTTLPHLMHADEDNPLPDLLDPITLEPVVRPAISPYGHVMGMATWKVGGCVWGLGWRCCWAGAWRGVPVGTACRQGSHDPEXXXXLGWRCCWAGAGRGVPVGTACRQGSHDPEACSAVTGRPAVQSPRPASSGPGCPPSQALRLVPPTLPILAGSADLGVVQGAHQAQHPPARRPHHPLSLSLRAACLQSQPPCHPCLDGHPRKVLSATRSLGGRGRGAAAAAAEAAGAELGAVLAGGTGLVGAVAAAVAAAKAVGPVAAEAGAVPAEAVAAGGPVAAEALLQGAGGLHERGGDHLGGQVQVLAQVLDAGVGEEPVEVAPGVPLGDQLLGAQGLEQLDDLQVGHALQVLLGVLLQVEVLLGVHHAICGGVGGRG

SEQ ID NO: 13720 - protein, 793 aa, Chlorella protothecoides
  MOD_RES (18)..(21): Any amino acid
  MOD_RES (446)..(497): Any amino acid
MHPAQSPSSPVLSPFTPXXXXVFDGGWSCSMQRSPCPMSEPWLPPSQAPCPVPLLSSTFPLHSKDQPIHHTHPLQRVLLLDHDRASGRIRLRQYSIVVQPSGVTKNLKALLGRRAVPDLGECKDVSEFLTRSGYGSESEGDDPDTTRVELAEDLGKGNQKARQSRIRLHEVGGFVCVCGGGVCDNGGGGGWKGGGVRQLGRCPRLRRCTAWQSGISNPGWEQLRIYSFMTGCVKATCSTMPTSRRTRRRLRSARPRKRSGRRCDASGEPNRCGGWRRVIGDGMALSVSQGSRLGQRPGVCGEGLSPVAAVHGSWRVEGLQAMCRSRILPPCHPAAHTCAPRSASGESIPDLAALPIAGGEREEEGERGEAPPAAAGRCARSQAPPARGGRSLRGRRRRRVLPPGGRGGAGGGHAGSGPQRRRQRRLPWAREGPVWARAGDPWRRRXXXXXXXXXXXXXXXXXXXXXXXXXXXXXXXXXXXXXXXXXXXXXXXXXXXXPVGVRGAAGAVVAPRGEALAAVAGLDEAGLDGDLPAAAGLDEAAGADAGVVDDVDGHSTLPPATSLPLIHFTWLLYPDVTLYNVCAIGKWGGHGSSGWGWLAAELARVQGPNPLHRQSQPPHRSPPNSSLIPGPGLPGPQSRRVAPRPTHPSSQGQARLGHKGGDPQGDGQRAQRVQLEQGAGEARRVLARAPRQLQQDDQVLGGGHGGLQEQDQERQGADPGQGHRAQGQGRGQGQEEEARQADGGQRPRLQRVLRPEQGRRAAHEAHHGAGALAGVRLRVVVAVAAVTAAASRA

SEQ ID NO: 13721 - protein, 93 aa, Chlorella protothecoides
MMQESRKNVLKDFVQVAGPLGVTHFLMLSATQRAGYLRVAKTPRGPTLTLRVLEYSLMRDVQSAQQRPRCPQVCGTCYLPETRDASMRGADLY

SEQ ID NO: 13722 - protein, 178 aa, Chlorella protothecoides
MPRRAWVPARPPPPSSTPTHPTTDGVMYAEKDFNLKQHPEKDLEGVSNLEVIKLLQSLRSKELVTERYAWRHFYWFLTDSGIEYLREYLNLPAEVVPATLMKSTRPLEKGFGGDRPPRGDRFGGDRPRFGGDRPDRFGGGDRGGYRSDKTGAPGEYRPEFRSGGFGRGGGSAPAPATE

SEQ ID NO: 13723 - protein, 150 aa, Chlorella protothecoides
MPIVVCRQWPGGSARVRGLTRRFSDSAPGGHGRSIQPPTAPTPSAILPVASAFATTGAVLGIIVALVVGATNVYTCRLLIRGAQYTGTRDYESFAHAVGGPWFKGLDLPPARSPSGRGAGFVRRAVPSGRHAPPHGIAHSTLGHETSEMV

SEQ ID NO: 13724 - protein, 89 aa, Chlorella protothecoides
MGSSLAYKDMSGQDLRKAKYNKADLRGADFSGSNLAGVPMFGAICVDAKFVGTDLSAADLESADLEGADLTNAVLQGTLVRSLVPGLVA

SEQ ID NO: 13725 - protein, 299 aa, Chlorella protothecoides
MHLEHYNRPALQIRVVRILWMVPIYAVDAWLSLRFSDARTYIDPLRECYEAFVIYNFYCYLMAYLEEEYGDVDAYYATRPPVPHPAPMDRLLRPWAPGADFFWETKRGVLAYVITRPLTTAVGVVTNLAGVYGDGEFRHDRAYPWLATVGSLSQTWALYCLILMYRATRQELAPIRPLAKFLVIKAVVFLTFWQSVGINLASKFDLLKPASWSTYDDDDIAAGLQNFLICLEMFAAAIAHAHAFPPRVREGGGGRSLGAGNGGERRKNVGVRLGWGGFGEGGVEVSALLMGRGRGAGAS

SEQ ID NO: 13726 - protein, 125 aa, Chlorella protothecoides
PGAAPSLLEGAVASGDREALRTLCARRAAELAGTPEAETWAFLGTHYAPDARRYLLERLGFGDDLPPVEEAEPAAVQAAADDVARLSLGAASSDAAPHPPPEPQEVDPFSTDGERLFESGMGLKG

SEQ ID NO: 13727 - protein, 152 aa, Chlorella protothecoides
MSRVELLLSAGLVPVMVFDGGRLPNKGEEEASRGRSRAAARERARALAAAGNVAGAYEAYQRAVDVTPRHAFQLIRALRRRGVDYVVAPYEADAQMAHMATTGQVELVVSEDSDMLAYGCPLVSSECARVGTGVGWANMQRHAAARFPWYRE

SEQ ID NO: 13728 - protein, 233 aa, Chlorella protothecoides
  MOD_RES (72)..(74): Any amino acid
  MOD_RES (92)..(95): Any amino acid
  MOD_RES (122)..(125): Any amino acid
  MOD_RES (179)..(189): Any amino acid
MAKSGKRKNAGVGIDFKRAKHKVGRKLPAAANATDTTIKSATISLGQQSMAVDRAGQAVTARNLTLKVRRRXXXKCGGRHRFQACQAQGWAXXXXRCWVGKAIVEGWGGVEGGFSFGLGHRXXXXAAGLGSRITSWDIVPQPAEARPCLCCCLSTPSTSPAALPNSPSTGDAGPVLALXXXXXXXXXXXRESTAGRAGGPGPAGARRRARLSARRLGRGGRRRGAAGRRRSQR

SEQ ID NO: 13729 - protein, 278 aa, Chlorella protothecoides
MRAVVCTRLGDASKPFGTPDAPLALVDDQPRQQLPSKGVRIRVSAGALNFADALMVKGTYQEKPPLPFIPGSECSGTVIEVGSGVRSVAVGDKVCALTPSQALCEEAVADEASVVRLDPSTSEARLEEAAGLPVTYGTAYLALVDRARLAPGQTLLVLGAGGGVGLAAVQLGRALGARVVAVARGPEKGVVLRAAGADAVIDSAAAGKLRDAIKAAAPRGVDVVLDPVGGDHFFEAFKCVAWGAHMLVIGFAGGVPNIPANIALVKNTTIHGEPVVFF

SEQ ID NO: 13730 - protein, 611 aa, Chlorella protothecoides
  MOD_RES (73)..(76): Any amino acid
  MOD_RES (215)..(218): Any amino acid
MFGAGSLAAAGRGSLPPLPSTPPKPIGFAYNERVAAALLPSLIILAGFDGGSMASILMGLSHCTSPPSYARSXXXXTLLAWGWGPDGRDSPTAPLPQLVRVPLLNHRAGGGHGGVHPGHPEAEGDGLWRGLGHPGPRPPGRRVGETLPGQRNAGHPRRPRLAHHCSVPGPHGCEVNGGHSTLHSFLRHLCRATLSPSIPKPLAPQHTHTHTRAHXXXXACLALTGARFAGDIPPCTRFCATSAAPRFPLQPQAPRSSNTHTHTHARTDPLTGLWISIQFRWIQLQYPVVVAGFEKTLIGGSFPVAAAVQSWALTVAAGVDAAPFLLVALLCTLYHLLALPLEPSLAPRGRGGWGVSWFGGFLGVEGVGGAEAGHRRPPLLRRHGAGAGGGRGGLLPGGHAACGHVRSGGGGGPGALGARLEPAAPGLAPAPGGGLHAARPLVAGRRRARTPPARRAAPRLTGGGAGGAGGARGLPLLRAVPAPAPALELPGARDGGAGAGGGRGGRRTGAGPAALGHARAAGCGGGAGRVGRDAAGGRLRGVRPGHAPGRGLVPAPPLLVPGGSCGRVRAAHPVPGPGRRPGPGPAPRWRPARAGGGAARRLAPRRPGRAS

SEQ ID NO: 13731 - protein, 489 aa, Chlorella protothecoides
  MOD_RES (96)..(108): Any amino acid
  MOD_RES (265)..(268): Any amino acid
  MOD_RES (347)..(350): Any amino acid
  MOD_RES (373)..(375): Any amino acid
  MOD_RES (395)..(398): Any amino acid
MKTEGFHSFQHARSPPPMHSTRTADESARGPPDPAAHRPPPGRHQPDLLPVHPGPDEHHRAHGIRQAAGCWRGGQACLLGSFDCVGRNDALSGMLXXXXXXXXXXXXXGAAPLPLHATLLRCRPGAGGGGGGPQVRPCAPQAAPRRRWVAWPGGQELPLHRLPTALVHPFLSVEPHTGITVRGARRIQLSSWFGPRWKPIDGGVTPTYLPIFWADEASELRQGCSCARVRSSVYEVEHGQVNSPSYHPTHAQASEEQMQLFKPLXXXXVPFMRDVAHATRCQGPAHPLALAPGGGADDGRRGTAGLGRHPYAARRGRGDQGRRPAVSRDDGGGGHGSRSSAGPRARXXXXPGQIWSRERIDSTGAPLGREVVXXXLGGRMYIMEGCLMVLGAQNXXXXGWLDVHYEGCLMVLGAQNSLFHSQLYVRINHDPLPKPAQIWSQERIDWTGAPLGREVVHIAPLHPACQGTAPVCFASQYSNTTKMGAAWML

SEQ ID NO: 13732 - protein, 145 aa, Chlorella protothecoides
MGGSDRATSLRARVQADPYDQDAWDDLLDELKTQKDVTAVREAYEALLAEFPTAVRVARWTHQGSRDLDMFADLTAMSLSQAQTIRGRPTLGAGPVLEGLCRVRGWPRRKQRRQSGVQPLPAAVPQHRSVAVVPPARPSGAWVGV

SEQ ID NO: 13733 - protein, 216 aa, Chlorella protothecoides
MDGAPAPLCNNAIPLFQLHPGEREARRCRAGRGAPGLRVHPGSPGPGRGVWRHLAGLRGLPAGGGAVGLVWFLGEMTGVGLMLPRTGRLAGVGRGHGSSPPPPRRPNPSLGAPLTPQAPRLGSPELAALFGGADASQEDSARMVALRRAFQKAILVPGPASDALWAAYEAFELAGANKALGRRAVDEWRPRWQAARALSTQRATLAGRLAHHALPA

SEQ ID NO: 13734 - protein, 627 aa, Chlorella protothecoides
  MOD_RES (555)..(558): Any amino acid
GAAAAGAAAATAELAELRELRADVERRERQQAEVVASQAKRLEELDRLYREESLARKKAHNALEDAKGKIRVYCRVRPLLPFERERGQEMAVQLPDELTISLTYLEKKREYAFDAVFPGGTPQERVFEDTRHLIQSAVDGYNVCIFAYGQTGSGKTFTIYGNEELPGLTPRGVTELFDIIDRDAGKFSFRVEVSLLELYCDDLQDLLAENKAGEKREAWPGDERDHSTLALPMHHFPGTRPPHLLSPPFPNSNPPTVQAAQAGHQEGPQGRGDGARGHDCGGHLRARPAGHDRGGTGEAPRQQHGHEPGVVAVAPHHHHRRGGHQPADAVRVARQAVLCGPGRQRAREEVQVGGRAAEGGPGHQQVAVGAGQRHRRAGHRAGARTLSRPQADHAHVRLHRRDRQDAHVRQRVARGRQPGRDQQLAAVRHARVHHPQRGGQERGQQGRAAPAAPGRALEGAGGAGAPPPGLRGPGGDQGCRPERGGVRRGQACVEGWDERVAHRGGEEGSRFCGPGPRPVPGAPAPGSPSHPCVGSQPPCLPPPVSPNSSRSYSPXXXXGGLGRERRAQVGAEEGSRFCGPGPRPVPGAPAPGSPSHPRVGSQPLAFPPDPPQLLQILQPCAVGMPDS

SEQ ID NO: 13735 - protein, 344 aa, Chlorella protothecoides
MPLAHFHGISDFQLERSGLFVALTEMRVFKLDMEVEIMRYCARVAASAHIRVMQAVRGAGYCPAGRCSCGPTLPRCRRVRLPCIPAPHYFPLPKSKHPRPGMYEYQLESLFLHDIYSEGGCRFSPYTPIFGSGPNSAVLHYGHSGAPHDRRIADGDLVLADAGAEYYRYGSDLTVTFPANGRFSPRQRVVYEAVLDARRAVLAAMRPEVCWTDLHLVAEERILAALTRAGLLVGDPAEQVAARLGALFMPHGLGHFLGKQTHDVGGYVAGRFRERPTQPGLDRLRTARILEPHMVLTVEPGCYFIPALLEPALEGGPLHRFLVPEEIRCYMVGGGGRIWVAAGR

SEQ ID NO: 13736 - protein, 406 aa, Chlorella protothecoides
MPTPTQAISWLLGVPGASRTVLDVQVPYSPTALKSLLGGQAFASASSPDSVAALSQAAFQRAASLTALGTPVAGLACSAALGTDRVRRGEDRSVPGRAIRCPHAQPPRPRCRQVYIAAHGTGGRASFSLVLDKAAPRPRWAQDAVASRLLIHAAALSCGLPVPEGDLARRWLRLEPGDVLESGRPQPPPTLRQALQSLGRGEITSVEAGLGPVTAGAPRGGRLYLPGSFNPLHAGHTAMLQAAQSLCPELEGCYELSTGNADKGLLLVEEVERRVRHFEEARLPVVLTQAPLYAQKARLFPGSVFVIGYDTAIRLLDPKYYGSREDMLLQGRDRWRTILWRRHHSQLEVVCTHISNAARPPGHQRLLVPRGRPAGHPDPAVHAAGGPGRPVPAQGVASVVGPPAWA

SEQ ID NO: 13737 - protein, 508 aa, Chlorella protothecoides
  MOD_RES (47)..(49): Any amino acid
  MOD_RES (75)..(78): Any amino acid
  MOD_RES (169)..(171): Any amino acid
  MOD_RES (455)..(458): Any amino acid
MSSAFLAHIHRLPHHAQLFNEINSRKIRDELNVFKGFLSSIVFTVVXXXLRGNSNPRSSRHKAALAMETLPKLSXXXXSHSPSGSRCVPVRGGRRRVWGQGERWPAEGHEPLGDLVIRRNGMDLDPSDGVLVRTGRDQTALKPLSRQGAPYTPHSTPNPRAHAGNHHVXXXIPSRCSPTLLTPPQPHVPMQVIIMFFLNGIFKTTRLSGLEWALSIIIGSSVLLVSLLTKLISRWVVLGYQQGDSTPLSSWHKAALAMETLPKLSGPMHHPLSVQALFPAPRTNRGGGGGEAPLFPRTRGSVPPALVAVAASPAPRPRQERLEGAEAGGQGCAAPAALWECPGGGHDRLSVACRLELTLSELLTLLDAAIRPCKAGLCLVYPVPLLLYATSAQQHVKQACISDRVCNHLQGALGLGGAWGSLRKNICHGPHQSTDAKSARDPSVYSIIDQAGHPXXXXRIFAVVHSNPLMQKVLVIHQSIASSIRRGIPFTRCPGWKWQRPRPHSPPG

SEQ ID NO: 13738 - protein, 305 aa, Chlorella protothecoides
  MOD_RES (236)..(239): Any amino acid
MRGGSLGQDLAFTAPHPSIDIYPPNTKPHPVSPLFSRSITQRVEVVADEAAKRAWLRQHLPTLVDAGEVLLFAGTKARVDELAAELAAQGVRAGAIHGDLDAGSRAAVLASFRAGTTHVLVATDVAARGLDIKTLKTVRRGVCGHPGPKTLTTTALPTLPPEHRTQVVNYDAGRSIDSYIHRIGRTGRAGDKEGVAYTLLLPSEGQMADNTYGWNAPHTYHHKRCDPDSHALTIKXXXXLLDNTYGELVGCLEAAGQPVSAELRAVASKDPRWRRGAGRGKGSGGRGGRGGRGGRRSTVRACGRL

SEQ ID NO: 13739 - protein, 655 aa, Chlorella protothecoides
  MOD_RES (582)..(585): Any amino acid
  MOD_RES (612)..(614): Any amino acid
MSKRPFPYATGVPEFVVGRTRPTSNPTREYEEPRVFQAKQPGAFVDYDGLVDGPVGTDFQGWTEEELRAFLDQRGEDFEASDDKAALVKAAVRCEEATGPAVTAAVRCEEATGHAVRPDCKGGAGNSMAPADEEEVDPLDAFMAEMKELEKASDAQAPSARAAGKPAAERFDDLDPAADFLEVGMGTALCGGLTAKKAGALPPSAVTAAAMQSGAAGADGSDEEVYAAAAAALESDAVGVGGGKLENSSGRWILQGAKDCDPNRHVQVLPWTLCDMKIDSLPGFKQAVGSLAPLDHPNLTYEDFDKDFYVEAPALTAMSQAEVGAGSTAAGSRHFRTVGSQGRARRIIQVSARRRSLGLTVSGFDAPRPIATFTQAGFDAPLLTAIVRAGYKEPTAIQAQALPAILSGRWAGQFALPGLPVARCMHGSWVWSSQFLVPQEHALSPRRRVLSLSSMVPLTLKKRCRDVLGIAKTGSGKTAAFVLPAMVHIMDQRELEKGKGPIAIIVGPTHELAEQIHRETRESRACSCVGYGRFVWFASLKGGGVCLLTTATSLDGCISLLEPHPFADRFAKGYKLRVCAAXXXXAASHSLSHIRPQIALPRAISCGCVLRXXXSKVRRLAVVGMLAWMAKTGAAGVAIMLVPGLRTDQGEVFAC

SEQ ID NO: 13740 - protein, 234 aa, Chlorella protothecoides
  MOD_RES (80)..(83): Any amino acid
MRASRVGSRAFVEFQPCQQHRATVLRATPLGFSRHWTCRTPVALIRAHGGHRRFMQSIHATPAQHTSASLLVAVQSSVSXXXXRTPIALIRAHGGHKISMQSIHVTPAQHTSASLLVAVQSSVSAASGVPPEVATVLKTADAICFDVDSTFCEDESIDELAAFIGVGEAIATMTAQAMGGVVTFQESLAARLGIMSPSAQIVEEFLSSHPPRISPGTARFQYIPNISGAWKRDA

SEQ ID NO: 13741 - protein, 556 aa, Chlorella protothecoides
  MOD_RES (37)..(40): Any amino acid
MGAKGKTVKRRTPKRGKKAWRSIDTDDVTAAAAEKSXXXXGERRLGAASIQTMWVLGEAHGGGSCSRCMGCISIPCQIHDDVQVTAAAAEKSRQERQGLDFDRVPDADLFFVDKGDASAGPSTSDVEAPAAEEPAKLSKKEAARARPLRSQAILAAAHTATPVHQIRGGVKKAQKNGIAGVVAASGGNTGLARQGKKDATRLYDLWDDGPSALSRAARKKAATRSLHRDAVRAVEVDAPGCSFNPDPEEQQEAIAVAVAAEMKKIHQQVGQPRSWAVCPVHPDAMPTAPPKKVDYDVEEDELALLQVDEPESEEEDIIDGAGEPGAASKTGPIKRKKTKVDRNRAARRKAAEVAQAAARAAKAKRAALANLPTLLKEIDAEKEELASRQLRRKEIDAEQEELASRRLRRKVGGELERILEACCPLGPRRGAEQPAPGIPYADWTHPPHLHCTKLDKAETTAGLPPRLGKTKFEGMPLQLLTTDEVNGSLRKLKPTASLAKDRFPVYAPLGFLETGHVTDHVPAFCSDAMALDLAPGSTLERIFQLLTQESCFPWLG

SEQ ID NO: 13742 - protein, 373 aa, Chlorella protothecoides
  MOD_RES (74)..(77): Any amino acid
  MOD_RES (174)..(177): Any amino acid
  MOD_RES (308)..(311): Any amino acid
MFGAGHIGDRVDLRYFLTGRVVGACMAQLRLQRLFVCVRGGWHRVAQALHARPCPPPIHAHRGNDRQRHLRHPXXXXAWRNGGCRGSLCASEAAGTGWRRPCMPDPAPPPPMPTGGMIGSGTCVILMGAAYFLNIHTLGYFIAVQIVGGRAVAQPAPSSARVWGASSPKARGAXXXXGGHLGPFPVCGGVFWEGELSLSMRPAQHASGAQAHQKRVAPHPTQACCRPPAGPAWSASWPTGLGKESVASSWASGTRTPPWWTFPGPCEVAAALGDRRGMSGAAGNPTPGLPSPSRKHPWLAAGGIHAAXXXXGDPNPGLPSPSRKHPGLAAGGIHAAVRLGLVLHRPRHRHSRDGCAGPALGACGMPCGRPARM

SEQ ID NO: 13743 - protein, 393 aa, Chlorella protothecoides
MGPGSRLPPSPQRAQQPPILAPRASQCANSSTPAQLDGLRVLFCTQDMDSAFQRTRAVLASTLPGVEVRQCHRLEAGAALQHVDVVVPIAVPITAGMLGASPRLKLVIQFGVGVDAIDIPAATRLGITVANIPSLGTGNALSVAEHAIFLTLASLRHHGAMRRALEAQRLGVPEGLTLWGSTVLVVGYGNIAQELVTRWVGGWGSGGMGWGRGPWWSWRRTVQGGAWGRKPTCGNLLLPLPFTPPHPPKFPDSILRLQPFGCRVLCLRRSAWPEPRTGAAADLEDVGTFPDDVPRLAAQADVVILTCALNPSSVGLVGASFLAACKPGVHIINIARGAGGEGSGGSSCMSSRALWNLRQGTGAVEFEAGHRARPRAGLTIAASLIRTVPEWNS

SEQ ID NO: 13744 - protein, 87 aa, Chlorella protothecoides
MRCRRPRPPYTTKTMSIPPNLNSAQVVICSACSGHGFKFGSVIGEVLKDLALMGGTPLDIDFLRLSSLRKGQAAVLEEFGKQEPASA

SEQ ID NO: 13745 - protein, 351 aa, Chlorella protothecoides
MYEPAAAVLQPEGCIRASLTLALSAGAELVCGAAVTGWRVDDQGTVHVHTSKGEYEGRKLILAPGAWLPKLVPELQVRVGCMLCHAVLPLAWHRPLTCPCSTPPTQSLLSVERQVVGWFEVLNGSADFDADRFPMFVMDNRDGHSGVNKASRHFRGRTVYVSQGHRPRQSPGPCSLPACAGFPKDARGFKFGKIHHLGEIVDPDRVARHITSLDEATLRRAVHKYFPGASGALNHAAVCLYTNTPDEHFLVDQHPNHPQVGGLTRAGGGGRLCICLGMAHGGTGVILCSACSGQGFKFASVIGEVLKDLAASGATRHDIAFMRLDRKRPGHAQVLDSFQESAQGLQPSSRL

SEQ ID NO: 13746 - protein, 101 aa, Chlorella protothecoides
MATVKLFLNHTAAFPDQQSQVLGRVRDALLTLVSGREHEVVYAALSNTLVLAKRHPDAFAPVGPGMDSDGHLEPRWGSSSRRGSTISAGVLDPHGGADSVV

SEQ ID NO: 13747 - protein, 322 aa, Chlorella protothecoides
MLSLIYAYDLDTPPEPSFRVHAWHPLPRAYDEGAGALGQGTVSAARAITSLASLPGDGTRPDALLVGHADGEVSCLQGLNGEAAAPLQPAASGSGEGVRSVHLVPGSGEPTVVTVSAGGCVRGFARQPDDGAWAEAWRWQAACKEVECSGVDPTGRLLAVGGRGCELRLHALADGGVAFAGRGGKPSRVGLVDRPWNTALAFLPPSPAPAGEEEPAGARLVVGTGHHRVRLYDTAAGRRPQLDVGWGEAKITALASEPSGARCWVANGQGQIAVLELPSGLVVGGIKGAAGAMVGFPGRRCRSGCSPRLGLLLSRSRLGDGR

SEQ ID NO: 13748 - protein, 263 aa, Chlorella protothecoides
MGHYDVIVVGAGGTMGSSAMYHLAKSGSKASRLGSQGPGLATWCSLQQLCSDDPPIQQVLGLEAQPQAPHTAGSHHGLTRIIRLAYAEHPCYVPLLKRAFELWRQLEVESGQDLLKETGCINMSPKSLPDSCFKGAQASAQLHGLTHEVLTPAELQGRCPGYAPPEDFQIILEPVGGVLCPERCIAAHLAGAAAAGAEVLYGAAVTRWGVEPGGQVSVQAGPDAQTHTADRLILAPGAWLPRLVPELKARRVLLRGPFCFSMP

SEQ ID NO: 13749 - protein, 75 aa, Chlorella protothecoides
MVRTQLAEQYELYVNRFGPGMVIYWHGYVEGLLEHPGVLVVDDFPAKSSILQLPCLSVELVRPSEAPFRPAVQAA

SEQ ID NO: 13750 - protein, 78 aa, Chlorella protothecoides
MGSSALHHLAKSGVKVLGLEAQAEAPHSNGSHHGHTRVIRTAYVEHPSYLPLLGRAHQLWQELQQASGQVSDGAETGG

SEQ ID NO: 13751 - protein, 115 aa, Chlorella protothecoides
MYLPGETPICVTYPEGGCTITEPSQTGFCSGEETGCSRYTSMQSAYDAAGRVIMPVEEWAGREAGLHRLRVEWAQDPVGLSASVYLNVTLHDKATWPPLYVQRVASPPLRRQPSG

SEQ ID NO: 13752 - protein, 194 aa, Chlorella protothecoides
MPVRHAVLVSGPHGNAPGRPCICFIFGDTPHSRVPFSTQAMLRSLPHTSVAPFSRGPLRSRPKATRISAKLTLVPNGDGSKDHLKGEDDLVQPGPISLRSGTLELGRSSNADIRLDIPTVSGKHARIKVESSKILVTDLGSTNGTFVDGKELPANEEREVLPGGEVTFGDVYLAKFSLEESADEASATSTQDTE

SEQ ID NO: 13753 - protein, 206 aa, Chlorella protothecoides
MQTLAGPDERAAYIWVLGEHGQRVQSAPYLLEALVEGFADEAAKVRLALLAAVPRLFFRRAPECRGALGALLAAGAADADVEVRDRALFALRLLRHDVHAAREVLGAPLPLISRPGEEQAAEVEVSPAGFRVCGHGASTRLSARPRLSLLPIPGTLLAPQDRIFDEMNTLSVLYRAPAYTFIDPTITSVGGWRGVVRCGIGGIGSP

SEQ ID NO: 13754 - protein, 840 aa, Chlorella protothecoides
  MOD_RES (413)..(416): Any amino acid
  MOD_RES (436)..(438): Any amino acid
  MOD_RES (531)..(534): Any amino acid
  MOD_RES (606)..(609): Any amino acid
MSPEEVPDSEDAVDGRTSLLTPSEAPAEPEGSIKGAPHSPRDTHDADKPHIHTGGRRRRDAPGCQVCGCALGNLRSYYQVCTGFGGCSCFAGSPGCRALGFYATHRDAPSGRLRLTPQSHASSLNLVEHGFQPPKGLADMATVQAEEPVRGCDLNGSQPATACSGSQPCTCLPTLDSESRSLTRKHLPHCPVPREAGPSCPDVQPSIPTPLAPSLQCGRFQELAAFEGLMRTCRARLDKHAARRRRANQLPHANPDPDYRLPKSQRITYSALTAPSSGGSPDRRPPLSAEGAVRDEGDAVEVRMATAAAREASDTVPPLIISRPLHIQLTTAGQEAPAEACCEVALPPPPSGNAMHVYHLTGHCACLQRWQTSAPQEWALVPRPAPLPHSFVPRQSTGAGPGTLPALAEPSAXXXXRLGMAGVLRGSSPPCHQSTXXXKPLHLKNGLWHPAPPPLPHSFAPPPSTGAGPGALPALAERSAGGSQGRAVPVGHLSPGPDGRRARIHACKGGGGGGAGCARRGGVGGSRQPSXXXXEVAAAELAAHGVEASEGHGSHPTAVPYLDSQVRFVGWKLVGGGGGNHPVRDLCRPARTPVRHPDTRLPPSPXXXXRFVGWKLVGGGGGNHPVRVLCRPARTPARHPDTRLPPSPSPQTVVALLAAAAGVDVGPGGAPRPAEAPPRASSPGPSQALHRPLSSLDQLVRRLRRERSWGAAREGSTPSGTSQHLAAGEIGGRGPHRSWPCPSYQQRPPQQQQRVGSGPGSEPQPVRGFQRILSMQGSSDPARNPMPSPFKNPEVQVGTLGRGPESRPGPARRSSDGSPHAPVAHQASPSWELSRAHGSG

SEQ ID NO: 13755 - protein, 226 aa, Chlorella protothecoides
MASWTAVWRAGSYPARAGAPSGRGSAGEELDAGWSGRRGGICNRSRHKAPVVEPRDSAQFVLAVQDFQAKLDGPGTGGAVLFAVCRWGEVVVRSRVLGCSRGSPAADGDPGWRAVHAVHMQTPPPTPVLACRGKASEGIDFSDRAGRAVIITGIPYANKADAKVFVSPWRKQGAGAGQADARAGGARGGCLNRILHESKPRVVGFLMRSGHGNSWQRPLPLLDILP

SEQ ID NO: 13756 - protein, 156 aa, Chlorella protothecoides
MRELRTSGYRAVVEDVSARAALGVLLICAARESPLPPSTITFSQGALRRSFFARPHVPAPGGLHAARSGGEPRLPLPHQPPRLQVVGWRSGGQGTLGQHSLTFSRDLPITPPFPPRQHDVERFAKGNPDASLEVLDIEDLVRLGTQRQLCPFLLSK

SEQ ID NO: 13757 - protein, 155 aa, Chlorella protothecoides
MPGPDGRATVGAPTTGPRSSARPRVALANATNAARPGLGSGTAAGCKAALANVTNAARPGLGNGTAAGCKVPAWSGGAGPAPGRAAPARRPVGAGAPAPTPPCSICGKVPMSSAYEASCGHLACYACWLGALAKFKCPTCGKGVRKSHLLPKHFV

SEQ ID NO: 13758 - protein, 118 aa, Chlorella protothecoides
MHMSPRCQYVPHLNDPVGDGIAESGCRKTMYMHACSTECCRGQNSTAKHTHAQGWFDDRVECRAALGRLPSLEKLKDLDRSFLPWTRCDECVVGGGEREVEGSSSPLNDLSMVAADWW

SEQ ID NO: 13759 - protein, 1023 aa, Chlorella protothecoides
  MOD_RES (225)..(228): Any amino acid
  MOD_RES (248)..(283): Any amino acid
  MOD_RES (305)..(308): Any amino acid
  MOD_RES (688)..(691): Any amino acid
MFSARDHRNALARSSCLIATAMHRRSAFPHVSKVHAVNMTSDQAPASGRGIQWTGDGDSPAQDESVLQQEREKHRRRAEKFGVDFVEPGHRQELRLASKKERLQRPGFATGVDLFTEVKRRVGRRMPMRAKLAMRDFPSIPARPCPASTALPMQQEEIAKREQRAGRFGMSDTGLKWEPPAKDEAEEKRAQRAARFGTEYKPADALMDVGGYGRQGGVPCQPWAXXXXPSWTSVGTGSGRCAVPALGXXXXXXXXXXXXXXXXXXXXXXXXXXXXXXXXXXXXHCLATSPRHLHVSPKPSPRSTXXXXRERMNGHRPLLPPFHSQNLRQTCAVVTPYCLVLLRTASKLLLGTSIYHQSPPHVPPLCLHPPFSSDLLEVRAEPSLHTALRREAVYVYGVDLLSTADILRHFADYGPTFVEWINDSSCNVLFADGPSAKRALAGLGKALPPAEGSELQGEMGGEWFFAVAEQGQGWVFASWVDALVGGEGAAQAQSQLARLHLLVHGCCSGPVTACPAAPAAAWVCMGQTPAPRCSRLGGWHLGIPSLLCTHTGLDAADPSNMEYLWHKTAEEVRGATSDLLMRIANVDDVRPEGKVQSRRLWQAGQRGRGQGGRGAQARKRQRDGDEEMADAGEGAEQGVSHGWGVAEEVGGCLVQERSVNDGCGTGDRGGGKGEVSGHCAAQQGMPPXXXXLGRGASRGGGGCLDTALHSKACLHRNERPSSQQPPCRTRGGDGEGTGGRVPCRRASPQPSSPRRWEASRRKPRSENQPRRMPPRRPGRRSPTATSSGAWACDQLQGRRGACRSPPRHLTPLAGQAQAYARCLGRRITERNGRREVEPCAQPASHSLEGVADCRAGQRGIGRCLETMFSKGPALTLGDSRPFTLPCFSVTTQNCHQYGYRHAWSRQRKPGCIVLEACTPEPALCRVLRGLSAIPRCGRGKRGREKCPQPGYHPWCLDRLAGISMRIATPRCPWMTAARDPRWRVLISHNARDKSPPEPSESELVASPYITQCTGYKSSRAERQ

SEQ ID NO: 13760 - protein, 367 aa, Chlorella protothecoides
  MOD_RES (102)..(104): Any amino acid
  MOD_RES (261)..(263): Any amino acid
  MOD_RES (303)..(345): Any amino acid
NASAAAPDGGAHLIAGAADSASVESGLAAQRARRGAALQAGPGSPFRGRLRARVVVADLNAAGGKDYVVYQVRVGDDVGEWTVARRYRNFEGGEGGRGLKVXXXSRGGEGVRRLKGGERSGSVWACRAVQVSVPSWGRKGALLGILAGPGLSHLVLPPAIPLGASSPHPPPHPSTPLPKAQAATQARVCALPERGLCGGAARRARRLPSDGAGAPSAAGQAGVGGKGRRSGVVQCGDWSGNSGQCSRHQLLAARLGGLAVXXXDFVEERRVALNAYLQTVLAHPVLQGKLGLGEMGGEVGWFXXXXXXXXXXXXXXXXXXXXXXXXXXXXXXXXXXXXXXXXXXXRRPDSHMLPSCQPPGCSLTGNL

SEQ ID NO: 13761 - protein, 245 aa, Chlorella protothecoides
MAPPCSPSTTLAGAPSPPRPPTPPPDDGLSVSAPLYELVDCVFQLATRGFFRRQVFAVARQVLSLVAGTTIDEYLTARLRSLRSEHTIGRAIAGIQAALWPGGVWYQATPQYRAAQGVGLGAGIGVLGAGGPGSRARPPAARADSFLTPNGPPPLDAEEVREAVAQLLLTCAPATLVGLVGKSAYTSGMEDVIEMMQSETLILQLGYGALEILAVHLMPELKPLFLSLKHGGLGRPDADEDGPDM

SEQ ID NO: 13762 - protein, 96 aa, Chlorella protothecoides
MACARLTVLPYPPTTLIHILPYQQLFPRLEPAGVDLMKAMFEYDPVKRITAKDALLHPYFDDLDKALVDSMEDEEVGEQLAASIAALAAQRAGETA

SEQ ID NO: 13763 - protein, 194 aa, Chlorella protothecoides
MMYQLLKGVAHMHRHGVMHRDLKPQNLLVEEGPHPDHPLLKVADLGLGRAFSIPIKCYTHEIVTLWYRAPEVLLGISCYAPAVDMWSVACIFAELVRKHWPGMHPPAALATREPTPPHHHPSAQQAIFPGDSELQQLLHIFKLLGTPSEATWPGVGKLRDWHEFPQWKMQDLDLVRAGISRVLLSCHGMAMMRG

SEQ ID NO: 13764 - protein, 73 aa, Chlorella protothecoides
MKANLVVHPDKVRQKGGDVEAVARADMVFDILKAAWGKFEAARARRGSVEGAGLHLLSSSPRHPHSTGHCLVG

SEQ ID NO: 13765 - protein, 400 aa, Chlorella protothecoides
  MOD_RES (348)..(351): Any amino acid
MPRSRALPLGFARPGVVFLRPRHRTVLLRPGAPDEAPPRGHGAQPRAPVWPSHPDGGGARRGVPARPRPALRPQGSLDLASGIGRIPLAPSWHVQEDVAGVLRVAHHRAMFRPRRAEAEDMHQFHTEDYVSFLRTVTPDNVGAHQAALREYNMYEDCPVFSGLWEYCRISAGGSIAAAAQLNAGASDIAINWAGGLHHAKKFEASGFCYVNDIVLAILELLKYHSRCGRVEWRGRGNWSRCWAPPDPTPRRHALLLIGGVPPSMHATPPTPMLNPMSRVLYVDIDVHHGDGVEEAFLTTDRVMTLSFHKFGDGFFPGTGDVVNVGHGECAVTGSRGVRGAWTLAVEEXXXXDEAGKRIPGGRKRGGGASVRVCRHWIEGRAGSLDIGRGEECASGCLEIL

SEQ ID NO: 13766 - protein, 87 aa, Chlorella protothecoides
MLPAPPAAHHPPGQGKYYALNVPLRDGITDETYQALFRPILAKVMEVYRPEAVVLQCGTLFWAGCGAAVPPGPGGVGLQGLQGREGG

SEQ ID NO: 13767 - protein, 472 aa, Chlorella protothecoides
  MOD_RES (11)..(14): Any amino acid
SGAGILLSPYXXXXQGGCRAPQACGRLHRARQGGRAGDQEHGARRVGVRRETHLRRGGELVGWCVVCVRGESRGCQGRERGSSSHHMLISGHRWLLTGSHSMSLSSTHPHPNTVPPPPPLPSTGGWGEDGEAGEKTEYRVWNPFRSKLAAAVLAGVDNIHIRPGARVLYLGAASGTSVSHVSDIVGPEGVVYAVEFSHRSGRDLVNMAKKRPNVVPIIEDARHPQKYRMLVPMVDTVFADVAQPDQVGGWMGVGGAVTGRPLRGGWGRGCFRGYCLMDCTVLTCKALHQSTQSPECAISLRLRYSDPATWYCHPYPHDNTKAKPSSAHSQPPSPDPTPAQARIVGLNSQYFLKNGGNFVISIKASCIDSTAPPEAVFAREVKKLQEQQLKPKEQVRKGRDGGRHWRVAARGWATGRSGGLGDETLHTLTRPSTPGRARPPGGGPEPPAPCAPFGPARRGRTWTFFHDSDSPP

SEQ ID NO: 13768 - protein, 711 aa, Chlorella protothecoides
  MOD_RES (173)..(175): Any amino acid
  MOD_RES (264)..(271): Any amino acid
  MOD_RES (341)..(343): Any amino acid
METQAEIMDIDAQLDALVEVMRPAGPGLGGLGLSRSREELKSVMPPIVNYSQELGPGDDDSQFPEDTLKAEKDAGAGKEFPVGELGGTGSATSDGVHEQGMDAADDLNKDHGEPPRDAAPPLEPSLTLDVPVLIYHCQNLLAHLVPSLIQFNGVDTTAAPSPTEEPEPLGEVXXXLFLIDMPTATTDTCPISCLIPGADALNACHPTGDHAAAKAGQKARFWEAHPAGQEDTGRMMREMQNVPIYLVGCSCTGIPLPKPACTSXXXXXXXXNSGGDMPPPPRREPLVNKKRILARAAPASRSVTGTDATAGGLASPNEKVLVRQHQFCMYSWNCSEPRSAXXXPRLMRRFWAWQPTNLASMQRAQGHHTRWSRLRTSLNMLRPGPAAQQCNFSVPHPPSPQLFCEELRPTLVAENPKASMPELSRLLASAWRATSVEDKAAYAAMRADLMAAAGDPAISGIPATAEGRKELKKRVRSEGGKQASKTKGGCASSQACICFGDTCGCWYLSRRTPLVTCPSGTHADEAASDGESEKPCPPPSSKRLRAAAATEAHDSGEETEDDDKLRMVRHLFMKGPMVICKVGTCVRTRPHVQWLVRPIPSHYYPAHLLTFQECDWTKHPAAFIISENVKKGVPVLVAACAFGSWLGRGLGSVSRRAESPCKQEPCVFMAGRIFHSHAETLVVGLGWLEHTFPASHTQTQVIISWPGRDSL

SEQ ID NO: 13769 - protein, 967 aa, Chlorella protothecoides
  MOD_RES (426)..(441): Any amino acid
  MOD_RES (666)..(669): Any amino acid
  MOD_RES (834)..(837): Any amino acid
  MOD_RES (884)..(887): Any amino acid
MRCFARHRSPSPLIPPSLATMRAFAPSACAPCGASPRSGTRGALALRAPAPAFSPRRAQGRSFASSWPAPPMDHGTVAGAVATQAPPCPATVVPASKPGLISHDEVRALESSLDHGHSVRALYRFDAALRALSLDEFGEAGPAPLAECVGCVMRPPRPRTREFCVPSDHEAATGQSHRRCWRATKMACHPPPQVPSTLHPHFSLCLPFSAAKLRPVMLELAFNLESFNPAFTAVLLKVQSTIGLSGYHARDEALKRLILPLAGEYGLHADQPQGCGGPRASRRRDVGIDARGCGGRCRGDWGAPLLLGRPAHLVSFHRPLTRPLSHDHPAGATHRALFAEFYEDLLGEALEPAMRAAATSFPPAAAILYSQMMRDVLGGGGRTGDAQEQVGLGDLGRVDGMRAMARPGGARHLRFTARQSVPFPPXXXXXXXXXXXXXXXXPPPPPPPPSNKASYALGYNLAIEYLADVEKRLELEAFRHLDERVLAPAGRRLCAWEFLEVHAEGEAEHAAIGHAAACGLVPADHAGLLHAAAADHDRDFAAFYDALAAMLERRRGGGRGCEEGEAAWGAGVGTFCSLRRRLLPPSPACLGGWITGLGGVITLGDVKCKWVFPDEGIFSPRGHHRCPALGARRCSGGGQVDIAPCPRGAPQPSTPALTPPSAATGXXXXMQGAGSPVSAVWSLWVMSGASGSFQTRLFSLREATPDAPHSVRGGPQVVGSCGSVGRGEGRGCGWGWVSISHGDAGHKHAHNHVTRAQTRLALVTGTGPPLPRHPPAYLHPDVTPATRRQLVPGLTQLSLHPSGGCRSLGVMTRHALRAEGGRACCGQSWRPGRXXXXMVVRMLVPCVAMEDRHPTPCASSPLSPSPCPHCRSCPCWPPAACCSXXXXWRVQELGGHGPARIACRGRACCGQLWRPGRGRPPHPPLGLSPARHTSPGSSRGAGPPGPARCHLTRKSGGRCAACPGPAM

SEQ ID NO: 13770 - protein, 514 aa, Chlorella protothecoides
  MOD_RES (162)..(164): Any amino acid
  MOD_RES (183)..(186): Any amino acid
  MOD_RES (268)..(271): Any amino acid
MCFTVAVASLPYGGSVPPCEPLDEMAREFHRGLKGNFSQWNTETGRTKRRMPSHPGGDVPFSGPEGDRPTPDETRSSHCIGQDGLYEGICGTSTVHDSQGWGRPREATLEEQALPRAAFSVQRHRNAVPECVPLNLAPRSVCTAPAHDAAKHNKMYEDFLSXXXPTVNKRWYPGAHEPGSREXXXXPLSTRGGTPEHTSQVAEYWAARICTSILDAVGFDNHECTAATTSDRALPHVYLYIVYLQCEREFQGFPAGTDVIMCALPRDXXXXYLYIVYLQCGREFQGVLAGTDVSMCALPRDMLFARAAACAILTSFRNCPLPLSSAGAALLLPRYSPAILSRLESAMAPDQVRASHLLVKHRDSRRPSSWKEAQVTRSREEAESMIAEFHRQLTSGQADFAELARKESHCSRYLHSGRADWDAPRPADRPSARAGGDLGLFPRGAMQRPFEDAAFALPVGGLSGPVFTDSGVHLILQPLNLSSPHTLDLSDSKDSAVYDAESRLPIMNTEWPAL

SEQ ID NO: 13771 - protein, 576 aa, Chlorella protothecoides
  MOD_RES (69)..(71): Any amino acid
  MOD_RES (100)..(102): Any amino acid
  MOD_RES (258)..(261): Any amino acid
  MOD_RES (527)..(530): Any amino acid
MLRLLDRSSPALSHGGLYRAGAPPQPRTWVWCEVRGDEQRARVPGEVSGAFSWLSWHHTRHPQHWPPSXXXNRAGAPPQPRAWVWCEVHGDEQRARVPGXXXPDWLSCLFSLSMFHPCPRHPGVKRNECNFFCARCSPREGQAYCRMCLDSHGDCPGPVFQIRKYMYQTCVHVEDIAPLHDVTGIQAYLINSKRALLIHSKISALASANSALDEICRCPLCLVLLGLPGLGGHDIGSRWMGCPLHPPLSRAGCRLCDXXXXGWEGTRLDPDGWAVPCTLPFLGLGAVYVTVRAQIRPAAPDSGPPTADAGAPRPLTTHPGPTSSRSALPPPSPSSSAPPSAPPSPTLPLPQRLSASPSLGLPVLFAALQECRQQQQGVQTPYPFRQAPSAGFSDPGLAPPRRAPVLCGPPLPSDRLPPRAATGAHGGVPARAAPGPPPPRGRAGPALPKLQAIAAGAAAGRRRAAPALGGAPRCARPPRPAPGPHGLLGLAPADVRSWVSGPPLLRGGALWGLLLCKWLMIRCVGTXXXXAIAQGRGLVGIASMPVAHDPLRRHSLPGAGGAGAGGADRAVAPRSL

SEQ ID NO: 13772 - protein, 903 aa, Chlorella protothecoides
  MOD_RES (132)..(141): Any amino acid
  MOD_RES (475)..(478): Any amino acid
  MOD_RES (840)..(843): Any amino acid
VRRRRFQRGRAARPAAHHRGQRGLHQARQRVHRPHAVHRVGGLPLLQALRHDGGAAGPPARARGAQGPHVSEDVCYWELGGRGRGANGMLWSEARGVGRGSDLRGGEERGAFENVCGSTGPASTPSLSLSIXXXXXXXXXXSTPTPPPHPTPARHRQDDFHRILTEPESNMLRQQAALLATEGISLRFTDAAVREIARTAEEVNASVDNIGARRLHTIIERIVEDVSFEAPELVRAGWVGGGKCARDALDGVGGARVVGPPERREVRAAGWLHASIMSRGSGTEIPSLSYPLSVQTDSGSRPMEVVVDREDIVKKLEDLLKKQDLSRYVLSQGPGPRTTSAKSCQPERGAHLACNAGGCSTCRPTTVQAMCRSCLALPGSRDGAGVHGVPPGHATGPGGDWVLQHLHHCTSRAAEPGIGATMAAWTFSVHIRRVVESLNIGTTAATPGQGAAAGVAGSPPYEPRHQGGTVQGPGXXXXQQPEWLDLLPTTPGTKVVLYKGPGMLLFRILVRFKVAQMCGVGATGALLATLLRQEVCRRTGHTPPVGREHAPTPPLQHHGLLGQSRGVAGLERSSIGWLRVVPVTLPILHARRLTEPEAHILTSPAQWARHNMFGSFELSNSTGQGGGPWTAAPTPPRQLAGCCSRGCCVEKCMHAWLLCQMAPGAGKVVLRPFKNHVLTHEAVTAVHLVQSDSLGKRSCVCMGPTGGVGQLKLATVDVLARQGRHEAAASQVLKQVAITAGAAMSPCLEADQWQGLPLAAPACLSVQAGCSTQAGYWRRGESKRGVHPEQADTEGEEGGASVRRPLQAAAGSRQDEGLGLGPPRCRHQYWRGANMKPASXXXXASEAGERARVECIRSKPTLKVRKGGHLCGGHCRRQPAPGKIKGSDSGCHDAGISTGAALT

SEQ ID NO: 13773 - protein, 595 aa, Chlorella protothecoides
MGECREPAESRAGCMAAICCTFASNTHPFIIPRFIAEAAMGKIPVKFREVVYTLSPYEQNVMGGLWRDIPHKVSHYSTKVWDVRGPIITSASEASGWVVRDAVIFAVLPLWGIGWVWGYVGGGSERALGRVGGAPTVVRRSHSLQSLNSAGPSKAQASAPCCSSTVCLSSRCTLPYCNPAKRVCRRVYQASHEIPYRSLHPASPAKARCAVTFPLGCQAGWRRGMQTGLRHFDGVGADPAPSTPSDTIEHQLAACVREYLGNYLYDTATFLCERLVAETPSTVCWHAGGGPLTMVPSSGFNPHSLGLPVPQAHTLLLARCYYLSNQPYRTYHLLKGGEGVAPPPICMSAGPGCLSASDPRIPSPQASPPSQGVAHGAAGHFLLAKVHTLMNRHDSAASHHRAALSLDPMLWGAFEGLCTLGAETEAQAYLEGSGWAAQHGHAPGGGRAEACTSEQTPGASPSQEADVGPTPGSSQVGPPPTDSIADQAFSFPSPAPMADGGALLGVTPGSGGGPGYSGMQSYVTPSPTGLLAGAWWGAQRMRACHSRADGWTSLHARVQSAQQGSLLRMRSGHIPCGPPFGTPASTPTMHRAAPP

SEQ ID NO: 13774 - protein, 166 aa, Chlorella protothecoides
MGCGDTEKVRVFDLSWSRSDGRHLRDRQCATTASHPPRRLSSAKVLIVGCTGLGAEVRLEVAAGVDLEDTMSSMWRGVPGASTPRSVHPPVLPMSQVAKNIVLAGVGSVTLVDDTPCAQRDPGNFLVAKNIVLAGVGSVTLVDDTPCAQRDPGNFLVLADADGSQT

SEQ ID NO: 13775 - protein, 217 aa, Chlorella protothecoides
MNPLVDVQAQAGPPAGSGLEREAHGLVLDLTGDPASVSASSVACRAAGLPFFAGGSRGTIGWAFADLGEHRFVVERRGPGPDGATQAEACSTSYPSWARAMAADVGGRSMKRVHPVYLMLRAQALSPSGAGEGAGAAAADAIARLDEELGRPSGLQAEALESMTCTAHGLPAVSAVVGGILANDVLKAVSGRGRPMDNFFLYSIADGAGVVDRWGDA

SEQ ID NO: 13776 - protein, 151 aa, Chlorella protothecoides
MFGTNPPSSTPCCPLWSPFPLSSCNPASPPTHTPGYDEEARYFDPDVSAAKRAGLTSDLLDLVRPAYVAQLDALRGMALAGFSAQLADPQAPEGEAWVDRVARLEAEALAMFDSTAPDLAVGPAAEAWAGLEAGAREGLRSALGAEAAATR

SEQ ID NO: 13777 - protein, 201 aa, Chlorella protothecoides
MAVDLSRAWRVSAAVFYDRPTPALRPAKIEETHALLQRLRPDLARPLHPGDWLAAELAGTASSATPLTVRTAPGQAPARRGGRPALVLSSTSWTADEDFGLLLRAADLYDARVRVQGVSFWFVWGRRGEEGSLRQWGLARREGGWLNRMQGRGLNRNPRATRGAGSRQGECEEAHAHETPTKSPMRMRHRPRGPATDARFA

SEQ ID NO: 13778 - protein, 161 aa, Chlorella protothecoides
MDINLLRQPGLDVASGRPAAVANLRLQLEEAAKPSVAAVTGSCLGGGLELALACTARPALRLILSGAAIGAAEAATLGLVDEVAAAGEGPLAAAPDHPLRGRGSLLERDDRLPPPAEAEELFAAARDKTARQWVNLRSTLLCLDAVQYGVAHGGRAGEDKV

SEQ ID NO: 13779 - protein, 131 aa, Chlorella protothecoides
MRTHANDFSPYIAEVSLCEKLARWVESLVLAWHGTLGAVRCSRRKHSVSCWGDVWPSNKDDVTGPVEDGEVFEAYCKEVESTAAWGGHLELQALSQALGKPIKVWAAAAAPQLLGDEHPAWATIYETLSYA

SEQ ID NO: 13780 - protein, 249 aa, Chlorella protothecoides
  MOD_RES (43)..(45): Any amino acid
MGVEGVLVCIRCVFLQGSSINIDHASTPRFSPSTTARCMPGSXXXSQALILAMPQLLAPPTQPPPGACRGQSRLWLSLGGARRDWVPARPPPPAGLQDRCAAGLPATLRRSASPCMPRIVMFGARNVSIQHHQSLKRSLPHPPSRSEAGEEAVASASGSVFFFKNGEAQGEAFSGIPLATYYPAVSLYTHASQPTPARVSVNFGATPLAICGGRDSSEALAAAVQVPAVESVAALSLAVSAPPRALGAA

SEQ ID NO: 13781 - protein, 120 aa, Chlorella protothecoides
  MOD_RES (37)..(40): Any amino acid
MYEEGACDSHTSHHLLQAAIPRLLLQWWQGFHGPAAXXXXTKRELATHIPHTTSSRLSSLAFSFNGGKDSTVLLHIIRAAVAMHEQASPSGAAQAKGEPGFRPLETEGLPVGGRADNAER

SEQ ID NO: 13782 - protein, 361 aa, Chlorella protothecoides
  MOD_RES (87)..(90): Any amino acid
  MOD_RES (246)..(249): Any amino acid
MLPDTRLERAGRSDPARHASVLSDACETAGVIIVGDEILAAKVEDVNTRFLCKELRAAGWRVCKHTAHLGYMGALHTVCCSGVSTTXXXXGGCSISEAPDHGNSKCPAPKHTAHFGYMGALHAVCCSGVSTTRFRTLQVAVVRDDVKAIAAEIKTMSAAFNVVLTAGGVGPTVDDMTLEALAGEEGGRVFYACDGVGWRRQGVGVTARGGWLGENGWDEKEEGEGNTSFTRPPANARGAMADPAHXXXXEEGEGNTSFTQPPAKARGAMADPAHQLSFYPPSSPAEACDTHISRNPELERRIRAYFGSDVTNAHLKMAEIPEGKGDTLGWREGLAGHMTMAFWLKNQVQIEHLHLATHLVW

SEQ ID NO: 13783 - protein, 160 aa, Chlorella protothecoides
MEAGICRPTPVPSPTAHAPLSCAGSALAAPFRRSKKQRTSGESDGVSPGTCALPGEDVKPALPAPVKLSPTDRAPQTSITNDLTLSSSRGYRTVRATHGVSSGAWYYEVTVESLGQTGAARIGWATAVAELQGPVGGDAKGYSYRSLEGSKVCCVCHCRG

SEQ ID NO: 13784 - protein, 422 aa, Chlorella protothecoides
MHVGICQGSWVQTGLAHPLGAGAVHDAQGPVAQSLRAAILLALATLITPAVEAGPDVRGVTPDLLPRYSIPSDADFECLDGRGSVPASRINDEYCDCTDGSDEPGGCWEGPVRGWDCLEPMHRLSRRCNRNAVAVPLDSLVPTARASAGTSACPGGSFYCANVGFEPRTLKAALVDDGYGGNHTTSRLEVPLLGPADCCDGSDEPVGSCANTCQARGLARKAELAERLHAARAGLQRRAQYVQEAASKLTGWKAELARLRDDLSRQEVEQNAAEGVWGWLASGRGMLRATTWRCPGFQGLALTPYGMNDLLHPAPKVFTLSSIANVPQAALRDSLQAKEDELKAAAEAAEKAPASGGDTNKEHQGSTGTPDADQAAPEAISADEVVAADQVHEHVLLPEEVRIEGESPLSAWLGGTTRTRPT

SEQ ID NO: 13785 - protein, 441 aa, Chlorella protothecoides
MAEAQGDGTAQPATQTDKDMAAAAAAVSVPPGVLGRAKTGAIGAGQWLWKKCLAAGWVRVGGRAAHHQGQWLWKECLAAGWVRVCGRAAHHQGAWLRAGFPWRDVHLRPGVFQGPLLALFTALADVWSAALSLLPGSRSRSAPAVLKSKECKLTIKLPAWACTGRPLGPHNSVAFSLSIPHHPFLCPVLAQLKADLDAAKSPLSHARTTASAAATAVRETKKAIAELETKLENTGKGAYGEDSAWAALDGRCFSAQVDKYTYELCPFGAAKQVEGSGGGTNLGRWEGLLDDGARLAFQRGQQCWNGPARSLQVPVPDGRRAGSRDVGSGDREGVVVHRIHGDIQHIADIARPPMSLHTPARPAVSLPPISFPTSNHSNVSPLLLQATTLCGPTERLFDVSEPSRCEYAARFETPAACRAVDVAALERELARYGGAPVHEEL

SEQ ID NO: 13786 - protein, 150 aa, Chlorella protothecoides
MECYREEIFGPVLVCLEVDSLEAALDLVNANPHGNGTAVFTSHGATARKFQSEVDVGMVGVNIPIPVPLPYFSFTGRGHLGGREGRGGGGCGCGTSYTEGRVMLLGGAGGRRPSDARGGLNSGTRVADPGASRPTLPGHRPPPTATRTPS

SEQ ID NO: 13787 - protein, 36 aa, Chlorella protothecoides
MDRLAGARVFSKLDLRSGYHQVRVAEEDIPKTAFTT

SEQ ID NO: 13788 - protein, 496 aa, Chlorella protothecoides
MEVFLKAIDAASTMNGHGFVAIKLTALGLPELLERVSNALTAIRGLFQQFDDDGNGSVSIEEFKRVYKEFFIDDADDVPKGVRKLGRGVLGFWRGVGAGHVRAAGWRAGLGAAPTAIASPSASWFEQLDVTKDGQVDYIDWTGQVSAGRSGRGGAFTIRWKEGCETQSRNPPQFRRQAFPGRLASAPPRLPCHRPRGRLPTCIHPHSPPPPTLGAKYNSSPPRYPPPLLKISLFDTNSIAKRCRSRGPFSDAALNEEENELLRKMLGRVDRLAAAAAAAGVRLMVDAEHSWFQPAVDHATAQLQAEHNRERPIVFGTYQCYLKDALPRLAFDLERARRGGYRFGAKLVRGAYMVVERRRAAELGVPSPIHDSLAATHESYDACVAEVMAHVADEGAGMMVATHNQASIEAAVAAMEERGLGPQAGVYFGQLLGMADNLTFVLGQHGYGAYKYVPFGSVDEAMPYLIRRAQENSDMLGGVGKEMAMMRRELRRRLLG

SEQ ID NO: 13789 - protein, 164 aa, Chlorella protothecoides
MAAEAPPPEPLAPHLHRYGRAGHSPRNFGGPPLLVREQEDGPVEYKLRLDSVSHVRFQQLVGARGCDSRRREGGVCRPPCIGHPHPSIFAPTILGQVTQLQYRLSEGEGACVYYLGVEDNGHPQGLEPAQLEATLRTLHRMAAEVGARVASARPLPARGGRACA

SEQ ID NO: 13790 - protein, 435 aa, Chlorella protothecoides
GRRAGRAGAAGDAGRDAGGAGRAGGKGKASAGGKGMACPPAASRAGVGVRALGLSDIHRDRGRGCKGRAVWCAQRCSSPTPNPHRMRPARVTISTPPVSIPCTPTCRLQGGCSVPCRCLFPHPLVIPAHQLHPQGEELILYPIARCLSVDDEGRIANPLFPITNPRPGRDGGECGTHPGPDGAGGSTVAPRPPTPCARPTHHLLRRADTQGNPARGRSECRQGRGRGAWGGASAWWGVARSLRRHPHTHPAPHPPPQVVLANADKPRIIKHKGTTDLVTDTDSASEEAVLQTAVLHLAQSPPPTPQAITRAYPDHGILGEEGGVMGDVTSDYLWCVDPLDGTTNFAHGYPSFAVSVGVLRHAVPVAGVVIEFTGGPGGWITRTYEAARDMGATCDGRPISVSRVKVLEQSLLVSVLVFGAKKGERPQLGAALAAG

SEQ ID NO: 13791 - protein, 334 aa, Chlorella protothecoides
  MOD_RES (281)..(283): Any amino acid
MDLFRALTDVTQGVRREGAAAVDLCHLAAGLVDGYWEFRLKPWDMAAGLLIAEEAGATATTMGNGALSGKGTGGGAPAIDYSRGEAIVPTTQSVARLGTLSVGISSPLPAITEPDHSHDLHAVFDRSLLVTNGFVHEQLLALTDPKVSALLEAGVDLSQWPPVCHRVAFVVAGWWGPEMAAELAVYVSGEANLLEGVVRGQSARRRRRRCRRSLGWWWRRRCAAAPPPARSEGVAFVRQEAGTGQSQRANQSPLAGPPGLATHHHLGVALDGEADADDARXXXPPRRGPLAWPHTIILGLLLTEKPTQTMPGLYQRPYSQDSLAPVIPVPANSE

SEQ ID NO: 13792 - protein, 769 aa, Chlorella protothecoides
MKNCLKEAARGQPPYQEQNEFCFVTKGRGEEGWGGIIASCRPASASPGEGRQRRVGPPPARPSLGPHQGGTDRVGGGAALGGGRVAPVRLQLGGLDEAPLDARAGVRVHLAALVADHLVEVAAAALGEVALYAIAAGEGDFQGQRLIGSGRVDGGRRRLGDHLHVVRIGGRELVRLHAILMVVVVGEKISPQIILYKLLFEAHHKLDLRLDLRSQQILLGVGLPVPVALQGLEVAHEAVEVILGLRDPEAIEQRIRGPREHAVLARERGVELGNDRQAPVVPALAPGKGGRAGAGLEGGAVVARHQQGVVLRSIARLAQVHAIIVAVQYGRTRTDRAGRHVCREWGGGAGHSCSKVLGGVLVAVAPSHAVLPWAHLISDIGVELVMGCAPRGLSKTAALLPSLVEKCCMSDVVQRGINCGGLATSSTPKPTAGCAPSVPGPAPAPTMAMGMPYGMQSMLKDGHKIMSGLEEAVLRNIEACKGLTQITRTSLGPNGMNKVVINHLDKLFVTSDASTIAGELEIQHPAARLIVLAAQAQHAEVGDGCNFVLTFAGELLGHAEALLRDGLHPVEIADGYAKAGKAALAALESLVVPGSVDLDLTSADAVARRLLGPLSSKQYGVEATLAALVARACVAVLPPNPANFAVDNVRVVKIRGGTLSDSYVERGLVLRRGVEGRVASAANARVAVYAQGFDTSSTETKGTVLIRSAGELEGYAKGEEAKLEQVVKAVAGGCCVVLWGWRGDWVSPSDPDAVLPTPLHVRPNAPAHP

SEQ ID NO: 13793 - protein, 418 aa, Chlorella protothecoides
  MOD_RES (101)..(104): Any amino acid
  MOD_RES (378)..(381): Any amino acid
MYRRGRKPRCSGCQRLARIRRLLSASQAMRLFTGSAPLPPLPPTLVQTPDCTKLVEQWVYEMATHLKSLDQNHLVTIGAEGACGRRVDECAGVLSGKAGVXXXXGAEGACGRRADECAGVLQGRSVSMVLWQDGGCHGGHTGDRNWASFGACDCVTGAVPFLSVHARRNPPRSVVSTSLPSPPSHFPTTSPLAESRVLGGARQDADRQPRRGGGLGLGRQGGARLCASPQHARGGLCHHAPLAGQLADQEHQLCGRVDPQAHRGQHQGAQEARPARGVSGRRGWCNGGRGQQSVEVVVARGHGCDAWRHVSGVPNSGNDAGLESRDPLNECPCKRRPCLAACDAGCVAGMAQSTLNSHPFRNQHCPSTNFNHCHIDTXXXXPCKRRPCLAARDAGCVAGMAPIDTEQPPSPQSALSIN

SEQ ID NO: 13794 - protein, 388 aa, Chlorella protothecoides
  MOD_RES (18)..(21): Any amino acid
  MOD_RES (254)..(257): Any amino acid
MLAWSPSRAGAAGTAVGXXXXRPCWRGRRPGPEPLARRWELLPLSTCSTRPQQRASTPSAPGPTPQIPNNLSRRVGAVVPQIVSLSVCVPGQLAWRAVQMWAPLPVAFTPAPCSSLGNGEEACSPFSIPPPLPCLMQVSPGAYDENAFQALDLVIAEAEKKGLRVILSLVDNWKYEGGVDEFVDWAKTVPARDKKYPVATGGDGDVNDMVGWSRQSCVDGWGCTVGLLSRVVWLHRPRFLHYVGIQLKSRPAVXXXXMQVEHHLITLIPASATPNSHRQEWSEDRKQYEALRKVLFFTDAGVKTLYRNHIRAVSAPAVWDGDVAGMELAPGAMDCRMGPAISDPVWHRPLPHAARTITPAALSSCPDPGAREHCERQGVPRGPHHHGL

SEQ ID NO: 13795 - protein, 139 aa, Chlorella protothecoides
MHLKQEFVENDLRTDLLPNHHHHQDRVQAYQFSAAYADDMQMVPQAPPAPIHTPTSNESLSLEVPLTRRDRVERYLSKRRRRNFNKVVRYQCRKVYADARPRIKGRFVKPAELEAYRRDAAAAKGSPPADAISAPLVGA

SEQ ID NO: 13796 - protein, 139 aa, Chlorella protothecoides
MSLQRGVLLLLALSACVAAQSCSDISAISNGAKADGKTNDAAVFAAMNSKSSIGLIYMPKGTYLIGTSITISKPILADYGAIFKLSSGVTLSISNQPEHSIDTFFSGAGSGGLGLPSRRLKLHACLRSSPGHRGDTPCG

SEQ ID NO: 13797 - protein, 150 aa, Chlorella protothecoides
MTSCAICPRPAVLYCHNDGVHLCQACDTSEHNTLLMASHHRTALESSPGSPTFSGSESWDNGSLAVVPQFDASFPREDSMFPGAADALFDGFGIPESQDDFNCLMGDLEPLKSDWDWETDTKKDLLGPKVKSEVQLVVSLRLGGDGVGVS

SEQ ID NO: 13798 - protein, 370 aa, Chlorella protothecoides
MEPFPGARPRKTPSDACTRHPGDQSNSEKPMSSSSSSSSSAGAAAAAAAAGAGGVGQVGLDLLGQGEGVVGLHRDGQRVLVAVDEGVGRGGHGGEVEGQRGGGHVADAGGEQVAQGLVGDVQDLGVVERAVVVHLLDHQAVSEGLDAQLGQEGGLGGAHLLARLDQVHVRHDLHGALVDLGGDVQGLEEGGLGRVHARVPSVHRHIVRGHQAHACRGANLELLDLVADLVQVALGEDQAHVAHQMVQQHQPLLVASALHVQTQAAPDQGVLPHQHRGVLAQTLGVREWRGGEGESVGREEEEGETATRRSPGESSQRLPTHRADVHHLHGPDIVGVHQEGLGVRVQQLAQLGVILRGEGAGGKQGASCAR

SEQ ID NO: 13799 - protein, 320 aa, Chlorella protothecoides
MGLRALSLYLLATAGLVAGYVPLQQDGIASANPTREAYLADLAAIRASTSPPSPPRAPSSSINDTDTGPVLSYTVNQISRIVAVDILQATMSDTLRALESMPKATAGAGLTQGSEAIGYGRRRSSPSDDVNHFKAAVRRVSPSPPGRQLRVTAASMEDAAFSQSSSGEGLSMPDETLAPSSAAASPPQPRSPPPPEYVAASPPPPPTTYTPLGRATLSQLPAGLVPRVKTMAGVGKGCPGTRSARIYGARGDGTTDDSAALLATAAAQSYVYLPVGTYLIAKSITLTKPILAGACDSYILWGKRGTEKARSRWCKQNRSR

SEQ ID NO: 13800 - protein, 251 aa, Chlorella protothecoides
MALHFLDKYGLMAVKVPSKFDLRRVCRATGAVALMGTAAPTAAELGHAGCVELREVGSTPAVLFGGQASRAGIATIVLRGATDQLLDDVERAVDGGVNAFRALTKDARALPAGGAVEIELARRLADMARKVAGAGGGGGSRSGAYAIARFADALEVVPRTLAESSGLPAEESLAALHAAHAAGQARAGLDVETGAPRDLGEDGHLDLFAARWWGLRLAVEAATTVLRVDQIIMAKTAGGPKPRQGAGDDDD

SEQ ID NO: 13801 - protein, 297 aa, Chlorella protothecoides
  MOD_RES (274)..(277): Any amino acid
MLDDKRSACNAVGAISSSWLVAGHQTKKGRSHCFRFPPAEIGVALTGLGIAVQFLGVIFLFDRGLLAIGNSTLRGFPPARSMPSVSPSQVLFLSGVALTIGFWATLRFFMRRKNYKVGVRCAPWAIGMEWHADHWVAIQVWNPEGIEGMSHCPAPLQGSAFFLVGFALVVYGWSIPVAHEAASARFGRGSTSKCHRELPKGLSICPLPPRLPPGAVRLLAALLCFLPHRIVLPAENAVPAGHPGPACLQRGAWRLWMILPGQGGWGWAAACSRXXXXPACLQRGAWIVWMCLPGQGG

SEQ ID NO: 13802 - protein, 179 aa, Chlorella protothecoides
IETRREAEGRARALAAWSDDEVRLLQKALDKWPAGTAKRWEVVQGYVRTRTTDEILDMVKHGLKAHAARAVPQTYEVAAKRQGNTVIRSEATERHTSFTDVDVPAVNGSKPATASPEAAAPVQWTEAQELALIKALKVVRKEVPDRWEVVSSLVPGRTKADCFTRFKQMKAAHKAKTGK

SEQ ID NO: 13803 - protein, 378 aa, Chlorella protothecoides
MGPALEESSVIPTVAVGPDTDDGADIQIDDKLRRAAEREMRRSSNPSAKRVRTEASIGRFDYAAPGLMEEGLTGFLLTSTFDREKSALKEAVALLEGALVSQPNPIQALPPLSSIKLAARGLSALRLMPSSAAAEVAGDLPSPNRDLALLAASLAVSIVTGGSSARFLQRLTPIQTTCTADATAVRGAASDLATRSEHWQYCWPGGTAPDREDEAQLLTFAVAFKPRGNQGPCVGEAVKSRDQAAEPSTAVASGQGANALPAGGLDKEASPPSTDASGSAQDAVQTSRPKGDQGAAGATQSLRQELTAAAAAGLQAGIKTWLPHCTVRVDLAEPSLVVLLEMLPVGGSKVFAGLSLLSGEACTMKPRLAIKALEKAHK

SEQ ID NO: 13804 - protein, 632 aa, Chlorella protothecoides
  MOD_RES (100)..(103): Any amino acid
  MOD_RES (171)..(173): Any amino acid
MSTGQAGMGGDWGASAAPSQGCHGREAAAAGKGSFAWAWMLDERPEERARGVTVEVAMTRLTPRSWSWTAPSVCGGAGEGGRCGGQGRVTGIPSIPLAPXXXXRGGAGEGGSRGDQGRVIGIPSIPLAPCWIMASMFHLSTPLSPTQAASRRASRRPPAQGQSGARRGSTXXXPLKPPLTHPGGFEAGFAPPSGPGSIGGQTREHAQLARSLGISQLAVVGTKLDAISGDPEEQAARFAAVRGSLEPFLKSCGFASRAVQWLPASGVTGDNLRGRGDGTGLGAWWRGGTLEDAIDAFRPGSGGESERERALRLPLRLVVHEAAAAGSKGAAQLGGKLEAGALLPGSRVLVMPSGQAATVRTLGAEGAGGVAAGGSSPAALLAGSGASLTLAGLDDPGSVGPGSIVCDPAWPVPAASAFRARVLVLQVPGPILPGQQGVREYRGQTGSVAGMAGVVELRGDADVLDQEAQAMDWLSCEQQGVGVLPRRQGERDAEEASAGRALAPTGALSCVRPAGAGGGGAGEAAGAGDGCRPSRAGQGGAAGRGKDTGRGPHYRAPVAWESLAALLPITQAVVGQPQTRGYRSCVIATCIMRGGPVARPQGLITTRVGGRARSSTLRPTGAAAQLRGGQYR

SEQ ID NO: 13805 - protein, 337 aa, Chlorella protothecoides
  MOD_RES (315)..(318): Any amino acid
MVLGDTCTRGCRFCAVATSRAPPPPNPREPEDTARAVASWGVGYIVLTSVDRDDLPDGGADHFAQTVRSIKALRPDILVECLTPDFRSCPVPRRRRAERHVTTLPPQGRPRRRAPPGTLGAGRLCAQHRDGGLAAAARARSARRLLPVPGRAAGCEKGGRAHQILHHAGPGGGGRGGRGHHAGPEGRGCGHFDPGAVPAAHAAAPGSARICHAREVRVLPCTPPHMPTTHPLPTHTHLQAEIWRGGGRVPVRCLRAAGAVLVPRGRVLRGGHAAPGPCRKRGRRQAAGVGPRGARVLRCCSSLMGGTRDSCVATXXXXANSAAAVKLQGVDLVAPDF

SEQ ID NO: 13806 - protein, 662 aa, Chlorella protothecoides
  MOD_RES (362)..(364): Any amino acid
  MOD_RES (400)..(403): Any amino acid
MATASKCRRNVCKGGLHTSKTTLKCSGLFSHGSPQIMHVRHERTGEVLPAVWVCRWGPMAALTTPFLAPTACHAQSPFTHRKSATVGSSRRCFTVCRAALQPSLRSTETLRPVRGEVAASAPATVANLGPGFDWLGCAVERSALHAFWSKAPQGDLRAAPSRIKCKPSSSTFPTPLPGPGGHGGGSAPAHRPPRRDRDPARDGRGRAPVARPREELRGHRGGRYAARHGRAARLWRRPDPAQGPPPGQRPRLQRRLGRRGCGGGERAVWRPPEPHGPGPAGAGVGGRGASLELHSVEAVASWIPEATVTCRQGRHLTRDSLSSPLSAASPPPPVPSFLSATGAASRWTCSASPSRAAMCGSXXXAASSSSGGGAYFGCWVGGSFQWWVDGKEEAQVWRGXXXXRLRPHQELRASGRAAPRFPGRRCVVCAGQPLLRGPHRRDAGRAAQRGAHGGADAQLRGGRQPGGRHPAGRCRPARPQPGRRRGGRARAWAFDPGIRGGEGGGAGRRRLRLHHQWCGTDRRGGGAGPGHGGARGGGHVRRLQARGEPGHQLRPGGAPEPAGRAQGLTGRVCGGCVGSEGCDGCQPDGERSQVPRGLPGPCRAPCSVTAALLHHSGVRRRDTCRDCGHKHPSRQTSCKNRRFHRHLHCGRGQRARVAGRHT

SEQ ID NO: 13807 - protein, 219 aa, Chlorella protothecoides
MKSARINAECQDHECNLYPSVHSSDPPARNPHPTPSCVSKSESRPSLAGCLIAIPDRKACTSQLQARGTAPTASGTSTALPPALESIVQSFQAVPDPMSVRDGHLHARPAPNGGNHDRCSPKPVTPPLLYSPAAAHVMAPTPHHPLPPLAPQRYKQLLHFASRLDPLPAEFHTPEHKVEGCVSQVWVAAQLDRAANTLSWRADSDSQLTKVGPACWGRG

SEQ ID NO: 13808 - protein, 1059 aa, Chlorella protothecoides
  MOD_RES (14)..(17): Any amino acid
  MOD_RES (134)..(136): Any amino acid
  MOD_RES (816)..(818): Any amino acid
  MOD_RES (930)..(933): Any amino acid
MRAAYALYGLQALXXXXALPLAVTRGVHEAGQEGLLEMPTAGPPVREVMVHYSVSRACHRAASDGRAERDEAGVGRGSPFRQGGGRGCGAARNRVTRGSGGSGGATNGAWALGQLRSPEATEGAHAGAAVWRAXXXLEGREGLPMAHGHLGSSGVRSPRKRHMRAPRSGEPSPCRIARRLGSACCHGALPPLDLPCPPAPARAKLGRALEAAAHAAHAAHAARHGRARPLRLGRLGDHGLGGGEQGGDRRGVGERDAHDLDGVDHPRLDQVLELARGRVVAHVGVGLGALQQLAHDDSALLPRVGGDGGGRLADGALDDADPRALVEVGAGVLDRLQTARGVDQRDQRGAAPRHDALRHGGLGRVQRVHDAVLALAHLELGVAADLEHGHAAGQLGQPLLQLLAVVVGGGGGDRLPDHVAAVGQRGAVAAAVEQHGVVLGHGHLLGRAQVAQVHVLQLHAQVLGDDLAAGQRRDVGQVGLAVVAEAGGLDRADLDPGAKTVDDERGQGLALHVLGDDEQRALRLQRRLQHGDDGLDAGDLLLHDQDVGVLQLHAHRLVVGDKVGRDVAAVEAHALHHLQLRLQRLAVLHRDHALLAHTLHGARQQLTHLALAVGRDGAHLRDLLRGADLARAALQLAHHVVHRQVDAAAQVHGVHPRRHRLAPLHQDRAGQHCGRGRAIACRIVGGAGHLLHERRAQVVEAVGKLHRLGHSHAVLGDLGPAIRLLDHHVPALLVGVNASGWGHIWVGFRGCVCHPTVRPPGMCSWRGPAACHAPGPAFHRQGLGCSAVAGEAQSNSPLQTLMRLPGDSPPLPAMTXXXPTGKVWAAVPWQGKHNKIPHSRPLGAFQGDSPPLPAMTPGNSNRLPRHSSTIQAYLGAQGDLDGVSQLLHALQHGGAAGVAKQDVLGGIPAGLGGTPAPPQAHAPRHPVHGXXXXNGSMMWCKEPLHHSRYMLPDTPCTAITDPTHRLAARPGGLSQEAPCSLHDARSGDDSQSSACGADHKGVLPLTRGALLEFPSHPLPAVLRCPGGGKERIFRGWRDTIAGRCTPVLPHAALQGSFKR

SEQ ID NO: 13809 - protein, 267 aa, Chlorella protothecoides
  MOD_RES (140)..(143): Any amino acid
MAHGERELGPRNRLRAVRSPVMLILPPVAAGALESCPVPLPFAGPALTLPLDRPLLARVHVDAAYAGVFACLPDQHDLYFQGLEGVDSFSTNPHKGMLVTFDWCGGRVRCFIHGAAKVFSRDSVSQSRLQTSSHERRTPXXXXTGASRLQTSSHERRTPVLLAPSHPHLPSIPTPIQLGPVGSELVLAAHRALPGAAVPVCGAAACCRAPRLQGLAGAPGSAVPRPQALVCAPHVWDRASPGLPPPPVSSFGGMRSCWAYVPGGMLR

SEQ ID NO: 13810 - protein, 177 aa, Chlorella protothecoides
  MOD_RES (132)..(135): Any amino acid
MNLVAYGIHSHAAHYRLERGVLFDDVMVPPPLLSFSTIQFRQLGYKMIDAIVDYRSNIEKHPVRSEVAPGYLAEKLPESAPTQPEGLDAILSDVQTHIMPGITHWQHPSFFSWYPANSSYPALLGDMLSSAXXXXPAATELETVGFLGVLKPFVGAGRSFVGHSDRAPGSKHGHEAA

SEQ ID NO: 13811 - protein, 94 aa, Chlorella protothecoides
MAKALAQLVEADPAFDIITTPRFGLVCFAPRGASEEESTALLERVNASGRTFMVHTRLGGRHVWRLAVGGVHTQWRHVEEVWALVQKVVGGGEA

SEQ ID NO: 13812 - protein, 175 aa, Chlorella protothecoides
MSFIMGSHRKHEPLDAAVHLLLFYSMLLVTAALLAELARPSSPALGLARAWAAVFLGAWLCEVGVIEFDGLPQWSTEYAGSAMFAPVVWAMIGLLVASALLALFASLAALQRRGLLPALPPRVAGSGADGDCPWQGLDPKVEPRQTSMGPDAGAGQTYTPVSDGQRWPAAFHIDV

SEQ ID NO: 13813 - protein, 320 aa, Chlorella protothecoides
MDAETGMIYSFMPSVLFTITASIDAALRPATRLALQGFGITDPAQVDAAVTSAVASQWAACGTLLAAMSNPASGVTSPFLSSLGPFPYPPEFCAYLPGAMAPYLGFQPDPSQFGALGLALDTGAAAAFLAAAKGATNATAMDPAGAAFLGAFLTTPRAALLAGLAAAPATQALAQALTPITATQWGLLQGYLVSLVPTWGTLVYRGFLQSFAGRAGLVLTKTVDQWLNGYEDPILLLAAKQLHPTTWQLMPWTYTPQLALAFPTEDAPLRFFQQTTGAPMAVQDLSYRASDIGRYLPLIQQRALSTGQAANSTLLGVRWL

SEQ ID NO: 13814 - protein, 61 aa, Chlorella protothecoides
MGKAGQKGETHFALSIVSPRFQGLSTLKRHRLVYASLAEELAGSVHALQMNTQTPEEAGVV

SEQ ID NO: 13815 - protein, 159 aa, Chlorella protothecoides
MPSNPLHHLLLQVTLDWLARFLRLPNAFLSTGTTGGGGVIQGTASEAALVALLAARARALDGRNPGADGPRLVAYTTDQAHSCVKKACAVAGIQHLRLLPTSAERGWALDPATLEAAMTADEGHGLMPFFLTTLIGTTSSAAVDPVAELAAVARRHGAW

SEQ ID NO: 13816 - protein, 364 aa, Chlorella protothecoides
MAWLVKDWSWGAVLVASYFISGTANQNLFSAQHEISHFLAFRRPLYNKILALASNMVLVVPVAVKFREYHHDHHLFLGIDGGDVDLPTVLEVGAVGSLAAKLAWGLVYLCIYGLRPLIVRPKPPSAADAVNWATTLGFDLALLYFWGLKPVAYLLIGSLIGGSLLHPMGGHLLAEHYMFEKGQETYSYYGPMNALTYNVGYHNEHHDFPQIPHTRLHKLRRIAPEFYEPMYQHHSWCWVLWAFFADEKVGPWLRVHRLRKEGAAPTNTRFSEYGGLYAVWRRLACSDPEPFAPGVAGEAGPGAPAGTPVAEKLTPAPVLKERPTAAQPVLGGLAEKPALTRRSAAMAHGRNGSSEENTPPPTSR

SEQ ID NO: 13817 - protein, 543 aa, Chlorella protothecoides
MCLPPPTCIHTHQQGRNVVIEQPYGGPKITKDGVTVAKAVEFSDRFHNLGAALVKQVAGATNDAAGDGTTTATVLTRAILVEGCKSVAAGMNPMDLRRGINLAVDHVVSELKRRARQISTTEEIAQVGTISANGEREVGELLARAMERVGKEGVITVQDGKTLETELEVVEGMRFDRGYISPYFVTDNKTMRVELEDAYILIVEKKISGIQSIIPVLEAALKTQRPLLIISEDVESEALATLIVNRLRAGVKVCAVKAPGFGDNRKANLADIAALTGGQVISEDLGMKLENVDLSHLGTAKKVTVSKDDTVLLNGGGDRAALADRCDMIREAIAASTSDYDREKLEERLAKLSGGVAVLKVGGHSEFEVGERKDRIVDALNATKAAVAEGIVPGGGTALGIVPGGGTALVYASRSLESVKDACANFDQRTGVSIIQRAIRQPAATIAANAGQEGAVIVGKLLERPEADADVGYNAATGEFEDLVKAGVIDPIKVVRVALTDAASVASLLTTAEAVIAEAPKPEGASPAMPGGMGGMGGMGGGF

SEQ ID NO: 13818 - protein, 267 aa, Chlorella protothecoides
MPVDGSPPAQEHRAATLAQYSSRLAVQVAVVISKIARVDYPKAWPDLFQTLLALLSEATSRHTGGKGRIYALLGGRRLVGPSVEMRLGGCCSTNRPDPLGAEGAHSASRPPKHTWPMSPPTPPPRHTPPAEQRTLLVLHHVLKELASKRLQSDQRAFEAVAALLLGPLASRWSADTAALLALLSNPGGGPAPIYGSWLLGLKCLRRLLAYGFPSDARTLTCSSEVVAALPALLSALRALGLLQRDEAQEGTLKLLKALLHLQELHPW

SEQ ID NO: 13819 - protein, 143 aa, Chlorella protothecoides
MNTGEEQHHFRFQEPCRAVKFSVGEAFAAVSSDPFMQAVSAVRILPIAADPAEQGEEAVQTLRGPRGRIARVEWTDQNRTLITASEDGFVRRWDVEVHGWVWGENVAGRPRMGRATALIPGSQAGALWRFPTAQGLGWRDRQL

SEQ ID NO: 13820 - protein, 93 aa, Chlorella protothecoides
MWGAWWAYNVCLAVLKANHSRPYAAQPWFRMGLKRFYWMEPLLKIILPPLAVSVELYFDHTAFRWVDGRASVPGPYQPCVGVYACISGGYPGV

SEQ ID NO: 13821 - protein, 205 aa, Chlorella protothecoides
MVSGEEGPLPTHAWGSHRVSLHLPQNSESKRPASPSRRSFWPSCVLLPLLEWCVDWLAGPGRGAAAGAAARLPMLLLHQTLRCPSYRGASAALTLNLSARRQVEQQSSMAAEVRAGLEEFWGAEDRRPRLLRSLVLRYIPLTSEDLEEWAVGPEAFHHALMNVAWEESVRGCAENLALALFEVEDGRQRRHQLVLAGRGSALSSS

SEQ ID NO: 13822 - protein, 343 aa, Chlorella protothecoides
MAPSKPTQWANALFVLAALATLTALPTTAARALLADQVSNYNVDCGHDSLFHGCCELARALVELGMAGRVHLGRTPPLRQTDNATTPTSEDSLVSRFDGVDFLDPLQLADKVPQIGSDSFHGDGTAFSDAVNNTGAAFACSFRYLNNWASQYFVAMNEEQWNDGLVCGSCVRARCVDPKCPVQNVDIVAMVVDRCPECSYGDLDFSYPAYSAVTGSWPNRLKVSWEKVDCSAFIDGTIRMWPKDGVNPFWQAFYFANSKYQIQNVTLNGVPLTRQTFGFWIHPGTAPTGPSSLVFTAVNGATVNATLNSVWDAQDLDVQFPEDLNVQFPEVADAAPVATAGRR

SEQ ID NO: 13823 - protein, 508 aa, Chlorella protothecoides
MYRSAGALGPSTSAPSLPARASVPSARQCARRASVCTRASASTAPGDIRSNAVLRARAEGTFRAEYVPFADIASGTVGKETYSLDDVVYRAKDGGLLDVKHDFEALAKYDAKYWKTLFDGRVGTARWPHGSGVWSKKEWVLPQISDDDIVSMFEGNSNLFWAERFGRQIGMSDLWVKQCGNSHTGSFKDLGMTVLVSQVNRLSKLRPESVQAVGCASTGDTSAALSAYCAAAGIPSIVFLPADKISLAQLVQPIANGALVLSIDTDFDGCMRLIQEVTAASPIYLANSMNSLRLEGQKTAAIEILQQFDWEVPDWLIIPGGNLGNVYAFYKGFKLARDLGLTDRLPRLVVAQARNANPLYRAYRDGWGTFAPVKAQTTFASAIQIGDPVSVHRAILALEACDGIVEEASEEELMDAAARADLTGMFNCPHTGVALAALLKLRERGVIAPSDRTVVVSTAHGLKFTQSKTAYHAAEIQGLSSRYANPPVTVREDLGSVMDAIRTKFAKL

SEQ ID NO: 13824 - protein, 170 aa, Chlorella protothecoides
MNMTGISEGLLVLDTNNPATQPIIFEAGLLRPLQTRQRGLARDTGVTSPHRACTSALHPAPPPSYANPSLPTNYPLNCPGTKSSVKKIHTVQFTIDPVSLASCNASAYAAWAQATQFDQGKFQTAIGALTAASNYWDLVQNDMALTTFFEGTTFGSLGFYFGTEDPQRDR

SEQ ID NO: 13825 - protein, 63 aa, Chlorella protothecoides
MPSLAPAPPQVLAYSQSRGYAAKDILFGDACRASMLQGVEKLADAVQVTLGPKVGLYSGGVSG

SEQ ID NO: 13826 - protein, 199 aa, Chlorella protothecoides
MPSPLYVKPGPVENFNAPSWLDLPLKHVIESQQFNQASLNTIFEVARQMEDVRPGTPESRALDGAVMSTLFYEPSTRTRLSFEAAMARLGGTVLSTESAGEFSSAAKGETLEDTIRTVEGYADCIVLRHFQAGSAKKAASAASVPILNAGDGPGQHPTQALIDVYTIQREIGRLENFTVGLVGDLGGQVEGWWVGCGSE

SEQ ID NO: 13827 - protein, 180 aa, Chlorella protothecoides
MGGRFPYPPTVLPHIHIHPLPLQPPLTPSTTQTGKELAAEHVHEKNIQDLQMSVDGTHFITASVDCSSKLVDTQTLAVLKTYQSNVPVNSAALSPVYDHVILGGGQDASQVTTTSSRAGRFESRFFHKVFQEEFGNVRGHFGPINAVSFSPDGTGFASGGEEGYVRLHKFDADYFTTKFF

SEQ ID NO: 13828 - protein, 91 aa, Chlorella protothecoides
MMQHPHHAKVTPKFCKQYAAVGEVIQGALSAFQAEVSQRTFPGPRHSPYALGAGQEERLGQALRGAGLDAAAAAAEELIARQGLATAQNGA

SEQ ID NO: 13829 - protein, 369 aa, Chlorella protothecoides
MPMVGMESCCVMAAPTSSGTHSTTTITHPASSKACADERGRGGAGDDWVSQRGRPWFSAGRQRPAWRGVRQQGPGWRRRGRGVTPHKHTIPPHLGLGDDARGVVGVEARGPKPAQQRDRLRGQAHMPDHRDAGAHHGADGLHPGGRAAWRGKGGRVGWGDRCARQVGLPTSCGATPTRRTLDLDGVRAALLEHAHRGAHSRRRPLLEGAEWEVGDDEGAARAARHRAAVRQHLLQRDGQRGVVPVHHHGRRVAHQQHLDAGQLHLHGGREGKGGEEGVIGGGTSSGLVPGGTGIAPGVHAPQRAQRDAAGGGRYGARVDGVGRLAGVAAPVPGQAPGGGLRGDDRCPEGRSCVAWEHEMSGGVAGEQGF

SEQ ID NO: 13830 - protein, 226 aa, Chlorella protothecoides
MKDDIKEYLTGVGVQWEEVDDLGGSPGHQWSVGVCRLSHDTWLLTKNARSQVPHFPNAPRAQSLLDQAVAAEVDVLYQTRIQKERFQDRPDDYELAKGRYIVDAKLMALMKQKSVVMHPLPRVDEKSVVMHPLPRVDEVGVSMRSRCGPGGGVRVSMRGLAPSAPSKDGPIGGATCSAPIPPITSTPGQISPEVDSDPRAGYFRQAKNGLFVRMALLKLCLQDRLR

SEQ ID NO: 13831 - protein, 193 aa, Chlorella protothecoides
MWVPAEASDAVDAALCTARCPLLPLPARPRPPPCRPRTPILQGLAALLVVGLSGLSPQETVQISPDFITSLGFQQALTPSRNNGFLNMFRLMQRKALDLCLLQGGKAGASPGEAGGSPGHGAGAATTGAAAGEEAAGPGRPRGGGEAAPQPGDAAAEPSASEQQHMGPVAASMRRKLQDAFQPLRWGGDVQEG

SEQ ID NO: 13832 - protein, 372 aa, Chlorella protothecoides
MGVRIRAGMSRCQPSCRSPPCLCIVCMFSRRTACPPQQVSILITPCSCCAAPPAIHHVTAGEGRAGVPGGAGAHTMHPGRPRLGWHGGLACCGCPPGGGAAHGRPCLATPPSVPGSGLLHPPAVPEAGSVFRPTPSPLAQSPAQCNALQPSQVMVLHLVPSSTPCGCLHVPFRLQGSGLYAPKSTQGGDSGRHHHRPEQVGQSGHVKLQLKDSNQQEVLSCSSQDVDRTKALLGRPGALRAALNYYVASFDNQSRRPDQILKTHSEQSETTGKRTPCYLCRPLESTISVPLLVLYGQQDAAFLPSMFQVQRWVPSSVKCMKMHSSLKLFWYKKIFTGLCVTSLQDYGRFCADVTTLMVEGCSHWMQQDRCRG

SEQ ID NO: 13833 - protein, 200 aa, Chlorella protothecoides
MSNQDKFDVLLEGLEAHQTDTSLLKTGDSVELQHRDGALHCSSSAGIIGRVPEGNSGPLLEGDWRGSVRSLKRNAETKSLTQVLVSVVPASYSKKCSNLTVHAAAPGHKVEEADDVEFLSAAQYELLGESRYDVIVSVCSRVDSSTCCAEGEPSSSSPPRCPPANQPEMQQLLSNPELQSVVRSVDSAADREKVGLLCGV

SEQ ID NO: 13834 - protein, 541 aa, Chlorella protothecoides
MGVNPVREKKLSNMRSAGADEKVHLTPPRLMTLEDVIGYVAGDELIEVTPTKLRLRKRLLNASARKSASRAGSRLHLRVARRTRGILAASRLASGGGRPTARPLVAIRSGARRVRLVPPRSSAPPDLAVLARCLWAGLALRNSTQQPRVGVRPALLAIAGVARSQAPARAGAGDGSGGSLRHLHVLLLAALLRLPAGSSARPCRFWASVWVHDPGRNLEVALGLDGRHKRLRSEGRAGARSSCCGCTCCRGQRGSQPCHPEQPQTVHARPTPPSSHPEGQGVDEAGVMAGSHHGQMSPSWALSRSLHPHRQPVHMPAKLRGPGPGPVSPPPFTHQAGGLGVRHLLQHRLHELADRLEATSVLRSQTCEDRGGGTQAERPPTCMQAERPHTCTHPMPARLRPTLVPIPKPGRESPLKLSSVRFHSLSSSSVPKPQAARQQAVQTLPWDSLPEAAWRNGVRACNATLACHDALRQPRCDLSRPTKPAKHTCFQAAQEDSSRSSWRIVAANSGPRSGTEASDSYTLSWRACVGVGNALGSQDQS

SEQ ID NO: 13835 - protein, 102 aa, Chlorella protothecoides
MEYKLSSAAKVPSLRLLLDASLSLALQGVTHGGIPAALLEQVFDSLTVAECEVPFAYLEERLSDFKQPAVRARAALTLQRACNLLIHRLSKVGIARAYGVAL

SEQ ID NO: 13836 - protein, 158 aa, Chlorella protothecoides
MLPQASCPKEAFERPAAAPPAAAKTTDPLGPPFKRRKPSRDAVFGVTLGTEELDRLWNLTEDNLSGDSRPGLGMGTSVGRSRAGMGLRASAPVLAGLAAEDRGGFKTVSQLMEPVLEEMTDPEAPSLVCEWGRGDRPWAGATELGWHVHRLPMWVEGP

SEQ ID NO: 13837 - protein, 197 aa, Chlorella protothecoides
MLTDTFTLYDQGALDSLGKTVDAEFYGTFWSLQAAFSNPPQAGIEWSETARAVKIVLERLKKDPVTLTEAASGSSISAKYLSGSRLLSLQLRDATFRRHFLVQCLILFQFLEAPHAAKQAWPVLKGRQIEELKALQESVYESLASVPERGPEFAATIRQLLLDESSWAAWKQASLGGKDRSGVGAAHRGMPAWHCRP

SEQ ID NO: 13838 - protein, 150 aa, Chlorella protothecoides
MKRGHVKTASNAPSNPPSDLLSTVKAVMSAPLPRVYEEVGGGKVIPMTASTASGVVGAPNGPIVPIGGADYNAEEMSRVVKSAGKLVESEVLAPMERWMNAFVLIQQRMKRLESLRLEVDSRRRTVAKLGKKVGCDAAGCEYIASDHDGP

SEQ ID NO: 13839 - protein, 184 aa, Chlorella protothecoides
MENTIKILQHKESKLSGARRVKTAGCNPCSARAVLRIQSEALRSANTALGEQKARVPGSRGYPLPVEANSGASTPLQSLPPAGMPEVIAARRDERENVPRLQNGQQVREKGAWAWSGPRGGIRAKVGRNHSAGASVGLGHSKDSLYTLDDAPAAPTHRIPATQVPTAYDAYNEAAYSRNAVPAW

SEQ ID NO: 13840 - protein, 160 aa, Chlorella protothecoides
MPFELRALEAVLDTVSAHLERATGELEAAAHPALDALTGAITTPHLERVRRIKNRMVRLTTRVETLREVLEKFLDDDSDMHDMNLTAKVHEGVIVGGRGAGPLGAGRWVRDTPVAGWETRRTQRQSSPCFGTLLHETPEHGAGAAAAAHLPARLGGGHAL

SEQ ID NO: 13841 - protein, 184 aa, Chlorella protothecoides
MSPRTRRSASSASTDSSIVDEEVAAVEMLLEPYFMQVDNTYNKLQTLCEYIDDTEDYINIELDSHRNELIRLAIDLRAPHRLSPISLQLDLVLTALTASVALITAITSLFAMNLELSPGVQGQASREVGVWRRAVDQWFGAGVCLVLELGSPDRGSGPDCLPKSQSSELHPRANPGAVPGRNLR

SEQ ID NO: 13842 - protein, 241 aa, Chlorella protothecoides
MAHVQVEASVTRPEHALTTITNTFNFQFTFDLRKGPGGACLPPRIILPTTGVEVRPHGVHLVDQCLLGICRHRSRRSMLCIPIGKTKCSCQCSGAGPLLNTACHLLNLPHYAQRNRRWRWPDSSAPAHLPSASTRCCDVLYAVRAAQCADVVPRHAPGPCWNITLDQAGRREQGERIMQSGSARASSDQMLSGKASSDQALPPAVDHDAGEDECRGEAAHDRHDDELPVGALHNPWTGSGG

SEQ ID NO: 13843 - protein, 354 aa, Chlorella protothecoides
MQGLHDLVLDRLVVHHWPQPDRLTVHPCSKVDDPAARPPLCVTAAVEAIELRTKRIDLTEDMQVGSAQRVPAEQRQAHVPAPEAPTGILALDLIGPGSPTTTTPPSLAADERQSGLDGILLHGCVHGAAPGAVCLWPCLHLVIGPGFDSQVCRPMSASLCSPLPHQSGTKQLVALFTFVARDALTNAAQRISPVVPETAQDRALFARRQQISDARRTARARSSAAATGLHSQGGGKDGERGMSHGWVMHTPDHPCWSERGMFPPGCPESRLPPQRNPPHSPARFDPGGAALGGRATGGCKAAGDGAGAGGPSGAAGLGHSPGQQLHLHAAAAQHIRPCVWRLPHEVRWLGRRKG

SEQ ID NO: 13844 - protein, 361 aa, Chlorella protothecoides
MPPQLSLLDSLEYSDGKPSRPRMGRGSRGPRPRLFAKGKCQADGCSVNLSKLPFYYQRNHVCTEHNKCPSFRRQAPAGAPQRQEVGGAGHACRIRVAPSQWMSGRHGPNPCTRASGAPPPPDPTSHARHSLGNTSPASRICRRRLALAAAATPRSRSPAGERWAAPSEPGPLPLAPVVAPSASYAVPALSPAASAAAAGPVDERVCRGDECVCGPCCPPAALGCGRGGVPAAALGGAGSGAASARSPPAPAQPLCRPSGSLAGSSNDSAASCAGPAEAVSTADGPAAAGLPAHGPAGGRERAVSRSGAAAAATEAALGVLQRQHADAYGFLVQHQLELAGLLLAAARVAASAAPGRRAACH

SEQ ID NO: 13845 - protein, 170 aa, Chlorella protothecoides
  MOD_RES (10)..(13): Any amino acid
  MOD_RES (77)..(80): Any amino acid
MVGNRLVKLXXXXDAMQVDGVDVRGGVRCLENEWLGIAWSSCTHPQWELWTSITPGTFAPKLPLPPCHNRTPRCSTXXXXGGWRSGQEKTNEPQMGHHKSQSDVHHAGNIRTNAPPTLLPQQDTEVFYDFKKFLEDNNAPVPAALASHEAAKAKPGAVDTRRSAVQYAKK

SEQ ID NO: 13846 - protein, 1038 aa, Chlorella protothecoides
  MOD_RES (195)..(197): Any amino acid
  MOD_RES (1000)..(1003): Any amino acid
MRFGSSGTIDGRCFLRQCAPPPGALHGSGPKTQHVWAMELALLEWPLPSAPSPPWRYRTTRSKDSACVGHGACIAGLATTIRAIPALALQVLGGQVNLYMPYCRNCPGRTGHALPQRACTVNCQGSVKRDPVVSWRVRPLNKDDSDEIYRIAYIQVRCHCVGAWSCFMDRIVPVLKVHQSTVPQRSLPCTLCGAXXXLSLCGRLELLYGPHCAMLKLHQSTVPRRSLPCTLCGAAACSPNMQHLYAADTPPLTSPNTHNNNNPPQASCFQTSRHVPLVGPLLYRNFAAEVLSEMRKKARTPPDYPFASLVLEERRSREVVGVVEVSRARLQELQRSKDRAFFQAYISSMAVEDAWRRRGGATALLEAAEGVAREWGQAEAALHVYADNGAGIALYTARGYARAAADATWLAAVGLPSSACLAGLYRSSSVNDIRVKSGHCREEGRADTHTDSGRRRSDGSVRRLPPPRHAGLHGLALGALRQEVRVAHKVHHAGPGRQDWARGLARPAIRARCCLRLRACTGAFPRAGTLALLLVALARPVMLRCGGFCPAPELLRLFRPSCLCRLRGPCPLPRLPRLRLRPPFLRLAQRGRCFHRLSLRRVLRSELRGAQHGRQAGQPRPGVHLRQRLRRGAPRPRPDVLQVPEPQGAVARRRAHQPGKGVCCARALAGLDRRGRIRGRRLGRNGQAPDAAAMRLGDGQDLRLVLGMVSGWGGGRDEADEQGDRVKPDRRATRHPSPTMMYRHPAKAQSPAPHRFPPRLQPDLFNLAPCGMQRAVVAPCQQHVLAVESVAQHPALVAQRGQRGAGLCRHAVHAEHGPGQQRVHVAAGAEGDGLRGLRQLGGERAAALHQVPDAQRTVPGDGKRDAAGGVHRHARHLLGVRLEGLQACPLPAHAPDGQRAVGGAGEEVRGGAAPRGGVEHSRRHRALARGHQEAQVLVGAQVVDVNGVLRPATCQEWARGSDAPDGALVGWMREGFCQRGGGLLAQAMHILEKAIQKAQXXXXCGRACDSLPSGWMPTVAQAMQILEKAIQKAQFEAQ

SEQ ID NO: 13847 - protein, 124 aa, Chlorella protothecoides
  MOD_RES (28)..(38): Any amino acid
MPDGAVIPYRVFRGLCQVAPGGGGGGGXXXXXXXXXXXAAAPESPRPGNWGSRECQTPPRIRDHARRGEHVERIHRLNIGHLDENGVYNGSFSTLALHGQVRAKGNADSAVDILWKRKQAEIGQ

SEQ ID NO: 13848 - protein, 787 aa, Chlorella protothecoides
  MOD_RES (664)..(667): Any amino acid
MWAINTAHYMPSIIISPGMHPPAHPRWSATLANLPCPGCVMAATGRDRSLGQSKLSLSAWATAHDGPAGSSDGPWIGVCLPALLARSCQRASEGKSATPAWKRQRLPNHRPGESCPSRKPHSGASDLPFHHPARGIQKVCLSHARGRASCAPCPALSLPDSQLAPHLAGPALCSPPISTPPTPRILSLSLDVRSVGDQGSAAARAAPSVGNSGPPAGDAPTLALDPPVPPSFDPGTSPADMTAMGCVARKDGAPLLRRRVVSTAALYFRWFYADDGFAGTDPRALSLAALFLASKVEEMPVHAKGLMHTATTLGSSGRWHAPAALAAVLAAEAQLVYISIELTKMEERNACMREPEDIPRGARRHSHGKETFPLQLIPWPAHAWGLLHAARYQQRGLSAPHSPPHAQAKVNVALLVFDPIPSLLEGLHLPLQGDKTHARAGRGWGAQAFVQEPLLTEPRHPQGTQKPPANHRLHSPSRDPHRALLNDSYLSRCHLLHPPHTIALACIVLAAGAHGIDIEEWVAGLQADHAQVGCCLGAAIRPCNRIRTCCAQTTPRPPCCAPAWAPHTPRGPQLPHHPQGLRGGEEPAGHAGRVQRHHHPGHLPPVPRPIAPPGLAMMGRAEACMTGNGAMASPWTGPGLSGDMLYWGATCKTLHSSLRYQWRXXXXAATCSIGGPLARRFICHSGNHGGWPSPLTCRFQACAMRQGKKPILAGTHGRPPMGPALAHPRGFVILPGYTSHFDSPPRRLQSLSAPSSTHCLPSTPSPCKPRSLFRKLIPGQLHHAVQR

SEQ ID NO: 13849 - protein, 238 aa, Chlorella protothecoides
MWYGLLHRRLLALYRPPGGDRGTDGRQGNVTPLTSAMEDPAASPAPPAPPAQPPLEAITPAGEQQPAPPPAGPDTATPSAGPSAAEPQSGGGTYYTSSGQRARPQKTPFQKETLEAAFEMNRHPTEEMRRVLAERIDLTEQQVGTWFQHRRQRKRKEQVQQAVAQAVLPGAPAYMAGKPGDGGPEEDGKGAEDPAAVQELAALLELAAAHLPVPFRPDGPPLALEFDAPPAAAPIGAA

SEQ ID NO: 13850 - protein, 346 aa, Chlorella protothecoides
MLGNPEVEAEGPYAVVLAPTRELAQQIEEETRSLAHFTDFRVVSVVGGQSIEEQGFALRKGCEIVVATPGRLVDCIQRAYAVLNQCNYVVLDEADRMIDLGFEPQVMGVLDAMPSTNLKPEGEEEVVLEADRVYRTTYMFSATMPLAVERLARRYLRRPTVVNIGTAGKATDLVTQRVVMVKENEKPHTLEQELEVLSDDQRIIVFVNTKRQCDAVARQLDGLEYRCTLLHGGKTQDQREESIKVCSAAGRACREGQWDGGFREDKYNVLVATDVAGRGIDVPNVALVVNYDMPNNIEAYTHRIGRTGRAGRKGIAVTFLTLSVSGGEGGERWWGWDFGCDASGWG

SEQ ID NO: 13851 - protein, 99 aa, Chlorella protothecoides
MPCSAQGSTTPSSVQVGSGKLAGSNLEDAGDDYKLENNVRISDSRSALGKKVSRLQVAEVVAASIDISASSNKVLEVDAARDAPKEDIRSLLAALDEGR

SEQ ID NO: 13852 - protein, 396 aa, Chlorella protothecoides
MERGEEDEGGPSGPHPRPAAAKAEPLSLEELLRKKEAERAAQARPVFMSKKAREEAALARRAEEAAAVRARNAAVRAALAGPAHDDGPRPEDRERERRPLSNKEREAQAHKEVRGVALNLGMSPPVCSALPARRSTAHVPVAGAGERKGAGADQAAVSGHEQAGAVGEAHLWCLLVIIDAGSLPANVGSDSISKAVSRPPHLAILQKKKVLKATERFKFVFDWDAKEDTSRDLNPLYQNLHGEEGRGLLGEANLLFGRGFRAGIDRREQKKAAAGQEAELLRSLRSRTGARESVADRERDETRAADADRYEGRDMAVDSHWSEKSREEMTERDWRIFREDFSIGYKGTNVPMPLRNWEEANFPEPLRKVGGVGGVGLGLEGWGGGWGREAVSVPGS

SEQ ID NO: 13853 - protein, 270 aa, Chlorella protothecoides
MPPGSLNVVGYLSKPVTSPHACSLAASSPGFSLPGFKGKEPEAQAEESVRSTTKKVAQESQQIGLSLLKNFGRRDTNTVFVAGATGRLGARIVRELLNAGKKVRAGARNIEEAEKYADLAAAYGLLAPDAVRRLQIVPFDLRDDVDALQRAIGNANTVRRAVALPGRARVVSAARSTGNDARSIDGEGTVRLVQAAAEAGVGKFTLVSSAGVGSGGFLAGGAGDGNGGGAGTTYSAVLVLSIVLGVEGGGDCITMGMVRPPKLDPCPLQS

SEQ ID NO: 13854 - protein, 459 aa, Chlorella protothecoides
MAPGEGAVTAAVFHTPTGRSTPTHLLTGSADGSLSIWGVGGEWTCLKTFKAHTKEVTGVAVHPSGRVALSISRDGTLRIWDLVKGRSTFATKLPQAAEAITFSPSGDVYALLAGAVLSMHSVAAESSTALATLSHERRVLCHAFHGEDVLLTGCDDGSLHAWSIPGKVGNTAGCEVEQIRLESGRKPVRGRRLSLGGVAIHHCGRRDEAEILTIPEAHGSRIRGLAVAPQSSASDASSSIQASKSPSTAHALPRLVGTASSDGTLRLWNLEDIRAGAGGAAPQPLAEVDTRARLTCLTAMLSPTELAAQHAAEREAMKAAAALRKAKKRRTEPEAGEAGEGTRATKATKARRTKEAEELRGGAEAPAPQHDRTSKGNKEEGKSAGPRKGPRAGSESEAAARPDRRPGQAPRPVLPPRPGVVDFVSDADLLAQRSKRQSMQARVARGRKAAHRPIGPAAP

SEQ ID NO: 13855 - protein, 72 aa, Chlorella protothecoides
MGRERGGARPKGPPHVSPKQSPAVQEISGRDLFTVTEVLSSKEASCIVEYAESLGLTHQSSRGPKFGEVRGD

SEQ ID NO: 13856 - protein, 109 aa, Chlorella protothecoides
MRHLLTARADHTPFADMVGLVVSQLEAEVGTASPARPVYLLGESFGGLLALAVAAAAPHLVDRLVGWEGEDVVPEIFRKGEGGRAREGPRGVEQPSALHACALRSAKES

SEQ ID NO: 13857 - protein, 525 aa, Chlorella protothecoides
  MOD_RES (241)..(243): Any amino acid
MVGWKLLGSEAEFCMAMCSSQPNDQCTLWRSMCLMRICLHGSHQSLSRLILPDRPGALTAHLISPAVKANFAMFFAKLGLNSTGTSPATGVESDRGREVIMTADNAVLSMWNDRGPHQYHLYGLSGSVLGRPATLSLEVVPKSTSRLLQVSGTVVPKESPQCAGGCMNHVDVGGAHSVAGYSIPTPPSSPLITHSLSTSSEASLLVFERRYAGQCAGHCCDHVRCWQSSSQVIGRPTSPVXXXFERRYAGQGAQHHLALSPVSRPPSPAPNTSQGSPDFVHGHTEDSPLLPVPGEVFRLRKLVPQTPAYDFNIHIMDFSPGEHLNVKEMHYNQHGLLLLAGKGIYRLNEDWHAVQVCVGGQGGGHAGAGSLAPPGKRLCSWAKGAIAKPRPAIQPQSGYADASSSPSPPTAWRGRVKGFEDDMLRCAWRGHVKGFEDDMPRCGMLTVTNPTPHRSSPGWGRNLDGALRAPVVCGAGHAAHALPHLQGHHPRPAGDAVARPGRRRVGLRLRRAQLQRGMTPLLRSA

SEQ ID NO: 13858 - protein, 38 aa, Chlorella protothecoides
MVCSAFVVPHFSQVVREVQLLVYDEIHYLRDKERGVVW

SEQ ID NO: 13859 - protein, 594 aa, Chlorella protothecoides
  MOD_RES (144)..(147): Any amino acid
  MOD_RES (317)..(320): Any amino acid
  MOD_RES (481)..(484): Any amino acid
MQRPARPPLDSIQHFPPHHLASSYEHLPTPPSPPPQPVPEQGRPTRWRAGPLPPPPPPLAAEQVPRALRLAGRPPRFHAHRRCLVHGGAPGADPGEAGGRALQASPRKRGGEGLFYVWGKEDGTWLPRKGIGLCANIPALKPYXXXXGGRRTARGFRVRASAFVPTSPPSNPTPSPSRLTQNVVDGCGVTGVEGVFVAVCELTLTSPERRQTQAHAGILSSCSLATAGAAAAPGHHPERDGHLCARPLGGGGSVGGRALRGSCVAGQCGAVRLESRLATRVGGAQWGTQVLIRAALGTVWDILSTKPSSFAPAITTXXXXGGRALRGSCVAGQHGAVRLERRACKQGGRCSMAHSGSDPGRARHSVGHVVDESKFIRPCHHYRPAAGNAAGCELHPLPPAVLSGPGSAPHRGGQQQGEPGADVHLVDGLVLTGHWWKGRRCVAGKDLCVVVRSWREGPMPSDERSCLRARHLVHPLARCLXXXXRAAVRGWQRSLRGSALVEGGAHAIEWALLPQGSRSRPSSGSLPACFSANGYRMYSAMLPSLDPVASRPEAGVPNARHVADSVWYCIRGAGGQECDLKCAEDRERVVVPWS

SEQ ID NO: 13860 - protein, 358 aa, Chlorella protothecoides
MSDGTLRRVKAQFQVSLHPALSETSLAGVEELLNTLLLRVQVYRAGGPLYRFVTIFRGFGGHRVGLWEHHTRLPPWPHSTILSLHPCGRGGDRDAVQPQARVPIGCALRVGLQTHEWISIFLYPMPESASTPPLHTLQVLPTIPPFLTVGVVNKVGRDFIGLLVAGIVNASIGADAIRADLASRPAQSAWVSLCNPRHVISIGTTVVFDVLRGGACESTTTANAELNFSGHLISTGFLTRTSAAAHHADNTHTSLFTLDVFQPPSSRSVTQTGQFVSLKGALREPDTGAVEVVGYPGQPRKEVAVAEEAHKEENGKSTAKRKRRESAGDAAGEEARENGTKKKKKKEKTKTKKRSKDE

SEQ ID NO: 13861 - protein, 151 aa, Chlorella protothecoides
MFRRASLGVSCWRHRGRQQPGVARLGVTCVLQQLSASPPRPSQLAGGVAAIQLQNKEYDGRQTSCFHLIRPDGSVEDVSYRKCIASLDATVATLLAKEDGKKASPAKAGDARSGAARSSTRSGPTRSGSGGRGKPRGGRSGGRGRGRGSRR

SEQ ID NO: 13862 - protein, 681 aa, Chlorella protothecoides
MPAPTYHSPPSSPQAGDQRLTDTRADEQERGITIKSTGISLYYVMEDEDLKGFTGARDGNHFLINLIDSPGHVDFSSEVTAALRITDGALVVVDCIEGVCVQTETVLRQALGERIRPVLTINKIDRCFLELMLDPEEAYLSYRRVIENANVIMATYADDDLGDTQVGPWCGSVGGGGREEGKAGPGDTLLPGVHPEAGTVSFSAGLHGWAFTLTVFANLYAKKFGTDTKKMMEKLWGDNFFDPKTKKWTKKETGSASCKRGFCQFIYEPIRTVIDAAMTDSKDKLWALLEKLEVLHLLKSEDKELVGKPLMKRVMQTWLPAHSALLEMMIWHLPSPARAQKYRVDVLYEGPLDDAYASAMRACDPEGPLMMYVSKMIPAADKGRFFAFGRVFSGRIATGRKVRIMGPNYVPGTKKDLYVKTVQRTVMCMGRRQEAVEDVPCGNTVALVGLDQFITKNATLTDEKCEDAHTIKAMKFSVSPVVRVAVEPKHASDLPKLVEGLKRLAKSDPMVQCSIEETGEHIIAGAGELHLEICLKDLQDDFMGGAEIRVSEPVVAFRETVNIMSDHVVMSKSPNKHNRIYLQARPMEEGLAEAIDEGKVGPRDDPKIRSKILSEEFGWDKELAKKIWCFGPDTTGPNMLTDVTKGVQYLNEIKDSCVAAFQWASKEGVLAEENMRAIVFE

SEQ ID NO: 13863 - protein, 382 aa, Chlorella protothecoides
MRPVNSLALHDPLSGILGLIGDPGGKWIVSQGRSGPAQVHRADDLLPGAGGVGETRSNPVHIQREGDSFAAPALILPPSPDQAAAPLPGLRPGVPALVLPHAEGFAVACTGSGRRVVDVPSPKGAGMLTSLLAFCAWSTRDGPHVLAGYESGMLALWRLAQPPAPLASCALSKQPLLALARCPARGRGVAAGPRAALLPFRLELGGKRESERETEHEVDQRTSAPTSDGSSHNDDHQWAEAAPRISRGTRVPLSSAGVNCLALRSDGRLLALGGWDGRVRVFAFPSLRPLASLAGGRPQHAVHDQGTTTLSLSSAHFKSHSCPPAPRMQYHTESATCLAFGTPASGLLATGSRDGSIALYILYPFAEKQAGSEPEDGRDLEP

SEQ ID NO: 13864 - protein, 130 aa, Chlorella protothecoides
MTEAGVDEASKRPLEEPEVEGVDAKKQRTDEGNDADEGSDAMEVEPPSTSQPVTVGYRTFENGAALHEYYQGLHSKLRSYQNLNDYEFHMVLELIKKGHPDAERKVPGSDMWLPGVMPLGLKQVVSPCIS

SEQ ID NO: 13865 - protein, 248 aa, Chlorella protothecoides
MDLEPSNVQSDSQCNARLLTRYSGAEALLSAGWVQSRLKVLHSTRGTLRIWTKPYHSPDMLSCRTLTMSDFFGKTTVRTFRDWCLGDPHATLPRGGGGASGAVLRPCQGLRQTPRAIWLRLPCRHRPPAGPGLAPAQQPTPPSHMNDDEPTSQITECGSFDVLRDDLAHPYVNGNKLRKLDAVWPALRAGPARHVVTCGGAQSAHLVAVAALAAGTRGALASHLLVRGEAPAAPTGHALYMRLLGGNV

SEQ ID NO: 13866 - protein, 285 aa, Chlorella protothecoides
  MOD_RES (166)..(168): Any amino acid
  MOD_RES (192)..(200): Any amino acid
MTASMGGCSCHASPSRLQGRMKAPGPCLVSPSLSKRRKFRLRAGAHPLQASMAPLRQCLMPVAAFVMAMHLHAGACSAAEVLIGTPRVIDGDTLEVWMVAVQLHVECRARVTRPPPVLQAPLCPTPFPPKIRWLAPACASSASTRPRRSRLAWTAGASPTSAARPXXXPPPPPPPPPPNQVAGTRVRLFGIXXXXXXXXXACTVKTKDMYRRSVAVCTVVRPGERPLDLNAWLVEEGHAVAYRRYSKDFVPAELRAQEAKRGIWAGRFELPEGWRHKETMPQWFQ

SEQ ID NO: 13867 - protein, 358 aa, Chlorella protothecoides
  MOD_RES (239)..(242): Any amino acid
MSTLQVLMCALHLPHASVRAHLRFPQPSGLSVPVGGGEPLSVSFRGGVCEGGWNHNRMQGGMSSGSSILPHVPDRTVCYFPTVFGCSYEFLLPLPMSRCHSAPRGSVLPRTACPTLPQHTHATAPSSWRCPSVSWRAPSWAPSSCGSSTCPTSTSSPSRPPSPRPTPSSPTLCLVGAPTAPSPHPTWRWGAITTTPRTSTAVCAPARPSRGPCGRSGRCWGCSISRAHAGCPGQVQTLXXXXADYALLRGPGHSLISHAHAGCPGQVRTLSPTHSPVTLPLLRPACRRRHHPRFPLPPRINGPPHPGPPVAPLRNGDQQGGDSAAARPAGGALTHAQRARAAHAAGGRHPGVGDGTRG

SEQ ID NO: 13868 - protein, 317 aa, Chlorella protothecoides
  MOD_RES (255)..(258): Any amino acid
MGPIERVALRFRRPAASITCQTGMECTVHAGPSVPRNSAQLPMHRSVRSCLCLPQSRCLPLPMGCRQHQWGCNSPPQCQTFPPSVLQNTPIPPSNSPLSTEFLALAFSELAGAFLGAILLWLIYLPHFNVVPEPPSVTEQDPFFADPLLGAGANRTFSPTDLAVGGYNNDPLDRHMRMNPGQAIQGTMRDIGAVLGIVHDDIKQRKEELLKVRWRTCVLWGEQGGVKPLGGTPAPCSVVAGQTLLLSHLQIQNAXXXXGTPAPCSVVVGQPLLLSHLQIQNAPPPLTPSPSMAPLFPLKNPSTCATVPGPCLGRQQG

SEQ ID NO: 13869 - protein, 203 aa, Chlorella protothecoides
  MOD_RES (147)..(150): Any amino acid
MATLVVVPAIAPYSLAAKCGSEIIATCITIYIGESILANELLAKTKVTWVVGRAWPLVEGFNAALKGTSAPWGRRRCNTAPAASSQGNRMGWGFVAFGFGMSFGIAITPVGVHAPPQVAQAPALVPCPQHSTILLSGALVAPHADTXXXXSMPPAQHHSFQRCVRSPSHRHTTLSPQCSTTSLPTSTRPAAWRCGSSARSMGG

SEQ ID NO: 13870 - protein, 460 aa, Chlorella protothecoides
  MOD_RES (262)..(265): Any amino acid
  MOD_RES (347)..(350): Any amino acid
MPRLGAIILQASQSTLSTLNHRARRYSEREGGTGHDGGRSRQFRQHPAGKSSMAYMDAPSPIGHGATISAPHMHAYCLEALSPWLTPGAKVLDVGSGSGYLAAVMATLVQDRGSKAPGLVIGVEYIPTLVEAALQSAERDPTSRSLLDAGKTCRVCCWSLPLPVAPTGILQLRVGDGWQGWPESAPYDAIHVGAAAATVPQALVRQLAPGGRLVLPVGLDGQEQVGGDGGWSSMLGISSGIEQDCIGLMATLDSTSPQKSEXXXXGRFGGGSCSARLTGGASDRIPTPHSPHTLSTQVLTVVDKDYTGHVKTKGLFRFGGGSSARLTGVASDKIPTPHSPHTLSTQXXXXLFSGAQFLVPGGCNIGNLGGRKGVFIRRGARFLVPAGCNIGNLGGRRSVFIRRGFEVDFDSEGIMSFHSRAECTPRGLDDPGAPEDPRDKARGARGLAGWVASPGSFQSY

SEQ ID NO: 13871 - protein, 460 aa, Chlorella protothecoides
MCLEERIARSRLLTVCHPFKEAKLSITHHLVLGGDLHALLLPEAGHARECTQLVGAPGLGPGAPVGVVSGMDIARAHIPVEGHPDAGWMLYGSKTQETEVLQRLIHARSTRLLNCSSCAPHRRSWQRHGCRGTQGRRGTAQSLGGVIGSAEHGDGGTGLPLPQGHRRLRPCLPRPGPSPPGASHGGEPPASKRFCKFSSAAHCFPTIVHTQLWALVRSSLTSWVHRSNTCSDPLIHQARLDQYVEKVRKAVRTHELATSRRTLEMDVAAVNRFISNAVSDKDVKWKLQQPPSEKWPPGTDDTPASAIPMDKQTFLQETLSSIAQEIYKLETLLWMYTETLMIEKQYHDGVSPGFDRWPCSDTQKHGSSHTSGRAGVPTPCSQIKPGNQASLRTDESVLGGPSHNALYVRPAQVDSAGLDALGKEASRHTCSQHIMHNPTQMLPRSPYLANGERWPCHGAG

SEQ ID NO: 13872 - protein, 200 aa, Chlorella protothecoides
MRKLTLKARPKLITLPARKEKQLKRKEAKAETAAQLDKSIEKELLARLQAGTYGDIYNFPSKQYNKVLEGETVSDDAKEIEKEIEEEEELEEYVEGDEDTSDEEDDEEEEEEVEEVEYLDDGDFDEEEDDMEDWEGVSGSDEDAAAAAPAPTARQKRQAAPSALASRAADGGAQKRRKGRRGVEIEYEEERETGLQGRRS

SEQ ID NO: 13873 - protein, 462 aa, Chlorella protothecoides
MDLEVGSSCGPPKGRGRFRTEYLLAAYSPRRRGQSVRSWTPLHPRSSPFLVANLTPPPPLCVPLRTELPGTAARAQRGRGTAAAALPVRQRDGAGGGPRLGQARAQRLGAGAGGRETGRGHARGRRADARAGEGREDDKLGGGTPVDGAPTSEPGKAYRAPARPGAGRVEPEASKPRTARGAEAEAGPTERLMEARRARGDALFKAAIVADQNAKLSIFATRPAILSPVGGGGCCRGSGARWAVAVCVQVSCEPWVCPAGDKTAMPHSPQPAPRRPPAQAFNALCEVMCTATLILLYLLLVERGNMLYEPWWVGVGRCTSLCACAVPPAGLFRVTRGPGMRIVRLRYVRTPLLRDARPRCFQPSPSLPTPTACQTVGMWAGFLIFVLILGLGGPTGIAANPARDFGPRVAHWILPIPGKGPSEFYYGWIPLVACFAGGAVAGALFKAIEHLNHSNVPAGLAL

SEQ ID NO: 13874 - protein, 130 aa, Chlorella protothecoides
MAGDAKSLTQLSGSRPITGIYSCFGLQIIPGPAETLRSWAASLAPGGTLAVTYWPEIAEQEGPWRTLISLTPPADRPADWEVGIPGEALKEPGVELVADKGLDFSMEWPSAGAFFDVRPWSRVQEVPVSG

SEQ ID NO: 13875 - protein, 85 aa, Chlorella protothecoides
MALDACAGMQNLRTAILAYRDRMAYERNDARRGALLTVCLEYLERYYSLIAFASYVGAPGYDPGDDPGYARCGASWPPSWSACCA

SEQ ID NO: 13876 - protein, 414 aa, Chlorella protothecoides
MPAKAGARCTGAARPSDEQDGVQGIRKAKTPMVQKDVQILLPASLTSRQRALLHEVAEECGLAHSSTGEGSQRRLILGDAEVTRDCVSDGDGPIADDALAALLEQHLGAAVRTAFQGSAAQATTAGPGTHGIQARPGKGGNKAQVSGPSSGERSANCGDVPGFAARMQSLLDLEQAAEVSAAEAALDGGGGQGLVLPNLRLTGVEAGLLGRSLLTLVHNKDIAVCTGNMSLVRRERMGRVALGKGSMTRGESPARHAWRHQLSTAPVQGTPPGPLPVHKFGPHDIVRLRASKAAAGAPVLAEGVVYRLRDDSIVIAGRNAVQIPPTAIPRRCSAGPPMHLGTLGPSTTADLRRPACHSQAWRCLQLSCQAHPFVPVDDTPEDGLDVPLRLEKLVNTVTHTRMKAALNVRLGSGV

SEQ ID NO: 13877 - protein, 113 aa, Chlorella protothecoides
MIAARGSLLYEPARGLFGALFGFILGFFIFLIVLVIGGPTGVAINPARDLGPRIAHWMLPIPGKGPSEFLTYGWIPVVAPLCGGAAAGGLFILIQKFTGETNVPPGSVVCPNV

SEQ ID NO: 13878 - protein, 102 aa, Chlorella protothecoides
MAPKGPRSVMLTQQYRMHTDIMDWCSVALYGGRLVAAPAVAAHTLADLPGEGGDAVAGGKIRMGKEGALAGWGLCVWYDSGGRHSLGALIQGVLATSHRIGG

SEQ ID NO: 13879 - protein, 511 aa, Chlorella protothecoides
MVQDVIGSIDQGTQSTRFFLYDKDLNIVAKSQVPLAAATPHAGWVEQDAEAIIASVSEAIRQTMESAGSKYNVLSIGLTNQRETTVAWDSETGKPLTPAIVWSDARTAAVCKAMSDKVGGQDGLRAVTGLPVSTYFSAYKLRWMVEHVPAVAAALEAGRLAFGTVDSWVIYNLTGGVKGGVHITDVTNASRTSLMDIRSCDWHAETVATFGFQKVLLPRIVSNAERYGVLASGPLAGVPLAGCLGDQQAAVLGQRCALGEAKNTYGTGCFMLMNTGTEAVASSHGLLTTLAYQLGRDAAPEYALEGAIAVAGQGVSWLCDSLGLIASPAESEALAASVPHSGGVYCIPAFGGLLAPWWRPDARGVIVGLTQYSTKAHVVRAVLESIAFQTLDVLAAMEADSGHRLRRLAVDGGVTKNRLLMQVQADLLQCEVVRPANQETTSLGAALAAGIAVGFWTREGLFAQAKGGEGTVVFSPQASPEWASKRHAKWKLAVQRAMALDELAESDEEAE

SEQ ID NO: 13880 - protein, 189 aa, Chlorella protothecoides
MEEGLRVLKKVKDTFDVPIITDIHESWQAEKVAEVADIIQTDLLIAAAKTGKVIQIKKGQFCAASVMRNSTEKCKHAGGWLEGFCWGAWDSVRGNGAVIGSSDLPCSMALCTCAPATPPLLHKCFPPSITPPEGNPNVLVCERGTMFGYSDLIVDPRNFVLMRDAGVPVTADVTHALQQPAGRALEVSN

SEQ ID NO: 13881 - protein, 562 aa, Chlorella protothecoides
MSRKAQRGREALFQFRRRRAACSQSNKTVINILATSPNIQQVRQLYSSGQYFGSARPALPGAMPASDLSRRREGFVAKGPWHNANHNFKLGGGGLRLSHTAVSMASEPENGRDIIKAEELPRPLEILKYRDPQNASNVETKFYVLGTAHVSMQSCRDAADLIARVRPDFVLLELCNERISILSLDKFEAARTLGGDASTILPNPQEPNFGAAVAAIRSGKSTPFQALYSWLLAKVATNLEIKPGEEFRVALRSAQQVGAKVDIQPEARVRTHTPIKLCPGLTFWTASSPQSPHTSHQVVLGDRLVSVTLARVWGGLSIWEKLSLVKNLTWTGFSMLDAEALTKEIESMKVKRRGAREGARSGGGARSGGGSVQCPDGALALGRDRPWSARMYGTCHSAGMPLPHTLQEADVLTEAILEFGKEYPGMIGPLLTERNLYMVYMMRKLAAHASSVVAVVGAGHLQGIRRAASTQISDSYGQHLMRDGRENSASPRSCVLWVQASANMRELGIGYRHRGADGASPRPPFTPAAHQAGSFGWERPGRDPCRAIRPEKACLNGQGSVP

SEQ ID NO: 13882 - protein, 149 aa, Chlorella protothecoides
MAPGQPLISITRAVQGSRQMMITQSAHCRMKPSEPLVLLCIAAGLINQACARGVSDKEALVLQAFAFLEEYAATRLNTQESLYNLGRAAQQLGIPHVAVTYYCRALAEGVPRMGRDDMSREIAFNLMLIYRASGAAPLAADLARKYLTV

SEQ ID NO: 13883 - protein, 279 aa, Chlorella protothecoides
MSPLHIPPQEAFLDLALPTLGATLRALEAEAERSAPDVALRRRLRWLGRRGREVGRARGPVTMLDSEGGMFRGLDGRLDRRKEHVRELDARVEELVTTAVQRDSDALPVDPLVPLEPGWDWIARMSPIVNKNVSLGGRHEDCTDPGSSFCNCITHPAGSTRGSPSPPMPPKCAEEEEEGAAAGFVMRELLREEGPFALLVQAGQALHAEGRWEEARELASAALDVCGKRWAHRWKRDAVRLLAARGAIAAHDLPAALHNLRLACARWPLASQPWNSFAL

SEQ ID NO: 13884 - protein, 282 aa, Chlorella protothecoides
MQPDHAEVPKALARLYYKTGKHDLAVQALNSFITSHPAAVDATHINILAELFTEVGRWAEAVSLLSRVQTELFGGQPLPADLQVKRGLALLAQRDLPAALSNLESLLAEPVEGFADLYLEVGERLAAAGHPPLALRFLAPLMEVGGGSNPVVATLLADCHEALGDRRSALGVVQALVEGLDAGHPAHAAATLRAAALHRQLGDDAAATALLESVEQVLAVQQEGAGAEEGAGAELILRRAALLHSAGRRVRHALTGWGGGAVWVAGWDSPKRAQAPVSACLV

SEQ ID NO: 13885 - protein, 150 aa, Chlorella protothecoides
MKSGQVLTDSKWKWYEPEHWRFGDALGPQGINYMRHATGQAYGLSRPVAQYIARNAHILHRYANEDVSVGAWMLGLEVELVHDLLLCCSSAAQCREQTTPEKRCLVFSEVTCAGICQAETRLEPIWKSCLEKPYEAVTLATFDQTETSTA

SEQ ID NO: 13886 - protein, 938 aa, Chlorella protothecoides
  MOD_RES (83)..(86): Any amino acid
  MOD_RES (169)..(172): Any amino acid
  MOD_RES (854)..(857): Any amino acid
MRRTGGPSWGTFGDGLVAEGASPLQLQPLQDARGAECVMTWTHLGLVFRPVHFQACIKAEQGGSQRWLPEGGHQRWRVTHAPXXXXSKKACSLWSSGALSSSKAGSLGTLRSSLGGGASSESVCGLESTNLEATAVGCKDGALQGWNQIESVREDFASFRDTHMRRTGXXXXFRPVHFQACIEAEQGGSQRWLPEGGQQKVASHACPFSHPTHICNMLDCHELQSRHYRRPVSSRRRQLCVQAARSCRDLPNVKRPKLLGWEAKPVRVGKPYRLGTKHTRGRISIPSADSRAREVPGRCRRQSVRVCDQRVEVEYRSRAPNRALGRYRAGVGDRSWQPRRCEVPDDTLITHGINQIDSSKMASLEAFRQYDFEGDETWKAYLSRVEIPSGSEDALLKLKAKYYKREIDPDFEPSSVAKPAVPAADAASQAAASATARPAAEKPANAQAATARPDPPGLPTRSEVYIIAGEWALVLMAILSLQPFLPRLAYSAFTLTCQLSLLTNGLKLQPADPSHLVSSCCSACSVQPPPAAVPSARDSQPVPLPRGHHALDDGSLWYGPVCGPELPVERQRGLLPHPALRHPVQQPAPGRGGAPPGHPRPAPRRRRLPPHLRHQALVPGQLRPRARAGGAPPGAPAHRGRRGGGGAGLHHPPVRGAARPPRRWHRLCHLEPAQAALPVWPLGALPQAGGLRRRGANEGGCCGGGWQGGLRGRGANEPGCCGGGWQRGWRPPCSTLNSLPGGCMPGEHMDVHCVEAQPIAPPLPPHMPCTHLPPLARGGLTAGHDYSGVCMHRLGLTAALRPARMGALHGKLTGESGQPQAMGLGVCVPDAAQASGRPTRGCRVSDNPAKNLPXXXXHRPWDLVCVSRMQRRLQGDRRWGAESPTIQRKTFRALTGRDRIARTAVARSGCGHAASGQPVAQTVQYESCSETAGGWEWS

SEQ ID NO: 13887 - protein, 171 aa, Chlorella protothecoides
  MOD_RES (9)..(11): Any amino acid
MGWPIASRXXXAQHASECTQSPRSSPSHIPASAQVDLTSGDGLADCFSALGPELVAVVNCAAASAPAFCEQNADHAAALNVPHQLLKSLAGLATTPLLIHISTDQVYAGTGTPAAGWSEDCKPQPVNVYGATKLEAERVVQVEALSCREPHACEPYPDAKGTALADLLPSW

SEQ ID NO: 13888 - protein, 58 aa, Chlorella protothecoides
MEVEAGTSLVVVLALMFFGSLLASALPFMFQIRGNSMKVVAGLGGGLLLGTALSIVIP

SEQ ID NO: 13889 - protein, 187 aa, Chlorella protothecoides
MADSLRDRGVMQSWDAVHIYLHETTDQARCGHALSSAPPPSPAAQVAEEHGHAGHGHGADDWSGAILVLGFLGMMALDRSQPGHGHGCGGHAHEARPRGRPGGREGPPSPTRKPGAVDPAVLGLLVHCAADGLALGAAALSGNTQLSLIVSVAMLAHKVCGVWEAKSGTGLSLRVAAHTHPAPSTPP

SEQ ID NO: 13890 - protein, 426 aa, Chlorella protothecoides
  MOD_RES (127)..(139): Any amino acid
MHGAGAPHAVSCRAADLQTNVHPLPATPHARQAPMAFGLATYLIGRGAAWREARGSLLAFAGAAPASATLTYALLSLLPGGASSPTLVARSLLASGGTFLYAATMHILPEVLAGAGPGTVAATAGGXXXXXXXXXXXXXGWAMRTELPSLPPTWLQTETPLLESRGDILCRAGNGQFVRHGAEQTGMPWGADQRARSKRHLQQYESTKTRCTMTNPGTASQSGLGSGRAAHLALLARHACVGVGAASSTEGDLTELCSRLVNGHHQRKTPQAAGHSFTCHLPPSRPAAPPKSRTKAGTSTHVPRPASDLGPALASLVGFAEVLASSAPRPPVLGFTGHGRARGAAQQARAGRDLTPMAAPPWGGIAARLRWNRPAYRTTRPLIEGLQDSVIWTLPLLTCVIALEGQVQPLLHLVDQLGEVGPRDIC

SEQ ID NO: 13891 - protein, 515 aa, Chlorella protothecoides
  MOD_RES (252)..(255): Any amino acid
  MOD_RES (367)..(369): Any amino acid
MTDSEPGESDSQANSMEYEDEEFSYGSEAADFDFDDDAGSAGLLSDRKGGYTTLDNTTLQNRVDAAAGRIAELCCMPIGEAARLLHAFKWCAGLAGWRMLEVRPYTTIPLTHARYALAQYNTGTQRGFRMNGSRTQIRDDLVCTLVGISIVYSSTESWHAERLILMAKTCDNTALVDNHLPSVIFFPNLVLKQGQCGICFETFPATSMHAAACGHRYCKDCWTGYVHTAVESGPKCLDLRCPDPECSVLENXXXXRPRVQRAGRSGLFASFLVSLSELKESRARRGPSMPGEAAVGIAAEKYGKVYPFCGQLGLNGLLVKPWVPPFAKNIPPSFIDAAMHDAERADLVSRSRCVCEWRGLSVLVPSXXXLTWCPAPGAFPSAAVERAVAEAWDVMLVIRTRATSPIAPADCGRAAEAMSVPVTAALDVICDCGSKYCFKCKQEAHRPQGEREHDVDFGKYQELSKLQVSRTKNWGWMIVWGRPLKTRLKMVGQAPGCRLPALPHLATAPFLAGAT

SEQ ID NO: 13892 - protein, 857 aa, Chlorella protothecoides
  MOD_RES (515)..(518): Any amino acid
MAQCPPAPSFPPTPRPSPQQVEEEFEIDINDEEPLFLKGQSSKSGGEMSPIKIVKNPDGSMQRAAMTQSALAKERRELREAQQRTLLEAIPKDLSRPWEDPLADAGERALAAELRGIGLGTSEVPEWKQSALGKAPTFGIRDSRSIREQRESLPIFKLRDQLVAAVADNQVLVVIGETGSGKTTQMTQYLAEAGYTAAGKIGCTQPRRVAAMSVAKRVSEEVGCRLGEEVGYAIRFEDCTSQATVIKYMTDGMLLREALLDDAMTAYSVIVLDEAHERTIHTDVLFGLLKGVLARRRDLKLIVTSATLDAEKFSAYFFSCPIFTIPGRTYPVEILYTKVGAGYVGEGGARGGQKQERGARGRTGELQGFSSLGPSALQFKGPYCLCSLHAHPAFNASIPTTHIPRRIPTQPTAGSRERLHGCGHDHGDADPPDGAGGGHPALPDRAGGDRHRSPDAGTEDVGGGGKGDGNSEVGWAGDAITQPQCQSAVARGAGLCNLLHGETVLPPGASCSHLXXXXQEMWGVEARATRTGRWAGRVMRSRSHNARVQWPGGRGSITCCMVRQSSHQTRIFDPAPPGTRKTRIFDPAPPGTRKVVIATNIAEASLTIDGIYYVVDPGFSKQKVGRLHTHSRRAEPQYIHQTPTLQIGMDSLVVAPISQASARQRAGRAGRTGPGKCYRLYTEMAYKNEMLPTSIPEIQRWPGDLECGLGRGHRETELGVRLGSVQGHLMAGRVSPLTLQSRTPLTFFRSNLGLTVLTMKAMGINDLLNFDFMDPPPAQVGGGWCASTCMDHGRRGQDSGLARTITPPLCVQCGVPCQSPIMSSCTPLTLQTLVSALETLYNLGALDEEGMLTRLGR

SEQ ID NO: 13893 - protein, 262 aa, Chlorella protothecoides
  MOD_RES (193)..(195): Any amino acid
  MOD_RES (237)..(240): Any amino acid
MQGVVMPLAEEVVSWGDAGGCDALGRNGYPCSTTRPSHICRKMAEFPLDPPVAKMLIASVDIGCSEEILTIIGMLSAQNIFYSLGTRLHVHSIPPCFACAMRHAPYAIPTTHPCRPKEKQAQADQKKAKFHQPEGDHLTLLAVYEGWKNSKFSNPWCFENFIQARSMRRAQDVRKQLVAIMDRYKLDLVSAGXXXKELVRFGPRMAIWDPEGRERACLTGHDLAGACNRPVLHAQEXXXXRRWRGLGRTWPFGIQRAGRGRA

SEQ ID NO: 13894 - protein, 200 aa, Chlorella protothecoides
  MOD_RES (186)..(189): Any amino acid
MLRKVARPSRQTSLLQFRAREELHSHPKGNLRRVLRTRRTQGPPGESWLHRAGAHVPVLDWQKAKCEAWHALCSDASALDYNAASHSLPPAMYSLQEGHKTVVEHQPVFIHPSSALFQHQPDWVLYHELVLTTKEYMREVSFGRRGMGRMWPRRVAFLCAAATTGLAQHLLLEARWLTCLCALAGXXXXSNKWPCTTLVG

SEQ ID NO: 13895 - protein, 239 aa, Chlorella protothecoides
MICGAGPKVHFYCATEGLYHKERRATCKFPIGLRTLTSLRPHPRIPRMVNSAICTKPLPAPPSVDAKLFKSFGVEVVSGFDPTDFTPEQFIELERLLYEHDVVLFRGLDLAPEHQYKLTKAFDPTCESYGHGNNQAKSVLHPDLKTIPSVPQVQLIGNGIVHDHWGLAEAKLKHPHHRTFHKDPVSEEDEAAGATRFYRWHIDAALYGDLAPPKVDEGEGGPGVLLGNTHPGEGCTLRH

SEQ ID NO: 13896 - protein, 533 aa, Chlorella protothecoides
  MOD_RES (29)..(32): Any amino acid
  MOD_RES (339)..(342): Any amino acid
  MOD_RES (429)..(432): Any amino acid
MFTTLKSRLHGPLSRFPLGQRHVALSPLXXXXEHPSWEGLRSTTLVCIEKALVHVHKAKISIEWAAVEVPAQTEACCPQPAAGLLGLCTPYLPPLPPSRREHPGDLPVRSGCPRRPAPGLPVRRRDRGRARRPPGHYRLCLRHHHAGRAPARPAQPGGALLGPLRPASLRLDGPRPRAAHGPGPRGRGAGGPPRGAAPLGPPGPADPARVLAQPGDGAPAPAGPPLRHPGPGGRASAPRRGIPNDRRPLPRRRRGHRPGRGAAPGLRAAAPGHRAGAGVPARLVRRRPGPVPQPGRAAQRGGGLPARPGAQVPPVQPGRQRPPCRAHARGHRHVRILPXXXXAPELVWAPAPPCTCSCIPVAFRSFRAGKALTGRSEACTLPSCNVEVRMHGSPISRDACVSIVPPGQPALSLLHRQAPLIVLRTPCPXXXXGSQGYRCCTVRPPSLCSGLLAPDGSCSTPKCMLQHNAQNWDSLGFPLWHDNNTALVIIADPRAKLAWQGVMGDRSNNSSRTSTLWQLQGKRFTPWPDKVGC

SEQ ID NO: 13897 - protein, 200 aa, Chlorella protothecoides
  MOD_RES (31)..(34): Any amino acid
  MOD_RES (177)..(180): Any amino acid
MRGDPCVQICVKGDLWTTLTHAERSPLSLAXXXXESLPSQDDVVAQVRIRERGPLRSDLGERGPLDDPDPCRKESTLPGLPITCAHAISQDATFLDTTFDLNTLIPSNSSYAWYQGSLTAPPCWEGVSWHVFTDPMEGLSVPQLEALQSALASHPEERELTCSPDEDSGCGVTAADXXXXPRIPRSASSRAPQMKTAEVE

SEQ ID NO: 13898 - protein, 263 aa, Chlorella protothecoides
MVLSCIILCIAFALGDVLPLTAGCGQQHFHKGRRIAEESDTSAWNYDLNGADWPGTCKEGRAQSPIAIQLTAAAPFAGPPISFEFGKAKGLRVFNIRTAIQVRRHLLVMCRLGLIRSPPVPLSAESDHRRPGGRRVWGPPTLDIGQGHWSQEGLRSRIFCSRWIYQAPPLILTPPLTGGMGRPRGQPNRDPHERHVGVRRGEHLLRSRQTFPVPLAFYMRAHSGRLHVPLGAAPGHEGGQRDGRTGAEVLPEQHLPGGVRRHV

SEQ ID NO: 13899 - protein, 96 aa, Chlorella protothecoides
MLVHVRETPQEALASAPRELAWLQIECQRLGEENEALAAAAEAMQEELRASAALLRHSNPNQKIQYTQRLKLELEALRKECAAVTRERFTLEQCIR

SEQ ID NO: 13900 - protein, 163 aa, Chlorella protothecoides
MAGHAKSDGGPKDRAQWGEVVANRGALTGAALFFLQQFSGINAIVYFSSSVFEVGPGVILGANPCALVTEACMLCSGGVQPTARAWQGAGHEQHNPPSLSPSPRPSVSQRAGFHSGTLASAAVGTVNVLGSLLAASVIERVGRRCVGSTGSYTMRAGVQTGSQ

SEQ ID NO: 13901 - protein, 189 aa, Chlorella protothecoides
MLLMAAGMRLPALAHLGPYVAVLGTLAYILSFSLGVGPVPALLVPEITPVNLRGVCVGGRVKGRVLGGDFLRESSDALAGQRVLNPTCPLEDCRGKAVLRMSRDHSPRCQQDPSTRPDSLTLKGKAMAMAMGTHWICNFAIGQAFLLAVNAFSVPVLYTFFGVVCLIGAQFARGIKSSTQLPEELPGTS

SEQ ID NO: 13902 - protein, 76 aa, Chlorella protothecoides
MTISMTKGAVYALYPLTFSRRYQGAPTETIVTTTVENCNDEYGAVAPTCGWATLNGVNVLCAGDWSRGEGEEGGGV

SEQ ID NO: 13903 - protein, 157 aa, Chlorella protothecoides
MRDVDQATGEDLLPMAGGAGRGQPNGAGAGAAPSALHGLSGIKGSHRSLCGRRIPLLTPLRTRPPPYIHPQVKDDGDDAKPRRRGRRMTSPERWEISQLIKSGVLDPSEYPGFNDDEGTYADMDDEVGVDLDCAQKPCILREMSLGGNAARLAFASS

SEQ ID NO: 13904 - protein, 128 aa, Chlorella protothecoides
MQGRFSGRLETKEDEKRLTDECARIGPLLGAGGEGEGSHGTLAKIVRGLASGEIRAALEARERRYQELEERVALLSGGTAGAVSRLQEDCTRLRAELDGRDAALHRLEMELAALRDPGDAARAAGATA

SEQ ID NO: 13905 - protein, 360 aa, Chlorella protothecoides
MASSTSMPFPTQTATQHACFTVKVLTSRHEPSPVPRQGQGKEADPPRRPAHLAEVPGMVLVHHDAMVVLTTSVTATARMLPMLADAAMTGTDVAPLLPVLLQVCTARDGVGGGSVGGAGTAKEGPAGRRGGLQPQQPARARHRESQLRLPRPLTGRHRASCALATPLEGERGWRSTGSTALVLAMRASLAGLARNGEWVWTARTVGTPPMPMRVVYITALFTSGFEVLSKLPHHGVGSKLARTTWKEGTHYSITSIKLSQVRSLWRVHHSTLCMDPSRSSGDYINPTWSLLLPGRSAWQGLWSAELEWTGQRRAAPAHLRPPQEGVESGGRARAGPGVPGRCRAATRGCCRDRRGGCSDR

SEQ ID NO: 13906 - protein, 173 aa, Chlorella protothecoides
VVAHGDALKRLAAAEAARDALEARRAALAADLDAALLAKKRWAEERLPGAGRCRLGPRMPSIAPPLGQEPAPHPLTDAHTMPETQTRLEADWELERGELADKVAAAGRESADLAAQRDALQRQVEALASGEDGGEGGGARQPDLADMLRMLRRDREVAQMGLELAKREAARLR

SEQ ID NO: 13907 - protein, 447 aa, Chlorella protothecoides
  MOD_RES (191)..(194): Any amino acid
MYSGTKPSLVWGDFCLHWPYFAISCALYGNLPLGACALKHAVPLGNVEMIAVKSSKSPNGTKPSLVWGDFCLHWPCFSISCALDGNLPLGACALRHALPMGNVLDVARRRNSAKQTPATICTRVFKSKLGQVRHSGPHSGKSEVYLCPIASYLQRRIAVSVPGLDRKHVRIVRYKFPYQNCEWNHLHHTVXXXXTRRGSYKFPYKNCEWNHLHHTVPISANTITDPPMSSNTLPKRVLVAITSYNGALYDDGKRTGLYWSEALHPYNVFVEAGFEVDVASEKGTMGYDEHSIEGDGLDPESKEAWEDVNNPLKKALKESLLKAADVDPSKYGIFFGAGGHGAIYDYPGASGLHAAGSAIYGAGGVIAAVCHGPAILPGIKDPATGQPAIKGKKVTGFTKVGEEQMGLLESMRKDKVHTIEELVTEVGAEYVQVGRDGEQHVRKGGKL

SEQ ID NO: 13908 - protein, 101 aa, Chlorella protothecoides
  MOD_RES (23)..(26): Any amino acid
MENYRRVRQPRTDLPPIAPDELXXXXIMENYRRVRQPRTDLPPIAPDELLVTAISNPVEVAGKGVSMLEEEHPAITLKAMGQAIGKAVSVGGCLGGGPRRW

SEQ ID NO: 13909 - protein, 68 aa, Chlorella protothecoides
MPTAEILKRRVAGLHQLVATSTVALTDVWEPTVEGLERIETTRYASAIEITLSKVGSWRFSGSSHCVG

SEQ ID NO: 13910 - protein, 349 aa, Chlorella protothecoides
  MOD_RES (49)..(51): Any amino acid
MNSYNSCSLTFVLAEHSLLADSGADSQFREEKLSALTRKSYTQNLPSTXXXHSLLADSGADPQFSEEKLSALTRKPNTQNLPSSFLGASLLSDITYHVHCDEGLASINNARCVYGDLAVHTQQVSSTSLRQPITVHAAAVRIREGHSTLCKAQCPACVQPQRLAQVWGDGPGLRICSKSPGVAGSTTRPGDGAPSLENIESCPYDVDGSVLRAHSCTVQCAGALRTNLQSQGSDLEFREQHRTSGNDGSAFYAPDFFSNLKTRALGRVLLTSRATTSTQSLLQDSLRSLPDGVVFVADKQVQGKGTESRAGPWSLGRGRRHWQGGGSFVSGAEHALNQPADNLASPLLL

SEQ ID NO: 13911 - protein, 161 aa, Chlorella protothecoides
MAELPWTEADVIQRCQHEYQVAAREGGQEGQDATVRYQGSPVPPGRGSVSPQALPGRAHDAARPAQGGIKRFRRVGGSTQRRSNGCSPVESFSWPMHDVPAASPQPPACCYLQGNPEFRQAESLLKSVDEDIVRDGLVGVGAGAAVIGVIGAIAYAALRKR

SEQ ID NO: 13912 - protein, 239 aa, Chlorella protothecoides
MLERPVWQPPPLPPRPRPPQVASACNPHHTAPSYFLLPKRTHTLTLARQHPEYVDKYIAGTSDMFRAYIRDGLAKLEARDDGAQDPGTPPASAANGAPADGRPGGDDRPPLPVPPRRGAGVAALTRPSPGPAGLPPVLSIPSPGAAPGSGSGTPGGQGAAATPSPLASARSDGSAAGSVARLNSLRYEAARRGCGAGSRRETMSAVDSAGDATWVGLWRHGRLILGLAKGGSHLSKSLG

SEQ ID NO: 13913 - protein, 305 aa, Chlorella protothecoides
DSDWGRGDATAAGGGEPRGRAEGVRRAASGAARSSGAAAGPPPPPTLFHRLAEEAGLPVSLLDTQYRMHPALASFPSRLFYDGRLASGVGPADRPAVAGVAWPAASAGDPSAPSPLLFVESGGREQLVGSSAGSSLTHTYNNTLEAQAAVALAEAISAADPSVRSVAILTPYAGQAASLLRHADPTRLRIARPADAEGDGALAALDCADARGARPRGPLVCISTIDGFQGREADVVLLSTTRTQRLGFLADRRRVNVAITRARRGLAGHVPEAQPQRAERGGRRPRISADPGCYGGGCGVEENFL

SEQ ID NO: 13914 - protein, 278 aa, Chlorella protothecoides
MRLTISGQRLPFLQYLVSMAVVQAVREEAARCLQDSTKAIGGGGASTAGSRLLVSQSSASGVATPAPGLGAVAMKGHASPLRCTEPLMQPTWAPSSLLPSPPPPQGGAEVEVRLKWPNDIYAGEHKIGGVLCHSAYRDRAFHLVWGLGLNVGNRVPTTCLDRLFEEAAAARSLPAPPPARPERLLASLLGWLEPAVDGLAQHGFQPFQPGYLRAWLHSGQRVELEEAGSRVALTIEGLTPDGYLLARDDAGLAYELHPDGNSLDFFRGLVRKKLPAAS

SEQ ID NO: 13915 - protein, 223 aa, Chlorella protothecoides
MAGPRRVPGAGSLMASPCPTLFLLAEGDYGAVVRELKKVLAKDANITCATAAAEVAGALGSGLRSGFSNAAKAWPGRLHAHSVCSLQPNPSSLSSQSLCPNLLERLKEKNIMMSRAAEDTLRTLGTHCYSLLDVAEDLVAAMEHKNPKGRPWKACEQVQWIEMGHRKAAVRKAEARKRRGALGPWEHMQVVRCRVRDREGGAQWSCLTASSESQTARAQARNP

SEQ ID NO: 13916 - protein, 236 aa, Chlorella protothecoides
MAQLRPLSRLHPRLSTLTTNIPPAGAAPMDVDEGGSEPSPGAVSVDDLLPRTSIAGAITPTLLSMLASSNWKERNTGIEQVDDLVRGAGGRIAPDLGELLPALKRKPASLGSVSCMRIRCSRAHSSALSLHEPLRPAPAQSRLADTNRNLAAKALLTLSRIATAMGPEFDRVAGRLLLAPAVSNLSDNKKQVRDAALGLLTAWLGVASLDRLLPAVLEAVVATRTLADGKVAALAW

SEQ ID NO: 13917 - protein, 193 aa, Chlorella protothecoides
MEVGGLRARGGAESGPASLATYVSPLPPPLRTRPLNPPPQGVDLESLLLNIHDFFLFLGVDEIRRRSGVDDKPLRMVKTILHELCKMQGYGIYAHARGIPGRDAQPQPIIFAYIALNLQTLSNSGKGRDRPREGRLCVAGRGSGGGGGAGPAPSAISEEDKAAVKAGLKDIMPRLMHRSEAEGAMQQLYHLRR

SEQ ID NO: 13918 - protein, 235 aa, Chlorella protothecoides
MEKVAALVAERGPAARDPGVLIQCLAVLPSWGEKNFQVLNKVYEVIAALAAGPLSRRDAGIAVEGMAEKIAELKHRLPVIAGLDAVSEAVGPGFVCTTLQRLAGAAKNPKVPAEALAWVAAAVPAFGVAAFDVPALLAWAREALGSAAAPVRARGVDLLGACHAQLGPAMAAGALEGLKPAQVTQVEDAFRRNPREEVVPTRHVRRRGAGAGAGTAAGGELELREGRGRSGADRA

SEQ ID NO: 13919 - protein, 309 aa, Chlorella protothecoides
MDDVDRVLFVCRELDVYKIPPRTGAGGHRSGEWRVDDKIFTARCRVMARGQALEIRLEDTTTGDVFGVCPVPRGQLHLVVEPAADSSRNFVVRLEDAASKRHAFVGINFAERSTAFDFSVALSDHEKQLQRADKLQHIEASDDPLAAAAKSLPEAAALYQKQDLALEEGSTIRCGNVNLGEDLSSRFVCRCCHVHLAPSTIPAHAWGSPLHEAEHACPRPPSQVGGAQARGPEGGVAGGFLSRLPVQGGALASPGKGIGLAAPPAPSNGASTAPAAPRAFDPPPSAALQGAPVLPPPASGGEAGWATFD

SEQ ID NO: 13920 - protein, 458 aa, Chlorella protothecoides
MCVEAVLTVADLERKDVNLDLIKGIGCGCGTRCALAWGIAGCSAKFVPSSFLQTPLPSARQLDGKVGGRLEDSRLVQGVILDKDMSHPQMPKELHDVKIAILTCPFEPPKPKTKHKVAAGVPAARRPGCPSLEGWSPHQTRGAEHRSNARPSSPSRSASIPRPHNTSPPPRHRVATSSHPKSQVDIDTVEKFEALRGAEKAYFTDMVRACKASGATLVVCQWGFDDEANHLLMHEGLPAVRWVGGVEIELLALATGARIVPRFQELDASKLGSAALVKEVSFGTTRDRMLLVEGCPGSRAVTLFVRGGNKMVLEETKRSLHDALCVARNLVRDNRVVYGGGAAEMACSLAVEAAAERVGGVEQYAMRAFADALDVIPLSLAENSGLAPIASLTEVKTRQLTEGDPHLGIDCNDLGTNDMRAQNVFETLAGKRQQLQLATQVCKMILKIDDVIKPNEYA

SEQ ID NO: 13921 - protein, 340 aa, Chlorella protothecoides
MFYAQCAKGAIPLWGRLLEPCLPTATGSHNLHAAQVVPHDSLLAAQNGLPAGDKKAAGELFAKLAGGGLGEGPRGPAAPSAAGPAAMMTSAAAGRQAKPAAGAARLPGAFEPQPKAPEPVEAAILVPQPQAREERARRFRPRSLRYEGLSPDEPELLEKEFQGVTSPEFRDFKGHLQAADTLLAQLDLVWAGVVAGLDLILRWVVLRMADGNMQSLVRVLELARALLCALRDAGGHLTELDALVFLPAIVEKAGHGQDRVRALHREVLHAAAGLYPVPRLLDLVTPGLASKSARTRIECAEFLAERLDLDGAGPALASRSKPISAVAAVEGGRDLLSEAL

SEQ ID NO: 13922 - protein, 97 aa, Chlorella protothecoides
MADNEAAVLAAAKKLPLDERAAHKTWKVRSELFDDVKDACAKAFSSEDPILHQAGAEGGGGPLFAKGLGDANLNVQDTSIEALCAWLAKADVQQASR

SEQ ID NO: 13923 - protein, 136 aa, Chlorella protothecoides
MKKDVEAAIAELPPGKRAPERWTRREQEERAVAAGQPEAMDVDDEAEPGLVAAEAAEEVDEDGPAQYHGFWAGSAPNSAMEAASILIALSSRQNRVAFWDCFESKKWNVRKAALDRLRDAARATRSGFGKLEGVGG

SEQ ID NO: 13924 - protein, 100 aa, Chlorella protothecoides
MEVEHQVGKLLVELSKSQDHEIGDGTTGVTVLAGSLLEQAESLLDRGIHPLRIAEGYEMACKIATAELERISTRFDFGTGTKEDLEPLIKTCMTTLSSKM

SEQ ID NO: 13925 - protein, 284 aa, Chlorella protothecoides
  MOD_RES (207)..(210): Any amino acid
  MOD_RES (281)..(284): Any amino acid
MRTRVGGGSGLDWQDLQISRSMVRCQASSPGPVSSDPDRNSDVTPPHTAIMAWAKPAGAWAQAVEEEEAEQAPARDAVLHSVTGPILVPVVAKEKEFPSLGDAPDRAGFPSLGAAAAVKDSKKERRKKQTMSLADFVSTVDAPKPGTFVPSARVGGSALRRPLNDDDILRNLPTTSRGKVEGDEKPGDRLGGSFRDYGGDRAGGKAXXXXGGRREARRQAGGILPGLRRRSGRRYGVDPGREGQAHGVQVVAGEAGAVCLELGLSVGSVPIETKTVDSGAXXXX

SEQ ID NO: 13926 - protein, 294 aa, Chlorella protothecoides
MERGGEMIRPAVRFPSVTTTSPARPSPPKTGTVASTPHAPLTLADVIDAVVDHGAVQGLEAELGAAGGEGLNDARNVVADDDEACDAGVGLHRPPQRSLGVLHAAGESKKVRVTALVSAAWSSVRMCGSATQAGSWGCTATPQHAMASASPFLLLGPPAATHGGHCIGLVQDDDLVGWHASTRGRGAHRDGRKGLNFVADHRDAALVGGVQLQHPRTEEVGAKQLPDYGQGAGRLPGAGRAIEQEVWELRESVCSGWGHWDRPFREHTWSGTPSVCFHGQKGFKDPIRDLKATP

SEQ ID NO: 13927 - protein, 226 aa, Chlorella protothecoides
MRRAITTLQSAVRLGGSPVRPQTLMDVAGVVPDAAAHGLLHTCREGDFAGVQAAVADLIHKGYPVRGFERAWKSAVADLIHEGYPVRGFEERLEGFVGDMYGGGRVWSTGAESGGSSASEEDLDPHPSLTLPSPSSQSRRTGPGGAGRGAGRGVGGPRHRRRAQGQSVGAAGAGGQGADRWRRRVPAAAGGGQPDAARHPRPGVSAQRGWLGCSATGSRGAPGSPD

SEQ ID NO: 13928 - protein, 142 aa, Chlorella protothecoides
MAEDAVGRRQKSCNCRSALVTPSHPPPPTPTNSGKVTRASALEVFILSALAKAGATVVTYPMLTVKTRMMTARRGDADMQYSSVGDAVAKIWRTEGVPGYYQGLRPKLVQSVLAAALLFMAKEEITAATRRLLLARPVRATS

SEQ ID NO: 13929 - protein, 427 aa, Chlorella protothecoides
ETGEGLPAAVLQYAGRSLLESLVRDTLAREHLHWRLHGGAPRPTTPVAIMTSAAKGNAWRVEALCEARGWWGRGRDAFRLFSQPLVPVLSAADARWLLPAPLAPLMKPGGHGVIWKLMLDEGVYDWLRGRGRAAAVLRQISNPLAGTDDTALALAGRGLARGKAFGFASCERVVGAAEGVNVLARFADEGGDGGDAALPPRYAVTNVEYTEFGARGLVEQACGSGSGHSAYPANANILYADLRAVEGAVRAGAADGDAAALLPGLLLNTGKRVTVRDAAAGGATTTLAAGRLECTMQNLADCFAAPLGPACGGGAGPDHAADHHAADDHAADDPEADDGLPTFLVTNVRRKVTSSAKRAAAPGSTAIHQTPVGSFYDLQLNAAELLGRCGFDVPQVLCHVCSLAVSVCAWVVGRGGGTRRWECSIGP

SEQ ID NO: 13930 - protein, 88 aa, Chlorella protothecoides
MVWNFHPFSARPTPPPDRSHTRLPPFTPAVIREVFHEYGVPGFWNGCQASLVMVINPTLQYTLYEWLAGVRAKLRAQQTGAGAGVGHA

SEQ ID NO: 13931 - protein, 157 aa, Chlorella protothecoides
MHPAWAVLPSHSYLLAVAHHHCALHDLEPALKPLPLHPHSHLRVRDFQVQDTFPYGIQLTWQKEGERVTSTVFERGSHVPSAKMLTFYRTEPFDIEAAYTPESDLPSTADARIGGSGGGAMCWGHGGLVFGEEGVESGRTAPEGLPFGAAMPPQRVL

SEQ ID NO: 13932 - protein, 216 aa, Chlorella protothecoides
MLDEDRKDHPPPTPPPDKVLEEDIVKVAAAQIAVPGGGQDLELAAAQRHHADLGGGVPHVDENDVDGGVLRQVGAIDAPGQRGGSGVVEQAQALEAGGAGRGQHGVPFRLGEVHRHRQHGVRHGRALLALCQLAQVHQQCRHELLGGEARGGAQVLHLHLAAAVGALHHLVRQVLQVGLDGGVGKLLAQQPLDLAHGVAWVGGHRAHCAGDKRGRN

SEQ ID NO: 13933 - protein, 233 aa, Chlorella protothecoides
MPEPRFQPTHQRFSILTTNREFDAKYKLDIKGNLRASFRLRGACEKAKKILTTNPEAVVSVECIADDKDVAGSITREVFEEEAKATLDKLVQTVRKEGRRLCGCHGEGKTGPGCIERAQLDLSRSGACLRIPIATPPPFPLLLQLQAVEDAGLTPETVSNVEFVGGSSRVPAVTRHVTDYFGREPNRTLNATETVSRGCALQCAMLSPAFKCAAWPVLLFFWGGGGGAQGCRG

SEQ ID NO: 13934 - protein, 111 aa, Chlorella protothecoides
MTQDPAPLPEEDARRLSWEAATERFLDVSELREEDLARRPLDSALDRLAYAAHNSLTGVEGLRAAAGAGAGTRDNPQRLDDYDPALSLRGGIFDSKKRAGGRAEAVTRASA

SEQ ID NO: 13935 - protein, 322 aa, Chlorella protothecoides
  MOD_RES (184)..(187): Any amino acid
  MOD_RES (279)..(282): Any amino acid
MPLQIHIPQTPSSSPCPPQEKAQKDAGLVPGTSAPGTDANKEEADSRSVYVGSVDYAATPEELQSHFQGCGTVNRVTILSDKAGNPKGFAYIEFLEADAVSAACLLDGSELRGRTLKVNPKRTNVPGMRARGRGRGRGGAGGYMMPPPFMMPWMWGGSAASTGRTLLPLGQSARCNRNQERLPXXXXATAQLHQPVGPSSTGSVCWLQSKSGKTPGARHVGRLACPLSAPPSDRPQPEPPPTPKVLTLLTAHRLAKQQTRERCTGRYLAALLVKQQRRXXXXGSPCMPSLCPAERLAAARAPSYTESSDSADCIPPCKTANM

SEQ ID NO: 13936 - protein, 366 aa, Chlorella protothecoides
  MOD_RES (165)..(168): Any amino acid
TTAAAASACRSAPAQPRVAAARRASSSGSGGCGQRRVCARRTPRRSREDGRPTSTSRSKRPGRRRAGSRLSGELVAPITTTAPRLPTPSMRQSTVETTEANVWSEGESWRAVRAGASASSSSKKMMEGARRVACSEGGPEIGEEGLITGEGCGEEQVRVLKRAAXXXXSSSKKMMEGARRAACSEGGPGTGEEGVITEEGCGGEQGRVMKRAAGAMASGREEEWGRVRDTRKLTASLHPLLLALVIPPTLLAQLPAVSRQTAPHLVKEEAQRALGLPMELAQAVGAAADEERDTRGRKRSALARQGPDDEGLACPWRTMQQYAPGWQDRQGGIADDMGRGVGQGRRILECINRRRGDGVSCPTPFC

SEQ ID NO: 13937 - protein, 93 aa, Chlorella protothecoides
MSLSQCHHQVCETPEGGLRGVAGEVRRGRALRCAHCGKRGASLGCRLASCHSSFHVACAQAAGASFFLGSFQVACKAHARLFGGEPSVPKLLG

SEQ ID NO: 13938 - protein, 159 aa, Chlorella protothecoides
MSSTMPPCLSYHPGAYCCMGIEAPTGVIHDLRLTETSAEWGWARDAVPSPSVNAFKDPSPLADTPAHVIRYASLPILPPRGILLHGPPGTGKTLIVRALAGECAAFAASRVSLFVRSGADCLGKFHGEAERTLRLLFDEVRRCLPGDGRQLREEGGWDD

SEQ ID NO: 13939 - protein, 109 aa, Chlorella protothecoides
MRAPVPPSNRAAGSRQRELSSSDEEHLRSREAQREEREIASLQPVLLGAEPQGEGDGLYTRPLTTFADVAGMEGVKAALREMVLLPLLAPQVLQDMGISAPRQGREKAG

SEQ ID NO: 13940 - protein, 246 aa, Chlorella protothecoides
MRVAQGLYGQPTISVEPCGRVVVLHTLPHHRCPPQGMLPPETAALAAAGSAARGATAFLNLEPWEESGIAALRASGISRVVLGLRHPLPAFSGVAVAALRGAGVEVDILGETQVGPGAATNGPGAGPHAQAAAAAGDGPEAPAAAALRASLHANEDLVHRAALRLPLSLLKYAMTLDGKIAASSGHAAWISSAASRRLVMEERAACDAVVVGGCTVRRDNPRLTSRTEGKHNPVRIVMSRTMDLPE

SEQ ID NO: 13941 - protein, 273 aa, Chlorella protothecoides
MGWRSGGGNVTCCRVWDCCSGVRVRTDHPSPLCATTQPKTDYMNLPQPVRYDELQREIMTNAHRGSWGLYLALPPAGRGITFWASPACGLSPCHMALDPSHPLTPLPTPPPTPVSLKPDLFEGMRLELSKPLNHNFGLSHSVYMGNLEVPTANNQPVKMPIGTYEFGANLVTNSGNLMLGRVTTDGRLTGRAVYNLAPWAALKSQFQLAGEPGMSQGMFDVDVRGADWNGTLKYGTSNFYGANYFQSVAQNLSLGGEIFYLAEQRRSGGWRRL

SEQ ID NO: 13942 - protein, 453 aa, Chlorella protothecoides
MWHPNGTIPAQGGGPDRAVRLQEDPVTLAHASVPAVFPDGRVCISILHAPGFDPLNPQESAAEKWSPVHTVTPKCLGPAAPDILLSTALLPDQHSIPFPPRSSGGEHRAVHHQYAILAQRRVPRQHRRRQGVEGEPGRVPEEGGTHRQAQPGGALMLDAGQECCVEASPGLPPGSPVVHDEQACSSPVQQHSYIPCPTGAAASYLPPVPPPPFPATLPGPHHPQPNPLLCHTNPANNIHGTASGTSQGRGQACSLADVQAKAKLVVLLHVVQFGRQHKIDAHRQPLLHLRGGPDPGSACLQGSARQGCQAGRVTAPSQLPPLPQTGRARTGVDAAAESCLPQDVVVPERGRRLARVLVEHKVSGQGHLKWGGARLTTERQQAGVRHLDRGDRGVGGVPRRQTDACARGACGQGVTGTLARGGGVLCMHPGGPPLQSRDTHRGIKQSCKRLGFP

SEQ ID NO: 13943 - protein, 238 aa, Chlorella protothecoides
MPPAHGTGNRGAGRMGSRVTRTGRVLEDVFFKKAKAAGYVARSAYKLLEIQEKHRIIPRGGQVLDLGCHPGAWLQVACQAIGPRSAGGAVLGIDLQETSKPGKWCDDRVVVVQGDARELTLDFWQEYAPTVSEVSVEQVAASSAEERSPFHLIAVSLMPTVTLARGTPPFLTFSTQGMDVVLSDMCHFTHGNKMMDSYKSLELAQTAVDIAMSAGPGSNGILRPGGSLIMKLLQVRRV

SEQ ID NO: 13944 - protein, 454 aa, Chlorella protothecoides
  MOD_RES (239)..(242): Any amino acid
  MOD_RES (412)..(415): Any amino acid
MPSPTNTNRSRRRRRCCLPYQRTASCAGFPTSLPVDILQGTSGAEAEGGGGHIASYKWAEVLSADAFAAFEDAGLDNEAAVKETGRRFANTVLALGGGRAPHLVFEDLDNLLSALSEGIHSTSFKKENFAGHRCLMLPMCLLLLPTGFPREAAHGGCSAEAQQPCHCCLGRGWRGCVAQACPLASPESSKCMWYLCPPLDGSSTSWTCRRALCPNAASEAQGYLEGRCRSKERCAITPXXXXVARKVPLSATGWLFDLVDLWKSLVPQCSEGSAGLPRMTLQVERAFCNHPFKPQKHDLIPESALRRLIKVLTSLRSHQNSPRHSMEVWSGGVGQVGWGVAFEANEVHLLALAPGSLWPLPSHLLEVGTHVSRKLHCARPLQERDNRHGREQRGSLVYYPAAAPAGAAVHFXXXXPQTPLCQAPAGERQWTWPRTEGHLGVLPRCRACRSCCAL

SEQ ID NO: 13945 - protein, 900 aa, Chlorella protothecoides
  MOD_RES (354)..(357): Any amino acid
  MOD_RES (427)..(430): Any amino acid
  MOD_RES (584)..(587): Any amino acid
  MOD_RES (791)..(794): Any amino acid
  MOD_RES (829)..(832): Any amino acid
  MOD_RES (884)..(887): Any amino acid
MPTSPGLSFFLLTVLVTDVDGQHCLPKSTISIIVWVPHRSPPPPSSPCHQSQPLYAAFRALKDGPEWASLSEAQRRAVDLELRDFVLGGVALEGEARDRFNAIQQELSALSTKFSNNVLDATKAFKRLVTDRAEVAGLPPSALAGAAQAAAGEPGSEAATPEEGPWLFTLDFPSYFPVMTHAENRALREELYRANITRASAGALDNTPVIERTLELRREKAALLGYASYAELSMASKMATLGEAQALLEQLRAAARPAAEADLRDVQAFAAGRGFQGDLAHWDVTFWAERLKEDKYSISDEELRPFFALPNVLEGLFKVSLVSGEEGVLGRKKGEGEMSEAEGRGLGTIPRDCXXXXELRPFFALPNVLEGLFKVSSISGEEGVLGRKKGEGEVSEADGRGLGTNPRDCLRPPLDPAPRSCTLDGNXXXXPATVLPKGNLTIEAADGQAPIWHPDVRFFAVKKDGQPKAYFYLDPYSRPSEKRGGAWHRCSLLPIPPVAKDGRGVRTVTPVRSGWPVGALAGGAHGVQPDTAGGGQALPHDIQVTWGLRQGVGDVAEGSDNSMEIRTGLPAAIRHLVPDVPCLXXXXGLRQGVGDVVEGSDHSMEIRTGVPAAIRHLADSENFIPVPVFREVETLFHEFGHASQHMLTQQEEGLIAGIRGVEWDAVEVGWVAPGWHRGSARRAVWDDFLRTRCRSPLPARVRCTMSLRMRCQPSLMTCSRRSTPAAQLPSQFMENWCYDRCGAVAKGWISSCHGCAAAPGGARPVVQRWSREYTSISSFTHPNKPQANPGXXXXWAGCMGRSSLGCAPPMPSKGCAGQVQNPRGPTPRXXXXQRWSREYTSISFYTHPNKPQANPGRVCAPLRDRREAAGGPVPALVGRADLQXXXXRLDVSRCMSYFRR

SEQ ID NO: 13946 - protein, 138 aa, Chlorella protothecoides
MRCDMHLGQARWFTLYHDGNHSAISHVQDSPLPAFDAVRPEDVVPGIREVLARQHAALDELEKGLQPTWSGIVDPLERIADRMARAWGTVSHLKARWLFAAVKDNPALREAVEEVQPEKVKLSLRLSQVLRWDGGKVL

SEQ ID NO: 13947 - protein, 203 aa, Chlorella protothecoides
MRPARRHRFGGAARHRHLDRHGPGGEHRPAVAQLPPAREREGEGLGGASADALSKGCTAVLVTLSTDFVFNKNSREATASFGYDYILRQARLRGRIDTGACAPGGVAGRGRSRAQPGSLAVPSLASTRSQGQVPPAAGRLEISDPHSWNCPPSHALDPLLSPDGKIGAYVEERLSVGINFVLSAELDHVKKDYKFGFGLNVGE

SEQ ID NO: 13948 - protein, 226 aa, Chlorella protothecoides
  MOD_RES (11)..(14): Any amino acid
MASRSTGGGWXXXXWSTGGLGRVCSRGKPEHRWGLGGSARGWHPGVGLPWTGWAPYVRSHPLRPLGTAWAHAPICRLPSTSPPMHVQEDFDFEGGLAKFSKEKIDEGVVDALPKEKVYQKDDFFDELSCDALSRGPHGVYMAFAVSRGGAAQGGWMADAQFLPVQSCCAPRMGWECVRPDGRARAMAQRKTDFETFGKTGDVRRGGFGRGDRVSGEDICFGDRLRG

SEQ ID NO: 13949 - protein, 271 aa, Chlorella protothecoides
VAGETEVKAQIKLRFITGAGQPVVVIRSFQLTQRKASMAFKALDNVLQTVNRATGAREALSYRCADIDRAIPSLMGVSAAVLESVVFVHQEDSNWPLADAQAVKKRFDDIFAATRYTKALEALRKLRSEKTAEAREMRLRLDTLRSHRDGARVGGTAEGGSKEGGGPRVCWGGAAWRQGSGACGCGRHRLWLPHRIRRREHVLDMHSDGDRTLIPSNQHNRQRLRGAVEAGEDALVSLEARITELQRRIEVRVGRGVWEGGVVSMPAGTEP

SEQ ID NO: 13950 - protein, 304 aa, Chlorella protothecoides
  MOD_RES (226)..(249): Any amino acid
MHRGQGEYPPDCDARRVFVTGFTGSAGTAVVTSDAALLWTDGRYFLQAESQLESGWTLMKHGTPGCPEVRRPPACLPDASLLTGSGTSMPSRGWRVVHCAPYRGLAGRERTRGLRRGVRPLAAHGGGRGEAGGGPDGGRAPAGPPVPKPRGPGVGPRPACRPRRARGPARAGVGGRGGRREAGRPPARHGRAPRLGPPGHRPGRGGLAAQPARRRRRTQSRLHLLXXXXXXXXXXXXXXXXXXXXXXXXCLVTADAATLFVDGAKLGEAAGAALREAGVGVAAYEAVGDALAAAAAEARRTSTR

SEQ ID NO: 13951 - protein, 225 aa, Chlorella protothecoides
MAGIYNGPARGGTRGGKDQFNWESVRADQDREYYLGHSVVAGECITTCVSPPPQVAEGQGCILVHPREGGGCPGGTRKGAGHGEAAGGGPHDGGSSTPDRLMQSAELPEHLNESDRNLLLLRSHSLCPAPSPGAGHEAAAAKAGDTAQAGWCGHAEDTAWGRRRCRGGGPGRRGSGEGAGLQCLPPHVSRWRGRSMHPMYYAHSAARGMRGKPPQPAQPPAQAHD

SEQ ID NO: 13952 - protein, 200 aa, Chlorella protothecoides
MARSWALSLLCVAAVAGVALAQTMYPSQCDPTTVLTPGDLSILGPEQFLVAGTITQPPHIPGPLSGGVNNSYHMFNTLNITEPVRPLLLLNGMGATQYEWPPSFLAWLSQGSRPVVTLDHAGIGGSTFLAATAPSIPLLTENTAAFMAALSAAHPDTLLPEYDVLGYSMGAMVAQSLAASFPSSVHAVVSGARPGRGGTV

SEQ ID NO: 13953 - protein, 287 aa, Chlorella protothecoides
MPGSDSSFFTHVACLLYFLLTPANVCPRRPPAYWDDWMRLNSTRQGRQCIRCVCELPGMCCRLETVTHPGLRAADDWQPPPVAPQRYLTAGTQARGQPHLQFWRARLEQGPVLPHLPQARDSGQRGHRLGERGPEPPPAGRVRERVGKGGRGIAGNVNRILATLRCGFTLLRSGLRASFIRHKAGGSQPHQTFLTHPETPRLPPQVCHALRGNAGLRAHAGRRRGMDLRCRSRPRGVRQPATVPADHGEVPHAARVEGRRAARRLPRRRAREKPERRGGAHRAGAGV

SEQ ID NO: 13954 - protein, 155 aa, Chlorella protothecoides
MSFKKMRRYGKDPAVVAAALRSSELLEVSLSGKAVRRREPLKAVDHSELRSRTLLITGLPDKSSIGALGGKRGGCHGPRVLPAHRALRHPGLCEDPEAGGAGPPHRLQPPLHDLGGAPLVRARGVLELGGSPQGQGCAGLHRLLVRTGTLALAGR

SEQ ID NO: 13955 - protein, 434 aa, Chlorella protothecoides
MAEPVGALPRTATASEYLMVDQYTQQRAHGDCESCLVHPPSPAARLTGRCLTLPTRPTGTWADEVEEEEERLIQGMACLKGWSEQDAQVGALAAKLGLGSGSGGRNHAHRMHAAHMWDRSAHHVVCCVSDPRHGDGRQHHHLRSVSPTPDSCTRSDSGPRDPFPPTPAGETLEAPTVGPPHSGPPQAARSPRAPAAAARPTPSGPPYKIYISNLPWEVDEYAIERFFQGLEIRDIILLRHRDTQKPKGCFVEFGSGCFVEFGSVQNLTEALTADGAELMRRPISVSLAEARPNDRRGGGGGGGRHWNDGGYGAPRGGGAGSGDRYGAPPPGGRRMGDRDRNSRFPPRDNGYSAGPGEDAERWAPRREGEQGEAQRGMGLVLGGVSESLLRRSLGTLGRQPHGLFPVESGAAAGHGKGPRGPHLVSSVAAHRLHS

SEQ ID NO: 13956 - protein, 541 aa, Chlorella protothecoides
  MOD_RES (343)..(346): Any amino acid
  MOD_RES (453)..(456): Any amino acid
MITHAVACHAFSQVTAYMHAGARQFGFMVRGLQHLEQSLGKLHIPFFLLKGADQGAVVAGLLEPDTWGGGGWQGMGRLRQASVVAQIPSPEDALVGAEAPLYASQGTLSRTSPGSGTLVGAELAVLRGGWAGHWLASCTGFVQDRSFPTALPFQIVRRAVHLSHSATYIKCTHALTAASFAGGVEESEGWNQNGRASRTHNLFTADKRESAARTIRPKITRLLPEFLVEYPELRAQTVGWTGMPPPRVDWDGILEEVVERGRAVPEITWCTPGEDAAWQVLGEMLMEGQREGGKDWTPMNVCGSQEDCCAASQVGDLHALCNKPPHPHHVCQSLVHTGIVWKXXXXLWVTGGLLCSVARSRALGAGAYPTSAFCHRGPLGPIAVHSFRAAVSATGCPGSQEASRQAQGGAEGALGWGPDLGGTVQGALPSELAGFWDEMHWEVGAVCVLGCDXXXXGKHKVGQKVLWVGDLIWVGLFKGLCRLSWRVSEMRCTGSWELCVFWGATAGPSTSSIISLSTSTPGLKCRSPWIASLRNSSYGGS

SEQ ID NO: 13957 - protein, 378 aa, Chlorella protothecoides
MLSITKSPAHDVLTSKAIQARTCILKPCTPLGNQPMSSLPKSNPPTGLLDKVQAGHTRNSPGWCGLLPASGLCALGHRCSKEGPHDTSSVLLGQACSVASPLMAYTFPPPPKSMPPPSTPGAYAHDAQRQGTCDSESMRGRLTVLPVLKKFWSSSSEKETPPIERPLAVCARGAKRSRESSRTSIALCQVTGRWLLVALDTRAVLRSHSLAILPASVARVAWLHCVIPRQFLSKATGHTTRLASSAEHPRASSDHQNPGGMQVKRKVPEPAQVEAAGPASAGTGRAMQSSVDPRRVRELRSGEQGPGPVLYWMTRDQRSKDNWALLHAVDLAAKKGVPVAVVFNLVGARYYWPLNGHQVKLLGQELQPCTKEALPCAP

SEQ ID NO: 13958 - protein, 627 aa, Chlorella protothecoides
  MOD_RES (95)..(98): Any amino acid
  MOD_RES (252)..(255): Any amino acid
  MOD_RES (303)..(306): Any amino acid
  MOD_RES (336)..(338): Any amino acid
  MOD_RES (440)..(443): Any amino acid
MCPAAERERREHLHDIQIFERVDINDSGRTSAELAVRRFARTVCCLGLVLERMVEVQPVLCIDCVWWSTAGIILLRLPIIHLQHWHTPQTREQPXXXXASGGLLQGSYNFDYPSSISHTGTLLRHVNNHFLILHRMSGERAWEEGQGLQYLSGMGAGWVVSEAEQDAMRSGIWEREENEDQCCWLHITPRCCMHPQVWAGAQIPVGQIPGCSTGPVRSGHHGEAGVDVVELCCIPGWQTTLQHSGSFTSCPXXXXPPWIQSCATGPVRPGHHGEAGVDAVELCCIPDWQTTFQHSWSFTSCPXXXXSAEKTSLASDTPGSMLVCAGCNAGHRRTPXXXACLRMSLLSLCTRRLCVFTSCASMSSAEKTSLASETPGSMLVCAGCDAGHRRIPLHALGLPRAPALHLIHLVHAPLPVTEMEGFNSHLNIEQMNKRHPRRSXXXXLPRAPALHLTHLVPAPLPVTEMEGFNSHLNIEQMNKVTGGKAWACTRMGPGSVALISLSDMYETQAEKGQPVQSGEVKAPCRPKVMRMCLPPVTACEPPQQPPPHSCRAGVQGLPPALSHGSARQVQGGPAGLPRHLASAASGSEDVTSHPLGPATTEIPACITLNVASSRMGMNQALRISRRL

SEQ ID NO: 13959 - protein, 327 aa, Chlorella protothecoides
  MOD_RES (122)..(125): Any amino acid
MHPHPHPQDKLIDPSSITNIHKVTRTIGLLTTGVPGDARSLLQKARSEAAEFRFKYGYEMPVDFLARVLADQAQVYTQVWFGMRGLGHGSMCGALQLPWGYLDASLEQFLGGAAPGSSHLLXXXXILTPPLSSFLVGLPLAPLTSSGAAASVQRTPCNKSSTLQHAYMRPLGVISTLVGIDEERGPQLFKVDPAGYFVGYRATATGPKEQEAINYLEKKIRPDLSLSADDTVQMAISALQVRGCRVRGVLVGVGLLELLDVVQPVQGLSLHKEQNVLAEDLKATDLEVGIAETSNGGLFRSVGMGWDHPWTGCLCMQTPHGLGAVEI

SEQ ID NO: 13960 - protein, 313 aa, Chlorella protothecoides
MDTADEAAKTVVRHGFAIGTEGAGVQCALLVKGEFVEPPPPTQRAPSHRISEKSAGLRSGAVASVQLSPEGLQASVARQLEDQRAAQEASAALAAQAQEVARQTLHAQQQAARRAALQAKEAAEAARHEAALRAEEGRRQEEEQRRRAEEARVAQEAARQLAARQREEALLRAAAEERQRMEAERAAAAAAREAELRAAAAAAKERQRVEELQRRRRAEVRLRGSSLGGERFEWGACGYRIGGALALGGHDACSRTLGTHASCVLVRLGASFLSSSLGWSGGGSGATTSAGRSRGAGGGRGRSSPTEGGTGQG

SEQ ID NO: 13961 - protein, 636 aa, Chlorella protothecoides
  MOD_RES (74)..(77): Any amino acid
  MOD_RES (405)..(408): Any amino acid
  MOD_RES (436)..(438): Any amino acid
MSTLLTGVVRCDVASLPRNSSLPLHSDLAGLAPVVACRRHGPPTASEKWRMSRRRHAYTLRPQSVAADTSQASXXXXGGLGRWVDGGLTRTLPWEAPGMQARLGRKQASLSESAIRTETWTWRGHRIRYLVAGRRGDSSSPALLLVHGFGSNADHWRKIMEVQAGDRQVYAIDLLGAWVGWVREVGRWWFNQDFALGSAGDTGASWAKARYGYSDKPNPRLAGPPSSLYNFDTWSDQLLDFTRAVIGRSAVLSCNSVGGLAGLQAAVKDPAIVRAVQVINISLRALHLSKQAAWKRPAVSTLQRALRTTGAGPWLFKRLATRDGVRRVLQTCYGDPKTVTDELVDYILKPGLEPGAVEVFLDFISYSSGPLPEDLLQVCVAGWRERGHGARACAVNVTHVDNGCXXXXPGYKWQNRDPHTPRRWRWSHTHPHVPTXXXLLQVCVSGWRERGRGARACAVQGSQDELGMRIREANDACTLGLNLLPYPITNGKVGTHTLKVGWNGPTLIPMFLLLQACKVPVSILWGEADPWEPVKLGRTLALYPSVEEWASLPGKQGALWRRCRTAHGGLGKACQGTETFKFLTTPMRAPLLRCGTLPSGRGTRPGEPLCDGVHEAAWRGVRYFTKQPEEPTCFLK

SEQ ID NO: 13962 - protein, 128 aa, Chlorella protothecoides
MYRGQIRNKKRVALGSGSEARVHYTVNYNLPEIEGPGGAGAACLHSEGRVCSEGGRLGPPRRRTQHPDTIRLPSLLPSPTHSPPAPGPPSPVMQELQDGRAGPGPERHRRRRVRARRHPPRRAGPLAA

SEQ ID NO: 13963 - protein, 373 aa, Chlorella protothecoides
MVWGVAPHTPDRAVEFRDEGSQSRECIAYSTTSDRRIGTGQPLPNAREGEHYQGPWPTPFKLECPPFRLDNMAEVVEERRSGPKSVKDVPADEFIKAFSAYLKKTGKIQLPASVDIMKTGSFKELAPYDADWYYVRAGAPSRWMQWLQGLGWSMEASQRLPAVESVFLLERCWALGGGRWACAKYLIAVGPTRLPRDHHLTQSLFSSLTMQLPSLAACTSGRVWAWVPSAGSLAADPTPRAASPPVCGGWNEAGATAVAPSCCACRCRGVSWGNYSLAVPMMVCMFSLTPPPLPTTTTLPADHWPLPTIHTTEHFAKAAGGVVRHALQQLEALGLVEKTNTEKGGRKITPEGQRQMDLVAASVKLTPFALLLE

SEQ ID NO: 13964 - protein, 117 aa, Chlorella protothecoides
MCQAPLPHSTHAHRRYISSAELESLSSYMRGRLTADRVNQSLDELAAHAARNAALVLAARRGRVAGADKRHGMWLAYSVAVREGGGGPAGVAEGADRTLDEGMGMSAGRLAWGAATA

SEQ ID NO: 13965 - protein, 218 aa, Chlorella protothecoides
MPLAGELWCFDDDEVGTPSLEDPPARRGPATHSASPPSIYDACDRDLYECSCKELDQVVALAKANGAIGSRLTGAGWGGCTVSLVKDEDVDAFLRVVRCRGRYLAGDGGAAGDVEGLCLGGSGEKGWQAAAADGAAAGLMRAVRGTDSSSVLLAIISPPAEAPADSRTSPAGAADGGVRAPADRRGPPDRGDPVGQHLRLQAVQRRGPAQAGPVSGCQ

SEQ ID NO: 13966 - protein, 133 aa, Chlorella protothecoides
MAGTPISTHSDLESVYGEGAAAVRDRYVALSKAHHARFGTKPEIFARAPGTLGAHLGQDVQPGSGCRALGASPKSQARPPGSSPAGATPTFAGRVNLIGEHIDYEGYGVLPMAIHLVRAAVQCESGLVPRMPV

SEQ ID NO: 13967 - protein, 157 aa, Chlorella protothecoides
MMPHLLQLHHPPLQLTAPNVNTTFKRQIKAREDAGWTRVEWALVNRPTAENLSVVQGRAAMGDPKDPNTGFVQFTIRFNTKQRFRAFSKSGAVVAGGPDPVDVEELWVLEHPFKKQETNRWRLVGKLMPVPGTKEYTSSAPVITSESLRQHKAAQQA

SEQ ID NO: 13968 - protein, 223 aa, Chlorella protothecoides
MAALPRLALRACSHATHTLQGAPPCSAPAAFTSLLRLAQHATCPSGSYQPTRGYAGQEYLANKFPKGAFAASQTLGRPAGFRPSVVTSDHVFDPYQVTQRVVAGCTSPYPPPVSTHPSLAQGVPSGLSAATMLTPKGLKYLWRRAKGSAQNVYALAMAHKYAKPFKMPLFKQEALRLYEEINTHVAAGDRRALIAVSPWPDPGCMLGVWVPGCCSVPSQQPGW

SEQ ID NO: 13969 - protein, 280 aa, Chlorella protothecoides
MDQAISMLGARGIAKLVEFDPVRAHDVPLPAGATFVICNSLAVSNKAESATGRYNLRVVECRLAAAVLAALLGEGREAARAVRTLKQLEPVVAARYSGPKGSTAGAPLAAVHELLHPGGFSEGADAWGVGLRGLSRASWAAGRHVWVSRRGSRAGSPAVAQHAQVRGLSRLLPFPYTPPTGTYSAAEVEEILGAPLASLFEGDASAALVLAAFRDFKLHDRAAHVYSEAARVPAFRDVCLGHGSADEKIAALGKLMDDSQASCRLVWRGFGGREGPGSRG

SEQ ID NO: 13970 - protein, 137 aa, Chlorella protothecoides
MATGVLEQVVLAFSAQISELQQATLLRADDASAALYKDDLVALESRVRELEGRVRGVREQLARDRAALPAAQAVIRAATLQQRQLEHVEACLPTFLPSLPPTPPVHGGRGDTANAEPARRPRAPGQENCAEPNAVPR

SEQ ID NO: 13971 - protein, 199 aa, Chlorella protothecoides
DAGVELAPKSQAIVVDEFSRTSVPSIWAIGDVTDRVALTPVALMEGRALVETLFGGRDVAPDYANIASAVFAQPPLATVGLSEKEAQEKLNGEVDVYVSKFRPMKNTLSGAEEKTFMKMLVHVESDKSASGVQPAGVTVPAAGRHWYMHMHCNTQEGTLTPCSPIPHPSPAPGGRVPYGGTRCRRDHAGPGHRTQVRRN

SEQ ID NO: 13972 - protein, 234 aa, Chlorella protothecoides
  MOD_RES (94)..(96): Any amino acid
ELARRTDTLIRLIEKENEEDEERNAASKKGAKSGGAPARKRAGSVTAASSADVKEGGDDGKEEVGSARKATRAAAAVSPAKNWETQTPPHLWRXXXPSWWVLRCTWRLRPLPTYGAVAPRVVAPFSDVHKMAKQGSKGAITLHGGSNSSVHVTMDRARQQLHTENVGDACLLAAYLLSTSSKISLMRWMGSLNETRKAWRMIDRVQRDQDDVQAGDPRLTFQTLCKHNPADCSP

SEQ ID NO: 13973 - protein, 171 aa, Chlorella protothecoides
  MOD_RES (60)..(63): Any amino acid
MLTICVDIVVSKLLSRLRPLPLRQHAILQCLHGAARVGGCPAGPEHPSRPPRPPQAPTGXXXXSSNAFMALQDLGDALPAQNTPRDHPGRLKLPLVWLDLEMSGLDPAQDAILQVAVILTNGTLTEEVQGPEIVIYQPVDVLEGMNEWCQEHHTSSGLKEVRYQALGNASY

SEQ ID NO: 13974 - protein, 466 aa, Chlorella protothecoides
  MOD_RES (34)..(68): Any amino acid
  MOD_RES (355)..(358): Any amino acid
  MOD_RES (380)..(383): Any amino acid
MQAFTLCTPRTARANRKGKTSTSAGRTKSLHRQXXXXXXXXXXXXXXXXXXXXXXXXXXXXXXXXXXXITVAPGGSSHDELPGVESSPQRARDPHTKRLVCIHALDQISIKRCETRDPLAQHLPTACPSSCAQALPYKRDLGCDGWAGPETQGATEGHTRCSKSTGSPPGVGAGPCGEEEAVKGSGNLLLAWKRKCQLKAALDNDLSPAAAGLLGDAPSDLVKAFLTRCNFELEEALLEEGPQLELCPLHARIVAALRQRIEMIVPYKGVCVVVLNDVLGCIGVTECGNGTKGSGSALNIKSVASGLRLPPTHPPHSQPPGLVHWRPWDRRLPPWSSTWTPQASSGGRSAGHNTXXXXTHPPHLQPPGPVHWRPWDRRLXXXXSQQGVKDHDEVLWPSSAGHNTHLGAVSDPETTPGPQAGASHRLERGAGFLRAVSAHGQQPWARGHLGGGGPGRGRGAETTGQL

SEQ ID NO: 13975 - protein, 118 aa, Chlorella protothecoides
MQRHGRHQQTNTLHCMLVRALHGLRSTLPWPRLSAAGLSARPSVRPLARLCRQETLAMSQSVESGPAVHYSAALTSIDASQYEAQLATKVAWLETLFQDLEHPPFAIHRSEPEHFRMR

SEQ ID NO: 13976 - protein, 351 aa, Chlorella protothecoides
  MOD_RES (103)..(106): Any amino acid
MNQVNLHTTLSGQAMVTLLYHRKLGDAWQEAAQKLRVCLGDLASPIHIIGRSRWGGLPLVWMPAYPSNGVDGRMSAAAWPGMTALVLRPSHAAAKVWQSWAPXXXXGVDGRMSAAAWHGMTALVLRPCHAAAKAPVAAHPPPKPLSSPPSRRGQKICLDADEVEETLTVEGQTLRYVQVEANFSQPNAGISVQMLAWARRAAQGSGARDLLELYCGNGNFTAALAPRFRRVVATEVSKRSVAAARRNCAQNGVNNVFLARMRSEEFTEAWRMGGKKERCGGSGLVAKYSLLEDRGTGVEVEFVSLVSTVLAGSSYTGISSHSPDRAVHTSQPSLSLNSHTAQAKGVGSRRV

SEQ ID NO: 13977 - protein, 681 aa, Chlorella protothecoides
  MOD_RES (58)..(61): Any amino acid
  MOD_RES (185)..(187): Any amino acid
  MOD_RES (398)..(401): Any amino acid
  MOD_RES (583)..(586): Any amino acid
MNSTMSSTSAAILARDSKGQMLRGCLYIRDHAGVPFPVHFLGLRHAHMFRAITGFSTXXXXFLSLRRAQMFRAITGFSTARRLHNTPPPNTPCTETLHANLVAVKDTFDIVEYAVFDQFPWTPHIESGVYLQRKAGAPRPPKSSSIPDVAPENTAAPQGVKRKAEGANNSGHEAVPASRRGKRSXXXMGAAAPPFLRRTTPDMKSSQPRGGARDPDLYFGAEVRQLRQNLLQQPIKLRVEASNSASHTLVSRCTAPEKEWMLPNIASARISTAPLTGPISPVFDWLWSSPASCASINETCKNWHHLVHAKAPNLYPRGQDGCPNGTKQCQIAGTTPHSCSAGSSLCLRALQKRAETPFFRADPSPDVPRTGSCSARFVVSQPALESIEVDCSWLRPCXXXXLLAGSAIIPDQTTFKENPLFSTPSSDHAHAGGGWGSGIAAQVRQHGREPQSASWHGRIDLCTGVPISCGHSVSGTAHLRGLFPEARSVRPCRHFSAFTRPPAPGDCTLPFAERCLYDQPGCLPPPHFLGSSRLRVAHHGSGIAGGGSAESPCGPEVENLLSAVLTQLHQGHAGTPGKPEVCXXXXETYSLPYSPISFKAMLEHLGSLRCAGTWGAPSHLLRLFSMNTTWSFSNEHLQCLADSPCAPFLEELDLSRTSMATGCARQKAHPHSLLVDVTSLA

SEQ ID NO: 13978 - protein, 95 aa, Chlorella protothecoides
MPSKYTKDTLPRPDNPNVKIIEVPSRTMAVLTWNGGVPREETTASKTQELRALLAAAGVKSTGSVHVWAVRVPVFLLIGLRESSRQGCACKAFGM

SEQ ID NO: 13979 - protein, 66 aa, Chlorella protothecoides
MNKAMGSGFRQVAGFIFGKNKAVDREGAEKVSMTSPVAMEVVHNEKIGMTAPVMSQQDGGGVYKVN

SEQ ID NO: 13980 - protein, 114 aa, Chlorella protothecoides
MQLVRDTSETMAPSTAMDLRNFSLRVVCGPHDGRLDPKSMQILCCCAKCAPTYKTFTLGQWEIHGGRGHCRNAKSSIRVVETGKSLHNWLRDRATAEITTQAVRATRWATGWGE

SEQ ID NO: 13981 - protein, 451 aa, Chlorella protothecoides
  MOD_RES (42)..(45): Any amino acid
MSDSHTVLNQPRAISTPPRKVLEGQQGDAAIAHVHANPHSLXXXXQPRAISTPPRQALEGQQRDAAIAHVHPHSLGDRVFLDWPRSFPLALSRPPIAMQPDNLGHLFEDQAKFYAQFRPSYPPELYEAVYGLAKLPRRGTALDVATGSGQVAKVLANDFETVIGTDSSAGQLREAVRHPKITYQHVPAEDLQGVSDASVDLATVAEAFHWFDRERFFQEMRRVLKSDGVLAIWGYDFGYLEPGSAAQGSIPDSDVAAANAAFTEFHSGTEGLGPYWAPGRALVEAWYAGLEPGCSHFKDVTWLPEGMAIREDMSLDHLVRIWEKGVAHLMNRAEFIRIVVGLLNSWSALTTYRKQHPEKADLLAAFKATMARCFSIEDAEAPNTIRMVRNIFGFVAKEPQPLSIRMPDVMEQQSHSERESLSELATCHAQDDRCQFLLWLAIPGFQSSAKA

SEQ ID NO: 13982 - protein, 475 aa, Chlorella protothecoides
MAVGERATSSDHQLAPHESQAPLGPPQAPSPWWEAASRSSRFWARASSIYAGYKVAQVRAQLLKASGWSPDRITAEHWEPHHAAAGEAMHDLCISLRGFYLKAGQFIGARGDFVPAPICKRLARLQDQVPPMSPDRAASLIQAELGGAPLTSVFAWIDLERPLGSASVAQVHKAQLACPPSQRGRPLLARLGEWVWKPRRGRDAPAPALLPGGADMCLACAAAPRDGVVAVKVSSWSSALRQGKRGRDPRACSIPCLHVLCPIDLMALPTPQALPVTPLPAPSPPQIQYPDALNDMTLDLANLRRLSSFLSKTEIDFDLVSAVDELAAQIRLEFDFRREARVMDAVADQFKVGGFRGGYSEIREVGPQHGLCSARPINSAPKRCLASGTQDQGASQHPGAGHRSHDRDGVSGRHPHHPAGGAHLQVGWLCGSGMGRRLAYTCMHGRRMRGRRVVDLDGDGKIDCGSHAGCLSCPS

SEQ ID NO: 13983 - protein, 579 aa, Chlorella protothecoides
  MOD_RES (498)..(501): Any amino acid
MSAGALHRPVERAAEVDERTSVHRAARQAQRKQQDWRWREGRVPSARGCSSNPVCEQWVGSAEPRSFLGPLHAAAQVRSVPIRKDDEVTVVRGTFKGREGKVVQVYRKKWVIHVERLTREKVNGATVNVGVDPSKVVITKLKLDNDRKALLERKKVGRVDRSACCRAGMVEVRASRAAGRTRASSPPRRLPPWRTSTRHLASVNWGYACGVTRPHMVASSCSHCGSGRGFKGDRWLDDHGDRRGALHVGNLMEEELRAGNRVDSWCEAAGLLQVEGPGDSQVGLCLNPSLLGMSLPPRSLARGTACMVLHGGRYAPYQRHDAHRVDGVLPSNGHQPARSPREVHQPSLPSYQVSGVLFECPSSYAPIKPIGKGAYGIVCSACDVRTQERVAIKKIGAIFSNPLDAKRTLREVQILRHLTGHQNVVALKDLFPPPSGPTEYNDVYMVQEVSWLGVREVQGREPARSGTAPAGVPRVLLPAAGLGAGRLFAAGRGWGLPXXXXPGCCCRVLALARAGICRWKGLGPARQAHEGPLTLRAIPRNAPPRALLPMCSWQIQTSTRSSAPPSPSPTTTCSSSSTR

SEQ ID NO: 13984 - protein, 197 aa, Chlorella protothecoides
MLGRKPLFPGKDYVHQLNLVCKVEQPAGGETGVLSRAGVGRCRAAPFETLFLPLPLRQVVGTPSVEEVERVANPDARAYLRSMPYMPPIDLGSTFPAAPPAAIDLLRAMLRFDPGDRIGVQAALAHPYLAPLHDPSDEPDCPSPFVLNGAPAQPSLEQVRLRRGLRRPPQGDGRVLGFADLRVGHARGLAEASIRHT

SEQ ID NO: 13985 - protein, 103 aa, Chlorella protothecoides
MDGAQGRRNATVHPWAWPAILALTGSPSHHPTTGGTVGLIDYGQSKKLPDSYRALFARLILALHREDEAGISAALRALGVETQREDPPLASKLAYGMFDTRGK

SEQ ID NO: 13986 - protein, 1036 aa, Chlorella protothecoides
  MOD_RES (10)..(13): Any amino acid
  MOD_RES (252)..(255): Any amino acid
  MOD_RES (762)..(765): Any amino acid
  MOD_RES (801)..(804): Any amino acid
MHEVGVATFXXXXDHALGATVSLIPLLTMAGKTDSTIAQHNTPGHGREAGHCRGAAQREAGPGVHASWTSAACIVSRGGGVRFGKRVQGRDTKMHARSWGSHICQGEPWMCAIPSAETCPYVHPCTGATWTPCAEGGRHGCKGLPPPAWHGSSLQTYLHDTLYSCGARPAIARLDNSDCVSKDVDDRPHVIVSFIAVIIAPALLSQTYASAVLAKSPGLTRRDLRVYRRARVSTGAPIDTHRHGELVCRRCXXXXQELRSILTAMVNSSAADAELKARFPCRERSIDALATAVQTGQAGACTLLLHGPPSTGKTAIVRSVAAYGFMAGIAGPSEACQDHWGNYTMRGLWVLCHAGRRKCTSDRTGVHVGMGHAPRVHRLRGVQHPPPPAPVAAAPTQGRRKKARHGLRPGPGLRLAGGAPGPPAGPVPGSWPGTPPARCLGGAGQRAATGRQRPADGADARGGCRGRPAVRPAPGQAALVQHGVRHLHAGPGAAGHAGVGCLLQRPDDPGGLDEDWGWVQVAWTGVGMWEPSRDPMSGQGKPLVHQRAAMSDGNGVILEHRRRATLPAGAAPSGDAATFRAFLTAFVPTYRRATTDLLEVEAAVAALYPAFRAPLDAGRELRPAQLHARVNPLVQRVVAERSHTAAPAAKEVGSGVPCTGAAHDATPGSSSGAPPALASQLPFVSKYLILAAYVASRNKPTADRAVFDPGFRKKARRGAQAHDRMVRLMCRSARLGARVCDRRGVHERRGWDHWEASCVYHXXXXFGSGVPCMGAAHDATPGSSSGAPPALASQLPFVSKXXXXGCETRGLGRGRRGGLAAGAAPLPPGALPAHILRVVLEPRGGGGGGGRGLARPRRGGRGRGLERRQCDPGLLGPRATLAWKPAAGRRLRRGGPSGDLPARGAACRRADGPVQPGHAAHAQHEWRGPAGAGHAVPMRGGGGGGAGHRRQPQGAALRLPEAGLKVATRVQGTKPPFPADPLDGHTLPAATLTTVSPVRSSLPAFLNLHVCTTKAAGLHLQEFFDRSEDQGGQRRA

SEQ ID NO: 13987 - protein, 212 aa, Chlorella protothecoides
  MOD_RES (194)..(196): Any amino acid
MLAMGTRPVRSIKPQALGCGQTTLCSREVISEWASQAEVIHSVSVGMDTRVCIACPPIAPPPVHALLAQRLTSSFPPPSPLQRVKLMNQLLVGIRVLKMYAWEAAQEAAVRWAGIMEVRKDELWQLRKAIPYRAAMQCLLFSAPALAMVACFSAYGATSPDGFTPAAIFTSIALSITEYEQRSGPQDFSQSPTXXXYCRGDAVAVDSALHGS

SEQ ID NO: 13988 - protein, 300 aa, Chlorella protothecoides
MERRVESSESATGWPIQREREREAEVSGAPGSVPIRRRPAFPLPPPAPNNHPPDHLGDVVGDVVDDVHVQVVGRGVKHLGKGLAAQEGHGGAVDPGEVGGAGHGGQVVLALLGGDARAGQLAVVDRDAVARHGALHGHQRVGGHLVAQPARPGVDHDADLAHGVDAHLARRRAVEHGVHHLDLRVVVARAQRAHLGQAALLGAGGYPGRVRAQHAPCLLAVLLVLRPCVPLSQAPVHAQLQRPRQVAGGGGDDALGTHAHGDVVEQGLRQLLLHAQHVLLAQVGAQQAHSAAGFRGFGGG

SEQ ID NO: 13989 - protein, 245 aa, Chlorella protothecoides
MSHPSPCSLPLRAPDAWPDKGALQYTDVWMRYRAELGPVLKGVTFFVAPGEKVGIVGRTGSGKSSLIVSLFRLGEPYQGSIALDGIDLLSLGLNDVRSRIAVIPQLFTPSRTSPISPPQDPVLFSGSVRANLDPYDRYTDAEVWEALTHVAMRGPVAALPEGLSARVAEGGDNFSVGQRQLFCVARALLREPQVLVADEATASVDSETDTLIQQTIRREFRHCTVLTIAHRINTILDATKVGWGL

SEQ ID NO: 13990 - protein, 263 aa, Chlorella protothecoides
MGKSSLVQAILGEMDKETGHVRPGTGLDTNLLATPLYRNQACCLSQDLETLPGGADTEIGEKGINLSGGQKQRVSLARAMYQDADVYIMDDPLSAVDVHVGRHIFENLITGALKGKTRLLVTNQLQYCHHADQIIVVDEGQVVVQGTYETCMAHPTFAGLVREHAAEAGADEEAPEPAPFAKKGSGELVMRAVSRSEVALQEVLEEVEGTPEDAIDGPPHGQATKPAVTGSMLVRPSKGSSSSATKKHDVKVMVAGWDGRRGA

SEQ ID NO: 13991 - protein, 144 aa, Chlorella protothecoides
MVDGRMKSLLVHRKGATRAFPPHHPLIPVDYQLTGQPVLIGGTMGTASYVLTGTDKGMAETWGSTCHGAGRARSRNAARNKLDYQQVLDSLKTKGIAIRVASPKLVMEEAPESYKDVDDVIETCHQAGISKKTVKLRPIAVIKG

SEQ ID NO: 13992 - protein, 119 aa, Chlorella protothecoides
MSKAYLPVSIDAEFKLPSDISAFLPHTNLLSIFCAAQDTGDMDFMLSMSLSQLGTCVMNLLGTIIFIAVIQPWILVGIAPLTIVYYFIQKFYRWGCSKGLRRFIERFGLMTEFEFTLEE

SEQ ID NO: 13993 - protein, 92 aa, Chlorella protothecoides
MRVPGIFYVNGALRSILDDELRAYCDRGPAGGFLPAVKQIANVAALPGIVRHSIAMPDVHSGYGFSIGNVAAFDMSDPEAVVSPGGVGFDIK

SEQ ID NO: 13994 - protein, 206 aa, Chlorella protothecoides
MFQDLRPHLAQLLRARRGGVVAALLAGARRLGTLEADAAAATWAAAGALGGEHAGPVPALLSLDRPVPLARLGPSAGTRGKSGLSPLGTALLIQLLQLPVEASGQWADALAALPPAQLRLVAGDAGGCRVVETYLRAVQKSGKKVKAMLAALRGGWAFAAQGGSGAKFVQTCFDLAVRRGEERRGGGWVETDAEGGVGCGVSIPHC

SEQ ID NO: 13995 - protein, 1338 aa, Chlorella protothecoides
  MOD_RES (287)..(290): Any amino acid
  MOD_RES (317)..(320): Any amino acid
  MOD_RES (934)..(938): Any amino acid
MEPASTQTASDPRQGTPSCTCNQTPPNSTRHATHRQPIPDAGEEVFLEVDVSLGRQLDRGLLGGTLLGAGLSSHTCKPRVSGHSCTVQGRGGSGVRRGCWSRHQQWLPAPYSVHRGIVGDYLSSLKEVALPVMYGTPWRMHLLKSKPQPDRNSREEAWEGECTCQVSSPALVKPSCPATCRDPSSRACFFHSSSPFNQPHACDRKRRPVRLGAKAARPIWMSPNFCALAATCFRGIGCGAQDGHLIGRNGAQAGPARFVQGVGSQASQQPGRACKPAAAMHSPTTPXXXXLASTPALEWSDGAIQGALVSSILPPPXXXXQRPVSGASDAMLSGTGAQDGHLIGRNCVQAGPARFVQVDGSQASQQPGRACKPAAAMHLPTTPSSIPSPHPTYILIAGLHVVQVPWLGFVVKQASHLTVHSNKGGMVDGITDGGHELLQIMPCHLKSKNVGKYSDIGNRDHSSLPPCWRNQKAGNALISLAKVLSESPVRPRRRQGSSAAPLARSSGETHPSTLRSSHCTPGSASVQRPGTSNRDWARDERSGPESRGCQALIQRVRDLRLHAEVPMSRGNDRCILMATTPQTNPAQPHAAMRPLACAGVPVKATLPPRIIDTRSAQSSSSMRCVIQSAAPRPPPASTAARTQSRTPRWSPTSRNVVSSSRSRTAACSASAPAMATRCFCPPDRLDTGRACRPSNPTAARAEAVSLSTASCVRAQAAGEQPWLASFQHPSTPDLHPSSAHVPAQPKGHIGAHAGHDHLVVWVLEDKGVGRGQGNGARVGLQQAGQGSDQGGLAAPIGAQEHVQGAALDLQRQVVQHLQRACEWKLRELEGAGKGRAGGAYVLQDHVRVRAMDLAAPWPTGPLAHRPMRRFLWPPGPPAHEAVPLGEKVHNSYLGIGRLPRSCAKQSPLPAPCFLNRPTFLLPDSSDSVKLRFLXXXXXSVAHELWGRTHPSVGCGACLDHGPGTPPAIRSSRVGTAMSAFHDAEWSPNLHEVRNMSSQGPAVPCHTLSSPISGCESRIEEFRHFYHDCISIGCSMATSQDEVTVDLALEARCDLGESPVWDGKTNTLYFVVSLSSCRDCPSVRCQCHRLAPGVSWISHGAERASGTQCGDDDVPCVAVRRGSQRGHQASQPCVLLTSAFDPHANISSLQSPHQLQDINGRTIHGFQPETGEHFTIKADEPTGTIVPTNDPTKILVATQRDILVVDVPGRKVTKQAIATTPEEHGTGAGFELVDALVLACLLGWFRSHRYLLADTMHCWGISAGLGWTLQQAACYLFQLCLWFPFSAHASHAHTTNPPCRGLQVQRRKGVALRDPPDRPHEQQVEERRAWQAVPTRPRL

SEQ ID NO: 13996 - protein, 359 aa, Chlorella protothecoides
  MOD_RES (126)..(129): Any amino acid
  MOD_RES (325)..(328): Any amino acid
MSASPHLHHDVQSDTEEALLLPSSNSFQRAVQHQELRRPQFGAPDPPGFHVEVVKGPSGYNQLRLVKADPEVAAAARAAATSKAQADIHAAAGQRRWREPECRPSSASPLRPAHTLPCTHRLHGGXXXXSFLALPEWDHGNSSFICQRGPECRPSSAFPFALHTPSHAHTGFTAVLEMLRGAGKPVVGHNAFFDLAFILSSFATQLPPSLRAFKELVRAWFPAGFWDTKHLACQLQAAQPAAAPEDTSLGALYADLEARAAGGVASDPGEGGLIQTAPLPTVGHSVTFDRYDVRWERGVGVLFLGGEGCQEGCDMVMMKQLSGDXXXXEDCKEGCDMVMMKQLSGDAWQVGPDKFTLHK

SEQ ID NO: 13997 - protein, 154 aa, Chlorella protothecoides
MQAATEAESPRAGADPLGLRELARPRYRRPLAIGAGLMLFQQVTGQPSVLYYAASIFQAAGFQSSGQATGVSLGLGLFKLVMTGVAVATVDRLGRRPLLLWGVSGLVGALLCLALASGGALPIDPGLVAWTNLAALLVYVGCYQVCGSGVGPGV

SEQ ID NO: 13998 - protein, 230 aa, Chlorella protothecoides
MLLGANGCGKSTLVRALAGLLQPDSGTISLATPHAFVFQNPDHQVVMPSVGADVAFGLGRHVCTGGVEVWGTRVLEGGQPWLFSCCLRPSVPSCQSSPLGKYPYLTHDAVDRLTASALAAVGLEGLQARPVSSLSGGQKQRVAIAGALAEQAAVLLLDELTTFLDVGDQRGVLDCVRAAVDAGGGRGAALWITHRMEELDWADRVSIIRGGRVAFTGTPAQARGRMAAWG

SEQ ID NO: 13999 - protein, 643 aa, Chlorella protothecoides
  MOD_RES (445)..(448): Any amino acid
MPHNMDPTCRHFSRLCALSQPDCRALRPLAPPYAPSPTQSVDPDGPSPSLLSPPRSMHVGCVCVSSPARARSVMLAAYLKSPPLRTVPTSGNRTRLPSGGECAQGGAWLHPGGAAVSGRGPFHATSCPRALGASLGLYHLIHKAMCCIQRDPKPWRHSVTCPLQHPPTLSTLPPSPGAQLMSVINKDENKTFGATFRTPVDDSKGTPHILEHSVLCGSDKYPIKEPFVELMKGSLNTFLNAFTYPDRTCYPVASANLRDFYNLVDVYLDSVLHPNCVSDPQIFAQEGWHYELEGEAEPLTLKGVVFNEMKGVYSSPDSVNARVTQAALHPDSTYAKDSGGDPEAIPTLTFDGFKDFYARYYHPSNARFWFYGDDEPEERLRLLAAALDGFEARQVDSVVRPQPLLAQPRVVTERYAAGAVEEGGEPKTFVSLNWLLAEDQLDLEXXXXGGGRRAQDFRLPQLVAGGGPAGPGDGAGAGLPELHAAGHAGGAAAQGAERQRAGGEPDRGRDGGRDAAARLLRGPQGRGRGRRGGRGGAHPGDAGGAGARGLQRHLHRGFAEHHRVRAARKQHGPLPARPLPHAAQHGHLDLRPRPLPAPQVGGRPGQVQGPHRGRQRRLWWGIGVGGWCGARWMGGSGVHWVAG

SEQ ID NO: 14000 - protein, 330 aa, Chlorella protothecoides
MSALLGRSGNTSPGPPPGGAPAPPARPSIATMSDEVVDSNPYSRLMALQRMGIVTNYQAIRQKTVAVVGMGGVGSVAAEMLTRCGVGRLLMYDYDTVELANMNRLFFRPDQAGMTKTDAAAATLTGINPDVALEAFTMNITTLAGFEAFKRSLSDGAGRSRVDLVLSCVDNYEARMTINQPGVGPHPIITVMGIQPGSAPHDTAAFHPDHMAPTPTPFSTPPRLTQVCLELSQAWMESGVSEDAVSGHIQTILPGTTACFACVPPLVVASGIDERTLKREGVCAASLPTTMGVCGWKGGQARLGVTAWLCVSHRREGGWGRASRPWAPQL

SEQ ID NO: 14001 - protein, 459 aa, Chlorella protothecoides
  MOD_RES (147)..(150): Any amino acid
  MOD_RES (372)..(375): Any amino acid
MGWSYALVSIIASLVVNLNVEPPSEDTSAFVGEAGWRGGRCTGFRSGRLPDLRKRCLSTPRRHSSCRVMNDTLSSAETFQLLGLLDVLNAAVGLVASAPLTAFLQWAGRSNVLFGVLPLAPPEVSKSPIVTVLFAVWALADIIRFAXXXXQGPDAQGSKARGGIRGALRASGGHQYQDISGPRTDPILAGFQVPNRHCTLCCLGPGRHHPICLLRLCHHGKVCPHTGMAQARSRPTHGMPAGTWVFPSTSRLVLQLNEATIWRNPFLPPPQASSRPTHGMPVGTWVSPSTSRLVLQLNEAAVWRNPFLSRPQVLCLHPPVPHWNAWCGDQRWAGEKRACPPCRIHAHMRGLLRQLPLGESARMPGVEISAGXXXXMMHACVSGLRPRLGGSGVGTPHLPETHTPPWHPAGAPPNLHSNFLEAVQFLAATAQEEARWQLEEERCLMWGGRSSSARVGEIT

SEQ ID NO: 14002 - protein, 563 aa, Chlorella protothecoides
  MOD_RES (53)..(56): Any amino acid
  MOD_RES (245)..(247): Any amino acid
MGPGVPVDAGSHHQAVESEPLTSHGRLKHLQVTSRGNRPGALATTPVNRVSHXXXXNAGSYHQAVESEPYTSHGRLKHLQETSRGNRPGALATTPVNRVSHREAAGDGVPGLVGHIPMSLVHGAYHTPLMALSPGMGGHCRSVRMERRVSPSAVLQSPPAPAKTRPRPPSPRKMRMPTEPSDLVHFESTLEHRAWVYGTMGLLMGSVGIAGTHTDSPGEVLALLASCVASYYAAVEGNFPSFIPXXXFRLGCGALGPGQLWRRRHALLRQPDRGVPRAPQRALDHHAASLCQQCAQGVQAGDRTSPGLACRRPLHPILAHHLWRQPAAPAVPEPADARLGAQKAQPAAGCRPGPAGDDDDGGVVGQGILWSLWKGTGALARQVAGGGQQPPPRPHLVSAVPYAGVRAEVPAMTFTLPFPPSQDAGVIVSCKVHGAHHRPPFEGNYCIVSGVWNPILDGDGSGEGEGLVPQHVVTAGWAVAWRCIGAWDWSWAWPVCRHATHHEDSSWMACPSYQLKRVPACLAADQGFFRRLERIVQAATGVKPRCWTDPEGFAGTPEGDQDT

SEQ ID NO: 14003 - protein, 105 aa, Chlorella protothecoides
MGWSGQSEGSVGDRDRCAGPGRESLPAAQDLQEWHPFEKAMVSMHPPPPLDRFHRHVASGPTIRAPAPFAHAVDSIVKSEDHDVLLEVYAPWCGHCKVRVRVGGA

SEQ ID NO: 14004 - protein, 532 aa, Chlorella protothecoides
  MOD_RES (263)..(266): Any amino acid
  MOD_RES (289)..(292): Any amino acid
MYTHRDRQIGCPISGWVCAALTHDACLLPPRTLHPTWTSPPPPLLQPSVGLHRLEDLVGEEVGGEEADGAACQEHAPGHEPGVGEVEDDGDEAGEVVQGVEQEADGVDGDVGGDGAAAVGQRRDQGQEAEDVVEVALPQAGHCKVELHEDGAKGEQACRDKEDQRVGGPVRGGDVARDLVGAGGPGRDVAARGQCTAAVGQRDADQEPKEDDGEEEAQGDGARRPRVPQEHVEHGEHRHGHAGEEAGHAPAHLCTWGVGELGXXXXSGMEGARRKPGPTRPPAVIHLLXXXXKGEGGGEGLCRVEGDKLRWGWGGGFRECIVTSTTRPSPHRGDPPSHPPTHAHLVPALIGAVGHAPEPDGRRARRDGEQEVHGQRGGEQRATRGGGQEAQRGEEQGHPRAGQDLHPRPHLHRQGQSVGGRAEDVAAHHLPPRLLRLGRGRAGAGRPAVHQQGLVVRQVAADGAQRDQGHDARHDHHHHERVEDGEPVHAPAGHAQVRVPTRGPGDVARVPVDVIGVHDAGAWAGQEGGDVR

SEQ ID NO: 14005 - protein, 170 aa, Chlorella protothecoides
MPGGRVHWFSILNSLMVVVVMSCIVALITLRTIRRDLAHYEALLVDGGAAGPGAPPPEAEESGWKMVGGDVFRAPPDTLSLAVQVGSGVQILASAGVTLLFASLGFLSPAARGSLLTAALAMYLLLSVAAGAAAVWLWGVANRTYEGWHKVRVGGWMGGGVPTMRTGSRG

SEQ ID NO: 14006 - protein, 211 aa, Chlorella protothecoides
MFLWYTGSAGTIPLGFFFSIIFLWLLVSIPLAYGGGALAARRDIAPWPSRTNQIPRHIPAPHWASHPLVLFVAAGLLPFGTIFVELYFAMTSLWQGYFYYIFGFLALVAALTLIITIEVSIVCTYVQLCAEDYLWWWRSYHRGGSVAAYVAIYSVGFLFNTLHNLSGFVPVVLYLAYTGLMAWCMFLASGTIGFLSSYLFTYKIFESVKAD

SEQ ID NO: 14007 - protein, 191 aa, Chlorella protothecoides
  MOD_RES (179)..(182): Any amino acid
GGGLGGGPLGEGWTGSWLGVCGAWHGVSTFPVGSCPSMHRSHSQCPHQAPGNSQNLPQPCRGPHTFYLKQSGNVDRWGGALVNLVHYQDAAGLTLAVLQHRGPDGSPPRGETFVACDDEPITLQVAQGVIPLEILSDLPQCGTRITDSPRCTPVPLMGPTIPRTPHPPPSHTPLRASAXXXXGGASSGDLT

SEQ ID NO: 14008 - protein, 320 aa, Chlorella protothecoides
  MOD_RES (185)..(248): Any amino acid
MIRAAPRTAAWPRSLPSLSAPPRFAHRVSTRAMTFFLDTFAKRQWEDPDHAGSRLTWDQADFVARVERAHAEGAQLRDGYAPFCKHLFIPNFTDAAVGAERLTPDNVQSLRSGYLKRRPEELAVLSRWLPRSAVPPRTAKHLDIILYSREQLVKEHAALPHVSAGDAEKALPDAPWGIISIKAQXXXXXXXXXXXXXXXXXXXXXXXXXXXXXXXXXXXXXXXXXXXXXXXXXXXXXXXXXXXXXXXXIPIMHSAHHHPEERFGSGGRRKWRPTGQRSIRGGCRVLGRSCDHPMMPRLPLGRHAEICESPPAALKQAKPS

SEQ ID NO: 14009 - protein, 419 aa, Chlorella protothecoides
  MOD_RES (8)..(11): Any amino acid
MVGSSHFXXXXEGSCVPVSCTVGTITAVKMGMQPSHSRPLGDSWASARTETDAASCIRSQDPTGVFDKVGSNEDPLHVTSRCRAGEGRRGMRSAERPLMLPPDTLRDDFLHTKSCTLLTDVLLMSIESCPGTSVTLNSRDGAALGRTPGRDLRAVHHQSPSRGTRVRGTDVWWLCGSAGAASLASMPPVNPNPPLATHTPVWACSCTAASPSCPKQTGPPRCACKVRPLPRPRSVTSALALPCMPLPQDNIRAKDPTLSSLGLKEFCALIFDACPGLEPYRGSLDAIYSAFNDYKRAVPVRGVIMLDPTLRCCLVVRGWQEGASWGFPRGKLSKGESDLDCAAREVLEETGLDLRGRLSEQDCIARRSGAQDIRLYIVAGVDMDTQFAPQAKFEIGAYRWLPVEALPRSYDAERTVGGE

SEQ ID NO: 14010 - protein, 388 aa, Chlorella protothecoides
  MOD_RES (67)..(70): Any amino acid
  MOD_RES (98)..(101): Any amino acid
  MOD_RES (157)..(160): Any amino acid
MPILTAVMVPTAQETGTQEPSPAGAVPGDSSYVCICLSAASRTAQWAGGSAARHAWQPCSASCMPHXXXXKMRTPYHGVPPQGMLVLVVLLVATAGAXXXXPQVGRRSGQEGLQHGAHANPAAHPACRTTLEAPALRPQAGPRPFTRRRAAGHRGLXXXXAPALRPLAGPRPHTCRRAAGHRGLGAGWVVLWVVPRLLTASGFTVAVQRRPSQPPFPPPPPPLMQSGLVRHILASNATELQEDILNTTGRLINAKYKQLLAYSLCLRDFRLQHRWMGEAGPQGDWGGGTWSCWPPDTLVILVGAHVRGSPPDPAGSTCAPIASGDPSAPWTGPRDGPPPALLLMLLAGRRQRGPGSALLVRHRAWFIPFKAHVRSPSHHTIPAPLHPA

SEQ ID NO: 14011 - protein, 379 aa, Chlorella protothecoides
  MOD_RES (377)..(379): Any amino acid
MRPHCIWRSLGSPDWSTGRPTTCTPAHAPCREEAQGPWVRTPAFIDADEYLTVREANATLVSILADYEAYGGVGVNWRMYGAGGRLERPRAPAPDAYHSCYPVGEPENVHIKTVANTAYVARAGGAHHAEYRRGYYAVTTDRRRVLGPKSAAPVYDRLVLRHYVSKSLWDYSQKILRGSGMSRVKTMPYFHHVQIRAWQDCRRAAAWQDGGPEQVAPATMLRAFPLDAEGNALSWEAALATSRAAGGARGEEAVRVGTGHIPDVAGTGAGAVAASAETGGAATGGGAMESAGTGGIAAEGTVAGGAVTGGAVVKSAVAGGAAAEGATIGGAAAESALTEGVVADRTTAAEVSTTATSAAGTSAGGATAVPAGPGAAXXX

SEQ ID NO: 14012 - protein, 584 aa, Chlorella protothecoides
MAGLSCALPARPRVCPSFTASAASSSRISGHSTPHLGKAPCLLLPGRITRARPAFVTGCPAPRLRFTTTASLSPPAGHVSTAWGRREWRLPCEAKHMVTGWGVGSGRPVFRAPAPPGTTSRIGAVRELTPLSFPRVQERQGSPSTSGASPLPTCLAAPTTGMARGLGSSSGGATLERSKLSLKQRVTQTAPKLDDGMGGGGLGKGVFNGGGGGDDGGDDDDYSGGFGEGDDGGGDDGFFRKVLSELYDARALAAVLQEWYRGVGDLPFVLRQAVQMGLVSSASLVRFMAMDVRPGVTRALTRALPPTVSREVVGRLMADPAFMQKLALEQAITIASSLAYEARTRGDAFLSELDLVAANTLSLAAANAALVYLVAPTRAAPAPARHAWRNALARLPNNVFDAATPMRAYTPGARAAALGVKCAQLCGVGLVAGGAQAALGRALCALRRARDPTYAPSVPVPALGKSALGAAAAMGVFANARYQVIAGVDRYLFDHAAYLWSYLAASGAFRALSTHLGDQTRLYLQGMPLERPAPAPGSTSEREAAARELAKALKQQVAARQAAPAPPRRRKRPAGFEMGIGAPA

SEQ ID NO: 14013 - protein, 590 aa, Chlorella protothecoides
MGRRWVRGPYTPALPVTNPPTPPASREYNSKTLLKVHAARLGGLDLPIRVAQVKADTDFGALVTAHPWLNTTPLVVKPDCLFGKRGKHDLVGLKLDLAGAEDFIAQRMGKVINMGTVSGPIDCFIIEPFVPHDAEYYLCIQSTRAGTDLSFSEAGGVEIEEHWDQVRSVSLAVGEAVTGEALAPLLATLPLELRPGMEAFLATAHAVFTDLDFTLMEMNPFTLGPDGAPFPLDMRGELDDTAAFRSAKKWGDLEFPLPFGRRLGPAEAAVARMDEGTGASLKLSVLNPRGRVWTMVAGGGASVIYADTVGDLGAADELGNYAEYSGGPNAAETHAYALRLLDCATAGPDGRARALIVGGGIANFTDVAATFKGIIQVSWCVGGGGSLSGGLRRGSVQGQGRDHWRGSDAMNPEVARCIPDVREQATDLESRPAQTTSGHPWPMHSLTRRCTPRSCAASLTSAGKRRTWNRGHSQTTSGHPCPTHSLTRRCTPVSGAKRSQHLPPTPCTHPPRLRQAIRERADAVKAARLKLFVRRGGPNYRAGLDAMRALGSEIGIDIEVYGPEASMTGICKLAIDHLKVSDARDAKAAQ

SEQ ID NO: 14014 - protein, 80 aa, Chlorella protothecoides
MMAAQIFEAARKDLPDFEAEAAAGNFSKLKAWLNKNIHQVEVGSLYPSADELLEKVTGSPLDPSILLEHLKSKYSELYGL

SEQ ID NO: 14015 - protein, 306 aa, Chlorella protothecoides
MATAVTPGEVAIAPSSKAFTALSEKLKEIQAFSGISGLLGWDEMVMMPAGAAGSRGAQKSALAGLLHERKSDPAIGELLEQLQREEGQGADAFRAAAVREAAREYRKVTAVTKDLAKREAEHETEAYQARQASNFSLFAPALEKWVALRRERAALIDPGKPVYDVLLDDYQPGLTSARLDSIFDQPPPACTSGPLRAAPVAQGHVMPVHQSRPLQHLWTPLVLACALRTISRSPPPQPQVKAGLVPLLADLRARGTPPDTAWLKGEFDTDAQAALCREIALTLGFDLEKGRLDVSVHPFTGGGLER

SEQ ID NO: 14016 - protein, 149 aa, Chlorella protothecoides
MLCSTLIQHAHTLFVDHRKELIHFGWWARGGEAVEGGGCKEAWWWTTQWSGEHRLGSHECTGWMGMWALKFDNVAKPSAFLFLAHFLRVFPTPEKIMLQVYVALARMTQQESAARDVVRQAVDTLLPIFNAGRAPGQEPETPPSGDASL

SEQ ID NO: 14017 - protein, 272 aa, Chlorella protothecoides
MSCAGVPPQLLEKTAQIVWPSNTPALALLAPADQLRPQHCGATATTAAPAPRPGAERAALVRSLVETVIRELVSSKSNDAVRAGAAECLGVLAQAQGSTVSEVLGSMMDRLAGISDRRLLPLRAINAQTSYAHSIAFVIEHCPEQLPLTQEVVSFLADACTIMETDMAKGGNEPSEAGEHAGCWRVWRFDGMAAEAANAQSQAAHVPAGRPSPTPTTPTLQVTARVTARVTVRGQPPRAEVVGKLQVACVEVLVAALGWRAFRWAGQGLGGV

SEQ ID NO: 14018 - protein, 68 aa, Chlorella protothecoides
MSAGDPPCEVTLSTPSQDLLSGQFNVTLGEKITEHLKKWVDAEKWISPQPPQPGERADWRHVARAVMR

SEQ ID NO: 14019 - protein, 253 aa, Chlorella protothecoides
  MOD_RES (128)..(131): Any amino acid
MPRALGVGQRVTARHPATRQLHDGAVLTVAPTCVRVQFDRRELGVELVRDTDVAPADPAENLPPAYATQPPERRVLNGRLIVRGVCVHLGGGGGGGVWDWANEGLNPFLTLWVVQSPNRPHRSTDIPXXXXGGGGVWDWAKQGLNTFPTLWVVQSPNRPHRSTDIPISPIRIHTHTHTHTHTLPPPPPSAGKTVNVEGRAPGAAPSAAPSVSEASNLAPAPAVPGTKPPYYVLGATPQSGPGLPAAALCPAPG

SEQ ID NO: 14020 - protein, 136 aa, Chlorella protothecoides
MAIIATPPPPQVKQYCERQWTKILSGRVSIQDFVFAKEVRLGTYSARHGIIPPAALIATRAMSMDPRWVRRKFMPENVGRDYIDWDKGCFQEECIVIGLSSRQGHWEALARSLLWVFSHEEACVLHPHAGMPAAGE

SEQ ID NO: 14021 - protein, 397 aa, Chlorella protothecoides
MDADWEWSFAPIPESSLGPPRLESSPLRFAPPRTPRQVFCREAEIARLMQVLARRRKSCPVLLGEAGVGKTAIVEGLARCIATGSGGLAGQPLPLFLKGMRVLSLDLARLMAGTRERGELEARLTGLVAEAGAAPDVILFVDEIHQLVGGGAALAGRGGMGGGGGPDLAALFKPALARGRLRCVGATTEREFRRHFERDPALERGGAAPSGVLAPARRSRRGAWPGSPLTVLPALHPAGPNAKRPPRRRFQPVWVEAPDAAATLGMLRGSRPAYEAHHRCLYTDASLVAAVALAGRHLPARPFPDSALDVLDEAGSLVRVLKHRARRARCEEETEARAAAHAGYLEVLATARDCAAAGHYEEAGLLARRRGELEARLGGEARRDPVLPRVTPEHVAR

SEQ ID NO: 14022 - protein, 121 aa, Chlorella protothecoides
MRAGASAGCAWDPDTCEWQGTLVSDLAAKRRMRSSYVTPAPACDPGHKRCPSPNTTCTEVKLNIYTLEAVSAAVLQLRVPHIPQHQLHAWYQAGPGGEAGCDEVVELPWHRHVGILDECSA

SEQ ID NO: 14023 - protein, 120 aa, Chlorella protothecoides
MFVVVPGKSREAAFKIGAEIQRVVTAANPSPILLKLEKVYHPCVLLTKKRYVGFAYESHSQATPAFDAKGIETVRRDTCPAVAKMMERSLRLLFTTKDLSQVVCCACYAADCGQGAMVLS

SEQ ID NO: 14024 - protein, 158 aa, Chlorella protothecoides
MSVPPSAPLTRPFSPPPEPPPAQVKGAMKRLPPAAKVLLRCLNARQFGLKLIANVTYGYTSAGFSGRMPMAEIADAIVSLARATLENAIDVINKHPDWGARVVYGDTGMDSWACKHCGMMWRRGRHGGGVNAVGPMLRAFPLPRVVKYDVEHVLGIPL

SEQ ID NO: 14025 - protein, 436 aa, Chlorella protothecoides
MPSVAAASGASTHTGWKRLRGGRFAFGPAGWRAGNTGRVALEVAPELALRGGPDATQPPPRQRRLEERGEVRAAAAAHAAAACQRRAAAHQLVDLVHEQDDVGRGASLGHQPREPRLQLAALTCAGHEAGQVQAQHAHALQKQGQGLACQAAAPRGDAARQPLHDGRLAHTGLAQEHRAALAAPGQHLHQPGNLGLAAEHLSGGSGGGESERRGFETRRTKGGLWDWGERPFPVGAGRFRPRKHASDAVSTANQSAPRRTHRIDAASQGGGGQVAAVRVQHLAPLARAGVLGRWPRRGAASARRGHGRLHTAPSTLRPLLHGLVPQAPQRLGHHAPWVQAQRAQQAQRGVVPATHHAQHQVVRGHEGHAHALRLLHRCDGEDPPGVPGEVKLVGGESPAGSAVHALHRGLGILQLQWGGRGARLGRAGGLGVCCHA

SEQ ID NO: 14026 - protein, 236 aa, Chlorella protothecoides
MLVGVVEGGQWTSFRSQAGEDQKVLWHVAPASRAPALLDTMRVSPPPSHTFHDTHPTPGLAPDDDLFFDAAEDELRTVRSGELSVRRSASLASDAPARELAEFTFTIARPGTAGYAGVDTCLDVTLGTLRFYCNRPTLAALMSAGADFAAAAAGGGDGAGGDQEEPEVADAKELGAPSGVELAQAVDQSLAEKLEGSPVRRGGWKSWRMSWPWNVFWGGGAQWRSKACTARPHTAI

SEQ ID NO: 14027 - protein, 373 aa, Chlorella protothecoides
  MOD_RES (291)..(294): Any amino acid
MNIKCRASGLTPSAVVLVATVRALKMHGGGPAVTAGRPLAPAYTSEDVALTRAGCANLARHVANAAAYGLPVLVAINRFATDTDAELEAVREEALAAGARAAVVCRHHALGGEGAVDLAQAVVEACAAPRPEFRFLYPPEMPIEVGRVCLGGVDGGELFQRVATCISRAVSSAACCIGRAREQDKWRATSLTLSSEDACVPAHGRVIPPIPVPPPAQEKIRTIAVKTYGAASVSFTPEALASIARFTEQGFGNLPVCMAKTQYSFRWGRGRTDKGGERRAHSRCALAHGGXXXXKDEKGGRKGGHTADVRWRMEACAMTGRRPVLPARMQLGSSLDRSRRAHLSLPIRPLPPLPATTLPPRGPLPDSTCGCGR

SEQ ID NO: 14028 - protein, 101 aa, Chlorella protothecoides
MTRRGTFHPTPPLAKPIPTPPAPPQTLEATPVLVHAGPFANIAHGNSSVIADRLALKLVGPEGYVVTEVRVGMVGCSRGGGREFEPRVQRQKLQVCTVSGA

SEQ ID NO: 14029 - protein, 171 aa, Chlorella protothecoides
MAAAIEARAFHEATQSDAALFGRLCPAGRDGARRFAPIMRRRLAKLGLEGAADPDALSEEDRRRFARLDIDPATITWRRVLDTNDRFLRGVTLGRGPKEAGHERESGFDIAVASEIMAVLALAGSLPDFRERLGAMVFASSKAGCDSLVGSGDALGQRGFGRLSEQACLSP

SEQ ID NO: 14030 - protein, 339 aa, Chlorella protothecoides
MPSLKLCRPSAIPQHSLPLTPSQAAEHVGFPAVIKPIFGAASIGVVRVDNLAGLRAKHAEVCRQMSSARVVDGALLEGDGEEEGGNAGGWIQTTLMMEEYMDGPEVDVDVVMSEGQAVYGARGVAVGVVGGEDLALSVQCPPQPASWPVGGQPLSRPTPDPRPLPSCAEPQVDYDLNPYNPRGGREVVPTSLKSSSIKSNFLTEAVIGSLPRGLSHSEREFIVANTPLSPSLNLLSSLPRDQVSARSVEGRTLRRHVLRGAVIVFITAGYSGGRWWCWWWANSKSDSIAWAKELGVRSVLIDGPDSWSQVGWAEWFHDSPGTSGGHGRPGMDLDEDAAA

SEQ ID NO: 14031 - protein, 390 aa, Chlorella protothecoides
MTDADSVFDRALAAIEKVKKVSILDVARVGEVLTAWHGVEDFGELDGVVSFSEMAQPLVARLIEKLGLPGNSSAAVDSARDKHATRRCMSEAGLPTPRNFLITREDELDAASQLVGYPAVIKPIHGAASLGVVRVDDHEALLRAYARVRREMGSVRVHSGIVEQMASDDEGEGNFTTTLMMEEYLDGPEVDVDVVFSEGQAVYGAPYFNETGSNSPSILPSAQQRELLELGVASVKALGFDMGVFHVECKYTSRGARLIEVNCRMGGGPVRNMNLLVWGVDLVEEALLAAAGIPSRPNVASRPLRCLGEYLVNAPKTGVLGDLGFLREFAERKGVLLAKPCVAPGSKVVCVADGMPTWLVELQVEADTPRAAVALAEALSKEITERIPIH

SEQ ID NO: 14032 - protein, 113 aa, Chlorella protothecoides
MEEEGVIERFIPLDMSDSDTVLDRALEAILAAKKAVGGDLDGVLSFSEMAQPLVARLAEKLGLQGPSPEVVDAARDKFATRKCMEAAGLPTPRNILIEKAEDIEKVGEGGKGG

SEQ ID NO: 14033 - protein, 601 aa, Chlorella protothecoides
MNLHTLPSLSCGRTLVAPLGPGHGTLAGLQQRLTRPRPASAAGGHRLGAGAGPALLAAGARAGGRDPGGGGHRFPLPRPDSGRGACGGGRRRAHGRGGRRDLCQHPHCARVCRGGAGAGALRPPCGRGAAGGPGIQQGQGAAGEREPRRHPRLPPRPLRPRRLPGEPGPAAHGHDADGHRLHLQPGVRDAGHAAELHRRADHSRRPPPCAGRAGGAAARPLHGCQPGARRGSGVPYTPPPLSLLTKTISLSPPGAWWEVANAAADACELPGTSNAENRPDDGKWSRATSTSAASGAVDDGTPASGGPTHSSSSSSERGNTNDTGVPTTSPRPAPAPLPTGDVVFKDVWFSYPARPERPVLRGLNLRLPAGRVTALVGHSGAGKSTVGLLIQRLYSVDSGEISLGGVPIQSFSREAWVAGVTAVAQEPRLFSGTVAENIAYGAPEATSLEVERAARAAHAHDFVTGLPLGYDTRVGERGGLLSGGQRQRVALARAFLRDAPILVLDEATSALDAASEAAVQSALRTLTAQRTVLVIAHRLSTVQAADQILVLEEGRVVEAGAHEELLARGGRYAHLVSAQTLVLGAPGRGGAGVPDGTYSGR

SEQ ID NO: 14034 - protein, 293 aa, Chlorella protothecoides
MDRAKQQAGDGTPANAVTRAIPTPASRTTAQPHSLLKGLLLHQVLKQGAGEHGRHEVAGHTHHHGEAGPDQLRPLLAHQTPHVLIVQGASSWGPGAVCALGWGADPTQGGSCCGSQRDSPASRQAHRATCPVCRSGAPSQMLECGLTRYTDNGPCPGGALRARRMPDMNTIVAIYGISSPTPQSLHLEACGADSLYMTSHVCYDHARHCADAAQLREMAADPTLASCCQRDAQEQAVVAKLKASLTLVDRSRHREHLRESVLGCTPGDTRPDRDSLETSDDEELGTWSSVLGV

SEQ ID NO: 14035 - protein, 499 aa, Chlorella protothecoides
  MOD_RES (241)..(244): Any amino acid
  MOD_RES (430)..(433): Any amino acid
MLWSCLEVLYALGTTGGAGHALLHERAAVGCTDHAAGYPPTTPPPFTDSAAGDSWNHLAVRLARTSPDEKGDPDLFGLFSGGKRGLAVPTRSSHGYDFQDTSAAQRAVVVKKVTKAAQGPEADYEGVLLCVRSYGAVPVAFSLKAARNVCPVGFDAGDASPLICSTRQDATEKRYEGCTADGQCLCTGQYAKPVPEVVPGKGFYRFHVAHDDFQVSLAVVEESETPGEHGAKGHGPFPVFXXXXPHPLAGLGFEDCSAPVTDLNATVPGEKNATVVSLEHQHVEPDRWPGSPHPPGSASLTPAPAGTRRNGTGSWRCCWTPGPPPSPGQPRCAPATGTPGSWGACAPPISPCSSTASTARWAARGTGPATPARRSTSGGAPATKGAGQAPPGWLADVVSAWFVPSHCGRWTMSTLHGVMCSVGAWAEAQXXXXTMSTLHGVICSVGARAEAQNSSEAVCRYGGEACSKSRAALEYGDVVQREPAQFEYEYFLMPAITGE

SEQ ID NO: 14036 - protein, 143 aa, Chlorella protothecoides
MPLPRWVGLCRSAHTRVGRSRPCSGWLAGATSHQTHSSSSALEQSPGASDQLLQAGLHVVGTPIGNLQDLSPRALHVLRSVERILCEDTRHTAHLCSYFDVRTPLESLHEHNESAKCAKGGASRLTEKKSMLPEAATHSPDPI

SEQ ID NO: 14037 - protein, 100 aa, Chlorella protothecoides
MGHYAIYACVLAILFSLFSIALAQDACSGHGRLTPSGGCDCDNPWPAPESRGWTGKDCSIPVYGSPADSEDMTDWCRAADQCDQLEPQAWVCFAAQFPWE

SEQ ID NO: 14038 - protein, 135 aa, Chlorella protothecoides
MFAQAGRHASGVLWRPTPIQSPHQPTLQHLRWRAAPTDWARRPVGLARCRRIPLAATAAASLSGVSAPAQGAHSPWTPRRGPLDDQYVWGLVRKQWPQLVRAGLAVMVCVACNLVSPVLSGALFENLVQQQPFEQ

SEQ ID NO: 14039 - protein, 178 aa, Chlorella protothecoides
MEVPGTIARRHRDAWPGARSAASVCNSCTRSSAGLPATVVAFVSPHALRAVLSDMCAVLGPDRRAVLGREMTKLHEQFLRGSLRELEQLHDPAQGARAPRGEYTLVLAPPEVDGAGGPEQGLTDEDVRSALAVAMRAGHTRSSAAASVSQSLRVPKKRSYRLSLEVGNTQPGQGEGQA

SEQ ID NO: 14040 - protein, 35 aa, Chlorella protothecoides
TSREIQTAVRLVLPGELAKHAVSEGTKAVTKFTSA

SEQ ID NO: 14041 - protein, 183 aa, Chlorella protothecoides
ERGGAAGLRAEAEAFAAAAALPTHGALVHVFFAQRSTKRVRGVTDVGLAPRGLRRLAVLGGGLMGSGIATASALAGIEVLLKEINQGFLDAGLARIRANLASGVKRGSLKQAAADAALARVTGTLTYDEFGSVDMVIEAAIEQVELKQRIFADLERVTRPACILATNTSTIDIKVVGAKTRSQ

SEQ ID NO: 14042 - protein, 460 aa, Chlorella protothecoides
  MOD_RES (136)..(138): Any amino acid
  MOD_RES (332)..(335): Any amino acid
  MOD_RES (380)..(383): Any amino acid
MGPRRGTLAAVMRGAPDRCAILVAALRSACHSHTPQVADEKNGAAVFAVLRFSLDGKYLLAVVEGRIYVMDAFEGTVERKVCGVAGSSRLAMRKGAAWAEGTAVQMQAMAVPARARVSSLDPTSRSTTDLTPAEVXXXQCRCRPWQCQTEPGSAAWDPDLVHSNIPEGGTALEACLTADGKYVLSGCADRAVRAWSVADGSVVSEWKGHAGVPTCLKVAKFSQLGEPEPCAAMCGVDTRSQRLSGAPFIIEMPLCEPIPSLCLPVQWSPRKMLVASACAFFSTVTWGQGCHAASRTVRRLGHPPAMGRRAWCASRPCAALLGSSFFASMPPXXXXVAKFSQLGEQEPCAAMCGIDTRSQRLSGAPFIVEMPLCDPIPSLXXXXAQHVVLAHSKCFLLDGDLGTGVPCCLTHRQEARSSASDGEACMTCFQTMCGAPEELILRLNATTKPICTEAALRSRV

SEQ ID NO: 14043 - protein, 505 aa, Chlorella protothecoides
MFSRSALMLRVKTCNSMRVEYSLQCCTSMYAYRRCKQNERPEHFPLPHRHREYYFRVTRILVLCAGFVLNEERCMPWDNAYRATWTTRATLALPRFFETHAILRAACDREAPRTASGVGLTETGCYLTGARALRALFTRSSDGYPPATGPADGVPGPPSHFLVPHHDRQGTRRVSKPTLNRLHVRNSSKAGAGPVSDAHLAHLRNAGHPVPEAPGLQGFVAKLKAAWQIFFPEKPPVLTPKDEGKNRLRMILVADRWDGREDKEWALRECTSIPSMQVLQPMGRRDEMQHLSCLSKRPSSALCGITPDSLTGMRESIVQAVSAYVDIETEEEIEVNLSTDPELGTIYSVAVPVRRVKSRRIGGVDTSEDGKIIVKVRGDSSGGLFVALQALMAWGLGMRSSTLSRRVACPVCFGPLTLTSLPCSGIQRTPTAIPVTSSPLACEVPMLGLKSCGVAATTELSIQQLHTSFSRIHVPHQFVLNAPAEMIFPERMRSFHPQRCTTKSS

SEQ ID NO: 14044 - protein, 789 aa, Chlorella protothecoides
MTRQSRIPLTAGSDACSTDPSPTEQGLHSLLHILLATLSTPSHPTCRVLLKEPKGREVEDGDRFTYNEGYTSRLFRVKINSIQLRESAEESAKTNDQVLQDRQYQVDAAVVRIMKTRRTLSHKLLVNELMVQLKFPIKAVSGEGGAPWARGRGTVQLAQRPASPSLGRGGRDMQQISPPAPTSDLKKRIESLIEREYLERDGRPPWARSSADSLDPTDQHRCSVDLLDLGAWAGALGGAGAGGGAACGGAAGRVQLGDDGAAHALQLLALVGDLLLLGQLVVVQPLDGLVDGGLHGGLVAGLQLLGHRPLLQRVAHGVRVVLQPPVARLHLLGVRLVLALVLLRLLHHALDLLLGQAPLVVGDGDLVLDPRRLVLRADVQDAVGVHVKGDGDLGHAARRGRDARQLELAQQVVVLGARALTLVHLNQHAGLVVRVGGEHLLLLGGDGGVARDQRRHHAACGLQAQGEGDDVQEQQVLHLLMRLAVQDGRLQDRADSDPHPPAHLDGGAVGDGLVGVDALAQLLAVEKVLEQGLDLGDTGGAADQHHLVDLALVHLGVADDLLHRVHALAEQVHVQLLEAGAGDGGVEVDALVQGVDLDGGLGGGGELALGALAGSAQAAQRARVAADVLLVLALELLDEEADQTVVKVLAAQVGVARGGLHLEDALLDRQQGHIKGAAAQVKDEHVLLAGGGVLLVQAVRNGGGGGLVDDAHDVQARNHAGVLGRLALGVVEVGGHGDHRLLHLLVGAHKGLGHLLHLHQHHGGDLLGGKGLGLALVLDCIEGREGGGW

SEQ ID NO: 14045 - protein, 348 aa, Chlorella protothecoides
MRGFRSSLRLSGGDGSVPAGGRRTVTLRAQVSGGPGGCADALLSSRACSLDAVLVLRVARGNDMFLAVGGAYRPSWMGLRPRTLAERGPYPMSKLWQAGEDVGTGSEDGAAGDEGAEAGDEGAEAGDSEAESSGAAHAGAAAAGSGSGPPPERTPGVPLELARLIEALEEEEALGTPGLFMPLAAIREALDRGAAAWPRGVGPCDLAAALLAALAALPEPVLPEGAKALCDVASHTTVRMLGRRACAATAMGVVRGSLSGPRLELFERVLGLLRAALAPRRAERNGLAPAALAVVLAEVMFPPLPREMHAAGGGLGDAAARGLGAAAENLAAIGMRRIRFIQHLLTEE

SEQ ID NO: 14046 - protein, 287 aa, Chlorella protothecoides
MRGPVSARGRGDVRKVVIRPLKRLATGLPSGYEEGAWAQLETAVLAVQSGTPTSTSLEELYHAVEFLCKDGGGAGLYGRLSVLIRAHAAAVVQGLASAPPSAPVFLEQVGSAWRAYTSQLLLTRQIFMYLDCGYLKASANVPGVRSLYELGLSDFGAELAARPALVDRVVRGLVDLVEADRNGAAVDGKLAAGLLQALTLLHLYGPAFQRPLLAATLAYYTAEGTRLAQELDVPAYLLHAERRLAEEEARCEAYLGQQSRDLLMATLKASLLEEHMGEEGRGYCRKE

SEQ ID NO: 14047 - protein, 192 aa, Chlorella protothecoides
MLGPPLKSKGENPGDEAKRHYDHAEILRRGYFGDATTASVARPTLGAATGSLTPDVQRVAGPAARGGHWGPALSHMMATQHVFWMGDLNYRLHGGGAGSTTILKAIAEGELESLLARDQLLHAMRSGAAFAGWQEAPIRFPPTFKFKRGSPRYLGQEGEGSASPGLGTAANLASRAAEEGVASIPPLNEVWG

SEQ ID NO: 14048 - protein, 600 aa, Chlorella protothecoides
MNPINTVFDAKRLIGRKFNDGNIQHDISHWPFKVVSGAGEKPMIQVEYKGETKTFAPEEISSMVLVKMKEVAQSFVGADKEVKKAVVTVPAYFNDSQRQATKDAGVIAGLDVMRIINEPTAAAIAYGLDKKHATTGEQNVLIFDLGGGTFDVSLLTIEEGIFEVKATAGDTHLGGEDFDNRLVSFFVQEFKRKNKKDISGNPRALRRLRTACERAKRQLSSSTQASIEIDSLYEGIDFYSAITRARFEELNMDLFRKCMDPVEKVIRDAKMDKGQIHEVVLVGGSTRIPKVQTLLQDFFNGKELCKSINPDEAVAYGAAVQAAILNGETHEKVQDLLLLDVIPLSLGLETAGGVMTTLIARNTTIPTKKEQVFSTYSDNQPGVLIQVYEGERTRTKDNNLLGKFELTGIPPAPRGVPQITVTFDVDANGILNVSAEDKTTGIKNKITITNDKGRLSKEEIERMVQEAEKYKGEDEAHSKKVEARNGLENYAYSMRNTLKEGSNYAYSMRNTLKEGSVAEKLEASDKAAMEAAIDKAIEWLDHNQLAEEEEISHQREELEGVCSPIISKLYAAGGAPAGGAPAGPGAPEGTGPGPKIEEVD

SEQ ID NO: 14049 - protein, 455 aa, Chlorella protothecoides
MPHSHPHLHTAPQPPCCSGRVEDLSRAFRLSERIDALDGLRAAFKGHVRRVGLARVGDLEREGTLVSDLLTWRSRLESYVATAFARSEAFAQALKEAFEYFINQRQNKPAELIAKYIDGVMRGGVKGLAQDDIDSALDAVLVLFRYIQVFIVLHGSHVWQGGYVVVRQGGGGGGLGRGGGTESEEEDAPAQAWWLEEAECWIALARSPAGLSRGLQADCGDQQRCKLPTHPPTRPHPHPPQGKDVFEAFYKKDLAKRLLLGRSSSIDAEKACISKLKAECGAQFTTKLEGMFKDVELSHDVVAGFRASLAGPGAGQLAVGGAAVQEMGVHVLTLGFWPSYPADECSLPEVLTASQQVCARVGVCRWGQGVLGGGRCRGMRWKVVHGGLALDTTPPHPPAPPSSSPDIQGLLPEKALGAATRLVQLAGHLRLAGQLPRRVQGAVRVALPGDRAHAV

SEQ ID NO: 14050 - protein, 268 aa, Chlorella protothecoides
MSPPSVTHRQRQEVKDLRAVPPGIGVPAWVSGGSVLRWGTVWSTRSDPLPTAPALQPDPWWHPGQAQDQPPRSNSHLGDLPRLVVPPQQGDVGGPARLEQHEQREDLQGVVAAVHKIAHEDVVGGGDLAPRLKQLQQVVQLAMDVAAHLLGSSCLVGMPSRWAEKITRELRGWQTPGHLHHRVLAPPPPCTYTHGGILQPPTALRKPYAKPRRHTDRDGGVHRLHIGLLHQDFLNRVAKRLELLLCKVLGFLNLLQPGVQVFAGRSGG

SEQ ID NO: 14051 - protein, 196 aa, Chlorella protothecoides
MLSQVHLFTLQESTDRINSLDFHRTHDLLVTGGDDDAIRLYDTETGTALQALLSKKYGVKSGADYALRYHDLHSNRYVRYFRGHGAKVTTLCMSPKSDNFLSAAEDKQVRLWDLRQPHCQAMLQTPGLPTVAYDEQGLVFCVGAESGVVKLYDARNYGQGPFAAFTVRAQRGRKSCQGWTAVPGGYAASRRAVAGG

SEQ ID NO: 14052 - protein, 343 aa, Chlorella protothecoides
  MOD_RES (30)..(58): Any amino acid
  MOD_RES (85)..(88): Any amino acid
  MOD_RES (129)..(131): Any amino acid
MPTCKQILFDDPMLSISPCMRRKAETEADXXXXXXXXXXXXXXXXXXXXXXXXXXXXXSDRVEQRGDCRHRPMVLVSLHQPQPRXXXXFMATCEQILFDELMLPISPCLRRKAETEADIIGIQRAHATXXXPSLPPTCFVDPIFHRASSDPHQLAAQACYDPAAAASVFQKLGAAEKKMGGTAMPKFLRTHPLSDERVARIKEVCSGVFSTWCSGCGVALFLHGTWSSAANSGHQCLRLPCHRSCPRPSACMSWRDAAPSEAGQGASSQALAMEAGDDKGGDRAVFALCSAHPPCNPQSLCHHCTLADSTTITAVTRVADCARRHSAAEFKNWWVWECSAMGC

SEQ ID NO: 14053 - protein, 650 aa, Chlorella protothecoides
MHGACYMRLQCHIFCAAIPDWPALPLNELLRRPSPYHPATRTCGTPHPFQPTKAAGLGSARRHVRGLLGYKRGASQRRGSSLVVHAERDFYGILGVSRDADKKTIKSAYRQLARKWHPDVNKEAGAEDKFKDISAAYEVLSDDNKKSVYDRFGEAGLQGGGGRPGGAGFESVRHESGRHCCVCGGVGWGKKGQVTILEPYALVCCSPGQLASPNCHLLVSQASLCAIPHPPPPPPSPPCSNPFDIFESFFGGMGGGNPFSDAFGGGGGRGQARDPREGALAQAGLPTCCPRVVPEWRKVPWPFNYLAAMACSATNSIFCPHPHPLPPSAHDGPGLGCSWTSWRPSSAATRSWTSATWSRAAPALAPGSRPAPPPPPARPAAGRARWCRQCARRWACSSRWPAARPAAGRGRSRRPAAPAAATAACAPRRGSACGCRQELTRAAGCACGAREMQGRGARGGEGGGESFLFFGGGGVRMEILPGPLAHPPGPNHPPRSPLDPSTNRQGWRARGPVRHADRQGAPHAAAGGPDHPLRRARALHRRHPGGVGQRDHGGRGRGPEGAGGDAAGDHPGHGQARRAQAGQGRRARRPPGARPGQHPQDPERRGAAAGGAAGGAQLQGVGQEERGQGGVVWVSPRGSRCGLLATAAAI

SEQ ID NO: 14054 - protein, 325 aa, Chlorella protothecoides
  MOD_RES (321)..(324): Any amino acid
MLHRYPYISNTTAWERVGSHLNCPAQGTAGQAPRPFPYAARRSGRSAVGLGHTLDLVLLLDGVGVGGPLGGIDQLVGQALGDGLDVPERGLARASGDQPDGLVHAAQGGHIHRLAAHHTSGPDAGGILAGAAVDDGLHQHLDGVLVGQQVHDFKGMLHDAHRHLLLSVVTAVHHQGVGQPIGGKKIVKVATSWFAQGRYTRQQLRRLNHAHHPPLHHGALGLAEAALLEAAGRVGRVSVMLGLHRDVVDERQVGDLRPGKAREAAVQKHSVPSARTDGGTAHARRSHKGRAYSYPSPSNHSAASACRSTSPRLDARLPGRXXXXS

SEQ ID NO: 14055 - protein, 604 aa, Chlorella protothecoides
  MOD_RES (128)..(131): Any amino acid
  MOD_RES (223)..(226): Any amino acid
MTTRVGAKVLAQACRPFWRSLVPSSAVGRVEGMQNPGADLGLHSAEHGVWGRHALFHTAPQSLASLPVTIPALGESISDGTVASLLKKAGDTVEEDEPIVSIETDKVTVDVRAPQAGVILAVLRFPHXXXXWQERAEASFSEVGGFEITSAWKQRFPHPSTVQHEQPQGIDHGTHGRVLLKPTASVLPTLFVEEGATVEVGHVVATIDTDKAAQNHLVRPHMXXXXGPYAMDATMGMPSLLCKTTLTLMSLSPAQNHLVRPHMCGTILMPPRIHPVHTAAGAPAKKSTSQDQPETTPKAPAEPSASHAASAGESGWSRTPSIHFPARRTDDGTVISSLPANEAQAALQSEEMGWCLDIRASIFAWFGLSRYSGRGPPLLGMVYQLRASPWPSRQARCLMRNPSHAAPNPEVCDAPPLTLHRTGGRKQQWRDRRQSSPNSPCVSQPPTQAGPVAATEPPPGTGSHGTGRDLPRPSSLQPLGVVHARTPYITSATISAIPCCPSVEGAGVQQERWSEGIGDQSLFVAAWLQFHQQPAPACQLDRVHLQVDRILLVFETANGFPKQVVLRAPTQHLSSAMTMVRGGWGGIGGCGNLGTRRPSVARLH

SEQ ID NO: 14056 - protein, 761 aa, Chlorella protothecoides
  MOD_RES (115)..(118): Any amino acid
  MOD_RES (588)..(591): Any amino acid
MEDLDDPAPGSGGMSECIGLCQTKVCGLLGITGDVWDRFSRSENWWVIGQRIDPWDAVGGHIKRVSMSIIFTMACFTPQVGPAGVPVSTQHSIRHPDTGRQGVERGMTFKTPDQXXXXVLDRMFNYQTSSCLLLTAHPSPIRYQTFKTPDQGKGSARHLCLLKVHAQPLSKATFSSNVSGCIVMLSAPSALDQHASTHGLHVEDPTCLGGHCPKGLLSSPDVSRPWPLAPQVVAMELSRGIQEQLAVLSSRVFIPMLQAQARQALMGAKPCGGTCIPPSAARTAAQALQQYVLKVNAAKPALQPGSFLVIPDLGSAELYDGGPDAPTPASRDLLAALDQAAGAWIGQLREALAAIPVVPSAQRWPRAPAFLAAWAARAESLQGLHDQAAGPGMQRALALLRANASPRLPALERLLAELREACPKAASVARHGAALGPRLAALAGAGVQHLPQTFRPVMLTAILMWQHCPDLRAAPGLMLSLLRHVTNDIAESVRQGTEGTSILVLEGPEAVRRLELCLHVLGTWKSMYLEMAVAPAWHPVRVVMVEKHFKYRQLGSFAQTLSPAKHKNKLCTALSPPYLTTPCSSTQXXXXNTLSTDNWAALLELFHLPSTRTSCAQPFHLHISPPLAAQHSRTPTKGASMWRFPPATIFSGMDELLERAHDVLGPGEELGSQHLISNLYSCIYPAPGPRIDGQSACHPDRVQVCAHHYARGEWQMLQPSFWQPGIPLTVLLTASADYPHQWPEQMPPTHLDAGGRRPPGP

SEQ ID NO: 14057 - protein, 774 aa, Chlorella protothecoides
  MOD_RES (518)..(521): Any amino acid
  MOD_RES (760)..(763): Any amino acid
MLEGLAAVVLASARRLLGVICIHDAGQQCEGGPLLEVTLQCQAGQLFWKPDMHAARSDEWTLMAEARRCTRASQGRQFIEKSMQALVASWLEGFLEVGRAMARPGLEDGEDGGRGCTRSGNLYRLQTYKPFHKTVRGCHSGRHSQRRGMHCLGGCMDAIRAPLEADPQERAAGKHRLQAPQPWSAGQQEYLAADEVLDQAGFLSRFEMKVQQLHALSEQIQGTTLMCASPSTNHAPYPVFSTSPQALPATSTLGWLRVDARLFKQSLLTCAGKLSHAFTSHLQTQKRDGGARVIQLSPGLAPCLPGKYLQTCKQPSPPFPFPPSAAGQVRRRRERLHHIRCHRAERCHRCAWRRLGAALPRPVPVHQAHVATRHRQPLAQRRPGCQPGGLQSTLHPLQPRRQPAGAGQAEAAERQVGRRDGGQGRGVPRLRQPVHPPTTSVRGEQERTVPGRTALRPRGQGRDQGNCSSAGVCRRVRWGPQGGRGLLDWVLLLLWAWWSTQVLIEVHTSLPPAALLAXXXXWAWWSTQIFIEVHASLPPAALLARSGAALSAGVQNQVEAVAREWRSLQKKLLHMKEALAHFISAETQELHRAVIAYRADVEAHRMRFTATAPYAVTAELTLACQCAQGIPGCTCSQVSPALEVLQGLEHDGGPEVRPGLMGVGHSLKARHDLLDLPYEPLASLSACKVGGGCHASRRLQGAEVSCSFVLWDARHKEAVLHQALALILQSEATALRGMWDMIARFLSSHEEWRAQSWTGXXXXAPSSPCPHPSE

SEQ ID NO: 14058 - protein, 725 aa, Chlorella protothecoides
  MOD_RES (73)..(75): Any amino acid
  MOD_RES (282)..(285): Any amino acid
  MOD_RES (461)..(464): Any amino acid
  MOD_RES (632)..(634): Any amino acid
  MOD_RES (690)..(710): Any amino acid
MTSLQGTDGSLSTRHRPPSQSLGRTIHTRSVEIIADHAWDAQELSGFSHGKRCLTYGHTVTTPALTPCAMQVXXXGGFSHGKRCLTYDHTITMPALTPCAMQVDAAFDAREDGNENALKANGDLAGHDVLILVDMWAPHEPQHRHFTQFAIGPPPQELHAKLQAQVSELIARINGKLTPSERQKLITLCTVDVHARDVVQRLIEEKVDSVNAFQWQSQLRYYQSPQSKECMVGPGAVTVYGVTLGVQQDMPRKGQLEGICLYTYVHVYMVCMPMSLARSADXXXXGWSDLGHAAGQATERPAGGRISPQVSICDADIEYGYEYIGNCGCLCITPLTDRCYITLTQAQRLHLGKHAAGGLGQLPGSHDLGTHHGPHHSRPAGGAPAGPAGTGKTETTKDLARALGVQCYVFNCSDQMDYLAMGQIYKGLAQTGMASARSSASLLGRFGMVTDGSHSSACTVXXXXLQGPGANRCGFCGELCLALGQAPGAALTSSIGFQSLSCQSALPSTRWWQLLSTHTKCFTTPQTLLDALRAKKDRFVFEGTEIPLRHSAMAFITMNPGYIGRAELPESLKALFRPVSMAAPDLTLICEIMLMAEGFQEAKTLARNLRFAGQVGTDVDELHSPCAVQTVXXXVRKRLAQTSMYCTLPVLCRLCEDLLSKSKHYDWKLRAIKTTLYVAGGMKRAAPELXXXXXXXXXXXXXXXXXXXXXTYTPFTRSSVAYGGP

SEQ ID NO: 14059 - protein, 318 aa, Chlorella protothecoides
MLSLASNERIPLTDTMRLLLEINHMNYCSPATVSRGGVIYMNVHSTRRSSRNWFLSSGEPGEWDESMLRILVLLKYVEKTIEFCAKNLRYVTPMSPANQVQTLCKRLHDGTLASQQLLDASLPSSEEDPSRFRVEAHFVMACIWAFGGALSYPMAGPTSTPEQTLSFAPVKTLTNTIQSAGSCPHPLSGCRQPGCILQVVARGVQERRPARRGVSHDRRSPPDPPHDASGVQTSPTIGPSGLLTPWRNRTLTALVPHTCPGHCLRLLYGQCQRANGALDAAHPCQHARPPSDREGRNSGRADPRVCGNGGYCAAALVD

SEQ ID NO: 14060 - protein, 291 aa, Chlorella protothecoides
  MOD_RES (85)..(88): Any amino acid
MEQIRSALTSSRVPPSWIAASYPTMRNLASWLEDLSQGASVTASDLRVGMQGAGGPVLRSERNEGPPIQPPHHLLHRAQRAQQLXXXXGPPIHFPHHLLHRAQRAQQLEDWTRAMEPPPVVWLPGLFNPMAFLTAVLQTTARQQGWALDRTLLVTEVSMPSCADALQIPFPVTIGSRGMPTATGPARRPEWCLVPLCPGLLEQSLDSPMTRAGHDFTQVTRRAYEAVSEPAREGAYIHGLTLEGAHWDEKAGCLEDARHKVLSCRMPVMHIRVRLMGMASVFEAARVSRGA

SEQ ID NO: 14061 - protein, 581 aa, Chlorella protothecoides
MPTLAPMPTLAFTPIPGACQGPEEGAWQQDPGSSHRGAGHRRHARHSGECEPLCIPGDWRGGRAGISLCITRRVGTAVGLVVPQGIGVLARPYRSDQVGPWMDQSLPSAPRPPSPPAPLPPTVHVVGDLPPGCGRGHPLPRLHHPRAAGEASRRRPRRRAPARGPALAAAHRRGAHPGPGVLSDRGAALPLRPARPRQGAAGLAAGGHAPHDAAGAGGAGPAVRQQVCGGLRRGPAQEPVLGAGAGGQPGPDRQAAGDRGHHLPQHVCGGRADRPRSGPGLGRQPERHDGVPGARRAGADAPVPDNPHRPRGRQRVGPRHAPGRLRALRPLPGLRRGHDGAGGPAARPGQPGGAALDPARDARDRGEPQQGAAQGVCLGHAQGRQGGARLRPRRAAPHRPALHLPASVCAEAPARLPHVQAGQRPVRGGARHPHRHGQGEEPLAQRGRALRRPAPVLRHHPGELLHRALWRVARHGGAGAGRLVPRAGPAHRAAQEPHRGCHAGPRQGAVRQELEGAEAAAGAEAGWPSGVDPQQDGMRARWLSRQSREARAGPLRLLGPRRTSPLPPSPCGGRLRCPSLP

SEQ ID NO: 14062 - protein, 181 aa, Chlorella protothecoides
MGNVDAFLRALLTFNKDGLHVPNVERVEKEYLSQPGFRPESIKSKSSAAAGLCAWVLNICKYFRVYQVVAPKRAALAEANQRLAVASQKLTAIRAVVADLNAKVAALESNLLRATEEKNTAIAQAERTASKEDISRRLIAGLAGENERWAATVAEMEDEEGEAEGAGQMCECFALVGQGAW

SEQ ID NO: 14063 - protein, 92 aa, Chlorella protothecoides
MFLNSSLPRFPWPQVTDLSLIDYIAVKAKHDRYTPHSAGRFQKRRFRKAQCPVVERWVMGMIESSELLPRVAPLCKPAGCDFNNLLSAGVRH

SEQ ID NO: 14064 - protein, 86 aa, Chlorella protothecoides
MARALESMDGQGVMVNRLPLNSCHDGPSLQTILERPLEKKAGMRYGPRGSKRLIYWLDNVNMPIVDKYETQSALELIRQSIDYGGW

SEQ ID NO: 14065 - protein, 85 aa, Chlorella protothecoides
MGLVEGLEATKATAANVEDRVAEARENEAIILQSLETYRPVAIRAAIIFFIMDSLPALDRVYLFSMAAFVMVSVIGVWMWLDHGR

SEQ ID NO: 14066 - protein, 203 aa, Chlorella protothecoides
MPPSSCPGAGWVWHRGRLLPCPWLLQCVAAQGAGGAGAPASLRGAGGRPWAVYQLGMDIIGRTPHRHGQRETLAWESWWNAGQHSPSPLHKPGMQVSMFGKEVEAAAVVFREQRSCPLVGPGMAPFSGAVAWSRGIQERIRGGHQGMASLPPAILNSKGGREVQRAYGELLAELKAFEAEQMELWEAEVDVTSASSLMQPLIR

SEQ ID NO: 14067 - protein, 279 aa, Chlorella protothecoides
MQLSLTSSYGDPEFKMVRMEARAEITTLQVADIGVKSVAGSKVSLPHPPPRKDILAMCRKAGVKNKGVAFLLNDGHVTKEDFLAHISDLMTSGSPASLCSQEDKEGFCDGVRAEVKASGLLDTADNCWDFFTKRGELAKETVVVEEKKAATQELIESIRREREVVDEAVGASQADEEEAAALQREVTAFQTECAADLATAEPIIKEAEAALNSLDKASLGELKSFGSPAKEVVDVLAAVMILASSGGNIPKVCLAQAGTPRSSGQGGGGDPCASHALLK

SEQ ID NO: 14068 - protein, 70 aa, Chlorella protothecoides
MHVKTGDVVQVCHIGYGLVDRFLGQVIAGDDRGKVGKIVKVHTKIGKVLIEGVNVKVSRHLYVGSTVGAV

SEQ ID NO: 14069 - protein, 65 aa, Chlorella protothecoides
MTTDAVLSSWTDVQRLWQDYLETKRLAFPRFYFVAPADLLDILANASQPQAIVRLSSGHASPRSV

SEQ ID NO: 14070 - protein, 193 aa, Chlorella protothecoides
MCQALFERHKLVAATQLCMRVLLRGGSVSAAAAACLTNGSEGLEAPPPNPLADWMSDSSWRAVANLARVSGFETLLHELVGLPKRWREWAELARPEEVLLPGEWKRAGSLERLLVLRALRPDRLTQATELFVASTLGPKFAASQPWSLDDAYKVSLGVCRVPLGNGPWGDWGSPFHNKRLIRWVLVQCASVQR

SEQ ID NO: 14071 - protein, 123 aa, Chlorella protothecoides
MQAIGARFELQTGTLLGEVLDLKLHRHAAKCEEVLEQVQREVVVETALAKVASNWAEQRATFVDKPGQGVALLTVADARATFVDKPGQGVALLTIADAVVELLENDTLTLQGLASSKFVLVRG

SEQ ID NO: 14072 - protein, 128 aa, Chlorella protothecoides
MQQEYPIHHSNVAHYSEAQKVASRIGHKHGGLRVDPTSSWRMPFQHPLHLTLQVPKGLLCARQCNSELGSFEHEADTCLGPLCPRLLRSQGHGEHLLPETGLGGIDWAFVDIPGLKASHREGLSGVEA

SEQ ID NO: 14073 - protein, 62 aa, Chlorella protothecoides
MEVDYNPAFRLYLQTEISSPHFGPEVAGHERPDLQASAAEIVRSLGALSAQLQSLEDDLLAR

SEQ ID NO: 14074 - protein, 127 aa, Chlorella protothecoides
MHGRNNGKKQMAVRIVQHAFEIVHLLTDQNPIQVLVQAIINGGPREDATRIGSAGVVRRQAVDVSPLRRVNQAIWLITTGARESAFRNIKTIAECLADELINAAKGSSNSYAIKKKDEIERVAKANR

SEQ ID NO: 14075 - protein, 576 aa, Chlorella protothecoides
  MOD_RES (398)..(401): Any amino acid
  MOD_RES (564)..(567): Any amino acid
MPVIERSCRPHQQGGNRCPLPSLLSTCAQCLPESVEAPPAVPQSHPPLSSQVGHGAHRFTYDHVFGGDMGRPAWELYGACVAPLVEGLFSGYNATVFAYGQTGSGKTFTMGSSGFGARPEEARGVIPRAMEDLFGHVTQRPAMHCTVRVGFVEIHNEEIRDLLTAAVGGGGAGGGAGIKIREVPGQGVCLAGAAEMEVTSREELAAVLEAGSVLRATAATGMNRRSSRSHAIFTVTVEQRRMEEGEDGAGGPRRCSTASQEDTHGGGRSGDEAEDDAAEEAPQAAAPGEDEGGAGSYLCAKLHLVDLAGARLWGTLEEGRGAGRHPAGHGGVCLAFPGRRACGALREHALPCPAPAWPPQTHPAPCVSVVPGVSHGCLIGRTGYLLPGPPLPPSRILXXXXPAPCVSVVPGLSHGCLIGRMGYLLPGPPLPPSRILHTRAPLPPPPSPSPPGSERLKRTGATGARLQEGIDINKGLSELGNVISALSEGKPHVPYRNSKLTRMLQARASWETGGVRSCASTGVRPWESRQEQHPRWRSLGWGRWGGGCRCTHCFHHAPAPQPPXXXXESRQEQHPR

SEQ ID NO: 14076 - protein, 418 aa, Chlorella protothecoides
MHDGASIEHLQGHDEAVALGCPKCRWAVRGCGRCRALSPEARRIKRQKRELGSRLGRRGAAANAPRGPAQLKQNNSQTGPSKRCFPAEAPAASKAQSQTGACAAPPAKFRRVEQEASPVPGKQAFAAATGSVRQREGPEAAPLPGPDGPPPSKFRRVQPSGSCSPSHGTVSSGSTSTAPPPSPAHAVPAADFRKKLEVGMEEARKRRLSGKSDTSHPSPLSPPLKRMCKGPGPASPRLLPEDPRVALWHPPISPYGLLEEELYPDPWKLLVACMLLNKTTSRAVRSVIWTLFDMCPGPLVAAATHVARIQALIQPLGLANKRAEAIQRLSWDYAHKDWRDPQELHGVGRYGADAYHMFCRGLWREVEPEDKDLRRYRDWLLATGGQGMGFQAEAGGGGRGGGAAGSQGPERVEAMCCD

SEQ ID NO: 14077 - protein, 67 aa, Chlorella protothecoides
MAGASSPPSKAPAEPHTPDTEASKAECVCVAVHVRPLIESELAEGCEHALTVTPGLPQVRLMVGGPL

SEQ ID NO: 14078 - protein, 1135 aa, Chlorella protothecoides
MTRLLSPTFHFAGQLTGSASVPSHVLDLASAATPPGSKPGDRPPRDAHSVLAIDVLASHRSLGGRGSETPGVAPSLSHFTPVSIARYAQDLPDTTFHSSPEPIIPLALSVSALKPPLPPPPQEIGHWVLAGTPHAVLVCQLTPEGRLRVHHAFRDPGLEGQDAWSGPPGPPIATWGISEDWSEPGGRRTVHIAIAWSGGRVALYRTSIMDSLPPPVAEDGGSRRGDASHAASPGPGGTSASNPATPPPRRDHRAEAPLLAEPEALGVLRLPSAPSALQLLQSGSLTALAPWGPAGTSTAVWMFADPWRGGDTHGPGHGALQTPHMTGVDSMRLPDWLAGGPPPDEANGGSGGASAPGPPPPAGNAVAFAGDQVVLLGSRHVSVLQRCTWDQRCAALAAAGRHGAVLCACLKAEARVLMVPRGGRPGLESAWPADRPPSGRAAVHGAAERALLALLADQLAGPQGARGTGGSGDHHGCTASSHAFLSPAVLADVAVRTCLLLGRPDLLSGAVANAFLSAPGAQDQGAAGRGELGEASLATPRHAFLEALVPHVSAGRLTSLGPEVMQELVGSYAAAGRPEVVEACVLRLDPTTLDLSQGSVPMKLVSWDAWGGLGTLALYTAWLRLGLLALHCSPSNKFSPSLSRPQVVPLCMRHDLHAALIAIFGGVLRDWTTPLCLLLVEAVSAGAAQEGKGDAEAGAASHGPRGAGCQADGLRPYTAREMQLAARLWLLLEACLLGLGYPPHRAGSLDPGVAPVAKSQALAFLLLTPWPAIADCWRAWSGGQRESGGQNSAPPAVQVSLGGYWGGMCGDAVMGRASTTIALISEREGPNTYGTDHPPTLAYALITSPTPLSNPSVQQSRHPALTFLMDLDPLSTLAVLSSGLEGWEAMLGDVVDLAGQSCPRMDQDTLDSTVTQHAVDVLAAEVLATWPADVPQARASLDFIGAHLAAGRARACGGVVLRVLQRLAALPHGEAAFTAVTAVNAAAMTPGEREEALSLARRHSFPRAEASLHHAGGDYAAALASCLSIESWGAETSEGSLAPRAPAAAYAESVLDGSTQIDAGTRSAFLEHAVSRAAAFVAQDADSAAAFFLRWIAPDRQRQILEGLASQAQLHYGYLGALVGLGDGGGRLKVR

SEQ ID NO: 14079 - protein, 205 aa, Chlorella protothecoides
MAAPDSEADDPVHAAAEALEEVAREVEFVAQSVGAPDENRLGIQPPPSALLPHQCSLPLPHVTLRLEQVAAGLWPVETGLPLPAGRVGRAVSVAAGSDREGALRAYETLLGTAGVDAGDESAAPSLRARLVESALLLLQAAAEQLPGTAPRERAALAGSCDALLGYARRLQDSAAAARLVPELEAAAAALHSRTSGRGLALLGGF

SEQ ID NO: 14080 - protein, 329 aa, Chlorella protothecoides
MRHEGCQTAAGYLLERSGDSSAALEVYALAASTLALARRIARSSDADLAEFMMSQHSLGEDIDLRRGSFSAGTASRGAWPDASSPHAPLPGSSMPELQASQRALEAALTLCTRVSQEAEDDGLGDGASSAPDTKPQSLWFRLLEFCLVQALDREGALQGVQVLESRPPLPAPAQFPSPLAQPPSPPGLTDQQWAVLHALLLGFAQQVVAGAAGRVSPRSIAERIIAAAGRVGSDAQCAARRPGPMAGGFRATLLSLLSTCSLEASLLRCARTAAGSDGAGLLTLAAGACSKPTLMLSAGGGTLDMTMGGAGHVTQQPEAANSQHEPLTS

SEQ ID NO: 14081 - protein, 239 aa, Chlorella protothecoides
MAVLFLGLQQHTQHVGTAAHNPSHSYRRPRTAAKGTRWEGLVASIAPREAPELRRALLDAAVATRDPGLLDALYSCLVDAGAVGELIAADAPGLETHLIRGGGLAGVAHASQIRGLEPGQVARVVALARFYTARREYAKAAQAYEVLADVPVTGPRQELTLEQRAEYLALATLQGLYGKGLPGPDTIGSPIWEPLPTTPPALRLPGAKLWGGCAPGPAHGQGQGAGGAEAHPGDADKGR

SEQ ID NO: 14082 - protein, 170 aa, Chlorella protothecoides
MSGIAGGRISAGVGANLIGMHSTDRNQEATVYVGNVDPQVTEELLWELFVQAGPVGEPGCIEVQVVGQHPKVPLPMTSLNWRSGAWAGHCWRKRAAAPATHPLELQDVLPVACLTALLFCLSGGCAGRSHHVSPPPHTPLAHSERLHAQGPGDQPAPELWLRRVPIGGGR

SEQ ID NO: 14083 - protein, 402 aa, Chlorella protothecoides
MDGRISVQGHQAKGLFIVCVRPPDLTWQLRSPTAPLRVSCTPLEDHDRQQRLVGPAVAQRLVRHLTMAAWSEAHGDTHPPPPHPTYDVYKVLAGFGVIDAALEEDAGDLGDISALSTYAARVCRPGAQDQGQAALGCRRRHEGGLMSLPPARACPPPYNWIPADTQATAEFTAKAAGVVAGLWVAGAVFARVDPTIALTWRVTEGQRVERGARLGSAHGPARALLAAERVALNFMQRAGGIATATAAMAAEAAGTRAVLLDTRKTAPGLRLLDKWAVAAGGGANHRMGLFDMVMIKDNHIAAAGGIAAAVARAEVGRRRALEGGRKGGRESSRTPWPRIPVAAHNVQGAASTHPPPHAHPVCAHPSLSTELLAGAGHPVWPGGGDQHTGRGAPGHQHPGPPA

SEQ ID NO: 14084 - protein, 290 aa, Chlorella protothecoides
MPTPSLTLLPPCHVVEHDAGDQCVRLVVQDADDLAHLFQCAGLHLQATLDAPLPQVALWKGMGAHRRGGHGEVDESMQHLAHCVRRLGSGAMEFYWTGVSRALKHVDKQPPRTGIQDGLSLECSTPPYLCPCHRGGDTPRRRNVVVLDHHHVEEAHAVVGPAPRRHRPLVKQAQPRRRLARVQQHGARASGLGGHGSRGGGDPPRPLHKVQRHALRRQQCAGGAMGAAQARAALHPLPLRHPPGQRNGGVHAREDGASHPQPRHHARRLGRELGSGLGVRRDPARWGWGG

SEQ ID NO: 14085 - protein, 126 aa, Chlorella protothecoides
MEYFKNVMLKLFETGEAGSLLPVVATVLRFSPEELERCRKATAQWGTGHANHTQSASQGGGEQRGAFRVEPARRCAHTIARCVRELSRNPSWHASTSIQPHQTSCADGADAPSLLSGLTSWLGSGS

SEQ ID NO: 14086 - protein, 331 aa, Chlorella protothecoides
MATTHPVAPLQLLHDTFGAFGVVVGAPKVMRDPDTGLSKGFGFVSFDDFESSGELMGGWVQVVRGILFLVMKAAGQDAPVRSAEAWPARAHPPAPPVRPRRELPMPGSHASSTPPLHDSPDAAIEAMDGQFLMNRTISVGYAFKKDTRGERHGTPAERLLAAQKKLQSKEVQRPHTRFATGALRARPSVVGAAFPWASFGSGRRRGGVCAQAVAAPRRPAGVVGWVVPAMHEMPALPRRPEAGGAADRVPGARSPGGHGAHRVCGGGTHAAPAPGGHGARRPRYDAPAAPCPPGVWQLRAPPTHGVPARGSPAPAGVRRAAAPPAPRPRLW

SEQ ID NO: 14087 - protein, 420 aa, Chlorella protothecoides
MRTFALLLVLSLALGSSPAVHAARPKFLQPEFYGSIARQLITQLEVDYGLTPEQAEVVQALYGDVTAPEAEEAIQGIGRHEPAIGPIRPGMESARVHRPMVTCVPSFPTSQGDFASGALDLTKSEATEAAPAQESLNVLNSLLFAKAGDGDVPAVEDLLNVQVGCKVLRAAGCSAWDLSWGPMDHSSLRGAIFAPWAWPAAPHQTHSPSSHVPRQADPNAAADGQTPLLAALVLGNTGLAGVLISRGADTNRPGPDGKTPLLVAIANSSVASAEELLDNVSRAGALPDAADLSDLKHTPCVCTASGLLVAGADANLADGEGVTPLLAALEGGDADIVRSLIDHGADVNLAGPEGVSPFQWVLAQSPIDAAWVSEFISAGADVNTPNAEGATPLDLAAGDADVTAALIAAGAIPPPEVEAP

SEQ ID NO: 14088 - protein, 612 aa, Chlorella protothecoides
  MOD_RES (112)..(114): Any amino acid
MVEGGSDWVRVRYWQGGAGCRWPWMTGGPCEGGKRKVTGVGAKERGEVGSWVGTCSELECLWGAQSIRSDAAHALPMQCSWALNQDCIPPPPSTSHTIGPLERRPWWPAWRXXXAATPAQVKRALLAAATRDRVLLAGSEAHNRLAYTDLTFNATVPDSGAGPGGEGGGGGGLSTPAILGLALPLGALLLLAVGGGLCYGWARLASRRGAALVAHRLDGEWEIAEKRIKLVRRADGEPWQLGHGSHGPLYKAVKDGVQVVAVRPLRCGGEGAEHERCVREIAMMRFLSRDANITQFYGAVVGAQSLTLVAEFMAGGDLRAAIDADARGRLAWWAGGKGVALDVTRGLHFLHTLRVAHRDVKSGSVLLTRDGRAKLSDVGMARVVGEQAPDDGFVGTQAWAAPELLAGQAYDERVDIWSLGTLLWEIVTREVPMRGMLRPPLVPEECPQEVADVIAACMQRDPARRPDAHTVYTLLLEAEPATGAEAAGAAPDAYPGSGSVTDCSSVGTPRGGTAPSPLSVISNSLSLAEPLRWSATPTGSRAQSKGSAVHPVSPQLRCMVDQIQRRFRHHEAMAAARAEAVSPRFPSPFEEQAGPTPVRNVFGRPSAGTGFV

SEQ ID NO: 14089 - protein, 138 aa, Chlorella protothecoides
MDAANIWAPEGLPSGFDYVLSTAKGPSVMLIETWGQNRYSSEKDDFINQALHQRVQLALAQNITIIIPAGIGLCPICENILAAHPNIITVQGVDVRDQLSSFAESNSSCLSLLAPGGGMGNGVLGAMAQGNLTTILPQ

SEQ ID NO: 14090 - protein, 647 aa, Chlorella protothecoides
  MOD_RES (331)..(334): Any amino acid
  MOD_RES (387)..(390): Any amino acid
  MOD_RES (607)..(610): Any amino acid
MRKPSHASPHTLTDMTPDQPPLPTTLLTAIIDDARPLTTHVLPSLHPNLQRENRRGSWMHGQHLSTSHSEMGRLYQTHDHRNVNLSRPADRDTTQPSHGLQSRSLLPEHQIDLRLRSLAHAKLLPARPEARLRRKTQRPGLHPCQAFESLHHLRACSSRHHAWNRVRFLRDGAAGSGAGRWAGTCLEAGFPRSTPSRPWPPALFNLQSIDGQNVPLNRYKNKVLLIVNVASQCGFTPQYLELVELQSKFNSKGFEVLAFPCNQFGKQEPGTAEEIKAFAKSKGANFPLFAKINVNGSDGGLSGPDLWWEHIWASGFPVRWVGADPLWKWLXXXXCGPDLWWEHVWASGFPVRWAGTDPLWKWLKGEKGGFLVDGIKWMAAVADDLPXXXXKKEFMLNIPWVNGCDGFIVLVAAVADDLPPSSCIMSSPCQISDVRRLHQVPRRQGGQGGEALWQHHHARRHRRRHRQAGVMQTLIAGADFWSMAWAVQLCRDGSRHVTPPSYYLQWPRNEGSVSSFPPGRGQPAANQRVHGAGSGVSRVHAGPGPRLPGRQLYRDHPAARGPNVPTCCAGGHPSTPSNHPGAWSRASSREPQRANSASSPLPHPLTXXXXRGPQELSAGSLMMGPRSPKSGMLKEGEETSAALGRFQ

SEQ ID NO: 14091 - protein, 488 aa, Chlorella protothecoides
MHSALLSPHVHPCCPHLPAGKPSTLEIPEGPQASEAPATPGASPEPWRSPRAPRPARPPPPPGSPCTSPARPPPPAPLPPRTRPPQATRSRRSAAPAPTPSKASGCRSSASAGLARPRWRPWARARRSPLWTPAPTSRWSPWPPPTWRASSSRRPPSWCAWGPEGGGFGDSGEEGGGSLARTRRCKPGLEQQMAGVQLIRRRCLQPPPFPCQAAQRQQELEEKEGELQRLKEQAETLEVDAEGLLAQASLEKLKVDQAEEKRAEIEGNEAALYGEAEAAEKERRAVVARARPIAAEAEARERDAAAVKAQAADTEYHAQVLEARSRALLAESEELKTLSESKAAEAELFAAELTIVEQEREEIAAKAASIHSGDLPARIQANQVEIGVLSARIKKLRDEIEWAEAEMRKVRADADDWQRIAARKKHETAGLTLRISEAREAARLALERSREAAEEARAPSEFAEAKYGEAAELAKRAEALEAEAAGRR

SEQ ID NO: 14092 - protein, 193 aa, Chlorella protothecoides
MQLRDHSCRVLAAVLAAGNALNSGTARGGAAALKLESLLKLADVKASEGSQPRPHAGRRGEGPGASRADGPGTEGAGVGPPSSDGPPAAPPFALKLRSLLDFVAWIVYRGEGAEVRAATQYLASELGALSEAVRRMQSGEGQGCGGWLMRVLVGSLEQGQEGGGTTSAAVAWSAVPSAFVVRRGGVGRRGLGL

SEQ ID NO: 14093 - protein, 145 aa, Chlorella protothecoides
MPRPTPTLPLPAGQIVPSDDEAKALRAYPGPAEELSPPEKFMLVMSDVPLIVGHAGAACTVGLSEGTWGPRGPHEDSPPCHATPCCASSSPQPHQVGALMFRLQFRSLCEDAAAGMAAVRLATEQLRASRRLRKVRCVCSRGAGI

SEQ ID NO: 14094 - protein, 112 aa, Chlorella protothecoides
MQTGHCHRGGACTYAHGYDDLRARGQGWVGTPRQGSGSSQAPGTCLSSSLRAGSDGDTGVALGLRLPLPPPPLARAHTIPLVAPAFTGERAESDATPGSVQTLSPRAPTDRG

SEQ ID NO: 14095 - protein, 784 aa, Chlorella protothecoides
  MOD_RES (33)..(36): Any amino acid
  MOD_RES (114)..(116): Any amino acid
  MOD_RES (148)..(151): Any amino acid
  MOD_RES (615)..(618): Any amino acid
RAPPTAACASLLPRTAPPGRAHPVPRGTTAWPXXXXPRQPVGEGGQRRGRPSTGRRSGGQGGPPGRRGAFRRQRARYRRRRARLRRRRARTSCYGRPRRGGRIQCRVARQPGPXXXGIQNPGCTSVVNGSQKQQPIDKGCRGGAAHSXXXXVEEEVAAYRAELERSGLPRPAVAASAAARRAQLLADVAARGAGRERASKRARSPDRRAGRSSSLLRKAVEGAQRIAKVGNWWTPAAEPWGLALAPHVPEARTPGKVGIQGESPRTSRAYSTTRAHTPPYYFHCMSLCPGNTLELGGRSVRDFRPRPKSDMASLAGGYFAHSVLPPRQPPRERSRVGQIRNPRRRVALNVAAVCAEPSPHLDRATGTQPRTLQALLFMARSLAKNELSDSEAPWGLPPALLAQLEWVGGPLPVTLTQAATSPPAPKQRAPPASEQAGRGGPDPEREDDDKDPNKKSKDYYANVGDVIRTLRDDIPCIFWKPFDCALGHCWGSSPDSACASFEKRIAWLAMTWCHFALLTPFNSPISPRPTHTDHIYRDDVVFRDPNISFRGLTNYKLVIWSLTTFGRLFFAGKEVSVVNIWQPEEGIIKCVGQGWGWSLLFSYCWCWLDGAVRDXXXXIKCVGQFWGWSLLFCSFRCWLDGAVRDFRCCAQDWRVAPVHPLPPHPALHSPRMRWQVQARPRLWWLAEGVFDGISEYRLDHRGLVQEHLVTNVQLRDPPITNPLLYGLNLLMSPRLAPQPSRVPCPGERAVCFGCWLHVCRPLQRECEHRHAGCCVTALLPTFNL

SEQ ID NO: 14096 - protein, 298 aa, Chlorella protothecoides
  MOD_RES (253)..(255): Any amino acid
MTAWRASEKGDRGLGGKVAGGSGLEPGACRPTLQVTKRAQPLLTPRYLESKLKDQAAALDLLAHSRGLEGLRQLQGPYLDLEVRGLPGLQYFGGLVWGGIIDEFAAGEGWRGWGGEAGWPAGCQRRGGLLEAARMLQAAPLSPSQHTKCLRPAPILPYLRRGQALLHAGWKGRRGKDQLLRLPGRPAGGRRAHDAGGVHRPRALPLRRPGPGEGVWWEGTRSSEWSRERRRGDGVGEGGRRARGAGSAWGPGXXXDQVRACGGRASGARMESRAAVWGWRGGRGEGGRGARAPHGGPT

SEQ ID NO: 14097 - protein, 65 aa, Chlorella protothecoides
MASQQPDSSQALILAQQEMEYRVALFNKYKDGDLNVGENSCVDRCTSKYWQTTGIVGQLLGTGQA

SEQ ID NO: 14098 - protein, 93 aa, Chlorella protothecoides
MGAPSATLPTQDLWAPPPFPQATRLAAEVVGGLTQEAAEHLGLAPGTPVAQGGVDAQIGMLGLGVIDPGSLALLMGSSHLHLGVTDQMCVGDG

SEQ ID NO: 14099 - protein, 112 aa, Chlorella protothecoides
MNTAKALFHDEARTQFIVVTIPTVMAAAESVRLAESLRKESVPVRTLVVNQVIGDGATQSFLDNRRKDQARALQRLHDNPELRGLEVITAPLFDLEVRGLPALEYFGRQVWK

SEQ ID NO: 14100 - protein, 327 aa, Chlorella protothecoides
MLQTLEQILGYCTPRQLGALESSCSFFIKSGITDKVAMHHLSFIPRAKGLKPDFKCVLDVWVGLGGPHAHAARRVVCDAVRVCDRAVQCGSPGHGPGAGHLPHRGPAVLRGRPRGARRGGRVRAAHHRPRLPRPAGPGRLRAASAADARARRGPQRGIWRRGIWRRGGGALLLRRRRRRGAAGGGGSGELTHRLHLAPRRALHLGPGLLGRAGARGLDAHRGVRAAPGGLPPPRARGVGGSGGQPHAGHLGGGPALVLRARAARPAGARRLPRRGRADAGGGHARRARGVGRRGARALAGAGRRRPALLLGRRAVGPAGAPLPGSPG

SEQ ID NO: 14101 - protein, 231 aa, Chlorella protothecoides
  MOD_RES (126)..(129): Any amino acid
  MOD_RES (228)..(230): Any amino acid
MMCFRYTGNHSSNAEAARHGQMPEMKAEARGTRYRRTWLGPALWRAECADMTLNEFMLQHAIGVRRDAGPMCRPSLCFAYSSQGVYNTARCRGIGNEAIVQALRELAGYEVWTWEECVNTFCQKDXXXXALRELAGYEVWTWEECVSTFCQKCTVGVAHMCSFAWGHSLSSRMDLPGRHSRRLLHRARRTRHQPSSEGCAAIVCGLGWTMRGLRRQPCRPEAVNATAXXXL

SEQ ID NO: 14102 - protein, 118 aa, Chlorella protothecoides
MCATASCRPLWTMRSLAGGSGGKWVGKACREVEAEPGVIQCLHEPSSPPFPLQATLLRRCPCRYDGQIFVKPPEVLARDRLLGMYVRVIGVRACRRDCTGAGEVWEVQRSLKQHHRPP

SEQ ID NO: 14103 - protein, 139 aa, Chlorella protothecoides
MAISLLNHFAGVEEQIVYLVGSFGASAVLLFAVTESKLAQPRNALHDLQPLWAYVGAAAATGSGPLVSQTGPAAFCSFLPFTPQFVGGQILGALVGLGIRHAIHVPWVASPLAMALSLTGMQLTSTTHPPGGWECHRDG

SEQ ID NO: 14104 - protein, 356 aa, Chlorella protothecoides
EAAALLGAAAPLLAALLGPYAPAPTPSQIRAAVEAEVETRAAALAAQRGELAATQARAAELAGQLGGLRAQTEAARSELAELAGRLRRGLEGVGGGAGAADAAADAADDMAADVALCQRRLEEEKASNVHKLKTGGMGPLDVAGSFQCCAVPLDLDSSSSLDLDRYLCPAPDPAPHNQLPASPAHPTQADAFLTMNERFLSTARQHNACHTCGRPFHGAGELEAFLARQERERAKLPSARGAWEAALRDAEARLARLQGLAPIAARHDRLRDTTLPELEAACSGLESALATARGEAELREEGVAEAVHLLQEARGLLETVAWPADKLAAEIRFEISVGRVHVCAWGLKGEDAVLQA

SEQ ID NO: 14105 - protein, 266 aa, Chlorella protothecoides
AHARAAHDAAGRRRARRQPHRQLPGHAARRRRRGDPGAAAGGPGGANARGARAAPRPGECVGLVCGGREGGSRSRLEGGGARPRRIRRLLPSPARVVILRMHWAGLAHGPHSNPSPPHTGTPVPHALTPSPAHPKSEILQELRRVGGPLAMRSNDALHLRILLDHSCLEVFTGTGEVLSTRVYRGTPPPGTGPGIDLICFGAGPAHLRSLAAWELRALDAATASVPLSPVVSPRGDGGGGGGSAGALFDQLMAGLDGLSVVDRASA

SEQ ID NO: 14106 - protein, 224 aa, Chlorella protothecoides
MPEVGGGGPLLSRSFGWDLTGAVVFIGQPPTADPFPHCHRIGGAVAVAVGEGGAPARAPQTSSPRDPLLAWGRVFRCTDPVSTSRQSSYPLSPHQQGETWSVSAAGDRFNRWWGEDHYGDGSVRKHGHSTAGGGEGQSSRGETSVGKRPLCAAVTSSEHTQTPPPTADVTGEAWDAVEQMDTYYNPIPHFGYELALAHSPQLRSVPTLPWEDEDDLGDSGLGAF

SEQ ID NO: 14107 - protein, 236 aa, Chlorella protothecoides
MAVPAPVIAKQYSTPSHPSRTVLPIPCPAPLQWYERWWEVSDWKGMKELGAEKWGCNANGGCSWVGHRVCSSLPAVESLSNPGPHPASPLPNPWSGDAWRETWKETISVDPVTGQPSVARSAHKWANNAAGDEWEEKWDEGYLSKGAASKSASKWARQGAEVWHEEWGEDYDGAGRKWGGTWARDGRWEGDGGRRRCIADRSGVARGGCVKYTNKWAEAEEAEGGRREVGGCGEGA

SEQ ID NO: 14108 - protein, 292 aa, Chlorella protothecoides
  MOD_RES (232)..(235): Any amino acid
MLMERVRSVHSVMQRMAAGEVPFDADVARGAAALASGLPALGDLAALRQEVSGEADVLMMVLAAAVTKGSGAGTSGVGWGLGISGGLARTRDSVCFRSQDRAEIPAVALHSKPNHTAAASTMTPSPASARSRGDDQQVQSGLRSDWCCRHQQAPDRASHGWRNPLALRAADHPLSPAPALPFPALPRKRSFIAVRLAGTHVSPGHTRHACLPGGGGDGTGLLACKPGSDTRXXXXFIAVRLAGTHTCHQSTLAMPACGGGGDGTGLRACKPGVGTRTASFRPGMGRRQCPPH

SEQ ID NO: 14109 - protein, 668 aa, Chlorella protothecoides
MSDSVPGTSDPWYPPAHAAGLHQCSTMTHRPFWPAPQPLLVTAYYIIFYQQTNLTLPHGPDTGSVAASISISEASRLEVRERCLDPGALVRVWCWYAAIRAHHDAARAGQHEVQAKTTPLTHRTLQVLAYFVKTHDLVKVKDLPFKESYLSAQVLCHRVPLYFPAQATSVPTVFYYCPKTDIALNIKTCSQNTTVGVVVDVYDDKLDAIRHGCMAASAHPIVLHMCRSTSRAGPSISVNVSGVDMAADRACQNFASDTEHPLTSCLDSARERTGICGEGHPPVLPHSGGDAQLEELHNGCHLLPRSHDLWPLEEELITWHWHRHPSTRTCLERDNNSMLAEALPPSIFELSPDPSSKGSTIIRDFLTSSREFQRSRALRTFFHAEPPASPGRPPGRPPQKARAQDLPRASHASWLPLRDGSRRQYGTQAGLAPTPPPGIRLTATDGGKVAIGLLYLTFRTMRSSLQGWRNASYPSRRRWLVNPPSSLFRLRDGKCADANQLLTHPTILRKRGYARVGTMHTGNLKSTRLKIAAVSLVSLKTCKSPSCQALMAVECLPKGQPACTPDWMGNTGDGNIGWHNFGTANQGDRNLGNKNQGSHNIGSNNKGNVNICNNLSGDSQSCTPSDLNNSDTIVVSFPPPPSKKRSPPPPRKRAPPPPKAKSPPPPKA

SEQ ID NO: 14110 - protein, 259 aa, Chlorella protothecoides
MASFRSLPMQGSIGAARPYSRPLRMATLSAIKRTTEKNVVCIKMLKIRAGSEKAVLRLCHEDGPPCSVHVMGWRTDLVPWTAPPRTPLMTMPSTSGSGTRATWLWAGTTPAPSCYPVAGRRAHPTIHRESFPLLQVQPHLESPIGMALYEWNDGQLGAVCLQGGPKGEGGLDDATGASGAAGGAGLKQTSATLDLSEHCLGLCGAAWTNRGVSCTCLAIAPSNFTPAIARPLAHSQLSGQGGRLTGGLGPGKSEETGRW

SEQ ID NO: 14111 - protein, 401 aa, Chlorella protothecoides
MTEVCCMLFGSSFINLPAAEDSAHQRNPASHTPCRPVQFWVSQANHWCEYCKVWLKDTAQSRAVHEKGIKHQENVAKRDCPHPSPHTGLSAMRRKAVDEKAAAVQTAKTMKAIEEEAAAQFARDRAEAAAHRAASLGEWVLNHETGQHYNAQHRWYYDSGSKMYYGGDPPDWTASPATLPHAARFEVMYPPLTRPRPTPGQGPPAAASAAGARASGRAAAHPLSGLGGYAMPSVGRIGGAKGVGRVEAKATDAQVGKGDWMRGGRGQGASGGHEDACWRHLSSPRDDIRPPKPLFLSVRPVEKTCRQAEGEEGDRKGSAQAGAGGSGAAGGGAGPGAAAHDVGVRAAVMPASPARQRAMLGSAWGHRAGMGPAAYGHMAHGEALRRHRTLCSWHALMLLAE

SEQ ID NO: 14112 - protein, 317 aa, Chlorella protothecoides
MHGVALPGCYLLQVDEALDISAPARLSSGQFIGTDSTPHAGTQHAVGLEQTALKELGRDFPAGIKLVVTCPPVCRGMLLLRPDNTRVAGGSVPALEHARRAAVEVWNRPIGARGDMDAAGWTPGGKLRCSDSSAEAPRARVSYYNAVCQSRFRPKLHTQTHAYLPLLTTSHPTVGRPRGLPSLAALQAEASAAAWQQHAAGDTAGPTASRQDPVRPESGTAAAPPRRYHTEASLACAPGRGIHASLEGQASGGTAPASSRWAGGQEGRQPLRALNTNRNSVARAAASAESVPAPGCEPRCAWLRGVDVWGALRSTLM

SEQ ID NO: 14113 - protein, 87 aa, Chlorella protothecoides
MIKLQPVGCKTPGTGMEIAHTKLRGVESAGMICSAQDLGWASGAEGEAARVPPGLLPGEPIPEEEPAQVQGCAACLHPGHGTNDAHN

SEQ ID NO: 14114 - protein, 233 aa, Chlorella protothecoides
MRANVMIERGVKKYGVILAFDVPGALGAAGWRVWLQEYGAGQGWGWPAALTGKLWPINEQLWVRSPPPSLLQSPLPPHPYTNPPTPTPDAVNKEAREMAEELGVNIFTADIIYHLFDQFTAYLKHVKEEEQEAARLEAVFPCVLRIMPTCVFNKKDPIVVGVEIAEGIARIGTPICVPSQVRGSAGAARKRADSRPAGGLGCRSWRRRGRGYPCLDRLAGLKCHRGIPCSRSE

SEQ ID NO: 14115 - protein, 218 aa, Chlorella protothecoides
MEKDHKAVDTAKRGDAVAMKIEGGHGWSSGAAPAYATVKLRLECRCTAHMPSCGKPCSVACWLVYNTGECRDDSRALATNPDQAARLYGRHFDHKDDLVSKITRKSINVLKDMFRDDLTKDDWRLVVRLKKVGRDVQVESCMESALGRRLKHDLEAAGYMCFPAGLPLCTLVRQSCSAQARSRLTRRSQLWPPSALEKESQGDIHRPGNPASASNRNT

SEQ ID NO: 14116 - protein, 387 aa, Chlorella protothecoides
MAISEEKSKAMWLQIAGHRPQPPGQGSAVTPPPGTSRYGSASAPPSSCTTNGCFLSPVREQAWAGHGPGQGWGPDGRHGLNCARRVLAPWGAAVVSTARLALSATFIDPSPPHIALTPPSGFPYPVALTLWHMVFCSFLATVIVKLGYVEPIGMSRETYLRAIVPIGFLYAGTLWLGNAAYLYLSVSFIQMLKALMPVAVFGVGCIFGTEAYSPATLANMLVVSLGVAIASWGEINFVLVGVALQMLSIATESTRLTLVQILLQRRGLKLNPITTLYYLAPACAAFLLVPFALIEAPKMLADAELVIAPAIMISNAAAAFALKRGQHTWSGPACMAAVHLEAVLATLSPQGKCLPVAWLDRGVRPQRIVLPPDLHQDLTSLPNSPTP

SEQ ID NO: 14117 - protein, 465 aa, Chlorella protothecoides
MAEYMWTGFAVALRKKDSRGGYLQLPSRARKGASPQALTVKEHFHLIDHSNKSLARWVSALPLSVRQGWGCWSIDAELQNGSVPESWDLRARCRDSHGVDASPLHSPPPCSLANLTASVTLVSCCGMHGVLPGVFHVGEAAHGPKATLPCRIQLHLVLCGRGCGREAQPEDPAAGCGGRFTAPSHPTPNPHGRSLRGHRGVCAVPGGARECVRCLLQAHRLQEPDSKLRWVLGTGCLVTCPSAVHGEAGGLAPVCGIPALHAVQYLCACCLYLSGSVEVPKMNLDDVFISKEQIAAAVKEELAKSMTGFGFAIVNTLITDIEPAAKVKAAMNDINAAQRLRLAAYEQSEADKIRIVKAAEADAEAKYLAGQGIARQRQAIISGLRESVQTFQNEVSDVNSRDVMELLLITQYFDTLKVGIGAGFGVGVGSETKRLAPRLGYLWGALPCMLVRRGDPMSLHRVDDL

SEQ ID NO: 14118 - protein, 379 aa, Chlorella protothecoides
MEILASTAHQPLHRFEDRDHKEASNTLIRMHRQGSSVSTENFSIIESRDSVKVSCHFVDWSVVVPLPPAPWLEYTVRSIHLQCPLFPLHQSFEGMHFDDIYANITARRNRIFLLMEEVRRLRIQLRAKVRERFDSPGGRRIACPQDACCCWQLKSCVTRTLACQGGTESKEALLESETYPSSIPLFPAISDETLKRYWRYYFTAVAGIISFGALLAPTLELRLGLGGLEFQSRCQGGVGEGHRGEWAQSFPHPLASLGPSRRLHPVLPPSTCLPNTSLQAPPTATSSPACTCQISWRTWTPLWPPSVGARSAFSPPCCWWRSTTLKCTTSSAACTARWVGVGLGMLCDGGPAWMGGCDCTGARTFARVPFKLARPLTIA

SEQ ID NO: 14119 - protein, 612 aa, Chlorella protothecoides
MSHVVTTVPSQHPLLACPFSLRGTRHGTWAFKSGLPPRRHQTHRVCFATRGSNDSRPEARPAPQEHPMPALSSDHKAFNPDTHVSSKPTRTGLPSLPLALGSFAALSAGILVDAVSPDPDPRSCPVPIPDPPLHPTHRPSFGAGPGGRRLGAGGGAGTGCDGGLPRAGPLHRRTISGHPRLQVLHRLRPSPGPRPTGRGGVCPQGTAAGRLCGVPGRRPKLHHPQGHVELEDPLAMWLEGRLLHAWHSRGGRFLYYALRYTYSSTHTHTASSAADDPDLLRNRPVADRVRVVIAGVVFNVLLAASICTAQPPANQVPLLCNSSAGIDGGHGGAHLLAGRAGGGGAARRHWRAGRLAAWGPADQGGAADGALLRVQPERGGGPDQVQRGRGGDSGSSRKGVGGGQHAGCRPCRQACRLAPRLLRSWPSCHQQSALGAHTLHPTPHPCCSENPGRQLALDVVRGGEPLSLAVAPAEQPDGRGRIGVALAPNVVLRRTKASDPVTALRLGASQTARLAGVIWKGAWAVGGPGRRDTCVVCSCREATAAPMLGLERIISGAEASTSSVLFMVSQRVRTLKRVSNPDPKVLHKPPTPRSTPPPNPNPPPPTPTPTPQ

SEQ ID NO: 14120 - protein, 258 aa, Chlorella protothecoides
MTWSSRHIPTPCVPPPCPQALAQVTGKKEAAVRAEYGQCGDLGAVAAAARGLQKTMFPPPRLTVPGVLRAFRDVAAAEGSGSQDRKKAMIVKLLVAARDNEAGYVMRALQGKLRIGLAEQTVLVALAHAAVLSSVGDETAGGAAAAAGPAPPAASHEALAGRLEEAARAVKLAYSQCPSYDDLVPALLAHGPLRLPDHVHFRPGVPVKPMLAKPANGVSEVLDKFTDAPFTCEYKYDGERAQIHFTEDGTVKVCWRWP

SEQ ID NO: 14121 - protein, 267 aa, Chlorella protothecoides
MIKPGVKSAVLDAEAVAYDRVEKRVLPFQVRRTHGVESQFPHHIPYDQPSTPCIVHGELGHRLRTPHLASLPHPLPSLNPPSTPPLETPSPSHSQVLSTRARKDVSLASIKVAVCVFVFDCLYLDGRVLVQESLTTRREAMRAALSEAPGELQFATAKVSTDVEELSAFLDDAVEAGTEGLIVKTLGDTYEPSRRSSHWLKLKKDYLEGVGDTFDLVPIGAWHGRGKRTGMYGSYLLAVYDPENEEYQTISKIGTGFRSGRGVGGGK

SEQ ID NO: 14122 - protein, 340 aa, Chlorella protothecoides
MALCPPLVLADAILTRTEELRRGKSFDLKLPGLLVIDTPVEMYEGPPLAASYQAGLACHDFPRTLLRPARVLPCSVTTLAQNPFPGHESFSNLRSRGSGLCDIAVLVVDLMHGLEQQTIESLNLLRMRKTPFVIAMNKEVSTCAQPFLGCAAPLFCAALQMRAWPMHHVTHTDPFSPQVDRLYGWKSVPNSPIIDALERQAEHVCTEFEQRMDKVWRLWHGPWGTGALGLGCGRKVCRDVCESVPPAEGTRLTRGPDGMEVRALPSHPWWSLHGSRLEERLHLSKVGIPGPQILRSPAPPRAADHAATERAGHERGAVLAQQGPPLLHQHRAHLGTHRRG

SEQ ID NO: 14123 - protein, 233 aa, Chlorella protothecoides
MLQGPCIQRIKVADVRFPHTAPYRRTRVVAAPWPTKTGNGTWQQYVTLPEAALQPVPEGLSDEAASQFLVNPVTVYGFVKTLETDNLIKNGWIVSNAAGSALGRMFITYAKHKGLKTIALVRREALREELLSLGAAAVIVTGEGVDVEAEIKKVTDGEGADAAFECVGGDVSGIVKGLRHGGALIVYGAMAEFTFTAGIPDILFRWEGWRGLGRSLIGELGPACHASSFSCLP

SEQ ID NO: 14124 - protein, 140 aa, Chlorella protothecoides
MVRQKAKYERFLNKRSVSNPRHGAVKFRAPSRILWRTVRGMVPHKTARGAAALARLKVFEGIPTPYDKVKRVVIPDALKVLRLQHGHRNVALGDIATSIGWKHQETVKELEHKRKIKSAARYVAKKKLAALRAKAEASVQ

SEQ ID NO: 14125 - protein, 199 aa, Chlorella protothecoides
MAEKLTFVNDLQVELGGGAGYRCGAGCWLVLSNGNTRSAPSFPQCTVLEVKSIEGLGTTIDVVLINGQLQEGDTIVVCGLGGAIVTPIRALLTPQPLRRCTISLVASPTPPFPPKTEQEMRVKGTYVHHKEVRAAMGIKLAAHNLETAVAGTQVRQGARRYLLVPGSREGRARHPLWCGGKLGGVPGAQCKVHAPRGQL

SEQ ID NO: 14126 - protein, 292 aa, Chlorella protothecoides
MTTIPDPSLNRKAEKLARREQLKKEGKLLTGKAKAEAERLARVREQFLKQAGIDVDAGAPKKKPVYTNRKRTQQRKQVNPEAEGPVSAAAEEEPAPAPEPESEVPADEPAAPADEPVEGAVEETWEATVDDWEAMDEDTLVLPGQQPAAPVATAAGTPQAEVAEQNGEAATSEKAVEEAVAEEEESDEEEEEGETSSSDASESGSGTETESESESESSSEYSSSEEESTDSEAEMEERIAAQREKRAERRKLAMALRNPADLRSPICCILGHVDTGLLMGFGAQGYLGCLDC

SEQ ID NO: 14127 - protein, 141 aa, Chlorella protothecoides
MGFADIILDLVSSGVTLRENNLREVAGGRVMASQGVLVASRRALLERPGLLGLVHELLERLDAHLVADSYYSVVANMRGESAEAVAALLLGSKLLGGLEGPTISPVLTRGADGGPAQHGFYAAQVCVPKSLLYPAVKEIRK

SEQ ID NO: 14128 - protein, 368 aa, Chlorella protothecoides
  MOD_RES (217)..(220): Any amino acid
  MOD_RES (239)..(242): Any amino acid
MTPAQCGNGHAPREAGGEEAPQDDDTVLQSFSGVVLKRSSSDAGWPGSLQCTKRAPPHLLSPSALSWLPQEGGPPALALPFTEIAMHAVVSATGDQAACLYLQLAGGDSDYDDEAEEEGEGASEVWLIPSDPALVEPLFAALSEGAERNPDDDCEEGEDEEGGIFFDEEEVLAGTDAALHRLEIQEVSDAGSACLGCGRWPGAATSLPPVCLWKFCXXXXGCCTASPGDRRVCLWKLCXXXXHVIPWMRQALGGDPTRFSDADEADEDEEGMSQCRRDCTGSLWQASVLSLLLHIHVIPWMRQPIALAWNPSPCPYAMIPVLLFRVCTDDQTPVMPVLLLTSRDTITLDHMSEHTPAMHHPFHSLGCR

SEQ ID NO: 14129 - protein, 262 aa, Chlorella protothecoides
MVGGVTPKKGGTTHLGLPVFNTVAEARAATGATATAIYVPPPFAAAAIMEALEAEIPLIVCITEGIPQHDMVRVKKALSQQSASRLIGPNCPGIIKPGECKIGIMPGYIHTPGRVGVVSRSGTLTYEAVFQTTQQGLGQSTVVGIGGDPFNGTNFVDCLERFVADPQTEGIIMIGEIGGTAEEEAADFLRASGTDKPVVSFIAGLTAPPGRRMGHAGAIISGGKGTAGDKIAALEAAGVTVSQSPAQMGVAMKKLFEERGLL

SEQ ID NO: 14130 - protein, 116 aa, Chlorella protothecoides
MPRGPHQRFNPIPSTPAPLPLRMFKRSKVPIVVGGTGLYLQWFMHGKPGTPVSTPETAAAAQARLAQAWEEAAEQGQTLSQEQAWALGCRLVRDLGDAQAAERYQGGVREMHPRGV

SEQ ID NO: 14131 - protein, 307 aa, Chlorella protothecoides
  MOD_RES (5)..(8): Any amino acid
MACSXXXXLVLVSCRVAARSSFRQHGLRLSTEWYQAPERLTKLTNVLFDGAMLARCPVTRPRRIACRVGRPAYRSTIPALDPRQLATRRAENLVPVRMEVHRMSRLDTALSSTLGHVTEVFPEKREHGVSSCHTWPCCHETDSPVCPCGARTARPHRNPMIAGPSRIASRAGYAALAARGLARMTSDQARPRPAVVIITGPTAVGKTDLSIRLAKALDGEIISADSVQVYRQLDVGSDKVRTNRTWTPGGLSTLQPMFRNTAQQTPLLWLAHPLTTQTDSCGSKAGRAPPPHRHPGPPARLLGRHLP

SEQ ID NO: 14132 - protein, 302 aa, Chlorella protothecoides
  MOD_RES (91)..(94): Any amino acid
MSGAWEQFSGNGGDEGIGLALVMYTSPRSALVSCLRVPPSHPPAPCSLSPPHALHHPPADPKFALLGAMQSLFEGSMYTFVFLWTPALSTXXXXGVSCCATYTCVLGLDAPFYSTPPLPPSQPQRRAPAAWHDLRLFHGVLHGRLCPGRQAHVADHGNRSGQDATRDRSALLPSHPANPQIHILHLCRIKVERYMQVVFAFAALCLTIPVVVPPAKASNRLDEGREGGCAGGGWLERKHAVAWFLPSRHELVQCFPAQHVWSHMPYPHRPPRSAAIACRWLASSTSWPSAASRSAWASSGPP

SEQ ID NO: 14133 - protein, 318 aa, Chlorella protothecoides
  MOD_RES (200)..(203): Any amino acid
RRRVERGGRDGAGPLALARAWVQHAPSLARGGGAGATAPHAGFVPTAVTCTHGGRRGPHIRRKVCLAPTPTLHILGCRHPVCLQGLQGMKECECYGDKLYCHSGWVGRGDREAHSRGPQAGRGRWRAGAWEGLPAHSVARRAAPPARPPPDAGPHQSGNRPAGGGRAGLGAGKAWCGQTLPLAGQPPCMASKVPLQHGTXXXXGGAQQGTTGREGAVACRCLGKRGGQPRSQSPPGGRGGGHWGPAMSPWGDGFGRGTGGMVGRIEPSGPCPLTPRRPLPQQPGTLSPAWRRPPDAGPHQSGSRPAGGGKGGVGAGKP

SEQ ID NO: 14134 - protein, 468 aa, Chlorella protothecoides
MNAVCSWDTDPGATWDRGTSIHSVGRGTPPAPLSEQSPLLKQLLHGDAHLGGGLADGDPRGLQRSNLVPGGTLPARDDGARVAHPAPRRRGQPRDEAHHGLVSAGGAEEVGGLFLGRAPNLADHDDALGLRVRHEPLQAVHEVGAVEGVAANAHHRALAQALLRGLEHGLVGEGAGAGNDADATRGVDVAGHDADLALPGLDDAGAVGPDETRRALLAQCLLHAHHVVLGDALRDADDEGDLRLQRLHDGRGSKRGRDIDGGGGGPRRRPCLRHRVEHREAQVGGATLLRRHTPDHVGAVVDGLLGVEGPVLAREPLYDNPGGLVHEHGGGLRGWSRGVKGWDGCDTWDEAHWERPSRPCTLTSAGWDGRDTWAEGHWERPSRPRTLTSAVLRSRDPSGAKACAATLCESGGRDWLAMQMNVCSMKLRRITVRTSADAACWARHEEEVRGVYWCQNAGGDGAHRLLGP

SEQ ID NO: 14135 - protein, 103 aa, Chlorella protothecoides
MEAFYIYLFMVGAVAAAVFEYGNRLVKVTAAPDLAFRGFKTNYLVVYSFMMGTRGRGEGHSGPYVYALYEHYGFTRGEIGRLFIAGFGSSMIFGTVMGSLADK

SEQ ID NO: 14136 - protein, 354 aa, Chlorella protothecoides
MHAPCTCLSTLVLPSQPPSQLPKRCLAALAEWEELYSVCRREWQKMEPQTRRELAPVAAHAAWQLGEWKCMEDYVDVIKHQQAGSSEGAFLSAVLHVKKEDYTAAMGERDLDGGGMRRGRGPCQEQGSEGPPPTSSHPGPRPTSFMLPPMLSSAVDVDQARELLGTELSALVGESYERAYGDMVRVQQLTELEDILTFKLAEQVTKGGRGGLRWGGGGLREEGRAHFLVHGEGGKSLGMDPTTSPWLIHVHAERHERLARSVCPCTSPSRYRDTPPSTFIQPASHPTLHRKPCHHDAHQELHAGDVGGADAGRATQCGGLAGAAQRAWPAAGHARGHRHLAQVCLPLPQERAKE

SEQ ID NO: 14137 - protein, 460 aa, Chlorella protothecoides
  MOD_RES (275)..(278): Any amino acid
  MOD_RES (442)..(445): Any amino acid
MGTRSILLPGFVAVRDALRCCLRPLCAGGSRPAARAVHQRRVDANLTPCMACTGSSMCLRVARGACSGPVNNKSLPRPPNSSALVCRDHGLPPHLLPLWDGGAPRPRPILPHIPGDVRLPHPLRDAGVADRLPLPHHEVRGVDQGGSPDGVHQGGQAGEEGLLVLDGREDGSPAPPPPPLVPAATSSRPAVCHGRRASSTSRGPRWSSPSSSSPSACATRTAAPTQTRWAGRRAASGAALDACRSGLQTLPPVWCATRVCMACAGRRLRGSFGGXXXXLQTLPPVWCATRVWMACAGRRLRGSFGGEVIEPALQGQRLPTPCMARGGAPHAGSLWALPLHPFPPTHLPLATWPPLHSPAALPPYSTPQHDRPYRAAMRLDRLPSLLEYYSYCFASGNLLAGPFFEAKEYFDFIERRVGGRVGSPGRAIPGWGKEALRRMWPXXXXSPGRAIPGWGGEALR

SEQ ID NO: 14138 - protein, 190 aa, Chlorella protothecoides
  MOD_RES (10)..(13): Any amino acid
  MOD_RES (104)..(107): Any amino acid
SWRPARGARXXXXAAREGTRAAPVRPWDREKLEAGPRGAAAGPLEGVRDLRELLQRRSSDGGEAARRGPGAGGDAAPAAPGAHRVADARPPPAQGYPGRGAVLXXXXCIDAWPWNPLEGLRGIQAGAQDEPGEPLQLDDLFRRTAAKPSLYWLPLTAEQVAAKRAGAGNGQAAAISGSEAALETRRPLPA

SEQ ID NO: 14139 - protein, 1313 aa, Chlorella protothecoides
  MOD_RES (103)..(106): Any amino acid
  MOD_RES (195)..(198): Any amino acid
MATGAAPINVREILSVRGALGAGSSSRRWLTRSQDPRHSTPFSPNPQLQNLGIQNANITFTNVTLESEKYICVRETSPTNQLAALQYGASPSDRPVPALREPXXXXTACLELGLLEHAGGPFDPRMFQAALQYGAPPSNRPVPALREPWSYSPFSQRQQSHETMGAARALALIQRATSLPTPPPLASTPLPCAGXXXXYPRTLLSLGLDPFPSSPSLAGPRPYPACDILPTPPPSASTPLPCAGDHRPEQPQLAPAPPHHRRLGADEPRLPDHRFEGRGARRDGGQPADLRPGGQGQAEERAVPAVGRVLEVGEPRPPGPGHRHLGLPLGPGGGRAACQGLRPRGQPGGHPDHHLPRGRGGEVVRAGGHRAGRARPPRPGQGLHAAVQRGPGTEPGAGGPRRGLRQPGPARPRRPGAGHRLCPEDGGGGGGGDLQAPRHRAGPAREDQPQAQRGALLPPRVRRRLPRVHADRGQVRPGLRRHQARPALRLRPGDGHRHLPHPHLGRPLLHRCARALHRRLRRHQPPRAGVCCGGSRGRVFQMKGCSPEWDRFSSMEQIQHLHEGVAARMGIASVPWSRYSTCVHPQTPSNHSPLPPDTRPQVLAGGPAPDAIIPFIAGQLQNVELALALAQRGNLPGAEGLVVQSFQRQYAAGQYREAAETAARSPQGSLRTRETVEAFKRVPAVPGQTSPLLVYFGTVLAREALNAYESVELGRLVLAQGKKPLLDGWWRDGKLSASEELGDLFRGAGDWDAALAVYRAAGAQGKVVEALAAKGDFEELGRYAATTGSQPDYLFLLQSLLRDSPEAAVGLAKAVARQPGPPLDLNTMADLFLQRNAVKEATAFLLDALADDSPAHAALQTKLLEINLVTAPAVADAILGAGGLTRYDRPRVAQLCEKAGLYARALAHYTDLADIKRVLGNARAIDPAALVEYFGTLSAEWALDCLRVLLEADPAANLELVVRVAREYSEQLTVARIVALFEAAGSWDGLYFFLGGVLAGSEDPEVHYKYIEAAARTGQVKEVERVTRESSCYPPDRVKTFLMEANLPDARPLINVCDRHGFVPDLTLYLYKKSMLRYIEGYVQKVSPAKTPAVVGALLDAEADEAFITNLVLSVRSLVPVAELVEAVESRNRLKMLNPLLEQLVSEGSRDPGVHDALGKIIVDANTNPEHFLTTNPYYDSLVVGRFAERRDPGLACVAYKRGQCDEALVACTNKHAMFKLQARYVVERADAGLWESVLGPENASRRQLIDQVVSTALPECKNPEQVSVAVKAFMGADLQAPLIELLEKIVLNNSSFSNNHNLQNLLIITAIK

SEQ ID NO: 14140 - protein, 109 aa, Chlorella protothecoides
MHCSMITPQGAGTADSTPDMLTLPEPLLLRLVCFLSPDDTLSLAQTCRHLARLAGEDLVWRRHFLYRWPDAGMQDEGATPAWKPSGYGRDQFTPEPSVPVPELGHVLAW

SEQ ID NO: 14141 - protein, 120 aa, Chlorella protothecoides
  MOD_RES (97)..(100): Any amino acid
MQGAAPDLAPVITGAQAVTQAAPVTTSRKASGSALHEPDPAVVPAVEQAQGRRRGQVAAPPATEAAGPEISCPVCRLPDYGRPLLGCDACQMWFHYXXXXRAGGSRHNLEKGIGKRVART

SEQ ID NO: 14142 - protein, 344 aa, Chlorella protothecoides
HRALRIETARRELAQRADAAARRARDAKALKGEVLGERGGALRDALSMRNKGAWRSGRGPRGWVREGCEPATGTSGPAVPGRSARGVGREGCEPATGTLGPGGAWPQRSRAALNLGKSTRHRLTDSSTGLLRAHERLARERNKLKGDDRQLRLEALKAHDFEAYQEMLRAQSTGAASAGEKYVAISKFLKDTEEYLIRLASKIAGVKLSAEVSKATADAIVKARAQVRPEGAGLSEEDVQAAAHAAAQDAASNSAVLRAAGGGGGPSDAQSHYYELAHSNREAIAEQPSLLRPPGDARLREYQLVGLQWMVSLYNNHLNGILADEMGLGKTVQASEAVQDCDRG

SEQ ID NO: 14143 - protein, 564 aa, Chlorella protothecoides
MALIAYLMEHKSNYGPHLIIVPNAVLVNWKSELTQWLPGARCVYYVGTRDERARRYASEVQSLQFNVLVTTYEFIMRDRAKLAKIDWQYIVIDEAQRMKDRQSKLAKDLDRFTAARRLLLSGTPLQNDLLELWSLLNLLLPEVFDDRKMFAEWFGDGGAGAGAGAGSEADWLEKEKRVVVIHRLHQILEPFMLRRQVEDVESKLPAKVAMTVRVPMTPYQSAIYDWVKATGTLRLDPSAPQEYKMKRQFASLNNKCMELRKVGDAFLLWRAWRVGVGVGCGVDRGLQPVAAPACAAHVSAIWLAIDIPMHTEPLIPPPFLSAQLCNHPLLSYPPLDWGLGDAIVRQCGKLVVLDRLLVKLVATGHRVLLFSTMTRLLDLLEVYLRWRTLPPAACQLLEDRRRASAAAVKREGAQSGAGGDVTAGAGTAGEPAGAGAGAGGDAGQPDGPAGAEETTGAPASPNPPPPPRRTMGYLRIDGTTALEDRERAIQAFNAPDSDAFVFLLSIRAAGRGLNLQSADTVVIYDPDPNPKNEEQAIARGSSKAQESEWMEGFGGAHARFPCRL

SEQ ID NO: 14144 - protein, 225 aa, Chlorella protothecoides
MLARGAILPLFLAFAVLACPATASAAVQVTLYGESLCPYCRAWILEQASDLFDQGFSSYIEFRYVAWGNAHRSHVSEGGGRVWDMGLPHSTRGAPATGPAAPSLDGGAAHLHVAVYGLPQSAWWPWRSVGGRPQHLPAGRPADTSSHRPHAPPLPPHTHAGWPPVPARCGRVRGQRPDQLRPGAVPRPGPVVPVRTVPGTHRRARPGRGLRRLRGLQRARGLGPD

SEQ ID NO: 14145 - protein, 118 aa, Chlorella protothecoides
MTVFVTVFATAIAITKDLPDIAGDRANNIQTFATRLGMRRVAWLGSGLLLANYVGGALAAAANPVALNARLVVPAHALLAAALTWQTARMAETQAGVTAYYRFVWYLFYAEYLLLPFI

SEQ ID NO: 14146 - protein, 138 aa, Chlorella protothecoides
MSASPGGHPSSPSPPTPFLAAFWRFLRPHTIRGTLLGSCAITAKALAENPALIDWGLLPRACLGVLALLAGNGYIVGINQVYDVEIDAINKPWLPIAAGDLSLPVAWALCLGLAAGEVIDCVGLGVARGCQAGNRSPQ

SEQ ID NO: 14147 - protein, 186 aa, Chlorella protothecoides
MAFLQRLMNYWLNEVLVNTLANSRTFQKFAVRSSASVEELVKKTAEHKERIAGQGGDFMKVFREEVRFRGRLASRRWMACTIPRVCRRGATHRVTPCTSASLTDDQGPKRSPEEGREVVVDLRDSLKPVQSRRGHPQTALTRDHATRSPLPLPPTNPSPRRDVYQSALPRPPSSPRGVQGAGARRM

SEQ ID NO: 14148 - protein, 677 aa, Chlorella protothecoides
MAVELARTASLLLNKRFESPIDASSSRWVQVVLEADGKPAGSAGDPRNESTACFLRCMQSPPRSPHEKSTSDLSRLLAWLRLDQTAGNLRDTDIRAEFNLMECRMPSVWSILGLATAIKVLLVPAYKSTDFEDCLAPTSALNSSSAAARYVLEANLSAQLLPSCPTAHRLLTSSCTKGGLLGGPRHAGGAAPELRQPCHSGIPAWKRHRERGGAPRGGLVGLQVPGKESTELGPGSGGSAPRPHHGGPHPLPVQRHTAGWDGRGVGHGVDHGCWHDIRDLCCVYGGPERWAAPAGCGPLCCAPQLQAHLPLCRAGLLCLPAATLLQVFVGGDMRDALGGLDQASCQAAQDATIEQGARGRSAPSRFLLLGCIVAAVFLLSLGPFVTRGQAGQLASRLFPFDRGLVHAYWAPNFWALYAAADKVLAAAVRRSGRWLPPTARMTGRGLQQDWVVWLGGPGGDGSFRGAATGRLQGHSPCDPGGHGALPPAHLALSQPSQVPAGCSALHPGIILLWVRVVWDGSGCMENLNVYHVHEKAILMVLVPGAVFVVHEAHPALANRFFFLTTLGTYSLFPLLYRPEEYSIKVLLLVLYTASAPQLLSWQLGTPSRLHTLPGAYLWGLVGVEAASSWILPYLPGSRLPFLPLALVSCYCAVGMGAALIWSSFPYISPPEPKRAPH

SEQ ID NO: 14149 - protein, 409 aa, Chlorella protothecoides
MPSIRLLGGPRSGSYSSFIRQAQSRPPAPASSRHPLTVRALKEVRTRREENVPGDVYVDHTCIGENGWATRSVSWRSPSSIRCINILLVDLVGMQTLKTQAFPMTFPPKHTTPITATQVLHPHATPVPGGDGAADVLLPLAHHRLPRRLPLRPPCRVHVWRRLLLHPPPGRQHPGGQPPLEPDAGGEARGAWRGGHHLPHPPRRRGRPRALGGALWREARPAPPGDERAPGHRVGACITVVLGKTSSGVLPSPRPSLCAGSCPHSPPHSSSSTRARSKVERPLDETGPWSLGEGLTVYLTPGHTEGHAVLFYAPDAALLAGDHLFLSRRLGRLAISITHNWYSLPRQLESVAELVDLPVRHVLPGHGRPMHFASAGEYRAAALEVLRCDGQWDDGRLRAVGGRTRELQV

SEQ ID NO: 14150 - protein, 360 aa, Chlorella protothecoides
MAADEETPGVQFSAAVQVARHRRAETVTDQVLYRKTGRFSPFWVLSKFLNLHRAHWSTGSSTSICVMCAIFRSSVVLMQVSVHIHGPRRVMDHPVCAGGAQQSHAVVHWCVLRVEERGGVECMCLGGGSLRTPIPCHTGLPKLTSTRGSLSLHHQPFHSPHNPGSGSTYSIWKLTDLDQTTLSIFLFSGAHDELWKQAPGTLIAIFTPKVKNDRELCLTAISGDQVWVLGTAAEFGYCRAQKKVWRREECMYIPNARHECPLGPCDAETSTSVGPSPSRAENVATVPHRLPFIPSQDGQPCRVPVNMARCPFCPYHVQVGILLEHCAQMVAQRESWGFLTVYLGRRSALFSSPPLTDTPP

SEQ ID NO: 14151 - protein, 118 aa, Chlorella protothecoides
MPGRLGGEAGLCPLYPPFRCWLSAENAAICANPSPSPTPHPEQVDGEASQQPAGTFTVSRQGQVPMLQRVHPALASVVKAVTDVLDDAREDEGISRKQHAALSSAMATALQDKLDPNN

SEQ ID NO: 14152 - protein, 92 aa, Chlorella protothecoides
MSSETIIKAILDEEHREKQLKKKRKGQGRHAAPRLYITPHTFTEGTRKNEKKGKTLEEMEKEEGGPVQESLVPMAQTQRAAKRKGAKDAGEV

SEQ ID NO: 14153 - protein, 146 aa, Chlorella protothecoides
MSIRHPRSDTSILEVSELQRAEEELEAQEDDGVKLEAFNLKEERARGHFDEAGNYVQDAKGSDEEEEEDAWLKSEEGGSGRVESGGQWGDRRSDWDPAAVIPACREPGYETLCRIHHVLLPATLPLPDELPIHSQPRWCLRRSVVG

SEQ ID NO: 14154 - protein, 103 aa, Chlorella protothecoides
MLEDVAQLYRRETGSAIVETAHMELTEPSLKQAVDSCVSQGATKIVVAPLFLGPGRHIQEDIPRLTEEAASAHPGVECRVAGHLGVDTLLVQLLKMRVQQVLS

SEQ ID NO: 14155 - protein, 172 aa, Chlorella protothecoides
RSWLVVTGRPVQRPHPDAPGHTRTFSTLAEAVQASQPGHTILLQGGQPHRVSGQPVVIRHALRLLGSGGRAEAVVLRGDPGLETVLLFHSLAQLLNLSVHSVRGACLMHLAGTLRVGGCILESSAAGLPHLVSQIALAGDAAERRRLHFDETRLLVRELGFDSLVPQARTEG

SEQ ID NO: 14156 - protein, 199 aa, Chlorella protothecoides
MAAAQPLTAAQVARLQHEAAALLEPGESVAAGLRRLGVGLGRRPGKQAAKAAQAAGAGAVPDPDSAAKFERLTALGVSLMEAGETDVYTQSKVGDAWGCAPCEVSWGGELASRQENPRRWPVALLKHARCENPRHPRALNLHLEYFARAAAVYIDADEGPSSLFGGSAPATTAYDDADEDMFGGGSGESAFGRLGGCCA

SEQ ID NO: 14157 - protein, 112 aa, Chlorella protothecoides
MQASAAHPTVVDVVDMLLEFWEAAVHAILAARGLYRPDLFTRERLYGLAVQRARHPGLCAYIANALQELRVMLLRSCGLTVGMLSPVDIVGGVQSMHAGGCPCTLLTPPRHR

SEQ ID NO: 14158 - protein, 237 aa, Chlorella protothecoides
MMQEASVAADDSLRPGPVPAEEPGSPDGVRAVASDKAEDVPDDKDFFSCNICYEVGHVRRVSPLGVHANPEFSLLTWPCDLTTGPVAAPTAQTAVNPVVTLCGHLYCWPCLYRWLQVQRHSHTCPVCKAGVDESKVVPIYGRGREGVDPRTQTQPREPTKAIPSRPLGQRTPPVVRAAAAEAQQAQHGMGLMPALFGLQPGAGGGSEPLTQEQQHQAFLSRLLLMLGSFVIMCLLLF

SEQ ID NO: 14159 - protein, 144 aa, Chlorella protothecoides
MGRVASPAPRTSVPPVLRACTFTRNPDTEGAGGRGDAQREGARKGGGQAGEAAGEPNRADHPSSRSKPAAEASAAAHYAAWPVKELRRFLTERGQDPRGIVEKDELVARVAAAAAEMAAAVPTPPQGYVYDPASKFWYSAASGD

SEQ ID NO: 14160 - protein, 197 aa, Chlorella protothecoides
MREGYPNLFGSQLGNKLLYTWLGAQHMLSIPGSDLSDLVQVEADGKPLELPAGIQGLMLLNINSFMGGVDLWATSSEAGLEQTLQPQRLWDGKLEASGGKGGWEGVLPHTRLPGLESRQDVIWRACRSNDGILPPNPFHPSPPHSKQLAAVFGIWHLGKLQIGLDSAIRLCQCSELSITLTKSMPMQVPGLGHWPRS

SEQ ID NO: 14161 - protein, 247 aa, Chlorella protothecoides
MLSCHPGPNARPPPRILVPLSSPKAESEAPSASDPQTFLLAQASPVQQSPIHLCCPRIHPLFLRGHAKSSFRAAQALEAMQDPRAAVVSLRECLSRQPGSDPAKALLRRLQAQLSVQCQAPGADELRRAACVTPPTGWDWRYMPSQDGCSQNLMLMLHGLGDSPEPYASLAQSLKIPQVQLWIIAQGERGALVEGSGTDLGPGSPLATPSALCIPRQTSWPSGDHSLSLSRRTDGAGMMHSTPTSRS

SEQ ID NO: 14162 - protein, 185 aa, Chlorella protothecoides
MQAVRPPVPCRVSPSWRARLRETLPTFAWRLLSPYGCTSRTRKGELQASPDTARRSYPGTVTRCHTSLATGSDRYLLLEDPETGDVLMPLIYMKALLEANYSRKLASLKHRVVTCEQGGCWAGLDPSGPLSPLTMSKLWFARSLVKRTPPREWMALAVESQMHMTMVASRFQLANRAFAGALAAP

SEQ ID NO: 14163 - protein, 218 aa, Chlorella protothecoides
MLRSLGLFKALHRCGMGLERIRRGSRCPIPPPTPTPPGHTACARGVWAYGAGVRRVLLQACPQTTPPSHRRCRAMKQSTYFPLLRPPPDDFMEELDAELAKESVQPPLFHGPRTIEASASKYMFMFQVGLRERETRSRRAARRPPGCPAPLPGGPGGGTACSATPPSQDSDTPYSPAGGRGAKGAGHQAALHPDRHTAGEGAVGGTDGALGAGVAHVG

SEQ ID NO: 14164 - protein, 242 aa, Chlorella protothecoides
  MOD_RES (45)..(48): Any amino acid
  MOD_RES (135)..(138): Any amino acid
  MOD_RES (217)..(220): Any amino acid
MLVGGTGAAWWWWEEGWVWRMSSVCLVHRSIPPTSMQTHGSALAXXXXWVGQAQPGGGRRRVGCGACHWCASSTARFYPCSCRHIALRSHPSPPVSFQTPLSTGLRVAAGAQGGCPGADIAGGPGAGRHCALRHXXXXVRRVAVQVLTSLEALVRAGIVHCDIKPENIMLVDRKRSDVKVGAPGRPCRVDIHRRPATGCPYRDLLLDDNVPFPNATXXXXGRGSGTAMPHGHPSPAGHCVPE

SEQ ID NO: 14165 - protein, 230 aa, Chlorella protothecoides
MVSLYDSLDTEIEHAAWPFRVQVPALLIPPLQASSAGKQRIAGLESVCTSLRALIVRHLFEKGAWHPSQCHVLGFSQGGTVALELTRLLEPGLGLGSCVAVSAGLLPEWLHAHSKSTEVPRERSEQGEGVSRVMLTYDPCDHVVPEREVLATKAYLESRPGRYEVQARPFSGRGHKFWASREEGLAIVEFWSQALSWRPPGSVSDADSTFVEIRPGTLQDLGPNAWHGPL

SEQ ID NO: 14166 - protein, 204 aa, Chlorella protothecoides
MTETGMILGNPLCGERRVGTTGRPGQQRCGGAFVRRAAGRALAAHRGHGSTSALLLLPDGAALAAWLAETLCTVHRLGWGYGRACALGDPQRPTAIASPHTVGKEGEIRVRGAQLFKEYWRNPEATRDAYDDEGYFQTGDQAVVEGDPPYYRMLGRSSVDIIKHGGYKVSPAPEASRSSRVGSGGAGGRCGTEAYHQALPLHAL

SEQ ID NO: 14167 - protein, 284 aa, Chlorella protothecoides
MGSSHLLPPPSPCPLRRELKYVLNDSGASAILASPSHFERMADLGKALGTTVVPVGRPLTHGSRPQQGSQGLKHLLDNVAPEDSALMIYTSGTTGRPKGVVHTHRGLHAQTSALIDAWGWQAEDHILHTLPLHHVHGIVVAMLCGLQAGAAVEFMPRFSPSRVWERVQVRVAAFGRKPHAHASKELRGEKSARAVFCPDLRWDGRVAEAKRSSADPVSIFMGVPTMYAFLINAYEGAPATSQGGMREAARRLRLWTCGSAACPKPTLAAWAEISGGGARCGGGS

SEQ ID NO: 14168 - protein, 174 aa, Chlorella protothecoides
MPGEDEKEQLACIMEVLGKPPSDIALYSARAPIFFDPGEGGGRQDGASKGGLVQGGTPGRLGTGVLTVASHVDGFQRRPQSPPLPISRAINPCVITPALPCLGPRPAESGEPRSTTLLGKDTLHRPGSVTLTRALGGVVGRDASFVRFVAACLRWRPEERLTPAEALRHEWIAG

SEQ ID NO: 14169 - protein, 993 aa, Chlorella protothecoides
  MOD_RES (222)..(225): Any amino acid
  MOD_RES (570)..(573): Any amino acid
  MOD_RES (857)..(859): Any amino acid
MHPAFSSAAGTVHSQRRPNGLHMRVHSSKHASKSTAVEKVSVVAGRCSLPAPNSRSQPTPSPEPNVKMEAMVHEYFQRVLTRADGDTASRILHPSVEHRDMVRDIGYQGVREVLEYVHQVKKSYPDLWVEATEFGPAEGGQAIFAAFEGLATEKTPLFKGIDLFRFNDDITRITEVEAPCARLPFTQCTGATGREPRVTKKGRKLLPTGPTATPLPTECTSXXXXGFRDHLEYLNDRCAADMTAAPLALTSNRSRSGVASRRHRIRYRHQWSCKGTPVGAPVTILTPMATFKRIVPPSTLYSGLSAWGALSAPRACSVRSVHWNGGVPLRRSRGCDQPKPHKQGVSVRAYKPTDKLQDWRVQQVRSGWDNSGLLLEKLGLHLPFRLCEWLTDEVLRAHQPRLPLHRCRIADGGPREEGWQGLSLGGMVIGRSAAPIPPSHPHKSPGIAWQDPAHPTVGVHGMQHYLHDLRTAFPDFTIEIDQIATCDMNSLMVQYSGTATGLGEYHSHKPSHHVSAFSGINLVRFNHDRSKIVEIQGMCGHCIVNTSPASLGTFCSSAHKSKPHPRLRQXXXXVLPLHCEQFPGLSGHLLLLRSRVQTPPTAETVYRSAFAEDRLELGERELHGEGGFRELRLRRLGTSPCAALGSGVEPWPRSQNKRPAGQANRILTAKSTGQVPVGAAHLVVPQRHLRSGPGLPPRALATPPPPPPAQAVHGLLGLLLARHMRPALTRRPAVLVAGASLDSLRGSAPPATIVPGRRGGIRRGRSLRPAGAAAAMSGVCRPCAGQHARHRPHRICAEERGREGRRLSLRTAQPPHAPKPLCSHPCARGSGYPSHPPPCTERRRPAARGAWPAAPPXXXAPRILHRALKSAGQSRAEPGQRRHQAGVDAESEPLVHHQAGRRGARGPATNPVVRLALAVLVLAFLLLRQLHRGGHQQQGQGRHLGARLDVCKGARMGGVARAGRGRAGTQALRCSTRALQSRGSPAFAAALGI

SEQ ID NO: 14170 - protein, 61 aa, Chlorella protothecoides
MAAAGRGRLETLRLLLAHGADVTARSQDGSSAAGWARMFGHADVAAELEQHEQQVNEGDHI

SEQ ID NO: 14171 - protein, 176 aa, Chlorella protothecoides
MVRVPGFTHPVEDFYLEEVLRLVQYQVPREAQGQRGGQQHAWHKARPGRGLGLGTAHAQDPWTARGGKRMDLLPVRCFVQGLCLLCVVSVCHEATPHPQGCSSSHRINHPLFVPPQQVSRAQRAAVQAAVEAAFKDDSDAAFEHLLSTLGLGMDGDGAVSAHVLDVQHEATGGRAG

SEQ ID NO: 14172 - protein, 443 aa, Chlorella protothecoides
MVLIGTATLTGSRYGNLNQDFVVSAWERRVGGTGRGRNIPAMGVGAWEANSMSMNCFLPGRCRSGLPEMSPAPITSHGLVHVRVHSGIRASWSTCAPHPGLDSIPPRPDPASHPLPFSPLSNPPPSPLQVVEQLLTARQMKALKLPQCYVAAVLDGHGMLGEDASREAGRAIAASLRAAPALHTRGLAALSDAEVEALLGAAFQAGHKAALGIAAHAPGVYTYPRGARGAQTYVLKSLDGGDKAYIDPHLGARILEYGTTATVALVQGRALALANVGDSLAVVGREEGGAYHVDLVSTRHYGADPGERARLAAEVGDAVAVESEDGYISVREGRMRGYQLAMTRALGHRLLSKLGVSQAPSVVRRTLGPDDLCLILASDGVWEVFSPSEAVLTLCDHLAAGHSAPEAALDLVRTAVEVSDGTNVDIGADNTTAAVFVFDDLLD

SEQ ID NO: 14173 - protein, 115 aa, Chlorella protothecoides
MGEGSPLATRFPLDTGNHPASRLTSRCQAAAAAAISQTALAVAQYQSETDIDEVDLDLILRLLQYICGEGPFSNPQAQKDAQPGAVLIFLPGWDEISRLKELLERDQAFRRTHSG

SEQ ID NO: 14174 - protein, 80 aa, Chlorella protothecoides
MAMVDGMRGQLASELQRLGFIRDVGEASSSAADLGLVRAVLAAGLYPMVGRLLPPTSGRAMVMTRRGEKVRIHPSSVNAK

SEQ ID NO: 14175 - protein, 194 aa, Chlorella protothecoides
MAAHRAELLAAVAAHRVVLVSGETGCGKTTQVPQYLLEDAWAAGRGCHVLCTQPRRISAVSCAERIAAERGEAPGVNVGYNIRLESCGGRDASLLFATNGVLLRMLSSGADALAHVTHLVMDEIHERDRFADFALILVRDVLPANPNLRVVLMSATLHADLFSGACRDAGRGLGLVPECVREGPLSPTQGQACL

SEQ ID NO: 14176 - protein, 241 aa, Chlorella protothecoides
MFGAIAGGIASALAGGAMSKLFGGGQKAASGGIQGDVLATDNNTVGMGDAGIKSAIQGSNVPNPDEAVPSFVSGAMAKAGKGLLEGTLQAGTSAVSDKLLDLVGLGGKSAADKGKDTRDYLAAAFPELNAWERAGADASSAGMVDAGFENQKELTKMQLDNQKEIAEMQNETQKEIAGIQSATSRQNTKDQVYAQNEMLAYQQKESTARVASIMENTNLSKQQQVSEIMRQMLTQAQTAGQ

SEQ ID NO: 14177 - protein, 130 aa, Chlorella protothecoides
  MOD_RES (110)..(112): Any amino acid
MPSPSQQTLLMAPLEAACGENLARWQALLPCGVRAGLAAALAPVARVTGAATWRSYVLALQSDGAGGAVMDLVLHLVGPEAGLQALAETRTRACPAATSSPALGPGVRGXXXCPRHRGGHLAVICARFAE

SEQ ID NO: 14178 - protein, 440 aa, Chlorella protothecoides
  MOD_RES (144)..(147): Any amino acid
MELVLHLVGPEAGLQALAETGTRACPAAATNSPALGPGVRGPPLLAPNFVTTAARVEAWSFVTHPSPTSGRLAATVRAVGGALGPGRLHVVQLVPRALRVVDAQTTLLDPRPGLHTLWERHETDEVSGDALLEVEVEVPAGMAXXXXTLWERHETDEVSGDALLELEVEVPAGMAASTHGTATPLLRLDCWFDRFILPVGDYPADASRGIALPGAIVTWTPHVDGAPCADSICSAAAHQVSAGHALVALPIPDFSMPFNVASFTALALSLIFASVLSVLLRWVLSTGVGGGDRGKLIPVVASEVLRGCTAGMRTSPSTANSVSGRCSGQPGNRPFRAGSGKGPGPEAGPGPAAGRRAHHCIRPRGPGGRPAWMDLGLSVQCPSHRGTSTRERSLGETWSTQRQVYQLHVHLAPPTSHASCSIVTKGSETRVCSMDRSQSA

SEQ ID NO: 14179 - protein, 107 aa, Chlorella protothecoides
MFFVTGSVDENEIILHNVLTGFVEAIVLLLRYECRASGDQMTLVAQQLHVVFASSAIINPACSARNAVEKKTVLENLDLILLAMDEIIEGGEREGQRSWQATWCAPL

SEQ ID NO: 14180 - protein, 129 aa, Chlorella protothecoides
  MOD_RES (95)..(98): Any amino acid
MNDIIDVDPTLPVVKNVLLMDNEGKRIAVNYYSSEWATVQQQAAYEKSLFAKTSRTNARGEAEIITFDNVVVVYKFVGDLMFFVTGSVDENEIIXXXXPHKCSRRRCAVVLISPVEDILLGLTGWQRVS

SEQ ID NO: 14181 - protein, 229 aa, Chlorella protothecoides
  MOD_RES (62)..(65): Any amino acid
MPIHCCLLVPGGLRHSNCVSVGTVECHLGEPWGCSRPTRAPRATRCRYQGHVSAALVLGGVXXXXNCLSVGTVVCHLGEARGCSRPTRPLHATRCRYQGHVSAALVLGGVDFKGPHLFTTCRHRTPPPSPPLQIYPHGSTDSLPYCTMGSGSLNAMSVFESGFRDDMDQASAVELVTRAIRWVLQGLCGVKCAFQWCQGRRVYSPGARHRSWSARRGRLPGSLLVPEIL

SEQ ID NO: 14182 - protein, 271 aa, Chlorella protothecoides
MVLKKIGEELEEEFAAVVDFLGREQGLLVVVEDSCHECLVRQGLGKWILPFHPSEAFGLHRAVDFIVSLGGDGLILHAAHLFGTTIPPIISFKLGSLGFLTCHDHRDYRRHLHDVIHGCTGCGQSRGPCYWAVGEKQELLGSGLWYLFRERRGVCSSAHTFLAVHCPHPFTSQELTECGPIKNSSGVALQGIPITLRMRLTCSVDRADVGEGPPPSEDCVEVLNEVVLSRGANPYLCNIEVYERDNYITQVCRGVWRRGGEGEPAAMEVLA

SEQ ID NO: 14183 - protein, 229 aa, Chlorella protothecoides
MIEAVENHMPQVVIVDEIGTAAEALACRTIAERGVMLVATAHGQTLGNLIKNPTLSDLVGGVTSVTLGDDEARARGSQKSVLERCAPATFPVVIEMRERARWVTHWVEESVDCLLAGRTPMVQLRTRDAQAGGVVVERARYDAGDGLTGDSGPNPLAQGGPASLRPGAGAGGAFDAMFGAGVARNGLPRTAGVGAVEESRAPDPFAWATRLREVPDEVSRGCGRGRYGS

SEQ ID NO: 14184 - protein, 243 aa, Chlorella protothecoides
MTAESLVDEDGSVIVRDDLEELLKVLPPDLRGGLCQHPHRASLLEVVLDLGRRPEARFLNQAGGEVLRERPVVLDLGRRPEARFLNQAGGEVLRERPVDRADLDRAMAAVGEFGGDNRAGITGTLHRISAIRNRKGSVVGLTCRVGRAVTGHMDMLADILQADPTSLLFLGRPGVGKTTVIRELARSLADDHARRVIIIDTSNEIGGDGDVPHPGIGGARRMQLSASLGAEQHVLTRYDQCLS

SEQ ID NO: 14185 - protein, 230 aa, Chlorella protothecoides
MAGAPSRHADAGSCRALAPSSDSPAPQPMPPPTPYPNQVQADGILVATPTGSTAYSVAAGGSMVHPNTPAILFTPICPHSLSFRRSAWHAGCAVGGPGGCGAPVSVIARHPLLCSMRCWIWSPLTQALGAALFRANNRPPTPVILPDYAVLRLRVSPDARCAAQVSFDGKRGTELAPGDSLRVCMSPNPVPTINHADQTTDWFGSIERCFHWNDRLSQKGLAQAQPPTRP

SEQ ID NO: 14186 - protein, 277 aa, Chlorella protothecoides
MAIGLRGRLSRDGLAALGSFENVFDLDTLQKSCAALKAGLRKHVSNTKYAGSCGEEGQAPKARRRPPPVRNPSAQQTAVGLAAFAHIIFVTGRAQWLTPTPASIAQGHALLQSPAQRTMTPPLPPCCIRAGAAPWALPRVFFAFLAVAMPWRFYDFVFRHRGYNLFYLFDFCYWVNAAVAWYLAGGAAGWDLPHLSAALYSLADGPVACALAAWRCRWTFGSADHTTRYVFCVCASNGVPSGWVGSAAHVHTSVQPAWPRLGRGRSYLVTVSACGES

SEQ ID NO: 14187 - protein, 348 aa, Chlorella protothecoides
  MOD_RES (144)..(147): Any amino acid
MDLQKLHVPGYVSCYVAGVVVMSLLGQDGGQMCWTCYHPGARDAIGCTPVRVQLQPRAGPPAPLPLTLGAATKPVVEPNLWPFLQTTGMRDWRGWAGDQMVVSSHSEVCSPCQVIKRVSDRRQAPSYWETRGEPAPLKCQTVQXXXXVGMGQTAANRRFNPFSSLCRQSNYCTQYAAAYAPPLPGSENIRSPLRIKNLDAEDASLKAMYSAAQGRISSQQLERIHEHLRERLSGKLGSHGGTAFKLRKVRTWQSMGRRSGIRLEWEIDQEGTRRCDEGGHAVLWDKDGHLPHLFILTPSPGLPWRRLRCAAQANINACRTRPPTEHFPVPHQVRSMIQSAKVASSTMI

SEQ ID NO: 14188 - protein, 389 aa, Chlorella protothecoides
  MOD_RES (76)..(79): Any amino acid
MCHHPWTPRNPLSPQSGGERHLLCDAAMLRSRRGSGDRRPRRRASVRLLLSPRPHPARLPLGRPRLLGPGRGTKLXXXXELASACSSAPALTLFDCHSDAHGCWARAGVQSSPHAIPGTLAAPPGLWAGRVASAVAAGPAPAACVVDGLDGWVGAHGVRAVLSLLADLARSPGVVGLLARLRPGAHEERACALLRRAVHAEVALLPPPPGAGPEALCVALCATPRARAGPRVEAVAVSRAGQVGEQGKPGQGGASLMYAPVTTATAPGPRVGEEAGGQGSRGEWERVGAAAACAIVTGGPEAGSCSPATDAHEEVRAAVPSPRGWDCCSPVHAVPGQAVRHPARRRPSPSRQWWLTAPPFPSLTAQAPACEQGWRPGRPLPQAQGWRGG

SEQ ID NO: 14189 - protein, 312 aa, Chlorella protothecoides
MRGWTTLVPLLRDVVARARCAGSLHAAKLDIRAFTSLSHAAPLGAAPPAVTGLRQCFITPHRTSSPLPPIEQLAKAAGSAPGLASWAARGALAAAPSPPHLLHGLRWVASLAGPGPAAATPYGAAALTAGLSAAQRRWLALWLGGCSAWVAVLVVLGGVTRLTRSGLSMTDWKFGGERAPSGDAEWEAEFARYAASPEFRRVNSRMTLDEFKAIYWMEFAHRYWGRGLGLLFAGPALAFAAGRAVTTPLARRLALLFAMGGTQGLVGWWMVRSGLEDPADPHAVPRVSAYRLAAHLTSAFAIYATLVWTTLD

SEQ ID NO: 14190 - protein, 134 aa, Chlorella protothecoides
MTRDRDDGARAPPGEIASPPWNRQGDLQMLLSFSVPDMKNRKKKPRSPLCCPPPRAGQRTPGGEDPPEDSAQESSLTAPLPSLPTMSRSAADRGCLVYVGNLPDDIREREVRRRWIDVSSVRVDLPPWPASASR

SEQ ID NO: 14191 - protein, 196 aa, Chlorella protothecoides
MAETDEGVWGEINRVGAPARGRGPLGVDNFIDTTNIEGRFDFSEFVRAYGKYLDEQLRLYAAVRWTCSAVAAGGPGAGAPGGESAAGYGAAGYGAPPGPADAQRSPGGAGRFRTLPAAELLHQLPLLQRLQRHLVDCVPRGAATHDPVALASFSVLFERGRMPGLGEVCLAWVQSCLPTVRRSRLGVAAVLGCLPT

SEQ ID NO: 14192 - protein, 77 aa, Chlorella protothecoides
MSASWQDLKDHFRKVCTPSYTNVIRERGEAVGVVEFDNEEDMDRAIRKLDDTEFKNPFEKAYIRLTEEGGRGRPAGG

SEQ ID NO: 14193 - protein, 513 aa, Chlorella protothecoides
MYWPGKDAPAHQSHEKKARIAPNSPPSQQAALDAVVRESFQLYKALSEGVINLADAYFSMPYLQAGGVPVVDLRCGLLRVVVCWWEVGWGLGAGPAARCIPVPAVAVHDPAERPIPAQNLIPFSSPPSPHTVKGLEIYREASAGTDALSAFYAAVGQLGGVSAARSLPSLTPPPADFVASMEEYLAEAPRPEGEAALPKRPSSLSISWRASWGGVVGAPARTLPRDKEAAQPPCPDPSLSSSTAQRSGPLRKGRLAHSASGRAGEGGAASHPRTLSSDPGMVLAPSQEPAGGEEGPDGGSGGGLASPGGAPGSPGAGTGPPRERDLLGSDPGTPARTPAHAAPSPLDLLGGLTLEGLDAPPHASANPFAGPDPFAAYGAEPGHGQPTRGADPFALPGAQHAFGFGAQGVDAAPWQAAPPGAPPGGRPPVPPLDTSFFAGLSNGAPTSSPAVLSPGGTTRWTQGAAGTPQGGGEDLGGGEDLVRAAGARDPFATLTTLSPGSSGRMPSPGGGLL

SEQ ID NO: 14194 - protein, 274 aa, Chlorella protothecoides
  MOD_RES (58)..(61): Any amino acid
METLPQECCLGELEEVQAPLSIPLSSVCGIHSTWIAGTCSRDPLNLSCPHPFSDSQYXXXXNPLVICVRHSINLGRRNLLPGSLQPLLPTSVSRLPILIPEFDTSRRIGARYSSVQRHQRRRRCARSRRPHGAGTDSGRIGPLCIRAGFGGAPLSGRQRGWSAVSCDHEAEFGLLPRESRVGRPSPQRGAWGKAAGYAEGRAMGVEQGFRISYEVAFYSGCLSQWHTAGEHGGRLKLNPRVLRHMALLEDLVRSFPWSDAQVRGWGSRLIQAPR

SEQ ID NO: 14195 - protein, 570 aa, Chlorella protothecoides
  MOD_RES (380)..(383): Any amino acid
MSIQTTHFAACRPCTRPGICPCSPIPHEPLHAGPARRSRVGSYPLRAVKRRVEILDEQAIDNLAACCDDFVCTSSPAVENSVRTLARDIQRADGSWTRRILAPDVVYKVMVQRDRQDAAGPWLRVCMNTMEENADSAMHGRAVCAPGRLMHLSASATGSFSCSATVLTAWASSPRPFLQDNFRSFKGIQGYDSLDFVPNIVSPSRVTIRRMRMLRQDLAVVEWVLDGRLGPLSLSVQGETEAQLNLLSGRIVEQRESWPGAPLPWTLARALWSVGKKTKDTVRGGKAAINSALDQEGESQNQFQGDPTDPTRFFMDQVCMGVGVGVLWASAPRLIVVGGVEGATVCLPWLCNLPASCYPLTASTRPLQTKNSLWNDMINXXXXLWPRCRNQRGQMHEGGHATWDRERWGPRLGEPVSATSGLGLGCSVVRLSLVDVHAERKDCITREHTSIGTVGRMCCDRGYGSLGTGAGAPKPVGGYPNDTPPSDALRPQQCIRQVGTAHASPNCPAMVLSRALPSTFCSRPRTQSLSAPPAARNQAGGGFAPGAVAALMTPAMRAATWDAGCTPLEF

SEQ ID NO: 14196 - protein, 346 aa, Chlorella protothecoides
MYAGSYPLRPGPGLATTAGPHGLDIPTPPCWGSERVRGPPNPPTSPTRNRASVCGCSTSACDAASATASTTPPSCCVAAGTPVSPGPGRVCDQGSAVHRASACCGIPTTSYTRSHSHHAAVCASCIRGSLDFQEKAGQPACPGCRHPCDARDLLPCHSLREAADRYRRARGAILDLLRPVPPPRASSAELEGAPAPPPAAAPGPPPPAPQRMRTRSSSKSSEAEAGPGSRGSDGTASPSASSSSSGSEWDVDPAAVSEADSSPAKGGRSGGQVPCKRQRTGAGGGSDEVRCVTGSDPEHSRNPGLGGPSPPESDPPKVRGRGRHGSGARQGAGVLFVGHRLEERES

SEQ ID NO: 14197 - protein, 86 aa, Chlorella protothecoides
MPPRPAVWPLQSPSPPGRPEAPQIAAGATDAGAQRRCIRAELVRWHPDKFQSRFGQRLAAAEAVGVLAGVVALSQSLNALAAGVAT

SEQ ID NO: 14198 - protein, 100 aa, Chlorella protothecoides
MARDARGNTPVHLAARGGHLEAVAALLAADPPPDIFTANLAGVTITAAINAAMAAQDRATDASPERSGGKADDGASRGWEGGDAWSDRLAAELSGDEDDP

SEQ ID NO: 14199 - protein, 180 aa, Chlorella protothecoides
MAARGGGLVVNIGSVSAWLATPYAGAYCASKAALHALSDSLRLELRPFNIQVTTVTAGAITSSFSNNAEAGQSGERFSNNAEAGQSGERYERPGSLYRAHAPSIRARARMSQNSKGVQPASQVAARIAGVINAATAPGAKPPPAWFLAAGGALKLWVLGLLQKVLGRALDSTIAGQFGLA

SEQ ID NO: 14200 - protein, 112 aa, Chlorella protothecoides
MKEINSRFGKNSIMLLGDNKFGEVRTTPSGALTLDIALGGGYPVGRIVEILGPEASGKTTLALHAMAEVQKRGGAVALIDAEHAFDPLFAKVVCFSMGKGRGGVQIGWLRMV

SEQ ID NO: 14201 - protein, 145 aa, Chlorella protothecoides
MSLADVTANLRAPVETATDNKPIVKVHAVEWAKIMAGEPVEINPSIGHGYKVMSVKEWAARWKPNEAYPECLTWCRGKKKWESETLCLDCHSFTKRSYCDPDFKTPEDFEKERWQAFVGSCSSEPWTEHVERPCPPRPYALVPRH

SEQ ID NO: 14202 - protein, 298 aa, Chlorella protothecoides
MALEVADSLMRSGAVDMVAVDSVAALVPRAELEGEIGQTQIGSQARLMSSALRKIAGNASRHACTLLFINQIRHKVGVIFGSPETTSGGMALKYYASVRLEVRPKEKIMADGEQAGIKIKSEALAMHAPCYTPLTPHRHNPNPNTESPPRAKCTKNKVAPPYRIAEFDIMFGSGINGAGCVLDAAEKVGVVIRRGAYYYLGEERLGQGREKTLETLAERPELLRAPHWLPSQPSNPTHSSTPCSHLEEETRQVLTKGGHAVGDAFGEASSSEEEPEFLSEADEGEAEAGGLDAEAVQP

SEQ ID NO: 14203 - protein, 145 aa, Chlorella protothecoides
MVEIASSSQDSLLAKVVLVSVGLQARGSIAGGGLGQALATCLHSQTTPDGRTLYKVYATARRLKTLEPLADLGISTLALDVGSEASVKEAVATVLSQEERLDVLVNNAGISKFGPLAEQPLSEVTAVFDTNVMGVLRMTQVGWLG

SEQ ID NO: 14204 - protein, 478 aa, Chlorella protothecoides
MPAGPTPLPARTLPGPSPSASRGALAVGRMLVGPGILGLGSGGTVVFEGSLDGRPVAVKRLLRQFYDLAASEIRTLILSDEHVNVVRYIAMEEDAQFCYLALERCAGSLNDVLAGGGTCGEEEGRKAGWQAEATESVEGTDGALPSPASHHRRPRRLAAADFWDAATGTPSALALRVAADACRGVAALHARGIVHRDLKPHNILLTAAGCAKLSDMGLSRRLVPDQISFETLGSGGMRGGGGGECVAWASMFGWDRDIKQPALLLQTCSTHALPAARPPQELALASTRPLFRSIMISNAHTNTGGSSGWQAPEQLAARDGQSARQTLAVDVFSLGLVGQHPFGSGVERDANIFHSSLLLKLLAACSPSHPRHYLQGKLRMGRLESQAIAADLVRGMLAQDPRRRPSAAAVLTHPLWWPSAQRLAFLIDVSDRVEGEDRVVSCDCYQRMGPASPVRVCFPGLRLGVVLLVGIWMGGAPG

SEQ ID NO: 14205 - protein, 275 aa, Chlorella protothecoides
MPASHHHHARSHHAAHCIIHWASLREQGDACCPQCKTPFSEIITYRNLDGTLQDFPVQNSVCLLKRAAWFKDRAERHTLPPEDGAAPRRERSWADEDAYDLCNDDDDDLEAFYFSSAAGRARVTLGNRRFGEGGYIASGRRQARPAPSSGKVRSGSSVHRGTLGGMLPPHTHTPRRSPCPQNPQPHDLPLQGKHASRQPCHGASPAPAPSAAVAVPARKRLDPGSVSPGAPPSWSGASPTPGQQQPMGSSPSGTGRRARRNARRAALDADVIVVA

SEQ ID NO: 14206 - protein, 139 aa, Chlorella protothecoides
MSIEQVQVSAHAGAEWVDSAGFPRLPRLSLGTSNLPRSPCGRSSGIQSHTTEEIEVRLVHHIAGTPGYKERPSWATTPLSPAPPVIWDALRAAAEADLRTAKLILQSAGIVVAAPDMTTYYDERGECTGLLPPEAPVAL

SEQ ID NO: 14207 - protein, 143 aa, Chlorella protothecoides
MPVWRGAPGPGMDPAEVAQGRSSSAAPQQDPLGPQGGRDAPAAPSTAATGPLPLPPKLVPGLVSDKALRAMLKRVGLPLDGRRADLVARYGRLRREVEVSNDRGERATYARLARRVVAAERQVAAATLLQGGGGEGGGGAAPR

SEQ ID NO: 14208 - protein, 253 aa, Chlorella protothecoides
MYEALEGLGLLAIPSGSWAPALDSRLVNNLGKYRRYNYASLRDLLRVIRNKHSHFRELPLDLQERLGPLPHGFLAYFEERCEEERGWIVVEGLRMSEEEERKEPHRSWALTLDPVRTHRCISAPSLHRFPSLLLACYYFAVRHCSDEPVFAKYLTPDSAELVEKLGPPADLRRTLPVLLSPDRPPFDPGLRAEAGAGWARGGQGGAAPPADVEGELPRRPGHAICEFYTKTGGCEAWGMERRWVARQGEGTTA

SEQ ID NO: 14209 - protein, 67 aa, Chlorella protothecoides
MPETQLRVAMACEGCAGAVRRVLGNLEGVEKVDIDLAKQKVTVLGSADPNTVKETVAKSGKKTEFWA

SEQ ID NO: 14210 - protein, 355 aa, Chlorella protothecoides
MVIDSAWLETENVPRRSGLTLQQFREEYELPNRPVILTDVVSAVSWGGVWRTAVCLGWDQALPLTPPHVPGHGAMAPDLHPPHSQPLVHVQVTKWPAMQKWGREYLAEKLAGHSVLVGDAPMSFEGYCAYADAQSDELPLYLFDKGFAERCPDLGADYQVLACAHGGGCLPGLAAAAAQHRHCCCHCRCWGLRASSIPILLPASNPCPPPHTSIQVPEVFSEDLFAVLGPGRPDHRWLIVGPARSGSTFHQDPNATCAWNAVVRGSKKWVMYPPHATPPGVRPSADGADVASPVSLTEWFLSFYEHRAAGGRAPAECVVRPGEVLFVPRQWWHLAINLEVGSRAECAECVGSHAV

SEQ ID NO: 14211 - protein, 214 aa, Chlorella protothecoides
  MOD_RES (181)..(184): Any amino acid
MGLSMSTIRLNPLEVVTPRSTEIIVAVECLKAGQKACTADSNGNIGSGNKGKNNFGTKNIGDDNIDSSGNIGPGNKGKNKFGTKNAGDDNIGNSNVGIANWESNNKGTSNCCFDKTGDRKIINDCSLLELLKYARVLDLPLPPSKKFPPPPAKNSPPPPAKKPPPPLSSPSCPPPVPLLHXXXXRATAASTASEIAKSSPPPPAKKSPPPPAKK

SEQ ID NO: 14212 - protein, 380 aa, Chlorella protothecoides
MQDASACGLTPAWTATFQVGVLLGPRAAAGTVHALLLRTAALLGHRLRDTVDLPALLAAAPEAAQSRLAAAAGACDAWRRGYLATRAELEAGGQTGRWEHDRAALFAGTDHAAGACRRLAGALAGVHGVLGLLGADLESVAGAGLDRLAGLRAEARAALGALRDAALAAPPGDFLDPGSAGRWDQCLASLEAAGKSLAAGAQDLLDTSLTRCPGAADGARLLGKLLRDRHAGVALLRHVPEKVTDLVQTFAAEVRRNQADERGGGGDRLGKPVQGGGMEIRVAEREADRWCEGGAGNRTPYPGLSALTSTLLRVSATRSRLEEAATAIQASGEALTPEDQGVMAACAGEWAQLLEISTGLVWRWRAGSGTVPQPVRSRAS

SEQ ID NO: 14213 - protein, 252 aa, Chlorella protothecoides
MCLYCHITAGEPRCAPLLQAIAAFTCTAKAVACAASEMRRALRALPRETDWPGEGTDTGSRVIDHAATNAGLGGSVRRGEEAAVAAAHSLQATLVRIEEGVLGTSTGSARSMAAYYEHWERRLQDALADCAISWIEGLTSRLSGSCDDTGRTIHVQVWDDEDVGCERSCTHRDGTSMSTCPRLVHPQAHVALVHLQMELQPQQGLGPLLAWQPRPSLVTEQLSALVTRRAALGAAVVRWIPGTCTPCHTQPL

SEQ ID NO: 14214 - protein, 155 aa, Chlorella protothecoides
MDEDVSLPRTTIQKAVKGALPPGLRVSWDAIDVLTSCCNEFVHLISSQANVISERTKRSTITPDHVIQALEELGFETLVGPVQEVLVEFKGEQRQHQGRIGGRKAAGKEALSKEEMLLLQQQLFAQARERTLSEPSPMEAGPEGGGGEGPEGASL

SEQ ID NO: 14215 - protein, 199 aa, Chlorella protothecoides
  MOD_RES (49)..(52): Any amino acid
MLRHAGAGLLFSSSQKVPESWSALQRCVDLARCACPNYSSARGSGTPQXXXXVPESWSALQHCVDLARCVCPNYSSATGSSTPHPSEGTTVDPFTQKLQQKTEEQLRQLTEAPTYAQEGAVEQGPRPGVSVNLLVTHRDSGGSAVPSMLEGQSHWRLLQPHTPLMPNTQNQPEGEEGGPKGPEPTRYGDWEKAGRCYDF

SEQ ID NO: 14216 - protein, 252 aa, Chlorella protothecoides
MVRDGLTEKVSQERTVKLAFANVGTLPPPVLQFSNVKFGYSPDAVLYSDVELGVDLDSRVALVGPNGCGKSTLLKLMTGQLEPLDGMVKRHNHLRIGQYHQHLTELLPLDVSALAYMMAEYPGVSMEEMRSVVGRFGITGAAQTLEMRKLSDGLKSRVVFAWLARRTPHMLLLDEPTNHLDIESIDSLADAINDWDGGLVLVSHDFRLISQVAKEIWTVQDGRVTRWEGDILSYKAHLKTSMAALAKRSDLG

SEQ ID NO: 14217 - protein, 64 aa, Chlorella protothecoides
LAAALARTREFGAAEAAHRAFVRDLVSRAFLDARPLASLVQALMEAAARICALIQVGGGGSGGW

SEQ ID NO: 14218 - protein, 308 aa, Chlorella protothecoides
MAPGSAREEAPLLPGQPPRAGHGVDGIVDIDLSRKIHRTAPLGVPASLLAGTLYCIASMSMVGGTDPPLPHGFPHPWPLNQVLLNKVALSSFSFASPNALLFFQCALCVVATRACHAAGLITLEPLSARIVRAWLPVNLLFVAMIGTSFWALASLNVAMATVLKNLTNLFTLGGDYVLHGRTYGAPVLGCMALMAVSALCSALTDLSFNARGYAWQMANCAATAAYSLALRGTMDKIAPLTVSGRKMDEFSMVRLLLGRGDQRRGYAGEMLLKAAGVRGGPGIPERVDVPGMSRAAPRDTPRGWQQGL

SEQ ID NO: 14219 - protein, 298 aa, Chlorella protothecoides
  MOD_RES (190)..(193): Any amino acid
  MOD_RES (222)..(227): Any amino acid
VLDAARRAAGPPSLALHLAAAEAHERRGALNDARAVHEETVAGLGPDAAGAGESDNDTKGLGLDQAQGTLAWVQYLRFCARAESLTAARKAFLRARRWEGLGWQAFAASADLEWAAAGGVDTVPRKILELGLERHLSEPGYVLHYLAFLRGEDSRTAKAPQGGEGGGKDMVAKGLRGPGVNFNILQRRAXXXXGGGKDMVAKGLRGPGVHFNILHWRSCRPXXXXXXHTTLRPRCRAWGRGQRPGAAGAGAARHACRARPPAVGRVPGAGGGGRHAGHAARRGGAAPRRAGRARTPAP

SEQ ID NO: 14220 - protein, 707 aa, Chlorella protothecoides
  MOD_RES (109)..(112): Any amino acid
MEEARPMQDLSQGPDAASRTLRIVCIHPPGPQRQAAGGGEGGRGTLLSACSRPGARRQPAQAPQDQPGPGHGEEGPVVGVVARVGRSGGLVFAGMNARMHAWLGDRLEXXXXAMARGKVSAFAGCTPMRRLMKRSPAVGSQNMAPALPGGNAPWRLLLYGVPIAGCVLGKPVRALPPPPPTPQRTHAHTLPQTRQYRARQLRISGYRAASPTRRAKLLAEAEGALRACMAMDPTDGRAYVALGKVLVSGKRFAEAEALYESGCTATCGANAHIWTAWAHLARLQGDLGKARRLFDAAIVASPAHAAAWHGWGQLERTEGNVKRARDLWIKAGNGASRGLRPCRQGEKSGMHVGSVPLVNETRMVGSPCELNCAKLCKGVFVPVRPWEIRLVCVNARTGPFPPSSTQAQGKSSQALWHTWAALESRRQPVDANRVRALYRRGLQAAPGSRYLLLSWAMWEKAAGDVEAARKLLEQGTQACPRDAALWSAWAKLEEQQGEVGVARELYKQGSVADPSHLYVWQVGWGGTVWSPSGNDGVAGAPSLSSGEFACTIRPHASLPPTAQGWGCLEFRQGNNDSARALFQRGISMCPPRAKSAAHLFQPWAVLESRNGNTRLARELFKCAVKADPESSPSWNAWADMEANLGALERANELRNFSMQERREVVKPFNFTTLPKAGTFSSMVAKLLGREDLNDVIPSEKNPDMLFP

SEQ ID NO: 14221 - protein, 687 aa, Chlorella protothecoides
  MOD_RES (63)..(66): Any amino acid
  MOD_RES (172)..(175): Any amino acid
  MOD_RES (321)..(324): Any amino acid
  MOD_RES (352)..(355): Any amino acid
  MOD_RES (435)..(438): Any amino acid
MARISACAEVEAAWVTPRVSMTATQGEESAGYRRLNQTNSWSLWSRSGHGGDFGARASDRPPXXXXDKRQSSWSLWSCSGHGGDVGARASDRPPEVCLILAPDRLHGPAHRHACQSSHGRRGWHGRSLQRSQGEFHVWRCRTKLGHSRYLLTWSTCRAHKIWSVSIVLYAPXXXXGGAGRSLASRSRSAVIAMASAAPSNILMLGPCLSWRFGAPWKLSCSPIQAMHAPCPGCPISSYHHPISSFLHPGGTRFIGQYLARQLVEEGHQVTLLTRGKAPIAARIPDDTDESHAAYSDAVQHIAADRKDADAVKNALKGREFXXXXLVLPPSTLLRPAPRWNPFHRAVPRPPAXXXXLGVRAGGKQWGLYVTLPPPCAGYDDADVPETTCASSTSLQNPCHHVLVTAISAPRPFPMQLCTTSTGVRQRRQISSWRPXXXXPRCEGRRETWGVCVTLLPPRAGYHDADVPEPSFASSTSLQNPCHHVRVTAISAPRPSPMQSCTTSTGVRRRRQISSWRPCPPWSSTSTAPLRASTRPPTSCHTLRRTPGTPSPGTRSEGEERGVDKVEAPREYPLALAPQTRPWARLHGRFTKVSQPHAQGKLNTEELLEKRGVNWTSIRPVYIYGPLNYNPVEEWFFHRIAAGRPILVPGKGNQVTQLGHVKDLATAFRKVLGNPKAARQAYNISGER

SEQ ID NO: 14222 - protein, 215 aa, Chlorella protothecoides
  MOD_RES (115)..(117): Any amino acid
MRGIAPPVPQHVFGPFHGLTAPISELQSLAHATSLPRSRFVTFDGLVRLCAEAAGAPEPELVHFDPKAHDLGKAKAFPLRDQHFFTSIAKVWHRPYCKLSCAASSTDSSSSPPPXXXWGLGWVIVQQCCPGAEVHDLPKASPLLQPLLRCKFNRQLFLAPSQAQADLDWTPEFDLAAGLRDSYEKDFSKTGGRKKADFSVDDLVLKGAGKQAVPA

SEQ ID NO: 14223 - protein, 776 aa, Chlorella protothecoides
  MOD_RES (46)..(49): Any amino acid
  MOD_RES (138)..(141): Any amino acid
  MOD_RES (183)..(186): Any amino acid
  MOD_RES (367)..(369): Any amino acid
  MOD_RES (581)..(584): Any amino acid
  MOD_RES (768)..(771): Any amino acid
MVPRQRILLRSAKSAHEKNPVRNKTQNLASSWPRHVHAFLGRIGAXXXXGCQSQQAISRQGWSLIDESCRAPRRGQAVCHPPANDTDYIAMERPWTPKSSTHAPDYRSSTTLTPPSGHAGRHPVRSHPGFSGWLQPFXXXXSPPVRREGLESAALSFGHERRAGDSEQTAACRLLASMQHQLXXXXMFKGSSYTGLPANLISSAMALRSQPSGEAYWIESVGQSWQGLMGQVVGKMARLSPGRPGPYTWLPRRVPSAKPALWHDRLPSLIQPAHHSPTPAGWRSAAACLARAPTPSSSLLARGRGPAPLPTAPCAAPGPEAGPALRRRPPPRPCPASTPAPSATPSPPPRPPPPPPPCAPPPPNPSXXXSTASSPPAALCPAPTQPLMGQSGKGHDRLALATPPSALGSDAWRGDHPAPFGRCSMDWPAEEERCVAASRELDARMNSSRQTMDFVRARRARFAKLDRGALTVWQVLDALEDLAPGSRERALYTADAAAKLFPALPWMPVVGLLARVGEVLGHDRWDEEGSGKSGWWWGDKHACCASRVVAVRFYLEPFNVAGAQCVHRCILLYEQGFQRTXXXXPEWWLCDSTLSLSMWLAHRVSIDASYFIWGSEPSWLLHAESFPVGCRVRAAVAASAFAFTNPDRRRKAYSTPTGMYSTGCGLENVYMSWTGAEYLYMVLSLNGSRLPPEALFLLRGTDLVGMTTSGEVHAPMGYIVEGVVILSRQSQRNGPLDRLPARAEMARSRPESAIVSCLSRHPLPIPLXXXXSWKEL

SEQ ID NO: 14224 - protein, 1157 aa, Chlorella protothecoides
  MOD_RES (598)..(601): Any amino acid
MIRLSDAAAPAPRLPHKLGKSIWIPLIMLSLVSGRVVRGKGLAVAVVGVTGLGGQAMNMLASGATTRGLPCATRPLVSLVGWGDGKYGLACHRLFLLRGLVYCMDLIAILNRWTRIRFSMSSQKLRARDADGGRGARRAKQCHLSLTQHASNAQDFGARDPFPGEIATNFTEKSFGNENTEHLIKCDVGSEEAPVRPWTGRGLLHMWGLVSEKLQWGCFNQELRSHAPEYCLQKVLSDSPKHTLSCLSNRPPDGLASLVGLKNRKCLACEGGDVKPLTDSEAEKLRHQIWDGYGGDTADPRVLLMSSGKVPARGDLTQSLFIFKFPDLKERHSLQTHPCLAVPRLEIDNQRQGHQEQGILIDPLRDFVAAVLDVRVCSASSGDGAAHPAAQSLTTSYLSACHPLSRVAAVAEAEGHHPDLHLVGYNRVTAELTTHSANGLTENDFIMAAVVVASCCMLRIEWAEGMMGIFREGKGKCILTREHVLETSWLNYSQTEVQDAQISTLVFAGQNQRSGRRRPPAQAQAQCVCLPWISRCCKGTTEYRLHSEEHKGGSVQGEEIVLSGFDGAAIPSSAPVVRLCAIGRERPCTLAKWGAAWXXXXVSIAQRGAQGWVGARRRNHIIRILLALPYPAVLQSFVCALLGEKDLACWPSGVLPAPALYGRRLTQQPPFGAHMAPPQRQSARQTRLNVPTPPEGLESHPPQAPKSTRIHPSHQDRGWEGRASWTKRGTVVCPGDAVQASPAQGRRGQGWHRVAMTPNPQPPGPASAGSLACPREGGWAGRPGAPSTGRTGRGWAGWRGTAARQVPRPGRACGWLPPHAPRPLCQARSRRVCSVHTRLWHGGGERAAGYDRWSDPPQSCDCCREGLQPTHRHNSTHTPCSSPAHPESKWQRHSPTYITGLPGGSSGKRASAQCRTVTGVEGGCRGTRMMVGRSGKVTVVVQSGRQECGDGEQGGRAYVSLTEAGLTRNQWKVGITVFHQCTVHRLHLLAVCQAASQWAAVSGPGNDGNGLLRECSQANTSRHVHFRHSQSFHAGMMITVIRQEHSRWNPAMRHTVYKELVVAVPESIHADPPGTPDLRFLVTLGPKKREYGVQSPSHDSRSIRTLSIHPGYRSRIHLFPVSARKIISPGEMGGGAGTTPNSCRTRIRSQRAATNPD

SEQ ID NO: 14225 - protein, 194 aa, Chlorella protothecoides
MASHLQSIQKRAGIGVGGRAPPHLGGRQPAAPGAPRSAACLSPPDPPLVQAQPQSRAGVWRRRRGGSKAAASTSSIRWQPRTCMSSRTEAGRSSRTSRRLRTGTSARRTPAACAASSFSLTPPTGSTRPRSVSSPVIATSARTVRPANRLTRATASVTPALGPSLGTAPAGRCTWTSQHAAGEAGASRCEPAPA

SEQ ID NO: 14226 - protein, 137 aa, Chlorella protothecoides
MQTARLQTQTISRSAPGAGPAAPPPDLSLRICSLPPRLDQERAFLLGLEVHNAGRRPSGPLLVSWRGSATTGAVVASGQHSVPAPALAPGERHRVALRFLPLAAGQQLLAGCLLTDERTGAVLDTLQPREVFIHPGA

SEQ ID NO: 14227 - protein, 236 aa, Chlorella protothecoides
MREGAVDRAIRTSDAPSGNWIEAGNGPHLTPSPRPSQCACALSGRGMLQPTVLEMSGVPAEPMQGEHEPAGGSTGDTPEVDPVGEPGPSHTAPETPGAMPGSDASNEDVLALLPKHTDFSEEEEEEEAAPSQAASHYSHLPQHQPRVPLPLPHTEGASPQRRSSSRTAAIPRINLNKLDINALRRYRTLHGLPGIGPHTSKDQLVVAVAEHLSAQTMDEMAVLEKFRERAKRYKAL

SEQ ID NO: 14228 - protein, 182 aa, Chlorella protothecoides
MAEPHSLAFRVMRLNPPKFPDDRPYKFDLLNDMEAIPSVDPQSLPLQHPFANRVHSADDGFGPSAVLATPATFGTVYLGHTFRACVVLCNLDRTPVSSLSVTTEGGRALLHSNAAGSHLTLPAGEQHSILINHGIKEVGLHTLTCSAAFTDADGNRRQESQAFRFSAANPLIVRTKVWKNMG

SEQ ID NO: 14229 - protein, 114 aa, Chlorella protothecoides
MPWTGVNPVQDPPEYDPENKYADPVLYYRHREAAVTEAYIKVSEAKVLRRKLKECYRTEGIDHLTQCKEVRHGVALQHRGRQVAQKYLEAIKGVGIYKANSGPHDKATWAKDKQ

SEQ ID NO: 14230 - protein, 334 aa, Chlorella protothecoides
MDLLYDKPSIIKPAPTAFRVDRHFLDGQRYTAGSIARYEFVFGQGFISPGGERLTQELAARLGLNPDAHVLDVGCGVGGSAFHLARTLGCYVYGMDLSANMILTALERAAASGNGDKASRRLGGMEGGPASRVPGLPSGKEASSAPTQRPCCPAPRATRCGPHLLSPPCPTRAQVSLEVSDATRRALPEASFDAVFTRDSLLHIHDKPALFSRLLRALRPGGQLLVTDYCRGGGPPSPGFSAYIDDRGYDLVAVAEYAALLSAAGFEVLSARDETPRFVATLGAELERLRERRDEFVARFSEREHADMVAGWEAKLERAHAGEHCWGVFHARRP

SEQ ID NO: 14231 - protein, 418 aa, Chlorella protothecoides
  MOD_RES (346)..(349): Any amino acid
  MOD_RES (377)..(392): Any amino acid
MQRVGPWGWHPGWPLRLPVAQVVDASDEKIEIKSSDQEPFRLHIEIVQFVSLQHPTRVGREWENLALFVKLQHPHPSWARVFDGETLHWFISRNHSDASRLTFCVRSASALAHLYHRGTHCVISTSHLSDRGAPVAHRAPGAPTMFYLLELNRELEVQPRHFGPKLAQEVEKRLRQEVSGLGGMQGLTIMLGLPILNLESLGKARIREGAGSAVFNVTYKCITFKPHKGEVLDVVVTTVNKVGVPLHRQHPRPMTQMGFFAEAGPLQVFVSNHLIPEAFEFSSIHEPCYATPDGEQRIAAASDVRLRIVGTRIDANEIVSRWATLVDFCGSDGGARECHTSDLHVXXXXVSRWATLVDFCGSDGGAGECHTSDLHVXXXXXXXXXXXXXXXXTNDLSPWAWNISGAAGTQGGSTCFPA

SEQ ID NO: 14232 - protein, 109 aa, Chlorella protothecoides
MYKQGDLNDMWVVAKQTNLTFDLVRGTRCGEGSQGGMHAGRSLAWGVPAFSLAPQGHPGSARGMRNVSFIAGCSLLIFAAAAYIFTRKRPVYLLNYHCFKPDDRCVGLG

SEQ ID NO: 14233 - protein, 327 aa, Chlorella protothecoides
MAAARGEANQVLFESVERVLAKTGISPKAVDILIVNCSLFNPTPSLSAMIVNHFGMRSNVITYNLSGMGCSAGVISLSLARELLQVYPRSTALVVSTENITQNWYFGNAKSMLIPNCLFRLGGAAMLLSNRRVDRWRAKLELLHVVRTHMGQDAAHYGCVYQQEDGAGQRGVHLSRELMRIAGHALKANITTLGPLVLPVSEQLLFFLNLVARKVLKRKGLKPYIPDFKLAFQHFCIHTGGRGVIDAIEQQLELGTRNAAPSRETLYRYGNISSASIWCGLRKGDRIWQIAFGSGFKCNSAVWRALRTCNEQHGAWVEGGQAGGKAV

SEQ ID NO: 14234 - protein, 265 aa, Chlorella protothecoides
  MOD_RES (124)..(127): Any amino acid
MGKHNGKSRKSGLSVGQSLVNRAKREGRTAGAAAHMYTTDLGPDNNMQSVIERNDLDEMMAMVKLMDGVGIALACMPCMHALLGWLKVGRPWAHIPTCPCHAGGQGLLCREAECGGDQHRLGGXXXXACMPCMHALLGWLKAGGAPGHISQAAHFAAPARRGLPPILSLTFSQSPHPPSPLQGHAGGQGLLRREAERGGDQHRLGGTQGHRARRGRAQRCGGAAPPPPHHPAPAVLGRGDHARGARRGGARLFPRLAPRPGAAGG

SEQ ID NO: 14235 - protein, 599 aa, Chlorella protothecoides
  MOD_RES (288)..(291): Any amino acid
  MOD_RES (411)..(414): Any amino acid
  MOD_RES (543)..(545): Any amino acid
MSTSPSSSPAVPPRTASASPSGCCRCAYWIGGCFGFIVGRGSSSAFAPPQHPIHHLTIIHGPPSAHQVPGATTYMGSVGKDEYGSILAAAAAKDGVQVRYHVDPEVPTGTCAACIVGGERSLVANLAAANNYKVDRPPAQAGELGGGGGCPCHLLRRLLHHRVPRLDAEGGPARRRQRQAVRAQHLRALHRGGAALPRRPQPAPALRRLPGVCGGGVIVVGEVGRWRSLCWVATGHQATLQGGAGAGHSNMDSPRVPPGILLPSHKAADNHPPPRSLNQFGNETEARXXXXGGAGTGHSNMDSPHVPPGILLPSHEAADNHSPPRSFNQFGNETEARAYAAAAEWGTEDVEEIALRISRLPKENGARPRTVIFTQGADPTVVAVHGKVALFPFPPSVPSTIIPSQTQRWCXXXXLCLRGLLYSSRPPSLQQSFPPKHKGGAVARREAGGHQWRRRLLRGRLLVAAGEDHGGGHRGPAVVLAHPLHRGTKLLCEPSLPLGLLSPANRSSCAQIPPPPPPSIPQPPLPSPPQSVGGRQGRGGGRXXXCRPFYNPPCPPPPNLQVAGKGVEEGVRAGHYAASIVVQRSGCTFPDLPYNFSWA

SEQ ID NO: 14236 - protein, 407 aa, Chlorella protothecoides
  MOD_RES (238)..(241): Any amino acid
MFAPGAAEAAPGAAGPLDFLRSNQQFQMLKAMVQQNPALLQPMLQVKKREGMCKVWPEGAGRYEEGESMMELGRNNPALLEQINANQAAFLAMINEPSAAGGADLETLVQQLAGEYEGGEGGGEAMDEGDVPPGANVVEVHLSPEEVEAVERLVGLGFDRQQGPVCISRYQLCLASPQVCLEAFLICDKNETLAANYLLYVCVGRGGGGVCVCVLALLVSGSGRRRAPCDHVNSERFXXXXGCKLPAVRVWGGRGRRGGRGVLALLVSDSGRRRAPCEHVSSERLWSSTSKNQVAVFEGPMSPMACSPPPHAGRTGKTHSEAPAPLGHCPPCSSNSACAALEPCPGRCACRHSRSCNRRAPDALLCALSRCDTPTHIPLDGTDALGRLYTNVRQGGKQREGTSNPTW

SEQ ID NO: 14237 - protein, 186 aa, Chlorella protothecoides
  MOD_RES (83)..(86): Any amino acid
GSAAAGASAGGYEEAASQLARGSELEAKVAAIVDMGFPREEVQRAMRAAFNNPERAVEYLMSGIPAGLGLHSGASITVASPTXXXXAVEYLMSGIPAGLGVSHVCVGGGSLDVGGCVMGAGAGNSPCARAPGLAKGAVGALASTATAPSRVSGALQPPLESLHLADVLSCTAGHPAQLPLPPISAG

SEQ ID NO: 14238 - protein, 266 aa, Chlorella protothecoides
MAARVSCATPVLGPVGGLLGVGLASALAGQASLLCRESLHGGGRAGTPGPAAARPARRGWSAETLLVDAALGIALFKLMGGRFRSVMPSDLSRVGAIALESMPTRGIEYASRGKRRELFRFFKRHAVGGLILGSRRRRFADAGGPTFAGVPSGGLQIQVQCPRLWASSAPSDHSTGFRAPHRDGCHHCGTRRGDVIGDHMPPNKLVLDRVEAMPAALRTLRRLPFVKEASEALGVHLGPTPQRYYPQVGGWRAEGGWRGGLVGVHR

SEQ ID NO: 14239 - protein, 256 aa, Chlorella protothecoides
  MOD_RES (42)..(59): Any amino acid
  MOD_RES (103)..(106): Any amino acid
DHATACGVQNLCADQSVPVPYLHSLGGIATCASPLPPLMHSXXXXXXXXXXXXXXXXXXDDPRVLCMHWMQAVLCSAFPPSLGLLQLSHPPLTTHSGPTQLKXXXXKILERPCLFLTTKRCQGTLNALDASCTLQCTPPISGNAATVTPTPTHPQWSNSAEEALKLALYLNDKYEIDGRDPNGVVGCMWAIYGIHDQGWTERAVFGKIRYMNYNGCKRKFDIEKYIARVEVTVREARKAHGKVQPKTTAVIGSSEA

SEQ ID NO: 14240 - protein, 427 aa, Chlorella protothecoides
MLSKSQRLVAGIDVARCQPLARTGTTKHLPWNQAPCPGRLRPGRRQHGGGGGGGWGRGPEGVVQIHGDGVCRAAAADRQPPRRGGHHRGGHAGPRGRGPGPAAAGKLEAAPAVWAPAGGERGGAGRAAVRRRARALPRQRGAPGCGAGHRQGVRGCVFLSAFWGGGTGLAELVGDGATVPFLWKTAGTRGVLSAPDAVARLRRCPGVGAAKAARIKAAWDALGGSRAGFLFAKGAGVPALVAQALAEELGSGVEAALRCDPYAALSGRGLGLARLDAVAARLACRRDLASRAGAGTLECLGAAANAEGHSYLPWRDLQAATLRTLGGSGGEPCASGALAAVVADLAAVGELALRRADGAEAPEFDIGAGARRRRGLAPGDTLRDAIAMYPLASLPLDARCYLPSLAAAEAVVAAAVAARAAAWRGPG

SEQ ID NO: 14241 - protein, 383 aa, Chlorella protothecoides
  MOD_RES (236)..(239): Any amino acid
MASRSAVAEWTPEEMYFLAKDELITIVPNFSLLTENGTAQCIGVRCECALEGRVRTIPTKQRVQGAPLASPHSVEEETVHNETTSLDECGPLGRCGPGACESCLPLTQVSEAVPDSTTSPSPQILPAVLNLDRRDATAFQPLPFHYIEIAHFLFTAGTDEALASGIFGDNLTRVSLGLQGCKDHAGVGASAARGALVLGLTYLWVAEIIANRCQRASILSSVSPPINVSSPLQIKXXXXYGASAATDALVLGLTYLWIKDLVELVQKARMAKVLAGLSTLQGAMTVKLNNLAAMEINAVRPFFLGALDMFHEYQKDPDADAGHGNRDDQGTWYGEAARRTPKLLELPLPALSLIFDIAIKRHRIEARFLKSPAVRSWEKDPRK

SEQ ID NO: 14242 - protein, 242 aa, Chlorella protothecoides
  MOD_RES (164)..(167): Any amino acid
MPWHRGLACLLILVLAATPVLANDSTSTESLNKFCIVVRTYRGHADAETGLPRLLRSLQRQSFSRRVVPGWFPLCKSCWTALLWEAVILVMDGAAFPELHSIVAASDDPRIWVFAEWRTHLRTDWARLCSQDGGWDVVALLPCPFIQPDRRCSVWWANGQWHPXXXXHYHALLYNLTDDAVIGGPTGSGIHVNHALWLRGLHEMHHPSLATSVSDPLIHCYNPSVRLSHVGILSLPFLSQCP

SEQ ID NO: 14243 - protein, 389 aa, Chlorella protothecoides
MTAYRLHDALAGAGRPTVVQKSQPTPKGTGKATKRQRQAQEAAAAPPPDLLALLLGGAGAGHQSQGESASQWGGARDARLAAGRVPEEAERPLPSNRASMEEGSLEASAVHPLLAMGDAALQPMQGNGQGDGQVATPAPLDLGTEELHAGEAGLPASSEPPRRRIQPQRLDAELPLLPIPAPGPPSRGRSGASGEQPDSDSGSLPPARVLMRPTPDMGEEEREAMWAAYIADKESMLDLLGDARYRDWFDEDSAPPPAARGGGGVDGALDAAFGGGTADGAPASLPASFLETSVAAPWQGAGAACLGLALCTLRACDGAGEVYAGDKVGAANGPLAWVQALLPPLEGSDAVALGVQAALGLLGFQSRNCWTAAMQGEGGGGVRGWGRLL

SEQ ID NO: 14244 - protein, 208 aa, Chlorella protothecoides
MHGRPRAKGPPDPERVKATAQKAELLGRLNAAVLQARSAGPAGPAELQLTARLLELNPEMYTAWNHRREALVPVFKEGAFWSAVSWLAPGQPMTFPQTGQQAMQAAAEELALTLRALTRNLKSYSAWHHRKWVIGHRLTSLEAEITLVETLLDADDRNFHGWAYRRFVADVGGAGSWGWGVAETARLWGPGRAPMVQGGSTRAAHSGS

SEQ ID NO: 14245 - protein, 184 aa, Chlorella protothecoides
MISSSRAGATGALVPHQTLEIEYELVSQAFFTEPEDQSGWIYHRWLLGEAEGRPSSQGCVWHETAKHLLPSHHTGCSVAHWQAAPESEAERARLADVLGCQLALVSDLLDLEPGSVWARKTRAHLLGLMQRVGGAAGGSAGRGSGGEAADCVAAAAAWEDLEGLDPYRAGYYRHACSVSARASV

SEQ ID NO: 14246 - protein, 117 aa, Chlorella protothecoides
MVRLRRLRCREGMTRSEAEDLVATALELAMARDGSSGGMVRLVTITEKGAERRMEWGTGVRPEHAWPMGESLGVSPPPMLKDLHHQPHSMRDGRRLIKPEEHPVLWDELPTPLGVVV

SEQ ID NO: 14247 - protein, 159 aa, Chlorella protothecoides
MDCSGEHNPSSTSPPHTGTTIVAVTYAGGVVIGADSRVSTGNYISNRASDKITPLTDRVYLLRSGSASDTQAVSDYVSPILKRIRTLIVTPRPPPRPNSSSLSTPAVRYFTEQHESQLQRPALVKTVAGMIRSVSECLKSGGPGQPCHPMRRTCIDVPP

SEQ ID NO: 14248 - protein, 228 aa, Chlorella protothecoides
MHSVQSGGTRIHPRFDFQRVETVPGQFEVGGHGPVAEVKYEARKYRGPDGELHAVTATDSYRRHTVLSIAQDLKDAVCRVSDGPFDPEENANIPQVTYELPDGQEIQVGADRFAVPEALFNPGLLARYGAEGAPDDAAPAPAPLQAAVNECVARCDVDARRELYANALLTGGTAGFASLRERLEREVTEAAPALARVKVRGGGKGASVSPCSSGLGWRGDSGRAGELA

SEQ ID NO: 14249 - protein, 259 aa, Chlorella protothecoides
MAGRATPAPAASRPPCLVCRIMIPSVPRVALVEPDYRVTVKRSSNDPLYPQQWHLPVISADTAWNSITGTGAVKVCVIDSGARIDHPDLVANIAGGWNLVPIPQVTGAAPPSPGTAAYANYNDTLGHGTHTAGSVAAAGNNGLGVAGVAWRTKLYICRFIWDDEAGYISDAMTCMSLCRAAGAMITSNSWGGIDYSTFLYDEIAKARDAGQLFVNAAGNSAIDMNTNPRYPASYNLDNIISVAATSMSDGLSAYSNYGT

SEQ ID NO: 14250 - protein, 121 aa, Chlorella protothecoides
MATPSVAGAASLVQAAALSRGKTLTYSAIRAYLLANADTLASLKGYVASARRLNVAKAVAAVLADFPPSPPPKVSFYPLPLFWGVPGPCPRAHPLNPCPVWKTTPAMPAPRPLLMDTPPVV

SEQ ID NO: 14251 - protein, 76 aa, Chlorella protothecoides
MNYQYKHLVGAMIVAGWDAAGGPQVYGCPIGGTLSKESWTTDGSGSTYIWGYLDEEFRCVVRPGRGRDAIPRPGDC

SEQ ID NO: 14252 - protein, 162 aa, Chlorella protothecoides
MEEVRGAGMWTHAHVHHWIAQPDRWYAVLSIPDEVNAVVVDLGSFTVKVGYAGEDTPKHVFPSVRHVFENVCIMLPLLPKARGLVSGVLNRSLPVLCPLNTQLTLAGIDPKSQALGSIDSPPNGDAMEVDGVGPSGRTFKVGTASLAVPQDGLEVGIEGQHS

SEQ ID NO: 14253 - protein, 298 aa, Chlorella protothecoides
MPIHSSRHPPQGLNDVAWAPSDAHLATASDDYTLRLWNAGTGAPLRTLRGHTHFAMCVAFSATGVLLVSGSFDETIVVWDVATGQAIRVIPGHSDPITSVAFSRDVLNPAIVSSSFDGLIRVWAGDTGNCLVSLLATGGPPVSFAAFTPNDKYVLAGRVDGKIVLWNYHTKQPLRTFEGHKNTKFCLQYCAAVQACPPCPQAAFLCLGVEETGSSAPPAAVVCGSEDHHIYVWGVNGSQGGVAPLLGLLRGRAGPDDPGEGHCDVVLSVAAHPHLPVLASCGHERDRSVKIWRHVSLP

SEQ ID NO: 14254 - protein, 447 aa, Chlorella protothecoides
MPPSLPHTPTQVYNHGRLLALADEEGYLTIIDTSQALPRSTADEAGPRPSAQWLAHRNAIFDLAWFREDEAMLAASGDQTISLWDTGMAEQLGTFCGHTGSVKTLDPMPGSRHVFASGARDGQLAVWDTRIHSRTPEGGTPPVLTVQGDGAKSKEQVAIPLPELLRPGSACQALLMPLTKGVRSKQRVGILCCTYQWAGETCSLNLPPALPSRNPFQHPTPPRHSQQDAHAAGEPRRRGRPRTPLQGRPKLSVTSALFLPDARTLATGGVDGMVRLWDLRRGGGCAAAARPGRGPAPGAAAAGASLRPVACISSPPLGSGLKQHGVTCLALHPDGARLLVSLTGGHHLAFDVLRPGAGPRAVYAGHAAASFYVKAGFSPDGRFLASGSSDRRVHVWEVDGPPAAAAAGGPVLHAPLAALEGHEGEVTAVAWCPTDPDRLASAADDAT

SEQ ID NO: 14255 - protein, 266 aa, Chlorella protothecoides
PPTRALGGAEQALLWRYRYALASERRALTRFLRCVDWADGGEAAQAAALMAAWAPIDVADALELLSPDYGNEEVRGHAVRVLEATGDEELLAYMLQLVQALRYEPADDSRLGRFLARRGAASLRLATPLFWYLCAELEDPGFGRRAALVQAALLRGLDPALEDALASQLDLAARLRHLADVVQATRGSAARRAETLRALVSPGGAAADLARLACPNPLDPGTRLLGLDASQCTVFKSALCPLRLVFFTEPWGDDGARAGVGGSGAG

SEQ ID NO: 14256 - protein, 84 aa, Chlorella protothecoides
MPVASGGIHVWHMPALVEIFGDDACLQFGGGTLGHPWGNAPGAAANRVALEACVQARNEGRDLAREGGDVIRAACKWSPELAAA

SEQ ID NO: 14257 - protein, 98 aa, Chlorella protothecoides
MAAALRTLGPRAVLSVAPLGLLEGLRTGAQARTWMLPLLRQNGGAGELGFWAEQLLPTAQAIGKRGAVATKGGRGWKGGKGVMSVIGVKRLVMWVSPH

SEQ ID NO: 14258 - protein, 141 aa, Chlorella protothecoides
MPSGLPKGVLNVVHGAHGTVNAILDHPDIKAVAFVGSDAGGEHVYARGCGAGKRVQANMGAKNHAVVMPDANFEATVAALTGAAFGAAGQRCMAISAAVFVGRGTLERYAPALEAKARGLRVGAGWEAGVDVGPLITPAAR

SEQ ID NO: 14259 - protein, 352 aa, Chlorella protothecoides
MKSGWETGEGVHQGIARHAKHGKPAPQGRKEARRPFTSSPPPYSPMCAAVQVLVTHRTPRDCPLKCPGMTQQSLTSLLRQDVTQLLLGESARDQGPACIGAGAVRRMPSSSERTLPRMLSLYNRMHSMARTCCECHGEHPQRDHGREVEGTDACSHLGGGEIEIPGWDGGQCRSRFCHNWPPCMSRHTRHGILGQQGTLKSGASGSLSPLDQVQGRMQQPLSPLSPRLAPPHPQRLADAVGVDAGGHVLQHLSHHVGADAGGVLDHLQAAEDVPSRVGQRLALFARHAGGQLLHVLPDQLLQLEEHARARRHGGGAPSGEGRLGRVYRRLELGWGGLRHAGHDLLRGLQGGN

SEQ ID NO: 14260 - protein, 83 aa, Chlorella protothecoides
MEKLQSVDWRGLYKTATNKVKKYTMNLSELELQVEDATSLEVWGPHGSVMTEIAESSFDPESYRQIMGVIARRLKEEVSVRGV

SEQ ID NO: 14261 - protein, 526 aa, Chlorella protothecoides
  MOD_RES (180)..(196): Any amino acid
  MOD_RES (299)..(302): Any amino acid
  MOD_RES (475)..(478): Any amino acid
MVRRHAALAPHGGPAVQVVNGNFTVARRRGIVDGVDFGLMGQVRYVKRDAVEVQLAAGAIVVLTNIGVTSSGELLNCNVYDVATHAAVELGADKLLCLTGQDVADLGLPAYLPLDDAEALIARGAGEGGTGAGRGVDGAFTFGSGEEVEGQGGWGRTAGAGPGQLAADRVPARGGGRGGXXXXXXXXXXXXXXXXXCRNGVRRAHLVDAATDGAMLIELYTRDGVRATRGGGGGSGAQLVASGRGGGGGAVAAPARACMDRFPPAQQSVPWTLRAFSAWSPVPLLPCEANPAVLCGCIXXXXQGGGGGRGGTLWHWGGGMEVAPWRRQRVPAWTASPLQSSRCPGRCALQRLEPCAAVSLRSKPRGSLRVHHGTGLRGAHPCAAALPLLTGTRGVTMIATDLYEGIRPAAWRDVDGITRLLTHLEEVEGYPLSGWLHEVSQRLRSITVLEREGKVGDAEAGCGKGGRGKGGGEEXXXXLEREGKVGDAGAGCGEGGRGKMGGGGWSGCGTRGRYAGLGSGGERRRR

SEQ ID NO: 14262 - protein, 594 aa, Chlorella protothecoides
  MOD_RES (11)..(14): Any amino acid
  MOD_RES (241)..(244): Any amino acid
  MOD_RES (365)..(368): Any amino acid
MLTTAGRVPYXXXXVCRHWRAHICAAKSTGRPPLLCLRPQAVYHMPTSEDDDPAKSMPLALQSVFYKVRGCVVVPVLHLWGGAGGRGCMGWRAKQRRRQGEQACDPGLGPYPMPGVAHEQTQHLPAPTGPPMQLQFTDGPVSTKDLTRSFGWDTSDAFQQHDVQELNRILCDRLEEKMKVWGRVLRRGRSSSFEQALSIPDGVGLEGACHGVAGEAPARRVREESMSLDATTKTPTHALRXXXXDGVGLEGACRGAAGEAPARRGREESMSLDATTKTPTHALRHAEHAGGGHHQQAVRGAHPELHRLHQRGLQVLPPRILHGPPDAGGRQSVPGGGARLAGRAQGRALRRLPPRAPAPAQALRXXXXPFPLLPPQLDVKGCKTILDSFDRYCEVETLEGDNQYLAEGHGLQDARKGVLFDGFPPVLQLQLKRFEYDFMKDSMVKINDRYEFGEELDLDVGDRKYLAASAARGVRNKYKLLAVLVHSGGVHGGHYYAYIRPDGARWLKFDDERVEAAEADRAVRGNWGGEDDRGAPGGGAPGLRFTRFANAYMLVYVRESEWGSVMCGVERRDISQHVCARLQVGVWGGGGGKR

SEQ ID NO: 14263 - protein, 372 aa, Chlorella protothecoides
GGGRGGGGGRPGEWETGCRACWLQGIDTRIRPFVGAEEQATMENDVTSHVPSPPTRQVTGLAPAAATTASAGGTAATAATRPSPKALLVAAGVAGMEHLHLETIMEAATSTRSRPLHSTRPQHRAATLPRARHTAVPLPRQGAMTPMGPRLRPDMDPLQEPTTVCVLWWAGALGLEPSLCWHGTIGDAFATPWVSHSSHHPAKVASPPPSFGGRGGYGAPPPTAAGPPYGAPAGGPPPRERVVAAPQGPPGLFAPEDWACTACGNVNWARRRECNQCNAPKPGAVDLTREGAGGGFKELDSAEVEEARRRRREHEAREEYDEFGRPRKPSAAEDRAARERAALERLAGKYGARERSRSPRRERSRSPRRERY

SEQ ID NO: 14264 - protein, 93 aa, Chlorella protothecoides
HAAVLRAARAAGLPDALRLLQEPVAAALAHGLGAGLDGELALVVDIGGGTTDGGGGQSGDEPGGAVGAGRGSVEQAGGLILPSSPLGRCLGRS

SEQ ID NO: 14265 - protein, 391 aa, Chlorella protothecoides
  MOD_RES (97)..(99): Any amino acid
MAFPGFSPVEKKKVWWVRVSEQSPWEGCLQSSLDTSHTHRQVFLRRYHSSRLPNGQMELYQPLQNTTLVPQSGHATFIPTPPPPPPPPCSPLGQTVXXXVWWVSVSEQSLEGMFTIFNGNMSYTSANIPVSKSLKQAPKWPYGIIPTPPKYNTSPPKWTRNFYSDPPSPFPASLLTLGADGGTVHDGLAAVQLELVVQIGQALRGGLVPAVDDPAVGLEQDGGSQVLVRVPPVGGAGGGAAGAKDALVQPIQLGPVLLGLAVLQAVGGLGLEQEGLDGFVLGVEVGHVHHQVPDDEHVGEGGHAGHGRGVALHLCQARQPVLAVDVHGAGAADALATGTAQGQARVVVVLDLQQHVQHHGAAPGRGEDARCRKFASEHRRWFVSVKPQAGC

SEQ ID NO: 14266 - protein, 68 aa, Chlorella protothecoides
MLSLSRALARGAARAAPEIGFVRAAATSAATPAAAAKPVVEKEFLVYRWNPDDGEAPKYQTYKVDINS

SEQ ID NO: 14267 - protein, 480 aa, Chlorella protothecoides
MESFGEAYASHLALSEFSRDTSVYVGVSQLEYARISLETGAAALNTYYATGAHLSVAPGRIAYTYGFKGGALSVDTACSSSLVTTHLAAAALERGESRAAASLGVNLTLVHSWTQACLRAGMLSEEGRCKTLDAAAGNVFRPLFIPAPLLTFAWIPPPLTTDGGWTALSVLVGSAVNQDGRSSSLTAPNGPSQQEVVQLALRAGGLEPGAVGHLQMHGTGVSGIGLCATHKLTPEPVPRPAGTPLGDPIEIGAAAALLLRASSKNGGPRGAPLTLTAAKAFMGHAEPAAGIVGLTRLALTLGQAGADPLPYLVHVNPYVDSALAATARGGPACRTLAPRQPVPSAYSGVSSVPLGGVSAFAFQGTNAHALLSPGAGQAGGATDVWMVAGRDAPWQEARSWIVPAPHALLSNASASARRGGELRVRLECGLASARLGAYAHHAVPRWPPAGRWAARSAACMSRPWPSRAPWCWPTPARCRS

SEQ ID NO: 14268 - protein, 523 aa, Chlorella protothecoides
MAYVLVALQPADLEHVVAAALDRGARALALVALFRPDDAALAPVQLRVDALGADLVVLCLDPASFLAGDRVRLRTALSAARELLPPYAAVLLPAAAEEEKAFASEKTAGAAVPSAPASAAATEVPATPPAAAGPDRKGLEAAVRRALSAILGTEAAAAVADDEPLMAAGLSSTAAVQFGAGLEAALGLTLPATLVFDYPSVQELVDFLCEETRGEVATPAPPTAMFTPPPAPRHGPSTVTAKPGPRPSSLAVVGQATAHLLGVSPASLDLDEPLMSAGLSSTAAVQLVTALETALGLELPGTLVFDYPSVREVADFIDAEVAPAGPAAVDQNAASQAEILRAVADLVGHGEDLQADTPLMAAGVSSSAAVQLVSALEAALGAELPGTLAFDYPSPAEMAAFIVDAGLAPALAQQQQRAEIAPAAATSQVPVALVLEPDAPARPVCVVTGQSHAVPGGKLAQGTRVHNDRITPVPLERWDVDLAPSYNLRGAVVECLHLTLIWPIQHRRAQQLIRLVPVGCGHV

SEQ ID NO: 14269 - protein, 246 aa, Chlorella protothecoides
MGDPPDAGQWPLADCWQVLANTARAQPDALAVVDVGSGALHSYASLHARAAALAAFLASQGVGRGDRVAVASRNSLGVMEAHFAAAALHAVVVNINVHLAPPEMAYILENSDPAAIVADTSLASGLLTALNAVQADSGGGLSVPSAPLLWLDVEGGQAGEQALASAVLPSGIEAFDYASVVDSLLDIGLETVAGLGLDRENAGEDNFHLYYTSGTTGKPKGVMLSQRIVLQHALGTIQGEARQRRW

SEQ ID NO: 14270 - protein, 130 aa, Chlorella protothecoides
PRKAGRGGAGLTLGFGGDASLLTAGLDVDERGHPRPGSNDPAQPAEDSDDDDDAGAGAPAAEEEEEDLHGDFIDEDSQSVRRGPGPGSAGGGSRGAAAVTNTSWRTMKWMRDYARLMWCVVEAQGGSMEG

SEQ ID NO: 14271 - protein, 931 aa, Chlorella protothecoides
MQAKGAVRAQRSLCGVLCMLHRALALGSAQARRKRREKSAARFHCHTIDCATNRAGPVRVPHIACDLDRKARPHVPSSSVHALTMRAFVTRRALWSLRVACRAQPGSGGIACVEDTRAAVFAGFPAYWASEAQHAGLRALCSKVPTTDLARKFISSVAEVGMDLMDAADKAYRPPTWPLLGRSSPQAHAAGQFHLSQPIMQQVDLPANASSEAPPPPTDTRLDIDFEELLTRPARPPRPGRPPSRASERAAAAFRILRRSGVVRDQALALYVNSALFPTAAAAFEDAVLSRARPRELAAIGALATGGAVADALFPAFARFVLREYRDQVTQYRSLVQTADLRAAHAWFPLARALQRRIVYHAGPTNSGKTYSALEAMKAAGSGVYCGPLRLLAMEVYDTCNAAGTFCDLITVGKAFQSQGRCRGCTAEHRVLGLPPPSQCLTSEVRERCLARCGCPSSLARSLYRPGEAGGAGVKPRVVHRGDGGPESACGRGGAGRDPDDRGRTPWLGLEPGADGRPRQRDPPVSQAVAAAAGAMFAGGGRAHVCGDGSAVELVRSLAAAMGDELEVRSYDRFTALAVEPGGLGPGVYAATQRGDCIVAFSRRDIFEIKAAVERETSHRCCVIYGALPPETRRQQAQLFNAGDNKYHVMVASDAVGMGLNLNIGRVVFHSLHKQFAREPRASRKGSGAMWAGLYGGQREGAGVRVDDQADRGPGGAAQLRVRAGQGDVQEPGGAWHTHGGAGGHIEGHGEAEVTYYVMLPHMPYPNTLYTPVAPPQKTPLDAMVTRKAGLFPEFEHLEVFAGQRPDDTFRQGGPQLLSRWCGAHQTPLGDRLHLTAKSAAHLSPSHPFPSETLNQFTRHAVLDSTFFLCKQDGVFAAAQLLGEVSAVAGVFCCGMYADTGGAPLASKCADWPLARWHARIEMSMQGWGKW

SEQ ID NO: 14272 - protein, 240 aa, Chlorella protothecoides
MGCFESKAVQEQAEEVEMIKQPAASTVPEEILGFNVARLASKTHFTAQEVASLHRLFLILSNELHEDNLIHKDEFLWALFKARRDSLFADRVRCTVTCLTFAGAVHCAFAICVTMSQDHYGLAVFELFDIKQNQVLDFEEFVCSLSVFHPDTPLEEKASFAFRIYDIGHTGAIERSELKRFLIAVMADNPEVDFDESVLEAIVDAVREFDAATLRHGRPLPYILRHKCSHTTIPGNTDFC

SEQ ID NO: 14273 - protein, 323 aa, Chlorella protothecoides
  MOD_RES (231)..(234): Any amino acid
MLIAAARAVAEAVTGERPMEGREGGDGGRVGGNRPMENLPLLGRQGQHLAQCRVMPRLHVRLIWSWQPQSRPAAPKLRCPPPLAINNADEDRALGALYPPLTALQDTAASVAAAVAAVAYHAGVASELPQPSDLLAKAYAVMHDPTYRHWPWCCCPLDFGLKIASGCLYIEAAAGQPKRIERFYRTTLSARQHGCKRGVPCRPTPHLLLESGDEFSQLGWTPSSLEEQSLXXXXNSTPSLGIWRRVLANLDGCHRHWKSRASHVQAAWQGISSGAVSYRPKTTTTSVTSPAQCKVASYEAPRPLQTLARRCPPCQALLFGGDD

SEQ ID NO: 14274 - protein, 419 aa, Chlorella protothecoides
  MOD_RES (28)..(31): Any amino acid
MTERVGRHRLHAPGKKKTPEGGAAPSYXXXXAGEGWRRVFVHCGGHPPRWLSTSAAPSPSSSPPGCSHEQGGLHQQARDLVGVEVGGGAPVLVIPRLLHGHHAPHADRAAAVGHAPGEVVHGGRLMLARQAALVALAVCGDVHRVALAQLLHLLLDGVPPRVLGARLVGGVVDVPARPVPVAGDGLGVEGDLHVVQLRAAHQDVARHPQLIAAVDAGDGAHLVLPLAGHDLRVHARHVQPRIQAGLEVGLDQVAPDGTPRPRRAVVGPLRPREAVGGPPQGPLGARVQHRVLLLDAEPGLVRGGLLHHLRARRARVGGDGHRGLDRAVGLHAWRLVGVGQHNDVVAAAEGVAVDGTRLQVHLRVVAGGLACGGTVVVPVGEVRCGLGHGVEHAGLGAQVLPGAADPHVLGADLARLQTP

SEQ ID NO: 14275 - protein, 148 aa, Chlorella protothecoides
MISIPVGLLCRGLSPGCCQQTLVHEHRIPWATAHGRLECWRPAHRHAPSRSQSTIPHSSASLHTLTVLTGCGAAGLSLEQVAPALSAPLLSIALAAVARTLGLLPDASPVYDAVWGLAMPMATALVLMEADMTRYAARGEDRDLRVYF

SEQ ID NO: 14276 - protein, 257 aa, Chlorella protothecoides
MAADNVAMAGYIAALMAVPVPRRVWRPALRAGLASLEVGAAGGPGLHGSSVLGDGTGPADVDVRHPGLASTPLSAASSLALAATACSLGVGASALLSTPHASLAATAVLTPALAAAARRLCGPRAFAGAGALGGALLALAFATIGGGGGDLRALTSAGPLLAFAASQLGLQLGITLLAATALRLPRRETLVAANAATLVAANAAVGGPGTAAAMAAARGWHDLVEPGVLAGTLGYAVGTAAGIAVSGVLRRGAALLA

SEQ ID NO: 14277 - protein, 141 aa, Chlorella protothecoides
MTLVAHGATQKRYAAQLDAALAAVRYGVVVVNANLGLGLWSAQTHWGVHGGAAEVAPGRTLRLGSTQNSLLYDEGVKGVVRFPFETYLHILPPEYRSITMRASRQLAVGIVDGMRGFLRGLKDKSWAPPVTLGEGSGGVVA

SEQ ID NO: 14278 - protein, 473 aa, Chlorella protothecoides
MYTGFGRAHDDEQRGDGSDQHVPPWASTVLTGVDLMRNNKVGVATGPGHPGWGALLGHAQHSYNKGLAFTREERDKFFLRGLLPAAVLGQDIQAERVVVNIRAQRSDVDRLAYLLALAERNERLFHHVLRGHLAELLPVLQHPTTARYCERFSLMFRSLPRGLFVSLEDAGSVTRLLQNWPMRRVKLVSLTDGSALGAGGDWGVQSIGSPLSRLALMTAVGGVHPSRCLPLVLDLGTDNARLLADPLYVGLRAPRARGEAARALRDELLAGVRRRFGASVLVDAADVDHATAQELVVAHRASLPVYADAVHGVPAAVLAGLYAALPAAGGALSAHRFMLVGDGPDLVAVAELLEEAVQREHRSGTVWEARKRIWLVDAGGLLVRDRPDADAVEDHRLPYVQEEGAAAPSLLDAVRAVRPTVLIGLSAGTPAWAFTQDVLREMATHCDRPVASARSPPPTRTPGPAAARSSPTR

SEQ ID NO: 14279 - protein, 122 aa, Chlorella protothecoides
MASSGVRSGGAVQARPDDKLLLDPDEESLHHGGSFRTYMHHKISKLGEQFEAQAADLGVSSRIFQGVAIHVNGYTSPSHQELKVLMAKHGGVFINYPTPTNHTHIICSNLTDAKIKQFEKAR

SEQ ID NO: 14280 - protein, 346 aa, Chlorella protothecoides
  MOD_RES (9)..(12): Any amino acid
  MOD_RES (108)..(111): Any amino acid
  MOD_RES (216)..(218): Any amino acid
  MOD_RES (266)..(269): Any amino acid
MGRRAPRSXXXXQAYLVVGRGGDGAQESCRKPRQEGAAGWGGGLRAAARTCGTGRRRGPERKRCRGSAATRAALACRAAGRSRQTRVGPGPLGRPQARGASPAAESAXXXXLACQAAGRSRHTRVGPVPLGRPQAGGASPAAESAAATARAAGGAAVLGGARPQCLCRRWKLHGRPCSRRRRRRRGGARSAAECELRPGDGEIRDAGAEESHPLAXXXGSAAGCELRPGDGGIRVAGAEESHPLALATRPCPASSHASGAGKAAGXXXXLGAAAALRARLLGRPLPAAVPEGVQGADAVEALPLVDARGRAVPGAFGREVAGAGAVPAGQGVGWLRCYGRMMAEGN

SEQ ID NO: 14281 - protein, 917 aa, Chlorella protothecoides
  MOD_RES (355)..(358): Any amino acid
  MOD_RES (566)..(569): Any amino acid
MPRRAWSASSSRLLCAWATPAPTRLWSACPYPWNVSLGGGGVREGCCDVLVVVGWGGWKLRPQWSPATSSVWNALSTAPSSPIPQCKQLPGERPWCSRKPLTMPRASGRSTTPSGSSIPGQRWGEDHLARGLVICSRWHSKITKLAPSMHHPAHGPALRASTPQGLRGSIPENFAYLHVEFGLSAGFVHVVDDESTFDASLARSVLIGALGWWLHRQRGLRLLRQYSSLGIRALQGTWSDKHWLESPCLAITSPCRSAGPARGGHASEGKGRVSDAAGTMGARIPGRCCGACNQQDKLVKYGGLYASGLGCAGAHILGPDQIDVSEFRTGLMIMLRISDGVLRLPSYPLGPYRSXXXXRSCDESPMACCACCRTLSARIEAANECELRKPIIPTLHAKVGSVAHPEVTWAPPDSPPPGKMTHADDASSSTSSLDLPLLVHHPYKAGFTRIQFDPKEEGCWQEIRTRVVRRCWSAPYSSTSMQSICEGGSMHLDRMGLCYAPLPFLAEGVPGPRLPLASHTLAEDHKASSLSLTHTQHDISLSLPQADISAGLSVAAMVIPQGMSYXXXXPGGPALRLRPVRRLRALSGLLPARLLAPAGGGARGHHLGPAGLGPARHHGRPGRARERPPQPPRRPRRAGSVQPGRGAGGLPGRLPVHRHRRAAPGLAHPPAEPRGDLRLHHRRQHHHRRLAAQVDPGGECAALRLRSGSGAEPGAGAGGGSAAGAGHGLRLRDPPPGHARAVVRAPPPALPPRAGPAGRLCPVHCHHGRLAPGRAGAGGRAAAHSPRGPHRAGPAGRHRGVVAAAAGARAPAQPGGGGLPGGCLRVHIHRAHVGDRQQVPPGADAGAAGHGRGQPGGVGLQLLHHHRLLLALRSFKRRRRQDAAGGGDHGGGPPGCPRLVDPTLHPHVCQRPGMVWD

SEQ ID NO: 14282 - protein, 508 aa, Chlorella protothecoides
  MOD_RES (167)..(170): Any amino acid
  MOD_RES (297)..(300): Any amino acid
  MOD_RES (330)..(333): Any amino acid
  MOD_RES (392)..(395): Any amino acid
  MOD_RES (420)..(423): Any amino acid
MARPAGSSAPAMNAAGGSGTGHATPVEGPTPEQQSSVARFAFLQHVMQQGYILEKNAEALYRQLTLAEDGGWQLDQRYFEFIAKINLDISFAGFELRRLLFPLDNQYYLGYVNRLADEQSKKAHPYSDKDGRPSLSHTSYFKHLWKIALSEPHCFLPNCPHLFSPQXXXXGGPPSPTPATSSTWQARAAPSHSALPWASERPPCSASWRMAGWRSSLRYPAASRWACAPSLNSPAGSWRQRSCRRPPGRSWNAAGLEGRLCGDHSGDAFPPLSIAVVTLLCITNIRGAARCARGYAXXXXYTWEEQELVQKDWEGRCEGLVDTVGEGRIXXXXTHGKNRNWYNKIGREGVKVLSTQLGGCKVHEGLCQAGSNEIMLWVQGDCLSPMHWDGWXXXXLNIPKACGGSKARHCRPVHTMHPRXXXXQLFGGEKRQRPHQHVSIAGPQGDVAQHTQGMWWVSGQALSSESHNAPPRPQGFLHIQDGIHDVCLDVLDTQLVHQACPLHDVQDL

SEQ ID NO: 14283 - protein, 758 aa, Chlorella protothecoides
  MOD_RES (14)..(17): Any amino acid
  MOD_RES (635)..(638): Any amino acid
  MOD_RES (672)..(675): Any amino acid
MRGLIMSNMFRNHXXXXLKWQIQNCPGAPPTWPGIAHVQGMSIPASDNTAWRISTNHNASPDYVKYVLKSWLSLTKLLGRHNAVIESTLAGSVELEVALHELVAVQVSSRCLSSRTMTTRLQLECNVCRICGHFIITSSLLRHIAREHGSVSFHSSIQPALQEGVASAMQDMSASAGFQSICSLNQVGHVVSSRENSWAHGLVSHCQAAGHGLSAWHSPKASHQHPASAPQHASLSSLQAILHYYLSDYSSAEAALQAAQNLPTPAHRVQRDFLATEVALARRLAVPARARLHTERAWLGLASAGPGVGRGGAASAECSTQPEPGLDLHAVHALHEVRASLRERDPAAPGVLESLLADIAALDPGEACSQATSSPGLHACLYLFPNQPRSCPQYSLSLQGEAAEVLTCQASALAGRATQALDPAGPSSESPAIRVALGCGALTCGRPNTAALHFTEALRGCSAAPVPTDAPGGSQPSLPETATRQAACPDALSGAGLAHLQAGRHGLAARCFAGAAQRAQRAPWPWIRLAECAMREEVFRRPLLDALALPPRRPWAWPEEGSELSPGEQRKLLEGWDTGPPDLSANAAAAYLGHARFLIRRRKEEQAVEGVPGALDAQRALDHIDACAEWWAVRXXXXSQLHGRRNRSVEHAQIQTDRLQAGQGPAIKERLXXXXVQALGQITEFDMSCAQLHTFSTTSQLHGRRNRTIEHAQIQTHRLQAGRGPAIKERLNQCSMMRIITLFPISRVFAGDVLMGAQ

SEQ ID NO: 14284 - protein, 583 aa, Chlorella protothecoides
  MOD_RES (381)..(384): Any amino acid
  MOD_RES (529)..(532): Any amino acid
MSGFCTSAARLGAPDAGLLSYAEMTEQARCCVEATAALPIIGDGDTGEGKDGMGISPTGRSGGCWQPGRGDKLAPVRHYIAPPAALPSRSHAGYGNAMNVKRTEAFIDDPLHELLQPFSGRACLPLFLQVPITPAPTEPSGVAQVVWARGQEAGGGQGGGAGAREGGLRCKLWPTTGLSTPSTLLSTTLPRRAFFRDEGSGIVVIARSDARQAVGLSEALHRAAAFAEAGADVVFVDALESDEEMTALCGVAGVVKMANMLEGGRTPILPPHALQAMGFGIVAYPLSLLGVCISGMQQALQDLKGGHIPAGLPSFQVGRGKFKEWWAFPSTLGRLTTTRPQARVRWGHPDKTLCPFPPPVLLPRAPAFEIGCGIPPMRCPXXXXLGIGHGMRPRALGETRSLSPPKLKSCVARPVPMAWTEVDGNSHICYIQVPECSVVIGLFTCCSAARARRSAPVPHGKARGLGPGKPTTEGTRRYSVAKPNQTAELGAHFHLDVVSGAHAFWPDGNHTSTELIPPKYLCCNSEFVXXXXAFWPDGNHTSTELISPKYLCCNSEFVSSYEYTVSGIEEWIGDGMLSVSTVL

SEQ ID NO: 14285 - protein, 162 aa, Chlorella protothecoides
MPHVEVHDKYPVKLYYTLHVGESAHSALGRVSSARSAAAASPEGDSSTTTGSTTSDAESGTGPPASSFQRAAAVPDSQHRVLFVMGLAACGNSEYLEGPLQHLLSLQVGVDAHGRPLVCACTFDNRGVGLSTIPQRWHHYSSTIMAEDVAQLLDHLGWHSKV

SEQ ID NO: 14286 - protein, 201 aa, Chlorella protothecoides
MHIYFFGSSAPTRGAWMEHLGLVLPDVKLDKKLLGCLPGMRRGHEHSSVQCRPTGRHSLHIVPLFRTQSLLLLEGTIPMYYQVGSGGRITWSDLCAFRMMLDAVVVGLTVKYNIPVAVWLPEQFPLAPPIVYVVPTPDMMIKPGHSVVDPSGSVASLYLENWLYPGSNLRILAEVGRQAGLADGVQQAGSRMPAWEWRAFR

SEQ ID NO: 14287 - protein, 656 aa, Chlorella protothecoides
MASCPSPGSHTSTSESGEAGAQSAVSHRGSGQRSPPPASDLNPARPLAGMHLTSSELKAHATCLAALARAGHGTRTVDDVLGWVKAELEARGPGLASEEGSAPTSSSALSQEGPEEPTRPSVAPPQGPAPAQLFAKATHSSHLNYSDILQAFAATASGGNTPPPHLALWWYGGHCLHGAGWSPRTCVPFASDQGAVHPRASGRLLCPSMEPCLDPESLADYLHNLAVLCHEAPDNELVVRPSVHSADPYGASGRAAPAQARGPAPPSRGHPLSSMLGSQPGVPPGPMYQPRPPGQPLPPRPPAHASLLDDGFRGHIVQPLRSSSDPLRLLSALEELERRESGHGPLALGGGLHLGELPWEEAPPALPSLAAHLLPSEGQGLLKTSSAPEHMLRGALAADSQGKRVDGVLGVVGVLSRGPNPGRGVGGPGCECRSGPAWELVLHILRPACRPGAGRHRQAVRAVAGGQDLCAASGLAPLHTLHAGRGAVKGRCWTRQARATKGKHAADVRTPRYDNLPSFDSRCTVPRSEARASTWNKRGLPNIYFSGLNLTKTHVGAPGSGHAERCETPCFDRGCGHHPESIRRHQMQTNVSIIASSSSPYHYISTPIPVRCGTGAQSCRLVVQQEDTAVLATVSQLGGRDAGHAPPVAVQTRYNS

SEQ ID NO: 14288 - protein, 472 aa, Chlorella protothecoides
MSLCSHEVCCSAPVRGSCDSTIRSPEVASTACSCKSLWDPSPHRYVPPCGMCASMRALRFPNTLHIRVRFLHTPGSLPQTHTGAYSIESTGIQYNCSVGTAVRVAVYGMFMSMIVAACLEFAIVAVGLNVGKSDLLTWLWASLFRCRRYGNVRTTGQSPCVIFLLGCEDQGSSCASPVHLVIHFIVSPECKITVPAVYSTYIVRSPSVGAECWDNNPCVYSDELPSACTGPKVAGVSTLSPPCQLVKENSVQWGICFGEWVFYGVSYIFHTEVFPESQWECPGPPPRPEFFDQWLADKYLDGEAVMYRCRVCMYACAHYVVEGPRLSSGQGDFCDEHCTCSQISLGHPHSRADFHSASYKAGRYEQDGSLNWVMKARTRPSFAGNITLLEELVAQDADVGQKELITNIDYSATGGSRSAVALYNEQIRDVRSLTREFEIDFLNATGVPYDPAAAGISAPWFPCQNTTCRQLI

SEQ ID NO: 14289 - protein, 128 aa, Chlorella protothecoides
MKAGPSWSNRTPSTISSLVNRYFRTSLSQGGSQPEMYPPGSVMFLRPFKRGRKKTPVQWDAVWINAAGECRAGCLWLFTKVRNPTLHRSFRWQSVRPLQPWHRPDWGGAAHLPSHDGAPPPVQPDRGV

SEQ ID NO: 14290 - protein, 169 aa, Chlorella protothecoides
MATLAPTTRARTTLAPTTPGVITLVIPMRATPTGGTTTTAWAIVASTRQGSPRSSITATCLSSANMLGSLASRRHPSRSRRRHPPRSRHRHPPRSRHRHPSRSRHRHPSRSPHHHPPRSRHPHPLGSLRHHPPRCLLRPHPRSLRLHPLPLLRPAPLLHRALLPHPPHH

SEQ ID NO: 14291 - protein, 175 aa, Chlorella protothecoides
MTFPPRSGEHAPSGNFQPYPGLSPGPPPDTAPPGSGRTNPAADLFGAGDGGHPGSPLGTPGRGLALLSPDQPPAKIQADLEVARNTVALLGEVLGGVQEGDDPAGVKEDYITDMADQARAMQARLAALAERVTDEALLSSALELNDEAQRALDRHRALVDVAEGRSPPPPRRAVA

SEQ ID NO: 14292 - protein, 278 aa, Chlorella protothecoides
MLNIVEQCCALLLGIPGENVASWSEQRSSPKSAEQYIPVSEAIRLRKSAFCRCARLRMALAQSKEHRIGRRDSPRRRLRARISPARINLDLGFPAVLRLGSADMALCLRRSVADLPGLIGLASRHASFQFHTSTVAPQIPEVPKETVDFGYQSVPRTEKETLVGGVFRSVAPSYDVMNDLMSAGMHRVWKDRLVEKLRPFPGMRHLDVAGGTGDVAFRVLRALREAEAAARPQVPGPGPSRSAPPQKGTVVIADINPAMLLEGRKRAAGEGIGEVVNG

SEQ ID NO: 14293 - protein, 148 aa, Chlorella protothecoides
MKDQHTDVRGWVAYHRAIGVGKFYLVDTGSGESMQSVLQDHIDSGLVDFTYDSGILPTRGTHGPQLGVYQQCIAKASKRNERWMALIDLDEFLVIRDATPDLPTLLHDYESAGALVVNWVVFGSSGQTVRRVWGLASMIGGKGLLAFW

SEQ ID NO: 14294 - protein, 183 aa, Chlorella protothecoides
MKSAACQQGTANGKSVPAHTSAPCFQPLAFVLPPLPHCFPHASLSHPHLLRQVRSPLEPLASFWMCAPDQHSENLHVKSIVQPARVAGGTTDPHHLKYVEPYFAVNTTHDRVDGPKSERQASDRLALYHYALKSEEEYQAKMKRGSGMGNQKTMAFFHYVNNYTAAVCLDGIDKGRYLASFVS

SEQ ID NO: 14295 - protein, 168 aa, Chlorella protothecoides
MEVGIEDCLHIEFEYDSPAFHLDDVVIGRIFFLLVRVKIKHMELEIKRRESVGAGAAARSESDTVAKYEIMDGAPARGEVIPIRLFLAPYDLSPSVDSVHNRFSVKYFLNLVLVDEEDRRYFKQQEITLYRAEEGAGDGAAKGGAARLPRGLVAALPEAPPPNPVAAA

SEQ ID NO: 14296 - protein, 162 aa, Chlorella protothecoides
MDSYTISFGIRNVTDRDAALREAKRVLRPGGRFLCLEFSKVVVPGLQQLYDLYSFAVIPQIGRTLLVPGGWAAHEVAPPRVLLQPAVMLSDPGPFPLFTTFPPTCRLVANDGASYQYLVESIRMFPDQESWARQLEAAGLVGVEYENLMGGVVAIHSGFKLH

SEQ ID NO: 14297 - protein, 603 aa, Chlorella protothecoides
MKPSSSVMDVTKPGDERSRGEGIKAVEELGSMPIIYTPWLNKGARVGSWERAGQVTVKPHVGCPPATLGHGHRRLIPFVPILTPLIGTNFSESERREKHLDGLLPPLSPCCMDGTLDVPTQGHAFTPPQPRHQMVSRLMTQLRNEDLTNLQRNNILKQIMATHTTLFYKALIENIEELAPIVYTPTIGEACQRWSTLFREPLGMYISAFRHRGRFDEVLGNWPNKNVQIIVVTDGSRILGLGDLGTNGIGISIGKTDGLVFMVRAWGGASSSPPQTPPLDSPPQIALYVAAVGFHPEHSLPIVLDMGCNRKELREDGLYLGERRERLEGEEYYAAVDEFCAAVKRRWPHALLQFEDFETSKAFKILEAQRSAMLCFNDDIQGTGAVVTSGFINGMKYQGTRLRDARVVFYGAGSSAVGVAKSIVTYMHKTEGISEEEARACIYMVDSKGLITDTRGDELPEHKQEMARRDGVPDMKDLREIVEYVKPHALIGLSAAGPVWTEPIVQALCQGTESPLVFPLSNPTPKAEISAENAYSWSKGRCIFAGGEGPEGRVGGYVEVPEGRDLPVARALAGHGVPECGGGGRRGVVPWDGVSRAWGRQTI

SEQ ID NO: 14298 - protein, 202 aa, Chlorella protothecoides
MARPAHALRHRSLTPHAHRPPLLTLATGSPFKPVKYDGQTFVPGQANNVFVFPGGSYCAEWGQLPDPFAIAAAAFHLPACVHALSSPGAPIPHPNPPSPPKSGIGFGAIMAKASSVNDEMFVAAAAGLADAVSEAELRGDKRLYPQISNLRQVSLDVAAAVAKAAWDSGVSQLKEAPADWRAYVEERQWWPDHASKQSAATA

SEQ ID NO: 14299 - protein, 264 aa, Chlorella protothecoides
MVRWVHLSAPAASAGHRNKLFGGLGIGHSCSVQLEFRRSGGGGVPTAAVKSTRSASRRDETEDLPVYRSKDTVEGEVRPAGMGRGGLGCWSFRPPLALPPHAPHPTLPQVKITPIPGKRVDHAGIRVQLVGEIELASERGYPHEFLSLVRDLAPPGDLPSQQAYSFSFDNVEMQHDSYLGLKVPPARHRRPGPGPVHGEGLPLLGAQPLPGPPKRGAHQGERGASAGLCPGRRKRGAFLPPRAPLPSPVLVLPMHGLPCPGDAP

SEQ ID NO: 14300 - protein, 557 aa, Chlorella protothecoides
  MOD_RES (399)..(402): Any amino acid
  MOD_RES (526)..(529): Any amino acid
MRQKQVGVHTFNDLSQELLVGGFHGAHRARAGPLGLYREGRKAGSLPGPLPRHAGIDFPDPAQRPRDPSRHQDLARPEAVGMKEAQYEGADAVRKDHVLVAVRFRPMRSASRVAGWGGEEGGRGPQWGLSPHLLPALSAMGAALLHRGAEPSLDACSDREYQRGDREVWECEGQAVGIADQDTGMQVKFMYDHVFGGAASNADVYGAVASPIVASALDGINGTIFAYGVTSSGKTHTMMGSGVAPGMVPQAIAQVFATVARAGARTEFTLRLSMMEIYNEVLNDLLDPARSNLKLREDPRRGVGVEGITEENLVSAEHAIQVIARGNENRKVRNFGVLPPKYWEVPGRRGDGGWRGRGGRLRGRGGERGVQRSAPGQGEGVERSRARFPGHANRVLVHXXXXLQSTGRCLAGGAMVGGEGGEGDQGAAGGERGVQRSASGQGEGVERSRARFPGHANRVLVHLGHPPAYVFMHGSAGPRICASRLTCVCLVAAAHSCLDPTPLPTTPGLTQTAATAFNEGSSRSHXXXXAYASRLICVCLMAAAHSCLDLTPLLTTP

SEQ ID NO: 14301 - protein, 320 aa, Chlorella protothecoides
MRGGRFPMKWMWAPSREQDCKIRQGCDLDADRASLDSGALRSVRSEACISALLPHGQQHAPSHPCTPHHALAGSGARVAVVCTVTPASTQAEETHNTLKFASRAKKIAIAAKRNEIMDQSTLISRYQEEITTLRSQLDIVMRERGWCSVFVLGGVVSRGDDTGNRGGGELRPTMSASQPLAASALDPPCAPACLHVPLWHSACPWPPRPGMMQAQCHPTTHMHEPSPRHPSPSPHPPPALDPGGGLPLHDPLHPEIRTLQERLEEERMALAARDADLDTLRRRLGGLARCVLDGAAAATQLQARLSDPRADGWHAELAAG

SEQ ID NO: 14302 - protein, 75 aa, Chlorella protothecoides
MTTTSPRTPLPPRRLSPGVPGTAGNRARECHISDDGVVHLVAEDSASTLQALAALDMGRARLLARVAHFWRRRAW

SEQ ID NO: 14303 - protein, 228 aa, Chlorella protothecoides
MGTMEPSHQQLLRQVIKRVHPDLFLAHPFEMKVNSDSLQVRMAVDGCELPPGLPTLRMAHQGSAFPSPASLASPLNTTPPQALNAYADQLAVGASPTPAQLEFYVRTGDAQAGLALITASLPGDGDLLPLLSAFGLADEAAARGTGELFAPAASLAAWLRESLSDAARLAGEHAALAAASQELRTAIERAYDLGHLQVGWGGVGVGRGQEGWLAGPLSGWRHLSKPLP

SEQ ID NO: 14304 - protein, 382 aa, Chlorella protothecoides
MLADELFSVLNLSAPGIGKGTREIRATGAGGQGRWACPNTHLGTPPHSAPWRETRDLKLSSSGHFQCAPSVVVEMPLIWGTQQAHREPHACIASPVKPSGARPAFRTTLPETRLPRYAVSWGRSHSMPALPRAAKGDSSEPNHVQEELVSQIQSEIEKKKARANVVDKEVDALADEMRAMVERVKEDTDSRSRQYMQESMDVMDNKLVGLVWEEGKAGLPGADLTPTPPCPQTDLMAELDEYEAVLKRSRQESAENAQELSEWKRDVARRRSKGHFFQSLYTADKEDEERPRRTEEGSRSPAGAAGRADSGRASAEAIQGVAASATSQSLSRGLLVALGSVLLAVVIGDLLSDDPSARADVLYTCLAGLAFWLAWRGVQTSN

SEQ ID NO: 14305 - protein, 323 aa, Chlorella protothecoides
  MOD_RES (47)..(50): Any amino acid
MHARRSARVSFACTASSSNPCTKTSQTPLTPALITGTILPAAAGARXXXXFPIPGADKLRTLNSSSASIEGTSTWVCYHRAHAQRVAVVWEERGSLRSGVRLPLVPSSVPARLAIWTCMPAALQELALHALLPAATLAPNLADPTHPCPHHWNHPPCRSRRKGPEFASEFLKVAPRALRHMLARADAATAGRVRRVIGVWRDRKVFGSAAGRALDELLDDAAGSGAPGAGGPGTAVPGAPHGAPGPGGYHNPPAPGDNDGRSDSPTPVAPEDLLRLLQAAQAARHESAASAASLARVPLQAARSTLDPGAVAAAHAALTAALG

SEQ ID NO: 14306 - protein, 176 aa, Chlorella protothecoides
RAATRPLVVVGAGVLARPDARAVLARVYELLAAGDVVREGWNGFAVLADAAGTVGALDLGFVPGAGARGVAPRAVYLLGADDFEEGDVPADAFVVYQGHHGERGAARADVVLPGAAYTEKFGTYVNAEGRAQSTKAAVGPPGAARDDWKVLRALSEVMGAPLPYDTLAGVRARLAE

SEQ ID NO: 14307 - protein, 131 aa, Chlorella protothecoides
MPPFSAPPTKIFAEIYEAKYRSDFEAAGIWYEHRLIDDMVAQALKSSGGFVWACKNYDGDALKSSGGFVWACKNYDGDVQSDIVAQGYGSLGLMTSVLVTPDGKTMEAEAAHGEGIRGLSSSWGWYMGGCL

SEQ ID NO: 14308 - protein, 738 aa, Chlorella protothecoides
  MOD_RES (50)..(53): Any amino acid
  MOD_RES (101)..(103): Any amino acid
  MOD_RES (130)..(133): Any amino acid
  MOD_RES (518)..(520): Any amino acid
  MOD_RES (635)..(638): Any amino acid
MPSLACCMASVTCTHQLLGSCTQCNAPAWPSIVARTCRKRPSYFFRMVFXXXXALHAAWPASHAHIIPWGPARSAMHPPAPPSWHAPAGSGRRTSSGWCSXXXVWEGAEKGGIRFGGWVDGARGDFPGEXXXXGGQVKWPGEEEGKEVGGRATSVSRGSETVVPCRSVYNAEQETRRIPQTQAATSPMAPSGMRATRRPRPGSQVLLPAQTPAHLAHNTVPLETRPPHPTPDAPLARQGILEAGLGKAADGLLRVVHGQADTRACVWQSGYSHILIITASTRASCTQLQAPCVPSPHPSPSRPSPSSKPTDQLALELEDLKVLHLPAVVWREAQLQLACPGDNQVGGLVLVAKGVPAHHDGLAPARDNARDVLDHDGLTEHGAIQDVADGAVGGAPHLLQAKLPDAGLVGGDGSALDAHIVLLWGGSGVKRSGVPLRAQLGGRPCTVVVFDVEVDVGEDQLLLDLVPNDAGHLVAVQVDDGVQHRNPGCCHCRTGEVTIYTASPSCTARSGQTHSNLXXXTRGLLHERQAKDGDDNPHPMMPQPFMYGEEWTNPFQSPNCYLEHLQSNVSATHALRAWHSSGGGPVLRNGARSWPRISAGPSPPGGGLPSSTRNSWRDNSEQNTRLSFRESVREXXXXGWGAVLRNGARSRPWISAGLSPLGGGLPSSPRNSWRDNSEQNTRLSFRESVRECESFTKYDLRFNGPSSRCSFAPLLCPSDTVLLDWPPGTLNMIACRVA

SEQ ID NO: 14309 - protein, 142 aa, Chlorella protothecoides
MGLGGGEGLTGGGGGILDGTGGDFLDEGGGDVLDEGGGDFLDGGGGDFLAGGGDFLAGGGRKLRTHAGSAHLGCECTCQSMLTDVTIPDILGAKVVFALVAGANVAVAVCRACLLGRLEALHSHQDLRGSIRQDLMVAHTDG

SEQ ID NO: 14310 - protein, 205 aa, Chlorella protothecoides
MAAARIAVLNPIVDLDGDEMTRVIWDQIKEKLIFPYIDLDIKYYDLSVESRDATNDQITVDAAEAIKKYNVGIKCATITPDEARVREFGLKQMWRSPNGTIRNILNGTVFREPIVIENIPRIVPGWRKPIVVGRHAFGDQYKATDLVVPGAGKLELRFTPDDGGEVQNFEVFKFQGELVCGFGRGGWPGRGGVWGGDTGRLKLSA

SEQ ID NO: 14311 - protein, 228 aa, Chlorella protothecoides
MATLVFKLFSLTLKTVSKPLANRLNGALLTHPVVRQRLVKVANVRKCFLKGCAHSYSLHHQAATESGAVGVVHLSAIPPVDPFEQFMHRVEVRITRGAEGRTGKAFIADMDEEHAMEGQAAAWEEDGSHGQESDQTAVLLLLLEQQRKANEDEVKQAKTIADRARVDALHEWHLGAEKFMDASKRNRLQDLQFCPAFAEAERCDNRLATCNEVHGGETGDAGTDAHAA

SEQ ID NO: 14312 - protein, 110 aa, Chlorella protothecoides
MAFMNIAKALVIASLLLLGLTGYQAMQYRETLRLEQLEFTGLPGSLLLNLVVAAVIGLVGGVQYWGNFSPIRLADNPRWGINVLEVLWTSLPWHGAALKCIRSRQSQVSE

SEQ ID NO: 14313 - protein, 333 aa, Chlorella protothecoides
  MOD_RES (14)..(16): Any amino acid
MLAVYGALSYVHLXXXSPLLQSEQVIGFSALRRPYEVHACSVWRSQLRAFALMTSSSHSGHAGARADIFPTKVHKTPFTHYNLFEATRDRAHLCRQSSSPCCRPPGGPSAATVLKGRDGLRVWARLITTQNIQKERGAPKASCSRIRVAGGASTQGLGMRSRCDGSMAACTADLKQNIKCRRCRESNPDHVRPERTGTQHHLTGTYTDRYTTSTGEAAPRELLRKPSPPCPIAVVARTGRVAGHQPHVVVMNDAPADSRIGVLALQGAFREHVTSLQSLPGVEAVEVRTKEQLDGVDGLIIPGDEPLADLRPCSPPRGDVQGLPSHCAMYVRV

SEQ ID NO: 14314 - protein, 646 aa, Chlorella protothecoides
MLKVRHPSFWGRPPVESGTPGDDDECEEKAAQCIPCSESANHRSSWRLFKSRPAHNDQEDRVHRCCGAGILLPLALVELDLGPLFRHVARATSVRLRIAIEDKCCYAHAAYAPNQYHWLTLTHLPLAGGPTMAMIAYKCPDIVVVVLDINEARIAAWNSDKLPIYEPGLDEVVKACRGRNLFFSIDVKKHVAEADIVFVSVNTPTKTRGVGAGKAADLTYWEGAARMIASVSTSSKIIVEKSTVPVKTAEAIEKVLRRNCADPGVDFQILSNPEFLAEGTAIADLTNPDRVLIGGKDNPAGHAAIEQLAAVYAHWVPQERILRTNLWSAELSKLTANAMLAQRISSMNSISALCEATGMCLTLSCRRQDGRLMGLWGFQSCSLPMGRLDALSQPGQYSSGRTVLYACNVHVHRISSRSYPARSGTYSTTRSPSETMRSPPPPMCRLYLEPCQICAWSQNMAPNIHTATLPLTRADVQEVGRSIGTDSRIGSKFLNASVGFGGSCFQKDILNLVYICETVGLKEVAEYWHSVITMNDYQKHRFVERVISSMFNTISKKRIAIYGFAFKKDTGDTRETPAIDVCRGLMADGAHCVIYDPQVGADQVHQDLATPKFEWDHPARAGSTVIGRDEISIVSVSGGRCAGCTG

SEQ ID NO: 14315 - protein, 137 aa, Chlorella protothecoides
  MOD_RES (105)..(107): Any amino acid
MCRSDQGVRTCNLSRSRTEQSSLLDPTQLDSPPSRAQDPYEAAHGAHGICLLTEWDMFATLDYQKRSQQHERPCPSTQIFENMVKPAFIFDGRNTLNHAALREVXXXEDRADHFSGSFSAPGNTSAPAYQHRSLRTW

SEQ ID NO: 14316 - protein, 195 aa, Chlorella protothecoides
MALVAERWGLIPELQRFTRELQRPVWGTCAGLIFLADRAVGTKTGGQALLGGLDVTVARNFFGAQIHSFETRLTAPECLLHAPTAVAGQPTFRALFIRAPAILETGPGVEVLARYHLTPEEAAEDSSRPASVVVAVRSGHLLATSFHPELVGDARWHALFADMVRETIKGKQREERQAREVSPLEARKPRDLPKH

SEQ ID NO: 14317 - protein, 224 aa, Chlorella protothecoides
MPEFLIIALKCVDLEVVVVDLNVSRIAAWNSDKLPIYEPGLDEVVKACRGRNLFFSIDVKKHVAEADIVFVSVNTPTKTRGVGAGKAADLTYWEGAARMIASVSTSSKIIVEKSTVPVKTAEAIEKFDILSNPEFLAEGTAVADLANPDRVLIGGKDGPAGHAAIEELAAVYARWVPQDRILRTSLWSAELSKLTANAMLAQRISSMNSISALCETTGGEVGSS

SEQ ID NO: 14318 - protein, 114 aa, Chlorella protothecoides
MNDYQKQRFVERIITSMFNTISRKNIAIYGFAFKKDTGDTRETPAIDVCHGLVADGAHCVIYDPQVGADQVHRDLATPKFEWDHPSRGQAAIAGRDEIKVVKVGEASIAALVWI

SEQ ID NO: 14319 - protein, 378 aa, Chlorella protothecoides
  MOD_RES (48)..(51): Any amino acid
CCLTYSYHAIPPVRTCDHTHLRTPDPAPPSPHALPFHAFRVPTATGWXXXXVVSEGAHGDRLVVGLTGYPNVGKSSTINALFGSKKTAVAPTPGKTKHFQTLNVTDDLTLCDCPGLVMPQYANSKAEMVAAGVIPIDRLTDVRAPVGAIALRISRRQFSSAYSLHLRGEGGEAPGRGGGAARSGPVAGLGGGVWPARRGAGRAPHPQGLHRWQAHVLQGAAGGGAGGEGRGGGPGTRRHARGVGLFLRSAGAGGALWRRAGGGLHVWGGGQRGGGRAGGVCCRRRRAGPGGPRAAGGAEAASDASDRTLYNTLRAAVSTPTPPRSARAKAEQAGASGTQVPQEGGALKGHAGDRGGPRHQRRRDAAARKARWARQDRV

SEQ ID NO: 14320 - protein, 247 aa, Chlorella protothecoides
MATELARVPCGSHQRLRFSWGPGSELYCCAVNSSEGQLGEEESTSTAVQWDCPGPISRRIIYDAHVKYVECEQVKGDPLLRPAQLEQFCTDVGAIMDASLPDDEELFDEEAQLIAEERALWTILSLFFGGMGESDRLISQVRCLPQCVGGDIGTQCLCRAGWEARAWRGCAWYSWGCMLWTGQHSLFQRGPVSPDCTPCHESLSLDHGGLFSPFPPTGAGQLASGQCCCAPGWGRRQTAVPRLPRRL

SEQ ID NO: 14321 - protein, 436 aa, Chlorella protothecoides
  MOD_RES (111)..(114): Any amino acid
  MOD_RES (271)..(274): Any amino acid
MPRVCVVLASTVPRWCEQHNPTGIGGSPPPLLPAILQAFHLPQCGADGADGPANTESDPWGSSFLHRRRKARAFPVAACSCPALLHSHTVPLPSPSGPGAGKSTLLRLILXXXXPLPSPPGPGAGKSTLLRLILGLEKPWSGTVELGQHSIVPNYFEQNQAEALDPNLSVLETLERWAGAVKEGEELGGIRAAAPDARMDDIKALLGRMMFTGTAQEKTVKWLSGGEKARLALAKFMLTKGTLLVRLWMHAGALGGNRKVQERFPCVPSLXXXXLELWVEVGRCRKGFPACHPCFMTSWPTPYLMQVLDEPTNHLDIPSKETLEEALQAFQGELFPFEGGRDMRLWSVVVVSHDRYFLKKVATRVVGVGGGKLTDYQGDYEFFLSKNKEEGSIMKAKAERDRDLEKSQIKAKSKKTKAEKVGLAVFGWDLVILLLD

SEQ ID NO: 14322 - protein, 303 aa, Chlorella protothecoides
  MOD_RES (282)..(285): Any amino acid
MYEGTVGAGLPIISTLKTLLDTGDDILRIEGVLSAMRSCPRACPAPPMPRPARTASPNPDFTWPPPDSHRSGTLSYIFNTMKPGDRFSEVVWSAKRRGYTEPDAREDLSGGWPGLSWSGATPDLGWMDGSTCGDEGMPGSLPVPATVRHRLSDMVRNRLLPVLLPWWAWRRVDQQVHRSSSIPCALPPSPPAQRRSTHRSTLLAFHPIRHRRDSENHHPGAWGVSWSTQTGHLRSGRPPHHAGRAGCRGRAPARRLGVSQPASTCGTDQLPPPGSYEPMSRXXXXPASTCGTDQLSPGGPTSL

SEQ ID NO: 14323 - protein, 73 aa, Chlorella protothecoides
MDKESTCEHHPDPSHPHLAQIITGKILADGGEVIKARADLRVAMLSQEFGVQLGRTLREEFLSAFEEAVQVGE

SEQ ID NO: 14324 - protein, 167 aa, Chlorella protothecoides
MGTSRKAHAWEPDANHGPTCAWLQANSAASTMFCRRASRGVRAVERRASRPFQAAHRTPRMTVRWAQGPYLSVAQQAIQAGRRACAPDSPPSGTPGCPGCGGLSRGPFRTEFERFSMLGSCPSLPQITKTFKGETVLHDVTWEVKKGEKVGLIGVNGAGKTTQLQVT

SEQ ID NO: 14325 - protein, 322 aa, Chlorella protothecoides
MFWWLKRHSFLGGLVNAKHAGLTQPASGPGPTRDMHVHQSWHLPPSPTQNAKRQEEIQAALENVGEDMDAMGDLLGVQGAVGTRSGLLPAEVGSLSPASRLPHPAPHRADELTHLTATAVELDTSLIEKQTQQMMAKLGFSPDDSERLVASFSGGWQMRMCLGKILLQAGAGLGGGRRVENGMQGLVRSTCGRGAASSCPARVWKSHLRPDLRAPDACTASGLLALRASGPSQLPTPSSMAHLPTQDPDLLLLDEPTNHLDLAAIEWLEGYLREQEIPMVIVSHDREFLDRLCTKIVETERGVTQTYKGASGMESLPCWGWV

SEQ ID NO: 14326 - protein, 236 aa, Chlorella protothecoides
MRRAGVDVSRVLAKPVPTARCCILSAPGQRTMRTAIAGSAALDPGELDAGSCAGAGWLFASAYAAYIPGMLDAAVRAAQAAGARLALDLASFEVVRAFRPTLRALLESGAVALCFANEDEACEVVGERRGADEGGPLRGLAYLAAHCDTAVVTLGERGCVVRSRGSDVVHAQPACTGVRVVDATGAGDLFAAGFLYGTLRGAALPRCAEIGCMAGGAVVQTLGAEMTNATWEWLHS

SEQ ID NO: 14327 - protein, 1316 aa, Chlorella protothecoides
MPDCETCTAAPSARETNLLKWNCHIPGKENTLWEGGFYPLTMEFSEEYPARPPKCKFPAGFFHPNIYPSGTVCLSILNEDEGWRPSITVKQILVGIQVSRLLHKAGAIGHAKPPFTSPVRRLPDVHPAVDRVQEEDQGCGVQVPASTLRAAGPAVIGARAQLERRTESAFTVLPVTSASLHPKAGIEGEPSSPQSGWLAMLSREGSSSTPGAVWDSHACPWQYHFTRLHEHLDTVNLAHGMIIWRRTVDIEDNLTLVHPDVSRSRVGVRTMPGTGAAPQTMARCHRYDGFRKGEGFRALLYFIAYVFGVLSGIGVEKLCLHYELSCEMRGISSPGARAVHESVSGDGIVGNILRLPASTVGEAMIEWVDTRPSCSPTGTYSIESTGIRFNCNVSTAVRLAVYGMFAVLLVSAIVEICIVSIGLKGGPLEEYKRAPIVPLLYAEVFLWVLALAWTGGMARCTRITVAHRALGDEQDGGVYGTYMVVSPVVAAQCWDNNPCAYSNRFPAACTGVPDSGGMDIVLEQDVGKAVLVSGVRVSSKHQEQAAVAKGAWPVERGCDMRIGGHGLHTVASSRTHSIAGANTLSPPCQTLLDNSRQWGGCFEEWFLLGTSYILHDEFRDDSVSAGDWNCSATTPAADNIDGWVANAFFDGDTAPSAAEEKCLVPSATLLGNLSWYLDRADQLLDGSVDDAGFNLDLLIEGGTLAAVRAYNQQLRSLGYLTRNIELAFLNLSGLPYDLERVAQGAPWAGCQNESCAWLIRCAAHAALGIRGKEGHVLPRSAGGLPPCQPEHAHGLEQPPLPPKSCDLARSASDACEQWDLLLALPVPRDNKRYFMILGAVLCHVGGSISPSPSHPAGPCSFLVALAFNSFPDYEDVESWEGGLRVFSRLCCFGNVLHEEVMEERTFSEGEDLKVCTLPLVIGLGEHDAGPRSCDTPLPCCRHVPSRVIAQSLSMLFGSIDLDPTDRLFAALLLAEQQRDQRQINMRLMLDRAGDGGDFGRRAAGHCTTSGRLSCGIALMPSCRPSAIPETPPVQASRCARQRAGPSSRVVVPGIAESLIRKSHMVFGDRACTPSSPGSELWRRATTPCTAGRGCITTTQAWARRTGAGQPRQEWRWPLSARVSACCRPVSHPWRPHAAGQGAAGWRLEESTWPCHNLTATNPGVQTLSPVFRMPAGPQRPVMASALQDMHRMATFAVAAYGVQNQAWNGGRRPVRCSGCIDTLKSLYSRIVGGRHGPRQRNCDAILDLTEEGVSRAFSSAQVSVITQPNLPMAHRMQTDGPALCLILINPSPHNVHPRCKHASRRTPVFGDVGPQP

SEQ ID NO: 14328 - protein, 192 aa, Chlorella protothecoides
MRHTLRVRGVGRVFSDLALACWSRGGVTTRTSGSPSLLPGGNIVCKRCAPDISLPSTPPPARYCKTSYFHDLEQPELYPPGDLAFLRPFKQRHRKESFWDAVWISANGAPLVHGGGVGGFAHAEIAVLRVLVRSLSSAPFCLHADLVGEGIQVSAAMLLHHRVYSLMDALESSLQHAQNLAATPVHCEARPS

SEQ ID NO: 14329 - protein, 364 aa, Chlorella protothecoides
MPELRLFRRRWHIASGTTFCVRGLGCILVVQGTLQPAWHCGRDTFPIVACVLACVHVGFLIPYISGAYSIESTGIQNNCSVGTAVRVAVYGMFAVMVVAACLEFAIVSIGLNGESWIDVARTESRGDWPASLSGYSVPGRGSLDAQGDAPILDPVCTIPPPPPCRYGDVQASGPCHSAFTQHECVRKGNHCSSAPRSRIESVICPPCRINPVAVYGTYIVRSPNVGAECWDNNPCAYSDDLPASCTGPKVAGASAGGASEPSITDHGVVGMALRVSTLSPPCKFVSENSQQWQLCFTEWVVYGVSYVWFAALDTADDWDCQVPPPGTEDVDQWVSDTYLDGEAVMVHRKYGLLHPAAGLACVQD

SEQ ID NO: 14330 - protein, 109 aa, Chlorella protothecoides
MTKRVLALFDVDGTLTVARKVGGCSAGPRWHDHLAVKVGTVGGSDLAKQLEQLGKTGDQGSKQGCLDWTRGNACSRSQMFSPCALCNPTIGGALGPLQGQEDLLWSEQT

SEQ ID NO: 14331 - protein, 201 aa, Chlorella protothecoides
MFSRTLLIYYPREPASREIAKSLNMLFGGIDLDPTDRLFAALLVAEHQSDQRQRNMRHMLSRAGYVTNMQRQGAFIKGSQRRDGGQLSQTPEPRAHRSVSWHLPPSPFSSRTSRVMPMYRRTMMKLDEVALEEGGRFDDAMSGTDSPSLKWVREQLGTRITLAYQYAPIITPVCLPAVYCDHLTPQEAADIYSGVWWCAMG

SEQ ID NO: 14332 - protein, 184 aa, Chlorella protothecoides
MSASLPVGDLEAFFTLDRLRGILRRREGASLKLALTGHSLGAAVACMLGLQLRQECPGLLDSGLVDRAPALQSCLRSLSLPPHTFYRHSVLGILPAGRPDELEPGSADSQVLYLDRGGQGCDQPHVVQCSQADGHPGSAKLRLPGAVQAWASRDEALRRFTSAQQKLPLTTCSPCVPGQQMPSP

SEQ ID NO: 14333 - protein, 119 aa, Chlorella protothecoides
MKVLRQLREKLRLNAAAVQCCAFEHSVGDFLPSLERRSGHAIAVPRLPAHAVTQGRSAVYLQIPMGVEDSMKGLIDLVERKAFVFEGPSGDSVVGALKEGSLRCLAGLWTLSCVCEDVV

SEQ ID NO: 14334 - protein, 536 aa, Chlorella protothecoides
MEAKRTELVERVAEVDEGVGELFLMEEPVDAASLRHGIRRATLSLGFVPVFMGSAFKNKGVQLLLDGVTDYLPCPIDITNTGVDLADSEAPVPVHCTRQASNERPVCACQPGGKRNGVLVLLRPIPCLHASLSTPHSCPPPARSGPLVALAFKLEEGRFGQLTYVRIYSGVLRKGDNIVNQSTGKRLKVPRLVRMHSNELEDIAEAGAGDIVALFGVECASGDTFTDGTRVAMTSIRVPEPVMSLAVAPRARDQSANFSKALNRFQKEDPTFRMAQDGESGQTVISGMGELHLEIYIERMRREYRVDCEVGRPRVNYRETITRAATFDYLHKKQSGGQGQYARVAGRIEPLPPGHPTKFEFENGIIGNVIPPAYLPACEKGFAEAVNSGSLIGHPVEGVRVVLTDGAAHAVDSSELAFKLACVHAFRAAFERAGATVLEPIMRVEVQAPTEFQGGVMGDINRRKGVINGSEQEGDDTVLEASVPLNQMFGYSTALRSMTQGKGEFTMEYQGHQPVTQDVLAELTSNHQAAKTAARG

SEQ ID NO: 14335 - protein, 102 aa, Chlorella protothecoides
MVERFNISSFPAVVAVCGGDAGTTIRHTGDMKSEALAKFVLSFRDGSRCIEAIQLTPETDLNKFKVAQLKKLLASKGVTCPECLEKVDYLHRVQEVFGLASV

SEQ ID NO: 14336 - protein, 737 aa, Chlorella protothecoides
  MOD_RES (45)..(47): Any amino acid
RRPRRRPARAHRLPPPRATGPLRHGPPLPWRRRQGPVAALPRPAXXXSTGCQPPRPRGPCAAARPIHGDDAGDLWQHCLAQLPRARVEEHGAAYPEPHAHGGIDWAAGLEPGLEGAQADLLHQHQRVRQAQGHPVSGPRVRRSPAGPVAQAQAKGDALLRQKQVDGALFAVVGGGGAQHVAGQAGGGGRESRWAGGEERGAAVPLPGSGTSAGPGHDLSAAGLSWRVALGGQALRRQGCSSRQTAGLPSTHPSPSPKYPSALRPLRAPPTVCVPRGEPAAWAGGQGHARTAFPCLPRAGGPVDPRPSEGAPRPGAPASACEQPQPAWGTAAGWGVPARRLPLGLQERIARNKKEQDRHPDRPMDLQRRHTSSTACRASVGSPENTLASTSTCLGWGGEGAMHWKNGWFLGGPMHATSMLIDWRTGRPWMSRGPDMVAGTAPGAEGTSLQSYYYYMPFLRSSESLSAPPDHFSSLGLDQNHPDVWAPAESPAPTAGSARARAGHRPLLQRGGRRGGQWSQQPIRPSSGLGRFCMPHGGVHVAPHFVGAWCSMVLCAQCIYLQDESEAEREASSQEEASDDDAATTSAVGAPPTKLAPALPTPKQPSKRQQAREEEDIDKVLAELGIDQPPTPAHKSTSAPSPDGSHAPTRPTAAPAKPLLAVNMRALKASDELKRMFGAAAVHEDAEDAGAAYAGRAGWAKMCQDEVAILHARISGRHSSLLNNAWCCLACGCHDFRG

SEQ ID NO: 14337 - protein, 66 aa, Chlorella protothecoides
MSSGVELQPMQSSAFVRPYSIMYQLDGRKRRWDAVESHPSVACVLLHKGLDSLIMVRQFRPAVSGT

SEQ ID NO: 14338 - protein, 270 aa, Chlorella protothecoides
MQLLVRGDRTCVVEVGQGATVQTLLQAACDREGSVPAHAARLVHGGRALDADASLASYAIASGATLQLVSRLRGGAGGFTVHPRLQRERWSLYWKETMATTTDLLDDIALDLDPVTATPADVLTATAAAQGWAPVADLLALEGFEGPWERLLFQGRELEAGTPLTEQGVPAGAELTAVRLALVAEGWKGSASLHAPLSFLACVLHVGPRHNEPGAEPSMQCCTFKSNALIPRRPISLQIQADDDDLSSSSDDEAAFVQLHAHQRTGVRAQ

SEQ ID NO: 14339 - protein, 206 aa, Chlorella protothecoides
MERRRPFPLRPPIDSPAPALLPPAPGDAYSLRTPPPRNHRLVALVSCLGPDPASSLARNVLGASTTDHREESAINLLLPEERVTFGLGLSYWSSRGSPDPGSRDWVALRLAHPLVLVQEIRLRPFQAWFQPGGPVYAPVGVRFRIGGPMLFHPGSWQLGEAVLPQVPGVVAMDGAGRGAGAPSLASSPWKGRAMAQGPRGPGGWQP

SEQ ID NO: 14340 - protein, 92 aa, Chlorella protothecoides
MRAAEAAGEPTPPMSVGFTYELCAGIVDKRGLPLTKIMQEEINEECGFHVEEADLEKITSVITALGISGPRMTLFLAEVDDSQALPTRGGLG

SEQ ID NO: 14341 - protein, 113 aa, Chlorella protothecoides
MSIFLRQGGTLGAPDEELLPGQTCPLPPTHPQDFDSPCLKTKQHYNSFTTPFFLDAERWVIPRLQAGGRLSAQDLRGAAEHIRRPLACHRCGQGLANMPKVKDHLHACRAALA

SEQ ID NO: 14342 - protein, 142 aa, Chlorella protothecoides
MDVIFHDELCVGVLDKYPKARAHALVLAREPDLLSVHDLRQRHVSLLRHMLVRFAGLLWEATWVEAATSRLELCEQIQTTACAEARTALACIPRAPAPCHVRRGHAGGVQPGQPRTPACRPSGVAFTRCRPCPSFTCTSSPR

SEQ ID NO: 14343 - protein, 128 aa, Chlorella protothecoides
MATAEVLGQAEDSMPRGVHIIHSLLQPATLPRRLQVYLLFRDASGAVACIQDQCAHRACPLSSGKIVDGCAQCPYHGWQYDGAGGCVSMPSTVFQQVRPQGCRGGCACSQVLRRVRPLLVVPAPVDRA

SEQ ID NO: 14344 - protein, 164 aa, Chlorella protothecoides
MRVWHVAPDVVTFNSLLQAAGAGGSLAGVRATLGALRSASLAPTPTTYAVLFTALAAAGLRDADELWALLRAAGEGGLRPTPHMVSAFLAALRRTAPRDDQVADAVALVDALPWPGENEVTALLSLLRHRPGAAPRHVPALWRAIQAVGVLGCVCMPEGAEAGD

SEQ ID NO: 14345 - protein, 480 aa, Chlorella protothecoides
MEVVLGPGDLLILPRGTIHEGRSLPDTHSLHITLSANQGCSWAALLQAALPGALQEAAQRTLALRRPMGPDFRRLGCHTALEWYASASYSHRAASHIQGAGPGWVACRGAVPARPPAWTGPCPLSCPPPRTPSVCRPRPGTPRGGVDRQDCSPTSRRARRPPLSLPVAGEWELPGLLERRLRRMFKHFTDAVWAHIHIAAEEQWEGFMAERLPQYPPLPRPGSWWLGRGSDRPCFGQAGACCHPPALLRRGGRPVAPVADCARSGGGVAGAMLRTLATAPHPTECRTPTLPALGAGNPCFASPSANALHNTPPSTPTPPTHTNTRTGSVPHTKLHPGSRLSPVAQPGALRFTRPEPGVIRVVHGLFNDRATHARGEAAQEGAGTAGTALDFELRQAGVLAKALLRKDPEAHSVAEIQAMCKGHTEGGEVLQVLQALVAAGLLRVLDPGAQSPKPGRQKRARRADEGAAGGRRHGTGRAGA

SEQ ID NO: 14346 - protein, 541 aa, Chlorella protothecoides
  MOD_RES (260)..(268): Any amino acid
  MOD_RES (350)..(353): Any amino acid
  MOD_RES (427)..(430): Any amino acid
MSILLPVGCSGFEDWLLDKVDVGALLASIARGGELDLMAICRAPSSQRDAPASRRGSLLGRATPRTPQPSAEVTSAATPAPAPADRGLELSIQDVTLDLDESQLKDLTYATFLAAAGDQASPALLGVLRAQLEVSAARSDELRAVAALDAGAKQEIGTLHMHARLLKVGKGGWDSGAAGPPPNPLFPFTATDGAPLLLLQLQELCALAVRHLSHAVVCAAPGGDAALARRQRRLRPRGPGTAARRAAPRRRRRRRRVRRXXXXXXXXXAVVEAAGNVAACCDAGWDFGWLLCASIADRLLRGTFDALSEAEYVAESDELVGLLRARVWPALGITPELHLALYAWVHFRQXXXXDELVGLLRAHVWPALGITPELHLALYAWVHFRQFVLSGEGRLLDSANTIVKALPVLGGAGAGEASGGDGADTAXXXXGAGWGGGRGSERWRRGGHRAQRRDRERRLLDWQHADFLPPGHTAGTGLRRSRLPGPGLPVGGGAGPAARLPWVGGVADGHGAPAGPAPGRGARARHAGRPAVAPARRGAQL

SEQ ID NO: 14347 - protein, 353 aa, Chlorella protothecoides
  MOD_RES (126)..(128): Any amino acid
MFYPRCTPSMDYRGASATPSPARSCSAGGGTEGTLIANAGTPGARPTAVNAPDVFANRRRCMRPSHQPNAVRERDRDRCPSRAPDTCMPTCCLQWRSTALHFPRVHLPYPPPSIYVTLVLSVRPRXXXAHACRLVVFSGGPPFPSCPSALPSPKYLCHVGSFSQAALCIAHMGLSEDPPRRSLLLVLHLRILNVLGAGGARLPGQGGPDLHGGGLQRGHLLLEVRGRGGLKRPPQVGGGRLDLVHHRLRQAVLVLRQALVGGVQCRVSVVPRIDLGLALRVLACKALRVRHHALDLGLGQPATGLDGDGLLLARGLVLGGHMHDAVGVDVKGHLDLGHAARGGRDAHQVELGV

SEQ ID NO: 14348 - protein, 200 aa, Chlorella protothecoides
MVLSATFTQPQVGIKVFQGEREMAGDNNMLGQFDLVGIPPSPRGVPQIEVTFDIDANGIVHVAAKDKSTGKEQSITIQSSGGLSESQIQSMVSDAERFASEDAERKAQIDARNDADAALYSADKSLAEYKDRLPQAVVDEIEAAAADLRGALESASSADLKEKVTALQTASMKIGSSLSGQAGAAGAENVQDAEVKDKKE

SEQ ID NO: 14349 - protein, 130 aa, Chlorella protothecoides
MAGTFLFPCSYEQAGLGGVSLNDTHLPRAPPLPCPSHHRLTLFPPTPPPCAAQGGVLRGDVKDILLLDVTPLSLGIETLGGVMTKLITRNTTIPTKKSQVFSTAADNQTQAQGLAGRQGGGGAGAGAARS

SEQ ID NO: 14350 - protein, 119 aa, Chlorella protothecoides
MLPTGAQHAAPPAPPPGLHGKTLTSSTDDHGNDQAVDAQHTRHDHGDNRLDDQVRPEHSHGGDAHPGLGGSVGRTKACGMGRRKRDEGGPSQHGRASSTGTVTNPIDSQEKARAEAAPR

SEQ ID NO: 14351 - protein, 439 aa, Chlorella protothecoides
  MOD_RES (52)..(55): Any amino acid
  MOD_RES (77)..(80): Any amino acid
  MOD_RES (245)..(248): Any amino acid
MLKFTPFVAGVSPSLVPRQAAGAVGPWVELGGDWLWPERYLGALNRSRWSVXXXXPFVAGVSPSLVPRQAAGSCWPXXXXADATHSCRWQRWDETGMIRNQVGGDGMCGSMSMAITLMPLTGEGTCSQLSLAKPILANLCVRPSHSKLSTCPTPIAAAEDSAGKKPQGNWRQFSPKSEKPGRQLLDTLELVYATTQWPSDDTIQSFWVLHRMPRHQVRHSYGVKMILAVRKCREHCLSDIKDTEXXXXWSEDDLSSQKAEDDQTLPRMTRHWTSNIPEHPCIVSLEQLPKVVLAQAVSQEGPLAAPPPPTLLADIHLRIFPFPSPPCIPGRRVVCSSPAPGAGNSRVWDAAPLQEGKLGAGDAPIADMAARWSHGGGRSRWTKERREGAASGEEVHAVHGAGHRTFKFRRPMESEPLEISHHASSHAGGGAARHAGGEL

SEQ ID NO: 14352 - protein, 204 aa, Chlorella protothecoides
MGRPASGPEPLPSNESHAQIVRSCREEAAKFVDPTTLYSLQLALAVAEERFADAAKCAWTGFLMECGAGGRAGGPVRCEEGPRGARFEDPRFSATRSMCQQRRAQHICLALCWPAFPPPPSPTKPSPPLALSRLQGVIAEGYAQHPGARALVAMQAALQDGRFEEAARHRDELRRVRLIEFQASAVGVDPWEQRNQRRTETDAL

SEQ ID NO: 14353 - protein, 187 aa, Chlorella protothecoides
MCVVRGILGVQRARRLGRAAAAHHEHHPRSLSHLAAAAAPPGSQARPPPSTGSGAPQAPPAAEHDAEASSSQAAGGGPAESSTHPARSQARSATATSRLASGAAAGGAAPSAVSSPLIPSGKVLNEATGNLIGVGKATYCKLLAEGYILDADRGTITPPPKARGGRGAARGSGPGSGTPSRSSRRAS

SEQ ID NO: 14354 - protein, 639 aa, Chlorella protothecoides
MVINALNSGASVYMPDFEDSNSPTWDNMISGQVNLRDAVRRTISMAAAGKTYRLKPEVATMIVRPRGWHLWEKHVSVDGTPVPGGVFDFALFFFHNARALIERGSGPYFYLPKMQSHLEARLWNEVFTEAQLYCGVNLRDAVRRTITHTDPRSGKHYALKEEVAVLTVRPRGWHLWEHHVMVDGAPVPGALFDFGLYFFHNAHRLLENGSGPYFYLPKMEHYLECRLWNEVFVTAQAALGIPRGTIKATCLIETLPAAFQMDEFLYELREHSAGGIRVALDSDPGRVSSHPVDSKPSPHPTHPLLLPGLNCGRWDYMFSFIKTMRNDPSRVMPNRSMLTMEMPFMRAYTLLVIKTCHRRGAFAIGGMSAAIPIKDDPARNAAVMDKVRADKLREPFLRAYSQLVIKTCHRRRVHAIGGMSAFIPIKADAARNAAVMEKVRADKLREVCDGHDGSWVAHPGLIPIAREVFDAHMPGPNQIHRQREDVEVTAAELLAVPEGPRTRAEMRQNVAVTIGYLAAWLGGNGCVPLHNLMEDAATAEISRAQVWQWLRHGVALDDGAPLTATTVKLVILEEMEALRRDLGDAAFSAGAYLDAAFLFKLMALSSELPDFLTLPAYDVSRWEERRGGGEVVGRREACL

SEQ ID NO: 14355 - protein, 135 aa, Chlorella protothecoides
MGIEPQSVEALHAWAKMEAGEGDLNAARRLYAQGLAAAPTNCNVLADLALLEIKEGDLAAAQNLLDTAMQAGPRHPRTLAVCARLRAAQGSRREAAALSMQAQQLGRARRGQLNAIRHRNWPDAGRGRGGEREEG

SEQ ID NO: 14356 - protein, 756 aa, Chlorella protothecoides
  MOD_RES (88)..(91): Any amino acid
  MOD_RES (267)..(270): Any amino acid
PPPCPPFPPLRRTAPPLHHRAAGPGLRSRPAPARVAGADPCPQPRAGQAGGAAGAGPGHLAPRAGVAGLAAGRRACPGRPPVHHAHPXXXXLALLDWLRAGGHAPDDRLCTTLIRVAAQHGEAGEALAIYDWMRRPRREGGAGLAATVYTYTAAARAALAGGMLHRALAVWDDAAADPGCAPDCRLATTLIEVCARTGDADRALGVYARMLAAPRGSRLEPSVHAFTATMRAVAEGGRAGEALAIWADMQRLGCKPTGEMSWLPHQXXXXINGGDVCLCECVCVCAWGGFVGGEGLPIGGSGASASYNRCRGSHISHTSWFQRESWRLVMLDPGCVYHSPRSHPPPPSNHTNEGHAYAAVISACAAGGEWERAVGLFDEMLAARIRPDVVSCTALVAALGAAGQPRRAEGVVRWMARAEVRPNVRTYTALLAAHAGVGDWDRALGLLRELRAGRHGPGLEPNAYTYSALLKAAGEQGEVGLAETLFEGLELEARLDAAKQAALGALRPDEGTWDEGLEDEGLFEALETAAAMGSTPTAKASAVIAGPLESASAWRSPGVHDALTVPESSSSDPDLDASHAAALAVAAVAVARPAASPTACADPQLERLLCTQLGPALGGVDGAASSTPRSGPRGPGAGAEEASARGARGAGDHAVPTTANCKPLLAVSGVPISSSPFPSAATPSDGPQPSLRLAAAAAAAWGVASLDARGAAWGAGDDYGSIADGGTPALAGTAAASGGRDVPSAPHGSPASVLPA

SEQ ID NO: 14357 - protein, 481 aa, Chlorella protothecoides
MATVRDSRALVQSVSGVVRTTHAPLPGIRASQEHSQERLKCCNTVLQTRANEQLQFAPPFSRTSSWPAGFEGPGVPPRKHGRIAPSASSGMAAALRRGAHYCCNLAWDRVHILRSSAMASGLEAAAAKLLNFAEPLDVALLDATVAAFYGASTNDERGSAEAILRKFQEQPDAWTRVDAILETSKNQQSKFFGLQVTCSGMHGRGCGLHGLHSGHAATHRIPHFLCLPDTGAGVSDQDAVGGAARRAARGSQDLHQQPHNQAVHRRVAKPQTHLDTPPSTHPPTQPHHAGCLPARARLPEQAQPGAGGHPQAGPHSPHSFNASPQTTHQAQDWPHKWPSFIPDIVGASHTNAGLCENSMAILRLLSEEVFDFSDSLTAAKTRELKSSFNDQFAQVHELCLAVLNGNAARDLVRATLATLHAFLSWVPLGYIFESNVVDVLLRLLPQPALRNLALQCLTEVRGYLWLMGSGGCGEKEGLGGT

SEQ ID NO: 14358 - protein, 61 aa, Chlorella protothecoides
MALEGSEELQADLLAALDYLVGISYVDDDEVFKTCLDYWNYFVPEVYSFVCTTAGNETAQV

SEQ ID NO: 14359 - protein, 229 aa, Chlorella protothecoides
MASHTVPAVGEFLPRDALAWVEEIISTAWTTFKPGGRLHPQTFIESKGHLVVEAILLALISYLLFQGRQKPQRRKERPLSKEVGTRPGRGCCDSGSLQWCSLETQIKTCSPCPPLPTQEVDELCEEWQPEPLVGKLTAAQAARPPHVITSVSGYSVEVDGKPATSFASTDFLGFSNLEQGRQVCEEAIHKYGVGACGPRGFYGTMDVHLELEVRFVRGMMGRSCGTGCL

SEQ ID NO: 14360 - protein, 105 aa, Chlorella protothecoides
MGAEEAILYSYDIATISSIIPAFANAKDLIVCDEVGPGWRSVLDDGHSDLRCPAEHAGWGSKAPRRPAPTPPLLPLPHRCTPGGKLLHPDGLLPVPSQALDLQAQ

SEQ ID NO: 14361 - protein, 273 aa, Chlorella protothecoides
  MOD_RES (252)..(255): Any amino acid
MQPPPVGSGPGQQGYPPEGLGFPPSSDPGHMQQLVDLLGSKVPPKSTAVVECPKTMVGRVIGKGGETIKALQQYTGAMIQIDQSSDPTRVTIAGLPQALQLAVSMVNDIVRGTFKGFAMLRQIALANASSPGMATYGQQHAPVYVQGYGFVPPSQAYGGGEDPLAGMFRTSPAGPITPPISPMRGAGEGSFSPNLAAMLLGGGQVGGQPGYPGMGPGAMSQGNMSPQHQHHHQDNGEKVMHLAGREGPSGFXXXXAAARSAGSPASRAWARAP

SEQ ID NO: 14362 - protein, 415 aa, Chlorella protothecoides
  MOD_RES (135)..(137): Any amino acid
MWAPSGGTITVAGPFLKLPKERLPARWKLPDEGVGGDDVQQEIDCDLRPSTCRAAGPLSHNSLPSWIHPPSPLPAWMSTSDLPEAEVVIEGALASGSFENGLVIQLVGPACGNRANGEWVHEGVRVILARPMHGXXXMMRQTTGVELKARLPSHDERVLPQLISPCPPSTNGTAPPARRYYDGYLAHLMLFDHAVREEQVAQLYNAYAMSAPPGASPGSSVVTTAGEPSLFPPPAPPVQDTSSGGLSAGEIAGIVIGSLAGAALLAGAVAFALKSRKRRADKFERYAEDPAGLPPPGLPPSLMPAVLPGAYAAGTGGRHMEAEMSSSASSMKYDKEGEGGTPDSQNGGTKVSLLLGGVYPPCFEYKANLDACSRLIHVCRHVRAPTMHGPCENHPRTLMNPFPIGCPHRLDPRAG

SEQ ID NO: 14363 - protein, 66 aa, Chlorella protothecoides
MCLTNVVTFMFNRAELGLGNEYFQTSAGQRDRLLTATDRLGKTSDRIQAGRQQLLETEGNRGGAHG

SEQ ID NO: 14364 - protein, 108 aa, Chlorella protothecoides
MPQSKTAADSPDSFWPESQLQQTSKPSNPATPNHAQELGISVLGDLQRQRETILHSRDALAGVDEGISRSRAILSSMSRRIMQNKIIMWGIVALLLGAIGLIVWAKLS

SEQ ID NO: 14365 - protein, 178 aa, Chlorella protothecoides
MIFGAVSCANWGDYIYEYEPGFYPDPPFVGRGGLKPEHRLKTLDDYRERYACYRTDPDLQELHRKVPMIAVWWVVKVVHVLSRVMRDGLHCAERGLQATFNQQSASCNSIHITCEWHCLSPEVVLFLCLQAPLTHLSDHHRDDHEIADSTWQHGSEDFKGSKEEWGVQKLQALKVGVF

SEQ ID NO: 14366 - protein, 182 aa, Chlorella protothecoides
MTTRSQTDISAILPHWYPAKWRVPRASHLRCADDKLCLPSARGGHAFRLTPRAHPSPVLGSVGEGIEGPIQVVYLSILLSFLVVGAYLVVRQVLARRELEEAAKVFGDRVRSGEGSGEDYLELGVILLRKKLYTQSIKNLEKAKKAWKGPQEELAKGFAHFNLEQWSKAAAAYKQAVELQVL

SEQ ID NO: 14367 - protein, 267 aa, Chlorella protothecoides
MSLLGRRASSIHFNPALTFVSLATISNLASGEKQVENIRKVVAESIAEDRPWQILLSQTIMSQIKAPLLQETLHLQPKLLRKLSGGALNLAMDEKKAGKEGAEQARMYVGLGKYGVPMNPDAWDGFQAERRKACVCLAGASRFLGTSRGVPGAPQEAFAWMGLAGASAFLGTSWGGPGAPHEAFVIEALNQEGANPVIIAGDSHNAWAHNLVDEEGRRLGVEFDGPAVTCIGAFEDIYSRFKAKVGAQWAHIHTALLLTPRRPCSPS

SEQ ID NO: 14368 - protein, 110 aa, Chlorella protothecoides
MTWRRHAPAPPSPGCTQAYGEWIPVRGFDHDNITLDFAHRSFHFGNLASLVRRRGKGVPCRGDGMLAAIPAAREERDHREPGQCPVRAGGRRRDQLLQGDGAEEARGLER

SEQ ID NO: 14369 - protein, 86 aa, Chlorella protothecoides
MTGERATGIFSVVTFSLRRIPLPSKSVQPQYVTAWNNLGDAYEKAKEWRQALDAYNQALVAEPGNSVAQGRAQYCRGKVERMQLGQ

SEQ ID NO: 14370 - protein, 77 aa, Chlorella protothecoides
MIFNPPGVAPRAKMNQQRSRRFKAAKEAAAAAKKAEKAAAKTSDVAEDSKPPVFDSNCITPGTRKGDRGAGWGRVQA

SEQ ID NO: 14371 - protein, 306 aa, Chlorella protothecoides
  MOD_RES (161)..(164): Any amino acid
MPSNFSRTRATFCQSTPPVGIFLVFQGTAAEPSVLCQPSSRDFFGAVFMYPLCNVTSPRKQEGNVKSSTTTRPAHCKTSRWLGSQTQTTRAVHRGKERPAGLRGRRAKPSLPTAAGSAGHRPSLRCTTAFDCTGFHRNGCVRGNRRTHRCLDWQVGGSPAXXXXEWVRSGEPACASLFGLAGGRHSCTPAPTLPPSHPAGIPKFYRWLSERYPLINQPGGATVVPIIDNLYLDMNGIIHNCTHGNNPDVRLTEDEMILRIFTYLDKIFHIVKPQKLLFMAIDGEVSGGKVFEGGRLFPKGSLPCNH

SEQ ID NO: 14372 - protein, 314 aa, Chlorella protothecoides
  MOD_RES (181)..(184): Any amino acid
MGWRIRSHSRRESRLTVCPGRSDRACFLFPLSPSSPPSIRDSTFLYGTHRSKQVQFVGQYDPRGVTCRLEVGGPADLDRMLIKSENATISIPELEFEILGSNTPCLGLTRGDVSSVRDVLLTSITNLQMNQHERAPETAEAIESFLTVRGAVIGVLPPAPCLAVGGNGCTWGPQLTSNKQXXXXGFATGALSCSGWEWMYVGPSTDQQQAREGSTAWSDSSTDCKDMAYRARYLPPLSVQELQKLTEGQQPFTLVMDDPSGNSYIETTGDGDAALTVEQYERSVRQALAIGLPVQAELEENTLESVAEEDELDD

SEQ ID NO: 14373 - protein, 62 aa, Chlorella protothecoides
MVHRLGNVSEKTLERIARASSILLRCAAVAKRCWALLRSQAALVFAIALLLLAIFLRWRGWA

SEQ ID NO: 14374 - protein, 124 aa, Chlorella protothecoides
MPFPFSVERVVDDFVLFCMLIGNDFLPPLPTVDIAEGSLETMFDLYKELLPELGGYLTHAGKLHRGRLEVFLHKLANLEAKVLQERALVSSEAALPGASEVEGEAHASRSCAYVGGASLHWSRP

SEQ ID NO: 14375 - protein, 206 aa, Chlorella protothecoides
MPRFANVWRRGASAPRYRALRQDTSAPGPKLEPFVVQVSWDVGENSAAQRAATFQRQGTLACGDGLLVLPLPKDRLEDAATLLNDSFAESLGYISMYRWAWGVRAGGGDCNEHIRQYLRQHLPLLPKTVILAAFRVGDEQGTELAVEGPGDAEGEEVHLDHEPERELVGIVELSFSASTRTKALTLNPPPVSGGAVVQGACWRVLS

SEQ ID NO: 14376 - protein, 408 aa, Chlorella protothecoides
MPEAQSLDDKKRKKGPGETPAWASERVADRRREERAAGPNAPPAGDEVPELGLGHGGRFAALAPGRGLELLAAVEGLEEEEVEEEVILAPLPAPPAADAEPAPEPAPGAGEAAIPHPTPRPPAKPTMMSQEARDLFLKSASAEEAALAWKERLYVTKLGVGTDPAARWAVVDAYMHGLHWVLEYYYRGVASWNWYYPYHYAPMASDLEPVCLAEPGQASGAPTFSALPNTRKDAPRTQVDLEQVRISFTHGEPFLPYEQLLAVQPAASCQLLPAPYQVDMCWEAGQGLGGREDRVLPPLVGQRRQSSGYACAGLPLLCCQRPGRRAGMAPLGTRAHGHATQLPPPLTLQRFMLDPDSPINFFYPKDFVVDLEGKSERGSGRECRESREGSGGAGVPRPRLPVGGPLDE

SEQ ID NO: 14377 - protein, 62 aa, Chlorella protothecoides
MAVSQTMRRQGIGSFLLSSAEELAQTMGHTHVYLHSRCCGLGADQGMVFPCRHGRAATRLAV

SEQ ID NO: 14378 - protein, 114 aa, Chlorella protothecoides
MRVKFGVLQDLELGELAGTGDFGRVYRARWRGVPVAVKVVQSGPGSVALGPSVWEGLLAASLHHPNVVATYKISTLRSAGSGQGSAAQPDLAGNGGVEGQRRAARPGGKWGGRG

SEQ ID NO: 14379 - protein, 283 aa, Chlorella protothecoides
  MOD_RES (41)..(66): Any amino acid
  MOD_RES (197)..(218): Any amino acid
RRADRPVAVGDAGFWRPRRPRAAGRRAAAGPAGRGGGGARXXXXXXXXXXXXXXXXXXXXXXXXXXLRAEFDVRGDGWRWGPWALDSATAVGSYHSEEGLHLQEVGCLGEGARGGGEGGGVTGRWRLVMGLESGSDVGGGRISEGGNEWAMPGWAGGQSRKRNNDDANPPRASHGRACGRLERRDLPAPSSKLTPPXXXXXXXXXXXXXXXXXXXXXXPDSKTTRPAQFALALGDAKLLVRGGLLGAAQDASLLLTDFPVATLRPLFRGVPALRHAVPAAPPA

SEQ ID NO: 14380 - protein, 107 aa, Chlorella protothecoides
AVPFYPPTHPLNPSTHPTQVGRGIDIERVNIVINYDMPETDDKHGNGADTYLHRVGRAGRFGTKGLAVTFVASPADSEVLNQVQERFDVDIKPLPDSVDASTYMNTA

SEQ ID NO: 14381 - protein, 86 aa, Chlorella protothecoides
MTARLHLPRQPVCHGESGDYRCVEQPSPQLLVPAFLHTLQVSEPMLASVTVSRISGRRLTFDTQLTDSAGAVRVSGSALAMLPPST

SEQ ID NO: 14382 - protein, 213 aa, Chlorella protothecoides
  MOD_RES (161)..(164): Any amino acid
MCIKKEGRMCPPGLGGDKKEAVSVLANGMGAYRCCVGLKTCRHGTRSLLHDAVWPSSLRHHLPSLPSSTQINQKISKTTHLKEMNVEIEKLKLMLNATREKNGGRVTGANELDAAQHLWETWPWRGNQAIQGATIYKQAHQAGAWPGVSRYPWRHGPHACXXXXRGLAWGINTPLETWTPCLPTFALRSTFASPQACTSPPPSMMRSARRGSS

SEQ ID NO: 14383 - protein, 417 aa, Chlorella protothecoides
MRDDLADVLAALHLARATHARIRLNYLWALGYNALAVPVAAGALYPPLRFQLPAWVAGLAMALSSVSVVCSSLLLRRCRPPVVQGCGGEEGRASAAPTPWWRCQGGRGTPRPRPRAEVGLAKYWTASAVPTQLLCREIDSQGKAPGTRPERKLAPPHRPGICKCGQHYLYLLDHQPATTLSFSLRVQTKSCGNSTGERYQSRAHGPVICQGGQPHGRSQCDMERKGGDRSTAARSCYDLGQGIGGGTEPACLHWPSGLPRGQRVRGVGKGVRASGRLLQPGALEPGRTGKGVGWGFGMATMPSPGLCPGIGGITGHGGGGVAMGVPTPPLRALEWPAPIPTPCAAAPSPGAHPCRTEELKTGRCSRPSPAGTDQAPSAGAASATRPAAAIARLSASTSEPHPRRSPSSLPRLTGAPR

SEQ ID NO: 14384 - protein, 77 aa, Chlorella protothecoides
LAAAAVDAERAVQRRASCTAAQALEPLVEGVEAVFRVHQFAGGLNRAATEAATELMRRTVHCARMADPLWLRDAKFA

SEQ ID NO: 14385 - protein, 377 aa, Chlorella protothecoides
  MOD_RES (17)..(20): Any amino acid
  MOD_RES (347)..(349): Any amino acid
MDTTNTSTPQLPPDLEXXXXVVTSVSYHVTVWTVLQLSPDGIPRLASYRLLFIMDTTNTSTPQLPPDLEELSLAGNGIEELPEAIASLPCLTKLQLAGNELRRLPTALTTLQDLRGLWLHGNALETLPEDLGALEALELLSLAGNALRMLPWSVGDLHALRELNLAGNALTALPGSIGGLRGLQTLSLLGNRLEAVPETLGALGALRELWLQGNPGLGALPEELGGLTALTHASAADCGLARVPGSLLALPRLHTLSLYGNRLATLPAEALQQVYYEDDEESMTTMADGGGLAHPVFCVGCGSSGGWGPDVAGDGMSSATHPMPEPPPMVSTDSTHRATLRAPPCGXXXWGLGSRRGQGWDVFCHSPNAGAAADGQH

SEQ ID NO: 14386 - protein, 351 aa, Chlorella protothecoides
MSQDVTVGLDESQLQHAAASVGAVPIPANVQRSEILAPGPGLFKLVRWAGLAGIPAAARPSATQGAPLAAAETLLVAFGSAPGVPNWAGALKKVAARPEVAPFDVLFVVDAARAWYHGELFGMGTGGGTVAQPARPESRDELCACWGASPAAAHPHRHRHARRGRGHRGVRGPPAAGGLVLPPSGPAGRQHGRHGGPPLCRTGHQGGGLLPPGGPGALGHPPRRPRALARRAAAPRRGKCGSVQGRRGRARGNLGARPGAGGASGWVGGGGAMWTWAPWEDGSCRAGSRPPPHPILHHRHMPDHTLGARPGVRVGGGACSPGEQPQAECGAGEEWGARGDHRRLPDASLNP

SEQ ID NO: 14387 - protein, 304 aa, Chlorella protothecoides
MRDCRGIGTLSFGMAETASSRPESTAELASSGADGVTHSVRCRWTLTGFNTSKQLWSPYFTVAGSDGREHDGRVLIYPSGAGLGVPLKTPRPCRHHPLPSYSCRAGDSQALPGYVSVYLQLSDPGNSSKWDVFASYRLSIGTEAQKGREVLSRDSWHRFSARKKSHGTAKGLVAGDIEWKARCGVGCSGSTALCSTSTSVAASRWGWCDFAPHAALTEPGGAAGSLPESVELSLDITILAESTSFSRDPDLSGRVPGASDPCMAGKFLWTVQNFTAFQPLLKTQKIMSPAFTAGAGFWVWEGRE

SEQ ID NO: 14388 - protein, 207 aa, Chlorella protothecoides
MSGRRHPIPGHVWTPAPAGPTPHTEHRMSKAPAVSHRRHRFLVILVVHLLQGLGRQRRQPVPVQAQRVEARQRQEAPRHACQAAVGRGGVCQRRQAAQLLRQRAKARVALEPELAQRAQRPQRLRHRLQPVAQQAQRLQTTQAADGPRQRRQRVARQIELAQGVQVADRPRQHAQRIPRQGQQLQGLQRAQVLWQRLQRVAMQPEAA

SEQ ID NO: 14389 - protein, 248 aa, Chlorella protothecoides
  MOD_RES (52)..(55): Any amino acid
MATFKRHGSRRRIRTLERPADQVQPCTRYPWFHLEPLPQFAPPDVQKLLSGXXXXADQVQPCTRYPCFHLEPLPPFATPDVQKLLSGRPSSLLTRRCWRPSPASWGWSGNVAKAGPSVGPLPQLPSSTRHVGIDWRCHVPRLASPQLVRMLMQPSPSQHLLQGDGKTCLVTGNVGDARVVLVQGGTSYQLTTDHVPDSEDERLRIEAQNPNPKMPLVRYVGGTWRVGGILALSRAFGDAYLKVRAGQA

SEQ ID NO: 14390 - protein, 187 aa, Chlorella protothecoides
MRKEGLVSVAAQGSIVFPQAVTRGHIQQLLSTTPCNLLHIPLLASRVADNLRASVREAMATPLALESLLRVLNSLPLLILPAQPYTETRELTASDTWLVVASDGLFANEERGGGGGLTNQEVSRNCLSGAASTTCPVDMALERVIADELKRKSSLSCEALAKHLAAVAVEKGSTDDVTVVVLRLGQA

SEQ ID NO: 14391 - protein, 295 aa, Chlorella protothecoides
  MOD_RES (66)..(69): Any amino acid
  MOD_RES (169)..(172): Any amino acid
MTTGMKLASLSKILKCANGDDAITMKSEDNGDTITFMFESPEQERLSEFDLKLMDIDSEHLGIPEXXXXSILASLFQGCQAQPQSSPTDNEYDATVKLPAAEFQRIVKDLSTIGDTVEISVTKDAVKFGTTGDIGNANIMCRQNKAADKVCLWRGGGAEEHMLCIVCLXXXXCRQNKAADKVCLWRGGGAEEHMLWIYHLLLSSTTSHFTVSQPDESTEIDINEAVSLTFALRYLNSSLPAPHVAARHPFCSPQLRQGDPLEHTRRPEAQQGAPDPGGVPHPGGGPTCILPGSED

SEQ ID NO: 14392 - protein, 196 aa, Chlorella protothecoides
  MOD_RES (60)..(63): Any amino acid
MFEARLAQGALLKKVRHSGSGLHGTAMAIRSQFNPQSSTLIAQSRRLSAIALPGSRLMSXXXXVNSAITSAIGDSATGISSNGPREFQISTCPLLVCLLRPSSRQVVEAIKDLIEDANFDCNSSGFSLQAMDSSHVSLVALSLRADGFEHYRCDRNVSMGELQCVIRWRCMTSRGCRAMFASTDCYGAHMLSALKP

SEQ ID NO: 14393 - protein, 189 aa, Chlorella protothecoides
MPNLVPPVTTTPMVGSDCMLSMYGALFGKGCYFCHERNSMAKTCRWFTTVNPVKQISSAQRAGVCGGLESMLLGTTEPIGTHSLMRFTVWSVGSTARGSFVTASSTPSVTSLTIIRPDDWHLHVRDGPGLASVVPHTAEHFGRAIIMPNLVPPVTTTPMVGSVCMLSMCGALFGKGCYFCHERNSMAKT

SEQ ID NO: 14394 - protein, 76 aa, Chlorella protothecoides
MSLTHTGRDVYIDVSGWHLYLRDVKVPDSGGTTLASGLAAMLAQEGDGADVAGGLGQVPVPLGGGQVGDLKSGIGI

SEQ ID NO: 14395 - protein, 345 aa, Chlorella protothecoides
MTSHSSEAAARPLQHPTVAWINLAKIVLAVHGEVTDPAVDFFDREAVFIERVLRPLLDKAKIVLAVHGEVTDPAVDFFDREAVFIERVLRPLLDKESTTHCMPASASLANWGDMNLASCHSVSPTPPAATGCGIRLLTQPGPHPPPTPALPGQVPDLKVVMEHITTRQAADFVAEHAGTGRLAASLTPQHMLLNRNALFQGGLRPHAFCLPILKREEHRQAVLAAACSGSPAFFLGTDSAPHPKHAKESACGCAGIYSAPVALGLYAAAFEGAGRLDRLEGFASLHGPDFYGLPRNAGEARGWQSPMWGVQVDGPSFCESLAWTPSDHAMMTWYSTRVSNPLQTP

SEQ ID NO: 14396 - protein, 463 aa, Chlorella protothecoides
MPGLSSPRPRTLPPPRYNLPAHRPHPLSSRRPLWFWQDDAAGPRGHCRPRGTSCRPTDHTPSCHAGPSGSGKTTLLDVLAGRKTTGKQEGAVLYGGVQPSGPFLRRYTGYVEQFDTLLGNLTVRENLQYTAELKARVSLPLADKVARVERSLRQLGLETCQNVLVGTPAKRGVSGGQLKRTNIGLALVTSPLVLFLDEPTTGLDSYTSQEVMDTVAELARTGITVCATIHSPTPHVFRLFDRLFVILQGRTAYFGPNSEFRVWSEGGKERAAQGLDGLSERSSLSDVEYMTDIVVQSDRQGRSDAITDYYAASDLAAQNREDLGRLAGVLNDLTPSQREYLAVKRATVTPSWFGLKTLIKYRLRADLKDPLFLLPRVVDKLLIGFILFTLYWWGGLEGVGLSFEGDSRGHSQWSSTGAQDPGLNSFASSRHPRRACGQAWSSPLKRKSSNPHSLTVTLSLSLW

SEQ ID NO: 14397 - protein, 274 aa, Chlorella protothecoides
MWTVVVAYSASAYIPAILMERPLFIRERSDGLFRVVTYLGFKLLEEFSVQFILCLPISAMVFYPLELSGSWALFWLVYYFTTLVGISLGYFIAALSPNMDVANAALPLFITIFLFFTGLLIRWVDTPWYWRWVGYVNFLRYSWGALMINQFQGANAIYLGSECHVKAGWAHAAAPASNTLHAGGPGWWSKCTRRLLCGQHPCHACSRHLVNASAPPRAPVPGPGVLCAERVRCLAVLRLSDHLCGGVQLLGLARIGLHQARRAMKTAPWDHRRP

SEQ ID NO: 14398 - protein, 99 aa, Chlorella protothecoides
MPTVHRLILTGAPIQNRLTELWSLFDFVFPGKLGTLPVFQAQFGLPIQIGGYANASALQVSTAYKCAVVLRDVVGPYLLRRRKADVDVALPPKTEQARW

SEQ ID NO: 14399 - protein, 296 aa, Chlorella protothecoides
MGVRERRRVRLDHPPANAVPWEMCLTYQLGPGASHRHDHPSPTLRRVDEGYWRQGNSEYVQPVKRRRRPRLRKLRGPREESASSGEDVGGERDDADEANFDARQAARARRRDRGVAEEGGSGSEAEPEEDALVEFEGGFRISAGIYDRLFEYQRTGVKWLWELHTHRTGGILGDEMGLGKTVQIGAFLAGLLASGLYRPSLIVCPATVLRQWLRELRAWAPDLRVGIMHGLAGGARGAQALVSELAGSAAGLLLTTYEHMRLQRELLLSVDWGYVILDEGHKIRFFGGVGGTQGGS

SEQ ID NO: 14400 - protein, 107 aa, Chlorella protothecoides
MAMLQPQIQFSPLEHNARLQDYGNQERSGKLVVLARVLKHWHAQGHKALVFTQTQQMLDIVEKTVNTEGYRYHRMDGATAVSQRALLMDDFNDNPNGVCDVVRVIVG

SEQ ID NO: 14401 - protein, 62 aa, Chlorella protothecoides
MLTPVQRDLYKAYLASKDLKDIFAGHRAALAGIDILRKICNHPDLLDRARWEASEVCGEDGE

SEQ ID NO: 14402 - protein, 284 aa, Chlorella protothecoides
MMDNEDDSVDQETLLARYKDAARELQAIQSMVSSQAPEGLQASLMRQRQEGLQAALDRAGCELEAAGLPRPRVGDAGAPTSIQSEREGLPKTQAVPGQARSSAKGKAAAEELVEDDLFSEGEGKASSGALGKGSSGALVETDRDRLIRLGVLTPFDNVNGFERRVMHSKAGPSGRASPEGGSVVAGVLLVGGWEENRMCRDEGASDACSKDVYACQVVLKWQQPPLGYHLPGALIHFQQRSRGPRPPSAWPPGWRASRLPATPPGCWTPRTCLSRNAPPSALQE

SEQ ID NO: 14403 - protein, 782 aa, Chlorella protothecoides
  MOD_RES (131)..(134): Any amino acid
  MOD_RES (237)..(240): Any amino acid
MHAGAGPITPGNIFYDAPPAGMQQHGRCETFVAILPDCSPAGWAVAVSYTRQLSHRAGGGSAESLLVAHGPAAVAACAECREAFPPGLAICHVMNSGFDTSGHGGPVNGVWQFTPQHYSKLAVRSTGPSTXXXXATACVKGLWQYRIKRDAPQQDGLLRCRTTPFPPRHRAGGSASMHLDMEVPSMESGSSHPSITPNQQSGARARAQSPALGAPAPGYMGRTPPGWVHTWYAPAPXXXXLMSYPISSWPHGAYLSRMGPHLIITLCFLATLTAYVERTGFSIAYTGMAKTAGLSESVKGTVLSAFYWGYALSQVDLRADLGPLCAVNISAGLPRGALVEHTCLHAAHLQGFPAWTNPARRCFTLPSQLCVCGMLGNQSAGMVHKSSPLLHINNSSKIPGGMAAQRYGGDVMLSLSFALWATASLLTPGTAESVRAIILARVCVGVAQGFLIPAVHTGRPVGGWWRCSSRVSSRRYRPGFPVVHMPSSAQVGPLLACPCLPSVPPHKDNASQHPLCLLGPVATQFCLRLPTPTHAVLSAWVPPTERARAVSLTTSGMYLGSALAMQALPAVAAAFGPASLLRLSGALGLAWLLTWRASLATLGRRPPSIPVSSSGPADDGKGFAPGSRGRPGATPWRAMLRSPAVWAIVANNFTFHYAFYVLMNWIPTYFDKVLGADLSTMGAAKTLPYLTMFAASNAGGWAGDWLINTRRAGVAAGRKAVNTAGFWAAAAALLLMPGARSVAGGVAVTTLALGTCGFARGGFSVNHMDIAPKFAGIVMCAF

SEQ ID NO: 14404 - protein, 526 aa, Chlorella protothecoides
  MOD_RES (21)..(24): Any amino acid
  MOD_RES (148)..(150): Any amino acid
  MOD_RES (376)..(379): Any amino acid
MGIFAIGWRVGLFGMCCAPPXXXXPPKSIRLEFDGASKNNPGPAGLGAVLYDADSGREVKRVCHYMGHRTNNQAEYGGLIAGLQAAKELGCRDIHISGDSLLVINQLKGDWRVQHEGLKPYHAVATSLLGSFDKVEARQVPRDDVAPXXXWRRARCLGTTWRKLHEMEHECGGGCAVQPGHLGAPVRHYLAGLAAGEPLHSAVMLHSRNADKVLALHGSPAILDHPRPAPFWHERFPLSVTDDIYRCARARESWQKGSGQGSRGRTVLGVVVLTECGCPKPLSVPPVSLPTLCNNPCPMLGKARRACGSVKGGILGRVWAWATCQTAPAQSRGGEALASAPLMKPHSPEALRGSAAVACSLHGRFGRGERDCTGAXXXXPHSPEALRGSTAVACCLHGRFGRGERDCTGASGSRPWPSHALAAIRLPVALPRKLQRPCRVRTPLPSTPLPTVPVGVQLPLKLGHAGQGGPELRDLHLRCMDGLARRMSGPDRCSDGEEMTPPVAAVRAMPASLQARLPQIPASPPA

SEQ ID NO: 14405 - protein, 463 aa, Chlorella protothecoides
MEGWWLGAASPRHHHACRLKHQNFLHIHVPTVWHKPKTTLSQWMHPTSTIRNLHPQDDGDLAREISSRACARCSGSQNGKESGLSRSHLRRPMSIKSLHYEVKMDVGRRDPSLAKTASDPRPSAVFASGKGPFHNVRGGKRRWDAHVKAHCNPSLDPPILDFAPAVEALLGPLEQSVTSASSACWQLAEVPVQVKGSLFGTKTLQVQQAHFQEEKEREGLAAALAAWQREALGPGLCGALDLAVAQERLLHVVARSLDAAEDGSLDARLAALGALLSAHPAAARIPPALRFLQHAAWRVAAAEPRLPQASLLRTLGSHPGACDAWAAHLLTLAAGEGAGPGVNSGPLLSVLRSLPDACALPASLLESVVQGTDWAALDNTTLARLAGLLAERAPCAGDEGAAQAAGIAAVLGALSRAGRVARSQAARGAVWGAVATVILAYARGRPATVCFQRGGGALEVWPS

SEQ ID NO: 14406 - protein, 334 aa, Chlorella protothecoides
MLDVALRRLKGFQTQIQLQGLGRRDAGAATRKEGGGLLDRVKDILRPSEGRDEGECDCAGDAVRVGACPASRSKIPVLSSAAALPCFPSSRGTLAPHSPDHKGMGTRLPQTYLPMADPDDPAPPSPEPGPAPAAPNKLPKVWAKGLSAVRSKILPSSRGASPAKGQPPGRGRGPSVDQGPHNALSGHPRSDSALEQGDWVRLGLAAFAIAAYVRSVLCPSLVTPPRVGPADMSPATPLGQAQHSHARSISMGSWRWDEHLLRELDTVLEARGELDVLEQLRGCPALVQHGEEFHAFFTLVPELLSASTGVPAFQLRLQQLLLPGSEILHLLQTC

SEQ ID NO: 14407 - protein, 286 aa, Chlorella protothecoides
MDPDGDEDAAHDADFLLSTQELVWVVDPATGRPPFLGSGTFSTVYRAALGSGEAVAVKCLSVLPDAEGGNHVPLDVVRREAAVLRSCRSRYVVNFQGVVLPTALAAAAGTGREPPVPRGSLLVVTELVQGGDLYSALRAGRMRWYDGGARVAHDVAAGLAYLHSRRIIHFDLKSRNTLLTERGRAKLGDVGQARMLPFARSFLSSELHVGTWSHAAPETILGQRCTVQSDIYSYGVLLWEIVTGSVPIRNEMREVRWKLSFFLRGPGGGKGWVRGGRDWAQGELPE

SEQ ID NO: 14408 - protein, 156 aa, Chlorella protothecoides
  MOD_RES (18)..(21): Any amino acid
  MOD_RES (102)..(105): Any amino acid
  MOD_RES (132)..(135): Any amino acid
MEAGKIRGCSLRHRVKLXXXXCRHLLPGEPKEAGKIRSCSLRHRVKLHPVCIMKTTSLPGMQIGGCMEAFMIRTGFYERVTAIEAGRLEETREEREAFLAAXXXXDPNRLLRKAQVEQKTGGPLPPTLSQEXXXXKAQVEQKTGAPLPPLLSQEKP

SEQ ID NO: 14409 - protein, 125 aa, Chlorella protothecoides
MWGEKRRLRWQGGGPARAVAGHSWLFRGPCLSLQPLECDQGACPSSLIPVLQSTLFNALCSNSKAQAANFPFCTIEPNVGVVAVPDPRLDILVSMSKSGKAGLAWEGVQGPDRDVFIAHHFVSSP

SEQ ID NO: 14410 - protein, 503 aa, Chlorella protothecoides
MYGARPVPPQSGSGWSVLRHFDAFPKQREEAKEFFQSTMAGGVITLVAAALMTLLFVSELGEEGCDGGGGSLAARGDRRPSPNQAVSQPPTGIFMHTDTVTELLVDTSRGEKMDIHRGCDGRQRRAPAGRGGMAQPRDQGSGRAAGEAHACRGAGGRGRPCGSRDSCSIPAFFHHHPQDHTVFRRRLSPEGLAIGEDSEHHVGPTGQPLPAALGGSNATAACGSCYGAEFEAGKCCNTCEEVREAYRRRGWAVRDTATVIQCAEDHYLEEIKASRGGGCRIYGALSINKVAGNLHLAPGKSYQAGHMHVHDTSPFVGEVFDFSHTIDNLAFGQEYPGNGRARGKEECCAGPHGGSGDGSHAGRAPEEDGSSCAPARFHASASHACRIVIPADPAASPFPLSTLFTLPRQGMHNPLDGVDVHAVRDSHDRPVLGQHQYFLKVVPTEYHATRGAVIETNQFSVTEHFKPSGGMGQELTGIFFFYDLSPIKAGPREGGVRGLEVEG

SEQ ID NO: 14411 - protein, 212 aa, Chlorella protothecoides
MSDGDQAKPLRRDAASLGWLAQSSVQPRKRTAIEGVSGTSLVSLRSQLASKQQEAAATRSGALDPEELRARRKGRDVLSQSNPGVTSRDARDRADLPATPGDVLAASRAALERKAALYERLAAGEDSAGGEYEVDFALKAPDTARFAVTGGLVSRDMLAERKRRAWMEEEEVEANHAQESEAEARRRSRIDVSLGGPCVLCVLEGAAPRRAP

SEQ ID NO: 14412 - protein, 168 aa, Chlorella protothecoides
MHVLPQAVPHPPSTSPALARTPAQVGSSLLFVACIGIIIPTMAKRIYGSEVMTDAAVINLSHAIAILLMSASMDLEFALGLRPVWRRLHRLIGRRRPMQGCKTAHAEAFGGAQSTRLLFGYFCYLTFQLKTHSDLFASGESEDNPALSLSGALAFLSAITVIVAVCSE

SEQ ID NO: 14413 - protein, 143 aa, Chlorella protothecoides
MHGHRAREGESGLDDQGGHDRAPGASAVCTGVVGGDGGGAVVVERAAGAHVHVHGLSKGQGALPPGRCRGRCRRILPLPHNSQAAGVIHTDFEKGFIRAETVAYKDFVAVGGLAAAKEKGLTRLEGKDYVVKEGDIMLFRFNV

SEQ ID NO: 14414 - protein, 68 aa, Chlorella protothecoides
MWWASIQGRGHRGMASHHTLPYNCHPQVVRCFENDDVIHVDGRVNPVEDIDTINFELALADIGQVEKR

SEQ ID NO: 14415 - protein, 118 aa, Chlorella protothecoides
MEWRFGALVRLVKTWAKAHSLNDASAGSLNSHALTLLTRPVPLLPPLKAIFPGKGDRVNKAALAPADLLSAMDLLRGWRDAVPENTETLSELFLAFFQVTAPLLKLWATGLEQDPLAE

SEQ ID NO: 14416 - protein, 253 aa, Chlorella protothecoides
MDISRRQLHLVSADAARRSGVDGADQEGNLSLSTSLRSPRLSSRSRASGHLEEPLLDPEAAAEAGESPAGNGALPPHQPPRGAHNSERARRHWRFAASHVSKLMPDNFANSDSDTASILSERRLARRGGDRSRDAIAQTFISTLAGTLGTGTVLQNQSIAMEHHPGVWSPGSDARCIGLMLVSSYINVLLACIPVGILAGALGWSPTLVFIMVRIVKGEWGGRGTVCKEGHSLACHTREGSARCRICTVGPRT

SEQ ID NO: 14417 - protein, 100 aa, Chlorella protothecoides
MRVLGVGWGLQGDLNPSRSGLAADMAAIAPLHVRQPDPNPLPPSTTNQVTFIERRSSFLAFLTSTCAIVGGVFTISGIVDATVYHGQKMLRKKLEMGKQF

SEQ ID NO: 14418 - protein, 107 aa, Chlorella protothecoides
MKPLTYAANVGEADLADKGASNPHVQALQAKAAEEGCGVVLVSAQVEAELTDLDAAEAAEYLADLGASEGGLKSLVRTTYTQLGLLTYFTTGGQRGGTGCWRCGVGV

SEQ ID NO: 14419 - protein, 250 aa, Chlorella protothecoides
  MOD_RES (65)..(68): Any amino acid
PGRRALPRPPCGGRPPRRRPRRARLAGGGPGDRGRIARSGRGWGPFAGGTEPGRQLPPARPRRIXXXXEEDPGTGVESHGLGVAGAPLLAARSRAGSSLQHDPAASSASTLLALRCLRGWAQASVVNCATLARAGAGPVLPRFLALAAGQPERQELCGLMKDLARGCPPSVPLEAAGWLHPQLCTAADAAAAGEGALLHASLTAFAACVRRRGPGDGVPVRDIGILDEAGVGGDVQVLGGAPMHGAGRGR

SEQ ID NO: 14420 - protein, 109 aa, Chlorella protothecoides
MPYEFLVWLLAVLIQAAVLAINMHITLQFTDLENDNTNPHDAASAINSVVLWEYGLEGFLAIWLILNGKWFSALLPLAILAFHIQQARWILAWGVGMMGHAFSPGGLVL

SEQ ID NO: 14421 - protein, 809 aa, Chlorella protothecoides
MHDIKQTERKQPQTALLTLDLDLGGHLLDLLLGVGDVHQVAEVQLVHGVARCADLCVHLVPAADGSVVERGEEALVAPLLVGRIQPVLRLVGHGGGGSQRQHAGAHACAGRSTGPALRAARCIGLAVDPGLGQARGQPREVLREVVRVGSRDRDEARRGVWDVWTGSAGTTPTGGGATGGPGAQRGPNRLSTRCHRHPWRTCDSRLDPLSLVCRPQRMARTKAPPAERIATLALLYAMCTAERRGTLSNPGSTIAAYALANFAGSAPGMAGFSARSISCHTARLPRRRRVPVHLFVRGIWGGSPVSPGSKGPTMLQRSGSRAAEHVRTCLRAYSSAPEKTSFGGLEDKDRIFTNIYGRHDPFLKEGLRRCPAVLVWARWDVNPGVRLPSSCEYHPLVQPCQGAEKRGDWHRTKDLVSKGADWIVDQMKKSGLRGRGGAGFPSGLKWSFMPKVSDGRPGYLVVNGDESEPGTCKDREIMRHEPHKLVEGCLIAGTAMRARAGYIYVRGEFVAERLALQRAIDEAYAAGYLGRDACGSGKDFDLAVHWGAGAYICGEETALIESLEGKQGKPRLKPPFPANVGLYGCPTTVTNVETVAVSPTILRRGPEWFSGMGRKNNHGTKLFAISGHVNRPVTVEEEMSIPLRELIERHAGGVRGGWDNLLAVIPGGSSVPLLPKHACEDVLMDFDALKERQSGLGTAAVIVMNKSTDVIEAIARLSYFYKHESCGQCTPCREGTSWLYDVMTRMKAGDARLEEIDMLWELTKQIEGHTICALGDAAAWPVQGLIRHFRPLMEQRIEQAAEELQRIAA

SEQ ID NO: 14422 - protein, 292 aa, Chlorella protothecoides
MADEAEHGLDAPNQKWSHEGFFSSFDHRAIRRGYQVYTQVCATCHSVNQLHFRNLVDVAYTEEEVKEMAAEIEVQGEQRGTLSSEQGWIQGSACLCMHAIPLLAASPPTHLMPLPLPTTQLTDGPNDEGEMFDRPGRLSDKLPQPYANEEGARYANGGAYPPDLSLITKARHNGENYVFSLLLGYREPPEGISVREGLYYNPYFPGGAIAMPKMLNDEGVEYDDGTPATEAQQAKDVVTFLAWAAEPELDERKLMGAKWIGVLALVLATTIYYKRWKWAPVKSRRVIVDALN

SEQ ID NO: 14423 - protein, 533 aa, Chlorella protothecoides
MLPPQAVKQFDYGQYKLVHEALHERKTFLSNAPHLSHELPIMTPCYSWWEVPYYWAGMKLYDAVAGGKALSWSYYLGPTKSRAQFPTMAGDRPDGKTLKGTIVYYDGQFNDARLAVSLAVTAALAGATVVNHAEATSLIKAPDGRVTGAVVTDGLTGRATRVHARTVINATGPFADGLRRLSDPSTTPMIMPSAGVHVTLPDYYSPENVGLIVPKTKDGRVVFMLPWLGHTIAGTTDADCAVTMRPQAREEEVQFILDAIADYLTVKVRRSDVMSAWAGIRPLALDPNAADTASASRDHIVTVDPDGIITVTGGKWTTYRLMAQDAIDRVLRERGAAAGPCVTAALPLVGGAGFYPGLFTEVAQTYKVPHRPGAIDTKIAKYLVESYGDRAHEVTRIAEERRLGRRLVQGHPTLEAEVVYAVHNEFCETPEDFVARRTRFAFLDKRACEQALPRVSERVGGPAPTLLPSHTPIFNTRAPNKPPTHIQTKQQVVELMAKEKGWGRWKAAAELKRALEFIKTFDSPDHPAFVPTA

SEQ ID NO: 14424 - protein, 80 aa, Chlorella protothecoides
MRRLVLRSSLLAVGAGAGYALTGSSLADAKGVAPKLADRVPSREERLASLAKGTAENPFDVLIIGGGATGTGCALDAVTR

SEQ ID NO: 14425 - protein, 452 aa, Chlorella protothecoides
MASPGASGPSPCTMIIRPPLPKNQPCPSGGDALQLLGGLLDALLHEGSEVADEALHGPGRGVAQRADGVPLDLLGQLPEHVDLLQPRIPRLHAGHDVVEPGGALAARRALPARLVLVEVGQARDGLDHVGGLVHHDHRGGAQARLPLLERVKVHQHVLARVLGQERDGGAARDDGQQVVPAAAHAAGVALDQLAQRDAHLLLHRDGAVDVPRDGKELGAVVVLAPHAGEPLGAAAQDGGAHRHRLHVGHGGGAAVETHVGGEGRLQPRLALLPLQRLDQRGLLAADVGARAPVHRQVKVLARPAGVPAQVPRRVRLVDSALQGQALRHELAADVDVAGARAHGRPRDQAPLYQLVGFVAHDLAVLARARLRLVAVHHQVPGAAVRHLGHEGPVKQGCDARGEAGAAAAAQARLLHLVHDPVGALAHQILGAVPVPTLLRTLTGLDQWVVLAG

SEQ ID NO: 14426 - protein, 256 aa, Chlorella protothecoides
MDSQTLPSLPPSPTPAGSTYSTSATGATAVSGAVGSQVLTGTTAGTGGLPPSSYSFAVPAAEGGAQQAGSVTPTGSNAASSVTGSGPVSAVSVAGPGSATTSTTQDGVTTTGGTGLAGFSPAAGRLGLEAGGVVPVAPLQAQDSGFSFSAPGAQQAGAVTPTGTNAASSVVGTGSVSAVASATPAGASTSTTQGGQTTSMQTGGAAGGSPLTPGAAALAPAPEAEAEAYVARVSAAGAGSATSQACDSEGVAMELP

SEQ ID NO: 14427 - protein, 168 aa, Chlorella protothecoides
MPRGVTSLLLGCAVLAVVAGQAVPTSEAGTPVTKTIPLAAFSNISICTPLNTLVLPGPAGQYGIVLSGEPEVLAEIDASVTGQVLSIVLNGPIDTSQEVKVTVMLPADALSAVEHYAPGADVVIARGFKATDFSAKSAFGAGELYIQGLTATNVQLDVAGCVRFWMSG

SEQ ID NO: 14428 - protein, 239 aa, Chlorella protothecoides
MRPDGMLCESTPTPKREWTGGLHGGLQRGEQGAGALVAGTAAAQSAVLPASSPVPVMVGRRLTRQRWRANRCTTAQPAPSHRSQRRWPRQRAIPQRTQRLARGRGGDRARARRPPLLLAVRGGFSLAPPHARVQAAALQQLRMAAALHHLPLRQYHDGVGVGHRGQAVCHDEHAAVRALGRQAGLDARLRQPVQRGRCLVQHQDGRVLQDGARECHALLLPAAQSQAPLPDHRVVALCY

SEQ ID NO: 14429 - protein, 183 aa, Chlorella protothecoides
MEYRPSAPVCLHSLQGRRGHAAGGLERDPIALRGEARGDEKHVGESPTCIDAEPVLGESRGVRDPETLAKLQHDASEAAEFITTHVVQAATNERGNLGGLGLGDACVVVPPARSPPGSAWCSNRPVQPPAGQSSSRNIICSTEMTVPPITHGSEAEPVLPGMRLPREKKGRKAADANDGPRAE

SEQ ID NO: 14430 - protein, 243 aa, Chlorella protothecoides
MRIPRQASDQLYSDFSTMMLPESATSSLVGAQIVPAPAAAPATQAVNSHSSWDGNTAALLEEVLAAVQAVHGDRPAPDMPLVHAGLDSLGTVELSQRLAARFGLRLQPTLVFDHPTAAALARHIAELCGVAKEHGQGPEGDCSASLGLGRLESLVPPTADVVVLEHAHARLAAPMDGGHGRFAQDTCRSESLCPAGAPADKFSGTPIHSSHLQIHTLESLGCGWIQDPPCPWSQIWQAGRAVL

SEQ ID NO: 14431 - protein, 566 aa, Chlorella protothecoides
MLRKISPYATPERPIACMTAHQAHPCRLTPTPHVPPFQDVASFDRVMFDMSPGEAACLDPQARLLLTSALETLCGSGVSCMGACRSPRLISQISGPIDRQLHPLPPAPNRLCVPAGTNGSPDWHICRVGMRISRGPDGCTAWMPTSLAEGMEMAHLTSQAVWPMPLACVDPAVASTQPAHPRWWQPTVPAQVGSKGCQGVLVLEPEVRMECPGHWQKISDAPEGIGKRSLTLQKSASPPSRLQNCIPLTPGILAGECQAGLAGGVNVMLWPGTTVGICQLGALSSSGRCRSLEAGADGYGRGEGIVTVLLVLAAALGQGRHSDAQQQRPLAVLAGTAVNQDGRSSSLTAPNGPAQTALVAATLAAAGTGPADVGVAGLHGTGTALGDPLELGALLAALRAPRGVAARPIAVSAVKSCFGHTEGAAGRLDRAAVGGSHAGLRRRAPCRGPCPPEPTCRVCSVPWVGPRRVSGHAHPPGVGAGGKFRQPHRHQLLWNERRECARHLEGGWRLFRVESAGRPGSAALCACGGLALPPAVQSDDRGVAGGEEGQPAPGCHPGRCKACLAP

SEQ ID NO: 14432 - protein, 817 aa, Chlorella protothecoides
  MOD_RES (719)..(722): Any amino acid
MVSLLSQVSTASPSGMSAEVARSERPPSTPITASMQGVQCRGGQCTGGAEEPLGHRAALPPRRSSAQDCSEPAAPCRDLFEMGVDSEATTLDPQTRLLLQHTAALQPYIPSDATGVYVGCMYTAIWHAHGHAFQTDNRFPAGQLVNNPEHRCHTCTAEYLDSVLKAAGLADTQASSITGHGLSFMAGRLSYTFDLRGPCVALDTACSSSLVAVHQGRQVGVRHVERADSLELLEDKFLTDGCVAPTAHSCLPQRGVSVRSGVRRQSDARPRHDQPHLPPQSPLCGGQVPDAGRLGRRLRYVGWGLRGFRESCARTAGRGEGAATLLLKRQAAQGQEAHAPGADLALLQASAVNQDGRSSSLTSPSGPSQTALLAACLRQGAGALTLSSAAMHGTGTPLGDPIEVNALEAALKGSGGQLNGDDVAAPRVLLTSSKVGVACLWYGSLGILHQAVGFIVALFGHTEGVAGVTGVLLAAATTSTRRASLMPTLRTLNPFVTAALACFSAARQTGPVPAVLGSEPAAGATSSFGMSGVNAAALLSAPTGGDLEGAGVPAAQPWQLQAVQPLPACHAWVRPGPCVGVVLLRHAGASALEDCSIHGQKVLVLGGGLEILAAGCSMHFGAGPETEFALRNVTAASLLRWPGEELALRLDGVTGTAQLQGLGRGAMLQTSVATLPMRAQSSTSPPGASCPGSCRLPPEVRWTAILCWSDSHLTTICPXXXXTCVSCLGRRRGGHGAGTGSCRLPSEVRWAVVLCWIDSHLTTICPKTAIPPQAPHRLHIDPWMLQGGTDLQHINAAQERAVAVEGILAPGGSRWEP

SEQ ID NO: 14433 - protein, 657 aa, Chlorella protothecoides
  MOD_RES (98)..(101): Any amino acid
  MOD_RES (194)..(196): Any amino acid
  MOD_RES (445)..(448): Any amino acid
RHAQNGPGTGAPPTPAPRRRPGAPGRRAQPALPPHAQGHRLWDLGGGRPGSAQEEARGGICRHGRHIHRLLPRRRAVAHQAGWLWTGQGWQGMICSGXXXXTACVVAQVWRVPRFSGQCRPPPGARRGNHELPLVTGGPSISFLATLALFKAIQLGKPLPAVWEVVDERAAHGGRCRRELLPECCQVGPLPGRXXXIVLLACEDGVAHLLTPFNNRWRGEGRDSRAARQEGFCIDPKTRHGPDLCDNASGRYRLSLLQNYLSTHHGRLQPAREQGTGPKSGHGGCAVLGAPRACRMADEARQASKGYSCWVSQLVRRPAPHSAPDSLLHIVLTAGEVIKSWRRRWFVLKHGKIFWFKSDVVRPDSQPRGILEVSRCSGCGRRSILPFAPKLCRPATRFWHVLHCRLRQGVQGEQKEGEGDVLVNACLLQLHPVLCACDPAGAELXXXXCSKAVPVNHCLSIKGAEDAINKPHAFEISTADASMYFIADSDKVCRASRRRGGRCVGQRLFVAAASCPVCLRSRWSRAAMRLHRTRRTGSMPWVGPSSGTLEGGLQLRQRWAVMGGLRRHRGGVPNPGFAPAPGTVVAGEALLSWSLGAGGQRCWGHAVFLTLQLATHVFPGEQQQPMPPLGKILPCSVSSSPCPAHPLVHWTTPQPCF

SEQ ID NO: 14434 - protein, 314 aa, Chlorella protothecoides
MRVSDSSHVLILAACFRATPPDRQFQILASTGFSGAGVRSAGPLLPGPHLHCSLSTTAWAGTKVANLESAPQWSHTASDPMSQEGNHSLPKNPAAASRSAFGNAERARVLFEPLLLSSAPQLSSDCLNTISRVPRTTNTRLSILVGGTGGLGALVADQLLHSRAASRILILGRRASTREPTRLAATLSRQPLGLDSLVSVASVDGASAADLAGTKAWLAAQGWVVQDVLHAAGVTADAALPQQSPGRVRRAAAAKSLAGVLALGRGVQAQGRVVLFSSIAGLLGSRGQYSYAQANACLDELAGKHVHEVGAGRQ

SEQ ID NO: 14435 - protein, 337 aa, Chlorella protothecoides
MGRDWDAQLRLDASSSGLLAMPCAMGSHAGPVVESDLMCGAMLRCLLLEASLGNAALDVCSPLDPAPAAPLVPAGSPPAVRRRAVAAGVTLIPHLVESNPTRPGHLNNFSHSSTHNLVTGGTTGLGRLVAGWLAVCRGGATRLSLLGRSGRGTGGLASMHPWQNVPTVFTVTSCDIGCRSDASCLVRRAPPGSALFHAAGVLRDGLLAAVTPGALRHVAGPKTGCVGDLTSPAAGSRQGTGILVAVHTHSSPSSRRSMLVLFSSASAALGNAGQTAYAAANAMLDAHAGRCLTQGSPALALQWGPWAFVGMAAAAPNVLSTLARQGAPRLAEGGGEG

SEQ ID NO: 14436 - protein, 230 aa, Chlorella protothecoides
MAGFQLVAGAAAGHPLQTLAAFSSVAGPLGSVGQANYAAANAGLDTACGRLHASGIPSQALQWGPWAVVGMAAQSRGLLPLLARRGFQGLAPATGLDVVAKTLLARQTPAAEASLMVCLVEWQTYAPARSGWSRGLFSEVVGGDAMTPAKPRAWQSMGHLAGGDEQPALQYGHAMETGPTFGKPPATLAGSLDILGCVLEAVEAATGSALTPDVPFMSNGLDSIGAVELR

SEQ ID NO: 14437 - protein, 232 aa, Chlorella protothecoides
MTNDPSPITIPPKQPTPLAGLAKVWAPKPAATALLLDRLGCHPAETVQLFSSIASCLGGPGQANYALANAALNGLAAGGAARGRPAIAVAWGPWAGAGMAAAAGLGRLERQGYGALTPAHGAGLVLALMRAHARPGVGSFLLAARMHWGRRDNWPIVLGSDTKCPGIMDVALDDKKGMPAKAVASFPGAGKVVSQAVITQQVADCIAAVLGAAPATDAPLLAAGLDSLGECD

SEQ ID NO: 14438 - protein, 154 aa, Chlorella protothecoides
MDARSPLPSRMHHPVPATEAALMDPQQGSLLSHAAGLVRPDTSTALPTAVFVGIARVIDSAAASASTLAAIAAGSGHAATGKALSAAAGRLSYTFALTGPCVSLDTACSSSLLALHLAAGAVRGRETGTALAAGVNLPMVCETTAAFAAAGDTE

SEQ ID NO: 14439 - protein, 169 aa, Chlorella protothecoides
MGAIAQYLAEALAQTQAAPSGLPIAIHYLAEALAQTQAAPDGLSIAIHVTAGQPATPRPLAEARALPVYLEAVTGDLPCTGRLGITSMTFPMRDAMGPVPLSRWSLDDPPVKGLVLPRFGAFLLDWERFDAAAFGLSPAGKLFCSRKLWWALPHSAPLPHSLPVGVLQG

SEQ ID NO: 14440 - protein, 429 aa, Chlorella protothecoides
MLSPDGRCKTLESAADGSVGLDPNPIVLWGMAGVQCAQGHMCVQTWLEAMYMPCVTRPTPSCRYGRGEGCVTLGLTRQGQNTDALAVLAGTAMNQDGRSSSLTAPHGPSQQAVISQALAAAGAPPGALTGLELHGTGTPLGDPIELNAALTVLCPRLGRGRDGHDPGPCLGLHAVKTLVGHVEPAAGGAGLHSTLMRWVGAEGRDAHGLLNFYHEGHDTWLPASETAGGRRLVFLLSQPFWSITLQDSLAGAPPPAGTGRPQPADDGQLLRSFPRAARREAARAPGLLRPRDALGHQRLCLPGHQRARAADSAKGADADRGARPQASLAAPALLVRAPSPRPAGPGGGAQKCDLPAAGQPGLATAGLHLAACRARQAPPARRSHDGGDARRWGVSERQPRCLMRGAMVDGHSVHDRWGGSREDCASRQR

SEQ ID NO: 14441 - protein, 122 aa, Chlorella protothecoides
MSASGRCQTLDAAADGYSRAEASVVLRLGRGDPAGSASSAPPLLIMGSATNQDGRSSGLTAPHGPSQSRVVAAAARQAGACPGAFEMHGTGTPLGDPIEVSALATVMYALGRGDAEGELVHP

SEQ ID NO: 14442 - protein, 257 aa, Chlorella protothecoides
MLLSGQPEAHRTKHVGVYIGCMWAEDHTATLPPAAAVNPVASTGNGLSFMAGRLAFAFGLRGPASAVNTACSSSLVALHFSTHGLRATDCEAALVGGVSLVLDSGSAAKISALQALSPSGRCRALDEAADGYGRGEGVTALLLTTADPIEAVRSLKAASGPLAVLAATAVNSTGLASGVTAPSGPAQQRLLADAMRRAGVAADGVQSLSLHGTGTPLGDPIEVGAAMAQLGQRGAACLSLAATKAVFGHAEGMAGES

SEQ ID NO: 14443 - protein, 226 aa, Chlorella protothecoides
MGELAAAISDRFGLDIPPTALFDFPTLGSLGTRIHELRSIVRPSRSGQDSVPVHQLPELRGSVQLISDAREPRGSVQLISDARGDFPGVYRDDSSTSWLACLASAQEAAAPLHLARWDMDRTYSPEVSDTGTVACRFATMFRGQEHLLFDAELFGLSARDAALADPHLRLLLQHAQVGFGGSTHNQDACPATVQAYILLQAEVVDGVAFQSPIPWAAKRAHQASPP

SEQ ID NO: 14444 - protein, 421 aa, Chlorella protothecoides
  MOD_RES (85)..(88): Any amino acid
MSGGTGSLGRLVAAWLGEGSQCVTLHARRALLTQLPALSASNPACIWTLLQGHNALAANAHDRRAVHAVHVLAGGVLADAGIAGXXXXNSALAADAHDRLAVHAVHVLAGGVLADAGIAGQSPSSLRAVAAPKSTASASHRHQTAAEPVNICLLFGSAAALVGNAGQAGYAAANATLDVLAQRAQREGLRWHSTQWGPWAHGGMADAGILRRLAGQGMVGIAPAHGLHALARAMAMARPLPPPVVLAMRVLDWARALGPVHGQRPRFAEVAPTNGATIDDLAESIGALIAAQLGCRPLPNQTFAAAGLDADGRRALCSALGAKYSVPLEPQDLVDHPDALRLALLIAERAGETPRSKPAEQLARQSLGSAGTHQPLTRADTLRRVRDTVASVLGSLPGDGAPLREVSRRLGVWDGGCERQC
